United States Patent 12,624,385 (RIBOREGULATORS AND METHODS OF USE THEREOF) - sequence listing, part 4

SEQ ID NO: 50146 - DNA, 103 bp, Artificial Sequence
  Synthetic Polynucleotide
taatacgactcactatagggacacctacagtagctcacatctataagacaaacagaggagatgtcttatggatgtgagcaacctggcggcagcgcaaaagatg

SEQ ID NO: 50147 - DNA, 103 bp, Artificial Sequence
  Synthetic Polynucleotide
taatacgactcactatagggatggtacacctacagtagctcacatctataaacagaggagatatagaatggagctactgaacctggcggcagcgcaaaagatg

SEQ ID NO: 50148 - DNA, 103 bp, Artificial Sequence
  Synthetic Polynucleotide
taatacgactcactataggggtataacaaaaaaacagagatattgatttaaacagaggagataaatcatgatctctgttaacctggcggcagcgcaaaagatg

SEQ ID NO: 50149 - DNA, 103 bp, Artificial Sequence
  Synthetic Polynucleotide
taatacgactcactatagggatcaaatggtacacctacagtagctcacataacagaggagaatgtgaatgactgtaggtaacctggcggcagcgcaaaagatg

SEQ ID NO: 50150 - DNA, 103 bp, Artificial Sequence
  Synthetic Polynucleotide
taatacgactcactatagggagaaaatcaaatggtacacctacagtagctaacagaggagaagctacatgaggtgtaccaacctggcggcagcgcaaaagatg

SEQ ID NO: 50151 - DNA, 103 bp, Artificial Sequence
  Synthetic Polynucleotide
taatacgactcactatagggtagaaagaaaatcaaatggtacacctacagaacagaggagactgtagatgtaccatttgaacctggcggcagcgcaaaagatg

SEQ ID NO: 50152 - DNA, 103 bp, Artificial Sequence
  Synthetic Polynucleotide
taatacgactcactatagggagtattagaaagaaaatcaaatggtacaccaacagaggagaggtgtaatgtttgattttaacctggcggcagcgcaaaagatg

SEQ ID NO: 50153 - DNA, 103 bp, Artificial Sequence
  Synthetic Polynucleotide
taatacgactcactatagggtatatagtattagaaagaaaatcaaatggtaacagaggagaaccattatgttttctttcaacctggcggcagcgcaaaagatg

SEQ ID NO: 50154 - DNA, 103 bp, Artificial Sequence
  Synthetic Polynucleotide
taatacgactcactatagggagaaatatatagtattagaaagaaaatcaaaacagaggagattgattatgtttctaataaacctggcggcagcgcaaaagatg

SEQ ID NO: 50155 - DNA, 103 bp, Artificial Sequence
  Synthetic Polynucleotide
taatacgactcactatagggtcgagagaaatatatagtattagaaagaaaaacagaggagatttcttatgaatactataaacctggcggcagcgcaaaagatg

SEQ ID NO: 50156 - DNA, 103 bp, Artificial Sequence
  Synthetic Polynucleotide
taatacgactcactatagggcttcttcgagagaaatatatagtattagaaaacagaggagattctaaatgtatatatttaacctggcggcagcgcaaaagatg

SEQ ID NO: 50157 - DNA, 103 bp, Artificial Sequence
  Synthetic Polynucleotide
taatacgactcactatagggaagaacttcttcgagagaaatatatagtataacagaggagaatactaatgatttctctcaacctggcggcagcgcaaaagatg

SEQ ID NO: 50158 - DNA, 103 bp, Artificial Sequence
  Synthetic Polynucleotide
taatacgactcactatagggtgtgcaagaacttcttcgagagaaatatataacagaggagaatatatatgtctcgaagaaacctggcggcagcgcaaaagatg

SEQ ID NO: 50159 - DNA, 103 bp, Artificial Sequence
  Synthetic Polynucleotide
taatacgactcactatagggcatctgtataacaaaaaaacagagatattgaacagaggagacaatatatgtgtttttttaacctggcggcagcgcaaaagatg

SEQ ID NO: 50160 - DNA, 103 bp, Artificial Sequence
  Synthetic Polynucleotide
taatacgactcactataggggatgatgtgcaagaacttcttcgagagaaaaacagaggagatttctcatgaagaagttcaacctggcggcagcgcaaaagatg

SEQ ID NO: 50161 - DNA, 103 bp, Artificial Sequence
  Synthetic Polynucleotide
taatacgactcactatagggtcccagatgatgtgcaagaacttcttcgagaacagaggagactcgaaatggttcttgcaaacctggcggcagcgcaaaagatg

SEQ ID NO: 50162 - DNA, 103 bp, Artificial Sequence
  Synthetic Polynucleotide
taatacgactcactatagggtttattcccagatgatgtgcaagaacttctaacagaggagaagaagtatgtgcacatcaaacctggcggcagcgcaaaagatg

SEQ ID NO: 50163 - DNA, 103 bp, Artificial Sequence
  Synthetic Polynucleotide
taatacgactcactatagggagtattttattcccagatgatgtgcaagaaaacagaggagattcttgatgatcatctggaacctggcggcagcgcaaaagatg

SEQ ID NO: 50164 - DNA, 103 bp, Artificial Sequence
  Synthetic Polynucleotide
taatacgactcactatagggacagtagtattttattcccagatgatgtgcaacagaggagagcacatatgctgggaataaacctggcggcagcgcaaaagatg

SEQ ID NO: 50165 - DNA, 103 bp, Artificial Sequence
  Synthetic Polynucleotide
taatacgactcactatagggactcaacagtagtattttattcccagatgaaacagaggagatcatctatgaataaaataaacctggcggcagcgcaaaagatg

SEQ ID NO: 50166 - DNA, 103 bp, Artificial Sequence
  Synthetic Polynucleotide
taatacgactcactataggggatttactcaacagtagtattttattcccaaacagaggagatgggaaatgaatactactaacctggcggcagcgcaaaagatg

SEQ ID NO: 50167 - DNA, 103 bp, Artificial Sequence
  Synthetic Polynucleotide
taatacgactcactatagggtaactgatttactcaacagtagtattttataacagaggagaataaaaatgtactgttgaaacctggcggcagcgcaaaagatg

SEQ ID NO: 50168 - DNA, 103 bp, Artificial Sequence
  Synthetic Polynucleotide
taatacgactcactatagggaaaaataactgatttactcaacagtagtataacagaggagaatactaatgttgagtaaaaacctggcggcagcgcaaaagatg

SEQ ID NO: 50169 - DNA, 103 bp, Artificial Sequence
  Synthetic Polynucleotide
taatacgactcactatagggataaaaaaaataactgatttactcaacagtaacagaggagaactgttatgtaaatcagtaacctggcggcagcgcaaaagatg

SEQ ID NO: 50170 - DNA, 103 bp, Artificial Sequence
  Synthetic Polynucleotide
taatacgactcactatagggtaatacatctgtataacaaaaaaacagagaaacagaggagatctctgatgttttgttataacctggcggcagcgcaaaagatg

SEQ ID NO: 50171 - DNA, 103 bp, Artificial Sequence
  Synthetic Polynucleotide
taatacgactcactatagggtcgatataaaaaaaataactgatttactcaaacagaggagatgagtaatgcagttatttaacctggcggcagcgcaaaagatg

SEQ ID NO: 50172 - DNA, 103 bp, Artificial Sequence
  Synthetic Polynucleotide
taatacgactcactatagggcaatatcgatataaaaaaaataactgatttaacagaggagaaaatcaatgattttttttaacctggcggcagcgcaaaagatg

SEQ ID NO: 50173 - DNA, 103 bp, Artificial Sequence
  Synthetic Polynucleotide
taatacgactcactatagggtccatcaatatcgatataaaaaaaataactaacagaggagaagttatatgttttatatcaacctggcggcagcgcaaaagatg

SEQ ID NO: 50174 - DNA, 103 bp, Artificial Sequence
  Synthetic Polynucleotide
taatacgactcactatagggaaatgtccatcaatatcgatataaaaaaaaaacagaggagattttttatgtatcgatataacctggcggcagcgcaaaagatg

SEQ ID NO: 50175 - DNA, 103 bp, Artificial Sequence
  Synthetic Polynucleotide
taatacgactcactatagggtataaaaatgtccatcaatatcgatataaaaacagaggagatttataatgatattgatgaacctggcggcagcgcaaaagatg

SEQ ID NO: 50176 - DNA, 103 bp, Artificial Sequence
  Synthetic Polynucleotide
taatacgactcactatagggttaactataaaaatgtccatcaatatcgataacagaggagaatcgatatggatggacataacctggcggcagcgcaaaagatg

SEQ ID NO: 50177 - DNA, 103 bp, Artificial Sequence
  Synthetic Polynucleotide
taatacgactcactatagggtatccttaactataaaaatgtccatcaataaacagaggagatattgaatgacatttttaaacctggcggcagcgcaaaagatg

SEQ ID NO: 50178 - DNA, 103 bp, Artificial Sequence
  Synthetic Polynucleotide
taatacgactcactatagggcttattatccttaactataaaaatgtccataacagaggagaatggacatgtttatagttaacctggcggcagcgcaaaagatg

SEQ ID NO: 50179 - DNA, 103 bp, Artificial Sequence
  Synthetic Polynucleotide
taatacgactcactatagggggatacttattatccttaactataaaaatgaacagaggagacattttatgagttaaggaaacctggcggcagcgcaaaagatg

SEQ ID NO: 50180 - DNA, 103 bp, Artificial Sequence
  Synthetic Polynucleotide
taatacgactcactatagggctttgggatacttattatccttaactataaaacagaggagattatagatgaggataataaacctggcggcagcgcaaaagatg

SEQ ID NO: 50181 - DNA, 103 bp, Artificial Sequence
  Synthetic Polynucleotide
taatacgactcactatagggggctgtaatacatctgtataacaaaaaaacaacagaggagagtttttatgttatacagaaacctggcggcagcgcaaaagatg

SEQ ID NO: 50182 - DNA, 103 bp, Artificial Sequence
  Synthetic Polynucleotide
taatacgactcactatagggatctactttgggatacttattatccttaacaacagaggagagttaagatgaataagtataacctggcggcagcgcaaaagatg

SEQ ID NO: 50183 - DNA, 103 bp, Artificial Sequence
  Synthetic Polynucleotide
taatacgactcactatagggtcgttatctactttgggatacttattatccaacagaggagaggataaatggtatcccaaaacctggcggcagcgcaaaagatg

SEQ ID NO: 50184 - DNA, 103 bp, Artificial Sequence
  Synthetic Polynucleotide
taatacgactcactatagggtatcgtcgttatctactttgggatacttataacagaggagaataagtatgccaaagtagaacctggcggcagcgcaaaagatg

SEQ ID NO: 50185 - DNA, 103 bp, Artificial Sequence
  Synthetic Polynucleotide
taatacgactcactatagggttcgttatcgtcgttatctactttgggataaacagaggagatatcccatggtagataacaacctggcggcagcgcaaaagatg

SEQ ID NO: 50186 - DNA, 103 bp, Artificial Sequence
  Synthetic Polynucleotide
taatacgactcactatagggaatacttcgttatcgtcgttatctactttgaacagaggagacaaagtatgtaacgacgaaacctggcggcagcgcaaaagatg

SEQ ID NO: 50187 - DNA, 103 bp, Artificial Sequence
  Synthetic Polynucleotide
taatacgactcactataggggtataaatacttcgttatcgtcgttatctaaacagaggagatagataatgacgataacgaacctggcggcagcgcaaaagatg

SEQ ID NO: 50188 - DNA, 103 bp, Artificial Sequence
  Synthetic Polynucleotide
taatacgactcactatagggtaaaagtataaatacttcgttatcgtcgttaacagaggagaaacgacatgaacgaagtaaacctggcggcagcgcaaaagatg

SEQ ID NO: 50189 - DNA, 103 bp, Artificial Sequence
  Synthetic Polynucleotide
taatacgactcactatagggtttcctaaaagtataaatacttcgttatcgaacagaggagacgataaatgagtatttataacctggcggcagcgcaaaagatg

SEQ ID NO: 50190 - DNA, 103 bp, Artificial Sequence
  Synthetic Polynucleotide
taatacgactcactatagggtgtgatttcctaaaagtataaatacttcgtaacagaggagaacgaagatgttatactttaacctggcggcagcgcaaaagatg

SEQ ID NO: 50191 - DNA, 103 bp, Artificial Sequence
  Synthetic Polynucleotide
taatacgactcactataggggtcattgtgatttcctaaaagtataaatacaacagaggagagtatttatgcttttaggaaacctggcggcagcgcaaaagatg

SEQ ID NO: 50192 - DNA, 103 bp, Artificial Sequence
  Synthetic Polynucleotide
taatacgactcactatagggtatgaggctgtaatacatctgtataacaaaaacagaggagatttgttatgcagatgtataacctggcggcagcgcaaaagatg

SEQ ID NO: 50193 - DNA, 103 bp, Artificial Sequence
  Synthetic Polynucleotide
taatacgactcactatagggataaagtcattgtgatttcctaaaagtataaacagaggagatatactatgaggaaatcaaacctggcggcagcgcaaaagatg

SEQ ID NO: 50194 - DNA, 103 bp, Artificial Sequence
  Synthetic Polynucleotide
taatacgactcactatagggatctgataaagtcattgtgatttcctaaaaaacagaggagattttagatgatcacaatgaacctggcggcagcgcaaaagatg

SEQ ID NO: 50195 - DNA, 103 bp, Artificial Sequence
  Synthetic Polynucleotide
taatacgactcactatagggttttgatctgataaagtcattgtgatttccaacagaggagaggaaatatgaatgactttaacctggcggcagcgcaaaagatg

SEQ ID NO: 50196 - DNA, 103 bp, Artificial Sequence
  Synthetic Polynucleotide
taatacgactcactataggggttaattttgatctgataaagtcattgtgaaacagaggagatcacaaatgctttatcagaacctggcggcagcgcaaaagatg

SEQ ID NO: 50197 - DNA, 103 bp, Artificial Sequence
  Synthetic Polynucleotide
taatacgactcactatagggattttgttaattttgatctgataaagtcataacagaggagaatgactatgtcagatcaaaacctggcggcagcgcaaaagatg

SEQ ID NO: 50198 - DNA, 103 bp, Artificial Sequence
  Synthetic Polynucleotide
taatacgactcactatagggctttaattttgttaattttgatctgataaaaacagaggagatttatcatgtcaaaattaaacctggcggcagcgcaaaagatg

SEQ ID NO: 50199 - DNA, 103 bp, Artificial Sequence
  Synthetic Polynucleotide
taatacgactcactatagggtgctcctttaattttgttaattttgatctgaacagaggagacagatcatgattaacaaaaacctggcggcagcgcaaaagatg

SEQ ID NO: 50200 - DNA, 103 bp, Artificial Sequence
  Synthetic Polynucleotide
taatacgactcactatagggatacatgctcctttaattttgttaattttgaacagaggagacaaaatatgcaaaattaaaacctggcggcagcgcaaaagatg

SEQ ID NO: 50201 - DNA, 103 bp, Artificial Sequence
  Synthetic Polynucleotide
taatacgactcactatagggaaaaaatacatgctcctttaattttgttaaaacagaggagattaacaatgttaaaggagaacctggcggcagcgcaaaagatg

SEQ ID NO: 50202 - DNA, 103 bp, Artificial Sequence
  Synthetic Polynucleotide
taatacgactcactatagggttagaaaaaaatacatgctcctttaattttaacagaggagaaaaattatgggagcatgtaacctggcggcagcgcaaaagatg

SEQ ID NO: 50203 - DNA, 103 bp, Artificial Sequence
  Synthetic Polynucleotide
taatacgactcactatagggtaatatatgaggctgtaatacatctgtataaacagaggagatatacaatggtattacagaacctggcggcagcgcaaaagatg

SEQ ID NO: 50204 - DNA, 103 bp, Artificial Sequence
  Synthetic Polynucleotide
taatacgactcactatagggtatatttagaaaaaaatacatgctcctttaaacagaggagataaaggatgatgtattttaacctggcggcagcgcaaaagatg

SEQ ID NO: 50205 - DNA, 103 bp, Artificial Sequence
  Synthetic Polynucleotide
taatacgactcactatagggtacaatatatttagaaaaaaatacatgctcaacagaggagagagcatatgtttttttctaacctggcggcagcgcaaaagatg

SEQ ID NO: 50206 - DNA, 103 bp, Artificial Sequence
  Synthetic Polynucleotide
taatacgactcactatagggggagttacaatatatttagaaaaaaatacaaacagaggagatgtattatgttctaaataaacctggcggcagcgcaaaagatg

SEQ ID NO: 50207 - DNA, 103 bp, Artificial Sequence
  Synthetic Polynucleotide
taatacgactcactatagggtatctggagttacaatatatttagaaaaaaaacagaggagattttttatgaatatattgaacctggcggcagcgcaaaagatg

SEQ ID NO: 50208 - DNA, 103 bp, Artificial Sequence
  Synthetic Polynucleotide
taatacgactcactatagggatatgtatctggagttacaatatatttagaaacagaggagatctaaaatgattgtaactaacctggcggcagcgcaaaagatg

SEQ ID NO: 50209 - DNA, 103 bp, Artificial Sequence
  Synthetic Polynucleotide
taatacgactcactataggggatccatatgtatctggagttacaatatataacagaggagaatatatatgaactccagaaacctggcggcagcgcaaaagatg

SEQ ID NO: 50210 - DNA, 103 bp, Artificial Sequence
  Synthetic Polynucleotide
taatacgactcactatagggataaagatccatatgtatctggagttacaaaacagaggagattgtaaatgcagatacataacctggcggcagcgcaaaagatg

SEQ ID NO: 50211 - DNA, 103 bp, Artificial Sequence
  Synthetic Polynucleotide
taatacgactcactatagggtacacataaagatccatatgtatctggagtaacagaggagaactccaatgacatatggaaacctggcggcagcgcaaaagatg

SEQ ID NO: 50212 - DNA, 103 bp, Artificial Sequence
  Synthetic Polynucleotide
taatacgactcactatagggaattctacacataaagatccatatgtatctaacagaggagaagatacatgtggatctttaacctggcggcagcgcaaaagatg

SEQ ID NO: 50213 - DNA, 103 bp, Artificial Sequence
  Synthetic Polynucleotide
taatacgactcactatagggcatttaattctacacataaagatccatatgaacagaggagacatatgatgctttatgtgaacctggcggcagcgcaaaagatg

SEQ ID NO: 50214 - DNA, 103 bp, Artificial Sequence
  Synthetic Polynucleotide
taatacgactcactatagggttacgtaatatatgaggctgtaatacatctaacagaggagaagatgtatgacagcctcaaacctggcggcagcgcaaaagatg

SEQ ID NO: 50215 - DNA, 103 bp, Artificial Sequence
  Synthetic Polynucleotide
taatacgactcactatagggagatccatttaattctacacataaagatccaacagaggagaggatctatgtgtgtagaaaacctggcggcagcgcaaaagatg

SEQ ID NO: 50216 - DNA, 103 bp, Artificial Sequence
  Synthetic Polynucleotide
taatacgactcactatagggaaactagatccatttaattctacacataaaaacagaggagatttatgatgagaattaaaaacctggcggcagcgcaaaagatg

SEQ ID NO: 50217 - DNA, 103 bp, Artificial Sequence
  Synthetic Polynucleotide
taatacgactcactataggggctgaaaactagatccatttaattctacacaacagaggagagtgtagatgtaaatggataacctggcggcagcgcaaaagatg

SEQ ID NO: 50218 - DNA, 103 bp, Artificial Sequence
  Synthetic Polynucleotide
taatacgactcactatagggaccgtgctgaaaactagatccatttaattcaacagaggagagaattaatgggatctagtaacctggcggcagcgcaaaagatg

SEQ ID NO: 50219 - DNA, 103 bp, Artificial Sequence
  Synthetic Polynucleotide
taatacgactcactatagggctaccaccgtgctgaaaactagatccatttaacagaggagaaaatggatgtagttttcaaacctggcggcagcgcaaaagatg

SEQ ID NO: 50220 - DNA, 103 bp, Artificial Sequence
  Synthetic Polynucleotide
taatacgactcactatagggtatatctaccaccgtgctgaaaactagatcaacagaggagagatctaatgttcagcacgaacctggcggcagcgcaaaagatg

SEQ ID NO: 50221 - DNA, 103 bp, Artificial Sequence
  Synthetic Polynucleotide
taatacgactcactatagggctctatatatctaccaccgtgctgaaaactaacagaggagaagttttatgcacggtggtaacctggcggcagcgcaaaagatg

SEQ ID NO: 50222 - DNA, 103 bp, Artificial Sequence
  Synthetic Polynucleotide
taatacgactcactatagggtccacctctatatatctaccaccgtgctgaaacagaggagatcagcaatgtggtagataaacctggcggcagcgcaaaagatg

SEQ ID NO: 50223 - DNA, 103 bp, Artificial Sequence
  Synthetic Polynucleotide
taatacgactcactatagggattcctccacctctatatatctaccaccgtaacagaggagaacggtgatggatatatagaacctggcggcagcgcaaaagatg

SEQ ID NO: 50224 - DNA, 103 bp, Artificial Sequence
  Synthetic Polynucleotide
taatacgactcactatagggtataaattcctccacctctatatatctaccaacagaggagaggtagaatgatagaggtgaacctggcggcagcgcaaaagatg

SEQ ID NO: 50225 - DNA, 103 bp, Artificial Sequence
  Synthetic Polynucleotide
taatacgactcactatagggttctattacgtaatatatgaggctgtaataaacagaggagatattacatgctcatatataacctggcggcagcgcaaaagatg

SEQ ID NO: 50226 - DNA, 103 bp, Artificial Sequence
  Synthetic Polynucleotide
taatacgactcactatagggtcatctataaattcctccacctctatatataacagaggagaatatatatgggtggaggaaacctggcggcagcgcaaaagatg

SEQ ID NO: 50227 - DNA, 103 bp, Artificial Sequence
  Synthetic Polynucleotide
taatacgactcactatagggttccatcatctataaattcctccacctctaaacagaggagatagaggatgaggaatttaaacctggcggcagcgcaaaagatg

SEQ ID NO: 50228 - DNA, 103 bp, Artificial Sequence
  Synthetic Polynucleotide
taatacgactcactatagggttgtcttccatcatctataaattcctccacaacagaggagagtggagatgtttatagataacctggcggcagcgcaaaagatg

SEQ ID NO: 50229 - DNA, 103 bp, Artificial Sequence
  Synthetic Polynucleotide
taatacgactcactatagggctaacttgtcttccatcatctataaattccaacagaggagaggaattatgagatgatggaacctggcggcagcgcaaaagatg

SEQ ID NO: 50230 - DNA, 103 bp, Artificial Sequence
  Synthetic Polynucleotide
taatacgactcactatagggaccatctaacttgtcttccatcatctataaaacagaggagattatagatgatggaagacaacctggcggcagcgcaaaagatg

SEQ ID NO: 50231 - DNA, 103 bp, Artificial Sequence
  Synthetic Polynucleotide
taatacgactcactatagggagaacaccatctaacttgtcttccatcatcaacagaggagagatgatatgagacaagttaacctggcggcagcgcaaaagatg

SEQ ID NO: 50232 - DNA, 103 bp, Artificial Sequence
  Synthetic Polynucleotide
taatacgactcactataggggatgtagaacaccatctaacttgtcttccaaacagaggagatggaagatgagttagatgaacctggcggcagcgcaaaagatg

SEQ ID NO: 50233 - DNA, 103 bp, Artificial Sequence
  Synthetic Polynucleotide
taatacgactcactataggggattggatgtagaacaccatctaacttgtcaacagaggagagacaagatggatggtgttaacctggcggcagcgcaaaagatg

SEQ ID NO: 50234 - DNA, 103 bp, Artificial Sequence
  Synthetic Polynucleotide
taatacgactcactatagggtatatgattggatgtagaacaccatctaacaacagaggagagttagaatgtgttctacaaacctggcggcagcgcaaaagatg

SEQ ID NO: 50235 - DNA, 103 bp, Artificial Sequence
  Synthetic Polynucleotide
taatacgactcactatagggtcagatatatgattggatgtagaacaccataacagaggagaatggtgatgtacatccaaaacctggcggcagcgcaaaagatg

SEQ ID NO: 50236 - DNA, 103 bp, Artificial Sequence
  Synthetic Polynucleotide
taatacgactcactatagggactctcattcctcatccacaaccccattaaaacagaggagattaatgatgttgtggatgaacctggcggcagcgcaaaagatg

SEQ ID NO: 50237 - DNA, 103 bp, Artificial Sequence
  Synthetic Polynucleotide
taatacgactcactatagggacacgttctattacgtaatatatgaggctgaacagaggagacagcctatgatattacgtaacctggcggcagcgcaaaagatg

SEQ ID NO: 50238 - DNA, 103 bp, Artificial Sequence
  Synthetic Polynucleotide
taatacgactcactatagggtatcttcagatatatgattggatgtagaacaacagaggagagttctaatgccaatcataaacctggcggcagcgcaaaagatg

SEQ ID NO: 50239 - DNA, 103 bp, Artificial Sequence
  Synthetic Polynucleotide
taatacgactcactataggggggtatatcttcagatatatgattggatgtaacagaggagaacatccatgcatatatctaacctggcggcagcgcaaaagatg

SEQ ID NO: 50240 - DNA, 103 bp, Artificial Sequence
  Synthetic Polynucleotide
taatacgactcactatagggtcttcgggtatatcttcagatatatgattgaacagaggagacaatcaatgatctgaagaaacctggcggcagcgcaaaagatg

SEQ ID NO: 50241 - DNA, 103 bp, Artificial Sequence
  Synthetic Polynucleotide
taatacgactcactataggggtatatcttcgggtatatcttcagatatataacagaggagaatatatatgaagatatacaacctggcggcagcgcaaaagatg

SEQ ID NO: 50242 - DNA, 103 bp, Artificial Sequence
  Synthetic Polynucleotide
taatacgactcactatagggagtgtgtatatcttcgggtatatcttcagaaacagaggagatctgaaatgatacccgaaaacctggcggcagcgcaaaagatg

SEQ ID NO: 50243 - DNA, 103 bp, Artificial Sequence
  Synthetic Polynucleotide
taatacgactcactatagggttattagtgtgtatatcttcgggtatatctaacagaggagaagatatatgcgaagatataacctggcggcagcgcaaaagatg

SEQ ID NO: 50244 - DNA, 103 bp, Artificial Sequence
  Synthetic Polynucleotide
taatacgactcactatagggtaaatttattagtgtgtatatcttcgggtaaacagaggagatacccgatgatatacacaaacctggcggcagcgcaaaagatg

SEQ ID NO: 50245 - DNA, 103 bp, Artificial Sequence
  Synthetic Polynucleotide
taatacgactcactatagggaataataaatttattagtgtgtatatcttcaacagaggagagaagatatgcacactaataacctggcggcagcgcaaaagatg

SEQ ID NO: 50246 - DNA, 103 bp, Artificial Sequence
  Synthetic Polynucleotide
taatacgactcactatagggtcataaataataaatttattagtgtgtataaacagaggagatatacaatgtaataaattaacctggcggcagcgcaaaagatg

SEQ ID NO: 50247 - DNA, 103 bp, Artificial Sequence
  Synthetic Polynucleotide
taatacgactcactatagggaaatatcataaataataaatttattagtgtaacagaggagaacactaatgaatttattaaacctggcggcagcgcaaaagatg

SEQ ID NO: 50248 - DNA, 103 bp, Artificial Sequence
  Synthetic Polynucleotide
taatacgactcactatagggagatgacacgttctattacgtaatatatgaaacagaggagatcatatatgacgtaatagaacctggcggcagcgcaaaagatg

SEQ ID NO: 50249 - DNA, 103 bp, Artificial Sequence
  Synthetic Polynucleotide
taatacgactcactatagggcgtataaatatcataaataataaatttattaacagaggagaaataaaatgattatttataacctggcggcagcgcaaaagatg

SEQ ID NO: 50250 - DNA, 103 bp, Artificial Sequence
  Synthetic Polynucleotide
taatacgactcactatagggtcaaacgtataaatatcataaataataaataacagaggagaatttatatgttatgatataacctggcggcagcgcaaaagatg

SEQ ID NO: 50251 - DNA, 103 bp, Artificial Sequence
  Synthetic Polynucleotide
taatacgactcactatagggacgaatcaaacgtataaatatcataaataaaacagaggagattatttatgatatttataaacctggcggcagcgcaaaagatg

SEQ ID NO: 50252 - DNA, 103 bp, Artificial Sequence
  Synthetic Polynucleotide
taatacgactcactatagggtttgaacgaatcaaacgtataaatatcataaacagaggagatatgatatgtatacgtttaacctggcggcagcgcaaaagatg

SEQ ID NO: 50253 - DNA, 103 bp, Artificial Sequence
  Synthetic Polynucleotide
taatacgactcactatagggttatttttgaacgaatcaaacgtataaataaacagaggagatatttaatggtttgattcaacctggcggcagcgcaaaagatg

SEQ ID NO: 50254 - DNA, 103 bp, Artificial Sequence
  Synthetic Polynucleotide
taatacgactcactatagggatcgtttatttttgaacgaatcaaacgtataacagaggagaatacgtatgattcgttcaaacctggcggcagcgcaaaagatg

SEQ ID NO: 50255 - DNA, 103 bp, Artificial Sequence
  Synthetic Polynucleotide
taatacgactcactatagggtaccaatcgtttatttttgaacgaatcaaaaacagaggagatttgatatgttcaaaaataacctggcggcagcgcaaaagatg

SEQ ID NO: 50256 - DNA, 103 bp, Artificial Sequence
  Synthetic Polynucleotide
taatacgactcactatagggacaaataccaatcgtttatttttgaacgaaaacagaggagattcgttatgaaataaacgaacctggcggcagcgcaaaagatg

SEQ ID NO: 50257 - DNA, 103 bp, Artificial Sequence
  Synthetic Polynucleotide
taatacgactcactatagggcctgtacaaataccaatcgtttatttttgaaacagaggagatcaaaaatgaacgattggaacctggcggcagcgcaaaagatg

SEQ ID NO: 50258 - DNA, 103 bp, Artificial Sequence
  Synthetic Polynucleotide
taatacgactcactatagggaggtacctgtacaaataccaatcgtttattaacagaggagaaataaaatgttggtatttaacctggcggcagcgcaaaagatg

SEQ ID NO: 50259 - DNA, 103 bp, Artificial Sequence
  Synthetic Polynucleotide
taatacgactcactatagggaaggtagatgacacgttctattacgtaataaacagaggagatattacatgatagaacgtaacctggcggcagcgcaaaagatg

SEQ ID NO: 50260 - DNA, 103 bp, Artificial Sequence
  Synthetic Polynucleotide
taatacgactcactataggggatgtaggtacctgtacaaataccaatcgtaacagaggagaacgattatgatttgtacaaacctggcggcagcgcaaaagatg

SEQ ID NO: 50261 - DNA, 103 bp, Artificial Sequence
  Synthetic Polynucleotide
taatacgactcactatagggctaatgatgtaggtacctgtacaaataccaaacagaggagatggtatatgtacaggtacaacctggcggcagcgcaaaagatg

SEQ ID NO: 50262 - DNA, 103 bp, Artificial Sequence
  Synthetic Polynucleotide
taatacgactcactatagggatctcctaatgatgtaggtacctgtacaaaaacagaggagatttgtaatggtacctacaaacctggcggcagcgcaaaagatg

SEQ ID NO: 50263 - DNA, 103 bp, Artificial Sequence
  Synthetic Polynucleotide
taatacgactcactatagggctatcatctcctaatgatgtaggtacctgtaacagaggagaacaggtatgtacatcattaacctggcggcagcgcaaaagatg

SEQ ID NO: 50264 - DNA, 103 bp, Artificial Sequence
  Synthetic Polynucleotide
taatacgactcactatagggaatagctatcatctcctaatgatgtaggtaaacagaggagatacctaatgcattaggagaacctggcggcagcgcaaaagatg

SEQ ID NO: 50265 - DNA, 103 bp, Artificial Sequence
  Synthetic Polynucleotide
taatacgactcactatagggagttaaatagctatcatctcctaatgatgtaacagaggagaacatcaatgggagatgataacctggcggcagcgcaaaagatg

SEQ ID NO: 50266 - DNA, 103 bp, Artificial Sequence
  Synthetic Polynucleotide
taatacgactcactataggggggttagttaaatagctatcatctcctaataacagaggagaattaggatgtgatagctaaacctggcggcagcgcaaaagatg

SEQ ID NO: 50267 - DNA, 103 bp, Artificial Sequence
  Synthetic Polynucleotide
taatacgactcactatagggataacgggttagttaaatagctatcatctcaacagaggagagagatgatggctatttaaaacctggcggcagcgcaaaagatg

SEQ ID NO: 50268 - DNA, 103 bp, Artificial Sequence
  Synthetic Polynucleotide
taatacgactcactatagggtgacaataacgggttagttaaatagctatcaacagaggagagatagcatgttaactaacaacctggcggcagcgcaaaagatg

SEQ ID NO: 50269 - DNA, 103 bp, Artificial Sequence
  Synthetic Polynucleotide
taatacgactcactatagggtacggtgacaataacgggttagttaaatagaacagaggagactatttatgtaacccgttaacctggcggcagcgcaaaagatg

SEQ ID NO: 50270 - DNA, 103 bp, Artificial Sequence
  Synthetic Polynucleotide
taatacgactcactatagggttaataaggtagatgacacgttctattacgaacagaggagacgtaatatgacgtgtcataacctggcggcagcgcaaaagatg

SEQ ID NO: 50271 - DNA, 103 bp, Artificial Sequence
  Synthetic Polynucleotide
taatacgactcactatagggaataatacggtgacaataacgggttagttaaacagaggagataactaatgcgttattgtaacctggcggcagcgcaaaagatg

SEQ ID NO: 50272 - DNA, 103 bp, Artificial Sequence
  Synthetic Polynucleotide
taatacgactcactatagggattacaataatacggtgacaataacgggttaacagaggagaaacccgatgttgtcaccgaacctggcggcagcgcaaaagatg

SEQ ID NO: 50273 - DNA, 103 bp, Artificial Sequence
  Synthetic Polynucleotide
taatacgactcactatagggactgaattacaataatacggtgacaataacaacagaggagagttattatgaccgtattaaacctggcggcagcgcaaaagatg

SEQ ID NO: 50274 - DNA, 103 bp, Artificial Sequence
  Synthetic Polynucleotide
taatacgactcactatagggtagctactgaattacaataatacggtgacaaacagaggagatgtcacatgattattgtaaacctggcggcagcgcaaaagatg

SEQ ID NO: 50275 - DNA, 103 bp, Artificial Sequence
  Synthetic Polynucleotide
taatacgactcactatagggttgtctagctactgaattacaataatacggaacagaggagaccgtatatgtgtaattcaaacctggcggcagcgcaaaagatg

SEQ ID NO: 50276 - DNA, 103 bp, Artificial Sequence
  Synthetic Polynucleotide
taatacgactcactatagggaccatttgtctagctactgaattacaataaaacagaggagattattgatgttcagtagcaacctggcggcagcgcaaaagatg

SEQ ID NO: 50277 - DNA, 103 bp, Artificial Sequence
  Synthetic Polynucleotide
taatacgactcactatagggcattgaccatttgtctagctactgaattacaacagaggagagtaattatgtagctagacaacctggcggcagcgcaaaagatg

SEQ ID NO: 50278 - DNA, 103 bp, Artificial Sequence
  Synthetic Polynucleotide
taatacgactcactatagggcatatcattgaccatttgtctagctactgaaacagaggagatcagtaatgagacaaatgaacctggcggcagcgcaaaagatg

SEQ ID NO: 50279 - DNA, 103 bp, Artificial Sequence
  Synthetic Polynucleotide
taatacgactcactatagggaaaatcatatcattgaccatttgtctagctaacagaggagaagctagatgaatggtcaaaacctggcggcagcgcaaaagatg

SEQ ID NO: 50280 - DNA, 103 bp, Artificial Sequence
  Synthetic Polynucleotide
taatacgactcactataggggattaaaaatcatatcattgaccatttgtcaacagaggagagacaaaatgtcaatgataaacctggcggcagcgcaaaagatg

SEQ ID NO: 50281 - DNA, 103 bp, Artificial Sequence
  Synthetic Polynucleotide
taatacgactcactataggggaaagttaataaggtagatgacacgttctaaacagaggagatagaacatgtcatctaccaacctggcggcagcgcaaaagatg

SEQ ID NO: 50282 - DNA, 103 bp, Artificial Sequence
  Synthetic Polynucleotide
taatacgactcactatagggatcttgattaaaaatcatatcattgaccataacagaggagaatggtcatggatatgattaacctggcggcagcgcaaaagatg

SEQ ID NO: 50283 - DNA, 103 bp, Artificial Sequence
  Synthetic Polynucleotide
taatacgactcactatagggaatgaatcttgattaaaaatcatatcattgaacagaggagacaatgaatggatttttaaaacctggcggcagcgcaaaagatg

SEQ ID NO: 50284 - DNA, 103 bp, Artificial Sequence
  Synthetic Polynucleotide
taatacgactcactatagggttaaaaatgaatcttgattaaaaatcatataacagaggagaatatgaatgttaatcaagaacctggcggcagcgcaaaagatg

SEQ ID NO: 50285 - DNA, 103 bp, Artificial Sequence
  Synthetic Polynucleotide
taatacgactcactatagggatattttaaaaatgaatcttgattaaaaataacagaggagaatttttatgcaagattcaaacctggcggcagcgcaaaagatg

SEQ ID NO: 50286 - DNA, 103 bp, Artificial Sequence
  Synthetic Polynucleotide
taatacgactcactatagggaataaatattttaaaaatgaatcttgattaaacagaggagataatcaatgttcatttttaacctggcggcagcgcaaaagatg

SEQ ID NO: 50287 - DNA, 103 bp, Artificial Sequence
  Synthetic Polynucleotide
taatacgactcactataggggttctaataaatattttaaaaatgaatcttaacagaggagaaagattatgttttaaaataacctggcggcagcgcaaaagatg

SEQ ID NO: 50288 - DNA, 103 bp, Artificial Sequence
  Synthetic Polynucleotide
taatacgactcactatagggcagatgttctaataaatattttaaaaatgaaacagaggagatcatttatgaaatatttaaacctggcggcagcgcaaaagatg

SEQ ID NO: 50289 - DNA, 103 bp, Artificial Sequence
  Synthetic Polynucleotide
taatacgactcactatagggctaatcagatgttctaataaatattttaaaaacagaggagatttaaaatgtttattagaaacctggcggcagcgcaaaagatg

SEQ ID NO: 50290 - DNA, 103 bp, Artificial Sequence
  Synthetic Polynucleotide
taatacgactcactatagggggcttctaatcagatgttctaataaatattaacagaggagaaatattatgtagaacatcaacctggcggcagcgcaaaagatg

SEQ ID NO: 50291 - DNA, 103 bp, Artificial Sequence
  Synthetic Polynucleotide
taatacgactcactatagggatagtggcttctaatcagatgttctaataaaacagaggagattattaatgcatctgattaacctggcggcagcgcaaaagatg

SEQ ID NO: 50292 - DNA, 103 bp, Artificial Sequence
  Synthetic Polynucleotide
taatacgactcactataggggcggtgaaagttaataaggtagatgacacgaacagaggagacgtgtcatgtaccttattaacctggcggcagcgcaaaagatg

SEQ ID NO: 50293 - DNA, 103 bp, Artificial Sequence
  Synthetic Polynucleotide
taatacgactcactatagggactctatagtggcttctaatcagatgttctaacagaggagaagaacaatggattagaagaacctggcggcagcgcaaaagatg

SEQ ID NO: 50294 - DNA, 103 bp, Artificial Sequence
  Synthetic Polynucleotide
taatacgactcactatagggtagaaactctatagtggcttctaatcagataacagaggagaatctgaatggaagccactaacctggcggcagcgcaaaagatg

SEQ ID NO: 50295 - DNA, 103 bp, Artificial Sequence
  Synthetic Polynucleotide
taatacgactcactatagggatgtttagaaactctatagtggcttctaataacagaggagaattagaatgcactatagaaacctggcggcagcgcaaaagatg

SEQ ID NO: 50296 - DNA, 103 bp, Artificial Sequence
  Synthetic Polynucleotide
taatacgactcactataggggttatatgtttagaaactctatagtggcttaacagaggagaaagccaatgtagagtttcaacctggcggcagcgcaaaagatg

SEQ ID NO: 50297 - DNA, 103 bp, Artificial Sequence
  Synthetic Polynucleotide
taatacgactcactatagggctattgttatatgtttagaaactctatagtaacagaggagaactataatgtttctaaacaacctggcggcagcgcaaaagatg

SEQ ID NO: 50298 - DNA, 103 bp, Artificial Sequence
  Synthetic Polynucleotide
taatacgactcactatagggtctaactattgttatatgtttagaaactctaacagaggagaagagttatgaaacatataaacctggcggcagcgcaaaagatg

SEQ ID NO: 50299 - DNA, 103 bp, Artificial Sequence
  Synthetic Polynucleotide
taatacgactcactatagggttgtatctaactattgttatatgtttagaaaacagaggagattctaaatgtataacaataacctggcggcagcgcaaaagatg

SEQ ID NO: 50300 - DNA, 103 bp, Artificial Sequence
  Synthetic Polynucleotide
taatacgactcactatagggtatctttgtatctaactattgttatatgttaacagaggagaaacataatgcaatagttaaacctggcggcagcgcaaaagatg

SEQ ID NO: 50301 - DNA, 103 bp, Artificial Sequence
  Synthetic Polynucleotide
taatacgactcactatagggttcggtatctttgtatctaactattgttataacagaggagaataacaatggttagatacaacctggcggcagcgcaaaagatg

SEQ ID NO: 50302 - DNA, 103 bp, Artificial Sequence
  Synthetic Polynucleotide
taatacgactcactatagggaattcttcggtatctttgtatctaactattaacagaggagaaatagtatgatacaaagaaacctggcggcagcgcaaaagatg

SEQ ID NO: 50303 - DNA, 103 bp, Artificial Sequence
  Synthetic Polynucleotide
taatacgactcactatagggactatgcggtgaaagttaataaggtagatgaacagaggagacatctaatgtattaacttaacctggcggcagcgcaaaagatg

SEQ ID NO: 50304 - DNA, 103 bp, Artificial Sequence
  Synthetic Polynucleotide
taatacgactcactataggggatttaattcttcggtatctttgtatctaaaacagaggagattagatatgaagataccgaacctggcggcagcgcaaaagatg

SEQ ID NO: 50305 - DNA, 103 bp, Artificial Sequence
  Synthetic Polynucleotide
taatacgactcactatagggcgttagatttaattcttcggtatctttgtaaacagaggagatacaaaatgaccgaagaaaacctggcggcagcgcaaaagatg

SEQ ID NO: 50306 - DNA, 103 bp, Artificial Sequence
  Synthetic Polynucleotide
taatacgactcactatagggattctcgttagatttaattcttcggtatctaacagaggagaagatacatgagaattaaaaacctggcggcagcgcaaaagatg

SEQ ID NO: 50307 - DNA, 103 bp, Artificial Sequence
  Synthetic Polynucleotide
taatacgactcactatagggaacatattctcgttagatttaattcttcggaacagaggagaccgaagatgtaaatctaaaacctggcggcagcgcaaaagatg

SEQ ID NO: 50308 - DNA, 103 bp, Artificial Sequence
  Synthetic Polynucleotide
taatacgactcactatagggattataacatattctcgttagatttaattcaacagaggagagaattaatgctaacgagaaacctggcggcagcgcaaaagatg

SEQ ID NO: 50309 - DNA, 103 bp, Artificial Sequence
  Synthetic Polynucleotide
taatacgactcactatagggtctctattataacatattctcgttagatttaacagaggagaaaatctatggagaatatgaacctggcggcagcgcaaaagatg

SEQ ID NO: 50310 - DNA, 103 bp, Artificial Sequence
  Synthetic Polynucleotide
taatacgactcactatagggacttatctctattataacatattctcgttaaacagaggagataacgaatgtatgttataaacctggcggcagcgcaaaagatg

SEQ ID NO: 50311 - DNA, 103 bp, Artificial Sequence
  Synthetic Polynucleotide
taatacgactcactatagggcttaaacttatctctattataacatattctaacagaggagaagaataatgtataatagaaacctggcggcagcgcaaaagatg

SEQ ID NO: 50312 - DNA, 103 bp, Artificial Sequence
  Synthetic Polynucleotide
taatacgactcactatagggaacgccttaaacttatctctattataacataacagaggagaatgttaatgtagagataaaacctggcggcagcgcaaaagatg

SEQ ID NO: 50313 - DNA, 103 bp, Artificial Sequence
  Synthetic Polynucleotide
taatacgactcactatagggatgcaaacgccttaaacttatctctattataacagaggagaataataatgataagtttaaacctggcggcagcgcaaaagatg

SEQ ID NO: 50314 - DNA, 103 bp, Artificial Sequence
  Synthetic Polynucleotide
taatacgactcactatagggaaacaactatgcggtgaaagttaataaggtaacagaggagaaccttaatgactttcaccaacctggcggcagcgcaaaagatg

SEQ ID NO: 50315 - DNA, 103 bp, Artificial Sequence
  Synthetic Polynucleotide
taatacgactcactatagggagcgaatgcaaacgccttaaacttatctctaacagaggagaagagatatgtttaaggcgaacctggcggcagcgcaaaagatg

SEQ ID NO: 50316 - DNA, 103 bp, Artificial Sequence
  Synthetic Polynucleotide
taatacgactcactatagggaaccaagcgaatgcaaacgccttaaacttaaacagaggagataagttatgggcgtttgcaacctggcggcagcgcaaaagatg

SEQ ID NO: 50317 - DNA, 103 bp, Artificial Sequence
  Synthetic Polynucleotide
taatacgactcactatagggcgttaaaccaagcgaatgcaaacgccttaaaacagaggagattaaggatgttgcattcgaacctggcggcagcgcaaaagatg

SEQ ID NO: 50318 - DNA, 103 bp, Artificial Sequence
  Synthetic Polynucleotide
taatacgactcactatagggaacgccgttaaaccaagcgaatgcaaacgcaacagaggagagcgtttatgttcgcttggaacctggcggcagcgcaaaagatg

SEQ ID NO: 50319 - DNA, 103 bp, Artificial Sequence
  Synthetic Polynucleotide
taatacgactcactatagggtccaaaacgccgttaaaccaagcgaatgcaaacagaggagatgcattatgttggtttaaaacctggcggcagcgcaaaagatg

SEQ ID NO: 50320 - DNA, 103 bp, Artificial Sequence
  Synthetic Polynucleotide
taatacgactcactatagggcattttccaaaacgccgttaaaccaagcgaaacagaggagatcgcttatgttaacggcgaacctggcggcagcgcaaaagatg

SEQ ID NO: 50321 - DNA, 103 bp, Artificial Sequence
  Synthetic Polynucleotide
taatacgactcactatagggtttttcattttccaaaacgccgttaaaccaaacagaggagatggtttatgggcgttttgaacctggcggcagcgcaaaagatg

SEQ ID NO: 50322 - DNA, 103 bp, Artificial Sequence
  Synthetic Polynucleotide
taatacgactcactatagggagtactttttcattttccaaaacgccgttaaacagaggagataacggatgtttggaaaaaacctggcggcagcgcaaaagatg

SEQ ID NO: 50323 - DNA, 103 bp, Artificial Sequence
  Synthetic Polynucleotide
taatacgactcactatagggtatctagtactttttcattttccaaaacgcaacagaggagagcgtttatgaaaatgaaaaacctggcggcagcgcaaaagatg

SEQ ID NO: 50324 - DNA, 103 bp, Artificial Sequence
  Synthetic Polynucleotide
taatacgactcactatagggatacgtatctagtactttttcattttccaaaacagaggagattggaaatggaaaaagtaaacctggcggcagcgcaaaagatg

SEQ ID NO: 50325 - DNA, 103 bp, Artificial Sequence
  Synthetic Polynucleotide
taatacgactcactatagggtttgcaaacaactatgcggtgaaagttaataacagaggagaattaacatgcaccgcataaacctggcggcagcgcaaaagatg

SEQ ID NO: 50326 - DNA, 103 bp, Artificial Sequence
  Synthetic Polynucleotide
taatacgactcactatagggtttttatacgtatctagtactttttcatttaacagaggagaaaatgaatgagtactagaaacctggcggcagcgcaaaagatg

SEQ ID NO: 50327 - DNA, 103 bp, Artificial Sequence
  Synthetic Polynucleotide
taatacgactcactatagggatacctttttatacgtatctagtactttttaacagaggagaaaaaagatgtagatacgtaacctggcggcagcgcaaaagatg

SEQ ID NO: 50328 - DNA, 103 bp, Artificial Sequence
  Synthetic Polynucleotide
taatacgactcactatagggatcagatacctttttatacgtatctagtacaacagaggagagtactaatgacgtataaaaacctggcggcagcgcaaaagatg

SEQ ID NO: 50329 - DNA, 103 bp, Artificial Sequence
  Synthetic Polynucleotide
taatacgactcactatagggatcaaatcagatacctttttatacgtatctaacagaggagaagatacatgtaaaaaggtaacctggcggcagcgcaaaagatg

SEQ ID NO: 50330 - DNA, 103 bp, Artificial Sequence
  Synthetic Polynucleotide
taatacgactcactatagggattatatcaaatcagatacctttttatacgaacagaggagacgtataatgaggtatctgaacctggcggcagcgcaaaagatg

SEQ ID NO: 50331 - DNA, 103 bp, Artificial Sequence
  Synthetic Polynucleotide
taatacgactcactatagggaattcattatatcaaatcagatacctttttaacagaggagaaaaaagatgtctgatttgaacctggcggcagcgcaaaagatg

SEQ ID NO: 50332 - DNA, 103 bp, Artificial Sequence
  Synthetic Polynucleotide
taatacgactcactatagggcactgaattcattatatcaaatcagataccaacagaggagaggtatcatgtttgatataaacctggcggcagcgcaaaagatg

SEQ ID NO: 50333 - DNA, 103 bp, Artificial Sequence
  Synthetic Polynucleotide
taatacgactcactatagggacagtcactgaattcattatatcaaatcagaacagaggagactgattatgtataatgaaaacctggcggcagcgcaaaagatg

SEQ ID NO: 50334 - DNA, 103 bp, Artificial Sequence
  Synthetic Polynucleotide
taatacgactcactataggggtgatacagtcactgaattcattatatcaaaacagaggagattgataatgtgaattcagaacctggcggcagcgcaaaagatg

SEQ ID NO: 50335 - DNA, 103 bp, Artificial Sequence
  Synthetic Polynucleotide
taatacgactcactatagggtgcgtgtgatacagtcactgaattcattataacagaggagaataatgatgtcagtgactaacctggcggcagcgcaaaagatg

SEQ ID NO: 50336 - DNA, 103 bp, Artificial Sequence
  Synthetic Polynucleotide
taatacgactcactatagggccgtatttgcaaacaactatgcggtgaaagaacagaggagactttcaatgcatagttgtaacctggcggcagcgcaaaagatg

SEQ ID NO: 50337 - DNA, 103 bp, Artificial Sequence
  Synthetic Polynucleotide
taatacgactcactatagggtatggtgcgtgtgatacagtcactgaattcaacagaggagagaattcatggactgtatcaacctggcggcagcgcaaaagatg

SEQ ID NO: 50338 - DNA, 103 bp, Artificial Sequence
  Synthetic Polynucleotide
taatacgactcactatagggtagtatatggtgcgtgtgatacagtcactgaacagaggagacagtgaatgtatcacacgaacctggcggcagcgcaaaagatg

SEQ ID NO: 50339 - DNA, 103 bp, Artificial Sequence
  Synthetic Polynucleotide
taatacgactcactatagggagtaatagtatatggtgcgtgtgatacagtaacagaggagaactgtaatgcacgcaccaaacctggcggcagcgcaaaagatg

SEQ ID NO: 50340 - DNA, 103 bp, Artificial Sequence
  Synthetic Polynucleotide
taatacgactcactatagggtgataagtaatagtatatggtgcgtgtgataacagaggagaatcacaatgaccatatacaacctggcggcagcgcaaaagatg

SEQ ID NO: 50341 - DNA, 103 bp, Artificial Sequence
  Synthetic Polynucleotide
taatacgactcactatagggcatcgtgataagtaatagtatatggtgcgtaacagaggagaacgcacatgatactattaaacctggcggcagcgcaaaagatg

SEQ ID NO: 50342 - DNA, 103 bp, Artificial Sequence
  Synthetic Polynucleotide
taatacgactcactatagggccaatcatcgtgataagtaatagtatatggaacagaggagaccatatatgattacttataacctggcggcagcgcaaaagatg

SEQ ID NO: 50343 - DNA, 103 bp, Artificial Sequence
  Synthetic Polynucleotide
taatacgactcactatagggggttcccaatcatcgtgataagtaatagtaaacagaggagatactatatgttatcacgaaacctggcggcagcgcaaaagatg

SEQ ID NO: 50344 - DNA, 103 bp, Artificial Sequence
  Synthetic Polynucleotide
taatacgactcactatagggtgactggttcccaatcatcgtgataagtaaaacagaggagattacttatgacgatgattaacctggcggcagcgcaaaagatg

SEQ ID NO: 50345 - DNA, 103 bp, Artificial Sequence
  Synthetic Polynucleotide
taatacgactcactatagggattcatgactggttcccaatcatcgtgataaacagaggagatatcacatggattgggaaaacctggcggcagcgcaaaagatg

SEQ ID NO: 50346 - DNA, 103 bp, Artificial Sequence
  Synthetic Polynucleotide
taatacgactcactatagggaattgattcatgactggttcccaatcatcgaacagaggagacgatgaatgggaaccagtaacctggcggcagcgcaaaagatg

SEQ ID NO: 50347 - DNA, 103 bp, Artificial Sequence
  Synthetic Polynucleotide
taatacgactcactatagggaagacactctcattcctcatccacaaccccaacagaggagaggggttatggatgaggaaaacctggcggcagcgcaaaagatg

SEQ ID NO: 50348 - DNA, 103 bp, Artificial Sequence
  Synthetic Polynucleotide
taatacgactcactatagggattaaccgtatttgcaaacaactatgcggtaacagaggagaaccgcaatgttgtttgcaaacctggcggcagcgcaaaagatg

SEQ ID NO: 50349 - DNA, 103 bp, Artificial Sequence
  Synthetic Polynucleotide
taatacgactcactatagggctactaattgattcatgactggttcccaataacagaggagaattgggatgcagtcatgaaacctggcggcagcgcaaaagatg

SEQ ID NO: 50350 - DNA, 103 bp, Artificial Sequence
  Synthetic Polynucleotide
taatacgactcactatagggaaactctactaattgattcatgactggttcaacagaggagagaaccaatgatgaatcaaaacctggcggcagcgcaaaagatg

SEQ ID NO: 50351 - DNA, 103 bp, Artificial Sequence
  Synthetic Polynucleotide
taatacgactcactatagggttataaaactctactaattgattcatgactaacagaggagaagtcatatgtcaattagtaacctggcggcagcgcaaaagatg

SEQ ID NO: 50352 - DNA, 103 bp, Artificial Sequence
  Synthetic Polynucleotide
taatacgactcactatagggcttcgttataaaactctactaattgattcaaacagaggagatgaatcatgtagtagagtaacctggcggcagcgcaaaagatg

SEQ ID NO: 50353 - DNA, 103 bp, Artificial Sequence
  Synthetic Polynucleotide
taatacgactcactatagggggctacttcgttataaaactctactaattgaacagaggagacaattaatggagttttataacctggcggcagcgcaaaagatg

SEQ ID NO: 50354 - DNA, 103 bp, Artificial Sequence
  Synthetic Polynucleotide
taatacgactcactatagggcaactggctacttcgttataaaactctactaacagaggagaagtagaatgttataacgaaacctggcggcagcgcaaaagatg

SEQ ID NO: 50355 - DNA, 103 bp, Artificial Sequence
  Synthetic Polynucleotide
taatacgactcactataggggcagccaactggctacttcgttataaaactaacagaggagaagttttatgacgaagtagaacctggcggcagcgcaaaagatg

SEQ ID NO: 50356 - DNA, 103 bp, Artificial Sequence
  Synthetic Polynucleotide
taatacgactcactatagggtcgtagcagccaactggctacttcgttataaacagaggagatataacatggtagccagtaacctggcggcagcgcaaaagatg

SEQ ID NO: 50357 - DNA, 103 bp, Artificial Sequence
  Synthetic Polynucleotide
taatacgactcactatagggtcgtctcgtagcagccaactggctacttcgaacagaggagacgaagtatgcagttggctaacctggcggcagcgcaaaagatg

SEQ ID NO: 50358 - DNA, 103 bp, Artificial Sequence
  Synthetic Polynucleotide
taatacgactcactatagggacgtctcgtctcgtagcagccaactggctaaacagaggagatagccaatgggctgctacaacctggcggcagcgcaaaagatg

SEQ ID NO: 50359 - DNA, 103 bp, Artificial Sequence
  Synthetic Polynucleotide
taatacgactcactatagggaaaggattaaccgtatttgcaaacaactataacagaggagaatagttatgtgcaaatacaacctggcggcagcgcaaaagatg

SEQ ID NO: 50360 - DNA, 103 bp, Artificial Sequence
  Synthetic Polynucleotide
taatacgactcactatagggaggcgacgtctcgtctcgtagcagccaactaacagaggagaagttggatgctacgagacaacctggcggcagcgcaaaagatg

SEQ ID NO: 50361 - DNA, 103 bp, Artificial Sequence
  Synthetic Polynucleotide
taatacgactcactatagggggaataggcgacgtctcgtctcgtagcagcaacagaggagagctgctatgagacgagacaacctggcggcagcgcaaaagatg

SEQ ID NO: 50362 - DNA, 103 bp, Artificial Sequence
  Synthetic Polynucleotide
taatacgactcactatagggtatcaggaataggcgacgtctcgtctcgtaaacagaggagatacgagatgagacgtcgcaacctggcggcagcgcaaaagatg

SEQ ID NO: 50363 - DNA, 103 bp, Artificial Sequence
  Synthetic Polynucleotide
taatacgactcactataggggaacttatcaggaataggcgacgtctcgtcaacagaggagagacgagatgtcgcctattaacctggcggcagcgcaaaagatg

SEQ ID NO: 50364 - DNA, 103 bp, Artificial Sequence
  Synthetic Polynucleotide
taatacgactcactatagggataaagaacttatcaggaataggcgacgtcaacagaggagagacgtcatgtattcctgaaacctggcggcagcgcaaaagatg

SEQ ID NO: 50365 - DNA, 103 bp, Artificial Sequence
  Synthetic Polynucleotide
taatacgactcactatagggactgtataaagaacttatcaggaataggcgaacagaggagacgcctaatgctgataagtaacctggcggcagcgcaaaagatg

SEQ ID NO: 50366 - DNA, 103 bp, Artificial Sequence
  Synthetic Polynucleotide
taatacgactcactatagggtttcaactgtataaagaacttatcaggaataacagaggagaattcctatgaagttctttaacctggcggcagcgcaaaagatg

SEQ ID NO: 50367 - DNA, 103 bp, Artificial Sequence
  Synthetic Polynucleotide
taatacgactcactatagggggttgtttcaactgtataaagaacttatcaaacagaggagatgataaatgctttatacaaacctggcggcagcgcaaaagatg

SEQ ID NO: 50368 - DNA, 103 bp, Artificial Sequence
  Synthetic Polynucleotide
taatacgactcactatagggtaagcggttgtttcaactgtataaagaactaacagaggagaagttctatgtacagttgaaacctggcggcagcgcaaaagatg

SEQ ID NO: 50369 - DNA, 103 bp, Artificial Sequence
  Synthetic Polynucleotide
taatacgactcactatagggatttctaagcggttgtttcaactgtataaaaacagaggagatttataatgttgaaacaaaacctggcggcagcgcaaaagatg

SEQ ID NO: 50370 - DNA, 103 bp, Artificial Sequence
  Synthetic Polynucleotide
taatacgactcactatagggaggtcaaaggattaaccgtatttgcaaacaaacagaggagatgtttgatgatacggttaaacctggcggcagcgcaaaagatg

SEQ ID NO: 50371 - DNA, 103 bp, Artificial Sequence
  Synthetic Polynucleotide
taatacgactcactatagggcgcttatttctaagcggttgtttcaactgtaacagaggagaacagttatgacaaccgctaacctggcggcagcgcaaaagatg

SEQ ID NO: 50372 - DNA, 103 bp, Artificial Sequence
  Synthetic Polynucleotide
taatacgactcactatagggatacgcgcttatttctaagcggttgtttcaaacagaggagatgaaacatgcgcttagaaaacctggcggcagcgcaaaagatg

SEQ ID NO: 50373 - DNA, 103 bp, Artificial Sequence
  Synthetic Polynucleotide
taatacgactcactatagggcacacatacgcgcttatttctaagcggttgaacagaggagacaaccgatgagaaataagaacctggcggcagcgcaaaagatg

SEQ ID NO: 50374 - DNA, 103 bp, Artificial Sequence
  Synthetic Polynucleotide
taatacgactcactatagggccacacacacatacgcgcttatttctaagcaacagaggagagcttagatgtaagcgcgtaacctggcggcagcgcaaaagatg

SEQ ID NO: 50375 - DNA, 103 bp, Artificial Sequence
  Synthetic Polynucleotide
taatacgactcactatagggctataccacacacacatacgcgcttatttcaacagaggagagaaataatggcgtatgtgaacctggcggcagcgcaaaagatg

SEQ ID NO: 50376 - DNA, 103 bp, Artificial Sequence
  Synthetic Polynucleotide
taatacgactcactatagggcggatctataccacacacacatacgcgcttaacagaggagaaagcgcatgtgtgtgtgtaacctggcggcagcgcaaaagatg

SEQ ID NO: 50377 - DNA, 103 bp, Artificial Sequence
  Synthetic Polynucleotide
taatacgactcactatagggggatacggatctataccacacacacatacgaacagaggagacgtatgatggtgtggtataacctggcggcagcgcaaaagatg

SEQ ID NO: 50378 - DNA, 103 bp, Artificial Sequence
  Synthetic Polynucleotide
taatacgactcactatagggctttcggatacggatctataccacacacacaacagaggagagtgtgtatggtatagatcaacctggcggcagcgcaaaagatg

SEQ ID NO: 50379 - DNA, 103 bp, Artificial Sequence
  Synthetic Polynucleotide
taatacgactcactatagggtccatctttcggatacggatctataccacaaacagaggagatgtggtatggatccgtataacctggcggcagcgcaaaagatg

SEQ ID NO: 50380 - DNA, 103 bp, Artificial Sequence
  Synthetic Polynucleotide
taatacgactcactatagggccagttccatctttcggatacggatctataaacagaggagatatagaatggtatccgaaaacctggcggcagcgcaaaagatg

SEQ ID NO: 50381 - DNA, 103 bp, Artificial Sequence
  Synthetic Polynucleotide
taatacgactcactatagggcgacgaggtcaaaggattaaccgtatttgcaacagaggagagcaaatatggttaatcctaacctggcggcagcgcaaaagatg

SEQ ID NO: 50382 - DNA, 103 bp, Artificial Sequence
  Synthetic Polynucleotide
taatacgactcactataggggtacaccagttccatctttcggatacggataacagaggagaatccgtatgcgaaagatgaacctggcggcagcgcaaaagatg

SEQ ID NO: 50383 - DNA, 103 bp, Artificial Sequence
  Synthetic Polynucleotide
taatacgactcactataggggaacggtacaccagttccatctttcggataaacagaggagatatccgatggatggaactaacctggcggcagcgcaaaagatg

SEQ ID NO: 50384 - DNA, 103 bp, Artificial Sequence
  Synthetic Polynucleotide
taatacgactcactataggggactcgaacggtacaccagttccatctttcaacagaggagagaaagaatgaactggtgtaacctggcggcagcgcaaaagatg

SEQ ID NO: 50385 - DNA, 103 bp, Artificial Sequence
  Synthetic Polynucleotide
taatacgactcactatagggttggtgactcgaacggtacaccagttccataacagaggagaatggaaatggtgtaccgtaacctggcggcagcgcaaaagatg

SEQ ID NO: 50386 - DNA, 103 bp, Artificial Sequence
  Synthetic Polynucleotide
taatacgactcactatagggaaaatttggtgactcgaacggtacaccagtaacagaggagaactggtatgccgttcgagaacctggcggcagcgcaaaagatg

SEQ ID NO: 50387 - DNA, 103 bp, Artificial Sequence
  Synthetic Polynucleotide
taatacgactcactatagggtttgtaaaatttggtgactcgaacggtacaaacagaggagatgtaccatgcgagtcaccaacctggcggcagcgcaaaagatg

SEQ ID NO: 50388 - DNA, 103 bp, Artificial Sequence
  Synthetic Polynucleotide
taatacgactcactatagggatttttttgtaaaatttggtgactcgaacgaacagaggagacgttcgatgcaccaaattaacctggcggcagcgcaaaagatg

SEQ ID NO: 50389 - DNA, 103 bp, Artificial Sequence
  Synthetic Polynucleotide
taatacgactcactatagggaattgatttttttgtaaaatttggtgactcaacagaggagagagtcaatgaattttacaaacctggcggcagcgcaaaagatg

SEQ ID NO: 50390 - DNA, 103 bp, Artificial Sequence
  Synthetic Polynucleotide
taatacgactcactatagggtccttaattgatttttttgtaaaatttggtaacagaggagaaccaaaatgtacaaaaaaaacctggcggcagcgcaaaagatg

SEQ ID NO: 50391 - DNA, 103 bp, Artificial Sequence
  Synthetic Polynucleotide
taatacgactcactatagggctatctccttaattgatttttttgtaaaataacagaggagaattttaatgaaaaatcaaaacctggcggcagcgcaaaagatg

SEQ ID NO: 50392 - DNA, 103 bp, Artificial Sequence
  Synthetic Polynucleotide
taatacgactcactataggggaaatcgacgaggtcaaaggattaaccgtaaacagaggagatacggtatgtcctttgacaacctggcggcagcgcaaaagatg

SEQ ID NO: 50393 - DNA, 103 bp, Artificial Sequence
  Synthetic Polynucleotide
taatacgactcactatagggagatgctatctccttaattgatttttttgtaacagaggagaacaaaaatgtcaattaagaacctggcggcagcgcaaaagatg

SEQ ID NO: 50394 - DNA, 103 bp, Artificial Sequence
  Synthetic Polynucleotide
taatacgactcactatagggatagaagatgctatctccttaattgattttaacagaggagaaaaatcatgtaaggagataacctggcggcagcgcaaaagatg

SEQ ID NO: 50395 - DNA, 103 bp, Artificial Sequence
  Synthetic Polynucleotide
taatacgactcactatagggtagatatagaagatgctatctccttaattgaacagaggagacaattaatgagatagcataacctggcggcagcgcaaaagatg

SEQ ID NO: 50396 - DNA, 103 bp, Artificial Sequence
  Synthetic Polynucleotide
taatacgactcactatagggtaatctagatatagaagatgctatctccttaacagaggagaaaggagatggcatcttctaacctggcggcagcgcaaaagatg

SEQ ID NO: 50397 - DNA, 103 bp, Artificial Sequence
  Synthetic Polynucleotide
taatacgactcactatagggccggttaatctagatatagaagatgctatcaacagaggagagatagcatgttctatatcaacctggcggcagcgcaaaagatg

SEQ ID NO: 50398 - DNA, 103 bp, Artificial Sequence
  Synthetic Polynucleotide
taatacgactcactatagggttactccggttaatctagatatagaagatgaacagaggagacatcttatgtatctagataacctggcggcagcgcaaaagatg

SEQ ID NO: 50399 - DNA, 103 bp, Artificial Sequence
  Synthetic Polynucleotide
taatacgactcactatagggatcaattactccggttaatctagatatagaaacagaggagatctataatgagattaaccaacctggcggcagcgcaaaagatg

SEQ ID NO: 50400 - DNA, 103 bp, Artificial Sequence
  Synthetic Polynucleotide
taatacgactcactatagggttataatcaattactccggttaatctagataacagaggagaatctagatgaaccggagtaacctggcggcagcgcaaaagatg

SEQ ID NO: 50401 - DNA, 103 bp, Artificial Sequence
  Synthetic Polynucleotide
taatacgactcactatagggaacctttataatcaattactccggttaatcaacagaggagagattaaatggagtaattgaacctggcggcagcgcaaaagatg

SEQ ID NO: 50402 - DNA, 103 bp, Artificial Sequence
  Synthetic Polynucleotide
taatacgactcactataggggttataacctttataatcaattactccggtaacagaggagaaccggaatgattgattataacctggcggcagcgcaaaagatg

SEQ ID NO: 50403 - DNA, 103 bp, Artificial Sequence
  Synthetic Polynucleotide
taatacgactcactatagggggtcggaaatcgacgaggtcaaaggattaaaacagaggagattaatcatgtgacctcgtaacctggcggcagcgcaaaagatg

SEQ ID NO: 50404 - DNA, 103 bp, Artificial Sequence
  Synthetic Polynucleotide
taatacgactcactatagggttaaggttataacctttataatcaattactaacagaggagaagtaatatgttataaaggaacctggcggcagcgcaaaagatg

SEQ ID NO: 50405 - DNA, 103 bp, Artificial Sequence
  Synthetic Polynucleotide
taatacgactcactatagggttatattaaggttataacctttataatcaaaacagaggagattgattatgaaggttataaacctggcggcagcgcaaaagatg

SEQ ID NO: 50406 - DNA, 103 bp, Artificial Sequence
  Synthetic Polynucleotide
taatacgactcactataggggtctattatattaaggttataacctttataaacagaggagatataaaatgtataaccttaacctggcggcagcgcaaaagatg

SEQ ID NO: 50407 - DNA, 103 bp, Artificial Sequence
  Synthetic Polynucleotide
taatacgactcactatagggaccccgtctattatattaaggttataacctaacagaggagaaggttaatgccttaatataacctggcggcagcgcaaaagatg

SEQ ID NO: 50408 - DNA, 103 bp, Artificial Sequence
  Synthetic Polynucleotide
taatacgactcactataggggtataaccccgtctattatattaaggttataacagaggagaataaccatgatataatagaacctggcggcagcgcaaaagatg

SEQ ID NO: 50409 - DNA, 103 bp, Artificial Sequence
  Synthetic Polynucleotide
taatacgactcactatagggccagggtataaccccgtctattatattaagaacagaggagacttaatatgatagacgggaacctggcggcagcgcaaaagatg

SEQ ID NO: 50410 - DNA, 103 bp, Artificial Sequence
  Synthetic Polynucleotide
taatacgactcactatagggtaattccagggtataaccccgtctattataaacagaggagatataatatgcggggttataacctggcggcagcgcaaaagatg

SEQ ID NO: 50411 - DNA, 103 bp, Artificial Sequence
  Synthetic Polynucleotide
taatacgactcactatagggagtaataattccagggtataaccccgtctaaacagaggagatagacgatgttataccctaacctggcggcagcgcaaaagatg

SEQ ID NO: 50412 - DNA, 103 bp, Artificial Sequence
  Synthetic Polynucleotide
taatacgactcactatagggacttaagtaataattccagggtataaccccaacagaggagaggggttatgccctggaataacctggcggcagcgcaaaagatg

SEQ ID NO: 50413 - DNA, 103 bp, Artificial Sequence
  Synthetic Polynucleotide
taatacgactcactatagggttacaacttaagtaataattccagggtataaacagaggagatataccatggaattattaaacctggcggcagcgcaaaagatg

SEQ ID NO: 50414 - DNA, 103 bp, Artificial Sequence
  Synthetic Polynucleotide
taatacgactcactatagggagattggtcggaaatcgacgaggtcaaaggaacagaggagacctttgatgtcgtcgattaacctggcggcagcgcaaaagatg

SEQ ID NO: 50415 - DNA, 103 bp, Artificial Sequence
  Synthetic Polynucleotide
taatacgactcactatagggctaatttacaacttaagtaataattccaggaacagaggagacctggaatgattacttaaaacctggcggcagcgcaaaagatg

SEQ ID NO: 50416 - DNA, 103 bp, Artificial Sequence
  Synthetic Polynucleotide
taatacgactcactatagggttctcctaatttacaacttaagtaataattaacagaggagaaattatatgttaagttgtaacctggcggcagcgcaaaagatg

SEQ ID NO: 50417 - DNA, 103 bp, Artificial Sequence
  Synthetic Polynucleotide
taatacgactcactatagggtttgtttctcctaatttacaacttaagtaaaacagaggagattacttatgttgtaaattaacctggcggcagcgcaaaagatg

SEQ ID NO: 50418 - DNA, 103 bp, Artificial Sequence
  Synthetic Polynucleotide
taatacgactcactataggggactttttgtttctcctaatttacaacttaaacagaggagataagttatgaattaggagaacctggcggcagcgcaaaagatg

SEQ ID NO: 50419 - DNA, 103 bp, Artificial Sequence
  Synthetic Polynucleotide
taatacgactcactatagggcgcgtgactttttgtttctcctaatttacaaacagaggagatgtaaaatgggagaaacaaacctggcggcagcgcaaaagatg

SEQ ID NO: 50420 - DNA, 103 bp, Artificial Sequence
  Synthetic Polynucleotide
taatacgactcactatagggtaaatcgcgtgactttttgtttctcctaataacagaggagaattaggatgaacaaaaagaacctggcggcagcgcaaaagatg

SEQ ID NO: 50421 - DNA, 103 bp, Artificial Sequence
  Synthetic Polynucleotide
taatacgactcactatagggcccagtaaatcgcgtgactttttgtttctcaacagaggagagagaaaatgaaagtcacgaacctggcggcagcgcaaaagatg

SEQ ID NO: 50422 - DNA, 103 bp, Artificial Sequence
  Synthetic Polynucleotide
taatacgactcactatagggcttatcccagtaaatcgcgtgactttttgtaacagaggagaacaaaaatgcacgcgattaacctggcggcagcgcaaaagatg

SEQ ID NO: 50423 - DNA, 103 bp, Artificial Sequence
  Synthetic Polynucleotide
taatacgactcactataggggaaatcttatcccagtaaatcgcgtgacttaacagaggagaaagtcaatggatttactgaacctggcggcagcgcaaaagatg

SEQ ID NO: 50424 - DNA, 103 bp, Artificial Sequence
  Synthetic Polynucleotide
taatacgactcactatagggacttagaaatcttatcccagtaaatcgcgtaacagaggagaacgcgaatgactgggataaacctggcggcagcgcaaaagatg

SEQ ID NO: 50425 - DNA, 103 bp, Artificial Sequence
  Synthetic Polynucleotide
taatacgactcactatagggcgcccagattggtcggaaatcgacgaggtcaacagaggagagacctcatggatttccgaaacctggcggcagcgcaaaagatg

SEQ ID NO: 50426 - DNA, 103 bp, Artificial Sequence
  Synthetic Polynucleotide
taatacgactcactatagggcagtaacttagaaatcttatcccagtaaataacagaggagaatttacatggataagattaacctggcggcagcgcaaaagatg

SEQ ID NO: 50427 - DNA, 103 bp, Artificial Sequence
  Synthetic Polynucleotide
taatacgactcactatagggtgcagcagtaacttagaaatcttatcccagaacagaggagactgggaatggatttctaaaacctggcggcagcgcaaaagatg

SEQ ID NO: 50428 - DNA, 103 bp, Artificial Sequence
  Synthetic Polynucleotide
taatacgactcactatagggtatgatgcagcagtaacttagaaatcttataacagaggagaataagaatgctaagttacaacctggcggcagcgcaaaagatg

SEQ ID NO: 50429 - DNA, 103 bp, Artificial Sequence
  Synthetic Polynucleotide
taatacgactcactatagggagttatatgatgcagcagtaacttagaaataacagaggagaatttctatgttactgctgaacctggcggcagcgcaaaagatg

SEQ ID NO: 50430 - DNA, 103 bp, Artificial Sequence
  Synthetic Polynucleotide
taatacgactcactatagggtgtttagttatatgatgcagcagtaacttaaacagaggagataagttatggctgcatcaaacctggcggcagcgcaaaagatg

SEQ ID NO: 50431 - DNA, 103 bp, Artificial Sequence
  Synthetic Polynucleotide
taatacgactcactatagggtaacgtgtttagttatatgatgcagcagtaaacagaggagatactgcatgatcatataaaacctggcggcagcgcaaaagatg

SEQ ID NO: 50432 - DNA, 103 bp, Artificial Sequence
  Synthetic Polynucleotide
taatacgactcactatagggaaacctaacgtgtttagttatatgatgcagaacagaggagactgcatatgataactaaaaacctggcggcagcgcaaaagatg

SEQ ID NO: 50433 - DNA, 103 bp, Artificial Sequence
  Synthetic Polynucleotide
taatacgactcactatagggtaaagaaacctaacgtgtttagttatatgaaacagaggagatcatatatgtaaacacgtaacctggcggcagcgcaaaagatg

SEQ ID NO: 50434 - DNA, 103 bp, Artificial Sequence
  Synthetic Polynucleotide
taatacgactcactatagggaacaataaagaaacctaacgtgtttagttaaacagaggagataactaatgacgttaggtaacctggcggcagcgcaaaagatg

SEQ ID NO: 50435 - DNA, 103 bp, Artificial Sequence
  Synthetic Polynucleotide
taatacgactcactatagggacccaaacaataaagaaacctaacgtgtttaacagaggagaaaacacatgaggtttcttaacctggcggcagcgcaaaagatg

SEQ ID NO: 50436 - DNA, 103 bp, Artificial Sequence
  Synthetic Polynucleotide
taatacgactcactatagggttatacgcccagattggtcggaaatcgacgaacagaggagacgtcgaatgccgaccaataacctggcggcagcgcaaaagatg

SEQ ID NO: 50437 - DNA, 103 bp, Artificial Sequence
  Synthetic Polynucleotide
taatacgactcactataggggttttacccaaacaataaagaaacctaacgaacagaggagacgttagatgtctttattgaacctggcggcagcgcaaaagatg

SEQ ID NO: 50438 - DNA, 103 bp, Artificial Sequence
  Synthetic Polynucleotide
taatacgactcactatagggaatctgttttacccaaacaataaagaaaccaacagaggagaggtttcatgattgtttggaacctggcggcagcgcaaaagatg

SEQ ID NO: 50439 - DNA, 103 bp, Artificial Sequence
  Synthetic Polynucleotide
taatacgactcactatagggcgagaaatctgttttacccaaacaataaagaacagaggagactttatatgttgggtaaaaacctggcggcagcgcaaaagatg

SEQ ID NO: 50440 - DNA, 103 bp, Artificial Sequence
  Synthetic Polynucleotide
taatacgactcactatagggatattcgagaaatctgttttacccaaacaaaacagaggagattgtttatgtaaaacagaaacctggcggcagcgcaaaagatg

SEQ ID NO: 50441 - DNA, 103 bp, Artificial Sequence
  Synthetic Polynucleotide
taatacgactcactatagggcccgtatattcgagaaatctgttttacccaaacagaggagatgggtaatgcagatttctaacctggcggcagcgcaaaagatg

SEQ ID NO: 50442 - DNA, 103 bp, Artificial Sequence
  Synthetic Polynucleotide
taatacgactcactatagggcttggcccgtatattcgagaaatctgttttaacagaggagaaaaacaatgttctcgaataacctggcggcagcgcaaaagatg

SEQ ID NO: 50443 - DNA, 103 bp, Artificial Sequence
  Synthetic Polynucleotide
taatacgactcactatagggtctaacttggcccgtatattcgagaaatctaacagaggagaagatttatggaatatacgaacctggcggcagcgcaaaagatg

SEQ ID NO: 50444 - DNA, 103 bp, Artificial Sequence
  Synthetic Polynucleotide
taatacgactcactataggggagattctaacttggcccgtatattcgagaaacagaggagatctcgaatgtacgggccaaacctggcggcagcgcaaaagatg

SEQ ID NO: 50445 - DNA, 103 bp, Artificial Sequence
  Synthetic Polynucleotide
taatacgactcactatagggtactggagattctaacttggcccgtatattaacagaggagaaatataatggccaagttaaacctggcggcagcgcaaaagatg

SEQ ID NO: 50446 - DNA, 103 bp, Artificial Sequence
  Synthetic Polynucleotide
taatacgactcactataggggtagttactggagattctaacttggcccgtaacagaggagaacgggcatggttagaatcaacctggcggcagcgcaaaagatg

SEQ ID NO: 50447 - DNA, 103 bp, Artificial Sequence
  Synthetic Polynucleotide
taatacgactcactatagggattcattatacgcccagattggtcggaaataacagaggagaatttccatgcaatctgggaacctggcggcagcgcaaaagatg

SEQ ID NO: 50448 - DNA, 103 bp, Artificial Sequence
  Synthetic Polynucleotide
taatacgactcactatagggctatggtagttactggagattctaacttggaacagaggagaccaagtatgaatctccagaacctggcggcagcgcaaaagatg

SEQ ID NO: 50449 - DNA, 103 bp, Artificial Sequence
  Synthetic Polynucleotide
taatacgactcactatagggtcccactatggtagttactggagattctaaaacagaggagattagaaatgccagtaactaacctggcggcagcgcaaaagatg

SEQ ID NO: 50450 - DNA, 103 bp, Artificial Sequence
  Synthetic Polynucleotide
taatacgactcactatagggtgatatcccactatggtagttactggagataacagaggagaatctccatgaactaccataacctggcggcagcgcaaaagatg

SEQ ID NO: 50451 - DNA, 103 bp, Artificial Sequence
  Synthetic Polynucleotide
taatacgactcactatagggctggatgatatcccactatggtagttactgaacagaggagacagtaaatgccatagtggaacctggcggcagcgcaaaagatg

SEQ ID NO: 50452 - DNA, 103 bp, Artificial Sequence
  Synthetic Polynucleotide
taatacgactcactatagggagctgctggatgatatcccactatggtagtaacagaggagaactaccatggtgggatataacctggcggcagcgcaaaagatg

SEQ ID NO: 50453 - DNA, 103 bp, Artificial Sequence
  Synthetic Polynucleotide
taatacgactcactatagggtctctagctgctggatgatatcccactatgaacagaggagacatagtatgatatcatccaacctggcggcagcgcaaaagatg

SEQ ID NO: 50454 - DNA, 103 bp, Artificial Sequence
  Synthetic Polynucleotide
taatacgactcactataggggacggtctctagctgctggatgatatcccaaacagaggagatgggatatgatccagcagaacctggcggcagcgcaaaagatg

SEQ ID NO: 50455 - DNA, 103 bp, Artificial Sequence
  Synthetic Polynucleotide
taatacgactcactataggggaattgacggtctctagctgctggatgataaacagaggagatatcatatggcagctagaaacctggcggcagcgcaaaagatg

SEQ ID NO: 50456 - DNA, 103 bp, Artificial Sequence
  Synthetic Polynucleotide
taatacgactcactatagggttctcgaattgacggtctctagctgctggaaacagaggagatccagcatgtagagaccgaacctggcggcagcgcaaaagatg

SEQ ID NO: 50457 - DNA, 103 bp, Artificial Sequence
  Synthetic Polynucleotide
taatacgactcactatagggtatctttctcgaattgacggtctctagctgaacagaggagacagctaatgaccgtcaataacctggcggcagcgcaaaagatg

SEQ ID NO: 50458 - DNA, 103 bp, Artificial Sequence
  Synthetic Polynucleotide
taatacgactcactataggggagataagacactctcattcctcatccacaaacagaggagatgtggaatgggaatgagaaacctggcggcagcgcaaaagatg

SEQ ID NO: 50459 - DNA, 103 bp, Artificial Sequence
  Synthetic Polynucleotide
taatacgactcactatagggttcagattcattatacgcccagattggtcgaacagaggagacgaccaatgtgggcgtataacctggcggcagcgcaaaagatg

SEQ ID NO: 50460 - DNA, 103 bp, Artificial Sequence
  Synthetic Polynucleotide
taatacgactcactatagggtgatctatctttctcgaattgacggtctctaacagaggagaagagacatgcaattcgagaacctggcggcagcgcaaaagatg

SEQ ID NO: 50461 - DNA, 103 bp, Artificial Sequence
  Synthetic Polynucleotide
taatacgactcactatagggtcaaatgatctatctttctcgaattgacggaacagaggagaccgtcaatgcgagaaagaaacctggcggcagcgcaaaagatg

SEQ ID NO: 50462 - DNA, 103 bp, Artificial Sequence
  Synthetic Polynucleotide
taatacgactcactatagggtaatttcaaatgatctatctttctcgaattaacagaggagaaattcgatgaagatagataacctggcggcagcgcaaaagatg

SEQ ID NO: 50463 - DNA, 103 bp, Artificial Sequence
  Synthetic Polynucleotide
taatacgactcactataggggttgataatttcaaatgatctatctttctcaacagaggagagagaaaatgagatcatttaacctggcggcagcgcaaaagatg

SEQ ID NO: 50464 - DNA, 103 bp, Artificial Sequence
  Synthetic Polynucleotide
taatacgactcactatagggaaaacgttgataatttcaaatgatctatctaacagaggagaagatagatgatttgaaataacctggcggcagcgcaaaagatg

SEQ ID NO: 50465 - DNA, 103 bp, Artificial Sequence
  Synthetic Polynucleotide
taatacgactcactatagggccagtaaaacgttgataatttcaaatgatcaacagaggagagatcatatgaaattatcaaacctggcggcagcgcaaaagatg

SEQ ID NO: 50466 - DNA, 103 bp, Artificial Sequence
  Synthetic Polynucleotide
taatacgactcactatagggtaattccagtaaaacgttgataatttcaaaaacagaggagatttgaaatgatcaacgttaacctggcggcagcgcaaaagatg

SEQ ID NO: 50467 - DNA, 103 bp, Artificial Sequence
  Synthetic Polynucleotide
taatacgactcactatagggttgtctaattccagtaaaacgttgataattaacagaggagaaattatatgcgttttactaacctggcggcagcgcaaaagatg

SEQ ID NO: 50468 - DNA, 103 bp, Artificial Sequence
  Synthetic Polynucleotide
taatacgactcactatagggccttgttgtctaattccagtaaaacgttgaaacagaggagatcaacgatgtactggaataacctggcggcagcgcaaaagatg

SEQ ID NO: 50469 - DNA, 103 bp, Artificial Sequence
  Synthetic Polynucleotide
taatacgactcactatagggaggtgccttgttgtctaattccagtaaaacaacagaggagagttttaatggaattagacaacctggcggcagcgcaaaagatg

SEQ ID NO: 50470 - DNA, 103 bp, Artificial Sequence
  Synthetic Polynucleotide
taatacgactcactatagggtaaagttcagattcattatacgcccagattaacagaggagaaatctgatggtataatgaaacctggcggcagcgcaaaagatg

SEQ ID NO: 50471 - DNA, 103 bp, Artificial Sequence
  Synthetic Polynucleotide
taatacgactcactatagggtttataggtgccttgttgtctaattccagtaacagaggagaactggaatgagacaacaaaacctggcggcagcgcaaaagatg

SEQ ID NO: 50472 - DNA, 103 bp, Artificial Sequence
  Synthetic Polynucleotide
taatacgactcactatagggcccaatttataggtgccttgttgtctaattaacagaggagaaattagatgacaaggcacaacctggcggcagcgcaaaagatg

SEQ ID NO: 50473 - DNA, 103 bp, Artificial Sequence
  Synthetic Polynucleotide
taatacgactcactatagggttgagcccaatttataggtgccttgttgtcaacagaggagagacaacatggcacctataaacctggcggcagcgcaaaagatg

SEQ ID NO: 50474 - DNA, 103 bp, Artificial Sequence
  Synthetic Polynucleotide
taatacgactcactatagggaacccttgagcccaatttataggtgccttgaacagaggagacaaggcatgtataaattgaacctggcggcagcgcaaaagatg

SEQ ID NO: 50475 - DNA, 103 bp, Artificial Sequence
  Synthetic Polynucleotide
taatacgactcactatagggaaataaacccttgagcccaatttataggtgaacagaggagacacctaatgattgggctcaacctggcggcagcgcaaaagatg

SEQ ID NO: 50476 - DNA, 103 bp, Artificial Sequence
  Synthetic Polynucleotide
taatacgactcactatagggttaataaataaacccttgagcccaatttataacagaggagaataaatatggctcaagggaacctggcggcagcgcaaaagatg

SEQ ID NO: 50477 - DNA, 103 bp, Artificial Sequence
  Synthetic Polynucleotide
taatacgactcactatagggaagcattaataaataaacccttgagcccaaaacagaggagattgggcatgagggtttataacctggcggcagcgcaaaagatg

SEQ ID NO: 50478 - DNA, 103 bp, Artificial Sequence
  Synthetic Polynucleotide
taatacgactcactatagggcactaaagcattaataaataaacccttgagaacagaggagactcaagatgttatttattaacctggcggcagcgcaaaagatg

SEQ ID NO: 50479 - DNA, 103 bp, Artificial Sequence
  Synthetic Polynucleotide
taatacgactcactatagggaatttcactaaagcattaataaataaacccaacagaggagagggtttatgtattaatgcaacctggcggcagcgcaaaagatg

SEQ ID NO: 50480 - DNA, 103 bp, Artificial Sequence
  Synthetic Polynucleotide
taatacgactcactataggggttaaaatttcactaaagcattaataaataaacagaggagatatttaatgatgctttagaacctggcggcagcgcaaaagatg

SEQ ID NO: 50481 - DNA, 103 bp, Artificial Sequence
  Synthetic Polynucleotide
taatacgactcactataggggaaattaaagttcagattcattatacgcccaacagaggagagggcgtatgatgaatctgaacctggcggcagcgcaaaagatg

SEQ ID NO: 50482 - DNA, 103 bp, Artificial Sequence
  Synthetic Polynucleotide
taatacgactcactatagggcacaagttaaaatttcactaaagcattaataacagaggagaattaatatgttagtgaaaaacctggcggcagcgcaaaagatg

SEQ ID NO: 50483 - DNA, 103 bp, Artificial Sequence
  Synthetic Polynucleotide
taatacgactcactatagggtagaacacaagttaaaatttcactaaagcaaacagaggagatgctttatggaaattttaaacctggcggcagcgcaaaagatg

SEQ ID NO: 50484 - DNA, 103 bp, Artificial Sequence
  Synthetic Polynucleotide
taatacgactcactatagggccatttagaacacaagttaaaatttcactaaacagaggagatagtgaatgtttaacttgaacctggcggcagcgcaaaagatg

SEQ ID NO: 50485 - DNA, 103 bp, Artificial Sequence
  Synthetic Polynucleotide
taatacgactcactatagggcgcatccatttagaacacaagttaaaatttaacagaggagaaaatttatgcttgtgttcaacctggcggcagcgcaaaagatg

SEQ ID NO: 50486 - DNA, 103 bp, Artificial Sequence
  Synthetic Polynucleotide
taatacgactcactatagggataaccgcatccatttagaacacaagttaaaacagaggagattaactatggttctaaataacctggcggcagcgcaaaagatg

SEQ ID NO: 50487 - DNA, 103 bp, Artificial Sequence
  Synthetic Polynucleotide
taatacgactcactatagggctctaataaccgcatccatttagaacacaaaacagaggagattgtgtatgaaatggatgaacctggcggcagcgcaaaagatg

SEQ ID NO: 50488 - DNA, 103 bp, Artificial Sequence
  Synthetic Polynucleotide
taatacgactcactatagggattacctctaataaccgcatccatttagaaaacagaggagattctaaatggatgcggttaacctggcggcagcgcaaaagatg

SEQ ID NO: 50489 - DNA, 103 bp, Artificial Sequence
  Synthetic Polynucleotide
taatacgactcactatagggacatcattacctctaataaccgcatccattaacagaggagaaatggaatgggttattagaacctggcggcagcgcaaaagatg

SEQ ID NO: 50490 - DNA, 103 bp, Artificial Sequence
  Synthetic Polynucleotide
taatacgactcactatagggagataacatcattacctctaataaccgcataacagaggagaatgcggatgttagaggtaaacctggcggcagcgcaaaagatg

SEQ ID NO: 50491 - DNA, 103 bp, Artificial Sequence
  Synthetic Polynucleotide
taatacgactcactatagggaacaaagataacatcattacctctaataacaacagaggagagttattatgggtaatgataacctggcggcagcgcaaaagatg

SEQ ID NO: 50492 - DNA, 103 bp, Artificial Sequence
  Synthetic Polynucleotide
taatacgactcactatagggtacaagaaattaaagttcagattcattataaacagaggagatataatatgtctgaacttaacctggcggcagcgcaaaagatg

SEQ ID NO: 50493 - DNA, 103 bp, Artificial Sequence
  Synthetic Polynucleotide
taatacgactcactatagggttaagaacaaagataacatcattacctctaaacagaggagatagaggatgtgatgttataacctggcggcagcgcaaaagatg

SEQ ID NO: 50494 - DNA, 103 bp, Artificial Sequence
  Synthetic Polynucleotide
taatacgactcactatagggtagtcttaagaacaaagataacatcattacaacagaggagagtaatgatgttatctttgaacctggcggcagcgcaaaagatg

SEQ ID NO: 50495 - DNA, 103 bp, Artificial Sequence
  Synthetic Polynucleotide
taatacgactcactatagggacctatagtcttaagaacaaagataacatcaacagaggagagatgttatgtttgttcttaacctggcggcagcgcaaaagatg

SEQ ID NO: 50496 - DNA, 103 bp, Artificial Sequence
  Synthetic Polynucleotide
taatacgactcactataggggggacacctatagtcttaagaacaaagataaacagaggagatatcttatgtcttaagacaacctggcggcagcgcaaaagatg

SEQ ID NO: 50497 - DNA, 103 bp, Artificial Sequence
  Synthetic Polynucleotide
taatacgactcactatagggctgacgggacacctatagtcttaagaacaaaacagaggagattgttcatgagactatagaacctggcggcagcgcaaaagatg

SEQ ID NO: 50498 - DNA, 103 bp, Artificial Sequence
  Synthetic Polynucleotide
taatacgactcactataggggcatactgacgggacacctatagtcttaagaacagaggagacttaagatgataggtgtcaacctggcggcagcgcaaaagatg

SEQ ID NO: 50499 - DNA, 103 bp, Artificial Sequence
  Synthetic Polynucleotide
taatacgactcactatagggtgtctgcatactgacgggacacctatagtcaacagaggagagactatatgtgtcccgtcaacctggcggcagcgcaaaagatg

SEQ ID NO: 50500 - DNA, 103 bp, Artificial Sequence
  Synthetic Polynucleotide
taatacgactcactatagggcattttgtctgcatactgacgggacacctaaacagaggagataggtgatgcgtcagtataacctggcggcagcgcaaaagatg

SEQ ID NO: 50501 - DNA, 103 bp, Artificial Sequence
  Synthetic Polynucleotide
taatacgactcactatagggatcttcattttgtctgcatactgacgggacaacagaggagagtcccgatggtatgcagaaacctggcggcagcgcaaaagatg

SEQ ID NO: 50502 - DNA, 103 bp, Artificial Sequence
  Synthetic Polynucleotide
taatacgactcactatagggcttggatcttcattttgtctgcatactgacaacagaggagagtcagtatgcagacaaaaaacctggcggcagcgcaaaagatg

SEQ ID NO: 50503 - DNA, 103 bp, Artificial Sequence
  Synthetic Polynucleotide
taatacgactcactatagggatgattacaagaaattaaagttcagattcaaacagaggagatgaatcatgactttaattaacctggcggcagcgcaaaagatg

SEQ ID NO: 50504 - DNA, 103 bp, Artificial Sequence
  Synthetic Polynucleotide
taatacgactcactatagggcaaatcttggatcttcattttgtctgcataaacagaggagatatgcaatgaaaatgaagaacctggcggcagcgcaaaagatg

SEQ ID NO: 50505 - DNA, 103 bp, Artificial Sequence
  Synthetic Polynucleotide
taatacgactcactatagggttctacaaatcttggatcttcattttgtctaacagaggagaagacaaatggaagatccaaacctggcggcagcgcaaaagatg

SEQ ID NO: 50506 - DNA, 103 bp, Artificial Sequence
  Synthetic Polynucleotide
taatacgactcactatagggaatgcttctacaaatcttggatcttcatttaacagaggagaaaatgaatgtccaagattaacctggcggcagcgcaaaagatg

SEQ ID NO: 50507 - DNA, 103 bp, Artificial Sequence
  Synthetic Polynucleotide
taatacgactcactatagggatttaaatgcttctacaaatcttggatcttaacagaggagaaagatcatggatttgtagaacctggcggcagcgcaaaagatg

SEQ ID NO: 50508 - DNA, 103 bp, Artificial Sequence
  Synthetic Polynucleotide
taatacgactcactataggggtcgcatttaaatgcttctacaaatcttggaacagaggagaccaagaatggtagaagcaaacctggcggcagcgcaaaagatg

SEQ ID NO: 50509 - DNA, 103 bp, Artificial Sequence
  Synthetic Polynucleotide
taatacgactcactatagggaactcgtcgcatttaaatgcttctacaaataacagaggagaatttgtatgagcatttaaaacctggcggcagcgcaaaagatg

SEQ ID NO: 50510 - DNA, 103 bp, Artificial Sequence
  Synthetic Polynucleotide
taatacgactcactatagggtttctaactcgtcgcatttaaatgcttctaaacagaggagatagaagatgttaaatgcgaacctggcggcagcgcaaaagatg

SEQ ID NO: 50511 - DNA, 103 bp, Artificial Sequence
  Synthetic Polynucleotide
taatacgactcactatagggatatctttctaactcgtcgcatttaaatgcaacagaggagagcatttatgtgcgacgagaacctggcggcagcgcaaaagatg

SEQ ID NO: 50512 - DNA, 103 bp, Artificial Sequence
  Synthetic Polynucleotide
taatacgactcactatagggttaatatatctttctaactcgtcgcatttaaacagaggagataaatgatgcgagttagaaacctggcggcagcgcaaaagatg

SEQ ID NO: 50513 - DNA, 103 bp, Artificial Sequence
  Synthetic Polynucleotide
taatacgactcactatagggtattcttaatatatctttctaactcgtcgcaacagaggagagcgacgatgtagaaagataacctggcggcagcgcaaaagatg

SEQ ID NO: 50514 - DNA, 103 bp, Artificial Sequence
  Synthetic Polynucleotide
taatacgactcactatagggttcgaatgattacaagaaattaaagttcagaacagaggagactgaacatgaatttcttgaacctggcggcagcgcaaaagatg

SEQ ID NO: 50515 - DNA, 103 bp, Artificial Sequence
  Synthetic Polynucleotide
taatacgactcactatagggtggattattcttaatatatctttctaactcaacagaggagagagttaatgagatatattaacctggcggcagcgcaaaagatg

SEQ ID NO: 50516 - DNA, 103 bp, Artificial Sequence
  Synthetic Polynucleotide
taatacgactcactatagggcattctggattattcttaatatatctttctaacagaggagaagaaagatgtattaagaaaacctggcggcagcgcaaaagatg

SEQ ID NO: 50517 - DNA, 103 bp, Artificial Sequence
  Synthetic Polynucleotide
taatacgactcactataggggtgtacattctggattattcttaatatatcaacagaggagagatataatgagaataatcaacctggcggcagcgcaaaagatg

SEQ ID NO: 50518 - DNA, 103 bp, Artificial Sequence
  Synthetic Polynucleotide
taatacgactcactataggggaatagtgtacattctggattattcttaataacagaggagaattaagatgaatccagaaaacctggcggcagcgcaaaagatg

SEQ ID NO: 50519 - DNA, 103 bp, Artificial Sequence
  Synthetic Polynucleotide
taatacgactcactatagggctttcgaatagtgtacattctggattattcaacagaggagagaataaatgagaatgtacaacctggcggcagcgcaaaagatg

SEQ ID NO: 50520 - DNA, 103 bp, Artificial Sequence
  Synthetic Polynucleotide
taatacgactcactatagggtaagactttcgaatagtgtacattctggataacagaggagaatccagatggtacactataacctggcggcagcgcaaaagatg

SEQ ID NO: 50521 - DNA, 103 bp, Artificial Sequence
  Synthetic Polynucleotide
taatacgactcactatagggatccctaagactttcgaatagtgtacattcaacagaggagagaatgtatgctattcgaaaacctggcggcagcgcaaaagatg

SEQ ID NO: 50522 - DNA, 103 bp, Artificial Sequence
  Synthetic Polynucleotide
taatacgactcactatagggtcctcatccctaagactttcgaatagtgtaaacagaggagatacactatgcgaaagtctaacctggcggcagcgcaaaagatg

SEQ ID NO: 50523 - DNA, 103 bp, Artificial Sequence
  Synthetic Polynucleotide
taatacgactcactatagggatgcttcctcatccctaagactttcgaataaacagaggagatattcgatggtcttagggaacctggcggcagcgcaaaagatg

SEQ ID NO: 50524 - DNA, 103 bp, Artificial Sequence
  Synthetic Polynucleotide
taatacgactcactatagggagaatatgcttcctcatccctaagactttcaacagaggagagaaagtatgagggatgagaacctggcggcagcgcaaaagatg

SEQ ID NO: 50525 - DNA, 103 bp, Artificial Sequence
  Synthetic Polynucleotide
taatacgactcactatagggattatttcgaatgattacaagaaattaaagaacagaggagactttaaatgcttgtaatcaacctggcggcagcgcaaaagatg

SEQ ID NO: 50526 - DNA, 103 bp, Artificial Sequence
  Synthetic Polynucleotide
taatacgactcactatagggactatagaatatgcttcctcatccctaagaaacagaggagatcttagatgtgaggaagcaacctggcggcagcgcaaaagatg

SEQ ID NO: 50527 - DNA, 103 bp, Artificial Sequence
  Synthetic Polynucleotide
taatacgactcactatagggttctgactatagaatatgcttcctcatcccaacagaggagagggatgatgaagcatattaacctggcggcagcgcaaaagatg

SEQ ID NO: 50528 - DNA, 103 bp, Artificial Sequence
  Synthetic Polynucleotide
taatacgactcactataggggaaaattctgactatagaatatgcttcctcaacagaggagagaggaaatgtattctataaacctggcggcagcgcaaaagatg

SEQ ID NO: 50529 - DNA, 103 bp, Artificial Sequence
  Synthetic Polynucleotide
taatacgactcactatagggtccatgaaaattctgactatagaatatgctaacagaggagaagcataatgtatagtcagaacctggcggcagcgcaaaagatg

SEQ ID NO: 50530 - DNA, 103 bp, Artificial Sequence
  Synthetic Polynucleotide
taatacgactcactatagggctacatccatgaaaattctgactatagaataacagaggagaattctaatgtcagaatttaacctggcggcagcgcaaaagatg

SEQ ID NO: 50531 - DNA, 103 bp, Artificial Sequence
  Synthetic Polynucleotide
taatacgactcactatagggtaaatctacatccatgaaaattctgactataacagaggagaatagtcatgattttcatgaacctggcggcagcgcaaaagatg

SEQ ID NO: 50532 - DNA, 103 bp, Artificial Sequence
  Synthetic Polynucleotide
taatacgactcactataggggcgtctaaatctacatccatgaaaattctgaacagaggagacagaatatgcatggatgtaacctggcggcagcgcaaaagatg

SEQ ID NO: 50533 - DNA, 103 bp, Artificial Sequence
  Synthetic Polynucleotide
taatacgactcactataggggacacgcgtctaaatctacatccatgaaaaaacagaggagattttcaatgatgtagattaacctggcggcagcgcaaaagatg

SEQ ID NO: 50534 - DNA, 103 bp, Artificial Sequence
  Synthetic Polynucleotide
taatacgactcactataggggtctagacacgcgtctaaatctacatccataacagaggagaatggatatggatttagacaacctggcggcagcgcaaaagatg

SEQ ID NO: 50535 - DNA, 103 bp, Artificial Sequence
  Synthetic Polynucleotide
taatacgactcactatagggatttcgtctagacacgcgtctaaatctacaaacagaggagatgtagaatgagacgcgtgaacctggcggcagcgcaaaagatg

SEQ ID NO: 50536 - DNA, 103 bp, Artificial Sequence
  Synthetic Polynucleotide
taatacgactcactatagggtaaaaattatttcgaatgattacaagaaataacagaggagaatttctatgaatcattcgaacctggcggcagcgcaaaagatg

SEQ ID NO: 50537 - DNA, 103 bp, Artificial Sequence
  Synthetic Polynucleotide
taatacgactcactatagggaatctatttcgtctagacacgcgtctaaataacagaggagaatttagatgcgtgtctagaacctggcggcagcgcaaaagatg

SEQ ID NO: 50538 - DNA, 103 bp, Artificial Sequence
  Synthetic Polynucleotide
taatacgactcactatagggtaaataatctatttcgtctagacacgcgtcaacagaggagagacgcgatgctagacgaaaacctggcggcagcgcaaaagatg

SEQ ID NO: 50539 - DNA, 103 bp, Artificial Sequence
  Synthetic Polynucleotide
taatacgactcactataggggctgttaaataatctatttcgtctagacacaacagaggagagtgtctatgcgaaatagaaacctggcggcagcgcaaaagatg

SEQ ID NO: 50540 - DNA, 103 bp, Artificial Sequence
  Synthetic Polynucleotide
taatacgactcactataggggaatagctgttaaataatctatttcgtctaaacagaggagatagacgatgtagattattaacctggcggcagcgcaaaagatg

SEQ ID NO: 50541 - DNA, 103 bp, Artificial Sequence
  Synthetic Polynucleotide
taatacgactcactatagggatcttgaatagctgttaaataatctatttcaacagaggagagaaataatgtatttaacaaacctggcggcagcgcaaaagatg

SEQ ID NO: 50542 - DNA, 103 bp, Artificial Sequence
  Synthetic Polynucleotide
taatacgactcactatagggataaaatcttgaatagctgttaaataatctaacagaggagaagattaatgaacagctataacctggcggcagcgcaaaagatg

SEQ ID NO: 50543 - DNA, 103 bp, Artificial Sequence
  Synthetic Polynucleotide
taatacgactcactatagggcgataataaaatcttgaatagctgttaaataacagaggagaatttaaatgctattcaagaacctggcggcagcgcaaaagatg

SEQ ID NO: 50544 - DNA, 103 bp, Artificial Sequence
  Synthetic Polynucleotide
taatacgactcactatagggcacctcgataataaaatcttgaatagctgtaacagaggagaacagctatgcaagattttaacctggcggcagcgcaaaagatg

SEQ ID NO: 50545 - DNA, 103 bp, Artificial Sequence
  Synthetic Polynucleotide
taatacgactcactatagggtttgacacctcgataataaaatcttgaataaacagaggagatattcaatgttttattataacctggcggcagcgcaaaagatg

SEQ ID NO: 50546 - DNA, 103 bp, Artificial Sequence
  Synthetic Polynucleotide
taatacgactcactatagggcacagtttgacacctcgataataaaatcttaacagaggagaaagattatgttatcgaggaacctggcggcagcgcaaaagatg

SEQ ID NO: 50547 - DNA, 103 bp, Artificial Sequence
  Synthetic Polynucleotide
taatacgactcactatagggcaaactaaaaattatttcgaatgattacaaaacagaggagattgtaaatgttcgaaataaacctggcggcagcgcaaaagatg

SEQ ID NO: 50548 - DNA, 103 bp, Artificial Sequence
  Synthetic Polynucleotide
taatacgactcactatagggagctacacagtttgacacctcgataataaaaacagaggagatttattatggaggtgtcaaacctggcggcagcgcaaaagatg

SEQ ID NO: 50549 - DNA, 103 bp, Artificial Sequence
  Synthetic Polynucleotide
taatacgactcactatagggaatctagctacacagtttgacacctcgataaacagaggagatatcgaatggtcaaactgaacctggcggcagcgcaaaagatg

SEQ ID NO: 50550 - DNA, 103 bp, Artificial Sequence
  Synthetic Polynucleotide
taatacgactcactatagggacgcgaatctagctacacagtttgacacctaacagaggagaaggtgtatgactgtgtagaacctggcggcagcgcaaaagatg

SEQ ID NO: 50551 - DNA, 103 bp, Artificial Sequence
  Synthetic Polynucleotide
taatacgactcactatagggtgtaaacgcgaatctagctacacagtttgaaacagaggagatcaaacatggtagctagaaacctggcggcagcgcaaaagatg

SEQ ID NO: 50552 - DNA, 103 bp, Artificial Sequence
  Synthetic Polynucleotide
taatacgactcactatagggcattctgtaaacgcgaatctagctacacagaacagaggagactgtgtatgtagattcgcaacctggcggcagcgcaaaagatg

SEQ ID NO: 50553 - DNA, 103 bp, Artificial Sequence
  Synthetic Polynucleotide
taatacgactcactatagggcaccgcattctgtaaacgcgaatctagctaaacagaggagatagctaatgtcgcgtttaaacctggcggcagcgcaaaagatg

SEQ ID NO: 50554 - DNA, 103 bp, Artificial Sequence
  Synthetic Polynucleotide
taatacgactcactatagggaatggcaccgcattctgtaaacgcgaatctaacagaggagaagattcatgtttacagaaaacctggcggcagcgcaaaagatg

SEQ ID NO: 50555 - DNA, 103 bp, Artificial Sequence
  Synthetic Polynucleotide
taatacgactcactatagggtcatgaatggcaccgcattctgtaaacgcgaacagaggagacgcgttatgagaatgcggaacctggcggcagcgcaaaagatg

SEQ ID NO: 50556 - DNA, 103 bp, Artificial Sequence
  Synthetic Polynucleotide
taatacgactcactatagggcattttcatgaatggcaccgcattctgtaaaacagaggagattacagatggcggtgccaaacctggcggcagcgcaaaagatg

SEQ ID NO: 50557 - DNA, 103 bp, Artificial Sequence
  Synthetic Polynucleotide
taatacgactcactatagggtattacattttcatgaatggcaccgcattcaacagaggagagaatgcatggccattcataacctggcggcagcgcaaaagatg

SEQ ID NO: 50558 - DNA, 103 bp, Artificial Sequence
  Synthetic Polynucleotide
taatacgactcactatagggggatgcaaactaaaaattatttcgaatgataacagaggagaatcattatgaataattttaacctggcggcagcgcaaaagatg

SEQ ID NO: 50559 - DNA, 103 bp, Artificial Sequence
  Synthetic Polynucleotide
taatacgactcactataggggattttattacattttcatgaatggcaccgaacagaggagacggtgcatgtcatgaaaaaacctggcggcagcgcaaaagatg

SEQ ID NO: 50560 - DNA, 103 bp, Artificial Sequence
  Synthetic Polynucleotide
taatacgactcactatagggtcatggattttattacattttcatgaatggaacagaggagaccattcatgaaaatgtaaaacctggcggcagcgcaaaagatg

SEQ ID NO: 50561 - DNA, 103 bp, Artificial Sequence
  Synthetic Polynucleotide
taatacgactcactatagggagatctcatggattttattacattttcatgaacagaggagacatgaaatggtaataaaaaacctggcggcagcgcaaaagatg

SEQ ID NO: 50562 - DNA, 103 bp, Artificial Sequence
  Synthetic Polynucleotide
taatacgactcactatagggaaattagatctcatggattttattacatttaacagaggagaaaatgtatgaaaatccataacctggcggcagcgcaaaagatg

SEQ ID NO: 50563 - DNA, 103 bp, Artificial Sequence
  Synthetic Polynucleotide
taatacgactcactatagggatgaaaaattagatctcatggattttattaaacagaggagataataaatgccatgagataacctggcggcagcgcaaaagatg

SEQ ID NO: 50564 - DNA, 103 bp, Artificial Sequence
  Synthetic Polynucleotide
taatacgactcactatagggagttaatgaaaaattagatctcatggatttaacagaggagaaaatccatgagatctaataacctggcggcagcgcaaaagatg

SEQ ID NO: 50565 - DNA, 103 bp, Artificial Sequence
  Synthetic Polynucleotide
taatacgactcactataggggacttagttaatgaaaaattagatctcatgaacagaggagacatgagatgtaatttttcaacctggcggcagcgcaaaagatg

SEQ ID NO: 50566 - DNA, 103 bp, Artificial Sequence
  Synthetic Polynucleotide
taatacgactcactatagggttgtagacttagttaatgaaaaattagatcaacagaggagagatctaatgtttcattaaaacctggcggcagcgcaaaagatg

SEQ ID NO: 50567 - DNA, 103 bp, Artificial Sequence
  Synthetic Polynucleotide
taatacgactcactatagggtctatttgtagacttagttaatgaaaaattaacagaggagaaattttatgttaactaagaacctggcggcagcgcaaaagatg

SEQ ID NO: 50568 - DNA, 103 bp, Artificial Sequence
  Synthetic Polynucleotide
taatacgactcactatagggttatctctatttgtagacttagttaatgaaaacagaggagattcattatgtaagtctacaacctggcggcagcgcaaaagatg

SEQ ID NO: 50569 - DNA, 103 bp, Artificial Sequence
  Synthetic Polynucleotide
taatacgactcactatagggaggacgagataagacactctcattcctcataacagaggagaatgaggatggagagtgtcaacctggcggcagcgcaaaagatg

SEQ ID NO: 50570 - DNA, 103 bp, Artificial Sequence
  Synthetic Polynucleotide
taatacgactcactatagggactacggatgcaaactaaaaattatttcgaaacagaggagatcgaaaatgtttttagttaacctggcggcagcgcaaaagatg

SEQ ID NO: 50571 - DNA, 103 bp, Artificial Sequence
  Synthetic Polynucleotide
taatacgactcactatagggttgttttatctctatttgtagacttagttaaacagaggagataactaatgctacaaataaacctggcggcagcgcaaaagatg

SEQ ID NO: 50572 - DNA, 103 bp, Artificial Sequence
  Synthetic Polynucleotide
taatacgactcactatagggaaaacttgttttatctctatttgtagacttaacagaggagaaagtctatgaatagagataacctggcggcagcgcaaaagatg

SEQ ID NO: 50573 - DNA, 103 bp, Artificial Sequence
  Synthetic Polynucleotide
taatacgactcactatagggatatgaaaacttgttttatctctatttgtaaacagaggagatacaaaatgagataaaacaacctggcggcagcgcaaaagatg

SEQ ID NO: 50574 - DNA, 103 bp, Artificial Sequence
  Synthetic Polynucleotide
taatacgactcactatagggagatgatatgaaaacttgttttatctctataacagaggagaatagagatgaaacaagttaacctggcggcagcgcaaaagatg

SEQ ID NO: 50575 - DNA, 103 bp, Artificial Sequence
  Synthetic Polynucleotide
taatacgactcactatagggtaaaaagatgatatgaaaacttgttttatcaacagaggagagataaaatgagttttcataacctggcggcagcgcaaaagatg

SEQ ID NO: 50576 - DNA, 103 bp, Artificial Sequence
  Synthetic Polynucleotide
taatacgactcactataggggtatctaaaaagatgatatgaaaacttgttaacagaggagaaacaagatgtcatatcataacctggcggcagcgcaaaagatg

SEQ ID NO: 50577 - DNA, 103 bp, Artificial Sequence
  Synthetic Polynucleotide
taatacgactcactatagggtatacgtatctaaaaagatgatatgaaaacaacagaggagagttttcatgtcatcttttaacctggcggcagcgcaaaagatg

SEQ ID NO: 50578 - DNA, 103 bp, Artificial Sequence
  Synthetic Polynucleotide
taatacgactcactatagggagtggtatacgtatctaaaaagatgatatgaacagaggagacatatcatgtttttagataacctggcggcagcgcaaaagatg

SEQ ID NO: 50579 - DNA, 103 bp, Artificial Sequence
  Synthetic Polynucleotide
taatacgactcactatagggtccatagtggtatacgtatctaaaaagatgaacagaggagacatcttatgagatacgtaaacctggcggcagcgcaaaagatg

SEQ ID NO: 50580 - DNA, 103 bp, Artificial Sequence
  Synthetic Polynucleotide
taatacgactcactatagggaggtatccatagtggtatacgtatctaaaaaacagaggagattttagatgcgtataccaaacctggcggcagcgcaaaagatg

SEQ ID NO: 50581 - DNA, 103 bp, Artificial Sequence
  Synthetic Polynucleotide
taatacgactcactatagggagataactacggatgcaaactaaaaattataacagaggagaataattatgagtttgcataacctggcggcagcgcaaaagatg

SEQ ID NO: 50582 - DNA, 103 bp, Artificial Sequence
  Synthetic Polynucleotide
taatacgactcactatagggtatcaaggtatccatagtggtatacgtatcaacagaggagagatacgatgaccactatgaacctggcggcagcgcaaaagatg

SEQ ID NO: 50583 - DNA, 103 bp, Artificial Sequence
  Synthetic Polynucleotide
taatacgactcactatagggatggctatcaaggtatccatagtggtatacaacagaggagagtatacatgtatggatacaacctggcggcagcgcaaaagatg

SEQ ID NO: 50584 - DNA, 103 bp, Artificial Sequence
  Synthetic Polynucleotide
taatacgactcactataggggtttcatggctatcaaggtatccatagtggaacagaggagaccactaatgataccttgaaacctggcggcagcgcaaaagatg

SEQ ID NO: 50585 - DNA, 103 bp, Artificial Sequence
  Synthetic Polynucleotide
taatacgactcactatagggtgttcgtttcatggctatcaaggtatccataacagaggagaatggatatgttgatagccaacctggcggcagcgcaaaagatg

SEQ ID NO: 50586 - DNA, 103 bp, Artificial Sequence
  Synthetic Polynucleotide
taatacgactcactatagggaatagtgttcgtttcatggctatcaaggtaaacagaggagataccttatgagccatgaaaacctggcggcagcgcaaaagatg

SEQ ID NO: 50587 - DNA, 103 bp, Artificial Sequence
  Synthetic Polynucleotide
taatacgactcactatagggattctaatagtgttcgtttcatggctatcaaacagaggagatgatagatgtgaaacgaaaacctggcggcagcgcaaaagatg

SEQ ID NO: 50588 - DNA, 103 bp, Artificial Sequence
  Synthetic Polynucleotide
taatacgactcactatagggacttaattctaatagtgttcgtttcatggcaacagaggagagccatgatgcgaacactaaacctggcggcagcgcaaaagatg

SEQ ID NO: 50589 - DNA, 103 bp, Artificial Sequence
  Synthetic Polynucleotide
taatacgactcactataggggatctacttaattctaatagtgttcgtttcaacagaggagagaaacgatgactattagaaacctggcggcagcgcaaaagatg

SEQ ID NO: 50590 - DNA, 103 bp, Artificial Sequence
  Synthetic Polynucleotide
taatacgactcactatagggcagatgatctacttaattctaatagtgttcaacagaggagagaacacatgtagaattaaaacctggcggcagcgcaaaagatg

SEQ ID NO: 50591 - DNA, 103 bp, Artificial Sequence
  Synthetic Polynucleotide
taatacgactcactatagggattttcagatgatctacttaattctaatagaacagaggagactattaatgttaagtagaaacctggcggcagcgcaaaagatg

SEQ ID NO: 50592 - DNA, 103 bp, Artificial Sequence
  Synthetic Polynucleotide
taatacgactcactatagggagaggagataactacggatgcaaactaaaaaacagaggagattttagatggcatccgtaaacctggcggcagcgcaaaagatg

SEQ ID NO: 50593 - DNA, 103 bp, Artificial Sequence
  Synthetic Polynucleotide
taatacgactcactatagggagtggattttcagatgatctacttaattctaacagaggagaagaattatgtagatcatcaacctggcggcagcgcaaaagatg

SEQ ID NO: 50594 - DNA, 103 bp, Artificial Sequence
  Synthetic Polynucleotide
taatacgactcactatagggttgttagtggattttcagatgatctacttaaacagaggagataagtaatgcatctgaaaaacctggcggcagcgcaaaagatg

SEQ ID NO: 50595 - DNA, 103 bp, Artificial Sequence
  Synthetic Polynucleotide
taatacgactcactatagggcgatcttgttagtggattttcagatgatctaacagaggagaagatcaatggaaaatccaaacctggcggcagcgcaaaagatg

SEQ ID NO: 50596 - DNA, 103 bp, Artificial Sequence
  Synthetic Polynucleotide
taatacgactcactatagggtctatcgatcttgttagtggattttcagataacagaggagaatctgaatgtccactaacaacctggcggcagcgcaaaagatg

SEQ ID NO: 50597 - DNA, 103 bp, Artificial Sequence
  Synthetic Polynucleotide
taatacgactcactatagggcagtgtctatcgatcttgttagtggattttaacagaggagaaaaatcatgtaacaagataacctggcggcagcgcaaaagatg

SEQ ID NO: 50598 - DNA, 103 bp, Artificial Sequence
  Synthetic Polynucleotide
taatacgactcactatagggtacggcagtgtctatcgatcttgttagtggaacagaggagaccactaatgagatcgataaacctggcggcagcgcaaaagatg

SEQ ID NO: 50599 - DNA, 103 bp, Artificial Sequence
  Synthetic Polynucleotide
taatacgactcactatagggctatatacggcagtgtctatcgatcttgttaacagaggagaaacaagatggatagacacaacctggcggcagcgcaaaagatg

SEQ ID NO: 50600 - DNA, 103 bp, Artificial Sequence
  Synthetic Polynucleotide
taatacgactcactatagggttttcctatatacggcagtgtctatcgatcaacagaggagagatcgaatgacactgccgaacctggcggcagcgcaaaagatg

SEQ ID NO: 50601 - DNA, 103 bp, Artificial Sequence
  Synthetic Polynucleotide
taatacgactcactatagggtgtttttttcctatatacggcagtgtctataacagaggagaatagacatggccgtatataacctggcggcagcgcaaaagatg

SEQ ID NO: 50602 - DNA, 103 bp, Artificial Sequence
  Synthetic Polynucleotide
taatacgactcactatagggagagttgtttttttcctatatacggcagtgaacagaggagacactgcatgatataggaaaacctggcggcagcgcaaaagatg

SEQ ID NO: 50603 - DNA, 103 bp, Artificial Sequence
  Synthetic Polynucleotide
taatacgactcactatagggtgcatagaggagataactacggatgcaaacaacagaggagagtttgcatgcgtagttataacctggcggcagcgcaaaagatg

SEQ ID NO: 50604 - DNA, 103 bp, Artificial Sequence
  Synthetic Polynucleotide
taatacgactcactatagggcccgaagagttgtttttttcctatatacggaacagaggagaccgtatatgggaaaaaaaaacctggcggcagcgcaaaagatg

SEQ ID NO: 50605 - DNA, 103 bp, Artificial Sequence
  Synthetic Polynucleotide
taatacgactcactatagggtacaacccgaagagttgtttttttcctataaacagaggagatataggatgaaaacaactaacctggcggcagcgcaaaagatg

SEQ ID NO: 50606 - DNA, 103 bp, Artificial Sequence
  Synthetic Polynucleotide
taatacgactcactataggggtacctacaacccgaagagttgtttttttcaacagaggagagaaaaaatgaactcttcgaacctggcggcagcgcaaaagatg

SEQ ID NO: 50607 - DNA, 103 bp, Artificial Sequence
  Synthetic Polynucleotide
taatacgactcactatagggtcctagtacctacaacccgaagagttgtttaacagaggagaaaacaaatgttcgggttgaacctggcggcagcgcaaaagatg

SEQ ID NO: 50608 - DNA, 103 bp, Artificial Sequence
  Synthetic Polynucleotide
taatacgactcactatagggatttttcctagtacctacaacccgaagagtaacagaggagaactcttatggttgtaggtaacctggcggcagcgcaaaagatg

SEQ ID NO: 50609 - DNA, 103 bp, Artificial Sequence
  Synthetic Polynucleotide
taatacgactcactatagggtttggatttttcctagtacctacaacccgaaacagaggagatcgggtatgaggtactagaacctggcggcagcgcaaaagatg

SEQ ID NO: 50610 - DNA, 103 bp, Artificial Sequence
  Synthetic Polynucleotide
taatacgactcactatagggcgcaatttggatttttcctagtacctacaaaacagaggagattgtagatgctaggaaaaaacctggcggcagcgcaaaagatg

SEQ ID NO: 50611 - DNA, 103 bp, Artificial Sequence
  Synthetic Polynucleotide
taatacgactcactatagggagtgtcgcaatttggatttttcctagtaccaacagaggagaggtactatgaaaaatccaaacctggcggcagcgcaaaagatg

SEQ ID NO: 50612 - DNA, 103 bp, Artificial Sequence
  Synthetic Polynucleotide
taatacgactcactatagggtgaatagtgtcgcaatttggatttttcctaaacagaggagataggaaatgtccaaattgaacctggcggcagcgcaaaagatg

SEQ ID NO: 50613 - DNA, 103 bp, Artificial Sequence
  Synthetic Polynucleotide
taatacgactcactatagggttacatgaatagtgtcgcaatttggattttaacagaggagaaaaatcatgattgcgacaaacctggcggcagcgcaaaagatg

SEQ ID NO: 50614 - DNA, 103 bp, Artificial Sequence
  Synthetic Polynucleotide
taatacgactcactatagggacagttgcatagaggagataactacggatgaacagaggagacatccgatgttatctcctaacctggcggcagcgcaaaagatg

SEQ ID NO: 50615 - DNA, 103 bp, Artificial Sequence
  Synthetic Polynucleotide
taatacgactcactatagggttgcattacatgaatagtgtcgcaatttggaacagaggagaccaaatatggacactattaacctggcggcagcgcaaaagatg

SEQ ID NO: 50616 - DNA, 103 bp, Artificial Sequence
  Synthetic Polynucleotide
taatacgactcactatagggggtggttgcattacatgaatagtgtcgcaaaacagaggagattgcgaatgtattcatgtaacctggcggcagcgcaaaagatg

SEQ ID NO: 50617 - DNA, 103 bp, Artificial Sequence
  Synthetic Polynucleotide
taatacgactcactatagggcatgcggtggttgcattacatgaatagtgtaacagaggagaacactaatgatgtaatgcaacctggcggcagcgcaaaagatg

SEQ ID NO: 50618 - DNA, 103 bp, Artificial Sequence
  Synthetic Polynucleotide
taatacgactcactatagggattatcatgcggtggttgcattacatgaataacagaggagaattcatatgatgcaaccaaacctggcggcagcgcaaaagatg

SEQ ID NO: 50619 - DNA, 103 bp, Artificial Sequence
  Synthetic Polynucleotide
taatacgactcactatagggtctatattatcatgcggtggttgcattacaaacagaggagatgtaatatgaccaccgcaaacctggcggcagcgcaaaagatg

SEQ ID NO: 50620 - DNA, 103 bp, Artificial Sequence
  Synthetic Polynucleotide
taatacgactcactatagggaatcttctatattatcatgcggtggttgcaaacagaggagatgcaacatgcgcatgataaacctggcggcagcgcaaaagatg

SEQ ID NO: 50621 - DNA, 103 bp, Artificial Sequence
  Synthetic Polynucleotide
taatacgactcactatagggtaggtaatcttctatattatcatgcggtggaacagaggagaccaccgatggataatataaacctggcggcagcgcaaaagatg

SEQ ID NO: 50622 - DNA, 103 bp, Artificial Sequence
  Synthetic Polynucleotide
taatacgactcactataggggtgaataggtaatcttctatattatcatgcaacagaggagagcatgaatgtatagaagaaacctggcggcagcgcaaaagatg

SEQ ID NO: 50623 - DNA, 103 bp, Artificial Sequence
  Synthetic Polynucleotide
taatacgactcactatagggcgtaagtgaataggtaatcttctatattataacagaggagaataataatgaagattaccaacctggcggcagcgcaaaagatg

SEQ ID NO: 50624 - DNA, 103 bp, Artificial Sequence
  Synthetic Polynucleotide
taatacgactcactatagggatccacgtaagtgaataggtaatcttctataacagaggagaatagaaatgtacctattcaacctggcggcagcgcaaaagatg

SEQ ID NO: 50625 - DNA, 103 bp, Artificial Sequence
  Synthetic Polynucleotide
taatacgactcactatagggaatttacagttgcatagaggagataactacaacagaggagagtagttatgtcctctatgaacctggcggcagcgcaaaagatg

SEQ ID NO: 50626 - DNA, 103 bp, Artificial Sequence
  Synthetic Polynucleotide
taatacgactcactatagggttcatatccacgtaagtgaataggtaatctaacagaggagaagattaatgattcacttaaacctggcggcagcgcaaaagatg

SEQ ID NO: 50627 - DNA, 103 bp, Artificial Sequence
  Synthetic Polynucleotide
taatacgactcactatagggtgttgttcatatccacgtaagtgaataggtaacagaggagaacctatatgcttacgtggaacctggcggcagcgcaaaagatg

SEQ ID NO: 50628 - DNA, 103 bp, Artificial Sequence
  Synthetic Polynucleotide
taatacgactcactatagggactattgttgttcatatccacgtaagtgaaaacagaggagattcactatggtggatatgaacctggcggcagcgcaaaagatg

SEQ ID NO: 50629 - DNA, 103 bp, Artificial Sequence
  Synthetic Polynucleotide
taatacgactcactatagggtaataactattgttgttcatatccacgtaaaacagaggagattacgtatgtatgaacaaaacctggcggcagcgcaaaagatg

SEQ ID NO: 50630 - DNA, 103 bp, Artificial Sequence
  Synthetic Polynucleotide
taatacgactcactatagggaaaagtaataactattgttgttcatatccaaacagaggagatggataatgacaacaataaacctggcggcagcgcaaaagatg

SEQ ID NO: 50631 - DNA, 103 bp, Artificial Sequence
  Synthetic Polynucleotide
taatacgactcactatagggtagagaaaagtaataactattgttgttcataacagaggagaatgaacatgaatagttataacctggcggcagcgcaaaagatg

SEQ ID NO: 50632 - DNA, 103 bp, Artificial Sequence
  Synthetic Polynucleotide
taatacgactcactatagggcgttgtagagaaaagtaataactattgttgaacagaggagacaacaaatgttattacttaacctggcggcagcgcaaaagatg

SEQ ID NO: 50633 - DNA, 103 bp, Artificial Sequence
  Synthetic Polynucleotide
taatacgactcactatagggatcgtcgttgtagagaaaagtaataactataacagaggagaatagttatgacttttctcaacctggcggcagcgcaaaagatg

SEQ ID NO: 50634 - DNA, 103 bp, Artificial Sequence
  Synthetic Polynucleotide
taatacgactcactatagggctccaatcgtcgttgtagagaaaagtaataaacagaggagatattacatgtctctacaaaacctggcggcagcgcaaaagatg

SEQ ID NO: 50635 - DNA, 103 bp, Artificial Sequence
  Synthetic Polynucleotide
taatacgactcactatagggaaatcctccaatcgtcgttgtagagaaaagaacagaggagacttttcatgacaacgacgaacctggcggcagcgcaaaagatg

SEQ ID NO: 50636 - DNA, 103 bp, Artificial Sequence
  Synthetic Polynucleotide
taatacgactcactatagggtgagaaatttacagttgcatagaggagataaacagaggagatatctcatgtatgcaactaacctggcggcagcgcaaaagatg

SEQ ID NO: 50637 - DNA, 103 bp, Artificial Sequence
  Synthetic Polynucleotide
taatacgactcactataggggaactaaatcctccaatcgtcgttgtagagaacagaggagactctacatggacgattggaacctggcggcagcgcaaaagatg

SEQ ID NO: 50638 - DNA, 103 bp, Artificial Sequence
  Synthetic Polynucleotide
taatacgactcactatagggatcaggaactaaatcctccaatcgtcgttgaacagaggagacaacgaatgttggaggataacctggcggcagcgcaaaagatg

SEQ ID NO: 50639 - DNA, 103 bp, Artificial Sequence
  Synthetic Polynucleotide
taatacgactcactatagggaacttatcaggaactaaatcctccaatcgtaacagaggagaacgattatgggatttagtaacctggcggcagcgcaaaagatg

SEQ ID NO: 50640 - DNA, 103 bp, Artificial Sequence
  Synthetic Polynucleotide
taatacgactcactatagggcccataacttatcaggaactaaatcctccaaacagaggagatggaggatgtagttcctgaacctggcggcagcgcaaaagatg

SEQ ID NO: 50641 - DNA, 103 bp, Artificial Sequence
  Synthetic Polynucleotide
taatacgactcactatagggtggttcccataacttatcaggaactaaatcaacagaggagagatttaatgcctgataagaacctggcggcagcgcaaaagatg

SEQ ID NO: 50642 - DNA, 103 bp, Artificial Sequence
  Synthetic Polynucleotide
taatacgactcactatagggaaccctggttcccataacttatcaggaactaacagaggagaagttccatgtaagttatgaacctggcggcagcgcaaaagatg

SEQ ID NO: 50643 - DNA, 103 bp, Artificial Sequence
  Synthetic Polynucleotide
taatacgactcactatagggaaataaaccctggttcccataacttatcagaacagaggagactgataatgtatgggaacaacctggcggcagcgcaaaagatg

SEQ ID NO: 50644 - DNA, 103 bp, Artificial Sequence
  Synthetic Polynucleotide
taatacgactcactataggggaatgaaataaaccctggttcccataacttaacagaggagaaagttaatggaaccagggaacctggcggcagcgcaaaagatg

SEQ ID NO: 50645 - DNA, 103 bp, Artificial Sequence
  Synthetic Polynucleotide
taatacgactcactatagggtcttcgaatgaaataaaccctggttcccataacagaggagaatgggaatgagggtttataacctggcggcagcgcaaaagatg

SEQ ID NO: 50646 - DNA, 103 bp, Artificial Sequence
  Synthetic Polynucleotide
taatacgactcactatagggtagcgtcttcgaatgaaataaaccctggttaacagaggagaaaccagatgttatttcataacctggcggcagcgcaaaagatg

SEQ ID NO: 50647 - DNA, 103 bp, Artificial Sequence
  Synthetic Polynucleotide
taatacgactcactatagggcgcgttgagaaatttacagttgcatagaggaacagaggagacctctaatgaactgtaaaaacctggcggcagcgcaaaagatg

SEQ ID NO: 50648 - DNA, 103 bp, Artificial Sequence
  Synthetic Polynucleotide
taatacgactcactatagggttttatagcgtcttcgaatgaaataaacccaacagaggagagggtttatgtcattcgaaaacctggcggcagcgcaaaagatg

SEQ ID NO: 50649 - DNA, 103 bp, Artificial Sequence
  Synthetic Polynucleotide
taatacgactcactatagggactctttttatagcgtcttcgaatgaaataaacagaggagatatttcatgcgaagacgcaacctggcggcagcgcaaaagatg

SEQ ID NO: 50650 - DNA, 103 bp, Artificial Sequence
  Synthetic Polynucleotide
taatacgactcactatagggttgaaactctttttatagcgtcttcgaatgaacagaggagacattcgatgacgctataaaacctggcggcagcgcaaaagatg

SEQ ID NO: 50651 - DNA, 103 bp, Artificial Sequence
  Synthetic Polynucleotide
taatacgactcactatagggtatttttgaaactctttttatagcgtcttcaacagaggagagaagacatgataaaaagaaacctggcggcagcgcaaaagatg

SEQ ID NO: 50652 - DNA, 103 bp, Artificial Sequence
  Synthetic Polynucleotide
taatacgactcactatagggatgaatatttttgaaactctttttatagcgaacagaggagacgctatatgaagagtttcaacctggcggcagcgcaaaagatg

SEQ ID NO: 50653 - DNA, 103 bp, Artificial Sequence
  Synthetic Polynucleotide
taatacgactcactatagggaattaatgaatatttttgaaactctttttaaacagaggagataaaaaatgtttcaaaaaaacctggcggcagcgcaaaagatg

SEQ ID NO: 50654 - DNA, 103 bp, Artificial Sequence
  Synthetic Polynucleotide
taatacgactcactatagggtatagaattaatgaatatttttgaaactctaacagaggagaagagttatgaaaatattcaacctggcggcagcgcaaaagatg

SEQ ID NO: 50655 - DNA, 103 bp, Artificial Sequence
  Synthetic Polynucleotide
taatacgactcactatagggtttattatagaattaatgaatatttttgaaaacagaggagattcaaaatgattcattaaaacctggcggcagcgcaaaagatg

SEQ ID NO: 50656 - DNA, 103 bp, Artificial Sequence
  Synthetic Polynucleotide
taatacgactcactatagggtaaagtttattatagaattaatgaatatttaacagaggagaaaatatatgttaattctaaacctggcggcagcgcaaaagatg

SEQ ID NO: 50657 - DNA, 103 bp, Artificial Sequence
  Synthetic Polynucleotide
taatacgactcactatagggatcattaaagtttattatagaattaatgaaaacagaggagattcattatgtctataataaacctggcggcagcgcaaaagatg

SEQ ID NO: 50658 - DNA, 103 bp, Artificial Sequence
  Synthetic Polynucleotide
taatacgactcactataggggatatcgcgttgagaaatttacagttgcataacagaggagaatgcaaatgtaaatttctaacctggcggcagcgcaaaagatg

SEQ ID NO: 50659 - DNA, 103 bp, Artificial Sequence
  Synthetic Polynucleotide
taatacgactcactatagggtcgagatcattaaagtttattatagaattaaacagaggagataattcatgaataaacttaacctggcggcagcgcaaaagatg

SEQ ID NO: 50660 - DNA, 103 bp, Artificial Sequence
  Synthetic Polynucleotide
taatacgactcactatagggtttcatcgagatcattaaagtttattatagaacagaggagactataaatgactttaatgaacctggcggcagcgcaaaagatg

SEQ ID NO: 50661 - DNA, 103 bp, Artificial Sequence
  Synthetic Polynucleotide
taatacgactcactatagggattattttcatcgagatcattaaagtttataacagaggagaataaacatgaatgatctcaacctggcggcagcgcaaaagatg

SEQ ID NO: 50662 - DNA, 103 bp, Artificial Sequence
  Synthetic Polynucleotide
taatacgactcactataggggtaaaattattttcatcgagatcattaaagaacagaggagactttaaatgtctcgatgaaacctggcggcagcgcaaaagatg

SEQ ID NO: 50663 - DNA, 103 bp, Artificial Sequence
  Synthetic Polynucleotide
taatacgactcactatagggccgtcgtaaaattattttcatcgagatcataacagaggagaatgatcatgatgaaaataaacctggcggcagcgcaaaagatg

SEQ ID NO: 50664 - DNA, 103 bp, Artificial Sequence
  Synthetic Polynucleotide
taatacgactcactatagggtggtaccgtcgtaaaattattttcatcgagaacagaggagactcgatatgaataattttaacctggcggcagcgcaaaagatg

SEQ ID NO: 50665 - DNA, 103 bp, Artificial Sequence
  Synthetic Polynucleotide
taatacgactcactatagggaccagtggtaccgtcgtaaaattattttcaaacagaggagatgaaaaatgttttacgacaacctggcggcagcgcaaaagatg

SEQ ID NO: 50666 - DNA, 103 bp, Artificial Sequence
  Synthetic Polynucleotide
taatacgactcactatagggctatgaccagtggtaccgtcgtaaaattataacagaggagaataattatgcgacggtacaacctggcggcagcgcaaaagatg

SEQ ID NO: 50667 - DNA, 103 bp, Artificial Sequence
  Synthetic Polynucleotide
taatacgactcactataggggtaatctatgaccagtggtaccgtcgtaaaaacagaggagatttacgatggtaccactgaacctggcggcagcgcaaaagatg

SEQ ID NO: 50668 - DNA, 103 bp, Artificial Sequence
  Synthetic Polynucleotide
taatacgactcactataggggttacgtaatctatgaccagtggtaccgtcaacagaggagagacggtatgactggtcataacctggcggcagcgcaaaagatg

SEQ ID NO: 50669 - DNA, 103 bp, Artificial Sequence
  Synthetic Polynucleotide
taatacgactcactatagggatggagatatcgcgttgagaaatttacagtaacagaggagaactgtaatgttctcaacgaacctggcggcagcgcaaaagatg

SEQ ID NO: 50670 - DNA, 103 bp, Artificial Sequence
  Synthetic Polynucleotide
taatacgactcactatagggaaggtgttacgtaatctatgaccagtggtaaacagaggagataccacatgtcatagattaacctggcggcagcgcaaaagatg

SEQ ID NO: 50671 - DNA, 103 bp, Artificial Sequence
  Synthetic Polynucleotide
taatacgactcactatagggtgcacaaggtgttacgtaatctatgaccagaacagaggagactggtcatggattacgtaaacctggcggcagcgcaaaagatg

SEQ ID NO: 50672 - DNA, 103 bp, Artificial Sequence
  Synthetic Polynucleotide
taatacgactcactatagggcataatgcacaaggtgttacgtaatctatgaacagaggagacatagaatgcgtaacaccaacctggcggcagcgcaaaagatg

SEQ ID NO: 50673 - DNA, 103 bp, Artificial Sequence
  Synthetic Polynucleotide
taatacgactcactatagggttttacataatgcacaaggtgttacgtaataacagaggagaattacgatgcaccttgtgaacctggcggcagcgcaaaagatg

SEQ ID NO: 50674 - DNA, 103 bp, Artificial Sequence
  Synthetic Polynucleotide
taatacgactcactatagggtcgttttttacataatgcacaaggtgttacaacagaggagagtaacaatgtgtgcattaaacctggcggcagcgcaaaagatg

SEQ ID NO: 50675 - DNA, 103 bp, Artificial Sequence
  Synthetic Polynucleotide
taatacgactcactatagggtgcgatcgttttttacataatgcacaaggtaacagaggagaaccttgatgattatgtaaaacctggcggcagcgcaaaagatg

SEQ ID NO: 50676 - DNA, 103 bp, Artificial Sequence
  Synthetic Polynucleotide
taatacgactcactataggggtttatgcgatcgttttttacataatgcacaacagaggagagtgcatatggtaaaaaacaacctggcggcagcgcaaaagatg

SEQ ID NO: 50677 - DNA, 103 bp, Artificial Sequence
  Synthetic Polynucleotide
taatacgactcactatagggcggatgtttatgcgatcgttttttacataaaacagaggagattatgtatgaaacgatcgaacctggcggcagcgcaaaagatg

SEQ ID NO: 50678 - DNA, 103 bp, Artificial Sequence
  Synthetic Polynucleotide
taatacgactcactatagggtgatgcggatgtttatgcgatcgttttttaaacagaggagataaaaaatgatcgcataaaacctggcggcagcgcaaaagatg

SEQ ID NO: 50679 - DNA, 103 bp, Artificial Sequence
  Synthetic Polynucleotide
taatacgactcactatagggatagttgatgcggatgtttatgcgatcgttaacagaggagaaacgatatgataaacatcaacctggcggcagcgcaaaagatg

SEQ ID NO: 50680 - DNA, 103 bp, Artificial Sequence
  Synthetic Polynucleotide
taatacgactcactatagggatatagatagacgaggaaacaatgtagtgcaacagaggagagcactaatgtgtttcctcaacctggcggcagcgcaaaagatg

SEQ ID NO: 50681 - DNA, 103 bp, Artificial Sequence
  Synthetic Polynucleotide
taatacgactcactatagggaaccaaggacgagataagacactctcattcaacagaggagagaatgaatgtgtcttatcaacctggcggcagcgcaaaagatg

SEQ ID NO: 50682 - DNA, 103 bp, Artificial Sequence
  Synthetic Polynucleotide
taatacgactcactatagggtattaatggagatatcgcgttgagaaatttaacagaggagaaaatttatgaacgcgataaacctggcggcagcgcaaaagatg

SEQ ID NO: 50683 - DNA, 103 bp, Artificial Sequence
  Synthetic Polynucleotide
taatacgactcactatagggcaacgatagttgatgcggatgtttatgcgaaacagaggagatcgcatatgcatccgcataacctggcggcagcgcaaaagatg

SEQ ID NO: 50684 - DNA, 103 bp, Artificial Sequence
  Synthetic Polynucleotide
taatacgactcactatagggttttccaacgatagttgatgcggatgtttaaacagaggagataaacaatggcatcaactaacctggcggcagcgcaaaagatg

SEQ ID NO: 50685 - DNA, 103 bp, Artificial Sequence
  Synthetic Polynucleotide
taatacgactcactatagggcatcattttccaacgatagttgatgcggataacagaggagaatccgcatgaactatcgtaacctggcggcagcgcaaaagatg

SEQ ID NO: 50686 - DNA, 103 bp, Artificial Sequence
  Synthetic Polynucleotide
taatacgactcactatagggaatagcatcattttccaacgatagttgatgaacagaggagacatcaaatgtcgttggaaaacctggcggcagcgcaaaagatg

SEQ ID NO: 50687 - DNA, 103 bp, Artificial Sequence
  Synthetic Polynucleotide
taatacgactcactatagggattctaatagcatcattttccaacgatagtaacagaggagaactatcatgggaaaatgaaacctggcggcagcgcaaaagatg

SEQ ID NO: 50688 - DNA, 103 bp, Artificial Sequence
  Synthetic Polynucleotide
taatacgactcactatagggtgtaaattctaatagcatcattttccaacgaacagaggagacgttggatgatgatgctaaacctggcggcagcgcaaaagatg

SEQ ID NO: 50689 - DNA, 103 bp, Artificial Sequence
  Synthetic Polynucleotide
taatacgactcactatagggagttttgtaaattctaatagcatcattttcaacagaggagagaaaatatggctattagaaacctggcggcagcgcaaaagatg

SEQ ID NO: 50690 - DNA, 103 bp, Artificial Sequence
  Synthetic Polynucleotide
taatacgactcactatagggttaccagttttgtaaattctaatagcatcaaacagaggagatgatgcatgtagaatttaaacctggcggcagcgcaaaagatg

SEQ ID NO: 50691 - DNA, 103 bp, Artificial Sequence
  Synthetic Polynucleotide
taatacgactcactataggggtggattaccagttttgtaaattctaatagaacagaggagactattaatgtttacaaaaaacctggcggcagcgcaaaagatg

SEQ ID NO: 50692 - DNA, 103 bp, Artificial Sequence
  Synthetic Polynucleotide
taatacgactcactatagggactatgtggattaccagttttgtaaattctaacagaggagaagaattatgaaaactggtaacctggcggcagcgcaaaagatg

SEQ ID NO: 50693 - DNA, 103 bp, Artificial Sequence
  Synthetic Polynucleotide
taatacgactcactatagggatcattattaatggagatatcgcgttgagaaacagaggagatctcaaatggatatctccaacctggcggcagcgcaaaagatg

SEQ ID NO: 50694 - DNA, 103 bp, Artificial Sequence
  Synthetic Polynucleotide
taatacgactcactatagggttacaactatgtggattaccagttttgtaaaacagaggagattacaaatgtggtaatccaacctggcggcagcgcaaaagatg

SEQ ID NO: 50695 - DNA, 103 bp, Artificial Sequence
  Synthetic Polynucleotide
taatacgactcactatagggtaactttacaactatgtggattaccagtttaacagaggagaaaactgatgatccacataaacctggcggcagcgcaaaagatg

SEQ ID NO: 50696 - DNA, 103 bp, Artificial Sequence
  Synthetic Polynucleotide
taatacgactcactatagggaattttaactttacaactatgtggattaccaacagaggagaggtaatatgcatagttgtaacctggcggcagcgcaaaagatg

SEQ ID NO: 50697 - DNA, 103 bp, Artificial Sequence
  Synthetic Polynucleotide
taatacgactcactatagggggaacaattttaactttacaactatgtggaaacagaggagatccacaatgttgtaaagtaacctggcggcagcgcaaaagatg

SEQ ID NO: 50698 - DNA, 103 bp, Artificial Sequence
  Synthetic Polynucleotide
taatacgactcactatagggccaacggaacaattttaactttacaactataacagaggagaatagttatgaagttaaaaaacctggcggcagcgcaaaagatg

SEQ ID NO: 50699 - DNA, 103 bp, Artificial Sequence
  Synthetic Polynucleotide
taatacgactcactatagggaccatccaacggaacaattttaactttacaaacagaggagatgtaaaatgaaaattgttaacctggcggcagcgcaaaagatg

SEQ ID NO: 50700 - DNA, 103 bp, Artificial Sequence
  Synthetic Polynucleotide
taatacgactcactatagggttattaccatccaacggaacaattttaactaacagaggagaagttaaatgtgttccgttaacctggcggcagcgcaaaagatg

SEQ ID NO: 50701 - DNA, 103 bp, Artificial Sequence
  Synthetic Polynucleotide
taatacgactcactatagggacagtttattaccatccaacggaacaatttaacagaggagaaaattgatgcgttggatgaacctggcggcagcgcaaaagatg

SEQ ID NO: 50702 - DNA, 103 bp, Artificial Sequence
  Synthetic Polynucleotide
taatacgactcactatagggattaaacagtttattaccatccaacggaacaacagaggagagttccgatggatggtaataacctggcggcagcgcaaaagatg

SEQ ID NO: 50703 - DNA, 103 bp, Artificial Sequence
  Synthetic Polynucleotide
taatacgactcactataggggcgatattaaacagtttattaccatccaacaacagaggagagttggaatgtaataaactaacctggcggcagcgcaaaagatg

SEQ ID NO: 50704 - DNA, 103 bp, Artificial Sequence
  Synthetic Polynucleotide
taatacgactcactatagggttgacatcattattaatggagatatcgcgtaacagaggagaacgcgaatgctccattaaaacctggcggcagcgcaaaagatg

SEQ ID NO: 50705 - DNA, 103 bp, Artificial Sequence
  Synthetic Polynucleotide
taatacgactcactatagggtttgtgcgatattaaacagtttattaccataacagaggagaatggtaatgaactgtttaaacctggcggcagcgcaaaagatg

SEQ ID NO: 50706 - DNA, 103 bp, Artificial Sequence
  Synthetic Polynucleotide
taatacgactcactatagggaattctttgtgcgatattaaacagtttattaacagaggagaaataaaatgtttaatatcaacctggcggcagcgcaaaagatg

SEQ ID NO: 50707 - DNA, 103 bp, Artificial Sequence
  Synthetic Polynucleotide
taatacgactcactatagggtctaaaattctttgtgcgatattaaacagtaacagaggagaactgttatgtatcgcacaaacctggcggcagcgcaaaagatg

SEQ ID NO: 50708 - DNA, 103 bp, Artificial Sequence
  Synthetic Polynucleotide
taatacgactcactatagggtagtgtctaaaattctttgtgcgatattaaaacagaggagattaataatgcacaaagaaaacctggcggcagcgcaaaagatg

SEQ ID NO: 50709 - DNA, 103 bp, Artificial Sequence
  Synthetic Polynucleotide
taatacgactcactatagggagagttagtgtctaaaattctttgtgcgataacagaggagaatcgcaatgagaattttaaacctggcggcagcgcaaaagatg

SEQ ID NO: 50710 - DNA, 103 bp, Artificial Sequence
  Synthetic Polynucleotide
taatacgactcactatagggaaaacagagttagtgtctaaaattctttgtaacagaggagaacaaagatgtttagacacaacctggcggcagcgcaaaagatg

SEQ ID NO: 50711 - DNA, 103 bp, Artificial Sequence
  Synthetic Polynucleotide
taatacgactcactatagggttaataaaacagagttagtgtctaaaattcaacagaggagagaatttatgacactaactaacctggcggcagcgcaaaagatg

SEQ ID NO: 50712 - DNA, 103 bp, Artificial Sequence
  Synthetic Polynucleotide
taatacgactcactatagggttcggttaataaaacagagttagtgtctaaaacagaggagattagacatgaactctgttaacctggcggcagcgcaaaagatg

SEQ ID NO: 50713 - DNA, 103 bp, Artificial Sequence
  Synthetic Polynucleotide
taatacgactcactatagggcctcgttcggttaataaaacagagttagtgaacagaggagacactaaatgtgttttattaacctggcggcagcgcaaaagatg

SEQ ID NO: 50714 - DNA, 103 bp, Artificial Sequence
  Synthetic Polynucleotide
taatacgactcactatagggggtctcctcgttcggttaataaaacagagtaacagaggagaactctgatgtattaaccgaacctggcggcagcgcaaaagatg

SEQ ID NO: 50715 - DNA, 103 bp, Artificial Sequence
  Synthetic Polynucleotide
taatacgactcactatagggcgaatttgacatcattattaatggagatataacagaggagaatatctatgttaataatgaacctggcggcagcgcaaaagatg

SEQ ID NO: 50716 - DNA, 103 bp, Artificial Sequence
  Synthetic Polynucleotide
taatacgactcactatagggtatatggtctcctcgttcggttaataaaacaacagaggagagttttaatgaccgaacgaaacctggcggcagcgcaaaagatg

SEQ ID NO: 50717 - DNA, 103 bp, Artificial Sequence
  Synthetic Polynucleotide
taatacgactcactatagggcaaactatatggtctcctcgttcggttaataacagaggagaattaacatgacgaggagaaacctggcggcagcgcaaaagatg

SEQ ID NO: 50718 - DNA, 103 bp, Artificial Sequence
  Synthetic Polynucleotide
taatacgactcactatagggtaatccaaactatatggtctcctcgttcggaacagaggagaccgaacatggagaccataaacctggcggcagcgcaaaagatg

SEQ ID NO: 50719 - DNA, 103 bp, Artificial Sequence
  Synthetic Polynucleotide
taatacgactcactatagggattattaatccaaactatatggtctcctcgaacagaggagacgaggaatgcatatagttaacctggcggcagcgcaaaagatg

SEQ ID NO: 50720 - DNA, 103 bp, Artificial Sequence
  Synthetic Polynucleotide
taatacgactcactatagggcatgaattattaatccaaactatatggtctaacagaggagaagaccaatgagtttggataacctggcggcagcgcaaaagatg

SEQ ID NO: 50721 - DNA, 103 bp, Artificial Sequence
  Synthetic Polynucleotide
taatacgactcactatagggatttccatgaattattaatccaaactatataacagaggagaatatagatgggattaataaacctggcggcagcgcaaaagatg

SEQ ID NO: 50722 - DNA, 103 bp, Artificial Sequence
  Synthetic Polynucleotide
taatacgactcactataggggttaaatttccatgaattattaatccaaacaacagaggagagtttggatgaataattcaaacctggcggcagcgcaaaagatg

SEQ ID NO: 50723 - DNA, 103 bp, Artificial Sequence
  Synthetic Polynucleotide
taatacgactcactatagggtcgctgttaaatttccatgaattattaatcaacagaggagagattaaatgttcatggaaaacctggcggcagcgcaaaagatg

SEQ ID NO: 50724 - DNA, 103 bp, Artificial Sequence
  Synthetic Polynucleotide
taatacgactcactataggggttcttcgctgttaaatttccatgaattataacagaggagaataattatgggaaatttaaacctggcggcagcgcaaaagatg

SEQ ID NO: 50725 - DNA, 103 bp, Artificial Sequence
  Synthetic Polynucleotide
taatacgactcactatagggtaagggttcttcgctgttaaatttccatgaaacagaggagatcatggatgtttaacagcaacctggcggcagcgcaaaagatg

SEQ ID NO: 50726 - DNA, 103 bp, Artificial Sequence
  Synthetic Polynucleotide
taatacgactcactatagggcaacacgaatttgacatcattattaatggaaacagaggagatccattatgaatgatgtcaacctggcggcagcgcaaaagatg

SEQ ID NO: 50727 - DNA, 103 bp, Artificial Sequence
  Synthetic Polynucleotide
taatacgactcactataggggttattaagggttcttcgctgttaaatttcaacagaggagagaaattatgcagcgaagaaacctggcggcagcgcaaaagatg

SEQ ID NO: 50728 - DNA, 103 bp, Artificial Sequence
  Synthetic Polynucleotide
taatacgactcactataggggttttgttattaagggttcttcgctgttaaaacagaggagattaacaatgaagaaccctaacctggcggcagcgcaaaagatg

SEQ ID NO: 50729 - DNA, 103 bp, Artificial Sequence
  Synthetic Polynucleotide
taatacgactcactatagggaattagttttgttattaagggttcttcgctaacagaggagaagcgaaatgcccttaataaacctggcggcagcgcaaaagatg

SEQ ID NO: 50730 - DNA, 103 bp, Artificial Sequence
  Synthetic Polynucleotide
taatacgactcactataggggacagaattagttttgttattaagggttctaacagaggagaagaaccatgaataacaaaaacctggcggcagcgcaaaagatg

SEQ ID NO: 50731 - DNA, 103 bp, Artificial Sequence
  Synthetic Polynucleotide
taatacgactcactatagggttattgacagaattagttttgttattaaggaacagaggagaccttaaatgcaaaactaaaacctggcggcagcgcaaaagatg

SEQ ID NO: 50732 - DNA, 103 bp, Artificial Sequence
  Synthetic Polynucleotide
taatacgactcactatagggatgtcttattgacagaattagttttgttataacagaggagaataacaatgctaattctgaacctggcggcagcgcaaaagatg

SEQ ID NO: 50733 - DNA, 103 bp, Artificial Sequence
  Synthetic Polynucleotide
taatacgactcactatagggagttgatgtcttattgacagaattagttttaacagaggagaaaaactatgtctgtcaataacctggcggcagcgcaaaagatg

SEQ ID NO: 50734 - DNA, 103 bp, Artificial Sequence
  Synthetic Polynucleotide
taatacgactcactatagggtaggtagttgatgtcttattgacagaattaaacagaggagataattcatgcaataagacaacctggcggcagcgcaaaagatg

SEQ ID NO: 50735 - DNA, 103 bp, Artificial Sequence
  Synthetic Polynucleotide
taatacgactcactatagggttccttaggtagttgatgtcttattgacagaacagaggagactgtcaatgagacatcaaaacctggcggcagcgcaaaagatg

SEQ ID NO: 50736 - DNA, 103 bp, Artificial Sequence
  Synthetic Polynucleotide
taatacgactcactataggggaatattccttaggtagttgatgtcttattaacagaggagaaataagatgtcaactaccaacctggcggcagcgcaaaagatg

SEQ ID NO: 50737 - DNA, 103 bp, Artificial Sequence
  Synthetic Polynucleotide
taatacgactcactataggggtatacaacacgaatttgacatcattattaaacagaggagataataaatgtgtcaaattaacctggcggcagcgcaaaagatg

SEQ ID NO: 50738 - DNA, 103 bp, Artificial Sequence
  Synthetic Polynucleotide
taatacgactcactatagggcgcttgaatattccttaggtagttgatgtcaacagaggagagacatcatgtacctaaggaacctggcggcagcgcaaaagatg

SEQ ID NO: 50739 - DNA, 103 bp, Artificial Sequence
  Synthetic Polynucleotide
taatacgactcactatagggtaattcgcttgaatattccttaggtagttgaacagaggagacaactaatgaaggaatataacctggcggcagcgcaaaagatg

SEQ ID NO: 50740 - DNA, 103 bp, Artificial Sequence
  Synthetic Polynucleotide
taatacgactcactatagggcagagtaattcgcttgaatattccttaggtaacagaggagaacctaaatgatattcaagaacctggcggcagcgcaaaagatg

SEQ ID NO: 50741 - DNA, 103 bp, Artificial Sequence
  Synthetic Polynucleotide
taatacgactcactatagggtcggacagagtaattcgcttgaatattcctaacagaggagaaggaatatgcaagcgaataacctggcggcagcgcaaaagatg

SEQ ID NO: 50742 - DNA, 103 bp, Artificial Sequence
  Synthetic Polynucleotide
taatacgactcactatagggtttcctcggacagagtaattcgcttgaataaacagaggagatattcaatggaattactcaacctggcggcagcgcaaaagatg

SEQ ID NO: 50743 - DNA, 103 bp, Artificial Sequence
  Synthetic Polynucleotide
taatacgactcactatagggtttcgtttcctcggacagagtaattcgcttaacagaggagaaagcgaatgactctgtccaacctggcggcagcgcaaaagatg

SEQ ID NO: 50744 - DNA, 103 bp, Artificial Sequence
  Synthetic Polynucleotide
taatacgactcactatagggcagtctttcgtttcctcggacagagtaattaacagaggagaaattacatggtccgaggaaacctggcggcagcgcaaaagatg

SEQ ID NO: 50745 - DNA, 103 bp, Artificial Sequence
  Synthetic Polynucleotide
taatacgactcactatagggttctacagtctttcgtttcctcggacagagaacagaggagactctgtatgaggaaacgaaacctggcggcagcgcaaaagatg

SEQ ID NO: 50746 - DNA, 103 bp, Artificial Sequence
  Synthetic Polynucleotide
taatacgactcactatagggttagcttctacagtctttcgtttcctcggaaacagaggagatccgagatgacgaaagacaacctggcggcagcgcaaaagatg

SEQ ID NO: 50747 - DNA, 103 bp, Artificial Sequence
  Synthetic Polynucleotide
taatacgactcactataggggtatgttagcttctacagtctttcgtttccaacagaggagaggaaacatgagactgtagaacctggcggcagcgcaaaagatg

SEQ ID NO: 50748 - DNA, 103 bp, Artificial Sequence
  Synthetic Polynucleotide
taatacgactcactatagggtatgggtatacaacacgaatttgacatcataacagaggagaatgatgatgaattcgtgtaacctggcggcagcgcaaaagatg

SEQ ID NO: 50749 - DNA, 103 bp, Artificial Sequence
  Synthetic Polynucleotide
taatacgactcactataggggtctcgtatgttagcttctacagtctttcgaacagaggagacgaaagatggtagaagctaacctggcggcagcgcaaaagatg

SEQ ID NO: 50750 - DNA, 103 bp, Artificial Sequence
  Synthetic Polynucleotide
taatacgactcactatagggaacatgtctcgtatgttagcttctacagtcaacagaggagagactgtatgagctaacataacctggcggcagcgcaaaagatg

SEQ ID NO: 50751 - DNA, 103 bp, Artificial Sequence
  Synthetic Polynucleotide
taatacgactcactatagggctactaacatgtctcgtatgttagcttctaaacagaggagatagaagatgacatacgagaacctggcggcagcgcaaaagatg

SEQ ID NO: 50752 - DNA, 103 bp, Artificial Sequence
  Synthetic Polynucleotide
taatacgactcactatagggtgaatctactaacatgtctcgtatgttagcaacagaggagagctaacatgcgagacatgaacctggcggcagcgcaaaagatg

SEQ ID NO: 50753 - DNA, 103 bp, Artificial Sequence
  Synthetic Polynucleotide
taatacgactcactatagggtctactgaatctactaacatgtctcgtatgaacagaggagacatacgatgcatgttagtaacctggcggcagcgcaaaagatg

SEQ ID NO: 50754 - DNA, 103 bp, Artificial Sequence
  Synthetic Polynucleotide
taatacgactcactatagggcggtctctactgaatctactaacatgtctcaacagaggagagagacaatgtagtagattaacctggcggcagcgcaaaagatg

SEQ ID NO: 50755 - DNA, 103 bp, Artificial Sequence
  Synthetic Polynucleotide
taatacgactcactatagggggtatcggtctctactgaatctactaacataacagaggagaatgttaatggattcagtaaacctggcggcagcgcaaaagatg

SEQ ID NO: 50756 - DNA, 103 bp, Artificial Sequence
  Synthetic Polynucleotide
taatacgactcactatagggggataggtatcggtctctactgaatctactaacagaggagaagtagaatgagtagagacaacctggcggcagcgcaaaagatg

SEQ ID NO: 50757 - DNA, 103 bp, Artificial Sequence
  Synthetic Polynucleotide
taatacgactcactatagggtatccggataggtatcggtctctactgaataacagaggagaattcagatgagaccgataaacctggcggcagcgcaaaagatg

SEQ ID NO: 50758 - DNA, 103 bp, Artificial Sequence
  Synthetic Polynucleotide
taatacgactcactatagggaagtttatccggataggtatcggtctctacaacagaggagagtagagatggatacctataacctggcggcagcgcaaaagatg

SEQ ID NO: 50759 - DNA, 103 bp, Artificial Sequence
  Synthetic Polynucleotide
taatacgactcactatagggttcagtatgggtatacaacacgaatttgacaacagaggagagtcaaaatggtgttgtataacctggcggcagcgcaaaagatg

SEQ ID NO: 50760 - DNA, 103 bp, Artificial Sequence
  Synthetic Polynucleotide
taatacgactcactatagggaacggaagtttatccggataggtatcggtcaacagaggagagaccgaatgctatccggaaacctggcggcagcgcaaaagatg

SEQ ID NO: 50761 - DNA, 103 bp, Artificial Sequence
  Synthetic Polynucleotide
taatacgactcactatagggttttaaacggaagtttatccggataggtataacagaggagaatacctatgcggataaacaacctggcggcagcgcaaaagatg

SEQ ID NO: 50762 - DNA, 103 bp, Artificial Sequence
  Synthetic Polynucleotide
taatacgactcactatagggaccatttttaaacggaagtttatccggataaacagaggagatatccgatgaaacttccgaacctggcggcagcgcaaaagatg

SEQ ID NO: 50763 - DNA, 103 bp, Artificial Sequence
  Synthetic Polynucleotide
taatacgactcactatagggaatacaccatttttaaacggaagtttatccaacagaggagaggataaatgtccgtttaaaacctggcggcagcgcaaaagatg

SEQ ID NO: 50764 - DNA, 103 bp, Artificial Sequence
  Synthetic Polynucleotide
taatacgactcactatagggggtccaatacaccatttttaaacggaagttaacagaggagaaacttcatgttaaaaatgaacctggcggcagcgcaaaagatg

SEQ ID NO: 50765 - DNA, 103 bp, Artificial Sequence
  Synthetic Polynucleotide
taatacgactcactatagggtaccaggtccaatacaccatttttaaacggaacagaggagaccgtttatgaatggtgtaaacctggcggcagcgcaaaagatg

SEQ ID NO: 50766 - DNA, 103 bp, Artificial Sequence
  Synthetic Polynucleotide
taatacgactcactatagggccgtctaccaggtccaatacaccatttttaaacagaggagataaaaaatgtgtattggaaacctggcggcagcgcaaaagatg

SEQ ID NO: 50767 - DNA, 103 bp, Artificial Sequence
  Synthetic Polynucleotide
taatacgactcactatagggacattccgtctaccaggtccaatacaccataacagaggagaatggtgatgtggacctggaacctggcggcagcgcaaaagatg

SEQ ID NO: 50768 - DNA, 103 bp, Artificial Sequence
  Synthetic Polynucleotide
taatacgactcactataggggtaaaacattccgtctaccaggtccaatacaacagaggagagtattgatgctggtagacaacctggcggcagcgcaaaagatg

SEQ ID NO: 50769 - DNA, 103 bp, Artificial Sequence
  Synthetic Polynucleotide
taatacgactcactatagggccagagtaaaacattccgtctaccaggtccaacagaggagaggacctatgagacggaataacctggcggcagcgcaaaagatg

SEQ ID NO: 50770 - DNA, 103 bp, Artificial Sequence
  Synthetic Polynucleotide
taatacgactcactatagggatcaattcagtatgggtatacaacacgaataacagaggagaattcgtatggtatacccaaacctggcggcagcgcaaaagatg

SEQ ID NO: 50771 - DNA, 103 bp, Artificial Sequence
  Synthetic Polynucleotide
taatacgactcactatagggcatctccagagtaaaacattccgtctaccaaacagaggagatggtagatggaatgttttaacctggcggcagcgcaaaagatg

SEQ ID NO: 50772 - DNA, 103 bp, Artificial Sequence
  Synthetic Polynucleotide
taatacgactcactatagggagcatcatctccagagtaaaacattccgtcaacagaggagagacggaatgttttactctaacctggcggcagcgcaaaagatg

SEQ ID NO: 50773 - DNA, 103 bp, Artificial Sequence
  Synthetic Polynucleotide
taatacgactcactatagggtttttagcatcatctccagagtaaaacattaacagaggagaaatgttatgctctggagaaacctggcggcagcgcaaaagatg

SEQ ID NO: 50774 - DNA, 103 bp, Artificial Sequence
  Synthetic Polynucleotide
taatacgactcactatagggtatattttttagcatcatctccagagtaaaaacagaggagatttactatggagatgatgaacctggcggcagcgcaaaagatg

SEQ ID NO: 50775 - DNA, 103 bp, Artificial Sequence
  Synthetic Polynucleotide
taatacgactcactatagggacacgtatattttttagcatcatctccagaaacagaggagatctggaatggatgctaaaaacctggcggcagcgcaaaagatg

SEQ ID NO: 50776 - DNA, 103 bp, Artificial Sequence
  Synthetic Polynucleotide
taatacgactcactatagggacagtacacgtatattttttagcatcatctaacagaggagaagatgaatgtaaaaaataaacctggcggcagcgcaaaagatg

SEQ ID NO: 50777 - DNA, 103 bp, Artificial Sequence
  Synthetic Polynucleotide
taatacgactcactatagggttgatacagtacacgtatattttttagcataacagaggagaatgctaatgaatatacgtaacctggcggcagcgcaaaagatg

SEQ ID NO: 50778 - DNA, 103 bp, Artificial Sequence
  Synthetic Polynucleotide
taatacgactcactatagggtccggttgatacagtacacgtatattttttaacagaggagaaaaaaaatgacgtgtactaacctggcggcagcgcaaaagatg

SEQ ID NO: 50779 - DNA, 103 bp, Artificial Sequence
  Synthetic Polynucleotide
taatacgactcactatagggttaaatccggttgatacagtacacgtatataacagaggagaatatacatgtactgtatcaacctggcggcagcgcaaaagatg

SEQ ID NO: 50780 - DNA, 103 bp, Artificial Sequence
  Synthetic Polynucleotide
taatacgactcactatagggcaaatttaaatccggttgatacagtacacgaacagaggagacgtgtaatgtatcaaccgaacctggcggcagcgcaaaagatg

SEQ ID NO: 50781 - DNA, 103 bp, Artificial Sequence
  Synthetic Polynucleotide
taatacgactcactatagggcgttcatcaattcagtatgggtatacaacaaacagaggagatgttgtatgcccatactgaacctggcggcagcgcaaaagatg

SEQ ID NO: 50782 - DNA, 103 bp, Artificial Sequence
  Synthetic Polynucleotide
taatacgactcactatagggatcgtcaaatttaaatccggttgatacagtaacagaggagaactgtaatgaccggatttaacctggcggcagcgcaaaagatg

SEQ ID NO: 50783 - DNA, 103 bp, Artificial Sequence
  Synthetic Polynucleotide
taatacgactcactatagggtttgtatcgtcaaatttaaatccggttgataacagaggagaatcaacatgatttaaattaacctggcggcagcgcaaaagatg

SEQ ID NO: 50784 - DNA, 103 bp, Artificial Sequence
  Synthetic Polynucleotide
taatacgactcactatagggcgaactttgtatcgtcaaatttaaatccggaacagaggagaccggatatgaatttgacgaacctggcggcagcgcaaaagatg

SEQ ID NO: 50785 - DNA, 103 bp, Artificial Sequence
  Synthetic Polynucleotide
taatacgactcactatagggttcgacgaactttgtatcgtcaaatttaaaaacagaggagatttaaaatggacgatacaaacctggcggcagcgcaaaagatg

SEQ ID NO: 50786 - DNA, 103 bp, Artificial Sequence
  Synthetic Polynucleotide
taatacgactcactatagggctatcttcgacgaactttgtatcgtcaaataacagaggagaatttgaatgtacaaagttaacctggcggcagcgcaaaagatg

SEQ ID NO: 50787 - DNA, 103 bp, Artificial Sequence
  Synthetic Polynucleotide
taatacgactcactatagggctggactatcttcgacgaactttgtatcgtaacagaggagaacgataatgagttcgtcgaacctggcggcagcgcaaaagatg

SEQ ID NO: 50788 - DNA, 103 bp, Artificial Sequence
  Synthetic Polynucleotide
taatacgactcactatagggcatttctggactatcttcgacgaactttgtaacagaggagaacaaagatggtcgaagataacctggcggcagcgcaaaagatg

SEQ ID NO: 50789 - DNA, 103 bp, Artificial Sequence
  Synthetic Polynucleotide
taatacgactcactatagggtcttccatttctggactatcttcgacgaacaacagaggagagttcgtatgagatagtccaacctggcggcagcgcaaaagatg

SEQ ID NO: 50790 - DNA, 103 bp, Artificial Sequence
  Synthetic Polynucleotide
taatacgactcactatagggttaactcttccatttctggactatcttcgaaacagaggagatcgaagatggtccagaaaaacctggcggcagcgcaaaagatg

SEQ ID NO: 50791 - DNA, 103 bp, Artificial Sequence
  Synthetic Polynucleotide
taatacgactcactatagggatttattaactcttccatttctggactatcaacagaggagagatagtatggaaatggaaaacctggcggcagcgcaaaagatg

SEQ ID NO: 50792 - DNA, 103 bp, Artificial Sequence
  Synthetic Polynucleotide
taatacgactcactatagggatgtaaaccaaggacgagataagacactctaacagaggagaagagtgatgtatctcgtcaacctggcggcagcgcaaaagatg

SEQ ID NO: 50793 - DNA, 103 bp, Artificial Sequence
  Synthetic Polynucleotide
taatacgactcactatagggtcgttcgttcatcaattcagtatgggtataaacagaggagatataccatgactgaattgaacctggcggcagcgcaaaagatg

SEQ ID NO: 50794 - DNA, 103 bp, Artificial Sequence
  Synthetic Polynucleotide
taatacgactcactatagggatgatatttattaactcttccatttctggaaacagaggagatccagaatgggaagagttaacctggcggcagcgcaaaagatg

SEQ ID NO: 50795 - DNA, 103 bp, Artificial Sequence
  Synthetic Polynucleotide
taatacgactcactatagggcgttaatgatatttattaactcttccatttaacagaggagaaaatggatgagttaataaaacctggcggcagcgcaaaagatg

SEQ ID NO: 50796 - DNA, 103 bp, Artificial Sequence
  Synthetic Polynucleotide
taatacgactcactataggggatatcgttaatgatatttattaactcttcaacagaggagagaagagatgataaatatcaacctggcggcagcgcaaaagatg

SEQ ID NO: 50797 - DNA, 103 bp, Artificial Sequence
  Synthetic Polynucleotide
taatacgactcactatagggggttggatatcgttaatgatatttattaacaacagaggagagttaatatgtatcattaaaacctggcggcagcgcaaaagatg

SEQ ID NO: 50798 - DNA, 103 bp, Artificial Sequence
  Synthetic Polynucleotide
taatacgactcactatagggttaatggttggatatcgttaatgatatttaaacagaggagataaataatgttaacgataaacctggcggcagcgcaaaagatg

SEQ ID NO: 50799 - DNA, 103 bp, Artificial Sequence
  Synthetic Polynucleotide
taatacgactcactatagggatccgttaatggttggatatcgttaatgataacagaggagaatcattatggatatccaaaacctggcggcagcgcaaaagatg

SEQ ID NO: 50800 - DNA, 103 bp, Artificial Sequence
  Synthetic Polynucleotide
taatacgactcactatagggttttcatccgttaatggttggatatcgttaaacagaggagataacgaatgccaaccattaacctggcggcagcgcaaaagatg

SEQ ID NO: 50801 - DNA, 103 bp, Artificial Sequence
  Synthetic Polynucleotide
taatacgactcactatagggtcttattttcatccgttaatggttggatataacagaggagaatatccatgcattaacggaacctggcggcagcgcaaaagatg

SEQ ID NO: 50802 - DNA, 103 bp, Artificial Sequence
  Synthetic Polynucleotide
taatacgactcactatagggatttttcttattttcatccgttaatggttgaacagaggagacaaccaatgacggatgaaaacctggcggcagcgcaaaagatg

SEQ ID NO: 50803 - DNA, 103 bp, Artificial Sequence
  Synthetic Polynucleotide
taatacgactcactatagggtctctatttttcttattttcatccgttaataacagaggagaattaacatgtgaaaataaaacctggcggcagcgcaaaagatg

SEQ ID NO: 50804 - DNA, 103 bp, Artificial Sequence
  Synthetic Polynucleotide
taatacgactcactatagggggtattcgttcgttcatcaattcagtatggaacagaggagaccatacatgattgatgaaaacctggcggcagcgcaaaagatg

SEQ ID NO: 50805 - DNA, 103 bp, Artificial Sequence
  Synthetic Polynucleotide
taatacgactcactatagggacaactctctatttttcttattttcatccgaacagaggagacggatgatgataagaaaaaacctggcggcagcgcaaaagatg

SEQ ID NO: 50806 - DNA, 103 bp, Artificial Sequence
  Synthetic Polynucleotide
taatacgactcactatagggttcgtacaactctctatttttcttattttcaacagaggagagaaaatatgaaaaatagaaacctggcggcagcgcaaaagatg

SEQ ID NO: 50807 - DNA, 103 bp, Artificial Sequence
  Synthetic Polynucleotide
taatacgactcactataggggttttttcgtacaactctctatttttcttaaacagaggagataagaaatgtagagagttaacctggcggcagcgcaaaagatg

SEQ ID NO: 50808 - DNA, 103 bp, Artificial Sequence
  Synthetic Polynucleotide
taatacgactcactatagggataaagttttttcgtacaactctctattttaacagaggagaaaaataatgagttgtacgaacctggcggcagcgcaaaagatg

SEQ ID NO: 50809 - DNA, 103 bp, Artificial Sequence
  Synthetic Polynucleotide
taatacgactcactatagggactagataaagttttttcgtacaactctctaacagaggagaagagagatgtacgaaaaaaacctggcggcagcgcaaaagatg

SEQ ID NO: 50810 - DNA, 103 bp, Artificial Sequence
  Synthetic Polynucleotide
taatacgactcactatagggaaacaactagataaagttttttcgtacaacaacagaggagagttgtaatgaaaaactttaacctggcggcagcgcaaaagatg

SEQ ID NO: 50811 - DNA, 103 bp, Artificial Sequence
  Synthetic Polynucleotide
taatacgactcactatagggcgcataaacaactagataaagttttttcgtaacagaggagaacgaaaatgctttatctaaacctggcggcagcgcaaaagatg

SEQ ID NO: 50812 - DNA, 103 bp, Artificial Sequence
  Synthetic Polynucleotide
taatacgactcactatagggagcaccgcataaacaactagataaagttttaacagaggagaaaaactatgtctagttgtaacctggcggcagcgcaaaagatg

SEQ ID NO: 50813 - DNA, 103 bp, Artificial Sequence
  Synthetic Polynucleotide
taatacgactcactatagggttggtagcaccgcataaacaactagataaaaacagaggagatttatcatgttgtttatgaacctggcggcagcgcaaaagatg

SEQ ID NO: 50814 - DNA, 103 bp, Artificial Sequence
  Synthetic Polynucleotide
taatacgactcactatagggatcctttggtagcaccgcataaacaactagaacagaggagactagttatgtatgcggtgaacctggcggcagcgcaaaagatg

SEQ ID NO: 50815 - DNA, 103 bp, Artificial Sequence
  Synthetic Polynucleotide
taatacgactcactatagggccgacggtattcgttcgttcatcaattcagaacagaggagactgaatatgtgaacgaacaacctggcggcagcgcaaaagatg

SEQ ID NO: 50816 - DNA, 103 bp, Artificial Sequence
  Synthetic Polynucleotide
taatacgactcactatagggtaaacatcctttggtagcaccgcataaacaaacagaggagatgtttaatgggtgctaccaacctggcggcagcgcaaaagatg

SEQ ID NO: 50817 - DNA, 103 bp, Artificial Sequence
  Synthetic Polynucleotide
taatacgactcactatagggaatgttaaacatcctttggtagcaccgcataacagaggagaatgcggatgtaccaaaggaacctggcggcagcgcaaaagatg

SEQ ID NO: 50818 - DNA, 103 bp, Artificial Sequence
  Synthetic Polynucleotide
taatacgactcactatagggaaaagaatgttaaacatcctttggtagcacaacagaggagagtgctaatgaaggatgttaacctggcggcagcgcaaaagatg

SEQ ID NO: 50819 - DNA, 103 bp, Artificial Sequence
  Synthetic Polynucleotide
taatacgactcactatagggtccaaaaaagaatgttaaacatcctttggtaacagaggagaaccaaaatgtgtttaacaaacctggcggcagcgcaaaagatg

SEQ ID NO: 50820 - DNA, 103 bp, Artificial Sequence
  Synthetic Polynucleotide
taatacgactcactataggggtttctccaaaaaagaatgttaaacatcctaacagaggagaaggatgatgaacattcttaacctggcggcagcgcaaaagatg

SEQ ID NO: 50821 - DNA, 103 bp, Artificial Sequence
  Synthetic Polynucleotide
taatacgactcactatagggttgccgtttctccaaaaaagaatgttaaacaacagaggagagtttaaatgtcttttttgaacctggcggcagcgcaaaagatg

SEQ ID NO: 50822 - DNA, 103 bp, Artificial Sequence
  Synthetic Polynucleotide
taatacgactcactatagggtccagttgccgtttctccaaaaaagaatgtaacagaggagaacattcatgtttggagaaaacctggcggcagcgcaaaagatg

SEQ ID NO: 50823 - DNA, 103 bp, Artificial Sequence
  Synthetic Polynucleotide
taatacgactcactataggggactttccagttgccgtttctccaaaaaagaacagaggagactttttatgagaaacggcaacctggcggcagcgcaaaagatg

SEQ ID NO: 50824 - DNA, 103 bp, Artificial Sequence
  Synthetic Polynucleotide
taatacgactcactatagggttgtcgactttccagttgccgtttctccaaaacagaggagattggagatgcggcaactgaacctggcggcagcgcaaaagatg

SEQ ID NO: 50825 - DNA, 103 bp, Artificial Sequence
  Synthetic Polynucleotide
taatacgactcactatagggtttggttgtcgactttccagttgccgtttcaacagaggagagaaacgatgactggaaagaacctggcggcagcgcaaaagatg

SEQ ID NO: 50826 - DNA, 103 bp, Artificial Sequence
  Synthetic Polynucleotide
taatacgactcactatagggtaacgccgacggtattcgttcgttcatcaaaacagaggagattgatgatggaacgaataaacctggcggcagcgcaaaagatg

SEQ ID NO: 50827 - DNA, 103 bp, Artificial Sequence
  Synthetic Polynucleotide
taatacgactcactatagggaaacgtttggttgtcgactttccagttgccaacagaggagaggcaacatgaaagtcgacaacctggcggcagcgcaaaagatg

SEQ ID NO: 50828 - DNA, 103 bp, Artificial Sequence
  Synthetic Polynucleotide
taatacgactcactatagggttaacaaacgtttggttgtcgactttccagaacagaggagactggaaatgcgacaaccaaacctggcggcagcgcaaaagatg

SEQ ID NO: 50829 - DNA, 103 bp, Artificial Sequence
  Synthetic Polynucleotide
taatacgactcactatagggagactttaacaaacgtttggttgtcgacttaacagaggagaaagtcgatgaccaaacgtaacctggcggcagcgcaaaagatg

SEQ ID NO: 50830 - DNA, 103 bp, Artificial Sequence
  Synthetic Polynucleotide
taatacgactcactatagggatagcagactttaacaaacgtttggttgtcaacagaggagagacaacatgacgtttgttaacctggcggcagcgcaaaagatg

SEQ ID NO: 50831 - DNA, 103 bp, Artificial Sequence
  Synthetic Polynucleotide
taatacgactcactatagggcactgatagcagactttaacaaacgtttggaacagaggagaccaaacatgtgttaaagtaacctggcggcagcgcaaaagatg

SEQ ID NO: 50832 - DNA, 103 bp, Artificial Sequence
  Synthetic Polynucleotide
taatacgactcactatagggcagatcactgatagcagactttaacaaacgaacagaggagacgtttgatgaagtctgctaacctggcggcagcgcaaaagatg

SEQ ID NO: 50833 - DNA, 103 bp, Artificial Sequence
  Synthetic Polynucleotide
taatacgactcactatagggacaaacagatcactgatagcagactttaacaacagaggagagttaaaatgtgctatcagaacctggcggcagcgcaaaagatg

SEQ ID NO: 50834 - DNA, 103 bp, Artificial Sequence
  Synthetic Polynucleotide
taatacgactcactatagggtctcaacaaacagatcactgatagcagactaacagaggagaagtctgatgtcagtgatcaacctggcggcagcgcaaaagatg

SEQ ID NO: 50835 - DNA, 103 bp, Artificial Sequence
  Synthetic Polynucleotide
taatacgactcactatagggacccgtctcaacaaacagatcactgatagcaacagaggagagctatcatggatctgtttaacctggcggcagcgcaaaagatg

SEQ ID NO: 50836 - DNA, 103 bp, Artificial Sequence
  Synthetic Polynucleotide
taatacgactcactataggggtttgacccgtctcaacaaacagatcactgaacagaggagacagtgaatggtttgttgaaacctggcggcagcgcaaaagatg

SEQ ID NO: 50837 - DNA, 103 bp, Artificial Sequence
  Synthetic Polynucleotide
taatacgactcactatagggactattaacgccgacggtattcgttcgttcaacagaggagagaacgaatgaataccgtcaacctggcggcagcgcaaaagatg

SEQ ID NO: 50838 - DNA, 103 bp, Artificial Sequence
  Synthetic Polynucleotide
taatacgactcactatagggaaattgtttgacccgtctcaacaaacagataacagaggagaatctgtatgttgagacggaacctggcggcagcgcaaaagatg

SEQ ID NO: 50839 - DNA, 103 bp, Artificial Sequence
  Synthetic Polynucleotide
taatacgactcactatagggtgttaaaattgtttgacccgtctcaacaaaaacagaggagatttgttatgacgggtcaaaacctggcggcagcgcaaaagatg

SEQ ID NO: 50840 - DNA, 103 bp, Artificial Sequence
  Synthetic Polynucleotide
taatacgactcactatagggacatctgttaaaattgtttgacccgtctcaaacagaggagatgagacatgtcaaacaataacctggcggcagcgcaaaagatg

SEQ ID NO: 50841 - DNA, 103 bp, Artificial Sequence
  Synthetic Polynucleotide
taatacgactcactatagggccaatacatctgttaaaattgtttgacccgaacagaggagacgggtcatgcaattttaaaacctggcggcagcgcaaaagatg

SEQ ID NO: 50842 - DNA, 103 bp, Artificial Sequence
  Synthetic Polynucleotide
taatacgactcactatagggtttatccaatacatctgttaaaattgtttgaacagaggagacaaacaatgttaacagataacctggcggcagcgcaaaagatg

SEQ ID NO: 50843 - DNA, 103 bp, Artificial Sequence
  Synthetic Polynucleotide
taatacgactcactatagggggtcctttatccaatacatctgttaaaattaacagaggagaaattttatgagatgtattaacctggcggcagcgcaaaagatg

SEQ ID NO: 50844 - DNA, 103 bp, Artificial Sequence
  Synthetic Polynucleotide
taatacgactcactataggggattaggtcctttatccaatacatctgttaaacagaggagataacagatgtattggataaacctggcggcagcgcaaaagatg

SEQ ID NO: 50845 - DNA, 103 bp, Artificial Sequence
  Synthetic Polynucleotide
taatacgactcactatagggaaatggattaggtcctttatccaatacatcaacagaggagagatgtaatggataaaggaaacctggcggcagcgcaaaagatg

SEQ ID NO: 50846 - DNA, 103 bp, Artificial Sequence
  Synthetic Polynucleotide
taatacgactcactataggggcgataaatggattaggtcctttatccaataacagaggagaattggaatgaggacctaaaacctggcggcagcgcaaaagatg

SEQ ID NO: 50847 - DNA, 103 bp, Artificial Sequence
  Synthetic Polynucleotide
taatacgactcactatagggtgttagcgataaatggattaggtcctttataacagaggagaataaagatgctaatccataacctggcggcagcgcaaaagatg

SEQ ID NO: 50848 - DNA, 103 bp, Artificial Sequence
  Synthetic Polynucleotide
taatacgactcactatagggaaattactattaacgccgacggtattcgttaacagaggagaaacgaaatgcgtcggcgtaacctggcggcagcgcaaaagatg

SEQ ID NO: 50849 - DNA, 103 bp, Artificial Sequence
  Synthetic Polynucleotide
taatacgactcactatagggatgcatgttagcgataaatggattaggtccaacagaggagaggacctatgccatttatcaacctggcggcagcgcaaaagatg

SEQ ID NO: 50850 - DNA, 103 bp, Artificial Sequence
  Synthetic Polynucleotide
taatacgactcactatagggttcaaatgcatgttagcgataaatggattaaacagaggagataatccatgtatcgctaaaacctggcggcagcgcaaaagatg

SEQ ID NO: 50851 - DNA, 103 bp, Artificial Sequence
  Synthetic Polynucleotide
taatacgactcactatagggatcttttcaaatgcatgttagcgataaatgaacagaggagacatttaatgctaacatgcaacctggcggcagcgcaaaagatg

SEQ ID NO: 50852 - DNA, 103 bp, Artificial Sequence
  Synthetic Polynucleotide
taatacgactcactatagggcacagatcttttcaaatgcatgttagcgataacagaggagaatcgctatgatgcatttgaacctggcggcagcgcaaaagatg

SEQ ID NO: 50853 - DNA, 103 bp, Artificial Sequence
  Synthetic Polynucleotide
taatacgactcactatagggcagaacacagatcttttcaaatgcatgttaaacagaggagataacatatgtttgaaaagaacctggcggcagcgcaaaagatg

SEQ ID NO: 50854 - DNA, 103 bp, Artificial Sequence
  Synthetic Polynucleotide
taatacgactcactatagggcgctacagaacacagatcttttcaaatgcaaacagaggagatgcattatgaaagatctgaacctggcggcagcgcaaaagatg

SEQ ID NO: 50855 - DNA, 103 bp, Artificial Sequence
  Synthetic Polynucleotide
taatacgactcactatagggtagttcgctacagaacacagatcttttcaaaacagaggagattgaaaatgtctgtgttcaacctggcggcagcgcaaaagatg

SEQ ID NO: 50856 - DNA, 103 bp, Artificial Sequence
  Synthetic Polynucleotide
taatacgactcactatagggtcaggtagttcgctacagaacacagatcttaacagaggagaaagatcatggttctgtagaacctggcggcagcgcaaaagatg

SEQ ID NO: 50857 - DNA, 103 bp, Artificial Sequence
  Synthetic Polynucleotide
taatacgactcactatagggcaaaatcaggtagttcgctacagaacacagaacagaggagactgtgtatggtagcgaacaacctggcggcagcgcaaaagatg

SEQ ID NO: 50858 - DNA, 103 bp, Artificial Sequence
  Synthetic Polynucleotide
taatacgactcactatagggacatgcaaaatcaggtagttcgctacagaaaacagaggagattctgtatggaactacctaacctggcggcagcgcaaaagatg

SEQ ID NO: 50859 - DNA, 103 bp, Artificial Sequence
  Synthetic Polynucleotide
taatacgactcactatagggaaagtaaattactattaacgccgacggtataacagaggagaataccgatggcgttaataaacctggcggcagcgcaaaagatg

SEQ ID NO: 50860 - DNA, 103 bp, Artificial Sequence
  Synthetic Polynucleotide
taatacgactcactatagggccactacatgcaaaatcaggtagttcgctaaacagaggagatagcgaatgacctgatttaacctggcggcagcgcaaaagatg

SEQ ID NO: 50861 - DNA, 103 bp, Artificial Sequence
  Synthetic Polynucleotide
taatacgactcactatagggttgtcccactacatgcaaaatcaggtagttaacagaggagaaactacatgattttgcataacctggcggcagcgcaaaagatg

SEQ ID NO: 50862 - DNA, 103 bp, Artificial Sequence
  Synthetic Polynucleotide
taatacgactcactatagggtttctttgtcccactacatgcaaaatcaggaacagaggagacctgatatggcatgtagtaacctggcggcagcgcaaaagatg

SEQ ID NO: 50863 - DNA, 103 bp, Artificial Sequence
  Synthetic Polynucleotide
taatacgactcactatagggctgattttctttgtcccactacatgcaaaaaacagaggagattttgcatgtagtgggacaacctggcggcagcgcaaaagatg

SEQ ID NO: 50864 - DNA, 103 bp, Artificial Sequence
  Synthetic Polynucleotide
taatacgactcactatagggcagatctgattttctttgtcccactacatgaacagaggagacatgtaatgggacaaagaaacctggcggcagcgcaaaagatg

SEQ ID NO: 50865 - DNA, 103 bp, Artificial Sequence
  Synthetic Polynucleotide
taatacgactcactatagggattatcagatctgattttctttgtcccactaacagaggagaagtgggatgaagaaaatcaacctggcggcagcgcaaaagatg

SEQ ID NO: 50866 - DNA, 103 bp, Artificial Sequence
  Synthetic Polynucleotide
taatacgactcactatagggttaatattatcagatctgattttctttgtcaacagaggagagacaaaatgaatcagatcaacctggcggcagcgcaaaagatg

SEQ ID NO: 50867 - DNA, 103 bp, Artificial Sequence
  Synthetic Polynucleotide
taatacgactcactatagggactttttaatattatcagatctgattttctaacagaggagaagaaaaatggatctgataaacctggcggcagcgcaaaagatg

SEQ ID NO: 50868 - DNA, 103 bp, Artificial Sequence
  Synthetic Polynucleotide
taatacgactcactatagggtgtcaactttttaatattatcagatctgataacagaggagaatcagaatggataatattaacctggcggcagcgcaaaagatg

SEQ ID NO: 50869 - DNA, 103 bp, Artificial Sequence
  Synthetic Polynucleotide
taatacgactcactatagggggttctgtcaactttttaatattatcagataacagaggagaatctgaatgtattaaaaaaacctggcggcagcgcaaaagatg

SEQ ID NO: 50870 - DNA, 103 bp, Artificial Sequence
  Synthetic Polynucleotide
taatacgactcactatagggatgaaaaagtaaattactattaacgccgacaacagaggagagtcggcatgaatagtaataacctggcggcagcgcaaaagatg

SEQ ID NO: 50871 - DNA, 103 bp, Artificial Sequence
  Synthetic Polynucleotide
taatacgactcactatagggcacaaggttctgtcaactttttaatattataacagaggagaataataatgaaaagttgaaacctggcggcagcgcaaaagatg

SEQ ID NO: 50872 - DNA, 103 bp, Artificial Sequence
  Synthetic Polynucleotide
taatacgactcactatagggaatgacacaaggttctgtcaactttttaataacagaggagaattaaaatgttgacagaaaacctggcggcagcgcaaaagatg

SEQ ID NO: 50873 - DNA, 103 bp, Artificial Sequence
  Synthetic Polynucleotide
taatacgactcactatagggcttccaatgacacaaggttctgtcaactttaacagaggagaaaagttatgagaaccttgaacctggcggcagcgcaaaagatg

SEQ ID NO: 50874 - DNA, 103 bp, Artificial Sequence
  Synthetic Polynucleotide
taatacgactcactatagggacggtcttccaatgacacaaggttctgtcaaacagaggagatgacagatgcttgtgtcaaacctggcggcagcgcaaaagatg

SEQ ID NO: 50875 - DNA, 103 bp, Artificial Sequence
  Synthetic Polynucleotide
taatacgactcactataggggaaacacggtcttccaatgacacaaggttcaacagaggagagaacctatggtcattggaaacctggcggcagcgcaaaagatg

SEQ ID NO: 50876 - DNA, 103 bp, Artificial Sequence
  Synthetic Polynucleotide
taatacgactcactatagggttggagaaacacggtcttccaatgacacaaaacagaggagattgtgtatgtggaagaccaacctggcggcagcgcaaaagatg

SEQ ID NO: 50877 - DNA, 103 bp, Artificial Sequence
  Synthetic Polynucleotide
taatacgactcactatagggttttattggagaaacacggtcttccaatgaaacagaggagatcattgatggaccgtgttaacctggcggcagcgcaaaagatg

SEQ ID NO: 50878 - DNA, 103 bp, Artificial Sequence
  Synthetic Polynucleotide
taatacgactcactatagggattaattttattggagaaacacggtcttccaacagaggagaggaagaatgtgtttctccaacctggcggcagcgcaaaagatg

SEQ ID NO: 50879 - DNA, 103 bp, Artificial Sequence
  Synthetic Polynucleotide
taatacgactcactatagggctattattaattttattggagaaacacggtaacagaggagaaccgtgatgctccaataaaacctggcggcagcgcaaaagatg

SEQ ID NO: 50880 - DNA, 103 bp, Artificial Sequence
  Synthetic Polynucleotide
taatacgactcactatagggggtttctattattaattttattggagaaacaacagaggagagtttctatgataaaattaaacctggcggcagcgcaaaagatg

SEQ ID NO: 50881 - DNA, 103 bp, Artificial Sequence
  Synthetic Polynucleotide
taatacgactcactatagggtaaagatgaaaaagtaaattactattaacgaacagaggagacgttaaatgtaatttactaacctggcggcagcgcaaaagatg

SEQ ID NO: 50882 - DNA, 103 bp, Artificial Sequence
  Synthetic Polynucleotide
taatacgactcactatagggagcatggtttctattattaattttattggaaacagaggagatccaatatgattaataataacctggcggcagcgcaaaagatg

SEQ ID NO: 50883 - DNA, 103 bp, Artificial Sequence
  Synthetic Polynucleotide
taatacgactcactatagggattgtagcatggtttctattattaattttaaacagaggagataaaatatgtaatagaaaaacctggcggcagcgcaaaagatg

SEQ ID NO: 50884 - DNA, 103 bp, Artificial Sequence
  Synthetic Polynucleotide
taatacgactcactatagggtaatgattgtagcatggtttctattattaaaacagaggagattaataatggaaaccatgaacctggcggcagcgcaaaagatg

SEQ ID NO: 50885 - DNA, 103 bp, Artificial Sequence
  Synthetic Polynucleotide
taatacgactcactatagggatcgataatgattgtagcatggtttctattaacagaggagaaatagaatgcatgctacaaacctggcggcagcgcaaaagatg

SEQ ID NO: 50886 - DNA, 103 bp, Artificial Sequence
  Synthetic Polynucleotide
taatacgactcactatagggttagtatcgataatgattgtagcatggtttaacagaggagaaaaccaatgtacaatcataacctggcggcagcgcaaaagatg

SEQ ID NO: 50887 - DNA, 103 bp, Artificial Sequence
  Synthetic Polynucleotide
taatacgactcactatagggtgtaattagtatcgataatgattgtagcataacagaggagaatgctaatgtcattatcgaacctggcggcagcgcaaaagatg

SEQ ID NO: 50888 - DNA, 103 bp, Artificial Sequence
  Synthetic Polynucleotide
taatacgactcactatagggaggtttgtaattagtatcgataatgattgtaacagaggagaacaatcatgatcgatactaacctggcggcagcgcaaaagatg

SEQ ID NO: 50889 - DNA, 103 bp, Artificial Sequence
  Synthetic Polynucleotide
taatacgactcactatagggaagacaggtttgtaattagtatcgataatgaacagaggagacattatatgtactaattaaacctggcggcagcgcaaaagatg

SEQ ID NO: 50890 - DNA, 103 bp, Artificial Sequence
  Synthetic Polynucleotide
taatacgactcactatagggtatcaaagacaggtttgtaattagtatcgaaacagaggagatcgataatgattacaaacaacctggcggcagcgcaaaagatg

SEQ ID NO: 50891 - DNA, 103 bp, Artificial Sequence
  Synthetic Polynucleotide
taatacgactcactatagggtatcctatcaaagacaggtttgtaattagtaacagaggagaactaatatgaaacctgtcaacctggcggcagcgcaaaagatg

SEQ ID NO: 50892 - DNA, 103 bp, Artificial Sequence
  Synthetic Polynucleotide
taatacgactcactataggggtatgtaaagatgaaaaagtaaattactataacagaggagaatagtaatgtactttttcaacctggcggcagcgcaaaagatg

SEQ ID NO: 50893 - DNA, 103 bp, Artificial Sequence
  Synthetic Polynucleotide
taatacgactcactatagggttatctatcctatcaaagacaggtttgtaaaacagaggagattacaaatgtgtctttgaaacctggcggcagcgcaaaagatg

SEQ ID NO: 50894 - DNA, 103 bp, Artificial Sequence
  Synthetic Polynucleotide
taatacgactcactatagggatgcgttatctatcctatcaaagacaggttaacagaggagaaacctgatgttgataggaaacctggcggcagcgcaaaagatg

SEQ ID NO: 50895 - DNA, 103 bp, Artificial Sequence
  Synthetic Polynucleotide
taatacgactcactatagggcattaatgcgttatctatcctatcaaagacaacagaggagagtctttatgaggatagataacctggcggcagcgcaaaagatg

SEQ ID NO: 50896 - DNA, 103 bp, Artificial Sequence
  Synthetic Polynucleotide
taatacgactcactatagggcttctcattaatgcgttatctatcctatcaaacagaggagatgatagatgagataacgcaacctggcggcagcgcaaaagatg

SEQ ID NO: 50897 - DNA, 103 bp, Artificial Sequence
  Synthetic Polynucleotide
taatacgactcactatagggcgattcttctcattaatgcgttatctatccaacagaggagaggatagatgacgcattaaaacctggcggcagcgcaaaagatg

SEQ ID NO: 50898 - DNA, 103 bp, Artificial Sequence
  Synthetic Polynucleotide
taatacgactcactatagggaacggcgattcttctcattaatgcgttatcaacagaggagagataacatgttaatgagaaacctggcggcagcgcaaaagatg

SEQ ID NO: 50899 - DNA, 103 bp, Artificial Sequence
  Synthetic Polynucleotide
taatacgactcactatagggcgcacaacggcgattcttctcattaatgcgaacagaggagacgcattatggagaagaataacctggcggcagcgcaaaagatg

SEQ ID NO: 50900 - DNA, 103 bp, Artificial Sequence
  Synthetic Polynucleotide
taatacgactcactatagggtgaatcgcacaacggcgattcttctcattaaacagaggagataatgaatggaatcgccgaacctggcggcagcgcaaaagatg

SEQ ID NO: 50901 - DNA, 103 bp, Artificial Sequence
  Synthetic Polynucleotide
taatacgactcactatagggtgttctgaatcgcacaacggcgattcttctaacagaggagaagaagaatggccgttgtgaacctggcggcagcgcaaaagatg

SEQ ID NO: 50902 - DNA, 103 bp, Artificial Sequence
  Synthetic Polynucleotide
taatacgactcactatagggaagtgtgttctgaatcgcacaacggcgattaacagaggagaaatcgcatgtgtgcgattaacctggcggcagcgcaaaagatg

SEQ ID NO: 50903 - DNA, 103 bp, Artificial Sequence
  Synthetic Polynucleotide
taatacgactcactataggggatccatgtaaaccaaggacgagataagacaacagaggagagtcttaatgcgtccttggaacctggcggcagcgcaaaagatg

SEQ ID NO: 50904 - DNA, 103 bp, Artificial Sequence
  Synthetic Polynucleotide
taatacgactcactatagggaccgagtatgtaaagatgaaaaagtaaattaacagaggagaaatttaatgtttcatcttaacctggcggcagcgcaaaagatg

SEQ ID NO: 50905 - DNA, 103 bp, Artificial Sequence
  Synthetic Polynucleotide
taatacgactcactataggggagaaaagtgtgttctgaatcgcacaacggaacagaggagaccgttgatggattcagaaaacctggcggcagcgcaaaagatg

SEQ ID NO: 50906 - DNA, 103 bp, Artificial Sequence
  Synthetic Polynucleotide
taatacgactcactatagggaggttgagaaaagtgtgttctgaatcgcacaacagaggagagtgcgaatgagaacacacaacctggcggcagcgcaaaagatg

SEQ ID NO: 50907 - DNA, 103 bp, Artificial Sequence
  Synthetic Polynucleotide
taatacgactcactatagggccagaaggttgagaaaagtgtgttctgaataacagaggagaattcagatgacacttttcaacctggcggcagcgcaaaagatg

SEQ ID NO: 50908 - DNA, 103 bp, Artificial Sequence
  Synthetic Polynucleotide
taatacgactcactatagggctctaccagaaggttgagaaaagtgtgttcaacagaggagagaacacatgtttctcaacaacctggcggcagcgcaaaagatg

SEQ ID NO: 50909 - DNA, 103 bp, Artificial Sequence
  Synthetic Polynucleotide
taatacgactcactatagggagcctctctaccagaaggttgagaaaagtgaacagaggagacactttatgcaaccttctaacctggcggcagcgcaaaagatg

SEQ ID NO: 50910 - DNA, 103 bp, Artificial Sequence
  Synthetic Polynucleotide
taatacgactcactatagggtcagcagcctctctaccagaaggttgagaaaacagaggagattctcaatgttctggtagaacctggcggcagcgcaaaagatg

SEQ ID NO: 50911 - DNA, 103 bp, Artificial Sequence
  Synthetic Polynucleotide
taatacgactcactatagggtattttcagcagcctctctaccagaaggttaacagaggagaaaccttatggtagagaggaacctggcggcagcgcaaaagatg

SEQ ID NO: 50912 - DNA, 103 bp, Artificial Sequence
  Synthetic Polynucleotide
taatacgactcactataggggtcattattttcagcagcctctctaccagaaacagaggagatctggtatggaggctgctaacctggcggcagcgcaaaagatg

SEQ ID NO: 50913 - DNA, 103 bp, Artificial Sequence
  Synthetic Polynucleotide
taatacgactcactatagggtacgcgtcattattttcagcagcctctctaaacagaggagatagagaatgtgctgaaaaaacctggcggcagcgcaaaagatg

SEQ ID NO: 50914 - DNA, 103 bp, Artificial Sequence
  Synthetic Polynucleotide
taatacgactcactatagggtatcgtacgcgtcattattttcagcagcctaacagaggagaaggctgatgaaaataatgaacctggcggcagcgcaaaagatg

SEQ ID NO: 50915 - DNA, 103 bp, Artificial Sequence
  Synthetic Polynucleotide
taatacgactcactatagggctagtaccgagtatgtaaagatgaaaaagtaacagaggagaacttttatgtctttacataacctggcggcagcgcaaaagatg

SEQ ID NO: 50916 - DNA, 103 bp, Artificial Sequence
  Synthetic Polynucleotide
taatacgactcactataggggactttatcgtacgcgtcattattttcagcaacagaggagagctgaaatgaatgacgcgaacctggcggcagcgcaaaagatg

SEQ ID NO: 50917 - DNA, 103 bp, Artificial Sequence
  Synthetic Polynucleotide
taatacgactcactatagggagtttgactttatcgtacgcgtcattatttaacagaggagaaaataaatgcgcgtacgaaacctggcggcagcgcaaaagatg

SEQ ID NO: 50918 - DNA, 103 bp, Artificial Sequence
  Synthetic Polynucleotide
taatacgactcactatagggctaatagtttgactttatcgtacgcgtcataacagaggagaatgacgatgacgataaagaacctggcggcagcgcaaaagatg

SEQ ID NO: 50919 - DNA, 103 bp, Artificial Sequence
  Synthetic Polynucleotide
taatacgactcactatagggctcgtctaatagtttgactttatcgtacgcaacagaggagagcgtacatgaaagtcaaaaacctggcggcagcgcaaaagatg

SEQ ID NO: 50920 - DNA, 103 bp, Artificial Sequence
  Synthetic Polynucleotide
taatacgactcactatagggaacccctcgtctaatagtttgactttatcgaacagaggagacgataaatgcaaactattaacctggcggcagcgcaaaagatg

SEQ ID NO: 50921 - DNA, 103 bp, Artificial Sequence
  Synthetic Polynucleotide
taatacgactcactatagggcatctaacccctcgtctaatagtttgacttaacagaggagaaagtcaatgtattagacgaacctggcggcagcgcaaaagatg

SEQ ID NO: 50922 - DNA, 103 bp, Artificial Sequence
  Synthetic Polynucleotide
taatacgactcactatagggtttaccatctaacccctcgtctaatagtttaacagaggagaaaactaatggacgaggggaacctggcggcagcgcaaaagatg

SEQ ID NO: 50923 - DNA, 103 bp, Artificial Sequence
  Synthetic Polynucleotide
taatacgactcactatagggtgtattttaccatctaacccctcgtctaataacagaggagaattagaatgggggttagaaacctggcggcagcgcaaaagatg

SEQ ID NO: 50924 - DNA, 103 bp, Artificial Sequence
  Synthetic Polynucleotide
taatacgactcactatagggtattttgtattttaccatctaacccctcgtaacagaggagaacgaggatgtagatggtaaacctggcggcagcgcaaaagatg

SEQ ID NO: 50925 - DNA, 103 bp, Artificial Sequence
  Synthetic Polynucleotide
taatacgactcactatagggtctattattttgtattttaccatctaacccaacagaggagagggttaatgggtaaaataaacctggcggcagcgcaaaagatg

SEQ ID NO: 50926 - DNA, 103 bp, Artificial Sequence
  Synthetic Polynucleotide
taatacgactcactatagggtaaaactagtaccgagtatgtaaagatgaaaacagaggagattcatcatgacatactcgaacctggcggcagcgcaaaagatg

SEQ ID NO: 50927 - DNA, 103 bp, Artificial Sequence
  Synthetic Polynucleotide
taatacgactcactatagggctatatctattattttgtattttaccatctaacagaggagaagatggatgaatacaaaaaacctggcggcagcgcaaaagatg

SEQ ID NO: 50928 - DNA, 103 bp, Artificial Sequence
  Synthetic Polynucleotide
taatacgactcactatagggcgaatctatatctattattttgtattttacaacagaggagagtaaaaatgaaaataataaacctggcggcagcgcaaaagatg

SEQ ID NO: 50929 - DNA, 103 bp, Artificial Sequence
  Synthetic Polynucleotide
taatacgactcactatagggaaatgcgaatctatatctattattttgtataacagaggagaatacaaatgaatagatataacctggcggcagcgcaaaagatg

SEQ ID NO: 50930 - DNA, 103 bp, Artificial Sequence
  Synthetic Polynucleotide
taatacgactcactatagggtatagaaatgcgaatctatatctattatttaacagaggagaaaataaatgatatagattaacctggcggcagcgcaaaagatg

SEQ ID NO: 50931 - DNA, 103 bp, Artificial Sequence
  Synthetic Polynucleotide
taatacgactcactatagggacaagtatagaaatgcgaatctatatctataacagaggagaatagatatggattcgcataacctggcggcagcgcaaaagatg

SEQ ID NO: 50932 - DNA, 103 bp, Artificial Sequence
  Synthetic Polynucleotide
taatacgactcactatagggcaccaacaagtatagaaatgcgaatctataaacagaggagatatagaatggcatttctaaacctggcggcagcgcaaaagatg

SEQ ID NO: 50933 - DNA, 103 bp, Artificial Sequence
  Synthetic Polynucleotide
taatacgactcactatagggcatttcaccaacaagtatagaaatgcgaataacagaggagaattcgcatgtctatacttaacctggcggcagcgcaaaagatg

SEQ ID NO: 50934 - DNA, 103 bp, Artificial Sequence
  Synthetic Polynucleotide
taatacgactcactatagggtgtaccatttcaccaacaagtatagaaatgaacagaggagacatttcatgacttgttggaacctggcggcagcgcaaaagatg

SEQ ID NO: 50935 - DNA, 103 bp, Artificial Sequence
  Synthetic Polynucleotide
taatacgactcactatagggttttctgtaccatttcaccaacaagtatagaacagaggagactatacatgttggtgaaaaacctggcggcagcgcaaaagatg

SEQ ID NO: 50936 - DNA, 103 bp, Artificial Sequence
  Synthetic Polynucleotide
taatacgactcactatagggtgatattttctgtaccatttcaccaacaagaacagaggagacttgttatggaaatggtaaacctggcggcagcgcaaaagatg

SEQ ID NO: 50937 - DNA, 103 bp, Artificial Sequence
  Synthetic Polynucleotide
taatacgactcactataggggatagtaaaactagtaccgagtatgtaaagaacagaggagactttacatgctcggtactaacctggcggcagcgcaaaagatg

SEQ ID NO: 50938 - DNA, 103 bp, Artificial Sequence
  Synthetic Polynucleotide
taatacgactcactataggggaacatgatattttctgtaccatttcaccaaacagaggagatggtgaatgggtacagaaaacctggcggcagcgcaaaagatg

SEQ ID NO: 50939 - DNA, 103 bp, Artificial Sequence
  Synthetic Polynucleotide
taatacgactcactatagggaataggaacatgatattttctgtaccatttaacagaggagaaaatggatgagaaaatataacctggcggcagcgcaaaagatg

SEQ ID NO: 50940 - DNA, 103 bp, Artificial Sequence
  Synthetic Polynucleotide
taatacgactcactatagggttcataataggaacatgatattttctgtacaacagaggagagtacagatgatatcatgtaacctggcggcagcgcaaaagatg

SEQ ID NO: 50941 - DNA, 103 bp, Artificial Sequence
  Synthetic Polynucleotide
taatacgactcactatagggatagtttcataataggaacatgatattttcaacagaggagagaaaatatgatgttcctaaacctggcggcagcgcaaaagatg

SEQ ID NO: 50942 - DNA, 103 bp, Artificial Sequence
  Synthetic Polynucleotide
taatacgactcactatagggaggatatagtttcataataggaacatgataaacagaggagatatcatatgcctattatgaacctggcggcagcgcaaaagatg

SEQ ID NO: 50943 - DNA, 103 bp, Artificial Sequence
  Synthetic Polynucleotide
taatacgactcactatagggggtgtaggatatagtttcataataggaacaaacagaggagatgttccatgtatgaaactaacctggcggcagcgcaaaagatg

SEQ ID NO: 50944 - DNA, 103 bp, Artificial Sequence
  Synthetic Polynucleotide
taatacgactcactatagggcttccggtgtaggatatagtttcataatagaacagaggagactattaatgaactatatcaacctggcggcagcgcaaaagatg

SEQ ID NO: 50945 - DNA, 103 bp, Artificial Sequence
  Synthetic Polynucleotide
taatacgactcactatagggaatctcttccggtgtaggatatagtttcataacagaggagaatgaaaatgtatcctacaaacctggcggcagcgcaaaagatg

SEQ ID NO: 50946 - DNA, 103 bp, Artificial Sequence
  Synthetic Polynucleotide
taatacgactcactatagggtcaggaatctcttccggtgtaggatatagtaacagaggagaactataatgtacaccggaaacctggcggcagcgcaaaagatg

SEQ ID NO: 50947 - DNA, 103 bp, Artificial Sequence
  Synthetic Polynucleotide
taatacgactcactatagggcaaagtcaggaatctcttccggtgtaggataacagaggagaatcctaatgcggaagagaaacctggcggcagcgcaaaagatg

SEQ ID NO: 50948 - DNA, 103 bp, Artificial Sequence
  Synthetic Polynucleotide
taatacgactcactatagggcttatgatagtaaaactagtaccgagtatgaacagaggagacatactatgtactagtttaacctggcggcagcgcaaaagatg

SEQ ID NO: 50949 - DNA, 103 bp, Artificial Sequence
  Synthetic Polynucleotide
taatacgactcactataggggaatgcaaagtcaggaatctcttccggtgtaacagaggagaacaccgatggagattcctaacctggcggcagcgcaaaagatg

SEQ ID NO: 50950 - DNA, 103 bp, Artificial Sequence
  Synthetic Polynucleotide
taatacgactcactatagggagatagaatgcaaagtcaggaatctcttccaacagaggagaggaagaatgtcctgacttaacctggcggcagcgcaaaagatg

SEQ ID NO: 50951 - DNA, 103 bp, Artificial Sequence
  Synthetic Polynucleotide
taatacgactcactatagggttttgagatagaatgcaaagtcaggaatctaacagaggagaagattcatgactttgcataacctggcggcagcgcaaaagatg

SEQ ID NO: 50952 - DNA, 103 bp, Artificial Sequence
  Synthetic Polynucleotide
taatacgactcactatagggacctattttgagatagaatgcaaagtcaggaacagaggagacctgacatggcattctataacctggcggcagcgcaaaagatg

SEQ ID NO: 50953 - DNA, 103 bp, Artificial Sequence
  Synthetic Polynucleotide
taatacgactcactatagggagagtacctattttgagatagaatgcaaagaacagaggagactttgcatgctatctcaaaacctggcggcagcgcaaaagatg

SEQ ID NO: 50954 - DNA, 103 bp, Artificial Sequence
  Synthetic Polynucleotide
taatacgactcactatagggctaacagagtacctattttgagatagaatgaacagaggagacattctatgtcaaaatagaacctggcggcagcgcaaaagatg

SEQ ID NO: 50955 - DNA, 103 bp, Artificial Sequence
  Synthetic Polynucleotide
taatacgactcactatagggagatactaacagagtacctattttgagataaacagaggagatatctcatgataggtactaacctggcggcagcgcaaaagatg

SEQ ID NO: 50956 - DNA, 103 bp, Artificial Sequence
  Synthetic Polynucleotide
taatacgactcactataggggagctagatactaacagagtacctattttgaacagaggagacaaaatatgtactctgttaacctggcggcagcgcaaaagatg

SEQ ID NO: 50957 - DNA, 103 bp, Artificial Sequence
  Synthetic Polynucleotide
taatacgactcactatagggttacagagctagatactaacagagtacctaaacagaggagataggtaatgtgttagtataacctggcggcagcgcaaaagatg

SEQ ID NO: 50958 - DNA, 103 bp, Artificial Sequence
  Synthetic Polynucleotide
taatacgactcactatagggatgctttacagagctagatactaacagagtaacagaggagaactctgatggtatctagcaacctggcggcagcgcaaaagatg

SEQ ID NO: 50959 - DNA, 103 bp, Artificial Sequence
  Synthetic Polynucleotide
taatacgactcactatagggataaacttatgatagtaaaactagtaccgaaacagaggagatcggtaatggttttactaaacctggcggcagcgcaaaagatg

SEQ ID NO: 50960 - DNA, 103 bp, Artificial Sequence
  Synthetic Polynucleotide
taatacgactcactatagggggaatatgctttacagagctagatactaacaacagaggagagttagtatgtagctctgtaacctggcggcagcgcaaaagatg

SEQ ID NO: 50961 - DNA, 103 bp, Artificial Sequence
  Synthetic Polynucleotide
taatacgactcactatagggttaatggaatatgctttacagagctagataaacagaggagatatctaatgctgtaaagcaacctggcggcagcgcaaaagatg

SEQ ID NO: 50962 - DNA, 103 bp, Artificial Sequence
  Synthetic Polynucleotide
taatacgactcactatagggcgtcattaatggaatatgctttacagagctaacagaggagaagctctatgaagcatattaacctggcggcagcgcaaaagatg

SEQ ID NO: 50963 - DNA, 103 bp, Artificial Sequence
  Synthetic Polynucleotide
taatacgactcactatagggaggtccgtcattaatggaatatgctttacaaacagaggagatgtaaaatgtattccattaacctggcggcagcgcaaaagatg

SEQ ID NO: 50964 - DNA, 103 bp, Artificial Sequence
  Synthetic Polynucleotide
taatacgactcactatagggtggagaggtccgtcattaatggaatatgctaacagaggagaagcataatgcattaatgaaacctggcggcagcgcaaaagatg

SEQ ID NO: 50965 - DNA, 103 bp, Artificial Sequence
  Synthetic Polynucleotide
taatacgactcactatagggctttttggagaggtccgtcattaatggaataacagaggagaattccaatgatgacggacaacctggcggcagcgcaaaagatg

SEQ ID NO: 50966 - DNA, 103 bp, Artificial Sequence
  Synthetic Polynucleotide
taatacgactcactatagggtatccctttttggagaggtccgtcattaataacagaggagaattaatatgggacctctcaacctggcggcagcgcaaaagatg

SEQ ID NO: 50967 - DNA, 103 bp, Artificial Sequence
  Synthetic Polynucleotide
taatacgactcactatagggatatatatccctttttggagaggtccgtcaaacagaggagatgacggatgtctccaaaaaacctggcggcagcgcaaaagatg

SEQ ID NO: 50968 - DNA, 103 bp, Artificial Sequence
  Synthetic Polynucleotide
taatacgactcactataggggtgcaatatatatccctttttggagaggtcaacagaggagagacctcatgaaaaagggaaacctggcggcagcgcaaaagatg

SEQ ID NO: 50969 - DNA, 103 bp, Artificial Sequence
  Synthetic Polynucleotide
taatacgactcactatagggttatcgtgcaatatatatccctttttggagaacagaggagactccaaatggggatatataacctggcggcagcgcaaaagatg

SEQ ID NO: 50970 - DNA, 103 bp, Artificial Sequence
  Synthetic Polynucleotide
taatacgactcactatagggaatttataaacttatgatagtaaaactagtaacagaggagaactagtatgactatcataaacctggcggcagcgcaaaagatg

SEQ ID NO: 50971 - DNA, 103 bp, Artificial Sequence
  Synthetic Polynucleotide
taatacgactcactatagggccacattatcgtgcaatatatatcccttttaacagaggagaaaaaggatgatatattgcaacctggcggcagcgcaaaagatg

SEQ ID NO: 50972 - DNA, 103 bp, Artificial Sequence
  Synthetic Polynucleotide
taatacgactcactatagggagtaaccacattatcgtgcaatatatatccaacagaggagaggatatatgttgcacgataacctggcggcagcgcaaaagatg

SEQ ID NO: 50973 - DNA, 103 bp, Artificial Sequence
  Synthetic Polynucleotide
taatacgactcactatagggggaagagtaaccacattatcgtgcaatataaacagaggagatatattatgcgataatgtaacctggcggcagcgcaaaagatg

SEQ ID NO: 50974 - DNA, 103 bp, Artificial Sequence
  Synthetic Polynucleotide
taatacgactcactatagggtcaacggaagagtaaccacattatcgtgcaaacagaggagatgcacgatgatgtggttaaacctggcggcagcgcaaaagatg

SEQ ID NO: 50975 - DNA, 103 bp, Artificial Sequence
  Synthetic Polynucleotide
taatacgactcactatagggagtagtcaacggaagagtaaccacattatcaacagaggagagataatatggttactcttaacctggcggcagcgcaaaagatg

SEQ ID NO: 50976 - DNA, 103 bp, Artificial Sequence
  Synthetic Polynucleotide
taatacgactcactatagggtggaaagtagtcaacggaagagtaaccacaaacagaggagatgtggtatgtcttccgttaacctggcggcagcgcaaaagatg

SEQ ID NO: 50977 - DNA, 103 bp, Artificial Sequence
  Synthetic Polynucleotide
taatacgactcactatagggtctgttggaaagtagtcaacggaagagtaaaacagaggagattactcatgcgttgactaaacctggcggcagcgcaaaagatg

SEQ ID NO: 50978 - DNA, 103 bp, Artificial Sequence
  Synthetic Polynucleotide
taatacgactcactatagggtattttctgttggaaagtagtcaacggaagaacagaggagacttccgatgactactttcaacctggcggcagcgcaaaagatg

SEQ ID NO: 50979 - DNA, 103 bp, Artificial Sequence
  Synthetic Polynucleotide
taatacgactcactatagggttggatattttctgttggaaagtagtcaacaacagaggagagttgacatgtttccaacaaacctggcggcagcgcaaaagatg

SEQ ID NO: 50980 - DNA, 103 bp, Artificial Sequence
  Synthetic Polynucleotide
taatacgactcactatagggaatacttggatattttctgttggaaagtagaacagaggagactacttatgaacagaaaaaacctggcggcagcgcaaaagatg

SEQ ID NO: 50981 - DNA, 103 bp, Artificial Sequence
  Synthetic Polynucleotide
taatacgactcactatagggtgtggaatttataaacttatgatagtaaaaaacagaggagattttacatgcataagtttaacctggcggcagcgcaaaagatg

SEQ ID NO: 50982 - DNA, 103 bp, Artificial Sequence
  Synthetic Polynucleotide
taatacgactcactatagggattaaaatacttggatattttctgttggaaaacagaggagattccaaatgaaaatatccaacctggcggcagcgcaaaagatg

SEQ ID NO: 50983 - DNA, 103 bp, Artificial Sequence
  Synthetic Polynucleotide
taatacgactcactatagggctagaattaaaatacttggatattttctgtaacagaggagaacagaaatgatccaagtaaacctggcggcagcgcaaaagatg

SEQ ID NO: 50984 - DNA, 103 bp, Artificial Sequence
  Synthetic Polynucleotide
taatacgactcactatagggatagtctagaattaaaatacttggatatttaacagaggagaaaatatatgagtattttaaacctggcggcagcgcaaaagatg

SEQ ID NO: 50985 - DNA, 103 bp, Artificial Sequence
  Synthetic Polynucleotide
taatacgactcactatagggtccaaatagtctagaattaaaatacttggaaacagaggagatccaagatgtttaattctaacctggcggcagcgcaaaagatg

SEQ ID NO: 50986 - DNA, 103 bp, Artificial Sequence
  Synthetic Polynucleotide
taatacgactcactatagggtcgtgtccaaatagtctagaattaaaatacaacagaggagagtatttatgttctagactaacctggcggcagcgcaaaagatg

SEQ ID NO: 50987 - DNA, 103 bp, Artificial Sequence
  Synthetic Polynucleotide
taatacgactcactatagggctatgtcgtgtccaaatagtctagaattaaaacagaggagattaattatggactatttgaacctggcggcagcgcaaaagatg

SEQ ID NO: 50988 - DNA, 103 bp, Artificial Sequence
  Synthetic Polynucleotide
taatacgactcactataggggctctctatgtcgtgtccaaatagtctagaaacagaggagatctagaatgtttggacacaacctggcggcagcgcaaaagatg

SEQ ID NO: 50989 - DNA, 103 bp, Artificial Sequence
  Synthetic Polynucleotide
taatacgactcactatagggatgaagctctctatgtcgtgtccaaatagtaacagaggagaactattatgacacgacataacctggcggcagcgcaaaagatg

SEQ ID NO: 50990 - DNA, 103 bp, Artificial Sequence
  Synthetic Polynucleotide
taatacgactcactatagggtattgatgaagctctctatgtcgtgtccaaaacagaggagattggacatgacatagagaaacctggcggcagcgcaaaagatg

SEQ ID NO: 50991 - DNA, 103 bp, Artificial Sequence
  Synthetic Polynucleotide
taatacgactcactatagggatgtctattgatgaagctctctatgtcgtgaacagaggagacacgacatggagagcttcaacctggcggcagcgcaaaagatg

SEQ ID NO: 50992 - DNA, 103 bp, Artificial Sequence
  Synthetic Polynucleotide
taatacgactcactatagggtagcttgtggaatttataaacttatgatagaacagaggagactatcaatggtttataaaaacctggcggcagcgcaaaagatg

SEQ ID NO: 50993 - DNA, 103 bp, Artificial Sequence
  Synthetic Polynucleotide
taatacgactcactatagggttcttatgtctattgatgaagctctctatgaacagaggagacatagaatgcttcatcaaaacctggcggcagcgcaaaagatg

SEQ ID NO: 50994 - DNA, 103 bp, Artificial Sequence
  Synthetic Polynucleotide
taatacgactcactatagggcaaatttcttatgtctattgatgaagctctaacagaggagaagagctatgtcaatagacaacctggcggcagcgcaaaagatg

SEQ ID NO: 50995 - DNA, 103 bp, Artificial Sequence
  Synthetic Polynucleotide
taatacgactcactatagggattggcaaatttcttatgtctattgatgaaaacagaggagattcatcatgagacataagaacctggcggcagcgcaaaagatg

SEQ ID NO: 50996 - DNA, 103 bp, Artificial Sequence
  Synthetic Polynucleotide
taatacgactcactatagggctaacattggcaaatttcttatgtctattgaacagaggagacaatagatgtaagaaattaacctggcggcagcgcaaaagatg

SEQ ID NO: 50997 - DNA, 103 bp, Artificial Sequence
  Synthetic Polynucleotide
taatacgactcactatagggcatcactaacattggcaaatttcttatgtcaacagaggagagacataatgaatttgccaaacctggcggcagcgcaaaagatg

SEQ ID NO: 50998 - DNA, 103 bp, Artificial Sequence
  Synthetic Polynucleotide
taatacgactcactatagggatattcatcactaacattggcaaatttcttaacagaggagaaagaaaatggccaatgttaacctggcggcagcgcaaaagatg

SEQ ID NO: 50999 - DNA, 103 bp, Artificial Sequence
  Synthetic Polynucleotide
taatacgactcactatagggtgtagatattcatcactaacattggcaaataacagaggagaatttgcatgtgttagtgaaacctggcggcagcgcaaaagatg

SEQ ID NO: 51000 - DNA, 103 bp, Artificial Sequence
  Synthetic Polynucleotide
taatacgactcactatagggtatattgtagatattcatcactaacattggaacagaggagaccaatgatggtgatgaataacctggcggcagcgcaaaagatg

SEQ ID NO: 51001 - DNA, 103 bp, Artificial Sequence
  Synthetic Polynucleotide
taatacgactcactataggggaatatatattgtagatattcatcactaacaacagaggagagttagtatggaatatctaaacctggcggcagcgcaaaagatg

SEQ ID NO: 51002 - DNA, 103 bp, Artificial Sequence
  Synthetic Polynucleotide
taatacgactcactatagggtctatgaatatatattgtagatattcatcaaacagaggagatgatgaatgtctacaataaacctggcggcagcgcaaaagatg

SEQ ID NO: 51003 - DNA, 103 bp, Artificial Sequence
  Synthetic Polynucleotide
taatacgactcactatagggcatagtagcttgtggaatttataaacttataacagaggagaataagtatgtaaattccaaacctggcggcagcgcaaaagatg

SEQ ID NO: 51004 - DNA, 103 bp, Artificial Sequence
  Synthetic Polynucleotide
taatacgactcactatagggtatcctctatgaatatatattgtagatattaacagaggagaaatatcatgaatatatataacctggcggcagcgcaaaagatg

SEQ ID NO: 51005 - DNA, 103 bp, Artificial Sequence
  Synthetic Polynucleotide
taatacgactcactatagggtgaaatatcctctatgaatatatattgtagaacagaggagactacaaatgatattcataaacctggcggcagcgcaaaagatg

SEQ ID NO: 51006 - DNA, 103 bp, Artificial Sequence
  Synthetic Polynucleotide
taatacgactcactatagggggagatgaaatatcctctatgaatatatataacagaggagaatatatatgcatagaggaaacctggcggcagcgcaaaagatg

SEQ ID NO: 51007 - DNA, 103 bp, Artificial Sequence
  Synthetic Polynucleotide
taatacgactcactatagggtttacggagatgaaatatcctctatgaataaacagaggagatattcaatgaggatatttaacctggcggcagcgcaaaagatg

SEQ ID NO: 51008 - DNA, 103 bp, Artificial Sequence
  Synthetic Polynucleotide
taatacgactcactatagggatatatttacggagatgaaatatcctctataacagaggagaatagagatgatttcatctaacctggcggcagcgcaaaagatg

SEQ ID NO: 51009 - DNA, 103 bp, Artificial Sequence
  Synthetic Polynucleotide
taatacgactcactatagggtgagcatatatttacggagatgaaatatccaacagaggagaggatatatgatctccgtaaacctggcggcagcgcaaaagatg

SEQ ID NO: 51010 - DNA, 103 bp, Artificial Sequence
  Synthetic Polynucleotide
taatacgactcactatagggatatatgagcatatatttacggagatgaaaaacagaggagatttcatatgcgtaaatataacctggcggcagcgcaaaagatg

SEQ ID NO: 51011 - DNA, 103 bp, Artificial Sequence
  Synthetic Polynucleotide
taatacgactcactatagggtataaatatatgagcatatatttacggagaaacagaggagatctccgatgatatatgctaacctggcggcagcgcaaaagatg

SEQ ID NO: 51012 - DNA, 103 bp, Artificial Sequence
  Synthetic Polynucleotide
taatacgactcactatagggtcttctataaatatatgagcatatatttacaacagaggagagtaaatatgtgctcatataacctggcggcagcgcaaaagatg

SEQ ID NO: 51013 - DNA, 103 bp, Artificial Sequence
  Synthetic Polynucleotide
taatacgactcactatagggtaatatcttctataaatatatgagcatataaacagaggagatatatgatgatatatttaaacctggcggcagcgcaaaagatg

SEQ ID NO: 51014 - DNA, 103 bp, Artificial Sequence
  Synthetic Polynucleotide
taatacgactcactatagggacactgatccatgtaaaccaaggacgagataacagaggagaatctcgatgttggtttacaacctggcggcagcgcaaaagatg

SEQ ID NO: 51015 - DNA, 103 bp, Artificial Sequence
  Synthetic Polynucleotide
taatacgactcactatagggtattccatagtagcttgtggaatttataaaaacagaggagatttataatgtccacaagcaacctggcggcagcgcaaaagatg

SEQ ID NO: 51016 - DNA, 103 bp, Artificial Sequence
  Synthetic Polynucleotide
taatacgactcactatagggatatgtaatatcttctataaatatatgagcaacagaggagagctcatatgtttatagaaaacctggcggcagcgcaaaagatg

SEQ ID NO: 51017 - DNA, 103 bp, Artificial Sequence
  Synthetic Polynucleotide
taatacgactcactatagggtttagatatgtaatatcttctataaatataaacagaggagatatattatgagaagatataacctggcggcagcgcaaaagatg

SEQ ID NO: 51018 - DNA, 103 bp, Artificial Sequence
  Synthetic Polynucleotide
taatacgactcactatagggattcatttagatatgtaatatcttctataaaacagaggagattatagatgatattacataacctggcggcagcgcaaaagatg

SEQ ID NO: 51019 - DNA, 103 bp, Artificial Sequence
  Synthetic Polynucleotide
taatacgactcactatagggccggtattcatttagatatgtaatatcttcaacagaggagagaagatatgacatatctaaacctggcggcagcgcaaaagatg

SEQ ID NO: 51020 - DNA, 103 bp, Artificial Sequence
  Synthetic Polynucleotide
taatacgactcactatagggtgattccggtattcatttagatatgtaataaacagaggagatattacatgtctaaatgaaacctggcggcagcgcaaaagatg

SEQ ID NO: 51021 - DNA, 103 bp, Artificial Sequence
  Synthetic Polynucleotide
taatacgactcactatagggatctatgattccggtattcatttagatatgaacagaggagacatatcatgatgaataccaacctggcggcagcgcaaaagatg

SEQ ID NO: 51022 - DNA, 103 bp, Artificial Sequence
  Synthetic Polynucleotide
taatacgactcactatagggaataaatctatgattccggtattcatttagaacagaggagactaaatatgtaccggaataacctggcggcagcgcaaaagatg

SEQ ID NO: 51023 - DNA, 103 bp, Artificial Sequence
  Synthetic Polynucleotide
taatacgactcactatagggtatcaaataaatctatgattccggtattcaaacagaggagatgaataatggaatcatagaacctggcggcagcgcaaaagatg

SEQ ID NO: 51024 - DNA, 103 bp, Artificial Sequence
  Synthetic Polynucleotide
taatacgactcactatagggatgattatcaaataaatctatgattccggtaacagaggagaaccggaatgatagatttaaacctggcggcagcgcaaaagatg

SEQ ID NO: 51025 - DNA, 103 bp, Artificial Sequence
  Synthetic Polynucleotide
taatacgactcactatagggtcaacatgattatcaaataaatctatgattaacagaggagaaatcatatgtttatttgaaacctggcggcagcgcaaaagatg

SEQ ID NO: 51026 - DNA, 103 bp, Artificial Sequence
  Synthetic Polynucleotide
taatacgactcactatagggtggtatattccatagtagcttgtggaatttaacagaggagaaaattcatgaagctactaaacctggcggcagcgcaaaagatg

SEQ ID NO: 51027 - DNA, 103 bp, Artificial Sequence
  Synthetic Polynucleotide
taatacgactcactatagggtactatcaacatgattatcaaataaatctaaacagaggagatagattatgttgataatcaacctggcggcagcgcaaaagatg

SEQ ID NO: 51028 - DNA, 103 bp, Artificial Sequence
  Synthetic Polynucleotide
taatacgactcactatagggtggtatactatcaacatgattatcaaataaaacagaggagattatttatgaatcatgttaacctggcggcagcgcaaaagatg

SEQ ID NO: 51029 - DNA, 103 bp, Artificial Sequence
  Synthetic Polynucleotide
taatacgactcactatagggatagttggtatactatcaacatgattatcaaacagaggagatgataaatgtgttgatagaacctggcggcagcgcaaaagatg

SEQ ID NO: 51030 - DNA, 103 bp, Artificial Sequence
  Synthetic Polynucleotide
taatacgactcactataggggtaatatagttggtatactatcaacatgataacagaggagaatcatgatgatagtatacaacctggcggcagcgcaaaagatg

SEQ ID NO: 51031 - DNA, 103 bp, Artificial Sequence
  Synthetic Polynucleotide
taatacgactcactatagggatgaggtaatatagttggtatactatcaacaacagaggagagttgatatgataccaactaacctggcggcagcgcaaaagatg

SEQ ID NO: 51032 - DNA, 103 bp, Artificial Sequence
  Synthetic Polynucleotide
taatacgactcactatagggaactgatgaggtaatatagttggtatactaaacagaggagatagtatatgaactatattaacctggcggcagcgcaaaagatg

SEQ ID NO: 51033 - DNA, 103 bp, Artificial Sequence
  Synthetic Polynucleotide
taatacgactcactatagggtagctaactgatgaggtaatatagttggtaaacagaggagataccaaatgtattacctcaacctggcggcagcgcaaaagatg

SEQ ID NO: 51034 - DNA, 103 bp, Artificial Sequence
  Synthetic Polynucleotide
taatacgactcactatagggtagagtagctaactgatgaggtaatatagtaacagaggagaactataatgcctcatcagaacctggcggcagcgcaaaagatg

SEQ ID NO: 51035 - DNA, 103 bp, Artificial Sequence
  Synthetic Polynucleotide
taatacgactcactatagggtaatctagagtagctaactgatgaggtaataacagaggagaattaccatgtcagttagcaacctggcggcagcgcaaaagatg

SEQ ID NO: 51036 - DNA, 103 bp, Artificial Sequence
  Synthetic Polynucleotide
taatacgactcactatagggctagataatctagagtagctaactgatgagaacagaggagactcatcatgtagctactcaacctggcggcagcgcaaaagatg

SEQ ID NO: 51037 - DNA, 103 bp, Artificial Sequence
  Synthetic Polynucleotide
taatacgactcactatagggatggttggtatattccatagtagcttgtggaacagaggagaccacaaatgactatggaaaacctggcggcagcgcaaaagatg

SEQ ID NO: 51038 - DNA, 103 bp, Artificial Sequence
  Synthetic Polynucleotide
taatacgactcactatagggtctgactagataatctagagtagctaactgaacagaggagacagttaatgactctagataacctggcggcagcgcaaaagatg

SEQ ID NO: 51039 - DNA, 103 bp, Artificial Sequence
  Synthetic Polynucleotide
taatacgactcactatagggatagttctgactagataatctagagtagctaacagaggagaagctacatgagattatctaacctggcggcagcgcaaaagatg

SEQ ID NO: 51040 - DNA, 103 bp, Artificial Sequence
  Synthetic Polynucleotide
taatacgactcactatagggctatgatagttctgactagataatctagagaacagaggagactctagatgatctagtcaaacctggcggcagcgcaaaagatg

SEQ ID NO: 51041 - DNA, 103 bp, Artificial Sequence
  Synthetic Polynucleotide
taatacgactcactatagggctcatctatgatagttctgactagataatcaacagaggagagattatatggtcagaactaacctggcggcagcgcaaaagatg

SEQ ID NO: 51042 - DNA, 103 bp, Artificial Sequence
  Synthetic Polynucleotide
taatacgactcactatagggctgttctcatctatgatagttctgactagaaacagaggagatctagtatgaactatcataacctggcggcagcgcaaaagatg

SEQ ID NO: 51043 - DNA, 103 bp, Artificial Sequence
  Synthetic Polynucleotide
taatacgactcactatagggcgcttctgttctcatctatgatagttctgaaacagaggagatcagaaatgtcatagatgaacctggcggcagcgcaaaagatg

SEQ ID NO: 51044 - DNA, 103 bp, Artificial Sequence
  Synthetic Polynucleotide
taatacgactcactatagggtaacacgcttctgttctcatctatgatagtaacagaggagaactatcatggatgagaacaacctggcggcagcgcaaaagatg

SEQ ID NO: 51045 - DNA, 103 bp, Artificial Sequence
  Synthetic Polynucleotide
taatacgactcactatagggaacaataacacgcttctgttctcatctatgaacagaggagacatagaatggaacagaagaacctggcggcagcgcaaaagatg

SEQ ID NO: 51046 - DNA, 103 bp, Artificial Sequence
  Synthetic Polynucleotide
taatacgactcactatagggtatggaacaataacacgcttctgttctcataacagaggagaatgagaatggaagcgtgtaacctggcggcagcgcaaaagatg

SEQ ID NO: 51047 - DNA, 103 bp, Artificial Sequence
  Synthetic Polynucleotide
taatacgactcactatagggcataatatggaacaataacacgcttctgttaacagaggagaaacagaatggtgttattgaacctggcggcagcgcaaaagatg

SEQ ID NO: 51048 - DNA, 103 bp, Artificial Sequence
  Synthetic Polynucleotide
taatacgactcactatagggctaagatggttggtatattccatagtagctaacagaggagaagctacatgggaatatacaacctggcggcagcgcaaaagatg

SEQ ID NO: 51049 - DNA, 103 bp, Artificial Sequence
  Synthetic Polynucleotide
taatacgactcactataggggatcccataatatggaacaataacacgcttaacagaggagaaagcgtatgattgttccaaacctggcggcagcgcaaaagatg

SEQ ID NO: 51050 - DNA, 103 bp, Artificial Sequence
  Synthetic Polynucleotide
taatacgactcactatagggtacctgatcccataatatggaacaataacaaacagaggagatgttatatgtccatattaaacctggcggcagcgcaaaagatg

SEQ ID NO: 51051 - DNA, 103 bp, Artificial Sequence
  Synthetic Polynucleotide
taatacgactcactatagggtgttttacctgatcccataatatggaacaaaacagaggagattgttcatgattatgggaaacctggcggcagcgcaaaagatg

SEQ ID NO: 51052 - DNA, 103 bp, Artificial Sequence
  Synthetic Polynucleotide
taatacgactcactatagggattattgttttacctgatcccataatatggaacagaggagaccatatatggggatcaggaacctggcggcagcgcaaaagatg

SEQ ID NO: 51053 - DNA, 103 bp, Artificial Sequence
  Synthetic Polynucleotide
taatacgactcactatagggaagcgattattgttttacctgatcccataaaacagaggagattatggatgcaggtaaaaaacctggcggcagcgcaaaagatg

SEQ ID NO: 51054 - DNA, 103 bp, Artificial Sequence
  Synthetic Polynucleotide
taatacgactcactatagggcaacaaagcgattattgttttacctgatccaacagaggagaggatcaatgaaaacaataaacctggcggcagcgcaaaagatg

SEQ ID NO: 51055 - DNA, 103 bp, Artificial Sequence
  Synthetic Polynucleotide
taatacgactcactataggggcgaacaacaaagcgattattgttttacctaacagaggagaaggtaaatgaataatcgcaacctggcggcagcgcaaaagatg

SEQ ID NO: 51056 - DNA, 103 bp, Artificial Sequence
  Synthetic Polynucleotide
taatacgactcactatagggtcaaggcgaacaacaaagcgattattgtttaacagaggagaaaacaaatgtcgctttgtaacctggcggcagcgcaaaagatg

SEQ ID NO: 51057 - DNA, 103 bp, Artificial Sequence
  Synthetic Polynucleotide
taatacgactcactatagggagctatcaaggcgaacaacaaagcgattataacagaggagaataatcatgttgttgttcaacctggcggcagcgcaaaagatg

SEQ ID NO: 51058 - DNA, 103 bp, Artificial Sequence
  Synthetic Polynucleotide
taatacgactcactatagggctggaagctatcaaggcgaacaacaaagcgaacagaggagacgctttatggttcgccttaacctggcggcagcgcaaaagatg

SEQ ID NO: 51059 - DNA, 103 bp, Artificial Sequence
  Synthetic Polynucleotide
taatacgactcactatagggctatactaagatggttggtatattccatagaacagaggagactatggatgataccaaccaacctggcggcagcgcaaaagatg

SEQ ID NO: 51060 - DNA, 103 bp, Artificial Sequence
  Synthetic Polynucleotide
taatacgactcactatagggtaaatctggaagctatcaaggcgaacaacaaacagaggagatgttgtatgccttgatagaacctggcggcagcgcaaaagatg

SEQ ID NO: 51061 - DNA, 103 bp, Artificial Sequence
  Synthetic Polynucleotide
taatacgactcactatagggctttttaaatctggaagctatcaaggcgaaaacagaggagattcgccatgatagcttccaacctggcggcagcgcaaaagatg

SEQ ID NO: 51062 - DNA, 103 bp, Artificial Sequence
  Synthetic Polynucleotide
taatacgactcactatagggtgaacctttttaaatctggaagctatcaagaacagaggagacttgatatgttccagattaacctggcggcagcgcaaaagatg

SEQ ID NO: 51063 - DNA, 103 bp, Artificial Sequence
  Synthetic Polynucleotide
taatacgactcactataggggaatgtgaacctttttaaatctggaagctaaacagaggagatagcttatggatttaaaaaacctggcggcagcgcaaaagatg

SEQ ID NO: 51064 - DNA, 103 bp, Artificial Sequence
  Synthetic Polynucleotide
taatacgactcactatagggcactagaatgtgaacctttttaaatctggaaacagaggagatccagaatgaaaaaggttaacctggcggcagcgcaaaagatg

SEQ ID NO: 51065 - DNA, 103 bp, Artificial Sequence
  Synthetic Polynucleotide
taatacgactcactatagggttcggcactagaatgtgaacctttttaaataacagaggagaatttaaatgggttcacataacctggcggcagcgcaaaagatg

SEQ ID NO: 51066 - DNA, 103 bp, Artificial Sequence
  Synthetic Polynucleotide
taatacgactcactatagggtaatgttcggcactagaatgtgaaccttttaacagaggagaaaaaggatgacattctagaacctggcggcagcgcaaaagatg

SEQ ID NO: 51067 - DNA, 103 bp, Artificial Sequence
  Synthetic Polynucleotide
taatacgactcactatagggaatgttaatgttcggcactagaatgtgaacaacagaggagagttcacatgctagtgccgaacctggcggcagcgcaaaagatg

SEQ ID NO: 51068 - DNA, 103 bp, Artificial Sequence
  Synthetic Polynucleotide
taatacgactcactatagggttcaaaatgttaatgttcggcactagaatgaacagaggagacattctatggccgaacataacctggcggcagcgcaaaagatg

SEQ ID NO: 51069 - DNA, 103 bp, Artificial Sequence
  Synthetic Polynucleotide
taatacgactcactatagggaaattttcaaaatgttaatgttcggcactaaacagaggagatagtgcatgacattaacaaacctggcggcagcgcaaaagatg

SEQ ID NO: 51070 - DNA, 103 bp, Artificial Sequence
  Synthetic Polynucleotide
taatacgactcactataggggtgttctatactaagatggttggtatattcaacagaggagagaatatatgaaccatcttaacctggcggcagcgcaaaagatg

SEQ ID NO: 51071 - DNA, 103 bp, Artificial Sequence
  Synthetic Polynucleotide
taatacgactcactatagggattaaaaattttcaaaatgttaatgttcggaacagaggagaccgaacatgaacattttgaacctggcggcagcgcaaaagatg

SEQ ID NO: 51072 - DNA, 103 bp, Artificial Sequence
  Synthetic Polynucleotide
taatacgactcactatagggttataattaaaaattttcaaaatgttaatgaacagaggagacattaaatgtttgaaaataacctggcggcagcgcaaaagatg

SEQ ID NO: 51073 - DNA, 103 bp, Artificial Sequence
  Synthetic Polynucleotide
taatacgactcactatagggccatattataattaaaaattttcaaaatgtaacagaggagaacatttatgaaatttttaaacctggcggcagcgcaaaagatg

SEQ ID NO: 51074 - DNA, 103 bp, Artificial Sequence
  Synthetic Polynucleotide
taatacgactcactatagggtacacccatattataattaaaaattttcaaaacagaggagattgaaaatgtttaattataacctggcggcagcgcaaaagatg

SEQ ID NO: 51075 - DNA, 103 bp, Artificial Sequence
  Synthetic Polynucleotide
taatacgactcactatagggatagctacacccatattataattaaaaattaacagaggagaaattttatgttataatataacctggcggcagcgcaaaagatg

SEQ ID NO: 51076 - DNA, 103 bp, Artificial Sequence
  Synthetic Polynucleotide
taatacgactcactatagggagttcatagctacacccatattataattaaaacagaggagattaattatgatatgggtgaacctggcggcagcgcaaaagatg

SEQ ID NO: 51077 - DNA, 103 bp, Artificial Sequence
  Synthetic Polynucleotide
taatacgactcactatagggaaacaagttcatagctacacccatattataaacagaggagatataatatgggtgtagctaacctggcggcagcgcaaaagatg

SEQ ID NO: 51078 - DNA, 103 bp, Artificial Sequence
  Synthetic Polynucleotide
taatacgactcactatagggtcattaaacaagttcatagctacacccataaacagaggagatatgggatgagctatgaaaacctggcggcagcgcaaaagatg

SEQ ID NO: 51079 - DNA, 103 bp, Artificial Sequence
  Synthetic Polynucleotide
taatacgactcactatagggattcatcattaaacaagttcatagctacacaacagaggagagtgtagatgtgaacttgtaacctggcggcagcgcaaaagatg

SEQ ID NO: 51080 - DNA, 103 bp, Artificial Sequence
  Synthetic Polynucleotide
taatacgactcactatagggtatgaattcatcattaaacaagttcatagcaacagaggagagctatgatgttgtttaataacctggcggcagcgcaaaagatg

SEQ ID NO: 51081 - DNA, 103 bp, Artificial Sequence
  Synthetic Polynucleotide
taatacgactcactataggggacatgtgttctatactaagatggttggtaaacagaggagataccaaatgtcttagtataacctggcggcagcgcaaaagatg

SEQ ID NO: 51082 - DNA, 103 bp, Artificial Sequence
  Synthetic Polynucleotide
taatacgactcactatagggtcagctatgaattcatcattaaacaagttcaacagaggagagaacttatgtaatgatgaaacctggcggcagcgcaaaagatg

SEQ ID NO: 51083 - DNA, 103 bp, Artificial Sequence
  Synthetic Polynucleotide
taatacgactcactatagggtattctcagctatgaattcatcattaaacaaacagaggagatgtttaatgatgaattcaaacctggcggcagcgcaaaagatg

SEQ ID NO: 51084 - DNA, 103 bp, Artificial Sequence
  Synthetic Polynucleotide
taatacgactcactatagggaaagatattctcagctatgaattcatcattaacagaggagaaatgatatgttcatagctaacctggcggcagcgcaaaagatg

SEQ ID NO: 51085 - DNA, 103 bp, Artificial Sequence
  Synthetic Polynucleotide
taatacgactcactatagggtgaataaagatattctcagctatgaattcaaacagaggagatgaattatgagctgagaaaacctggcggcagcgcaaaagatg

SEQ ID NO: 51086 - DNA, 103 bp, Artificial Sequence
  Synthetic Polynucleotide
taatacgactcactatagggttgaatgaataaagatattctcagctatgaaacagaggagatcatagatgagaatatctaacctggcggcagcgcaaaagatg

SEQ ID NO: 51087 - DNA, 103 bp, Artificial Sequence
  Synthetic Polynucleotide
taatacgactcactatagggtgttgttgaatgaataaagatattctcagcaacagaggagagctgagatgatctttattaacctggcggcagcgcaaaagatg

SEQ ID NO: 51088 - DNA, 103 bp, Artificial Sequence
  Synthetic Polynucleotide
taatacgactcactatagggaaacttgttgttgaatgaataaagatattcaacagaggagagaatatatgtattcattcaacctggcggcagcgcaaaagatg

SEQ ID NO: 51089 - DNA, 103 bp, Artificial Sequence
  Synthetic Polynucleotide
taatacgactcactatagggaataaaaacttgttgttgaatgaataaagaaacagaggagatctttaatgattcaacaaaacctggcggcagcgcaaaagatg

SEQ ID NO: 51090 - DNA, 103 bp, Artificial Sequence
  Synthetic Polynucleotide
taatacgactcactatagggaagagaataaaaacttgttgttgaatgaataacagaggagaattcatatgacaacaagtaacctggcggcagcgcaaaagatg

SEQ ID NO: 51091 - DNA, 103 bp, Artificial Sequence
  Synthetic Polynucleotide
taatacgactcactatagggtaattaagagaataaaaacttgttgttgaaaacagaggagattcaacatgaagtttttaaacctggcggcagcgcaaaagatg

SEQ ID NO: 51092 - DNA, 103 bp, Artificial Sequence
  Synthetic Polynucleotide
taatacgactcactatagggtttaagacatgtgttctatactaagatggtaacagaggagaaccatcatggtatagaacaacctggcggcagcgcaaaagatg

SEQ ID NO: 51093 - DNA, 103 bp, Artificial Sequence
  Synthetic Polynucleotide
taatacgactcactatagggcgttataattaagagaataaaaacttgttgaacagaggagacaacaaatgtttattctcaacctggcggcagcgcaaaagatg

SEQ ID NO: 51094 - DNA, 103 bp, Artificial Sequence
  Synthetic Polynucleotide
taatacgactcactataggggttatcgttataattaagagaataaaaactaacagaggagaagttttatgtctcttaataacctggcggcagcgcaaaagatg

SEQ ID NO: 51095 - DNA, 103 bp, Artificial Sequence
  Synthetic Polynucleotide
taatacgactcactatagggatgacgttatcgttataattaagagaataaaacagaggagattattcatgtaattataaaacctggcggcagcgcaaaagatg

SEQ ID NO: 51096 - DNA, 103 bp, Artificial Sequence
  Synthetic Polynucleotide
taatacgactcactatagggaattaatgacgttatcgttataattaagagaacagaggagactcttaatgataacgataaacctggcggcagcgcaaaagatg

SEQ ID NO: 51097 - DNA, 103 bp, Artificial Sequence
  Synthetic Polynucleotide
taatacgactcactataggggttataattaatgacgttatcgttataattaacagaggagaaattatatggataacgtcaacctggcggcagcgcaaaagatg

SEQ ID NO: 51098 - DNA, 103 bp, Artificial Sequence
  Synthetic Polynucleotide
taatacgactcactatagggaatccgttataattaatgacgttatcgttaaacagaggagataacgaatgcgtcattaaaacctggcggcagcgcaaaagatg

SEQ ID NO: 51099 - DNA, 103 bp, Artificial Sequence
  Synthetic Polynucleotide
taatacgactcactataggggagataatccgttataattaatgacgttataacagaggagaataacgatgttaattataaacctggcggcagcgcaaaagatg

SEQ ID NO: 51100 - DNA, 103 bp, Artificial Sequence
  Synthetic Polynucleotide
taatacgactcactataggggtagcgagataatccgttataattaatgacaacagaggagagtcattatgtataacggaaacctggcggcagcgcaaaagatg

SEQ ID NO: 51101 - DNA, 103 bp, Artificial Sequence
  Synthetic Polynucleotide
taatacgactcactatagggttattgtagcgagataatccgttataattaaacagaggagataattaatgcggattatcaacctggcggcagcgcaaaagatg

SEQ ID NO: 51102 - DNA, 103 bp, Artificial Sequence
  Synthetic Polynucleotide
taatacgactcactatagggtagagttattgtagcgagataatccgttataacagaggagaataacgatgtatctcgctaacctggcggcagcgcaaaagatg

SEQ ID NO: 51103 - DNA, 103 bp, Artificial Sequence
  Synthetic Polynucleotide
taatacgactcactatagggataactttaagacatgtgttctatactaagaacagaggagacttagtatggaacacatgaacctggcggcagcgcaaaagatg

SEQ ID NO: 51104 - DNA, 103 bp, Artificial Sequence
  Synthetic Polynucleotide
taatacgactcactatagggaaaaatagagttattgtagcgagataatccaacagaggagaggattaatgcgctacaataacctggcggcagcgcaaaagatg

SEQ ID NO: 51105 - DNA, 103 bp, Artificial Sequence
  Synthetic Polynucleotide
taatacgactcactatagggacgataaaaatagagttattgtagcgagataacagaggagaatctcgatgcaataactcaacctggcggcagcgcaaaagatg

SEQ ID NO: 51106 - DNA, 103 bp, Artificial Sequence
  Synthetic Polynucleotide
taatacgactcactatagggcatcaacgataaaaatagagttattgtagcaacagaggagagctacaatgactctatttaacctggcggcagcgcaaaagatg

SEQ ID NO: 51107 - DNA, 103 bp, Artificial Sequence
  Synthetic Polynucleotide
taatacgactcactatagggtgcctcatcaacgataaaaatagagttattaacagaggagaaataacatgatttttatcaacctggcggcagcgcaaaagatg

SEQ ID NO: 51108 - DNA, 103 bp, Artificial Sequence
  Synthetic Polynucleotide
taatacgactcactatagggttatgtgcctcatcaacgataaaaatagagaacagaggagactctatatgtatcgttgaaacctggcggcagcgcaaaagatg

SEQ ID NO: 51109 - DNA, 103 bp, Artificial Sequence
  Synthetic Polynucleotide
taatacgactcactatagggagatattatgtgcctcatcaacgataaaaaaacagaggagatttttaatgttgatgaggaacctggcggcagcgcaaaagatg

SEQ ID NO: 51110 - DNA, 103 bp, Artificial Sequence
  Synthetic Polynucleotide
taatacgactcactatagggcccaaagatattatgtgcctcatcaacgataacagaggagaatcgttatggaggcacataacctggcggcagcgcaaaagatg

SEQ ID NO: 51111 - DNA, 103 bp, Artificial Sequence
  Synthetic Polynucleotide
taatacgactcactatagggttattcccaaagatattatgtgcctcatcaaacagaggagatgatgaatgacataatataacctggcggcagcgcaaaagatg

SEQ ID NO: 51112 - DNA, 103 bp, Artificial Sequence
  Synthetic Polynucleotide
taatacgactcactatagggcagtattattcccaaagatattatgtgcctaacagaggagaaggcacatgatatctttgaacctggcggcagcgcaaaagatg

SEQ ID NO: 51113 - DNA, 103 bp, Artificial Sequence
  Synthetic Polynucleotide
taatacgactcactatagggttctccagtattattcccaaagatattatgaacagaggagacataatatgtttgggaataacctggcggcagcgcaaaagatg

SEQ ID NO: 51114 - DNA, 103 bp, Artificial Sequence
  Synthetic Polynucleotide
taatacgactcactatagggaattaataactttaagacatgtgttctataaacagaggagatatagaatgcatgtcttaaacctggcggcagcgcaaaagatg

SEQ ID NO: 51115 - DNA, 103 bp, Artificial Sequence
  Synthetic Polynucleotide
taatacgactcactatagggataagttctccagtattattcccaaagataaacagaggagatatcttatggaataatacaacctggcggcagcgcaaaagatg

SEQ ID NO: 51116 - DNA, 103 bp, Artificial Sequence
  Synthetic Polynucleotide
taatacgactcactatagggcggtcataagttctccagtattattcccaaaacagaggagattgggaatgatactggagaacctggcggcagcgcaaaagatg

SEQ ID NO: 51117 - DNA, 103 bp, Artificial Sequence
  Synthetic Polynucleotide
taatacgactcactatagggtattacggtcataagttctccagtattattaacagaggagaaataatatgggagaacttaacctggcggcagcgcaaaagatg

SEQ ID NO: 51118 - DNA, 103 bp, Artificial Sequence
  Synthetic Polynucleotide
taatacgactcactatagggttttttattacggtcataagttctccagtaaacagaggagatactggatgacttatgacaacctggcggcagcgcaaaagatg

SEQ ID NO: 51119 - DNA, 103 bp, Artificial Sequence
  Synthetic Polynucleotide
taatacgactcactatagggttttattttttattacggtcataagttctcaacagaggagagagaacatgtgaccgtaaaacctggcggcagcgcaaaagatg

SEQ ID NO: 51120 - DNA, 103 bp, Artificial Sequence
  Synthetic Polynucleotide
taatacgactcactatagggcttgtttttattttttattacggtcataagaacagaggagacttatgatggtaataaaaaacctggcggcagcgcaaaagatg

SEQ ID NO: 51121 - DNA, 103 bp, Artificial Sequence
  Synthetic Polynucleotide
taatacgactcactatagggggaatcttgtttttattttttattacggtcaacagaggagagaccgtatgaaaaaataaaacctggcggcagcgcaaaagatg

SEQ ID NO: 51122 - DNA, 103 bp, Artificial Sequence
  Synthetic Polynucleotide
taatacgactcactataggggaaaaggaatcttgtttttattttttattaaacagaggagataataaatgataaaaacaaacctggcggcagcgcaaaagatg

SEQ ID NO: 51123 - DNA, 103 bp, Artificial Sequence
  Synthetic Polynucleotide
taatacgactcactatagggtagtagaaaaggaatcttgtttttatttttaacagaggagaaaaaatatgaacaagattaacctggcggcagcgcaaaagatg

SEQ ID NO: 51124 - DNA, 103 bp, Artificial Sequence
  Synthetic Polynucleotide
taatacgactcactataggggacaatagtagaaaaggaatcttgtttttaaacagaggagataaaaaatggattcctttaacctggcggcagcgcaaaagatg

SEQ ID NO: 51125 - DNA, 103 bp, Artificial Sequence
  Synthetic Polynucleotide
taatacgactcactatagggttctcacactgatccatgtaaaccaaggacaacagaggagagtccttatgttacatggaaacctggcggcagcgcaaaagatg

SEQ ID NO: 51126 - DNA, 103 bp, Artificial Sequence
  Synthetic Polynucleotide
taatacgactcactatagggtaattaattaataactttaagacatgtgttaacagaggagaaacacaatgcttaaagttaacctggcggcagcgcaaaagatg

SEQ ID NO: 51127 - DNA, 103 bp, Artificial Sequence
  Synthetic Polynucleotide
taatacgactcactatagggatccagacaatagtagaaaaggaatcttgtaacagaggagaacaagaatgcttttctacaacctggcggcagcgcaaaagatg

SEQ ID NO: 51128 - DNA, 103 bp, Artificial Sequence
  Synthetic Polynucleotide
taatacgactcactataggggggagatccagacaatagtagaaaaggaataacagaggagaattcctatgctactattgaacctggcggcagcgcaaaagatg

SEQ ID NO: 51129 - DNA, 103 bp, Artificial Sequence
  Synthetic Polynucleotide
taatacgactcactataggggtaatgggagatccagacaatagtagaaaaaacagaggagattttctatgattgtctggaacctggcggcagcgcaaaagatg

SEQ ID NO: 51130 - DNA, 103 bp, Artificial Sequence
  Synthetic Polynucleotide
taatacgactcactatagggtgttagtaatgggagatccagacaatagtaaacagaggagatactatatgctggatctcaacctggcggcagcgcaaaagatg

SEQ ID NO: 51131 - DNA, 103 bp, Artificial Sequence
  Synthetic Polynucleotide
taatacgactcactatagggaggtgtgttagtaatgggagatccagacaaaacagaggagattgtctatgtctcccattaacctggcggcagcgcaaaagatg

SEQ ID NO: 51132 - DNA, 103 bp, Artificial Sequence
  Synthetic Polynucleotide
taatacgactcactataggggtattaggtgtgttagtaatgggagatccaaacagaggagatggatcatgcattactaaaacctggcggcagcgcaaaagatg

SEQ ID NO: 51133 - DNA, 103 bp, Artificial Sequence
  Synthetic Polynucleotide
taatacgactcactatagggccagagtattaggtgtgttagtaatgggagaacagaggagactcccaatgctaacacacaacctggcggcagcgcaaaagatg

SEQ ID NO: 51134 - DNA, 103 bp, Artificial Sequence
  Synthetic Polynucleotide
taatacgactcactatagggatgacccagagtattaggtgtgttagtaataacagaggagaattactatgacacctaataacctggcggcagcgcaaaagatg

SEQ ID NO: 51135 - DNA, 103 bp, Artificial Sequence
  Synthetic Polynucleotide
taatacgactcactatagggataatatgacccagagtattaggtgtgttaaacagaggagataacacatgtaatactctaacctggcggcagcgcaaaagatg

SEQ ID NO: 51136 - DNA, 103 bp, Artificial Sequence
  Synthetic Polynucleotide
taatacgactcactatagggaatctataatatgacccagagtattaggtgaacagaggagacacctaatgctctgggtcaacctggcggcagcgcaaaagatg

SEQ ID NO: 51137 - DNA, 103 bp, Artificial Sequence
  Synthetic Polynucleotide
taatacgactcactatagggatatgtaattaattaataactttaagacataacagaggagaatgtctatgagttattaaaacctggcggcagcgcaaaagatg

SEQ ID NO: 51138 - DNA, 103 bp, Artificial Sequence
  Synthetic Polynucleotide
taatacgactcactatagggcattaaatctataatatgacccagagtattaacagaggagaaatactatgggtcatattaacctggcggcagcgcaaaagatg

SEQ ID NO: 51139 - DNA, 103 bp, Artificial Sequence
  Synthetic Polynucleotide
taatacgactcactatagggtcggacattaaatctataatatgacccagaaacagaggagatctgggatgtattatagaaacctggcggcagcgcaaaagatg

SEQ ID NO: 51140 - DNA, 103 bp, Artificial Sequence
  Synthetic Polynucleotide
taatacgactcactatagggtctcttcggacattaaatctataatatgacaacagaggagagtcataatgtagatttaaaacctggcggcagcgcaaaagatg

SEQ ID NO: 51141 - DNA, 103 bp, Artificial Sequence
  Synthetic Polynucleotide
taatacgactcactatagggtatcgtctcttcggacattaaatctataataacagaggagaattataatgttaatgtccaacctggcggcagcgcaaaagatg

SEQ ID NO: 51142 - DNA, 103 bp, Artificial Sequence
  Synthetic Polynucleotide
taatacgactcactatagggaaatctatcgtctcttcggacattaaatctaacagaggagaagatttatggtccgaagaaacctggcggcagcgcaaaagatg

SEQ ID NO: 51143 - DNA, 103 bp, Artificial Sequence
  Synthetic Polynucleotide
taatacgactcactatagggcaccaaaatctatcgtctcttcggacattaaacagaggagataatgtatgaagagacgaaacctggcggcagcgcaaaagatg

SEQ ID NO: 51144 - DNA, 103 bp, Artificial Sequence
  Synthetic Polynucleotide
taatacgactcactatagggaatctcaccaaaatctatcgtctcttcggaaacagaggagatccgaaatgacgatagataacctggcggcagcgcaaaagatg

SEQ ID NO: 51145 - DNA, 103 bp, Artificial Sequence
  Synthetic Polynucleotide
taatacgactcactatagggctaataatctcaccaaaatctatcgtctctaacagaggagaagagacatgagattttggaacctggcggcagcgcaaaagatg

SEQ ID NO: 51146 - DNA, 103 bp, Artificial Sequence
  Synthetic Polynucleotide
taatacgactcactatagggcacgactaataatctcaccaaaatctatcgaacagaggagacgatagatgttggtgagaaacctggcggcagcgcaaaagatg

SEQ ID NO: 51147 - DNA, 103 bp, Artificial Sequence
  Synthetic Polynucleotide
taatacgactcactatagggcttaccacgactaataatctcaccaaaatcaacagaggagagattttatggagattattaacctggcggcagcgcaaaagatg

SEQ ID NO: 51148 - DNA, 103 bp, Artificial Sequence
  Synthetic Polynucleotide
taatacgactcactatagggaaacaatatgtaattaattaataactttaaaacagaggagattaaagatgttaattaataacctggcggcagcgcaaaagatg

SEQ ID NO: 51149 - DNA, 103 bp, Artificial Sequence
  Synthetic Polynucleotide
taatacgactcactatagggactttcttaccacgactaataatctcaccaaacagaggagatggtgaatgtattagtcgaacctggcggcagcgcaaaagatg

SEQ ID NO: 51150 - DNA, 103 bp, Artificial Sequence
  Synthetic Polynucleotide
taatacgactcactataggggaattactttcttaccacgactaataatctaacagaggagaagattaatggtcgtggtaaacctggcggcagcgcaaaagatg

SEQ ID NO: 51151 - DNA, 103 bp, Artificial Sequence
  Synthetic Polynucleotide
taatacgactcactatagggtgtctgaattactttcttaccacgactaataacagaggagaattagtatgggtaagaaaaacctggcggcagcgcaaaagatg

SEQ ID NO: 51152 - DNA, 103 bp, Artificial Sequence
  Synthetic Polynucleotide
taatacgactcactatagggagaagtgtctgaattactttcttaccacgaaacagaggagatcgtggatggaaagtaataacctggcggcagcgcaaaagatg

SEQ ID NO: 51153 - DNA, 103 bp, Artificial Sequence
  Synthetic Polynucleotide
taatacgactcactatagggcgttaagaagtgtctgaattactttcttacaacagaggagagtaagaatgtaattcagaaacctggcggcagcgcaaaagatg

SEQ ID NO: 51154 - DNA, 103 bp, Artificial Sequence
  Synthetic Polynucleotide
taatacgactcactataggggcgttcgttaagaagtgtctgaattactttaacagaggagaaaagtaatgcagacacttaacctggcggcagcgcaaaagatg

SEQ ID NO: 51155 - DNA, 103 bp, Artificial Sequence
  Synthetic Polynucleotide
taatacgactcactatagggacaccgcgttcgttaagaagtgtctgaattaacagaggagaaattcaatgacttcttaaaacctggcggcagcgcaaaagatg

SEQ ID NO: 51156 - DNA, 103 bp, Artificial Sequence
  Synthetic Polynucleotide
taatacgactcactatagggcattcacaccgcgttcgttaagaagtgtctaacagaggagaagacacatgttaacgaacaacctggcggcagcgcaaaagatg

SEQ ID NO: 51157 - DNA, 103 bp, Artificial Sequence
  Synthetic Polynucleotide
taatacgactcactataggggagtacattcacaccgcgttcgttaagaagaacagaggagacttcttatggaacgcggtaacctggcggcagcgcaaaagatg

SEQ ID NO: 51158 - DNA, 103 bp, Artificial Sequence
  Synthetic Polynucleotide
taatacgactcactatagggtccttgagtacattcacaccgcgttcgttaaacagaggagataacgaatgcggtgtgaaaacctggcggcagcgcaaaagatg

SEQ ID NO: 51159 - DNA, 103 bp, Artificial Sequence
  Synthetic Polynucleotide
taatacgactcactatagggatataaaacaatatgtaattaattaataacaacagaggagagttattatgtaattacataacctggcggcagcgcaaaagatg

SEQ ID NO: 51160 - DNA, 103 bp, Artificial Sequence
  Synthetic Polynucleotide
taatacgactcactataggggcaaatccttgagtacattcacaccgcgttaacagaggagaaacgcgatgtgaatgtacaacctggcggcagcgcaaaagatg

SEQ ID NO: 51161 - DNA, 103 bp, Artificial Sequence
  Synthetic Polynucleotide
taatacgactcactatagggtttaagcaaatccttgagtacattcacaccaacagaggagaggtgtgatggtactcaagaacctggcggcagcgcaaaagatg

SEQ ID NO: 51162 - DNA, 103 bp, Artificial Sequence
  Synthetic Polynucleotide
taatacgactcactatagggcttcctttaagcaaatccttgagtacattcaacagaggagagaatgtatgcaaggatttaacctggcggcagcgcaaaagatg

SEQ ID NO: 51163 - DNA, 103 bp, Artificial Sequence
  Synthetic Polynucleotide
taatacgactcactatagggatattcttcctttaagcaaatccttgagtaaacagaggagatactcaatgatttgcttaaacctggcggcagcgcaaaagatg

SEQ ID NO: 51164 - DNA, 103 bp, Artificial Sequence
  Synthetic Polynucleotide
taatacgactcactatagggatatgatattcttcctttaagcaaatccttaacagaggagaaaggatatgcttaaaggaaacctggcggcagcgcaaaagatg

SEQ ID NO: 51165 - DNA, 103 bp, Artificial Sequence
  Synthetic Polynucleotide
taatacgactcactatagggtcgtaatatgatattcttcctttaagcaaaaacagaggagatttgctatgaggaagaataacctggcggcagcgcaaaagatg

SEQ ID NO: 51166 - DNA, 103 bp, Artificial Sequence
  Synthetic Polynucleotide
taatacgactcactataggggcatttcgtaatatgatattcttcctttaaaacagaggagattaaagatggaatatcataacctggcggcagcgcaaaagatg

SEQ ID NO: 51167 - DNA, 103 bp, Artificial Sequence
  Synthetic Polynucleotide
taatacgactcactatagggatcaggcatttcgtaatatgatattcttccaacagaggagaggaagaatgtcatattacaacctggcggcagcgcaaaagatg

SEQ ID NO: 51168 - DNA, 103 bp, Artificial Sequence
  Synthetic Polynucleotide
taatacgactcactatagggtctttatcaggcatttcgtaatatgatattaacagaggagaaatatcatgttacgaaataacctggcggcagcgcaaaagatg

SEQ ID NO: 51169 - DNA, 103 bp, Artificial Sequence
  Synthetic Polynucleotide
taatacgactcactataggggtaaatctttatcaggcatttcgtaatatgaacagaggagacatattatgaaatgcctgaacctggcggcagcgcaaaagatg

SEQ ID NO: 51170 - DNA, 103 bp, Artificial Sequence
  Synthetic Polynucleotide
taatacgactcactataggggcgatatataaaacaatatgtaattaattaaacagaggagataattaatgacatattgtaacctggcggcagcgcaaaagatg

SEQ ID NO: 51171 - DNA, 103 bp, Artificial Sequence
  Synthetic Polynucleotide
taatacgactcactatagggcgttggtaaatctttatcaggcatttcgtaaacagaggagatacgaaatgcctgataaaaacctggcggcagcgcaaaagatg

SEQ ID NO: 51172 - DNA, 103 bp, Artificial Sequence
  Synthetic Polynucleotide
taatacgactcactatagggcttatcgttggtaaatctttatcaggcattaacagaggagaaatgccatgtaaagatttaacctggcggcagcgcaaaagatg

SEQ ID NO: 51173 - DNA, 103 bp, Artificial Sequence
  Synthetic Polynucleotide
taatacgactcactataggggatatcttatcgttggtaaatctttatcagaacagaggagactgataatgatttaccaaaacctggcggcagcgcaaaagatg

SEQ ID NO: 51174 - DNA, 103 bp, Artificial Sequence
  Synthetic Polynucleotide
taatacgactcactatagggtccgtgatatcttatcgttggtaaatctttaacagaggagaaaagatatgccaacgataaacctggcggcagcgcaaaagatg

SEQ ID NO: 51175 - DNA, 103 bp, Artificial Sequence
  Synthetic Polynucleotide
taatacgactcactatagggttacgtccgtgatatcttatcgttggtaaaaacagaggagatttaccatggataagataaacctggcggcagcgcaaaagatg

SEQ ID NO: 51176 - DNA, 103 bp, Artificial Sequence
  Synthetic Polynucleotide
taatacgactcactataggggaaacttacgtccgtgatatcttatcgttgaacagaggagacaacgaatggatatcacgaacctggcggcagcgcaaaagatg

SEQ ID NO: 51177 - DNA, 103 bp, Artificial Sequence
  Synthetic Polynucleotide
taatacgactcactatagggatctagaaacttacgtccgtgatatcttataacagaggagaataagaatgcacggacgtaacctggcggcagcgcaaaagatg

SEQ ID NO: 51178 - DNA, 103 bp, Artificial Sequence
  Synthetic Polynucleotide
taatacgactcactatagggctagtatctagaaacttacgtccgtgatataacagaggagaatatcaatgacgtaagttaacctggcggcagcgcaaaagatg

SEQ ID NO: 51179 - DNA, 103 bp, Artificial Sequence
  Synthetic Polynucleotide
taatacgactcactatagggctactctagtatctagaaacttacgtccgtaacagaggagaacggacatgagtttctagaacctggcggcagcgcaaaagatg

SEQ ID NO: 51180 - DNA, 103 bp, Artificial Sequence
  Synthetic Polynucleotide
taatacgactcactatagggatatactactctagtatctagaaacttacgaacagaggagacgtaagatgctagatactaacctggcggcagcgcaaaagatg

SEQ ID NO: 51181 - DNA, 103 bp, Artificial Sequence
  Synthetic Polynucleotide
taatacgactcactatagggtcgtagcgatatataaaacaatatgtaattaacagaggagaaattacatgttgttttataacctggcggcagcgcaaaagatg

SEQ ID NO: 51182 - DNA, 103 bp, Artificial Sequence
  Synthetic Polynucleotide
taatacgactcactatagggtgacaatatactactctagtatctagaaacaacagaggagagtttctatgtactagagtaacctggcggcagcgcaaaagatg

SEQ ID NO: 51183 - DNA, 103 bp, Artificial Sequence
  Synthetic Polynucleotide
taatacgactcactatagggacatgtgacaatatactactctagtatctaaacagaggagatagataatggagtagtataacctggcggcagcgcaaaagatg

SEQ ID NO: 51184 - DNA, 103 bp, Artificial Sequence
  Synthetic Polynucleotide
taatacgactcactatagggtttagacatgtgacaatatactactctagtaacagaggagaactagaatggtatattgtaacctggcggcagcgcaaaagatg

SEQ ID NO: 51185 - DNA, 103 bp, Artificial Sequence
  Synthetic Polynucleotide
taatacgactcactatagggtgaagtttagacatgtgacaatatactactaacagaggagaagtagtatgttgtcacataacctggcggcagcgcaaaagatg

SEQ ID NO: 51186 - DNA, 103 bp, Artificial Sequence
  Synthetic Polynucleotide
taatacgactcactatagggtctcttgaagtttagacatgtgacaatataaacagaggagatatattatgacatgtctaaacctggcggcagcgcaaaagatg

SEQ ID NO: 51187 - DNA, 103 bp, Artificial Sequence
  Synthetic Polynucleotide
taatacgactcactatagggatctctctcttgaagtttagacatgtgacaaacagaggagatgtcacatgtctaaacttaacctggcggcagcgcaaaagatg

SEQ ID NO: 51188 - DNA, 103 bp, Artificial Sequence
  Synthetic Polynucleotide
taatacgactcactatagggatataatctctctcttgaagtttagacatgaacagaggagacatgtcatgacttcaagaaacctggcggcagcgcaaaagatg

SEQ ID NO: 51189 - DNA, 103 bp, Artificial Sequence
  Synthetic Polynucleotide
taatacgactcactatagggtaatcatataatctctctcttgaagtttagaacagaggagactaaacatgaagagagagaacctggcggcagcgcaaaagatg

SEQ ID NO: 51190 - DNA, 103 bp, Artificial Sequence
  Synthetic Polynucleotide
taatacgactcactatagggtctagtaatcatataatctctctcttgaagaacagaggagacttcaaatgagagattataacctggcggcagcgcaaaagatg

SEQ ID NO: 51191 - DNA, 103 bp, Artificial Sequence
  Synthetic Polynucleotide
taatacgactcactatagggtgtcgtctagtaatcatataatctctctctaacagaggagaagagagatgttatatgataacctggcggcagcgcaaaagatg

SEQ ID NO: 51192 - DNA, 103 bp, Artificial Sequence
  Synthetic Polynucleotide
taatacgactcactatagggtaaattcgtagcgatatataaaacaatatgaacagaggagacatattatgttatatatcaacctggcggcagcgcaaaagatg

SEQ ID NO: 51193 - DNA, 103 bp, Artificial Sequence
  Synthetic Polynucleotide
taatacgactcactatagggatagctgtcgtctagtaatcatataatctcaacagaggagagagattatgtgattactaaacctggcggcagcgcaaaagatg

SEQ ID NO: 51194 - DNA, 103 bp, Artificial Sequence
  Synthetic Polynucleotide
taatacgactcactatagggataacatagctgtcgtctagtaatcatataaacagaggagatatatgatgactagacgaaacctggcggcagcgcaaaagatg

SEQ ID NO: 51195 - DNA, 103 bp, Artificial Sequence
  Synthetic Polynucleotide
taatacgactcactatagggtcatgataacatagctgtcgtctagtaatcaacagaggagagattacatgacgacagctaacctggcggcagcgcaaaagatg

SEQ ID NO: 51196 - DNA, 103 bp, Artificial Sequence
  Synthetic Polynucleotide
taatacgactcactatagggacatttcatgataacatagctgtcgtctagaacagaggagactagacatgagctatgttaacctggcggcagcgcaaaagatg

SEQ ID NO: 51197 - DNA, 103 bp, Artificial Sequence
  Synthetic Polynucleotide
taatacgactcactatagggatcaaacatttcatgataacatagctgtcgaacagaggagacgacagatgtgttatcataacctggcggcagcgcaaaagatg

SEQ ID NO: 51198 - DNA, 103 bp, Artificial Sequence
  Synthetic Polynucleotide
taatacgactcactatagggtttttatcaaacatttcatgataacatagcaacagaggagagctatgatgtcatgaaataacctggcggcagcgcaaaagatg

SEQ ID NO: 51199 - DNA, 103 bp, Artificial Sequence
  Synthetic Polynucleotide
taatacgactcactatagggacatatttttatcaaacatttcatgataacaacagaggagagttatcatgaaatgtttgaacctggcggcagcgcaaaagatg

SEQ ID NO: 51200 - DNA, 103 bp, Artificial Sequence
  Synthetic Polynucleotide
taatacgactcactataggggttatacatatttttatcaaacatttcatgaacagaggagacatgaaatgtttgataaaaacctggcggcagcgcaaaagatg

SEQ ID NO: 51201 - DNA, 103 bp, Artificial Sequence
  Synthetic Polynucleotide
taatacgactcactataggggacacgttatacatatttttatcaaacattaacagaggagaaatgttatgtaaaaatataacctggcggcagcgcaaaagatg

SEQ ID NO: 51202 - DNA, 103 bp, Artificial Sequence
  Synthetic Polynucleotide
taatacgactcactatagggccattgacacgttatacatatttttatcaaaacagaggagattgataatgatatgtataaacctggcggcagcgcaaaagatg

SEQ ID NO: 51203 - DNA, 103 bp, Artificial Sequence
  Synthetic Polynucleotide
taatacgactcactatagggctgtttaaattcgtagcgatatataaaacaaacagaggagatgttttatgtatcgctacaacctggcggcagcgcaaaagatg

SEQ ID NO: 51204 - DNA, 103 bp, Artificial Sequence
  Synthetic Polynucleotide
taatacgactcactatagggtactgccattgacacgttatacatatttttaacagaggagaaaaaatatgtataacgtgaacctggcggcagcgcaaaagatg

SEQ ID NO: 51205 - DNA, 103 bp, Artificial Sequence
  Synthetic Polynucleotide
taatacgactcactatagggcccaatactgccattgacacgttatacataaacagaggagatatgtaatgcgtgtcaataacctggcggcagcgcaaaagatg

SEQ ID NO: 51206 - DNA, 103 bp, Artificial Sequence
  Synthetic Polynucleotide
taatacgactcactataggggttgtcccaatactgccattgacacgttataacagaggagaataacgatgcaatggcagaacctggcggcagcgcaaaagatg

SEQ ID NO: 51207 - DNA, 103 bp, Artificial Sequence
  Synthetic Polynucleotide
taatacgactcactatagggattaagttgtcccaatactgccattgacacaacagaggagagtgtcaatggcagtattgaacctggcggcagcgcaaaagatg

SEQ ID NO: 51208 - DNA, 103 bp, Artificial Sequence
  Synthetic Polynucleotide
taatacgactcactatagggatcagattaagttgtcccaatactgccattaacagaggagaaatggcatgattgggacaaacctggcggcagcgcaaaagatg

SEQ ID NO: 51209 - DNA, 103 bp, Artificial Sequence
  Synthetic Polynucleotide
taatacgactcactatagggtattcatcagattaagttgtcccaatactgaacagaggagacagtatatggacaacttaaacctggcggcagcgcaaaagatg

SEQ ID NO: 51210 - DNA, 103 bp, Artificial Sequence
  Synthetic Polynucleotide
taatacgactcactatagggtaaattattcatcagattaagttgtcccaaaacagaggagattgggaatgcttaatctgaacctggcggcagcgcaaaagatg

SEQ ID NO: 51211 - DNA, 103 bp, Artificial Sequence
  Synthetic Polynucleotide
taatacgactcactataggggtatctaaattattcatcagattaagttgtaacagaggagaacaactatgtctgatgaaaacctggcggcagcgcaaaagatg

SEQ ID NO: 51212 - DNA, 103 bp, Artificial Sequence
  Synthetic Polynucleotide
taatacgactcactatagggataaagtatctaaattattcatcagattaaaacagaggagattaatcatgtgaataattaacctggcggcagcgcaaaagatg

SEQ ID NO: 51213 - DNA, 103 bp, Artificial Sequence
  Synthetic Polynucleotide
taatacgactcactatagggctgaaataaagtatctaaattattcatcagaacagaggagactgatgatgaatttagataacctggcggcagcgcaaaagatg

SEQ ID NO: 51214 - DNA, 103 bp, Artificial Sequence
  Synthetic Polynucleotide
taatacgactcactatagggtttctctgtttaaattcgtagcgatatataaacagaggagatatataatgctacgaattaacctggcggcagcgcaaaagatg

SEQ ID NO: 51215 - DNA, 103 bp, Artificial Sequence
  Synthetic Polynucleotide
taatacgactcactatagggtgttcctgaaataaagtatctaaattattcaacagaggagagaataaatgagatactttaacctggcggcagcgcaaaagatg

SEQ ID NO: 51216 - DNA, 103 bp, Artificial Sequence
  Synthetic Polynucleotide
taatacgactcactatagggtatcctgttcctgaaataaagtatctaaataacagaggagaatttagatgctttatttcaacctggcggcagcgcaaaagatg

SEQ ID NO: 51217 - DNA, 103 bp, Artificial Sequence
  Synthetic Polynucleotide
taatacgactcactatagggttccttatcctgttcctgaaataaagtatcaacagaggagagatactatgtttcaggaaaacctggcggcagcgcaaaagatg

SEQ ID NO: 51218 - DNA, 103 bp, Artificial Sequence
  Synthetic Polynucleotide
taatacgactcactatagggtacaattccttatcctgttcctgaaataaaaacagaggagatttattatgggaacaggaaacctggcggcagcgcaaaagatg

SEQ ID NO: 51219 - DNA, 103 bp, Artificial Sequence
  Synthetic Polynucleotide
taatacgactcactatagggttgggtacaattccttatcctgttcctgaaaacagaggagattcaggatgaggataaggaacctggcggcagcgcaaaagatg

SEQ ID NO: 51220 - DNA, 103 bp, Artificial Sequence
  Synthetic Polynucleotide
taatacgactcactatagggcagatttgggtacaattccttatcctgttcaacagaggagagaacagatgaaggaattgaacctggcggcagcgcaaaagatg

SEQ ID NO: 51221 - DNA, 103 bp, Artificial Sequence
  Synthetic Polynucleotide
taatacgactcactatagggattttcagatttgggtacaattccttatccaacagaggagaggataaatgattgtacccaacctggcggcagcgcaaaagatg

SEQ ID NO: 51222 - DNA, 103 bp, Artificial Sequence
  Synthetic Polynucleotide
taatacgactcactatagggtatttattttcagatttgggtacaattcctaacagaggagaaggaatatgacccaaatcaacctggcggcagcgcaaaagatg

SEQ ID NO: 51223 - DNA, 103 bp, Artificial Sequence
  Synthetic Polynucleotide
taatacgactcactatagggaccattatttattttcagatttgggtacaaaacagaggagattgtacatgaatctgaaaaacctggcggcagcgcaaaagatg

SEQ ID NO: 51224 - DNA, 103 bp, Artificial Sequence
  Synthetic Polynucleotide
taatacgactcactatagggaacacaccattatttattttcagatttgggaacagaggagacccaaaatggaaaataaaaacctggcggcagcgcaaaagatg

SEQ ID NO: 51225 - DNA, 103 bp, Artificial Sequence
  Synthetic Polynucleotide
taatacgactcactatagggactgatttctctgtttaaattcgtagcgataacagaggagaatcgctatgaatttaaacaacctggcggcagcgcaaaagatg

SEQ ID NO: 51226 - DNA, 103 bp, Artificial Sequence
  Synthetic Polynucleotide
taatacgactcactatagggcgtataacacaccattatttattttcagataacagaggagaatctgaatgtaaataatgaacctggcggcagcgcaaaagatg

SEQ ID NO: 51227 - DNA, 103 bp, Artificial Sequence
  Synthetic Polynucleotide
taatacgactcactatagggttctccgtataacacaccattatttattttaacagaggagaaaaataatgaatggtgtgaacctggcggcagcgcaaaagatg

SEQ ID NO: 51228 - DNA, 103 bp, Artificial Sequence
  Synthetic Polynucleotide
taatacgactcactatagggaattcttctccgtataacacaccattatttaacagaggagaaaataaatgtgtgttataaacctggcggcagcgcaaaagatg

SEQ ID NO: 51229 - DNA, 103 bp, Artificial Sequence
  Synthetic Polynucleotide
taatacgactcactatagggttaccaattcttctccgtataacacaccataacagaggagaatggtgatgtatacggagaacctggcggcagcgcaaaagatg

SEQ ID NO: 51230 - DNA, 103 bp, Artificial Sequence
  Synthetic Polynucleotide
taatacgactcactatagggtaacgttaccaattcttctccgtataacacaacagaggagagtgttaatgggagaagaaaacctggcggcagcgcaaaagatg

SEQ ID NO: 51231 - DNA, 103 bp, Artificial Sequence
  Synthetic Polynucleotide
taatacgactcactatagggatgtttaacgttaccaattcttctccgtataacagaggagaatacggatgagaattggtaacctggcggcagcgcaaaagatg

SEQ ID NO: 51232 - DNA, 103 bp, Artificial Sequence
  Synthetic Polynucleotide
taatacgactcactatagggaactaatgtttaacgttaccaattcttctcaacagaggagagagaagatgtggtaacgtaacctggcggcagcgcaaaagatg

SEQ ID NO: 51233 - DNA, 103 bp, Artificial Sequence
  Synthetic Polynucleotide
taatacgactcactatagggtttggaactaatgtttaacgttaccaattcaacagaggagagaattgatgacgttaaacaacctggcggcagcgcaaaagatg

SEQ ID NO: 51234 - DNA, 103 bp, Artificial Sequence
  Synthetic Polynucleotide
taatacgactcactatagggttaaatttggaactaatgtttaacgttaccaacagaggagaggtaacatgaaacattagaacctggcggcagcgcaaaagatg

SEQ ID NO: 51235 - DNA, 103 bp, Artificial Sequence
  Synthetic Polynucleotide
taatacgactcactatagggagtatttaaatttggaactaatgtttaacgaacagaggagacgttaaatgttagttccaaacctggcggcagcgcaaaagatg

SEQ ID NO: 51236 - DNA, 103 bp, Artificial Sequence
  Synthetic Polynucleotide
taatacgactcactatagggattttttctcacactgatccatgtaaaccaaacagaggagatggtttatgtggatcagtaacctggcggcagcgcaaaagatg

SEQ ID NO: 51237 - DNA, 103 bp, Artificial Sequence
  Synthetic Polynucleotide
taatacgactcactatagggtcctaactgatttctctgtttaaattcgtaaacagaggagatacgaaatgaaacagagaaacctggcggcagcgcaaaagatg

SEQ ID NO: 51238 - DNA, 103 bp, Artificial Sequence
  Synthetic Polynucleotide
taatacgactcactataggggataaagtatttaaatttggaactaatgttaacagaggagaaacattatgtccaaatttaacctggcggcagcgcaaaagatg

SEQ ID NO: 51239 - DNA, 103 bp, Artificial Sequence
  Synthetic Polynucleotide
taatacgactcactatagggcgattgataaagtatttaaatttggaactaaacagaggagatagttcatgatttaaataaacctggcggcagcgcaaaagatg

SEQ ID NO: 51240 - DNA, 103 bp, Artificial Sequence
  Synthetic Polynucleotide
taatacgactcactataggggtatccgattgataaagtatttaaatttggaacagaggagaccaaatatgaatactttaaacctggcggcagcgcaaaagatg

SEQ ID NO: 51241 - DNA, 103 bp, Artificial Sequence
  Synthetic Polynucleotide
taatacgactcactatagggtgtctgtatccgattgataaagtatttaaaaacagaggagatttaaaatgtttatcaataacctggcggcagcgcaaaagatg

SEQ ID NO: 51242 - DNA, 103 bp, Artificial Sequence
  Synthetic Polynucleotide
taatacgactcactatagggttgagtgtctgtatccgattgataaagtataacagaggagaatacttatgcaatcggataacctggcggcagcgcaaaagatg

SEQ ID NO: 51243 - DNA, 103 bp, Artificial Sequence
  Synthetic Polynucleotide
taatacgactcactatagggttccgttgagtgtctgtatccgattgataaaacagaggagattatcaatgggatacagaaacctggcggcagcgcaaaagatg

SEQ ID NO: 51244 - DNA, 103 bp, Artificial Sequence
  Synthetic Polynucleotide
taatacgactcactatagggatgttttccgttgagtgtctgtatccgattaacagaggagaaatcggatgcagacactcaacctggcggcagcgcaaaagatg

SEQ ID NO: 51245 - DNA, 103 bp, Artificial Sequence
  Synthetic Polynucleotide
taatacgactcactatagggataaaatgttttccgttgagtgtctgtatcaacagaggagagatacaatgactcaacggaacctggcggcagcgcaaaagatg

SEQ ID NO: 51246 - DNA, 103 bp, Artificial Sequence
  Synthetic Polynucleotide
taatacgactcactatagggagtatataaaatgttttccgttgagtgtctaacagaggagaagacacatgacggaaaacaacctggcggcagcgcaaaagatg

SEQ ID NO: 51247 - DNA, 103 bp, Artificial Sequence
  Synthetic Polynucleotide
taatacgactcactatagggagaaaagtatataaaatgttttccgttgagaacagaggagactcaacatgaaacattttaacctggcggcagcgcaaaagatg

SEQ ID NO: 51248 - DNA, 103 bp, Artificial Sequence
  Synthetic Polynucleotide
taatacgactcactatagggtttcttcctaactgatttctctgtttaaataacagaggagaatttaaatggagaaatcaaacctggcggcagcgcaaaagatg

SEQ ID NO: 51249 - DNA, 103 bp, Artificial Sequence
  Synthetic Polynucleotide
taatacgactcactataggggaattagaaaagtatataaaatgttttccgaacagaggagacggaaaatgttttatataaacctggcggcagcgcaaaagatg

SEQ ID NO: 51250 - DNA, 103 bp, Artificial Sequence
  Synthetic Polynucleotide
taatacgactcactatagggatgtagaattagaaaagtatataaaatgttaacagaggagaaacattatgtatacttttaacctggcggcagcgcaaaagatg

SEQ ID NO: 51251 - DNA, 103 bp, Artificial Sequence
  Synthetic Polynucleotide
taatacgactcactatagggaccatatgtagaattagaaaagtatataaaaacagaggagatttataatgttttctaataacctggcggcagcgcaaaagatg

SEQ ID NO: 51252 - DNA, 103 bp, Artificial Sequence
  Synthetic Polynucleotide
taatacgactcactatagggaatccaccatatgtagaattagaaaagtataacagaggagaatacttatgtaattctacaacctggcggcagcgcaaaagatg

SEQ ID NO: 51253 - DNA, 103 bp, Artificial Sequence
  Synthetic Polynucleotide
taatacgactcactatagggttactaatccaccatatgtagaattagaaaaacagaggagatttctaatgctacatatgaacctggcggcagcgcaaaagatg

SEQ ID NO: 51254 - DNA, 103 bp, Artificial Sequence
  Synthetic Polynucleotide
taatacgactcactatagggtttaattactaatccaccatatgtagaattaacagaggagaaattctatgtatggtggaaacctggcggcagcgcaaaagatg

SEQ ID NO: 51255 - DNA, 103 bp, Artificial Sequence
  Synthetic Polynucleotide
taatacgactcactatagggatatatttaattactaatccaccatatgtaaacagaggagatacataatgtggattagtaacctggcggcagcgcaaaagatg

SEQ ID NO: 51256 - DNA, 103 bp, Artificial Sequence
  Synthetic Polynucleotide
taatacgactcactataggggcatgatatatttaattactaatccaccataacagaggagaatggtgatgtagtaattaaacctggcggcagcgcaaaagatg

SEQ ID NO: 51257 - DNA, 103 bp, Artificial Sequence
  Synthetic Polynucleotide
taatacgactcactatagggactgagcatgatatatttaattactaatccaacagaggagaggattaatgattaaatataacctggcggcagcgcaaaagatg

SEQ ID NO: 51258 - DNA, 103 bp, Artificial Sequence
  Synthetic Polynucleotide
taatacgactcactatagggccattactgagcatgatatatttaattactaacagaggagaagtaatatgatatatcataacctggcggcagcgcaaaagatg

SEQ ID NO: 51259 - DNA, 103 bp, Artificial Sequence
  Synthetic Polynucleotide
taatacgactcactatagggaattttttcttcctaactgatttctctgttaacagaggagaaacagaatgatcagttagaacctggcggcagcgcaaaagatg

SEQ ID NO: 51260 - DNA, 103 bp, Artificial Sequence
  Synthetic Polynucleotide
taatacgactcactatagggaatatccattactgagcatgatatatttaaaacagaggagattaaatatgtcatgctcaaacctggcggcagcgcaaaagatg

SEQ ID NO: 51261 - DNA, 103 bp, Artificial Sequence
  Synthetic Polynucleotide
taatacgactcactatagggttcagaatatccattactgagcatgatataaacagaggagatatatcatgctcagtaataacctggcggcagcgcaaaagatg

SEQ ID NO: 51262 - DNA, 103 bp, Artificial Sequence
  Synthetic Polynucleotide
taatacgactcactatagggttatattcagaatatccattactgagcatgaacagaggagacatgctatgtaatggataaacctggcggcagcgcaaaagatg

SEQ ID NO: 51263 - DNA, 103 bp, Artificial Sequence
  Synthetic Polynucleotide
taatacgactcactatagggaaccattatattcagaatatccattactgaaacagaggagatcagtaatggatattctgaacctggcggcagcgcaaaagatg

SEQ ID NO: 51264 - DNA, 103 bp, Artificial Sequence
  Synthetic Polynucleotide
taatacgactcactatagggctgagaaccattatattcagaatatccattaacagaggagaaatggaatgtctgaatataacctggcggcagcgcaaaagatg

SEQ ID NO: 51265 - DNA, 103 bp, Artificial Sequence
  Synthetic Polynucleotide
taatacgactcactataggggttccctgagaaccattatattcagaatataacagaggagaatattcatgatataatggaacctggcggcagcgcaaaagatg

SEQ ID NO: 51266 - DNA, 103 bp, Artificial Sequence
  Synthetic Polynucleotide
taatacgactcactataggggattagttccctgagaaccattatattcagaacagaggagactgaatatgatggttctcaacctggcggcagcgcaaaagatg

SEQ ID NO: 51267 - DNA, 103 bp, Artificial Sequence
  Synthetic Polynucleotide
taatacgactcactatagggatgtggattagttccctgagaaccattataaacagaggagatataatatgtctcagggaaacctggcggcagcgcaaaagatg

SEQ ID NO: 51268 - DNA, 103 bp, Artificial Sequence
  Synthetic Polynucleotide
taatacgactcactatagggatcatatgtggattagttccctgagaaccaaacagaggagatggttcatggggaactaaaacctggcggcagcgcaaaagatg

SEQ ID NO: 51269 - DNA, 103 bp, Artificial Sequence
  Synthetic Polynucleotide
taatacgactcactatagggcgtttatcatatgtggattagttccctgagaacagaggagactcaggatgctaatccacaacctggcggcagcgcaaaagatg

SEQ ID NO: 51270 - DNA, 103 bp, Artificial Sequence
  Synthetic Polynucleotide
taatacgactcactatagggcagataattttttcttcctaactgatttctaacagaggagaagaaatatgttaggaagaaacctggcggcagcgcaaaagatg

SEQ ID NO: 51271 - DNA, 103 bp, Artificial Sequence
  Synthetic Polynucleotide
taatacgactcactatagggtttgccgtttatcatatgtggattagttccaacagaggagaggaactatgccacatatgaacctggcggcagcgcaaaagatg

SEQ ID NO: 51272 - DNA, 103 bp, Artificial Sequence
  Synthetic Polynucleotide
taatacgactcactatagggtttggtttgccgtttatcatatgtggattaaacagaggagataatccatgtatgataaaaacctggcggcagcgcaaaagatg

SEQ ID NO: 51273 - DNA, 103 bp, Artificial Sequence
  Synthetic Polynucleotide
taatacgactcactatagggatgtttttggtttgccgtttatcatatgtgaacagaggagacacataatgtaaacggcaaacctggcggcagcgcaaaagatg

SEQ ID NO: 51274 - DNA, 103 bp, Artificial Sequence
  Synthetic Polynucleotide
taatacgactcactatagggagcaaatgtttttggtttgccgtttatcataacagaggagaatgataatgggcaaaccaaacctggcggcagcgcaaaagatg

SEQ ID NO: 51275 - DNA, 103 bp, Artificial Sequence
  Synthetic Polynucleotide
taatacgactcactatagggacgatagcaaatgtttttggtttgccgtttaacagaggagaaaacggatgaccaaaaacaacctggcggcagcgcaaaagatg

SEQ ID NO: 51276 - DNA, 103 bp, Artificial Sequence
  Synthetic Polynucleotide
taatacgactcactatagggtagtaacgatagcaaatgtttttggtttgcaacagaggagagcaaacatgaaacatttgaacctggcggcagcgcaaaagatg

SEQ ID NO: 51277 - DNA, 103 bp, Artificial Sequence
  Synthetic Polynucleotide
taatacgactcactatagggtttactagtaacgatagcaaatgtttttggaacagaggagaccaaaaatgtttgctatcaacctggcggcagcgcaaaagatg

SEQ ID NO: 51278 - DNA, 103 bp, Artificial Sequence
  Synthetic Polynucleotide
taatacgactcactatagggttcattttactagtaacgatagcaaatgttaacagaggagaaacattatgtatcgttacaacctggcggcagcgcaaaagatg

SEQ ID NO: 51279 - DNA, 103 bp, Artificial Sequence
  Synthetic Polynucleotide
taatacgactcactatagggacgatttcattttactagtaacgatagcaaaacagaggagattgctaatgttactagtaaacctggcggcagcgcaaaagatg

SEQ ID NO: 51280 - DNA, 103 bp, Artificial Sequence
  Synthetic Polynucleotide
taatacgactcactatagggtaaagacgatttcattttactagtaacgataacagaggagaatcgttatgagtaaaatgaacctggcggcagcgcaaaagatg

SEQ ID NO: 51281 - DNA, 103 bp, Artificial Sequence
  Synthetic Polynucleotide
taatacgactcactataggggaagacagataattttttcttcctaactgaaacagaggagatcagttatgaagaaaaaaaacctggcggcagcgcaaaagatg

SEQ ID NO: 51282 - DNA, 103 bp, Artificial Sequence
  Synthetic Polynucleotide
taatacgactcactatagggtcctctaaagacgatttcattttactagtaaacagaggagatactagatgaatgaaatcaacctggcggcagcgcaaaagatg

SEQ ID NO: 51283 - DNA, 103 bp, Artificial Sequence
  Synthetic Polynucleotide
taatacgactcactatagggatagatcctctaaagacgatttcattttacaacagaggagagtaaaaatgaatcgtcttaacctggcggcagcgcaaaagatg

SEQ ID NO: 51284 - DNA, 103 bp, Artificial Sequence
  Synthetic Polynucleotide
taatacgactcactatagggatctaatagatcctctaaagacgatttcataacagaggagaatgaaaatgtctttagagaacctggcggcagcgcaaaagatg

SEQ ID NO: 51285 - DNA, 103 bp, Artificial Sequence
  Synthetic Polynucleotide
taatacgactcactatagggtacacatctaatagatcctctaaagacgataacagaggagaatcgtcatgagaggatctaacctggcggcagcgcaaaagatg

SEQ ID NO: 51286 - DNA, 103 bp, Artificial Sequence
  Synthetic Polynucleotide
taatacgactcactatagggaattatacacatctaatagatcctctaaagaacagaggagactttagatgatctattagaacctggcggcagcgcaaaagatg

SEQ ID NO: 51287 - DNA, 103 bp, Artificial Sequence
  Synthetic Polynucleotide
taatacgactcactatagggaggagaattatacacatctaatagatcctcaacagaggagagaggatatgttagatgtgaacctggcggcagcgcaaaagatg

SEQ ID NO: 51288 - DNA, 103 bp, Artificial Sequence
  Synthetic Polynucleotide
taatacgactcactatagggttttcaggagaattatacacatctaatagaaacagaggagatctattatgtgtgtataaaacctggcggcagcgcaaaagatg

SEQ ID NO: 51289 - DNA, 103 bp, Artificial Sequence
  Synthetic Polynucleotide
taatacgactcactatagggcatcgttttcaggagaattatacacatctaaacagaggagatagatgatgataattctcaacctggcggcagcgcaaaagatg

SEQ ID NO: 51290 - DNA, 103 bp, Artificial Sequence
  Synthetic Polynucleotide
taatacgactcactatagggaccatcatcgttttcaggagaattatacacaacagaggagagtgtatatgtctcctgaaaacctggcggcagcgcaaaagatg

SEQ ID NO: 51291 - DNA, 103 bp, Artificial Sequence
  Synthetic Polynucleotide
taatacgactcactatagggtgactaccatcatcgttttcaggagaattaaacagaggagataattcatgtgaaaacgaaacctggcggcagcgcaaaagatg

SEQ ID NO: 51292 - DNA, 103 bp, Artificial Sequence
  Synthetic Polynucleotide
taatacgactcactatagggatgaagaagacagataattttttcttcctaaacagaggagataggaaatgaaaattatcaacctggcggcagcgcaaaagatg

SEQ ID NO: 51293 - DNA, 103 bp, Artificial Sequence
  Synthetic Polynucleotide
taatacgactcactatagggtcaattgactaccatcatcgttttcaggagaacagaggagactcctgatgacgatgatgaacctggcggcagcgcaaaagatg

SEQ ID NO: 51294 - DNA, 103 bp, Artificial Sequence
  Synthetic Polynucleotide
taatacgactcactatagggaaacatcaattgactaccatcatcgttttcaacagaggagagaaaacatggatggtagtaacctggcggcagcgcaaaagatg

SEQ ID NO: 51295 - DNA, 103 bp, Artificial Sequence
  Synthetic Polynucleotide
taatacgactcactatagggaacaaaaacatcaattgactaccatcatcgaacagaggagacgatgaatgtagtcaattaacctggcggcagcgcaaaagatg

SEQ ID NO: 51296 - DNA, 103 bp, Artificial Sequence
  Synthetic Polynucleotide
taatacgactcactatagggacgaaaacaaaaacatcaattgactaccataacagaggagaatggtaatgaattgatgtaacctggcggcagcgcaaaagatg

SEQ ID NO: 51297 - DNA, 103 bp, Artificial Sequence
  Synthetic Polynucleotide
taatacgactcactataggggtttgacgaaaacaaaaacatcaattgactaacagaggagaagtcaaatgatgtttttgaacctggcggcagcgcaaaagatg

SEQ ID NO: 51298 - DNA, 103 bp, Artificial Sequence
  Synthetic Polynucleotide
taatacgactcactatagggataatgtttgacgaaaacaaaaacatcaataacagaggagaattgatatgtttgttttcaacctggcggcagcgcaaaagatg

SEQ ID NO: 51299 - DNA, 103 bp, Artificial Sequence
  Synthetic Polynucleotide
taatacgactcactatagggcggacataatgtttgacgaaaacaaaaacaaacagaggagatgttttatgtttcgtcaaaacctggcggcagcgcaaaagatg

SEQ ID NO: 51300 - DNA, 103 bp, Artificial Sequence
  Synthetic Polynucleotide
taatacgactcactatagggggattcggacataatgtttgacgaaaacaaaacagaggagattgtttatgtcaaacattaacctggcggcagcgcaaaagatg

SEQ ID NO: 51301 - DNA, 103 bp, Artificial Sequence
  Synthetic Polynucleotide
taatacgactcactataggggtataggattcggacataatgtttgacgaaaacagaggagattcgtcatgcattatgtcaacctggcggcagcgcaaaagatg

SEQ ID NO: 51302 - DNA, 103 bp, Artificial Sequence
  Synthetic Polynucleotide
taatacgactcactatagggtcagagtataggattcggacataatgtttgaacagaggagacaaacaatgtgtccgaataacctggcggcagcgcaaaagatg

SEQ ID NO: 51303 - DNA, 103 bp, Artificial Sequence
  Synthetic Polynucleotide
taatacgactcactatagggcgatgatgaagaagacagataattttttctaacagaggagaagaaaaatgtatctgtctaacctggcggcagcgcaaaagatg

SEQ ID NO: 51304 - DNA, 103 bp, Artificial Sequence
  Synthetic Polynucleotide
taatacgactcactatagggctctttcagagtataggattcggacataataacagaggagaattatgatggaatcctataacctggcggcagcgcaaaagatg

SEQ ID NO: 51305 - DNA, 103 bp, Artificial Sequence
  Synthetic Polynucleotide
taatacgactcactatagggcttacctctttcagagtataggattcggacaacagaggagagtccgaatgctatactctaacctggcggcagcgcaaaagatg

SEQ ID NO: 51306 - DNA, 103 bp, Artificial Sequence
  Synthetic Polynucleotide
taatacgactcactatagggtatgccttacctctttcagagtataggattaacagaggagaaatcctatgctctgaaagaacctggcggcagcgcaaaagatg

SEQ ID NO: 51307 - DNA, 103 bp, Artificial Sequence
  Synthetic Polynucleotide
taatacgactcactatagggccaaatatgccttacctctttcagagtataaacagaggagatatactatgaaagaggtaaacctggcggcagcgcaaaagatg

SEQ ID NO: 51308 - DNA, 103 bp, Artificial Sequence
  Synthetic Polynucleotide
taatacgactcactatagggataaaccaaatatgccttacctctttcagaaacagaggagatctgaaatgggtaaggcaaacctggcggcagcgcaaaagatg

SEQ ID NO: 51309 - DNA, 103 bp, Artificial Sequence
  Synthetic Polynucleotide
taatacgactcactatagggtagtcataaaccaaatatgccttacctcttaacagaggagaaagaggatgggcatatttaacctggcggcagcgcaaaagatg

SEQ ID NO: 51310 - DNA, 103 bp, Artificial Sequence
  Synthetic Polynucleotide
taatacgactcactatagggcgggatagtcataaaccaaatatgccttacaacagaggagagtaaggatgatttggtttaacctggcggcagcgcaaaagatg

SEQ ID NO: 51311 - DNA, 103 bp, Artificial Sequence
  Synthetic Polynucleotide
taatacgactcactataggggtatccgggatagtcataaaccaaatatgcaacagaggagagcatatatggtttatgacaacctggcggcagcgcaaaagatg

SEQ ID NO: 51312 - DNA, 103 bp, Artificial Sequence
  Synthetic Polynucleotide
taatacgactcactatagggaaaaagtatccgggatagtcataaaccaaaaacagaggagatttggtatgtgactatccaacctggcggcagcgcaaaagatg

SEQ ID NO: 51313 - DNA, 103 bp, Artificial Sequence
  Synthetic Polynucleotide
taatacgactcactatagggttgagaaaaagtatccgggatagtcataaaaacagaggagatttatgatgatcccggataacctggcggcagcgcaaaagatg

SEQ ID NO: 51314 - DNA, 103 bp, Artificial Sequence
  Synthetic Polynucleotide
taatacgactcactatagggatagacgatgatgaagaagacagataatttaacagaggagaaaattaatggtcttcttcaacctggcggcagcgcaaaagatg

SEQ ID NO: 51315 - DNA, 103 bp, Artificial Sequence
  Synthetic Polynucleotide
taatacgactcactatagggttgtattgagaaaaagtatccgggatagtcaacagaggagagactatatgggatactttaacctggcggcagcgcaaaagatg

SEQ ID NO: 51316 - DNA, 103 bp, Artificial Sequence
  Synthetic Polynucleotide
taatacgactcactatagggtttggttgtattgagaaaaagtatccgggaaacagaggagatcccggatgctttttctcaacctggcggcagcgcaaaagatg

SEQ ID NO: 51317 - DNA, 103 bp, Artificial Sequence
  Synthetic Polynucleotide
taatacgactcactatagggaagaatttggttgtattgagaaaaagtatcaacagaggagagatactatgtctcaatacaacctggcggcagcgcaaaagatg

SEQ ID NO: 51318 - DNA, 103 bp, Artificial Sequence
  Synthetic Polynucleotide
taatacgactcactatagggcgtccaagaatttggttgtattgagaaaaaaacagaggagatttttcatgatacaaccaaacctggcggcagcgcaaaagatg

SEQ ID NO: 51319 - DNA, 103 bp, Artificial Sequence
  Synthetic Polynucleotide
taatacgactcactatagggtagatcgtccaagaatttggttgtattgagaacagaggagactcaatatgaccaaattcaacctggcggcagcgcaaaagatg

SEQ ID NO: 51320 - DNA, 103 bp, Artificial Sequence
  Synthetic Polynucleotide
taatacgactcactatagggtctaatagatcgtccaagaatttggttgtaaacagaggagatacaacatgattcttggaaacctggcggcagcgcaaaagatg

SEQ ID NO: 51321 - DNA, 103 bp, Artificial Sequence
  Synthetic Polynucleotide
taatacgactcactatagggaattttctaatagatcgtccaagaatttggaacagaggagaccaaatatgtggacgatcaacctggcggcagcgcaaaagatg

SEQ ID NO: 51322 - DNA, 103 bp, Artificial Sequence
  Synthetic Polynucleotide
taatacgactcactatagggaagagaattttctaatagatcgtccaagaaaacagaggagattcttgatggatctattaaacctggcggcagcgcaaaagatg

SEQ ID NO: 51323 - DNA, 103 bp, Artificial Sequence
  Synthetic Polynucleotide
taatacgactcactataggggacgtaagagaattttctaatagatcgtccaacagaggagaggacgaatgattagaaaaaacctggcggcagcgcaaaagatg

SEQ ID NO: 51324 - DNA, 103 bp, Artificial Sequence
  Synthetic Polynucleotide
taatacgactcactatagggatatcgacgtaagagaattttctaatagataacagaggagaatctatatgaaaattctcaacctggcggcagcgcaaaagatg

SEQ ID NO: 51325 - DNA, 103 bp, Artificial Sequence
  Synthetic Polynucleotide
taatacgactcactatagggatccaatagacgatgatgaagaagacagataacagaggagaatctgtatgcttcatcataacctggcggcagcgcaaaagatg

SEQ ID NO: 51326 - DNA, 103 bp, Artificial Sequence
  Synthetic Polynucleotide
taatacgactcactatagggcagaaatatcgacgtaagagaattttctaaaacagaggagattagaaatgtctcttacgaacctggcggcagcgcaaaagatg

SEQ ID NO: 51327 - DNA, 103 bp, Artificial Sequence
  Synthetic Polynucleotide
taatacgactcactataggggggttcagaaatatcgacgtaagagaatttaacagaggagaaaattcatgtacgtcgataacctggcggcagcgcaaaagatg

SEQ ID NO: 51328 - DNA, 103 bp, Artificial Sequence
  Synthetic Polynucleotide
taatacgactcactatagggttaacgggttcagaaatatcgacgtaagagaacagaggagactcttaatgcgatatttcaacctggcggcagcgcaaaagatg

SEQ ID NO: 51329 - DNA, 103 bp, Artificial Sequence
  Synthetic Polynucleotide
taatacgactcactatagggatacattaacgggttcagaaatatcgacgtaacagaggagaacgtcgatgtttctgaacaacctggcggcagcgcaaaagatg

SEQ ID NO: 51330 - DNA, 103 bp, Artificial Sequence
  Synthetic Polynucleotide
taatacgactcactatagggaagatatacattaacgggttcagaaatatcaacagaggagagatattatggaacccgttaacctggcggcagcgcaaaagatg

SEQ ID NO: 51331 - DNA, 103 bp, Artificial Sequence
  Synthetic Polynucleotide
taatacgactcactataggggctaaaagatatacattaacgggttcagaaaacagaggagattctgaatgcgttaatgtaacctggcggcagcgcaaaagatg

SEQ ID NO: 51332 - DNA, 103 bp, Artificial Sequence
  Synthetic Polynucleotide
taatacgactcactatagggcggctgctaaaagatatacattaacgggttaacagaggagaaacccgatgatgtatatcaacctggcggcagcgcaaaagatg

SEQ ID NO: 51333 - DNA, 103 bp, Artificial Sequence
  Synthetic Polynucleotide
taatacgactcactatagggatatacggctgctaaaagatatacattaacaacagaggagagttaatatgtatcttttaaacctggcggcagcgcaaaagatg

SEQ ID NO: 51334 - DNA, 103 bp, Artificial Sequence
  Synthetic Polynucleotide
taatacgactcactatagggtcggaatatacggctgctaaaagatatacaaacagaggagatgtataatgtttagcagcaacctggcggcagcgcaaaagatg

SEQ ID NO: 51335 - DNA, 103 bp, Artificial Sequence
  Synthetic Polynucleotide
taatacgactcactatagggtgaaatcggaatatacggctgctaaaagataacagaggagaatctttatgcagccgtataacctggcggcagcgcaaaagatg

SEQ ID NO: 51336 - DNA, 103 bp, Artificial Sequence
  Synthetic Polynucleotide
taatacgactcactatagggacgttatccaatagacgatgatgaagaagaaacagaggagatcttctatgtcatcgtctaacctggcggcagcgcaaaagatg

SEQ ID NO: 51337 - DNA, 103 bp, Artificial Sequence
  Synthetic Polynucleotide
taatacgactcactataggggtcattgaaatcggaatatacggctgctaaaacagaggagattagcaatggtatattccaacctggcggcagcgcaaaagatg

SEQ ID NO: 51338 - DNA, 103 bp, Artificial Sequence
  Synthetic Polynucleotide
taatacgactcactatagggacttcgtcattgaaatcggaatatacggctaacagaggagaagccgtatgttccgatttaacctggcggcagcgcaaaagatg

SEQ ID NO: 51339 - DNA, 103 bp, Artificial Sequence
  Synthetic Polynucleotide
taatacgactcactatagggacgtcacttcgtcattgaaatcggaatataaacagaggagatatattatgatttcaatgaacctggcggcagcgcaaaagatg

SEQ ID NO: 51340 - DNA, 103 bp, Artificial Sequence
  Synthetic Polynucleotide
taatacgactcactatagggtaatgacgtcacttcgtcattgaaatcggaaacagaggagatccgatatgaatgacgaaaacctggcggcagcgcaaaagatg

SEQ ID NO: 51341 - DNA, 103 bp, Artificial Sequence
  Synthetic Polynucleotide
taatacgactcactatagggtcgtttaatgacgtcacttcgtcattgaaaaacagaggagatttcaaatgcgaagtgacaacctggcggcagcgcaaaagatg

SEQ ID NO: 51342 - DNA, 103 bp, Artificial Sequence
  Synthetic Polynucleotide
taatacgactcactatagggtgtaatcgtttaatgacgtcacttcgtcataacagaggagaatgacgatgtgacgtcataacctggcggcagcgcaaaagatg

SEQ ID NO: 51343 - DNA, 103 bp, Artificial Sequence
  Synthetic Polynucleotide
taatacgactcactatagggctgcgtgtaatcgtttaatgacgtcacttcaacagaggagagaagtgatgtcattaaacaacctggcggcagcgcaaaagatg

SEQ ID NO: 51344 - DNA, 103 bp, Artificial Sequence
  Synthetic Polynucleotide
taatacgactcactatagggtcatcctgcgtgtaatcgtttaatgacgtcaacagaggagagacgtcatgaaacgattaaacctggcggcagcgcaaaagatg

SEQ ID NO: 51345 - DNA, 103 bp, Artificial Sequence
  Synthetic Polynucleotide
taatacgactcactatagggtcaattcatcctgcgtgtaatcgtttaatgaacagaggagacattaaatgattacacgcaacctggcggcagcgcaaaagatg

SEQ ID NO: 51346 - DNA, 103 bp, Artificial Sequence
  Synthetic Polynucleotide
taatacgactcactatagggattaatcaattcatcctgcgtgtaatcgttaacagaggagaaacgatatgacgcaggataacctggcggcagcgcaaaagatg

SEQ ID NO: 51347 - DNA, 103 bp, Artificial Sequence
  Synthetic Polynucleotide
taatacgactcactatagggaagatattttttctcacactgatccatgtaaacagaggagatacatgatgcagtgtgagaacctggcggcagcgcaaaagatg

SEQ ID NO: 51348 - DNA, 103 bp, Artificial Sequence
  Synthetic Polynucleotide
taatacgactcactatagggcagagacgttatccaatagacgatgatgaaaacagaggagattcatcatggtctattggaacctggcggcagcgcaaaagatg

SEQ ID NO: 51349 - DNA, 103 bp, Artificial Sequence
  Synthetic Polynucleotide
taatacgactcactatagggaaaacattaatcaattcatcctgcgtgtaaaacagaggagattacacatgggatgaattaacctggcggcagcgcaaaagatg

SEQ ID NO: 51350 - DNA, 103 bp, Artificial Sequence
  Synthetic Polynucleotide
taatacgactcactatagggagggtaaaacattaatcaattcatcctgcgaacagaggagacgcaggatgaattgattaaacctggcggcagcgcaaaagatg

SEQ ID NO: 51351 - DNA, 103 bp, Artificial Sequence
  Synthetic Polynucleotide
taatacgactcactataggggtcaaagggtaaaacattaatcaattcatcaacagaggagagatgaaatgattaatgttaacctggcggcagcgcaaaagatg

SEQ ID NO: 51352 - DNA, 103 bp, Artificial Sequence
  Synthetic Polynucleotide
taatacgactcactatagggttaatgtcaaagggtaaaacattaatcaataacagaggagaattgatatgtgttttaccaacctggcggcagcgcaaaagatg

SEQ ID NO: 51353 - DNA, 103 bp, Artificial Sequence
  Synthetic Polynucleotide
taatacgactcactataggggctttttaatgtcaaagggtaaaacattaaaacagaggagattaatgatgtaccctttgaacctggcggcagcgcaaaagatg

SEQ ID NO: 51354 - DNA, 103 bp, Artificial Sequence
  Synthetic Polynucleotide
taatacgactcactatagggcaacagctttttaatgtcaaagggtaaaacaacagaggagagttttaatgtttgacattaacctggcggcagcgcaaaagatg

SEQ ID NO: 51355 - DNA, 103 bp, Artificial Sequence
  Synthetic Polynucleotide
taatacgactcactatagggagatacaacagctttttaatgtcaaagggtaacagaggagaacccttatgcattaaaaaaacctggcggcagcgcaaaagatg

SEQ ID NO: 51356 - DNA, 103 bp, Artificial Sequence
  Synthetic Polynucleotide
taatacgactcactatagggattttagatacaacagctttttaatgtcaaaacagaggagattgacaatgaaaagctgtaacctggcggcagcgcaaaagatg

SEQ ID NO: 51357 - DNA, 103 bp, Artificial Sequence
  Synthetic Polynucleotide
taatacgactcactatagggcttaaattttagatacaacagctttttaataacagaggagaattaaaatgctgttgtataacctggcggcagcgcaaaagatg

SEQ ID NO: 51358 - DNA, 103 bp, Artificial Sequence
  Synthetic Polynucleotide
taatacgactcactatagggttagtcttaaattttagatacaacagctttaacagaggagaaaagctatggtatctaaaaacctggcggcagcgcaaaagatg

SEQ ID NO: 51359 - DNA, 103 bp, Artificial Sequence
  Synthetic Polynucleotide
taatacgactcactataggggaatacagagacgttatccaatagacgatgaacagaggagacatcgtatgttggataacaacctggcggcagcgcaaaagatg

SEQ ID NO: 51360 - DNA, 103 bp, Artificial Sequence
  Synthetic Polynucleotide
taatacgactcactatagggtttctttagtcttaaattttagatacaacaaacagaggagatgttgtatgtaaaatttaaacctggcggcagcgcaaaagatg

SEQ ID NO: 51361 - DNA, 103 bp, Artificial Sequence
  Synthetic Polynucleotide
taatacgactcactatagggattcgtttctttagtcttaaattttagataaacagaggagatatctaatgtttaagactaacctggcggcagcgcaaaagatg

SEQ ID NO: 51362 - DNA, 103 bp, Artificial Sequence
  Synthetic Polynucleotide
taatacgactcactatagggattctattcgtttctttagtcttaaattttaacagaggagaaaaattatggactaaagaaacctggcggcagcgcaaaagatg

SEQ ID NO: 51363 - DNA, 103 bp, Artificial Sequence
  Synthetic Polynucleotide
taatacgactcactatagggagtatattctattcgtttctttagtcttaaaacagaggagattaagaatgaagaaacgaaacctggcggcagcgcaaaagatg

SEQ ID NO: 51364 - DNA, 103 bp, Artificial Sequence
  Synthetic Polynucleotide
taatacgactcactatagggaatagagtatattctattcgtttctttagtaacagaggagaactaaaatgacgaatagaaacctggcggcagcgcaaaagatg

SEQ ID NO: 51365 - DNA, 103 bp, Artificial Sequence
  Synthetic Polynucleotide
taatacgactcactatagggtgaagaatagagtatattctattcgtttctaacagaggagaagaaacatgtagaatataaacctggcggcagcgcaaaagatg

SEQ ID NO: 51366 - DNA, 103 bp, Artificial Sequence
  Synthetic Polynucleotide
taatacgactcactatagggtctcttgaagaatagagtatattctattcgaacagaggagacgaataatgtatactctaaacctggcggcagcgcaaaagatg

SEQ ID NO: 51367 - DNA, 103 bp, Artificial Sequence
  Synthetic Polynucleotide
taatacgactcactatagggagacatctcttgaagaatagagtatattctaacagaggagaagaataatgtctattcttaacctggcggcagcgcaaaagatg

SEQ ID NO: 51368 - DNA, 103 bp, Artificial Sequence
  Synthetic Polynucleotide
taatacgactcactataggggtttcagacatctcttgaagaatagagtataacagaggagaatactcatgtcttcaagaaacctggcggcagcgcaaaagatg

SEQ ID NO: 51369 - DNA, 103 bp, Artificial Sequence
  Synthetic Polynucleotide
taatacgactcactatagggaatacgtttcagacatctcttgaagaatagaacagaggagactattcatgaagagatgtaacctggcggcagcgcaaaagatg

SEQ ID NO: 51370 - DNA, 103 bp, Artificial Sequence
  Synthetic Polynucleotide
taatacgactcactatagggtcgtagaatacagagacgttatccaatagaaacagaggagatctattatgtaacgtctcaacctggcggcagcgcaaaagatg

SEQ ID NO: 51371 - DNA, 103 bp, Artificial Sequence
  Synthetic Polynucleotide
taatacgactcactatagggaagagaatacgtttcagacatctcttgaagaacagaggagacttcaaatgatgtctgaaaacctggcggcagcgcaaaagatg

SEQ ID NO: 51372 - DNA, 103 bp, Artificial Sequence
  Synthetic Polynucleotide
taatacgactcactatagggggtggaagagaatacgtttcagacatctctaacagaggagaagagatatgtgaaacgtaaacctggcggcagcgcaaaagatg

SEQ ID NO: 51373 - DNA, 103 bp, Artificial Sequence
  Synthetic Polynucleotide
taatacgactcactataggggatgtggtggaagagaatacgtttcagacaaacagaggagatgtctgatgcgtattctcaacctggcggcagcgcaaaagatg

SEQ ID NO: 51374 - DNA, 103 bp, Artificial Sequence
  Synthetic Polynucleotide
taatacgactcactatagggtgatggatgtggtggaagagaatacgtttcaacagaggagagaaacgatgtctcttccaaacctggcggcagcgcaaaagatg

SEQ ID NO: 51375 - DNA, 103 bp, Artificial Sequence
  Synthetic Polynucleotide
taatacgactcactatagggacaattgatggatgtggtggaagagaatacaacagaggagagtattcatgtccaccacaaacctggcggcagcgcaaaagatg

SEQ ID NO: 51376 - DNA, 103 bp, Artificial Sequence
  Synthetic Polynucleotide
taatacgactcactatagggcttttacaattgatggatgtggtggaagagaacagaggagactcttcatgcacatccataacctggcggcagcgcaaaagatg

SEQ ID NO: 51377 - DNA, 103 bp, Artificial Sequence
  Synthetic Polynucleotide
taatacgactcactatagggtaaaacttttacaattgatggatgtggtggaacagaggagaccaccaatgccatcaattaacctggcggcagcgcaaaagatg

SEQ ID NO: 51378 - DNA, 103 bp, Artificial Sequence
  Synthetic Polynucleotide
taatacgactcactatagggcccaataaaacttttacaattgatggatgtaacagaggagaacatccatgaattgtaaaaacctggcggcagcgcaaaagatg

SEQ ID NO: 51379 - DNA, 103 bp, Artificial Sequence
  Synthetic Polynucleotide
taatacgactcactatagggattctcccaataaaacttttacaattgatgaacagaggagacatcaaatgtaaaagtttaacctggcggcagcgcaaaagatg

SEQ ID NO: 51380 - DNA, 103 bp, Artificial Sequence
  Synthetic Polynucleotide
taatacgactcactataggggaccaattctcccaataaaacttttacaataacagaggagaattgtaatggttttattgaacctggcggcagcgcaaaagatg

SEQ ID NO: 51381 - DNA, 103 bp, Artificial Sequence
  Synthetic Polynucleotide
taatacgactcactatagggctctatcgtagaatacagagacgttatccaaacagaggagatggataatgtctctgtataacctggcggcagcgcaaaagatg

SEQ ID NO: 51382 - DNA, 103 bp, Artificial Sequence
  Synthetic Polynucleotide
taatacgactcactatagggtgtctgaccaattctcccaataaaacttttaacagaggagaaaaagtatgattgggagaaacctggcggcagcgcaaaagatg

SEQ ID NO: 51383 - DNA, 103 bp, Artificial Sequence
  Synthetic Polynucleotide
taatacgactcactatagggaaaattgtctgaccaattctcccaataaaaaacagaggagattttatatggagaattggaacctggcggcagcgcaaaagatg

SEQ ID NO: 51384 - DNA, 103 bp, Artificial Sequence
  Synthetic Polynucleotide
taatacgactcactatagggataaaaaaattgtctgaccaattctcccaaaacagaggagattgggaatgttggtcagaaacctggcggcagcgcaaaagatg

SEQ ID NO: 51385 - DNA, 103 bp, Artificial Sequence
  Synthetic Polynucleotide
taatacgactcactatagggttattataaaaaaattgtctgaccaattctaacagaggagaagaattatgcagacaattaacctggcggcagcgcaaaagatg

SEQ ID NO: 51386 - DNA, 103 bp, Artificial Sequence
  Synthetic Polynucleotide
taatacgactcactataggggagaattattataaaaaaattgtctgaccaaacagaggagatggtcaatgaatttttttaacctggcggcagcgcaaaagatg

SEQ ID NO: 51387 - DNA, 103 bp, Artificial Sequence
  Synthetic Polynucleotide
taatacgactcactatagggaatacgagaattattataaaaaaattgtctaacagaggagaagacaaatgttttataataacctggcggcagcgcaaaagatg

SEQ ID NO: 51388 - DNA, 103 bp, Artificial Sequence
  Synthetic Polynucleotide
taatacgactcactatagggtacttaatacgagaattattataaaaaaataacagaggagaatttttatgtaataattcaacctggcggcagcgcaaaagatg

SEQ ID NO: 51389 - DNA, 103 bp, Artificial Sequence
  Synthetic Polynucleotide
taatacgactcactatagggcgttatacttaatacgagaattattataaaaacagaggagatttataatgattctcgtaaacctggcggcagcgcaaaagatg

SEQ ID NO: 51390 - DNA, 103 bp, Artificial Sequence
  Synthetic Polynucleotide
taatacgactcactatagggggcatcgttatacttaatacgagaattattaacagaggagaaataatatgcgtattaagaacctggcggcagcgcaaaagatg

SEQ ID NO: 51391 - DNA, 103 bp, Artificial Sequence
  Synthetic Polynucleotide
taatacgactcactatagggaacttggcatcgttatacttaatacgagaaaacagaggagattctcgatgtaagtataaaacctggcggcagcgcaaaagatg

SEQ ID NO: 51392 - DNA, 103 bp, Artificial Sequence
  Synthetic Polynucleotide
taatacgactcactatagggtagcactctatcgtagaatacagagacgttaacagaggagaaacgtcatggtattctacaacctggcggcagcgcaaaagatg

SEQ ID NO: 51393 - DNA, 103 bp, Artificial Sequence
  Synthetic Polynucleotide
taatacgactcactatagggtaagtaacttggcatcgttatacttaatacaacagaggagagtattaatgataacgatgaacctggcggcagcgcaaaagatg

SEQ ID NO: 51394 - DNA, 103 bp, Artificial Sequence
  Synthetic Polynucleotide
taatacgactcactatagggcattttaagtaacttggcatcgttatacttaacagaggagaaagtatatggatgccaagaacctggcggcagcgcaaaagatg

SEQ ID NO: 51395 - DNA, 103 bp, Artificial Sequence
  Synthetic Polynucleotide
taatacgactcactataggggtaaccattttaagtaacttggcatcgttaaacagaggagataacgaatgcaagttactaacctggcggcagcgcaaaagatg

SEQ ID NO: 51396 - DNA, 103 bp, Artificial Sequence
  Synthetic Polynucleotide
taatacgactcactatagggctgatgtaaccattttaagtaacttggcataacagaggagaatgccaatgtacttaaaaaacctggcggcagcgcaaaagatg

SEQ ID NO: 51397 - DNA, 103 bp, Artificial Sequence
  Synthetic Polynucleotide
taatacgactcactatagggtataactgatgtaaccattttaagtaacttaacagaggagaaagttaatgaaaatggttaacctggcggcagcgcaaaagatg

SEQ ID NO: 51398 - DNA, 103 bp, Artificial Sequence
  Synthetic Polynucleotide
taatacgactcactatagggttttttataactgatgtaaccattttaagtaacagaggagaacttaaatgggttacatcaacctggcggcagcgcaaaagatg

SEQ ID NO: 51399 - DNA, 103 bp, Artificial Sequence
  Synthetic Polynucleotide
taatacgactcactatagggctttattttttataactgatgtaaccatttaacagaggagaaaatggatgcatcagttaaacctggcggcagcgcaaaagatg

SEQ ID NO: 51400 - DNA, 103 bp, Artificial Sequence
  Synthetic Polynucleotide
taatacgactcactataggggtcttctttattttttataactgatgtaacaacagaggagagttacaatggttataaaaaacctggcggcagcgcaaaagatg

SEQ ID NO: 51401 - DNA, 103 bp, Artificial Sequence
  Synthetic Polynucleotide
taatacgactcactatagggctagcgtcttctttattttttataactgataacagaggagaatcagtatgaaaaaataaaacctggcggcagcgcaaaagatg

SEQ ID NO: 51402 - DNA, 103 bp, Artificial Sequence
  Synthetic Polynucleotide
taatacgactcactatagggaattcctagcgtcttctttattttttataaaacagaggagattataaatgataaagaagaacctggcggcagcgcaaaagatg

SEQ ID NO: 51403 - DNA, 103 bp, Artificial Sequence
  Synthetic Polynucleotide
taatacgactcactatagggtaaagtagcactctatcgtagaatacagagaacagaggagactctgtatgctacgatagaacctggcggcagcgcaaaagatg

SEQ ID NO: 51404 - DNA, 103 bp, Artificial Sequence
  Synthetic Polynucleotide
taatacgactcactatagggtatgtaattcctagcgtcttctttatttttaacagaggagaaaaaatatggaagacgctaacctggcggcagcgcaaaagatg

SEQ ID NO: 51405 - DNA, 103 bp, Artificial Sequence
  Synthetic Polynucleotide
taatacgactcactatagggtcatctatgtaattcctagcgtcttctttaaacagaggagataaagaatgcgctaggaaaacctggcggcagcgcaaaagatg

SEQ ID NO: 51406 - DNA, 103 bp, Artificial Sequence
  Synthetic Polynucleotide
taatacgactcactatagggcaatatcatctatgtaattcctagcgtcttaacagaggagaaagacgatgggaattacaaacctggcggcagcgcaaaagatg

SEQ ID NO: 51407 - DNA, 103 bp, Artificial Sequence
  Synthetic Polynucleotide
taatacgactcactataggggtttacaatatcatctatgtaattcctagcaacagaggagagctaggatgtacatagataacctggcggcagcgcaaaagatg

SEQ ID NO: 51408 - DNA, 103 bp, Artificial Sequence
  Synthetic Polynucleotide
taatacgactcactatagggtgaccgtttacaatatcatctatgtaattcaacagaggagagaattaatgagatgatataacctggcggcagcgcaaaagatg

SEQ ID NO: 51409 - DNA, 103 bp, Artificial Sequence
  Synthetic Polynucleotide
taatacgactcactatagggagaagtgaccgtttacaatatcatctatgtaacagaggagaacatagatgatattgtaaaacctggcggcagcgcaaaagatg

SEQ ID NO: 51410 - DNA, 103 bp, Artificial Sequence
  Synthetic Polynucleotide
taatacgactcactatagggtacaaagaagtgaccgtttacaatatcatcaacagaggagagatgatatggtaaacggtaacctggcggcagcgcaaaagatg

SEQ ID NO: 51411 - DNA, 103 bp, Artificial Sequence
  Synthetic Polynucleotide
taatacgactcactatagggttcgatacaaagaagtgaccgtttacaataaacagaggagatattgtatgcggtcacttaacctggcggcagcgcaaaagatg

SEQ ID NO: 51412 - DNA, 103 bp, Artificial Sequence
  Synthetic Polynucleotide
taatacgactcactatagggctttattcgatacaaagaagtgaccgtttaaacagaggagataaacgatgacttctttgaacctggcggcagcgcaaaagatg

SEQ ID NO: 51413 - DNA, 103 bp, Artificial Sequence
  Synthetic Polynucleotide
taatacgactcactatagggaaatactttattcgatacaaagaagtgaccaacagaggagaggtcacatgtttgtatcgaacctggcggcagcgcaaaagatg

SEQ ID NO: 51414 - DNA, 103 bp, Artificial Sequence
  Synthetic Polynucleotide
taatacgactcactatagggcatcttaaagtagcactctatcgtagaataaacagaggagatattctatgatagagtgcaacctggcggcagcgcaaaagatg

SEQ ID NO: 51415 - DNA, 103 bp, Artificial Sequence
  Synthetic Polynucleotide
taatacgactcactatagggttatcaaatactttattcgatacaaagaagaacagaggagacttcttatgatcgaataaaacctggcggcagcgcaaaagatg

SEQ ID NO: 51416 - DNA, 103 bp, Artificial Sequence
  Synthetic Polynucleotide
taatacgactcactataggggagatttatcaaatactttattcgatacaaaacagaggagattgtatatgataaagtataacctggcggcagcgcaaaagatg

SEQ ID NO: 51417 - DNA, 103 bp, Artificial Sequence
  Synthetic Polynucleotide
taatacgactcactatagggtaaaagagatttatcaaatactttattcgaaacagaggagatcgaatatggtatttgataacctggcggcagcgcaaaagatg

SEQ ID NO: 51418 - DNA, 103 bp, Artificial Sequence
  Synthetic Polynucleotide
taatacgactcactatagggttgtataaaagagatttatcaaatactttaaacagaggagataaagtatgtgataaatcaacctggcggcagcgcaaaagatg

SEQ ID NO: 51419 - DNA, 103 bp, Artificial Sequence
  Synthetic Polynucleotide
taatacgactcactatagggcgtatttgtataaaagagatttatcaaataaacagaggagatatttgatgaatctctttaacctggcggcagcgcaaaagatg

SEQ ID NO: 51420 - DNA, 103 bp, Artificial Sequence
  Synthetic Polynucleotide
taatacgactcactataggggttttcgtatttgtataaaagagatttatcaacagaggagagataaaatgcttttatacaacctggcggcagcgcaaaagatg

SEQ ID NO: 51421 - DNA, 103 bp, Artificial Sequence
  Synthetic Polynucleotide
taatacgactcactatagggatatcgttttcgtatttgtataaaagagataacagaggagaatctctatgatacaaataaacctggcggcagcgcaaaagatg

SEQ ID NO: 51422 - DNA, 103 bp, Artificial Sequence
  Synthetic Polynucleotide
taatacgactcactatagggtaataatatcgttttcgtatttgtataaaaaacagaggagattttatatgaatacgaaaaacctggcggcagcgcaaaagatg

SEQ ID NO: 51423 - DNA, 103 bp, Artificial Sequence
  Synthetic Polynucleotide
taatacgactcactatagggtactgtaataatatcgttttcgtatttgtaaacagaggagatacaaaatggaaaacgataacctggcggcagcgcaaaagatg

SEQ ID NO: 51424 - DNA, 103 bp, Artificial Sequence
  Synthetic Polynucleotide
taatacgactcactatagggaacggtactgtaataatatcgttttcgtataacagaggagaatacgaatgcgatattataacctggcggcagcgcaaaagatg

SEQ ID NO: 51425 - DNA, 103 bp, Artificial Sequence
  Synthetic Polynucleotide
taatacgactcactatagggtgtctcatcttaaagtagcactctatcgtaaacagaggagatacgatatggtgctacttaacctggcggcagcgcaaaagatg

SEQ ID NO: 51426 - DNA, 103 bp, Artificial Sequence
  Synthetic Polynucleotide
taatacgactcactataggggtctaaacggtactgtaataatatcgttttaacagaggagaaaaacgatgttattacagaacctggcggcagcgcaaaagatg

SEQ ID NO: 51427 - DNA, 103 bp, Artificial Sequence
  Synthetic Polynucleotide
taatacgactcactatagggggaaagtctaaacggtactgtaataatatcaacagaggagagatattatgacagtaccgaacctggcggcagcgcaaaagatg

SEQ ID NO: 51428 - DNA, 103 bp, Artificial Sequence
  Synthetic Polynucleotide
taatacgactcactatagggtcgtaggaaagtctaaacggtactgtaataaacagaggagatattacatgaccgtttagaacctggcggcagcgcaaaagatg

SEQ ID NO: 51429 - DNA, 103 bp, Artificial Sequence
  Synthetic Polynucleotide
taatacgactcactatagggacggttcgtaggaaagtctaaacggtactgaacagaggagacagtacatgttagactttaacctggcggcagcgcaaaagatg

SEQ ID NO: 51430 - DNA, 103 bp, Artificial Sequence
  Synthetic Polynucleotide
taatacgactcactatagggaacaaacggttcgtaggaaagtctaaacggaacagaggagaccgtttatgctttcctacaacctggcggcagcgcaaaagatg

SEQ ID NO: 51431 - DNA, 103 bp, Artificial Sequence
  Synthetic Polynucleotide
taatacgactcactatagggccccaaacaaacggttcgtaggaaagtctaaacagaggagatagactatgctacgaaccaacctggcggcagcgcaaaagatg

SEQ ID NO: 51432 - DNA, 103 bp, Artificial Sequence
  Synthetic Polynucleotide
taatacgactcactatagggtaactccccaaacaaacggttcgtaggaaaaacagaggagatttcctatgaaccgtttgaacctggcggcagcgcaaaagatg

SEQ ID NO: 51433 - DNA, 103 bp, Artificial Sequence
  Synthetic Polynucleotide
taatacgactcactatagggaaagttaactccccaaacaaacggttcgtaaacagaggagatacgaaatgtttgtttggaacctggcggcagcgcaaaagatg

SEQ ID NO: 51434 - DNA, 103 bp, Artificial Sequence
  Synthetic Polynucleotide
taatacgactcactatagggttacgaaagttaactccccaaacaaacggtaacagaggagaaccgttatgttggggagtaacctggcggcagcgcaaaagatg

SEQ ID NO: 51435 - DNA, 103 bp, Artificial Sequence
  Synthetic Polynucleotide
taatacgactcactatagggattccttacgaaagttaactccccaaacaaaacagaggagattgtttatggagttaactaacctggcggcagcgcaaaagatg

SEQ ID NO: 51436 - DNA, 103 bp, Artificial Sequence
  Synthetic Polynucleotide
taatacgactcactatagggggatatgtctcatcttaaagtagcactctaaacagaggagatagagtatgactttaagaaacctggcggcagcgcaaaagatg

SEQ ID NO: 51437 - DNA, 103 bp, Artificial Sequence
  Synthetic Polynucleotide
taatacgactcactataggggttatattccttacgaaagttaactccccaaacagaggagatggggaatgaactttcgtaacctggcggcagcgcaaaagatg

SEQ ID NO: 51438 - DNA, 103 bp, Artificial Sequence
  Synthetic Polynucleotide
taatacgactcactatagggaccacgttatattccttacgaaagttaactaacagaggagaagttaaatgtcgtaaggaaacctggcggcagcgcaaaagatg

SEQ ID NO: 51439 - DNA, 103 bp, Artificial Sequence
  Synthetic Polynucleotide
taatacgactcactatagggaagataccacgttatattccttacgaaagtaacagaggagaactttcatgaggaatataaacctggcggcagcgcaaaagatg

SEQ ID NO: 51440 - DNA, 103 bp, Artificial Sequence
  Synthetic Polynucleotide
taatacgactcactatagggtggagaagataccacgttatattccttacgaacagaggagacgtaagatgtataacgtgaacctggcggcagcgcaaaagatg

SEQ ID NO: 51441 - DNA, 103 bp, Artificial Sequence
  Synthetic Polynucleotide
taatacgactcactatagggttttatggagaagataccacgttatattccaacagaggagaggaataatgcgtggtatcaacctggcggcagcgcaaaagatg

SEQ ID NO: 51442 - DNA, 103 bp, Artificial Sequence
  Synthetic Polynucleotide
taatacgactcactatagggatcagttttatggagaagataccacgttataacagaggagaataacgatgtatcttctcaacctggcggcagcgcaaaagatg

SEQ ID NO: 51443 - DNA, 103 bp, Artificial Sequence
  Synthetic Polynucleotide
taatacgactcactatagggattttatcagttttatggagaagataccacaacagaggagagtggtaatgtctccataaaacctggcggcagcgcaaaagatg

SEQ ID NO: 51444 - DNA, 103 bp, Artificial Sequence
  Synthetic Polynucleotide
taatacgactcactatagggtatatattttatcagttttatggagaagataacagaggagaatcttcatgataaaactgaacctggcggcagcgcaaaagatg

SEQ ID NO: 51445 - DNA, 103 bp, Artificial Sequence
  Synthetic Polynucleotide
taatacgactcactatagggttctttatatattttatcagttttatggagaacagaggagactccatatgactgataaaaacctggcggcagcgcaaaagatg

SEQ ID NO: 51446 - DNA, 103 bp, Artificial Sequence
  Synthetic Polynucleotide
taatacgactcactatagggtttatttctttatatattttatcagttttaaacagaggagataaaacatgtaaaatataaacctggcggcagcgcaaaagatg

SEQ ID NO: 51447 - DNA, 103 bp, Artificial Sequence
  Synthetic Polynucleotide
taatacgactcactatagggaacacggatatgtctcatcttaaagtagcaaacagaggagatgctacatgaagatgagaaacctggcggcagcgcaaaagatg

SEQ ID NO: 51448 - DNA, 103 bp, Artificial Sequence
  Synthetic Polynucleotide
taatacgactcactatagggcgacatttatttctttatatattttatcagaacagaggagactgataatgtatataaagaacctggcggcagcgcaaaagatg

SEQ ID NO: 51449 - DNA, 103 bp, Artificial Sequence
  Synthetic Polynucleotide
taatacgactcactatagggaagctcgacatttatttctttatatattttaacagaggagaaaaataatgaaagaaataaacctggcggcagcgcaaaagatg

SEQ ID NO: 51450 - DNA, 103 bp, Artificial Sequence
  Synthetic Polynucleotide
taatacgactcactatagggtaacaaagctcgacatttatttctttatataacagaggagaatataaatgaataaatgtaacctggcggcagcgcaaaagatg

SEQ ID NO: 51451 - DNA, 103 bp, Artificial Sequence
  Synthetic Polynucleotide
taatacgactcactatagggattggtaacaaagctcgacatttatttcttaacagaggagaaagaaaatgatgtcgagcaacctggcggcagcgcaaaagatg

SEQ ID NO: 51452 - DNA, 103 bp, Artificial Sequence
  Synthetic Polynucleotide
taatacgactcactatagggtatccattggtaacaaagctcgacatttataacagaggagaataaatatggagctttgtaacctggcggcagcgcaaaagatg

SEQ ID NO: 51453 - DNA, 103 bp, Artificial Sequence
  Synthetic Polynucleotide
taatacgactcactataggggaaggtatccattggtaacaaagctcgacaaacagaggagatgtcgaatgttgttaccaaacctggcggcagcgcaaaagatg

SEQ ID NO: 51454 - DNA, 103 bp, Artificial Sequence
  Synthetic Polynucleotide
taatacgactcactatagggaactggaaggtatccattggtaacaaagctaacagaggagaagctttatgaccaatggaaacctggcggcagcgcaaaagatg

SEQ ID NO: 51455 - DNA, 103 bp, Artificial Sequence
  Synthetic Polynucleotide
taatacgactcactatagggaatgtaactggaaggtatccattggtaacaaacagaggagatgttacatgtggatacctaacctggcggcagcgcaaaagatg

SEQ ID NO: 51456 - DNA, 103 bp, Artificial Sequence
  Synthetic Polynucleotide
taatacgactcactataggggttccaatgtaactggaaggtatccattggaacagaggagaccaatgatgaccttccagaacctggcggcagcgcaaaagatg

SEQ ID NO: 51457 - DNA, 103 bp, Artificial Sequence
  Synthetic Polynucleotide
taatacgactcactatagggatgtggttccaatgtaactggaaggtatccaacagaggagaggatacatgccagttacaaacctggcggcagcgcaaaagatg

SEQ ID NO: 51458 - DNA, 103 bp, Artificial Sequence
  Synthetic Polynucleotide
taatacgactcactatagggtatacaagatattttttctcacactgatccaacagaggagaggatcaatgtgagaaaaaaacctggcggcagcgcaaaagatg

SEQ ID NO: 51459 - DNA, 103 bp, Artificial Sequence
  Synthetic Polynucleotide
taatacgactcactatagggttgataacacggatatgtctcatcttaaagaacagaggagactttaaatggagacatataacctggcggcagcgcaaaagatg

SEQ ID NO: 51460 - DNA, 103 bp, Artificial Sequence
  Synthetic Polynucleotide
taatacgactcactatagggagctcatgtggttccaatgtaactggaaggaacagaggagaccttccatgtacattggaaacctggcggcagcgcaaaagatg

SEQ ID NO: 51461 - DNA, 103 bp, Artificial Sequence
  Synthetic Polynucleotide
taatacgactcactatagggacgtcagctcatgtggttccaatgtaactgaacagaggagacagttaatgtggaaccacaacctggcggcagcgcaaaagatg

SEQ ID NO: 51462 - DNA, 103 bp, Artificial Sequence
  Synthetic Polynucleotide
taatacgactcactataggggtctaacgtcagctcatgtggttccaatgtaacagaggagaacattgatgccacatgagaacctggcggcagcgcaaaagatg

SEQ ID NO: 51463 - DNA, 103 bp, Artificial Sequence
  Synthetic Polynucleotide
taatacgactcactatagggtttatgtctaacgtcagctcatgtggttccaacagaggagaggaaccatgtgagctgacaacctggcggcagcgcaaaagatg

SEQ ID NO: 51464 - DNA, 103 bp, Artificial Sequence
  Synthetic Polynucleotide
taatacgactcactatagggtagtttttatgtctaacgtcagctcatgtgaacagaggagacacatgatgtgacgttagaacctggcggcagcgcaaaagatg

SEQ ID NO: 51465 - DNA, 103 bp, Artificial Sequence
  Synthetic Polynucleotide
taatacgactcactatagggaatattagtttttatgtctaacgtcagctcaacagaggagagagctgatgttagacataaacctggcggcagcgcaaaagatg

SEQ ID NO: 51466 - DNA, 103 bp, Artificial Sequence
  Synthetic Polynucleotide
taatacgactcactatagggttcctaatattagtttttatgtctaacgtcaacagaggagagacgttatgcataaaaacaacctggcggcagcgcaaaagatg

SEQ ID NO: 51467 - DNA, 103 bp, Artificial Sequence
  Synthetic Polynucleotide
taatacgactcactatagggcggcattcctaatattagtttttatgtctaaacagaggagatagacaatgaaactaataaacctggcggcagcgcaaaagatg

SEQ ID NO: 51468 - DNA, 103 bp, Artificial Sequence
  Synthetic Polynucleotide
taatacgactcactatagggatatacggcattcctaatattagtttttataacagaggagaataaaaatgaatattaggaacctggcggcagcgcaaaagatg

SEQ ID NO: 51469 - DNA, 103 bp, Artificial Sequence
  Synthetic Polynucleotide
taatacgactcactataggggtcttatatacggcattcctaatattagttaacagaggagaaactaaatgtaggaatgcaacctggcggcagcgcaaaagatg

SEQ ID NO: 51470 - DNA, 103 bp, Artificial Sequence
  Synthetic Polynucleotide
taatacgactcactatagggtatttttgataacacggatatgtctcatctaacagaggagaagatgaatgatatccgtgaacctggcggcagcgcaaaagatg

SEQ ID NO: 51471 - DNA, 103 bp, Artificial Sequence
  Synthetic Polynucleotide
taatacgactcactataggggatacgtcttatatacggcattcctaatataacagaggagaatattaatgatgccgtataacctggcggcagcgcaaaagatg

SEQ ID NO: 51472 - DNA, 103 bp, Artificial Sequence
  Synthetic Polynucleotide
taatacgactcactatagggatggagatacgtcttatatacggcattcctaacagaggagaaggaatatggtatataagaacctggcggcagcgcaaaagatg

SEQ ID NO: 51473 - DNA, 103 bp, Artificial Sequence
  Synthetic Polynucleotide
taatacgactcactatagggtctttatggagatacgtcttatatacggcaaacagaggagatgccgtatgtaagacgtaaacctggcggcagcgcaaaagatg

SEQ ID NO: 51474 - DNA, 103 bp, Artificial Sequence
  Synthetic Polynucleotide
taatacgactcactatagggtaatttctttatggagatacgtcttatataaacagaggagatatataatgcgtatctccaacctggcggcagcgcaaaagatg

SEQ ID NO: 51475 - DNA, 103 bp, Artificial Sequence
  Synthetic Polynucleotide
taatacgactcactatagggaccactaatttctttatggagatacgtcttaacagaggagaaagacgatgctccataaaaacctggcggcagcgcaaaagatg

SEQ ID NO: 51476 - DNA, 103 bp, Artificial Sequence
  Synthetic Polynucleotide
taatacgactcactatagggattttaccactaatttctttatggagatacaacagaggagagtatctatgtaaagaaataacctggcggcagcgcaaaagatg

SEQ ID NO: 51477 - DNA, 103 bp, Artificial Sequence
  Synthetic Polynucleotide
taatacgactcactatagggtggccattttaccactaatttctttatggaaacagaggagatccataatgaaattagtgaacctggcggcagcgcaaaagatg

SEQ ID NO: 51478 - DNA, 103 bp, Artificial Sequence
  Synthetic Polynucleotide
taatacgactcactatagggtttcttggccattttaccactaatttctttaacagaggagaaaagaaatgagtggtaaaaacctggcggcagcgcaaaagatg

SEQ ID NO: 51479 - DNA, 103 bp, Artificial Sequence
  Synthetic Polynucleotide
taatacgactcactatagggtctattttcttggccattttaccactaattaacagaggagaaattagatgtaaaatggcaacctggcggcagcgcaaaagatg

SEQ ID NO: 51480 - DNA, 103 bp, Artificial Sequence
  Synthetic Polynucleotide
taatacgactcactatagggaaatttctattttcttggccattttaccacaacagaggagagtggtaatgtggccaagaaacctggcggcagcgcaaaagatg

SEQ ID NO: 51481 - DNA, 103 bp, Artificial Sequence
  Synthetic Polynucleotide
taatacgactcactataggggagtatatttttgataacacggatatgtctaacagaggagaagacatatgcgtgttatcaacctggcggcagcgcaaaagatg

SEQ ID NO: 51482 - DNA, 103 bp, Artificial Sequence
  Synthetic Polynucleotide
taatacgactcactatagggtttacaaatttctattttcttggccattttaacagaggagaaaaatgatgaagaaaataaacctggcggcagcgcaaaagatg

SEQ ID NO: 51483 - DNA, 103 bp, Artificial Sequence
  Synthetic Polynucleotide
taatacgactcactatagggacgtctttacaaatttctattttcttggccaacagaggagaggccaaatgaatagaaataacctggcggcagcgcaaaagatg

SEQ ID NO: 51484 - DNA, 103 bp, Artificial Sequence
  Synthetic Polynucleotide
taatacgactcactatagggattccacgtctttacaaatttctattttctaacagaggagaagaaaaatgaaatttgtaaacctggcggcagcgcaaaagatg

SEQ ID NO: 51485 - DNA, 103 bp, Artificial Sequence
  Synthetic Polynucleotide
taatacgactcactatagggaggtaattccacgtctttacaaatttctataacagaggagaatagaaatgtgtaaagacaacctggcggcagcgcaaaagatg

SEQ ID NO: 51486 - DNA, 103 bp, Artificial Sequence
  Synthetic Polynucleotide
taatacgactcactatagggccgagaggtaattccacgtctttacaaattaacagaggagaaatttgatgagacgtggaaacctggcggcagcgcaaaagatg

SEQ ID NO: 51487 - DNA, 103 bp, Artificial Sequence
  Synthetic Polynucleotide
taatacgactcactatagggtttcgccgagaggtaattccacgtctttacaacagaggagagtaaagatgtggaattacaacctggcggcagcgcaaaagatg

SEQ ID NO: 51488 - DNA, 103 bp, Artificial Sequence
  Synthetic Polynucleotide
taatacgactcactatagggaactatttcgccgagaggtaattccacgtcaacagaggagagacgtgatgttacctctcaacctggcggcagcgcaaaagatg

SEQ ID NO: 51489 - DNA, 103 bp, Artificial Sequence
  Synthetic Polynucleotide
taatacgactcactatagggttattaactatttcgccgagaggtaattccaacagaggagaggaattatgtctcggcgaaacctggcggcagcgcaaaagatg

SEQ ID NO: 51490 - DNA, 103 bp, Artificial Sequence
  Synthetic Polynucleotide
taatacgactcactatagggcagaattattaactatttcgccgagaggtaaacagaggagatacctcatggcgaaatagaacctggcggcagcgcaaaagatg

SEQ ID NO: 51491 - DNA, 103 bp, Artificial Sequence
  Synthetic Polynucleotide
taatacgactcactatagggaactacagaattattaactatttcgccgagaacagaggagactcggcatgatagttaataacctggcggcagcgcaaaagatg

SEQ ID NO: 51492 - DNA, 103 bp, Artificial Sequence
  Synthetic Polynucleotide
taatacgactcactatagggtaatggagtatatttttgataacacggataaacagaggagatatccgatgtatcaaaaaaacctggcggcagcgcaaaagatg

SEQ ID NO: 51493 - DNA, 103 bp, Artificial Sequence
  Synthetic Polynucleotide
taatacgactcactatagggtttataactacagaattattaactatttcgaacagaggagacgaaatatgtaataattcaacctggcggcagcgcaaaagatg

SEQ ID NO: 51494 - DNA, 103 bp, Artificial Sequence
  Synthetic Polynucleotide
taatacgactcactataggggaacgtttataactacagaattattaactaaacagaggagatagttaatgattctgtagaacctggcggcagcgcaaaagatg

SEQ ID NO: 51495 - DNA, 103 bp, Artificial Sequence
  Synthetic Polynucleotide
taatacgactcactatagggacacggaacgtttataactacagaattattaacagaggagaaataatatggtagttataaacctggcggcagcgcaaaagatg

SEQ ID NO: 51496 - DNA, 103 bp, Artificial Sequence
  Synthetic Polynucleotide
taatacgactcactatagggattacacacggaacgtttataactacagaaaacagaggagattctgtatgtataaacgtaacctggcggcagcgcaaaagatg

SEQ ID NO: 51497 - DNA, 103 bp, Artificial Sequence
  Synthetic Polynucleotide
taatacgactcactatagggaggttattacacacggaacgtttataactaaacagaggagatagttaatgacgttccgtaacctggcggcagcgcaaaagatg

SEQ ID NO: 51498 - DNA, 103 bp, Artificial Sequence
  Synthetic Polynucleotide
taatacgactcactatagggcgcgtaggttattacacacggaacgtttataacagaggagaataaacatgccgtgtgtaaacctggcggcagcgcaaaagatg

SEQ ID NO: 51499 - DNA, 103 bp, Artificial Sequence
  Synthetic Polynucleotide
taatacgactcactatagggtaatacgcgtaggttattacacacggaacgaacagaggagacgttccatgtgtaataacaacctggcggcagcgcaaaagatg

SEQ ID NO: 51500 - DNA, 103 bp, Artificial Sequence
  Synthetic Polynucleotide
taatacgactcactatagggcgtgataatacgcgtaggttattacacacgaacagaggagacgtgtgatgtaacctacgaacctggcggcagcgcaaaagatg

SEQ ID NO: 51501 - DNA, 103 bp, Artificial Sequence
  Synthetic Polynucleotide
taatacgactcactatagggcccaacgtgataatacgcgtaggttattacaacagaggagagtaataatgtacgcgtataacctggcggcagcgcaaaagatg

SEQ ID NO: 51502 - DNA, 103 bp, Artificial Sequence
  Synthetic Polynucleotide
taatacgactcactatagggatatccccaacgtgataatacgcgtaggttaacagaggagaaacctaatggtattatcaaacctggcggcagcgcaaaagatg

SEQ ID NO: 51503 - DNA, 103 bp, Artificial Sequence
  Synthetic Polynucleotide
taatacgactcactatagggcattttaatggagtatatttttgataacacaacagaggagagtgttaatgaaaatatacaacctggcggcagcgcaaaagatg

SEQ ID NO: 51504 - DNA, 103 bp, Artificial Sequence
  Synthetic Polynucleotide
taatacgactcactatagggtaactatatccccaacgtgataatacgcgtaacagaggagaacgcgtatgatcacgttgaacctggcggcagcgcaaaagatg

SEQ ID NO: 51505 - DNA, 103 bp, Artificial Sequence
  Synthetic Polynucleotide
taatacgactcactatagggtcctctaactatatccccaacgtgataataaacagaggagatattatatggttggggataacctggcggcagcgcaaaagatg

SEQ ID NO: 51506 - DNA, 103 bp, Artificial Sequence
  Synthetic Polynucleotide
taatacgactcactatagggaatgttcctctaactatatccccaacgtgaaacagaggagatcacgtatgggatatagtaacctggcggcagcgcaaaagatg

SEQ ID NO: 51507 - DNA, 103 bp, Artificial Sequence
  Synthetic Polynucleotide
taatacgactcactatagggtgtttaatgttcctctaactatatccccaaaacagaggagattggggatgtagttagagaacctggcggcagcgcaaaagatg

SEQ ID NO: 51508 - DNA, 103 bp, Artificial Sequence
  Synthetic Polynucleotide
taatacgactcactatagggttcgatgtttaatgttcctctaactatatcaacagaggagagatataatgagaggaacaaacctggcggcagcgcaaaagatg

SEQ ID NO: 51509 - DNA, 103 bp, Artificial Sequence
  Synthetic Polynucleotide
taatacgactcactatagggtcatcttcgatgtttaatgttcctctaactaacagaggagaagttagatgaacattaaaaacctggcggcagcgcaaaagatg

SEQ ID NO: 51510 - DNA, 103 bp, Artificial Sequence
  Synthetic Polynucleotide
taatacgactcactatagggttgattcatcttcgatgtttaatgttcctcaacagaggagagaggaaatgtaaacatcgaacctggcggcagcgcaaaagatg

SEQ ID NO: 51511 - DNA, 103 bp, Artificial Sequence
  Synthetic Polynucleotide
taatacgactcactatagggtacatttgattcatcttcgatgtttaatgtaacagaggagaacattaatgatcgaagataacctggcggcagcgcaaaagatg

SEQ ID NO: 51512 - DNA, 103 bp, Artificial Sequence
  Synthetic Polynucleotide
taatacgactcactatagggatagttacatttgattcatcttcgatgtttaacagaggagaaaacatatgagatgaatcaacctggcggcagcgcaaaagatg

SEQ ID NO: 51513 - DNA, 103 bp, Artificial Sequence
  Synthetic Polynucleotide
taatacgactcactatagggattgaatagttacatttgattcatcttcgaaacagaggagatcgaagatgaatcaaatgaacctggcggcagcgcaaaagatg

SEQ ID NO: 51514 - DNA, 103 bp, Artificial Sequence
  Synthetic Polynucleotide
taatacgactcactatagggataatcattttaatggagtatatttttgataacagaggagaatcaaaatgatactccataacctggcggcagcgcaaaagatg

SEQ ID NO: 51515 - DNA, 103 bp, Artificial Sequence
  Synthetic Polynucleotide
taatacgactcactatagggtccgcattgaatagttacatttgattcatcaacagaggagagatgaaatgaatgtaactaacctggcggcagcgcaaaagatg

SEQ ID NO: 51516 - DNA, 103 bp, Artificial Sequence
  Synthetic Polynucleotide
taatacgactcactatagggaaatctccgcattgaatagttacatttgataacagaggagaatcaaaatgaactattcaaacctggcggcagcgcaaaagatg

SEQ ID NO: 51517 - DNA, 103 bp, Artificial Sequence
  Synthetic Polynucleotide
taatacgactcactatagggagattaaatctccgcattgaatagttacataacagaggagaatgtaaatgttcaatgcgaacctggcggcagcgcaaaagatg

SEQ ID NO: 51518 - DNA, 103 bp, Artificial Sequence
  Synthetic Polynucleotide
taatacgactcactatagggtttacagattaaatctccgcattgaatagtaacagaggagaactattatgtgcggagataacctggcggcagcgcaaaagatg

SEQ ID NO: 51519 - DNA, 103 bp, Artificial Sequence
  Synthetic Polynucleotide
taatacgactcactatagggcttagtttacagattaaatctccgcattgaaacagaggagatcaatgatgagatttaataacctggcggcagcgcaaaagatg

SEQ ID NO: 51520 - DNA, 103 bp, Artificial Sequence
  Synthetic Polynucleotide
taatacgactcactatagggctctacttagtttacagattaaatctccgcaacagaggagagcggagatgtaatctgtaaacctggcggcagcgcaaaagatg

SEQ ID NO: 51521 - DNA, 103 bp, Artificial Sequence
  Synthetic Polynucleotide
taatacgactcactatagggcgaatctctacttagtttacagattaaatcaacagaggagagatttaatgtgtaaactaaacctggcggcagcgcaaaagatg

SEQ ID NO: 51522 - DNA, 103 bp, Artificial Sequence
  Synthetic Polynucleotide
taatacgactcactataggggtacccgaatctctacttagtttacagattaacagaggagaaatctgatgactaagtagaacctggcggcagcgcaaaagatg

SEQ ID NO: 51523 - DNA, 103 bp, Artificial Sequence
  Synthetic Polynucleotide
taatacgactcactatagggatacagtacccgaatctctacttagtttacaacagaggagagtaaacatggtagagattaacctggcggcagcgcaaaagatg

SEQ ID NO: 51524 - DNA, 103 bp, Artificial Sequence
  Synthetic Polynucleotide
taatacgactcactatagggaaatgatacagtacccgaatctctacttagaacagaggagactaagtatggattcgggtaacctggcggcagcgcaaaagatg

SEQ ID NO: 51525 - DNA, 103 bp, Artificial Sequence
  Synthetic Polynucleotide
taatacgactcactatagggccggaataatcattttaatggagtatatttaacagaggagaaaatatatgccattaaaaaacctggcggcagcgcaaaagatg

SEQ ID NO: 51526 - DNA, 103 bp, Artificial Sequence
  Synthetic Polynucleotide
taatacgactcactatagggtcgctaaatgatacagtacccgaatctctaaacagaggagatagagaatggggtactgtaacctggcggcagcgcaaaagatg

SEQ ID NO: 51527 - DNA, 103 bp, Artificial Sequence
  Synthetic Polynucleotide
taatacgactcactatagggttgaatcgctaaatgatacagtacccgaataacagaggagaattcggatgctgtatcataacctggcggcagcgcaaaagatg

SEQ ID NO: 51528 - DNA, 103 bp, Artificial Sequence
  Synthetic Polynucleotide
taatacgactcactataggggtactttgaatcgctaaatgatacagtaccaacagaggagaggtactatgtcatttagcaacctggcggcagcgcaaaagatg

SEQ ID NO: 51529 - DNA, 103 bp, Artificial Sequence
  Synthetic Polynucleotide
taatacgactcactatagggaagcagtactttgaatcgctaaatgatacaaacagaggagatgtatcatgtagcgattcaacctggcggcagcgcaaaagatg

SEQ ID NO: 51530 - DNA, 103 bp, Artificial Sequence
  Synthetic Polynucleotide
taatacgactcactataggggaaaaaagcagtactttgaatcgctaaatgaacagaggagacatttaatgattcaaagtaacctggcggcagcgcaaaagatg

SEQ ID NO: 51531 - DNA, 103 bp, Artificial Sequence
  Synthetic Polynucleotide
taatacgactcactatagggatttcgaaaaaagcagtactttgaatcgctaacagaggagaagcgatatgaagtactgcaacctggcggcagcgcaaaagatg

SEQ ID NO: 51532 - DNA, 103 bp, Artificial Sequence
  Synthetic Polynucleotide
taatacgactcactatagggttaccatttcgaaaaaagcagtactttgaaaacagaggagattcaaaatgctgctttttaacctggcggcagcgcaaaagatg

SEQ ID NO: 51533 - DNA, 103 bp, Artificial Sequence
  Synthetic Polynucleotide
taatacgactcactatagggacgcattaccatttcgaaaaaagcagtactaacagaggagaagtactatgtttttcgaaaacctggcggcagcgcaaaagatg

SEQ ID NO: 51534 - DNA, 103 bp, Artificial Sequence
  Synthetic Polynucleotide
taatacgactcactatagggatcatacgcattaccatttcgaaaaaagcaaacagaggagatgctttatgcgaaatggtaacctggcggcagcgcaaaagatg

SEQ ID NO: 51535 - DNA, 103 bp, Artificial Sequence
  Synthetic Polynucleotide
taatacgactcactatagggccgttatcatacgcattaccatttcgaaaaaacagaggagattttcgatgtggtaatgcaacctggcggcagcgcaaaagatg

SEQ ID NO: 51536 - DNA, 103 bp, Artificial Sequence
  Synthetic Polynucleotide
taatacgactcactatagggcgctgccggaataatcattttaatggagtaaacagaggagatactccatgaaaatgattaacctggcggcagcgcaaaagatg

SEQ ID NO: 51537 - DNA, 103 bp, Artificial Sequence
  Synthetic Polynucleotide
taatacgactcactatagggcgctgccgttatcatacgcattaccatttcaacagaggagagaaatgatgatgcgtatgaacctggcggcagcgcaaaagatg

SEQ ID NO: 51538 - DNA, 103 bp, Artificial Sequence
  Synthetic Polynucleotide
taatacgactcactataggggacttcgctgccgttatcatacgcattaccaacagaggagaggtaatatgtatgataacaacctggcggcagcgcaaaagatg

SEQ ID NO: 51539 - DNA, 103 bp, Artificial Sequence
  Synthetic Polynucleotide
taatacgactcactataggggcggagacttcgctgccgttatcatacgcaaacagaggagatgcgtaatgtaacggcagaacctggcggcagcgcaaaagatg

SEQ ID NO: 51540 - DNA, 103 bp, Artificial Sequence
  Synthetic Polynucleotide
taatacgactcactataggggaacggcggagacttcgctgccgttatcataacagaggagaatgataatggcagcgaagaacctggcggcagcgcaaaagatg

SEQ ID NO: 51541 - DNA, 103 bp, Artificial Sequence
  Synthetic Polynucleotide
taatacgactcactatagggcattagaacggcggagacttcgctgccgttaacagaggagaaacggcatggaagtctccaacctggcggcagcgcaaaagatg

SEQ ID NO: 51542 - DNA, 103 bp, Artificial Sequence
  Synthetic Polynucleotide
taatacgactcactataggggcctccattagaacggcggagacttcgctgaacagaggagacagcgaatgctccgccgtaacctggcggcagcgcaaaagatg

SEQ ID NO: 51543 - DNA, 103 bp, Artificial Sequence
  Synthetic Polynucleotide
taatacgactcactataggggttgagcctccattagaacggcggagacttaacagaggagaaagtctatgccgttctaaaacctggcggcagcgcaaaagatg

SEQ ID NO: 51544 - DNA, 103 bp, Artificial Sequence
  Synthetic Polynucleotide
taatacgactcactatagggaccttgttgagcctccattagaacggcggaaacagaggagatccgccatgctaatggagaacctggcggcagcgcaaaagatg

SEQ ID NO: 51545 - DNA, 103 bp, Artificial Sequence
  Synthetic Polynucleotide
taatacgactcactatagggtcggtaccttgttgagcctccattagaacgaacagaggagacgttctatgggaggctcaaacctggcggcagcgcaaaagatg

SEQ ID NO: 51546 - DNA, 103 bp, Artificial Sequence
  Synthetic Polynucleotide
taatacgactcactatagggtagattcggtaccttgttgagcctccattaaacagaggagataatggatgctcaacaagaacctggcggcagcgcaaaagatg

SEQ ID NO: 51547 - DNA, 103 bp, Artificial Sequence
  Synthetic Polynucleotide
taatacgactcactatagggaagttcgctgccggaataatcattttaatgaacagaggagacattaaatggattattccaacctggcggcagcgcaaaagatg

SEQ ID NO: 51548 - DNA, 103 bp, Artificial Sequence
  Synthetic Polynucleotide
taatacgactcactatagggaaaactagattcggtaccttgttgagcctcaacagaggagagaggctatgcaaggtaccaacctggcggcagcgcaaaagatg

SEQ ID NO: 51549 - DNA, 103 bp, Artificial Sequence
  Synthetic Polynucleotide
taatacgactcactatagggaaaacaaaactagattcggtaccttgttgaaacagaggagatcaacaatgtaccgaatcaacctggcggcagcgcaaaagatg

SEQ ID NO: 51550 - DNA, 103 bp, Artificial Sequence
  Synthetic Polynucleotide
taatacgactcactatagggcgagaaaaacaaaactagattcggtaccttaacagaggagaaaggtaatgaatctagttaacctggcggcagcgcaaaagatg

SEQ ID NO: 51551 - DNA, 103 bp, Artificial Sequence
  Synthetic Polynucleotide
taatacgactcactatagggattcgcgagaaaaacaaaactagattcggtaacagaggagaaccgaaatgagttttgttaacctggcggcagcgcaaaagatg

SEQ ID NO: 51552 - DNA, 103 bp, Artificial Sequence
  Synthetic Polynucleotide
taatacgactcactatagggacgatattcgcgagaaaaacaaaactagataacagaggagaatctagatgtgtttttctaacctggcggcagcgcaaaagatg

SEQ ID NO: 51553 - DNA, 103 bp, Artificial Sequence
  Synthetic Polynucleotide
taatacgactcactatagggagtcgacgatattcgcgagaaaaacaaaacaacagaggagagttttgatgttctcgcgaaacctggcggcagcgcaaaagatg

SEQ ID NO: 51554 - DNA, 103 bp, Artificial Sequence
  Synthetic Polynucleotide
taatacgactcactatagggttatgagtcgacgatattcgcgagaaaaacaacagaggagagtttttatggcgaatatcaacctggcggcagcgcaaaagatg

SEQ ID NO: 51555 - DNA, 103 bp, Artificial Sequence
  Synthetic Polynucleotide
taatacgactcactatagggctttcttatgagtcgacgatattcgcgagaaacagaggagatctcgcatgtatcgtcgaaacctggcggcagcgcaaaagatg

SEQ ID NO: 51556 - DNA, 103 bp, Artificial Sequence
  Synthetic Polynucleotide
taatacgactcactatagggattctctttcttatgagtcgacgatattcgaacagaggagacgaataatgtcgactcataacctggcggcagcgcaaaagatg

SEQ ID NO: 51557 - DNA, 103 bp, Artificial Sequence
  Synthetic Polynucleotide
taatacgactcactatagggccgctattctctttcttatgagtcgacgataacagaggagaatcgtcatgtcataagaaaacctggcggcagcgcaaaagatg

SEQ ID NO: 51558 - DNA, 103 bp, Artificial Sequence
  Synthetic Polynucleotide
taatacgactcactatagggatatcaagttcgctgccggaataatcatttaacagaggagaaaatgaatgttccggcagaacctggcggcagcgcaaaagatg

SEQ ID NO: 51559 - DNA, 103 bp, Artificial Sequence
  Synthetic Polynucleotide
taatacgactcactatagggacttaccgctattctctttcttatgagtcgaacagaggagacgactcatgagaaagagaaacctggcggcagcgcaaaagatg

SEQ ID NO: 51560 - DNA, 103 bp, Artificial Sequence
  Synthetic Polynucleotide
taatacgactcactatagggtatatacttaccgctattctctttcttatgaacagaggagacataagatggagaatagcaacctggcggcagcgcaaaagatg

SEQ ID NO: 51561 - DNA, 103 bp, Artificial Sequence
  Synthetic Polynucleotide
taatacgactcactatagggtcgtatatatacttaccgctattctctttcaacagaggagagaaagaatgtagcggtaaaacctggcggcagcgcaaaagatg

SEQ ID NO: 51562 - DNA, 103 bp, Artificial Sequence
  Synthetic Polynucleotide
taatacgactcactatagggagtattcgtatatatacttaccgctattctaacagaggagaagaataatggtaagtataaacctggcggcagcgcaaaagatg

SEQ ID NO: 51563 - DNA, 103 bp, Artificial Sequence
  Synthetic Polynucleotide
taatacgactcactataggggccatagtattcgtatatatacttaccgctaacagaggagaagcggtatgtatatatacaacctggcggcagcgcaaaagatg

SEQ ID NO: 51564 - DNA, 103 bp, Artificial Sequence
  Synthetic Polynucleotide
taatacgactcactatagggttattgccatagtattcgtatatatacttaaacagaggagataagtaatgatacgaataaacctggcggcagcgcaaaagatg

SEQ ID NO: 51565 - DNA, 103 bp, Artificial Sequence
  Synthetic Polynucleotide
taatacgactcactatagggcgcaattattgccatagtattcgtatatataacagaggagaatatatatgaatactatgaacctggcggcagcgcaaaagatg

SEQ ID NO: 51566 - DNA, 103 bp, Artificial Sequence
  Synthetic Polynucleotide
taatacgactcactatagggacattcgcaattattgccatagtattcgtaaacagaggagatacgaaatgtatggcaataacctggcggcagcgcaaaagatg

SEQ ID NO: 51567 - DNA, 103 bp, Artificial Sequence
  Synthetic Polynucleotide
taatacgactcactatagggataaaacattcgcaattattgccatagtataacagaggagaatactaatgcaataattgaacctggcggcagcgcaaaagatg

SEQ ID NO: 51568 - DNA, 103 bp, Artificial Sequence
  Synthetic Polynucleotide
taatacgactcactatagggagggaataaaacattcgcaattattgccataacagaggagaatggcaatgattgcgaataacctggcggcagcgcaaaagatg

SEQ ID NO: 51569 - DNA, 103 bp, Artificial Sequence
  Synthetic Polynucleotide
taatacgactcactatagggaataatatacaagatattttttctcacactaacagaggagaagtgtgatgaaaaatatcaacctggcggcagcgcaaaagatg

SEQ ID NO: 51570 - DNA, 103 bp, Artificial Sequence
  Synthetic Polynucleotide
taatacgactcactatagggatccaatatcaagttcgctgccggaataataacagaggagaattattatggcagcgaacaacctggcggcagcgcaaaagatg

SEQ ID NO: 51571 - DNA, 103 bp, Artificial Sequence
  Synthetic Polynucleotide
taatacgactcactatagggatcgaagggaataaaacattcgcaattattaacagaggagaaataatatggaatgttttaacctggcggcagcgcaaaagatg

SEQ ID NO: 51572 - DNA, 103 bp, Artificial Sequence
  Synthetic Polynucleotide
taatacgactcactatagggaatatatcgaagggaataaaacattcgcaaaacagaggagattgcgaatgttttattccaacctggcggcagcgcaaaagatg

SEQ ID NO: 51573 - DNA, 103 bp, Artificial Sequence
  Synthetic Polynucleotide
taatacgactcactatagggtcaaaaatatatcgaagggaataaaacattaacagaggagaaatgttatgttcccttcgaacctggcggcagcgcaaaagatg

SEQ ID NO: 51574 - DNA, 103 bp, Artificial Sequence
  Synthetic Polynucleotide
taatacgactcactatagggtattatcaaaaatatatcgaagggaataaaaacagaggagatttattatgttcgatataaacctggcggcagcgcaaaagatg

SEQ ID NO: 51575 - DNA, 103 bp, Artificial Sequence
  Synthetic Polynucleotide
taatacgactcactatagggtttcatattatcaaaaatatatcgaagggaaacagaggagatcccttatgtatatttttaacctggcggcagcgcaaaagatg

SEQ ID NO: 51576 - DNA, 103 bp, Artificial Sequence
  Synthetic Polynucleotide
taatacgactcactatagggatgtttttcatattatcaaaaatatatcgaaacagaggagatcgataatgttttgataaaacctggcggcagcgcaaaagatg

SEQ ID NO: 51577 - DNA, 103 bp, Artificial Sequence
  Synthetic Polynucleotide
taatacgactcactataggggagacatgtttttcatattatcaaaaatataacagaggagaatatttatgataatatgaaacctggcggcagcgcaaaagatg

SEQ ID NO: 51578 - DNA, 103 bp, Artificial Sequence
  Synthetic Polynucleotide
taatacgactcactatagggtgagagagacatgtttttcatattatcaaaaacagaggagatttgatatgatgaaaaacaacctggcggcagcgcaaaagatg

SEQ ID NO: 51579 - DNA, 103 bp, Artificial Sequence
  Synthetic Polynucleotide
taatacgactcactatagggtgatttgagagagacatgtttttcatattaaacagaggagataatatatgaaacatgtcaacctggcggcagcgcaaaagatg

SEQ ID NO: 51580 - DNA, 103 bp, Artificial Sequence
  Synthetic Polynucleotide
taatacgactcactatagggttgtctgatttgagagagacatgtttttcaaacagaggagatgaaaaatgtgtctctctaacctggcggcagcgcaaaagatg

SEQ ID NO: 51581 - DNA, 103 bp, Artificial Sequence
  Synthetic Polynucleotide
taatacgactcactataggggatatatccaatatcaagttcgctgccggaaacagaggagatccggcatggaacttgataacctggcggcagcgcaaaagatg

SEQ ID NO: 51582 - DNA, 103 bp, Artificial Sequence
  Synthetic Polynucleotide
taatacgactcactataggggatggttgtctgatttgagagagacatgttaacagaggagaaacatgatgctctcaaataacctggcggcagcgcaaaagatg

SEQ ID NO: 51583 - DNA, 103 bp, Artificial Sequence
  Synthetic Polynucleotide
taatacgactcactatagggtatgagatggttgtctgatttgagagagacaacagaggagagtctctatgaaatcagacaacctggcggcagcgcaaaagatg

SEQ ID NO: 51584 - DNA, 103 bp, Artificial Sequence
  Synthetic Polynucleotide
taatacgactcactatagggtattttatgagatggttgtctgatttgagaaacagaggagatctcaaatgagacaaccaaacctggcggcagcgcaaaagatg

SEQ ID NO: 51585 - DNA, 103 bp, Artificial Sequence
  Synthetic Polynucleotide
taatacgactcactatagggagaactattttatgagatggttgtctgattaacagaggagaaatcagatgaccatctcaaacctggcggcagcgcaaaagatg

SEQ ID NO: 51586 - DNA, 103 bp, Artificial Sequence
  Synthetic Polynucleotide
taatacgactcactatagggacgcgagaactattttatgagatggttgtcaacagaggagagacaacatgctcataaaaaacctggcggcagcgcaaaagatg

SEQ ID NO: 51587 - DNA, 103 bp, Artificial Sequence
  Synthetic Polynucleotide
taatacgactcactatagggccagcacgcgagaactattttatgagatggaacagaggagaccatctatgaaaatagttaacctggcggcagcgcaaaagatg

SEQ ID NO: 51588 - DNA, 103 bp, Artificial Sequence
  Synthetic Polynucleotide
taatacgactcactatagggcctctccagcacgcgagaactattttatgaaacagaggagatcataaatgagttctcgcaacctggcggcagcgcaaaagatg

SEQ ID NO: 51589 - DNA, 103 bp, Artificial Sequence
  Synthetic Polynucleotide
taatacgactcactatagggaactacctctccagcacgcgagaactatttaacagaggagaaaatagatgtcgcgtgctaacctggcggcagcgcaaaagatg

SEQ ID NO: 51590 - DNA, 103 bp, Artificial Sequence
  Synthetic Polynucleotide
taatacgactcactataggggcagcaactacctctccagcacgcgagaacaacagaggagagttctcatgtgctggagaaacctggcggcagcgcaaaagatg

SEQ ID NO: 51591 - DNA, 103 bp, Artificial Sequence
  Synthetic Polynucleotide
taatacgactcactatagggtacgagcagcaactacctctccagcacgcgaacagaggagacgcgtgatggagaggtagaacctggcggcagcgcaaaagatg

SEQ ID NO: 51592 - DNA, 103 bp, Artificial Sequence
  Synthetic Polynucleotide
taatacgactcactataggggttgtgatatatccaatatcaagttcgctgaacagaggagacagcgaatgtgatattggaacctggcggcagcgcaaaagatg

SEQ ID NO: 51593 - DNA, 103 bp, Artificial Sequence
  Synthetic Polynucleotide
taatacgactcactataggggattatacgagcagcaactacctctccagcaacagaggagagctggaatggtagttgctaacctggcggcagcgcaaaagatg

SEQ ID NO: 51594 - DNA, 103 bp, Artificial Sequence
  Synthetic Polynucleotide
taatacgactcactatagggggggagattatacgagcagcaactacctctaacagaggagaagaggtatgtgctgctcgaacctggcggcagcgcaaaagatg

SEQ ID NO: 51595 - DNA, 103 bp, Artificial Sequence
  Synthetic Polynucleotide
taatacgactcactatagggattctggggagattatacgagcagcaactaaacagaggagatagttgatgctcgtataaaacctggcggcagcgcaaaagatg

SEQ ID NO: 51596 - DNA, 103 bp, Artificial Sequence
  Synthetic Polynucleotide
taatacgactcactatagggatattattctggggagattatacgagcagcaacagaggagagctgctatgataatctccaacctggcggcagcgcaaaagatg

SEQ ID NO: 51597 - DNA, 103 bp, Artificial Sequence
  Synthetic Polynucleotide
taatacgactcactataggggaagtatattattctggggagattatacgaaacagaggagatcgtatatgctccccagaaacctggcggcagcgcaaaagatg

SEQ ID NO: 51598 - DNA, 103 bp, Artificial Sequence
  Synthetic Polynucleotide
taatacgactcactatagggacacagaagtatattattctggggagattaaacagaggagataatctatgcagaataataacctggcggcagcgcaaaagatg

SEQ ID NO: 51599 - DNA, 103 bp, Artificial Sequence
  Synthetic Polynucleotide
taatacgactcactatagggcgatgacacagaagtatattattctggggaaacagaggagatccccaatgtaatatactaacctggcggcagcgcaaaagatg

SEQ ID NO: 51600 - DNA, 103 bp, Artificial Sequence
  Synthetic Polynucleotide
taatacgactcactatagggttgaacgatgacacagaagtatattattctaacagaggagaagaataatgtacttctgtaacctggcggcagcgcaaaagatg

SEQ ID NO: 51601 - DNA, 103 bp, Artificial Sequence
  Synthetic Polynucleotide
taatacgactcactatagggataaattgaacgatgacacagaagtatattaacagaggagaaatataatgctgtgtcataacctggcggcagcgcaaaagatg

SEQ ID NO: 51602 - DNA, 103 bp, Artificial Sequence
  Synthetic Polynucleotide
taatacgactcactatagggtccgtataaattgaacgatgacacagaagtaacagaggagaacttctatgtcatcgttcaacctggcggcagcgcaaaagatg

SEQ ID NO: 51603 - DNA, 103 bp, Artificial Sequence
  Synthetic Polynucleotide
taatacgactcactatagggcaaaggttgtgatatatccaatatcaagttaacagaggagaaacttgatgttggatataaacctggcggcagcgcaaaagatg

SEQ ID NO: 51604 - DNA, 103 bp, Artificial Sequence
  Synthetic Polynucleotide
taatacgactcactatagggagaaatccgtataaattgaacgatgacacaaacagaggagatgtgtcatggttcaatttaacctggcggcagcgcaaaagatg

SEQ ID NO: 51605 - DNA, 103 bp, Artificial Sequence
  Synthetic Polynucleotide
taatacgactcactatagggactatagaaatccgtataaattgaacgatgaacagaggagacatcgtatgatttatacgaacctggcggcagcgcaaaagatg

SEQ ID NO: 51606 - DNA, 103 bp, Artificial Sequence
  Synthetic Polynucleotide
taatacgactcactatagggagagaactatagaaatccgtataaattgaaaacagaggagattcaatatgtacggatttaacctggcggcagcgcaaaagatg

SEQ ID NO: 51607 - DNA, 103 bp, Artificial Sequence
  Synthetic Polynucleotide
taatacgactcactatagggataacagagaactatagaaatccgtataaaaacagaggagatttataatgatttctataaacctggcggcagcgcaaaagatg

SEQ ID NO: 51608 - DNA, 103 bp, Artificial Sequence
  Synthetic Polynucleotide
taatacgactcactatagggattatataacagagaactatagaaatccgtaacagaggagaacggatatgtatagttctaacctggcggcagcgcaaaagatg

SEQ ID NO: 51609 - DNA, 103 bp, Artificial Sequence
  Synthetic Polynucleotide
taatacgactcactatagggaccgcattatataacagagaactatagaaaaacagaggagatttctaatgttctctgttaacctggcggcagcgcaaaagatg

SEQ ID NO: 51610 - DNA, 103 bp, Artificial Sequence
  Synthetic Polynucleotide
taatacgactcactatagggggcaaaccgcattatataacagagaactataacagaggagaatagttatgtgttatataaacctggcggcagcgcaaaagatg

SEQ ID NO: 51611 - DNA, 103 bp, Artificial Sequence
  Synthetic Polynucleotide
taatacgactcactatagggatgagggcaaaccgcattatataacagagaaacagaggagatctctgatgtataatgcgaacctggcggcagcgcaaaagatg

SEQ ID NO: 51612 - DNA, 103 bp, Artificial Sequence
  Synthetic Polynucleotide
taatacgactcactatagggtaatcatgagggcaaaccgcattatataacaacagaggagagttataatgtgcggtttgaacctggcggcagcgcaaaagatg

SEQ ID NO: 51613 - DNA, 103 bp, Artificial Sequence
  Synthetic Polynucleotide
taatacgactcactatagggttgtctaatcatgagggcaaaccgcattataacagaggagaataatgatgtttgccctcaacctggcggcagcgcaaaagatg

SEQ ID NO: 51614 - DNA, 103 bp, Artificial Sequence
  Synthetic Polynucleotide
taatacgactcactatagggattaacaaaggttgtgatatatccaatatcaacagaggagagatattatgtatatcacaaacctggcggcagcgcaaaagatg

SEQ ID NO: 51615 - DNA, 103 bp, Artificial Sequence
  Synthetic Polynucleotide
taatacgactcactatagggtgtcgttgtctaatcatgagggcaaaccgcaacagaggagagcggttatgcctcatgataacctggcggcagcgcaaaagatg

SEQ ID NO: 51616 - DNA, 103 bp, Artificial Sequence
  Synthetic Polynucleotide
taatacgactcactatagggactattgtcgttgtctaatcatgagggcaaaacagaggagattgcccatgtgattagacaacctggcggcagcgcaaaagatg

SEQ ID NO: 51617 - DNA, 103 bp, Artificial Sequence
  Synthetic Polynucleotide
taatacgactcactatagggagaacactattgtcgttgtctaatcatgagaacagaggagactcatgatgagacaacgaaacctggcggcagcgcaaaagatg

SEQ ID NO: 51618 - DNA, 103 bp, Artificial Sequence
  Synthetic Polynucleotide
taatacgactcactatagggaattcagaacactattgtcgttgtctaatcaacagaggagagattagatgacgacaataaacctggcggcagcgcaaaagatg

SEQ ID NO: 51619 - DNA, 103 bp, Artificial Sequence
  Synthetic Polynucleotide
taatacgactcactatagggatctaaattcagaacactattgtcgttgtcaacagaggagagacaacatgaatagtgttaacctggcggcagcgcaaaagatg

SEQ ID NO: 51620 - DNA, 103 bp, Artificial Sequence
  Synthetic Polynucleotide
taatacgactcactatagggcaactatctaaattcagaacactattgtcgaacagaggagacgacaaatgtgttctgaaaacctggcggcagcgcaaaagatg

SEQ ID NO: 51621 - DNA, 103 bp, Artificial Sequence
  Synthetic Polynucleotide
taatacgactcactatagggctgatcaactatctaaattcagaacactataacagaggagaatagtgatgtgaatttagaacctggcggcagcgcaaaagatg

SEQ ID NO: 51622 - DNA, 103 bp, Artificial Sequence
  Synthetic Polynucleotide
taatacgactcactatagggtcattctgatcaactatctaaattcagaacaacagaggagagttctgatgttagatagtaacctggcggcagcgcaaaagatg

SEQ ID NO: 51623 - DNA, 103 bp, Artificial Sequence
  Synthetic Polynucleotide
taatacgactcactatagggaacattcattctgatcaactatctaaattcaacagaggagagaatttatgtagttgatcaacctggcggcagcgcaaaagatg

SEQ ID NO: 51624 - DNA, 103 bp, Artificial Sequence
  Synthetic Polynucleotide
taatacgactcactatagggcaataaacattcattctgatcaactatctaaacagaggagatagataatggatcagaataacctggcggcagcgcaaaagatg

SEQ ID NO: 51625 - DNA, 103 bp, Artificial Sequence
  Synthetic Polynucleotide
taatacgactcactatagggtagatattaacaaaggttgtgatatatccaaacagaggagatggataatgcacaaccttaacctggcggcagcgcaaaagatg

SEQ ID NO: 51626 - DNA, 103 bp, Artificial Sequence
  Synthetic Polynucleotide
taatacgactcactatagggaacgccaataaacattcattctgatcaactaacagaggagaagttgaatggaatgaatgaacctggcggcagcgcaaaagatg

SEQ ID NO: 51627 - DNA, 103 bp, Artificial Sequence
  Synthetic Polynucleotide
taatacgactcactatagggtttccaacgccaataaacattcattctgataacagaggagaatcagaatgaatgtttataacctggcggcagcgcaaaagatg

SEQ ID NO: 51628 - DNA, 103 bp, Artificial Sequence
  Synthetic Polynucleotide
taatacgactcactatagggtaatttttccaacgccaataaacattcattaacagaggagaaatgaaatgttattggcgaacctggcggcagcgcaaaagatg

SEQ ID NO: 51629 - DNA, 103 bp, Artificial Sequence
  Synthetic Polynucleotide
taatacgactcactatagggatggataatttttccaacgccaataaacataacagaggagaatgtttatgggcgttggaaacctggcggcagcgcaaaagatg

SEQ ID NO: 51630 - DNA, 103 bp, Artificial Sequence
  Synthetic Polynucleotide
taatacgactcactataggggctgtatggataatttttccaacgccaataaacagaggagatattggatgtggaaaaataacctggcggcagcgcaaaagatg

SEQ ID NO: 51631 - DNA, 103 bp, Artificial Sequence
  Synthetic Polynucleotide
taatacgactcactatagggcagacgctgtatggataatttttccaacgcaacagaggagagcgttgatgaaattatccaacctggcggcagcgcaaaagatg

SEQ ID NO: 51632 - DNA, 103 bp, Artificial Sequence
  Synthetic Polynucleotide
taatacgactcactatagggctctgcagacgctgtatggataatttttccaacagaggagaggaaaaatgatccatacaaacctggcggcagcgcaaaagatg

SEQ ID NO: 51633 - DNA, 103 bp, Artificial Sequence
  Synthetic Polynucleotide
taatacgactcactatagggaaccactctgcagacgctgtatggataattaacagaggagaaattatatgtacagcgtcaacctggcggcagcgcaaaagatg

SEQ ID NO: 51634 - DNA, 103 bp, Artificial Sequence
  Synthetic Polynucleotide
taatacgactcactatagggctatcaaccactctgcagacgctgtatggaaacagaggagatccataatgcgtctgcagaacctggcggcagcgcaaaagatg

SEQ ID NO: 51635 - DNA, 103 bp, Artificial Sequence
  Synthetic Polynucleotide
taatacgactcactatagggaacaactatcaaccactctgcagacgctgtaacagaggagaacagcgatggcagagtggaacctggcggcagcgcaaaagatg

SEQ ID NO: 51636 - DNA, 103 bp, Artificial Sequence
  Synthetic Polynucleotide
taatacgactcactatagggtgtcgtagatattaacaaaggttgtgatataacagaggagaatatcaatgcctttgttaaacctggcggcagcgcaaaagatg

SEQ ID NO: 51637 - DNA, 103 bp, Artificial Sequence
  Synthetic Polynucleotide
taatacgactcactatagggctaggaacaactatcaaccactctgcagacaacagaggagagtctgcatggtggttgataacctggcggcagcgcaaaagatg

SEQ ID NO: 51638 - DNA, 103 bp, Artificial Sequence
  Synthetic Polynucleotide
taatacgactcactatagggaatatctaggaacaactatcaaccactctgaacagaggagacagagtatgtgatagttgaacctggcggcagcgcaaaagatg

SEQ ID NO: 51639 - DNA, 103 bp, Artificial Sequence
  Synthetic Polynucleotide
taatacgactcactatagggttttaaatatctaggaacaactatcaaccaaacagaggagatggttgatggttgttcctaacctggcggcagcgcaaaagatg

SEQ ID NO: 51640 - DNA, 103 bp, Artificial Sequence
  Synthetic Polynucleotide
taatacgactcactataggggattattttaaatatctaggaacaactatcaacagaggagagatagtatgtcctagataaacctggcggcagcgcaaaagatg

SEQ ID NO: 51641 - DNA, 103 bp, Artificial Sequence
  Synthetic Polynucleotide
taatacgactcactatagggagttggattattttaaatatctaggaacaaaacagaggagattgttcatggatatttaaaacctggcggcagcgcaaaagatg

SEQ ID NO: 51642 - DNA, 103 bp, Artificial Sequence
  Synthetic Polynucleotide
taatacgactcactatagggtagtaagttggattattttaaatatctaggaacagaggagacctagaatgttaaaataaaacctggcggcagcgcaaaagatg

SEQ ID NO: 51643 - DNA, 103 bp, Artificial Sequence
  Synthetic Polynucleotide
taatacgactcactatagggctgcctagtaagttggattattttaaatataacagaggagaatatttatgataatccaaaacctggcggcagcgcaaaagatg

SEQ ID NO: 51644 - DNA, 103 bp, Artificial Sequence
  Synthetic Polynucleotide
taatacgactcactatagggatttgctgcctagtaagttggattattttaaacagaggagataaaatatgccaacttacaacctggcggcagcgcaaaagatg

SEQ ID NO: 51645 - DNA, 103 bp, Artificial Sequence
  Synthetic Polynucleotide
taatacgactcactatagggagacaatttgctgcctagtaagttggattaaacagaggagataatccatgttactaggcaacctggcggcagcgcaaaagatg

SEQ ID NO: 51646 - DNA, 103 bp, Artificial Sequence
  Synthetic Polynucleotide
taatacgactcactatagggtatctagacaatttgctgcctagtaagttgaacagaggagacaacttatgaggcagcaaaacctggcggcagcgcaaaagatg

SEQ ID NO: 51647 - DNA, 103 bp, Artificial Sequence
  Synthetic Polynucleotide
taatacgactcactatagggtctattgtcgtagatattaacaaaggttgtaacagaggagaacaaccatggttaatatcaacctggcggcagcgcaaaagatg

SEQ ID NO: 51648 - DNA, 103 bp, Artificial Sequence
  Synthetic Polynucleotide
taatacgactcactatagggtattttatctagacaatttgctgcctagtaaacagaggagatactagatggcaaattgtaacctggcggcagcgcaaaagatg

SEQ ID NO: 51649 - DNA, 103 bp, Artificial Sequence
  Synthetic Polynucleotide
taatacgactcactatagggttcagtattttatctagacaatttgctgccaacagaggagaggcagcatgttgtctagaaacctggcggcagcgcaaaagatg

SEQ ID NO: 51650 - DNA, 103 bp, Artificial Sequence
  Synthetic Polynucleotide
taatacgactcactatagggtttgattcagtattttatctagacaatttgaacagaggagacaaattatgtagataaaaaacctggcggcagcgcaaaagatg

SEQ ID NO: 51651 - DNA, 103 bp, Artificial Sequence
  Synthetic Polynucleotide
taatacgactcactatagggcaccgtttgattcagtattttatctagacaaacagaggagatgtctaatgaaaatactgaacctggcggcagcgcaaaagatg

SEQ ID NO: 51652 - DNA, 103 bp, Artificial Sequence
  Synthetic Polynucleotide
taatacgactcactataggggtctgcaccgtttgattcagtattttatctaacagaggagaagataaatgactgaatcaaacctggcggcagcgcaaaagatg

SEQ ID NO: 51653 - DNA, 103 bp, Artificial Sequence
  Synthetic Polynucleotide
taatacgactcactatagggaatacgtctgcaccgtttgattcagtatttaacagaggagaaaatacatgatcaaacggaacctggcggcagcgcaaaagatg

SEQ ID NO: 51654 - DNA, 103 bp, Artificial Sequence
  Synthetic Polynucleotide
taatacgactcactatagggccgccaatacgtctgcaccgtttgattcagaacagaggagactgaatatgacggtgcagaacctggcggcagcgcaaaagatg

SEQ ID NO: 51655 - DNA, 103 bp, Artificial Sequence
  Synthetic Polynucleotide
taatacgactcactatagggtagaaccgccaatacgtctgcaccgtttgaaacagaggagatcaaacatggcagacgtaaacctggcggcagcgcaaaagatg

SEQ ID NO: 51656 - DNA, 103 bp, Artificial Sequence
  Synthetic Polynucleotide
taatacgactcactatagggtccattagaaccgccaatacgtctgcaccgaacagaggagacggtgcatgcgtattggcaacctggcggcagcgcaaaagatg

SEQ ID NO: 51657 - DNA, 103 bp, Artificial Sequence
  Synthetic Polynucleotide
taatacgactcactatagggtggattccattagaaccgccaatacgtctgaacagaggagacagacgatgtggcggttcaacctggcggcagcgcaaaagatg

SEQ ID NO: 51658 - DNA, 103 bp, Artificial Sequence
  Synthetic Polynucleotide
taatacgactcactatagggtgctgtctattgtcgtagatattaacaaagaacagaggagactttgtatgtatctacgaaacctggcggcagcgcaaaagatg

SEQ ID NO: 51659 - DNA, 103 bp, Artificial Sequence
  Synthetic Polynucleotide
taatacgactcactatagggtcaattggattccattagaaccgccaatacaacagaggagagtattgatggttctaatgaacctggcggcagcgcaaaagatg

SEQ ID NO: 51660 - DNA, 103 bp, Artificial Sequence
  Synthetic Polynucleotide
taatacgactcactataggggtcaatcaattggattccattagaaccgccaacagaggagaggcggtatgaatggaatcaacctggcggcagcgcaaaagatg

SEQ ID NO: 51661 - DNA, 103 bp, Artificial Sequence
  Synthetic Polynucleotide
taatacgactcactatagggagatagtcaatcaattggattccattagaaaacagaggagattctaaatgaatccaattaacctggcggcagcgcaaaagatg

SEQ ID NO: 51662 - DNA, 103 bp, Artificial Sequence
  Synthetic Polynucleotide
taatacgactcactatagggtcaaaagatagtcaatcaattggattccataacagaggagaatggaaatgaattgattgaacctggcggcagcgcaaaagatg

SEQ ID NO: 51663 - DNA, 103 bp, Artificial Sequence
  Synthetic Polynucleotide
taatacgactcactatagggtattttcaaaagatagtcaatcaattggataacagaggagaatccaaatgattgactataacctggcggcagcgcaaaagatg

SEQ ID NO: 51664 - DNA, 103 bp, Artificial Sequence
  Synthetic Polynucleotide
taatacgactcactatagggatgtatattttcaaaagatagtcaatcaataacagaggagaattgatatgctatcttttaacctggcggcagcgcaaaagatg

SEQ ID NO: 51665 - DNA, 103 bp, Artificial Sequence
  Synthetic Polynucleotide
taatacgactcactatagggtaaaaatgtatattttcaaaagatagtcaaaacagaggagattgactatgttttgaaaaaacctggcggcagcgcaaaagatg

SEQ ID NO: 51666 - DNA, 103 bp, Artificial Sequence
  Synthetic Polynucleotide
taatacgactcactataggggatcataaaaatgtatattttcaaaagataaacagaggagatatcttatgaaaatatacaacctggcggcagcgcaaaagatg

SEQ ID NO: 51667 - DNA, 103 bp, Artificial Sequence
  Synthetic Polynucleotide
taatacgactcactatagggtatcggatcataaaaatgtatattttcaaaaacagaggagatttgaaatgatacattttaacctggcggcagcgcaaaagatg

SEQ ID NO: 51668 - DNA, 103 bp, Artificial Sequence
  Synthetic Polynucleotide
taatacgactcactatagggacaagtatcggatcataaaaatgtatatttaacagaggagaaaatatatgtttttatgaaacctggcggcagcgcaaaagatg

SEQ ID NO: 51669 - DNA, 103 bp, Artificial Sequence
  Synthetic Polynucleotide
taatacgactcactataggggggactgctgtctattgtcgtagatattaaaacagaggagattaataatgacgacaataaacctggcggcagcgcaaaagatg

SEQ ID NO: 51670 - DNA, 103 bp, Artificial Sequence
  Synthetic Polynucleotide
taatacgactcactatagggttcttacaagtatcggatcataaaaatgtaaacagaggagatacattatgatgatccgaaacctggcggcagcgcaaaagatg

SEQ ID NO: 51671 - DNA, 103 bp, Artificial Sequence
  Synthetic Polynucleotide
taatacgactcactatagggctatattcttacaagtatcggatcataaaaaacagaggagattttatatgccgatacttaacctggcggcagcgcaaaagatg

SEQ ID NO: 51672 - DNA, 103 bp, Artificial Sequence
  Synthetic Polynucleotide
taatacgactcactatagggtatttctatattcttacaagtatcggatcaaacagaggagatgatccatgacttgtaagaacctggcggcagcgcaaaagatg

SEQ ID NO: 51673 - DNA, 103 bp, Artificial Sequence
  Synthetic Polynucleotide
taatacgactcactatagggatcattatttctatattcttacaagtatcgaacagaggagacgatacatgtaagaatataacctggcggcagcgcaaaagatg

SEQ ID NO: 51674 - DNA, 103 bp, Artificial Sequence
  Synthetic Polynucleotide
taatacgactcactataggggacttatcattatttctatattcttacaagaacagaggagacttgtaatgatatagaaaaacctggcggcagcgcaaaagatg

SEQ ID NO: 51675 - DNA, 103 bp, Artificial Sequence
  Synthetic Polynucleotide
taatacgactcactatagggtgatggacttatcattatttctatattcttaacagaggagaaagaatatggaaataatgaacctggcggcagcgcaaaagatg

SEQ ID NO: 51676 - DNA, 103 bp, Artificial Sequence
  Synthetic Polynucleotide
taatacgactcactatagggcacgatgatggacttatcattatttctataaacagaggagatatagaatgaatgataagaacctggcggcagcgcaaaagatg

SEQ ID NO: 51677 - DNA, 103 bp, Artificial Sequence
  Synthetic Polynucleotide
taatacgactcactatagggaaaaacacgatgatggacttatcattatttaacagaggagaaaataaatgtaagtccataacctggcggcagcgcaaaagatg

SEQ ID NO: 51678 - DNA, 103 bp, Artificial Sequence
  Synthetic Polynucleotide
taatacgactcactatagggggcaaaaaaacacgatgatggacttatcataacagaggagaatgataatgccatcatcgaacctggcggcagcgcaaaagatg

SEQ ID NO: 51679 - DNA, 103 bp, Artificial Sequence
  Synthetic Polynucleotide
taatacgactcactataggggaagaggcaaaaaaacacgatgatggacttaacagaggagaaagtccatgatcgtgtttaacctggcggcagcgcaaaagatg

SEQ ID NO: 51680 - DNA, 103 bp, Artificial Sequence
  Synthetic Polynucleotide
taatacgactcactatagggtagttaataatatacaagatattttttctcaacagaggagagagaaaatgtatcttgtaaacctggcggcagcgcaaaagatg

SEQ ID NO: 51681 - DNA, 103 bp, Artificial Sequence
  Synthetic Polynucleotide
taatacgactcactatagggaccatgggactgctgtctattgtcgtagataacagaggagaatctacatgaatagacagaacctggcggcagcgcaaaagatg

SEQ ID NO: 51682 - DNA, 103 bp, Artificial Sequence
  Synthetic Polynucleotide
taatacgactcactatagggcttatgaagaggcaaaaaaacacgatgatgaacagaggagacatcatatggtttttttgaacctggcggcagcgcaaaagatg

SEQ ID NO: 51683 - DNA, 103 bp, Artificial Sequence
  Synthetic Polynucleotide
taatacgactcactatagggtagttcttatgaagaggcaaaaaaacacgaaacagaggagatcgtgtatgtttgcctctaacctggcggcagcgcaaaagatg

SEQ ID NO: 51684 - DNA, 103 bp, Artificial Sequence
  Synthetic Polynucleotide
taatacgactcactatagggaaatatagttcttatgaagaggcaaaaaaaaacagaggagattttttatgctcttcataaacctggcggcagcgcaaaagatg

SEQ ID NO: 51685 - DNA, 103 bp, Artificial Sequence
  Synthetic Polynucleotide
taatacgactcactatagggagaaaaaatatagttcttatgaagaggcaaaacagaggagattgcctatgcataagaacaacctggcggcagcgcaaaagatg

SEQ ID NO: 51686 - DNA, 103 bp, Artificial Sequence
  Synthetic Polynucleotide
taatacgactcactataggggaataagaaaaaatatagttcttatgaagaaacagaggagatcttcaatggaactatataacctggcggcagcgcaaaagatg

SEQ ID NO: 51687 - DNA, 103 bp, Artificial Sequence
  Synthetic Polynucleotide
taatacgactcactatagggcattggaataagaaaaaatatagttcttataacagaggagaataagaatgatattttttaacctggcggcagcgcaaaagatg

SEQ ID NO: 51688 - DNA, 103 bp, Artificial Sequence
  Synthetic Polynucleotide
taatacgactcactatagggttgttcattggaataagaaaaaatatagttaacagaggagaaactatatgttttcttataacctggcggcagcgcaaaagatg

SEQ ID NO: 51689 - DNA, 103 bp, Artificial Sequence
  Synthetic Polynucleotide
taatacgactcactatagggtaatcttgttcattggaataagaaaaaataaacagaggagatattttatgttattccaaaacctggcggcagcgcaaaagatg

SEQ ID NO: 51690 - DNA, 103 bp, Artificial Sequence
  Synthetic Polynucleotide
taatacgactcactataggggagattaatcttgttcattggaataagaaaaacagaggagatttcttatgccaatgaacaacctggcggcagcgcaaaagatg

SEQ ID NO: 51691 - DNA, 103 bp, Artificial Sequence
  Synthetic Polynucleotide
taatacgactcactatagggctggagagattaatcttgttcattggaataaacagaggagatattccatggaacaagataacctggcggcagcgcaaaagatg

SEQ ID NO: 51692 - DNA, 103 bp, Artificial Sequence
  Synthetic Polynucleotide
taatacgactcactatagggatggaaccatgggactgctgtctattgtcgaacagaggagacgacaaatgacagcagtcaacctggcggcagcgcaaaagatg

SEQ ID NO: 51693 - DNA, 103 bp, Artificial Sequence
  Synthetic Polynucleotide
taatacgactcactatagggatactctggagagattaatcttgttcattgaacagaggagacaatgaatgagattaatcaacctggcggcagcgcaaaagatg

SEQ ID NO: 51694 - DNA, 103 bp, Artificial Sequence
  Synthetic Polynucleotide
taatacgactcactatagggtacaaatactctggagagattaatcttgttaacagaggagaaacaagatgaatctctccaacctggcggcagcgcaaaagatg

SEQ ID NO: 51695 - DNA, 103 bp, Artificial Sequence
  Synthetic Polynucleotide
taatacgactcactatagggatgtgtacaaatactctggagagattaatcaacagaggagagattaaatgctccagagtaacctggcggcagcgcaaaagatg

SEQ ID NO: 51696 - DNA, 103 bp, Artificial Sequence
  Synthetic Polynucleotide
taatacgactcactataggggatagatgtgtacaaatactctggagagataacagaggagaatctctatggagtatttgaacctggcggcagcgcaaaagatg

SEQ ID NO: 51697 - DNA, 103 bp, Artificial Sequence
  Synthetic Polynucleotide
taatacgactcactatagggcacttgatagatgtgtacaaatactctggaaacagaggagatccagaatgtttgtacacaacctggcggcagcgcaaaagatg

SEQ ID NO: 51698 - DNA, 103 bp, Artificial Sequence
  Synthetic Polynucleotide
taatacgactcactatagggccaatcacttgatagatgtgtacaaatactaacagaggagaagtattatgacacatctaaacctggcggcagcgcaaaagatg

SEQ ID NO: 51699 - DNA, 103 bp, Artificial Sequence
  Synthetic Polynucleotide
taatacgactcactatagggtggatccaatcacttgatagatgtgtacaaaacagaggagattgtacatgtctatcaagaacctggcggcagcgcaaaagatg

SEQ ID NO: 51700 - DNA, 103 bp, Artificial Sequence
  Synthetic Polynucleotide
taatacgactcactataggggattatggatccaatcacttgatagatgtgaacagaggagacacatcatgcaagtgattaacctggcggcagcgcaaaagatg

SEQ ID NO: 51701 - DNA, 103 bp, Artificial Sequence
  Synthetic Polynucleotide
taatacgactcactatagggaagacgattatggatccaatcacttgatagaacagaggagactatcaatggattggatcaacctggcggcagcgcaaaagatg

SEQ ID NO: 51702 - DNA, 103 bp, Artificial Sequence
  Synthetic Polynucleotide
taatacgactcactatagggaaaggaagacgattatggatccaatcacttaacagaggagaaagtgaatggatccataaaacctggcggcagcgcaaaagatg

SEQ ID NO: 51703 - DNA, 103 bp, Artificial Sequence
  Synthetic Polynucleotide
taatacgactcactatagggtgtttatggaaccatgggactgctgtctataacagaggagaatagacatgagtcccatgaacctggcggcagcgcaaaagatg

SEQ ID NO: 51704 - DNA, 103 bp, Artificial Sequence
  Synthetic Polynucleotide
taatacgactcactatagggtggggaaaggaagacgattatggatccaataacagaggagaattggaatgataatcgtcaacctggcggcagcgcaaaagatg

SEQ ID NO: 51705 - DNA, 103 bp, Artificial Sequence
  Synthetic Polynucleotide
taatacgactcactatagggtatattggggaaaggaagacgattatggataacagaggagaatccatatgcgtcttcctaacctggcggcagcgcaaaagatg

SEQ ID NO: 51706 - DNA, 103 bp, Artificial Sequence
  Synthetic Polynucleotide
taatacgactcactatagggacatatatattggggaaaggaagacgattaaacagaggagataatcgatgtcctttcccaacctggcggcagcgcaaaagatg

SEQ ID NO: 51707 - DNA, 103 bp, Artificial Sequence
  Synthetic Polynucleotide
taatacgactcactatagggtcactacatatatattggggaaaggaagacaacagaggagagtcttcatgtccccaataaacctggcggcagcgcaaaagatg

SEQ ID NO: 51708 - DNA, 103 bp, Artificial Sequence
  Synthetic Polynucleotide
taatacgactcactatagggtatcatcactacatatatattggggaaaggaacagaggagacctttcatgaatatatataacctggcggcagcgcaaaagatg

SEQ ID NO: 51709 - DNA, 103 bp, Artificial Sequence
  Synthetic Polynucleotide
taatacgactcactatagggtgtgttatcatcactacatatatattggggaacagaggagaccccaaatgatatgtagtaacctggcggcagcgcaaaagatg

SEQ ID NO: 51710 - DNA, 103 bp, Artificial Sequence
  Synthetic Polynucleotide
taatacgactcactataggggaatatgtgttatcatcactacatatatataacagaggagaatatatatgtagtgatgaaacctggcggcagcgcaaaagatg

SEQ ID NO: 51711 - DNA, 103 bp, Artificial Sequence
  Synthetic Polynucleotide
taatacgactcactatagggccaatgaatatgtgttatcatcactacataaacagaggagatatgtaatgatgataacaaacctggcggcagcgcaaaagatg

SEQ ID NO: 51712 - DNA, 103 bp, Artificial Sequence
  Synthetic Polynucleotide
taatacgactcactatagggtcttcccaatgaatatgtgttatcatcactaacagaggagaagtgatatgaacacatataacctggcggcagcgcaaaagatg

SEQ ID NO: 51713 - DNA, 103 bp, Artificial Sequence
  Synthetic Polynucleotide
taatacgactcactataggggggtttcttcccaatgaatatgtgttatcaaacagaggagatgataaatgatattcattaacctggcggcagcgcaaaagatg

SEQ ID NO: 51714 - DNA, 103 bp, Artificial Sequence
  Synthetic Polynucleotide
taatacgactcactatagggctcactgtttatggaaccatgggactgctgaacagaggagacagcagatgcatggttccaacctggcggcagcgcaaaagatg

SEQ ID NO: 51715 - DNA, 103 bp, Artificial Sequence
  Synthetic Polynucleotide
taatacgactcactataggggtggagggtttcttcccaatgaatatgtgtaacagaggagaacacatatgcattgggaaaacctggcggcagcgcaaaagatg

SEQ ID NO: 51716 - DNA, 103 bp, Artificial Sequence
  Synthetic Polynucleotide
taatacgactcactatagggtttaagtggagggtttcttcccaatgaataaacagaggagatattcaatgggaagaaacaacctggcggcagcgcaaaagatg

SEQ ID NO: 51717 - DNA, 103 bp, Artificial Sequence
  Synthetic Polynucleotide
taatacgactcactatagggggatatttaagtggagggtttcttcccaataacagaggagaattgggatgaaaccctccaacctggcggcagcgcaaaagatg

SEQ ID NO: 51718 - DNA, 103 bp, Artificial Sequence
  Synthetic Polynucleotide
taatacgactcactatagggaaggaggatatttaagtggagggtttcttcaacagaggagagaagaaatgctccacttaaacctggcggcagcgcaaaagatg

SEQ ID NO: 51719 - DNA, 103 bp, Artificial Sequence
  Synthetic Polynucleotide
taatacgactcactatagggttttaaaggaggatatttaagtggagggttaacagaggagaaaccctatgcttaaatataacctggcggcagcgcaaaagatg

SEQ ID NO: 51720 - DNA, 103 bp, Artificial Sequence
  Synthetic Polynucleotide
taatacgactcactatagggattaattttaaaggaggatatttaagtggaaacagaggagatccactatgatatcctccaacctggcggcagcgcaaaagatg

SEQ ID NO: 51721 - DNA, 103 bp, Artificial Sequence
  Synthetic Polynucleotide
taatacgactcactatagggtaaggattaattttaaaggaggatatttaaaacagaggagattaaatatgctcctttaaaacctggcggcagcgcaaaagatg

SEQ ID NO: 51722 - DNA, 103 bp, Artificial Sequence
  Synthetic Polynucleotide
taatacgactcactatagggactagtaaggattaattttaaaggaggataaacagaggagatatcctatgttaaaattaaacctggcggcagcgcaaaagatg

SEQ ID NO: 51723 - DNA, 103 bp, Artificial Sequence
  Synthetic Polynucleotide
taatacgactcactatagggggaaaactagtaaggattaattttaaaggaaacagaggagatcctttatgattaatcctaacctggcggcagcgcaaaagatg

SEQ ID NO: 51724 - DNA, 103 bp, Artificial Sequence
  Synthetic Polynucleotide
taatacgactcactatagggatactggaaaactagtaaggattaattttaaacagaggagataaaatatgtccttactaaacctggcggcagcgcaaaagatg

SEQ ID NO: 51725 - DNA, 103 bp, Artificial Sequence
  Synthetic Polynucleotide
taatacgactcactatagggataaactcactgtttatggaaccatgggacaacagaggagagtcccaatgttccataaaaacctggcggcagcgcaaaagatg

SEQ ID NO: 51726 - DNA, 103 bp, Artificial Sequence
  Synthetic Polynucleotide
taatacgactcactatagggccagaatactggaaaactagtaaggattaaaacagaggagattaatcatgactagttttaacctggcggcagcgcaaaagatg

SEQ ID NO: 51727 - DNA, 103 bp, Artificial Sequence
  Synthetic Polynucleotide
taatacgactcactatagggactatccagaatactggaaaactagtaaggaacagaggagaccttacatgttttccagtaacctggcggcagcgcaaaagatg

SEQ ID NO: 51728 - DNA, 103 bp, Artificial Sequence
  Synthetic Polynucleotide
taatacgactcactatagggcaaccactatccagaatactggaaaactagaacagaggagactagttatgcagtattctaacctggcggcagcgcaaaagatg

SEQ ID NO: 51729 - DNA, 103 bp, Artificial Sequence
  Synthetic Polynucleotide
taatacgactcactataggggaaaccaaccactatccagaatactggaaaaacagaggagatttccaatgttctggataaacctggcggcagcgcaaaagatg

SEQ ID NO: 51730 - DNA, 103 bp, Artificial Sequence
  Synthetic Polynucleotide
taatacgactcactataggggagtcgaaaccaaccactatccagaatactaacagaggagaagtattatggatagtggtaacctggcggcagcgcaaaagatg

SEQ ID NO: 51731 - DNA, 103 bp, Artificial Sequence
  Synthetic Polynucleotide
taatacgactcactatagggataatgagtcgaaaccaaccactatccagaaacagaggagatctggaatgtggttggttaacctggcggcagcgcaaaagatg

SEQ ID NO: 51732 - DNA, 103 bp, Artificial Sequence
  Synthetic Polynucleotide
taatacgactcactatagggacattataatgagtcgaaaccaaccactataacagaggagaatagtgatgggtttcgacaacctggcggcagcgcaaaagatg

SEQ ID NO: 51733 - DNA, 103 bp, Artificial Sequence
  Synthetic Polynucleotide
taatacgactcactatagggaacatacattataatgagtcgaaaccaaccaacagaggagaggttggatgcgactcattaacctggcggcagcgcaaaagatg

SEQ ID NO: 51734 - DNA, 103 bp, Artificial Sequence
  Synthetic Polynucleotide
taatacgactcactatagggcgttaaacatacattataatgagtcgaaacaacagaggagagtttcgatgcattataataacctggcggcagcgcaaaagatg

SEQ ID NO: 51735 - DNA, 103 bp, Artificial Sequence
  Synthetic Polynucleotide
taatacgactcactatagggaaagccgttaaacatacattataatgagtcaacagaggagagactcaatgtaatgtatgaacctggcggcagcgcaaaagatg

SEQ ID NO: 51736 - DNA, 103 bp, Artificial Sequence
  Synthetic Polynucleotide
taatacgactcactataggggaaagataaactcactgtttatggaaccataacagaggagaatggttatgtaaacagtgaacctggcggcagcgcaaaagatg

SEQ ID NO: 51737 - DNA, 103 bp, Artificial Sequence
  Synthetic Polynucleotide
taatacgactcactatagggcgattaaagccgttaaacatacattataataacagaggagaattataatgtatgtttaaaacctggcggcagcgcaaaagatg

SEQ ID NO: 51738 - DNA, 103 bp, Artificial Sequence
  Synthetic Polynucleotide
taatacgactcactatagggacgcgcgattaaagccgttaaacatacattaacagaggagaaatgtaatgttaacggctaacctggcggcagcgcaaaagatg

SEQ ID NO: 51739 - DNA, 103 bp, Artificial Sequence
  Synthetic Polynucleotide
taatacgactcactatagggttctaacgcgcgattaaagccgttaaacataacagaggagaatgtttatgggctttaataacctggcggcagcgcaaaagatg

SEQ ID NO: 51740 - DNA, 103 bp, Artificial Sequence
  Synthetic Polynucleotide
taatacgactcactataggggcaatttctaacgcgcgattaaagccgttaaacagaggagataacggatgtaatcgcgcaacctggcggcagcgcaaaagatg

SEQ ID NO: 51741 - DNA, 103 bp, Artificial Sequence
  Synthetic Polynucleotide
taatacgactcactatagggaaaaagcaatttctaacgcgcgattaaagcaacagaggagagctttaatggcgcgttagaacctggcggcagcgcaaaagatg

SEQ ID NO: 51742 - DNA, 103 bp, Artificial Sequence
  Synthetic Polynucleotide
taatacgactcactatagggaactaaaaaagcaatttctaacgcgcgattaacagaggagaaatcgcatgttagaaattaacctggcggcagcgcaaaagatg

SEQ ID NO: 51743 - DNA, 103 bp, Artificial Sequence
  Synthetic Polynucleotide
taatacgactcactatagggatagaaactaaaaaagcaatttctaacgcgaacagaggagacgcgttatgaattgctttaacctggcggcagcgcaaaagatg

SEQ ID NO: 51744 - DNA, 103 bp, Artificial Sequence
  Synthetic Polynucleotide
taatacgactcactatagggttaatatagaaactaaaaaagcaatttctaaacagaggagatagaaaatgcttttttagaacctggcggcagcgcaaaagatg

SEQ ID NO: 51745 - DNA, 103 bp, Artificial Sequence
  Synthetic Polynucleotide
taatacgactcactatagggtcctattaatatagaaactaaaaaagcaataacagaggagaattgctatgttagtttctaacctggcggcagcgcaaaagatg

SEQ ID NO: 51746 - DNA, 103 bp, Artificial Sequence
  Synthetic Polynucleotide
taatacgactcactatagggctatctcctattaatatagaaactaaaaaaaacagaggagattttttatgttctatattaacctggcggcagcgcaaaagatg

SEQ ID NO: 51747 - DNA, 103 bp, Artificial Sequence
  Synthetic Polynucleotide
taatacgactcactatagggtcaaagaaagataaactcactgtttatggaaacagaggagatccataatgagtgagtttaacctggcggcagcgcaaaagatg

SEQ ID NO: 51748 - DNA, 103 bp, Artificial Sequence
  Synthetic Polynucleotide
taatacgactcactatagggaacaactatctcctattaatatagaaactaaacagaggagatagtttatgtattaatagaacctggcggcagcgcaaaagatg

SEQ ID NO: 51749 - DNA, 103 bp, Artificial Sequence
  Synthetic Polynucleotide
taatacgactcactataggggtcacaacaactatctcctattaatatagaaacagaggagatctataatgataggagataacctggcggcagcgcaaaagatg

SEQ ID NO: 51750 - DNA, 103 bp, Artificial Sequence
  Synthetic Polynucleotide
taatacgactcactatagggactatgtcacaacaactatctcctattaataacagaggagaattaatatgagatagttgaacctggcggcagcgcaaaagatg

SEQ ID NO: 51751 - DNA, 103 bp, Artificial Sequence
  Synthetic Polynucleotide
taatacgactcactatagggtttttactatgtcacaacaactatctcctaaacagaggagataggagatggttgttgtgaacctggcggcagcgcaaaagatg

SEQ ID NO: 51752 - DNA, 103 bp, Artificial Sequence
  Synthetic Polynucleotide
taatacgactcactatagggtttcatttttactatgtcacaacaactatcaacagaggagagatagtatgtgtgacataaacctggcggcagcgcaaaagatg

SEQ ID NO: 51753 - DNA, 103 bp, Artificial Sequence
  Synthetic Polynucleotide
taatacgactcactatagggtatcatttcatttttactatgtcacaacaaaacagaggagattgttgatgcatagtaaaaacctggcggcagcgcaaaagatg

SEQ ID NO: 51754 - DNA, 103 bp, Artificial Sequence
  Synthetic Polynucleotide
taatacgactcactatagggacagttatcatttcatttttactatgtcacaacagaggagagtgacaatgtaaaaatgaaacctggcggcagcgcaaaagatg

SEQ ID NO: 51755 - DNA, 103 bp, Artificial Sequence
  Synthetic Polynucleotide
taatacgactcactatagggtctaaacagttatcatttcatttttactataacagaggagaatagtaatgatgaaatgaaacctggcggcagcgcaaaagatg

SEQ ID NO: 51756 - DNA, 103 bp, Artificial Sequence
  Synthetic Polynucleotide
taatacgactcactatagggctatttctaaacagttatcatttcatttttaacagaggagaaaaaatatgatgataactaacctggcggcagcgcaaaagatg

SEQ ID NO: 51757 - DNA, 103 bp, Artificial Sequence
  Synthetic Polynucleotide
taatacgactcactatagggaagagctatttctaaacagttatcatttcaaacagaggagatgaaatatgaactgtttaaacctggcggcagcgcaaaagatg

SEQ ID NO: 51758 - DNA, 103 bp, Artificial Sequence
  Synthetic Polynucleotide
taatacgactcactatagggtctcttcaaagaaagataaactcactgtttaacagaggagaaaacagatggtttatcttaacctggcggcagcgcaaaagatg

SEQ ID NO: 51759 - DNA, 103 bp, Artificial Sequence
  Synthetic Polynucleotide
taatacgactcactatagggatactaagagctatttctaaacagttatcaaacagaggagatgataaatgtttagaaataacctggcggcagcgcaaaagatg

SEQ ID NO: 51760 - DNA, 103 bp, Artificial Sequence
  Synthetic Polynucleotide
taatacgactcactatagggttcccatactaagagctatttctaaacagtaacagaggagaactgttatgaaatagctcaacctggcggcagcgcaaaagatg

SEQ ID NO: 51761 - DNA, 103 bp, Artificial Sequence
  Synthetic Polynucleotide
taatacgactcactatagggtgtaattcccatactaagagctatttctaaaacagaggagattagaaatggctcttagtaacctggcggcagcgcaaaagatg

SEQ ID NO: 51762 - DNA, 103 bp, Artificial Sequence
  Synthetic Polynucleotide
taatacgactcactatagggtccattgtaattcccatactaagagctattaacagaggagaaatagcatgtagtatgggaacctggcggcagcgcaaaagatg

SEQ ID NO: 51763 - DNA, 103 bp, Artificial Sequence
  Synthetic Polynucleotide
taatacgactcactatagggcctcatccattgtaattcccatactaagagaacagaggagactcttaatgtgggaattaaacctggcggcagcgcaaaagatg

SEQ ID NO: 51764 - DNA, 103 bp, Artificial Sequence
  Synthetic Polynucleotide
taatacgactcactatagggcacttcctcatccattgtaattcccatactaacagaggagaagtatgatgattacaatgaacctggcggcagcgcaaaagatg

SEQ ID NO: 51765 - DNA, 103 bp, Artificial Sequence
  Synthetic Polynucleotide
taatacgactcactatagggaatatcacttcctcatccattgtaattcccaacagaggagagggaatatgaatggatgaaacctggcggcagcgcaaaagatg

SEQ ID NO: 51766 - DNA, 103 bp, Artificial Sequence
  Synthetic Polynucleotide
taatacgactcactatagggtttcaaatatcacttcctcatccattgtaaaacagaggagattacaaatgatgaggaagaacctggcggcagcgcaaaagatg

SEQ ID NO: 51767 - DNA, 103 bp, Artificial Sequence
  Synthetic Polynucleotide
taatacgactcactatagggaggagtttcaaatatcacttcctcatccataacagaggagaatggatatggaagtgataaacctggcggcagcgcaaaagatg

SEQ ID NO: 51768 - DNA, 103 bp, Artificial Sequence
  Synthetic Polynucleotide
taatacgactcactatagggtctctaggagtttcaaatatcacttcctcaaacagaggagatgaggaatggatatttgaaacctggcggcagcgcaaaagatg

SEQ ID NO: 51769 - DNA, 103 bp, Artificial Sequence
  Synthetic Polynucleotide
taatacgactcactatagggaaatatctcttcaaagaaagataaactcacaacagaggagagtgagtatgtctttctttaacctggcggcagcgcaaaagatg

SEQ ID NO: 51770 - DNA, 103 bp, Artificial Sequence
  Synthetic Polynucleotide
taatacgactcactatagggttaattctctaggagtttcaaatatcacttaacagaggagaaagtgaatgttgaaactcaacctggcggcagcgcaaaagatg

SEQ ID NO: 51771 - DNA, 103 bp, Artificial Sequence
  Synthetic Polynucleotide
taatacgactcactatagggagatattaattctctaggagtttcaaatataacagaggagaatatttatgactcctagaaacctggcggcagcgcaaaagatg

SEQ ID NO: 51772 - DNA, 103 bp, Artificial Sequence
  Synthetic Polynucleotide
taatacgactcactatagggttaatagatattaattctctaggagtttcaaacagaggagatgaaacatgtagagaattaacctggcggcagcgcaaaagatg

SEQ ID NO: 51773 - DNA, 103 bp, Artificial Sequence
  Synthetic Polynucleotide
taatacgactcactatagggttcgtttaatagatattaattctctaggagaacagaggagactcctaatgaattaatataacctggcggcagcgcaaaagatg

SEQ ID NO: 51774 - DNA, 103 bp, Artificial Sequence
  Synthetic Polynucleotide
taatacgactcactatagggttttattcgtttaatagatattaattctctaacagaggagaagagaaatgatatctattaacctggcggcagcgcaaaagatg

SEQ ID NO: 51775 - DNA, 103 bp, Artificial Sequence
  Synthetic Polynucleotide
taatacgactcactatagggatatcttttattcgtttaatagatattaataacagaggagaattaatatgtattaaacgaacctggcggcagcgcaaaagatg

SEQ ID NO: 51776 - DNA, 103 bp, Artificial Sequence
  Synthetic Polynucleotide
taatacgactcactatagggttggaatatcttttattcgtttaatagataaacagaggagatatctaatgaacgaataaaacctggcggcagcgcaaaagatg

SEQ ID NO: 51777 - DNA, 103 bp, Artificial Sequence
  Synthetic Polynucleotide
taatacgactcactatagggtgatcttggaatatcttttattcgtttaataacagaggagaattaaaatgataaaagataacctggcggcagcgcaaaagatg

SEQ ID NO: 51778 - DNA, 103 bp, Artificial Sequence
  Synthetic Polynucleotide
taatacgactcactatagggtcttttgatcttggaatatcttttattcgtaacagaggagaacgaatatgagatattccaacctggcggcagcgcaaaagatg

SEQ ID NO: 51779 - DNA, 103 bp, Artificial Sequence
  Synthetic Polynucleotide
taatacgactcactataggggcgtgtcttttgatcttggaatatcttttaaacagaggagataaaagatgttccaagataacctggcggcagcgcaaaagatg

SEQ ID NO: 51780 - DNA, 103 bp, Artificial Sequence
  Synthetic Polynucleotide
taatacgactcactatagggctacaaaatatctcttcaaagaaagataaaaacagaggagatttatcatgctttgaagaaacctggcggcagcgcaaaagatg

SEQ ID NO: 51781 - DNA, 103 bp, Artificial Sequence
  Synthetic Polynucleotide
taatacgactcactatagggcacgtgcgtgtcttttgatcttggaatatcaacagaggagagatattatgagatcaaaaaacctggcggcagcgcaaaagatg

SEQ ID NO: 51782 - DNA, 103 bp, Artificial Sequence
  Synthetic Polynucleotide
taatacgactcactataggggcaaacacgtgcgtgtcttttgatcttggaaacagaggagatccaagatgaaaagacacaacctggcggcagcgcaaaagatg

SEQ ID NO: 51783 - DNA, 103 bp, Artificial Sequence
  Synthetic Polynucleotide
taatacgactcactatagggacgcagcaaacacgtgcgtgtcttttgatcaacagaggagagatcaaatgacacgcacgaacctggcggcagcgcaaaagatg

SEQ ID NO: 51784 - DNA, 103 bp, Artificial Sequence
  Synthetic Polynucleotide
taatacgactcactatagggtatacacgcagcaaacacgtgcgtgtctttaacagaggagaaaagacatgcacgtgtttaacctggcggcagcgcaaaagatg

SEQ ID NO: 51785 - DNA, 103 bp, Artificial Sequence
  Synthetic Polynucleotide
taatacgactcactatagggcttgttatacacgcagcaaacacgtgcgtgaacagaggagacacgcaatggtttgctgcaacctggcggcagcgcaaaagatg

SEQ ID NO: 51786 - DNA, 103 bp, Artificial Sequence
  Synthetic Polynucleotide
taatacgactcactatagggcgtcacttgttatacacgcagcaaacacgtaacagaggagaacgtgtatgctgcgtgtaaacctggcggcagcgcaaaagatg

SEQ ID NO: 51787 - DNA, 103 bp, Artificial Sequence
  Synthetic Polynucleotide
taatacgactcactatagggatatccgtcacttgttatacacgcagcaaaaacagaggagatttgctatgtgtataacaaacctggcggcagcgcaaaagatg

SEQ ID NO: 51788 - DNA, 103 bp, Artificial Sequence
  Synthetic Polynucleotide
taatacgactcactatagggagcggatatccgtcacttgttatacacgcaaacagaggagatgcgtgatgaacaagtgaaacctggcggcagcgcaaaagatg

SEQ ID NO: 51789 - DNA, 103 bp, Artificial Sequence
  Synthetic Polynucleotide
taatacgactcactatagggctattagcggatatccgtcacttgttatacaacagaggagagtataaatggtgacggataacctggcggcagcgcaaaagatg

SEQ ID NO: 51790 - DNA, 103 bp, Artificial Sequence
  Synthetic Polynucleotide
taatacgactcactatagggagctcctattagcggatatccgtcacttgtaacagaggagaacaagtatgggatatccgaacctggcggcagcgcaaaagatg

SEQ ID NO: 51791 - DNA, 103 bp, Artificial Sequence
  Synthetic Polynucleotide
taatacgactcactatagggaaaacatatagatagacgaggaaacaatgtaacagaggagaacattgatgcctcgtctaaacctggcggcagcgcaaaagatg

SEQ ID NO: 51792 - DNA, 103 bp, Artificial Sequence
  Synthetic Polynucleotide
taatacgactcactatagggtagtttagttaataatatacaagatattttaacagaggagaaaaataatgtgtatattaaacctggcggcagcgcaaaagatg

SEQ ID NO: 51793 - DNA, 103 bp, Artificial Sequence
  Synthetic Polynucleotide
taatacgactcactataggggatctctacaaaatatctcttcaaagaaagaacagaggagactttctatgaagagatataacctggcggcagcgcaaaagatg

SEQ ID NO: 51794 - DNA, 103 bp, Artificial Sequence
  Synthetic Polynucleotide
taatacgactcactatagggcttctagctcctattagcggatatccgtcaaacagaggagatgacggatgtccgctaataacctggcggcagcgcaaaagatg

SEQ ID NO: 51795 - DNA, 103 bp, Artificial Sequence
  Synthetic Polynucleotide
taatacgactcactatagggaagttcttctagctcctattagcggatatcaacagaggagagatatcatgtaataggagaacctggcggcagcgcaaaagatg

SEQ ID NO: 51796 - DNA, 103 bp, Artificial Sequence
  Synthetic Polynucleotide
taatacgactcactataggggaatgaagttcttctagctcctattagcggaacagaggagaccgctaatgggagctagaaacctggcggcagcgcaaaagatg

SEQ ID NO: 51797 - DNA, 103 bp, Artificial Sequence
  Synthetic Polynucleotide
taatacgactcactatagggaatgcgaatgaagttcttctagctcctattaacagaggagaaataggatgtagaagaacaacctggcggcagcgcaaaagatg

SEQ ID NO: 51798 - DNA, 103 bp, Artificial Sequence
  Synthetic Polynucleotide
taatacgactcactatagggcctggaatgcgaatgaagttcttctagctcaacagaggagagagctaatggaacttcataacctggcggcagcgcaaaagatg

SEQ ID NO: 51799 - DNA, 103 bp, Artificial Sequence
  Synthetic Polynucleotide
taatacgactcactatagggtatcgcctggaatgcgaatgaagttcttctaacagaggagaagaagaatgtcattcgcaaacctggcggcagcgcaaaagatg

SEQ ID NO: 51800 - DNA, 103 bp, Artificial Sequence
  Synthetic Polynucleotide
taatacgactcactataggggataatatcgcctggaatgcgaatgaagttaacagaggagaaacttcatgcgcattccaaacctggcggcagcgcaaaagatg

SEQ ID NO: 51801 - DNA, 103 bp, Artificial Sequence
  Synthetic Polynucleotide
taatacgactcactataggggttgagataatatcgcctggaatgcgaatgaacagaggagacattcgatgtccaggcgaaacctggcggcagcgcaaaagatg

SEQ ID NO: 51802 - DNA, 103 bp, Artificial Sequence
  Synthetic Polynucleotide
taatacgactcactatagggattttgttgagataatatcgcctggaatgcaacagaggagagcattcatggcgatattaaacctggcggcagcgcaaaagatg

SEQ ID NO: 51803 - DNA, 103 bp, Artificial Sequence
  Synthetic Polynucleotide
taatacgactcactatagggtctgaattttgttgagataatatcgcctggaacagaggagaccaggcatgattatctcaaacctggcggcagcgcaaaagatg

SEQ ID NO: 51804 - DNA, 103 bp, Artificial Sequence
  Synthetic Polynucleotide
taatacgactcactatagggtataagatctctacaaaatatctcttcaaaaacagaggagatttgaaatgatattttgtaacctggcggcagcgcaaaagatg

SEQ ID NO: 51805 - DNA, 103 bp, Artificial Sequence
  Synthetic Polynucleotide
taatacgactcactatagggtagaatctgaattttgttgagataatatcgaacagaggagacgatatatgctcaacaaaaacctggcggcagcgcaaaagatg

SEQ ID NO: 51806 - DNA, 103 bp, Artificial Sequence
  Synthetic Polynucleotide
taatacgactcactatagggaaagatagaatctgaattttgttgagataaaacagaggagattatctatgcaaaattcaaacctggcggcagcgcaaaagatg

SEQ ID NO: 51807 - DNA, 103 bp, Artificial Sequence
  Synthetic Polynucleotide
taatacgactcactatagggactctaaagatagaatctgaattttgttgaaacagaggagatcaacaatgttcagattcaacctggcggcagcgcaaaagatg

SEQ ID NO: 51808 - DNA, 103 bp, Artificial Sequence
  Synthetic Polynucleotide
taatacgactcactatagggtggatactctaaagatagaatctgaattttaacagaggagaaaaattatgattctatctaacctggcggcagcgcaaaagatg

SEQ ID NO: 51809 - DNA, 103 bp, Artificial Sequence
  Synthetic Polynucleotide
taatacgactcactatagggtttagtggatactctaaagatagaatctgaaacagaggagatcagatatgatctttagaaacctggcggcagcgcaaaagatg

SEQ ID NO: 51810 - DNA, 103 bp, Artificial Sequence
  Synthetic Polynucleotide
taatacgactcactatagggaatagtttagtggatactctaaagatagaaaacagaggagattctatatgtagagtatcaacctggcggcagcgcaaaagatg

SEQ ID NO: 51811 - DNA, 103 bp, Artificial Sequence
  Synthetic Polynucleotide
taatacgactcactatagggaccgtaatagtttagtggatactctaaagaaacagaggagatctttaatgtatccactaaacctggcggcagcgcaaaagatg

SEQ ID NO: 51812 - DNA, 103 bp, Artificial Sequence
  Synthetic Polynucleotide
taatacgactcactatagggcataaaccgtaatagtttagtggatactctaacagaggagaagagtaatgactaaactaaacctggcggcagcgcaaaagatg

SEQ ID NO: 51813 - DNA, 103 bp, Artificial Sequence
  Synthetic Polynucleotide
taatacgactcactatagggtaatacataaaccgtaatagtttagtggataacagaggagaatccacatgactattacgaacctggcggcagcgcaaaagatg

SEQ ID NO: 51814 - DNA, 103 bp, Artificial Sequence
  Synthetic Polynucleotide
taatacgactcactatagggcattgtaatacataaaccgtaatagtttagaacagaggagactaaacatgtacggtttaaacctggcggcagcgcaaaagatg

SEQ ID NO: 51815 - DNA, 103 bp, Artificial Sequence
  Synthetic Polynucleotide
taatacgactcactatagggagttttataagatctctacaaaatatctctaacagaggagaagagatatgttgtagagaaacctggcggcagcgcaaaagatg

SEQ ID NO: 51816 - DNA, 103 bp, Artificial Sequence
  Synthetic Polynucleotide
taatacgactcactatagggtagttcattgtaatacataaaccgtaatagaacagaggagactattaatgtttatgtataacctggcggcagcgcaaaagatg

SEQ ID NO: 51817 - DNA, 103 bp, Artificial Sequence
  Synthetic Polynucleotide
taatacgactcactatagggtctcttagttcattgtaatacataaaccgtaacagaggagaacggttatggtattacaaaacctggcggcagcgcaaaagatg

SEQ ID NO: 51818 - DNA, 103 bp, Artificial Sequence
  Synthetic Polynucleotide
taatacgactcactatagggagatttctcttagttcattgtaatacataaaacagaggagattatgtatgacaatgaacaacctggcggcagcgcaaaagatg

SEQ ID NO: 51819 - DNA, 103 bp, Artificial Sequence
  Synthetic Polynucleotide
taatacgactcactatagggtctaaagatttctcttagttcattgtaataaacagaggagatattacatggaactaagaaacctggcggcagcgcaaaagatg

SEQ ID NO: 51820 - DNA, 103 bp, Artificial Sequence
  Synthetic Polynucleotide
taatacgactcactatagggaaccgtctaaagatttctcttagttcattgaacagaggagacaatgaatgaagagaaataacctggcggcagcgcaaaagatg

SEQ ID NO: 51821 - DNA, 103 bp, Artificial Sequence
  Synthetic Polynucleotide
taatacgactcactatagggttctcaaccgtctaaagatttctcttagttaacagaggagaaactaaatgaaatctttaaacctggcggcagcgcaaaagatg

SEQ ID NO: 51822 - DNA, 103 bp, Artificial Sequence
  Synthetic Polynucleotide
taatacgactcactatagggaccttttctcaaccgtctaaagatttctctaacagaggagaagagaaatgtttagacggaacctggcggcagcgcaaaagatg

SEQ ID NO: 51823 - DNA, 103 bp, Artificial Sequence
  Synthetic Polynucleotide
taatacgactcactatagggatagaaccttttctcaaccgtctaaagattaacagaggagaaatcttatgacggttgagaacctggcggcagcgcaaaagatg

SEQ ID NO: 51824 - DNA, 103 bp, Artificial Sequence
  Synthetic Polynucleotide
taatacgactcactatagggtgttgatagaaccttttctcaaccgtctaaaacagaggagattagacatgtgagaaaagaacctggcggcagcgcaaaagatg

SEQ ID NO: 51825 - DNA, 103 bp, Artificial Sequence
  Synthetic Polynucleotide
taatacgactcactataggggatattgttgatagaaccttttctcaaccgaacagaggagacggttgatgaaaggttctaacctggcggcagcgcaaaagatg

SEQ ID NO: 51826 - DNA, 103 bp, Artificial Sequence
  Synthetic Polynucleotide
taatacgactcactatagggttgacagttttataagatctctacaaaataaacagaggagatattttatggagatcttaaacctggcggcagcgcaaaagatg

SEQ ID NO: 51827 - DNA, 103 bp, Artificial Sequence
  Synthetic Polynucleotide
taatacgactcactatagggggatcgatattgttgatagaaccttttctcaacagaggagagagaaaatgttctatcaaaacctggcggcagcgcaaaagatg

SEQ ID NO: 51828 - DNA, 103 bp, Artificial Sequence
  Synthetic Polynucleotide
taatacgactcactatagggagtgaggatcgatattgttgatagaaccttaacagaggagaaaggttatgtcaacaataaacctggcggcagcgcaaaagatg

SEQ ID NO: 51829 - DNA, 103 bp, Artificial Sequence
  Synthetic Polynucleotide
taatacgactcactatagggttcgaagtgaggatcgatattgttgatagaaacagaggagatctatcatgaatatcgataacctggcggcagcgcaaaagatg

SEQ ID NO: 51830 - DNA, 103 bp, Artificial Sequence
  Synthetic Polynucleotide
taatacgactcactatagggaactcttcgaagtgaggatcgatattgttgaacagaggagacaacaaatgcgatcctcaaacctggcggcagcgcaaaagatg

SEQ ID NO: 51831 - DNA, 103 bp, Artificial Sequence
  Synthetic Polynucleotide
taatacgactcactatagggatattaactcttcgaagtgaggatcgatataacagaggagaatatcgatgctcacttcgaacctggcggcagcgcaaaagatg

SEQ ID NO: 51832 - DNA, 103 bp, Artificial Sequence
  Synthetic Polynucleotide
taatacgactcactatagggcaataatattaactcttcgaagtgaggatcaacagaggagagatcctatgttcgaagagaacctggcggcagcgcaaaagatg

SEQ ID NO: 51833 - DNA, 103 bp, Artificial Sequence
  Synthetic Polynucleotide
taatacgactcactatagggccacccaataatattaactcttcgaagtgaaacagaggagatcacttatgagagttaataacctggcggcagcgcaaaagatg

SEQ ID NO: 51834 - DNA, 103 bp, Artificial Sequence
  Synthetic Polynucleotide
taatacgactcactataggggtttaccacccaataatattaactcttcgaaacagaggagatcgaagatgtaatattataacctggcggcagcgcaaaagatg

SEQ ID NO: 51835 - DNA, 103 bp, Artificial Sequence
  Synthetic Polynucleotide
taatacgactcactatagggatctagtttaccacccaataatattaactcaacagaggagagagttaatgttattgggtaacctggcggcagcgcaaaagatg

SEQ ID NO: 51836 - DNA, 103 bp, Artificial Sequence
  Synthetic Polynucleotide
taatacgactcactatagggtttttatctagtttaccacccaataatattaacagaggagaaatattatggggtggtaaaacctggcggcagcgcaaaagatg

SEQ ID NO: 51837 - DNA, 103 bp, Artificial Sequence
  Synthetic Polynucleotide
taatacgactcactataggggtcatttgacagttttataagatctctacaaacagaggagatgtagaatgcttataaaaaacctggcggcagcgcaaaagatg

SEQ ID NO: 51838 - DNA, 103 bp, Artificial Sequence
  Synthetic Polynucleotide
taatacgactcactatagggattcctttttatctagtttaccacccaataaacagaggagatattggatggtaaactagaacctggcggcagcgcaaaagatg

SEQ ID NO: 51839 - DNA, 103 bp, Artificial Sequence
  Synthetic Polynucleotide
taatacgactcactatagggaatagattcctttttatctagtttaccaccaacagaggagaggtggtatgctagataaaaacctggcggcagcgcaaaagatg

SEQ ID NO: 51840 - DNA, 103 bp, Artificial Sequence
  Synthetic Polynucleotide
taatacgactcactatagggtctttaatagattcctttttatctagtttaaacagaggagataaactatgtaaaaaggaaacctggcggcagcgcaaaagatg

SEQ ID NO: 51841 - DNA, 103 bp, Artificial Sequence
  Synthetic Polynucleotide
taatacgactcactatagggaacaatctttaatagattcctttttatctaaacagaggagatagataatgaggaatctaaacctggcggcagcgcaaaagatg

SEQ ID NO: 51842 - DNA, 103 bp, Artificial Sequence
  Synthetic Polynucleotide
taatacgactcactatagggtcttaaacaatctttaatagattcctttttaacagaggagaaaaaagatgtctattaaaaacctggcggcagcgcaaaagatg

SEQ ID NO: 51843 - DNA, 103 bp, Artificial Sequence
  Synthetic Polynucleotide
taatacgactcactatagggtctcttcttaaacaatctttaatagattccaacagaggagaggaatcatgtaaagattgaacctggcggcagcgcaaaagatg

SEQ ID NO: 51844 - DNA, 103 bp, Artificial Sequence
  Synthetic Polynucleotide
taatacgactcactatagggttaattctcttcttaaacaatctttaatagaacagaggagactattaatgattgtttaaaacctggcggcagcgcaaaagatg

SEQ ID NO: 51845 - DNA, 103 bp, Artificial Sequence
  Synthetic Polynucleotide
taatacgactcactatagggctcttttaattctcttcttaaacaatctttaacagaggagaaaagatatgttaagaagaaacctggcggcagcgcaaaagatg

SEQ ID NO: 51846 - DNA, 103 bp, Artificial Sequence
  Synthetic Polynucleotide
taatacgactcactatagggctttcctcttttaattctcttcttaaacaaaacagaggagattgtttatgaagagaattaacctggcggcagcgcaaaagatg

SEQ ID NO: 51847 - DNA, 103 bp, Artificial Sequence
  Synthetic Polynucleotide
taatacgactcactatagggcatcactttcctcttttaattctcttcttaaacagaggagataagaaatgaattaaaagaacctggcggcagcgcaaaagatg

SEQ ID NO: 51848 - DNA, 103 bp, Artificial Sequence
  Synthetic Polynucleotide
taatacgactcactataggggcgatgtcatttgacagttttataagatctaacagaggagaagatctatgaaaactgtcaacctggcggcagcgcaaaagatg

SEQ ID NO: 51849 - DNA, 103 bp, Artificial Sequence
  Synthetic Polynucleotide
taatacgactcactatagggacgttcatcactttcctcttttaattctctaacagaggagaagagaaatgaaagaggaaaacctggcggcagcgcaaaagatg

SEQ ID NO: 51850 - DNA, 103 bp, Artificial Sequence
  Synthetic Polynucleotide
taatacgactcactataggggttatacgttcatcactttcctcttttaataacagaggagaattaaaatgggaaagtgaaacctggcggcagcgcaaaagatg

SEQ ID NO: 51851 - DNA, 103 bp, Artificial Sequence
  Synthetic Polynucleotide
taatacgactcactatagggttactgttatacgttcatcactttcctcttaacagaggagaaagaggatggtgatgaacaacctggcggcagcgcaaaagatg

SEQ ID NO: 51852 - DNA, 103 bp, Artificial Sequence
  Synthetic Polynucleotide
taatacgactcactatagggttcttttactgttatacgttcatcactttcaacagaggagagaaagtatggaacgtataaacctggcggcagcgcaaaagatg

SEQ ID NO: 51853 - DNA, 103 bp, Artificial Sequence
  Synthetic Polynucleotide
taatacgactcactatagggccgaattcttttactgttatacgttcatcaaacagaggagatgatgaatgtataacagtaacctggcggcagcgcaaaagatg

SEQ ID NO: 51854 - DNA, 103 bp, Artificial Sequence
  Synthetic Polynucleotide
taatacgactcactatagggcatttccgaattcttttactgttatacgttaacagaggagaaacgtaatgcagtaaaagaacctggcggcagcgcaaaagatg

SEQ ID NO: 51855 - DNA, 103 bp, Artificial Sequence
  Synthetic Polynucleotide
taatacgactcactatagggaattacatttccgaattcttttactgttataacagaggagaataacaatgaaagaattcaacctggcggcagcgcaaaagatg

SEQ ID NO: 51856 - DNA, 103 bp, Artificial Sequence
  Synthetic Polynucleotide
taatacgactcactatagggtttagaattacatttccgaattcttttactaacagaggagaagtaaaatgattcggaaaaacctggcggcagcgcaaaagatg

SEQ ID NO: 51857 - DNA, 103 bp, Artificial Sequence
  Synthetic Polynucleotide
taatacgactcactatagggtaagttttagaattacatttccgaattcttaacagaggagaaagaatatggaaatgtaaaacctggcggcagcgcaaaagatg

SEQ ID NO: 51858 - DNA, 103 bp, Artificial Sequence
  Synthetic Polynucleotide
taatacgactcactatagggtgttgtaagttttagaattacatttccgaaaacagaggagattcggaatggtaattctaaacctggcggcagcgcaaaagatg

SEQ ID NO: 51859 - DNA, 103 bp, Artificial Sequence
  Synthetic Polynucleotide
taatacgactcactatagggtaaatgcgatgtcatttgacagttttataaaacagaggagattataaatgtgtcaaatgaacctggcggcagcgcaaaagatg

SEQ ID NO: 51860 - DNA, 103 bp, Artificial Sequence
  Synthetic Polynucleotide
taatacgactcactatagggtcctgtgttgtaagttttagaattacatttaacagaggagaaaatgtatgtctaaaactaacctggcggcagcgcaaaagatg

SEQ ID NO: 51861 - DNA, 103 bp, Artificial Sequence
  Synthetic Polynucleotide
taatacgactcactatagggatttatcctgtgttgtaagttttagaattaaacagaggagataattcatgaacttacaaaacctggcggcagcgcaaaagatg

SEQ ID NO: 51862 - DNA, 103 bp, Artificial Sequence
  Synthetic Polynucleotide
taatacgactcactatagggaaataatttatcctgtgttgtaagttttagaacagaggagactaaaaatgacaacacagaacctggcggcagcgcaaaagatg

SEQ ID NO: 51863 - DNA, 103 bp, Artificial Sequence
  Synthetic Polynucleotide
taatacgactcactatagggttattaaataatttatcctgtgttgtaagtaacagaggagaacttacatgacaggataaaacctggcggcagcgcaaaagatg

SEQ ID NO: 51864 - DNA, 103 bp, Artificial Sequence
  Synthetic Polynucleotide
taatacgactcactatagggacactttattaaataatttatcctgtgttgaacagaggagacaacacatgataaattataacctggcggcagcgcaaaagatg

SEQ ID NO: 51865 - DNA, 103 bp, Artificial Sequence
  Synthetic Polynucleotide
taatacgactcactatagggtatatacactttattaaataatttatcctgaacagaggagacaggatatgttatttaataacctggcggcagcgcaaaagatg

SEQ ID NO: 51866 - DNA, 103 bp, Artificial Sequence
  Synthetic Polynucleotide
taatacgactcactatagggtaacctatatacactttattaaataatttaaacagaggagataaattatgtaataaagtaacctggcggcagcgcaaaagatg

SEQ ID NO: 51867 - DNA, 103 bp, Artificial Sequence
  Synthetic Polynucleotide
taatacgactcactatagggtgcaataacctatatacactttattaaataaacagaggagatatttaatgaagtgtataaacctggcggcagcgcaaaagatg

SEQ ID NO: 51868 - DNA, 103 bp, Artificial Sequence
  Synthetic Polynucleotide
taatacgactcactatagggcgacatgcaataacctatatacactttattaacagaggagaaataaaatgtatataggtaacctggcggcagcgcaaaagatg

SEQ ID NO: 51869 - DNA, 103 bp, Artificial Sequence
  Synthetic Polynucleotide
taatacgactcactatagggaaacacgacatgcaataacctatatacactaacagaggagaagtgtaatgaggttattgaacctggcggcagcgcaaaagatg

SEQ ID NO: 51870 - DNA, 103 bp, Artificial Sequence
  Synthetic Polynucleotide
taatacgactcactatagggagatataaatgcgatgtcatttgacagtttaacagaggagaaaactgatgaatgacatcaacctggcggcagcgcaaaagatg

SEQ ID NO: 51871 - DNA, 103 bp, Artificial Sequence
  Synthetic Polynucleotide
taatacgactcactatagggtaataaaacacgacatgcaataacctatataacagaggagaatatagatgattgcatgtaacctggcggcagcgcaaaagatg

SEQ ID NO: 51872 - DNA, 103 bp, Artificial Sequence
  Synthetic Polynucleotide
taatacgactcactatagggttgattaataaaacacgacatgcaataaccaacagaggagaggttatatgatgtcgtgtaacctggcggcagcgcaaaagatg

SEQ ID NO: 51873 - DNA, 103 bp, Artificial Sequence
  Synthetic Polynucleotide
taatacgactcactatagggaatgattgattaataaaacacgacatgcaaaacagaggagattgcatatggtgttttataacctggcggcagcgcaaaagatg

SEQ ID NO: 51874 - DNA, 103 bp, Artificial Sequence
  Synthetic Polynucleotide
taatacgactcactatagggcctctaatgattgattaataaaacacgacaaacagaggagatgtcgtatgttattaatcaacctggcggcagcgcaaaagatg

SEQ ID NO: 51875 - DNA, 103 bp, Artificial Sequence
  Synthetic Polynucleotide
taatacgactcactatagggtaaatcctctaatgattgattaataaaacaaacagaggagatgttttatgaatcaatcaaacctggcggcagcgcaaaagatg

SEQ ID NO: 51876 - DNA, 103 bp, Artificial Sequence
  Synthetic Polynucleotide
taatacgactcactatagggtgtgataaatcctctaatgattgattaataaacagaggagatattaaatgatcattagaaacctggcggcagcgcaaaagatg

SEQ ID NO: 51877 - DNA, 103 bp, Artificial Sequence
  Synthetic Polynucleotide
taatacgactcactatagggtagtatgtgataaatcctctaatgattgataacagaggagaatcaatatgtagaggattaacctggcggcagcgcaaaagatg

SEQ ID NO: 51878 - DNA, 103 bp, Artificial Sequence
  Synthetic Polynucleotide
taatacgactcactatagggaatactagtatgtgataaatcctctaatgaaacagaggagatcattaatggatttatcaaacctggcggcagcgcaaaagatg

SEQ ID NO: 51879 - DNA, 103 bp, Artificial Sequence
  Synthetic Polynucleotide
taatacgactcactatagggttgtaaatactagtatgtgataaatcctctaacagaggagaagaggaatgatcacatacaacctggcggcagcgcaaaagatg

SEQ ID NO: 51880 - DNA, 103 bp, Artificial Sequence
  Synthetic Polynucleotide
taatacgactcactatagggctacattgtaaatactagtatgtgataaataacagaggagaatttatatgatactagtaaacctggcggcagcgcaaaagatg

SEQ ID NO: 51881 - DNA, 103 bp, Artificial Sequence
  Synthetic Polynucleotide
taatacgactcactataggggctaaagatataaatgcgatgtcatttgacaacagaggagagtcaaaatgcatcgcattaacctggcggcagcgcaaaagatg

SEQ ID NO: 51882 - DNA, 103 bp, Artificial Sequence
  Synthetic Polynucleotide
taatacgactcactatagggaatttctacattgtaaatactagtatgtgaaacagaggagatcacatatgagtatttacaacctggcggcagcgcaaaagatg

SEQ ID NO: 51883 - DNA, 103 bp, Artificial Sequence
  Synthetic Polynucleotide
taatacgactcactatagggtttctaatttctacattgtaaatactagtaaacagaggagatactagatgttacaatgtaacctggcggcagcgcaaaagatg

SEQ ID NO: 51884 - DNA, 103 bp, Artificial Sequence
  Synthetic Polynucleotide
taatacgactcactatagggtaatctttctaatttctacattgtaaatacaacagaggagagtatttatgatgtagaaaaacctggcggcagcgcaaaagatg

SEQ ID NO: 51885 - DNA, 103 bp, Artificial Sequence
  Synthetic Polynucleotide
taatacgactcactatagggtgatttaatctttctaatttctacattgtaaacagaggagatacaatatggaaattagaaacctggcggcagcgcaaaagatg

SEQ ID NO: 51886 - DNA, 103 bp, Artificial Sequence
  Synthetic Polynucleotide
taatacgactcactatagggtttaatgatttaatctttctaatttctacaaacagaggagatgtagaatgtagaaagataacctggcggcagcgcaaaagatg

SEQ ID NO: 51887 - DNA, 103 bp, Artificial Sequence
  Synthetic Polynucleotide
taatacgactcactatagggaatcatttaatgatttaatctttctaatttaacagaggagaaaattaatgagattaaataacctggcggcagcgcaaaagatg

SEQ ID NO: 51888 - DNA, 103 bp, Artificial Sequence
  Synthetic Polynucleotide
taatacgactcactatagggaatacaatcatttaatgatttaatctttctaacagaggagaagaaagatgaaatcattaaacctggcggcagcgcaaaagatg

SEQ ID NO: 51889 - DNA, 103 bp, Artificial Sequence
  Synthetic Polynucleotide
taatacgactcactatagggtcgttaatacaatcatttaatgatttaatcaacagaggagagattaaatgattaaatgaaacctggcggcagcgcaaaagatg

SEQ ID NO: 51890 - DNA, 103 bp, Artificial Sequence
  Synthetic Polynucleotide
taatacgactcactatagggtatcatcgttaatacaatcatttaatgattaacagaggagaaatcatatgatgattgtaaacctggcggcagcgcaaaagatg

SEQ ID NO: 51891 - DNA, 103 bp, Artificial Sequence
  Synthetic Polynucleotide
taatacgactcactataggggtatttatcatcgttaatacaatcatttaaaacagaggagattaaatatgtgtattaacaacctggcggcagcgcaaaagatg

SEQ ID NO: 51892 - DNA, 103 bp, Artificial Sequence
  Synthetic Polynucleotide
taatacgactcactatagggatttagctaaagatataaatgcgatgtcataacagaggagaatgacaatgcatttatataacctggcggcagcgcaaaagatg

SEQ ID NO: 51893 - DNA, 103 bp, Artificial Sequence
  Synthetic Polynucleotide
taatacgactcactatagggtattcgtatttatcatcgttaatacaatcaaacagaggagatgattgatgtaacgatgaaacctggcggcagcgcaaaagatg

SEQ ID NO: 51894 - DNA, 103 bp, Artificial Sequence
  Synthetic Polynucleotide
taatacgactcactatagggacagatattcgtatttatcatcgttaatacaacagaggagagtattaatgatgataaataacctggcggcagcgcaaaagatg

SEQ ID NO: 51895 - DNA, 103 bp, Artificial Sequence
  Synthetic Polynucleotide
taatacgactcactatagggataagacagatattcgtatttatcatcgttaacagaggagaaacgatatgaaatacgaaaacctggcggcagcgcaaaagatg

SEQ ID NO: 51896 - DNA, 103 bp, Artificial Sequence
  Synthetic Polynucleotide
taatacgactcactatagggtaaatataagacagatattcgtatttatcaaacagaggagatgataaatgcgaatatctaacctggcggcagcgcaaaagatg

SEQ ID NO: 51897 - DNA, 103 bp, Artificial Sequence
  Synthetic Polynucleotide
taatacgactcactatagggtattataaatataagacagatattcgtattaacagaggagaaatacgatgatctgtcttaacctggcggcagcgcaaaagatg

SEQ ID NO: 51898 - DNA, 103 bp, Artificial Sequence
  Synthetic Polynucleotide
taatacgactcactatagggtagcatattataaatataagacagatattcaacagaggagagaatatatgtcttatattaacctggcggcagcgcaaaagatg

SEQ ID NO: 51899 - DNA, 103 bp, Artificial Sequence
  Synthetic Polynucleotide
taatacgactcactatagggttaactagcatattataaatataagacagaaacagaggagatctgtcatgtatttataaaacctggcggcagcgcaaaagatg

SEQ ID NO: 51900 - DNA, 103 bp, Artificial Sequence
  Synthetic Polynucleotide
taatacgactcactatagggtactattaactagcatattataaatataagaacagaggagacttataatgataatatgcaacctggcggcagcgcaaaagatg

SEQ ID NO: 51901 - DNA, 103 bp, Artificial Sequence
  Synthetic Polynucleotide
taatacgactcactatagggtcatttactattaactagcatattataaataacagaggagaatttatatgatgctagttaacctggcggcagcgcaaaagatg

SEQ ID NO: 51902 - DNA, 103 bp, Artificial Sequence
  Synthetic Polynucleotide
taatacgactcactatagggaaagttcatttactattaactagcatattaaacagaggagataatatatgagttaatagaacctggcggcagcgcaaaagatg

SEQ ID NO: 51903 - DNA, 103 bp, Artificial Sequence
  Synthetic Polynucleotide
taatacgactcactatagggggagttagtttagttaataatatacaagataacagaggagaatcttgatgattattaacaacctggcggcagcgcaaaagatg

SEQ ID NO: 51904 - DNA, 103 bp, Artificial Sequence
  Synthetic Polynucleotide
taatacgactcactatagggatacgatttagctaaagatataaatgcgataacagaggagaatcgcaatgatatctttaaacctggcggcagcgcaaaagatg

SEQ ID NO: 51905 - DNA, 103 bp, Artificial Sequence
  Synthetic Polynucleotide
taatacgactcactatagggctgtaaaagttcatttactattaactagcaaacagaggagatgctagatgatagtaaataacctggcggcagcgcaaaagatg

SEQ ID NO: 51906 - DNA, 103 bp, Artificial Sequence
  Synthetic Polynucleotide
taatacgactcactatagggtagatctgtaaaagttcatttactattaacaacagaggagagttaatatgaaatgaactaacctggcggcagcgcaaaagatg

SEQ ID NO: 51907 - DNA, 103 bp, Artificial Sequence
  Synthetic Polynucleotide
taatacgactcactatagggtatactagatctgtaaaagttcatttactaaacagaggagatagtaaatgaacttttacaacctggcggcagcgcaaaagatg

SEQ ID NO: 51908 - DNA, 103 bp, Artificial Sequence
  Synthetic Polynucleotide
taatacgactcactatagggctaattatactagatctgtaaaagttcattaacagaggagaaatgaaatgttacagatcaacctggcggcagcgcaaaagatg

SEQ ID NO: 51909 - DNA, 103 bp, Artificial Sequence
  Synthetic Polynucleotide
taatacgactcactatagggtctgactaattatactagatctgtaaaagtaacagaggagaacttttatggatctagtaaacctggcggcagcgcaaaagatg

SEQ ID NO: 51910 - DNA, 103 bp, Artificial Sequence
  Synthetic Polynucleotide
taatacgactcactatagggaataatctgactaattatactagatctgtaaacagaggagatacagaatgagtataattaacctggcggcagcgcaaaagatg

SEQ ID NO: 51911 - DNA, 103 bp, Artificial Sequence
  Synthetic Polynucleotide
taatacgactcactatagggtacttaataatctgactaattatactagataacagaggagaatctagatgaattagtcaaacctggcggcagcgcaaaagatg

SEQ ID NO: 51912 - DNA, 103 bp, Artificial Sequence
  Synthetic Polynucleotide
taatacgactcactatagggtattatacttaataatctgactaattatacaacagaggagagtataaatggtcagattaaacctggcggcagcgcaaaagatg

SEQ ID NO: 51913 - DNA, 103 bp, Artificial Sequence
  Synthetic Polynucleotide
taatacgactcactatagggtcgtctattatacttaataatctgactaataacagaggagaattagtatgattattaagaacctggcggcagcgcaaaagatg

SEQ ID NO: 51914 - DNA, 103 bp, Artificial Sequence
  Synthetic Polynucleotide
taatacgactcactataggggctagtcgtctattatacttaataatctgaaacagaggagatcagatatgtaagtataaaacctggcggcagcgcaaaagatg

SEQ ID NO: 51915 - DNA, 103 bp, Artificial Sequence
  Synthetic Polynucleotide
taatacgactcactatagggaacatatacgatttagctaaagatataaataacagaggagaatttatatgtttagctaaaacctggcggcagcgcaaaagatg

SEQ ID NO: 51916 - DNA, 103 bp, Artificial Sequence
  Synthetic Polynucleotide
taatacgactcactatagggacttagctagtcgtctattatacttaataaaacagaggagattattaatgataatagacaacctggcggcagcgcaaaagatg

SEQ ID NO: 51917 - DNA, 103 bp, Artificial Sequence
  Synthetic Polynucleotide
taatacgactcactatagggaatagacttagctagtcgtctattatacttaacagaggagaaagtatatgagacgactaaacctggcggcagcgcaaaagatg

SEQ ID NO: 51918 - DNA, 103 bp, Artificial Sequence
  Synthetic Polynucleotide
taatacgactcactatagggcaaataatagacttagctagtcgtctattaaacagaggagataatagatgactagctaaaacctggcggcagcgcaaaagatg

SEQ ID NO: 51919 - DNA, 103 bp, Artificial Sequence
  Synthetic Polynucleotide
taatacgactcactatagggcctcgcaaataatagacttagctagtcgtcaacagaggagagacgacatgctaagtctaaacctggcggcagcgcaaaagatg

SEQ ID NO: 51920 - DNA, 103 bp, Artificial Sequence
  Synthetic Polynucleotide
taatacgactcactataggggtcatcctcgcaaataatagacttagctagaacagaggagactagctatgtctattattaacctggcggcagcgcaaaagatg

SEQ ID NO: 51921 - DNA, 103 bp, Artificial Sequence
  Synthetic Polynucleotide
taatacgactcactatagggtgagagtcatcctcgcaaataatagacttaaacagaggagataagtcatgtatttgcgaaacctggcggcagcgcaaaagatg

SEQ ID NO: 51922 - DNA, 103 bp, Artificial Sequence
  Synthetic Polynucleotide
taatacgactcactatagggtaatttgagagtcatcctcgcaaataatagaacagaggagactattaatggcgaggatgaacctggcggcagcgcaaaagatg

SEQ ID NO: 51923 - DNA, 103 bp, Artificial Sequence
  Synthetic Polynucleotide
taatacgactcactatagggtgtaataatttgagagtcatcctcgcaaataacagaggagaatttgcatggatgactctaacctggcggcagcgcaaaagatg

SEQ ID NO: 51924 - DNA, 103 bp, Artificial Sequence
  Synthetic Polynucleotide
taatacgactcactataggggtaagtgtaataatttgagagtcatcctcgaacagaggagacgaggaatgctctcaaataacctggcggcagcgcaaaagatg

SEQ ID NO: 51925 - DNA, 103 bp, Artificial Sequence
  Synthetic Polynucleotide
taatacgactcactatagggatgccgtaagtgtaataatttgagagtcataacagaggagaatgactatgaaattattaaacctggcggcagcgcaaaagatg

SEQ ID NO: 51926 - DNA, 103 bp, Artificial Sequence
  Synthetic Polynucleotide
taatacgactcactatagggatggtaacatatacgatttagctaaagataaacagaggagatatcttatgctaaatcgtaacctggcggcagcgcaaaagatg

SEQ ID NO: 51927 - DNA, 103 bp, Artificial Sequence
  Synthetic Polynucleotide
taatacgactcactatagggaacgaatgccgtaagtgtaataatttgagaaacagaggagatctcaaatgattacacttaacctggcggcagcgcaaaagatg

SEQ ID NO: 51928 - DNA, 103 bp, Artificial Sequence
  Synthetic Polynucleotide
taatacgactcactatagggtggttaacgaatgccgtaagtgtaataattaacagaggagaaattatatgacttacggcaacctggcggcagcgcaaaagatg

SEQ ID NO: 51929 - DNA, 103 bp, Artificial Sequence
  Synthetic Polynucleotide
taatacgactcactatagggggcattggttaacgaatgccgtaagtgtaaaacagaggagattacacatgcggcattcgaacctggcggcagcgcaaaagatg

SEQ ID NO: 51930 - DNA, 103 bp, Artificial Sequence
  Synthetic Polynucleotide
taatacgactcactatagggccataggcattggttaacgaatgccgtaagaacagaggagacttacgatgttcgttaacaacctggcggcagcgcaaaagatg

SEQ ID NO: 51931 - DNA, 103 bp, Artificial Sequence
  Synthetic Polynucleotide
taatacgactcactatagggtgacaccataggcattggttaacgaatgccaacagaggagaggcattatgtaaccaatgaacctggcggcagcgcaaaagatg

SEQ ID NO: 51932 - DNA, 103 bp, Artificial Sequence
  Synthetic Polynucleotide
taatacgactcactataggggtttatgacaccataggcattggttaacgaaacagaggagatcgttaatgaatgcctataacctggcggcagcgcaaaagatg

SEQ ID NO: 51933 - DNA, 103 bp, Artificial Sequence
  Synthetic Polynucleotide
taatacgactcactatagggtactcgtttatgacaccataggcattggttaacagaggagaaaccaaatgctatggtgtaacctggcggcagcgcaaaagatg

SEQ ID NO: 51934 - DNA, 103 bp, Artificial Sequence
  Synthetic Polynucleotide
taatacgactcactatagggacggatactcgtttatgacaccataggcataacagaggagaatgcctatggtgtcataaaacctggcggcagcgcaaaagatg

SEQ ID NO: 51935 - DNA, 103 bp, Artificial Sequence
  Synthetic Polynucleotide
taatacgactcactatagggcggacacggatactcgtttatgacaccataaacagaggagatatggtatgataaacgagaacctggcggcagcgcaaaagatg

SEQ ID NO: 51936 - DNA, 103 bp, Artificial Sequence
  Synthetic Polynucleotide
taatacgactcactatagggaatagcggacacggatactcgtttatgacaaacagaggagatgtcatatgcgagtatccaacctggcggcagcgcaaaagatg

SEQ ID NO: 51937 - DNA, 103 bp, Artificial Sequence
  Synthetic Polynucleotide
taatacgactcactatagggttacgatggtaacatatacgatttagctaaaacagaggagattagctatgtcgtatatgaacctggcggcagcgcaaaagatg

SEQ ID NO: 51938 - DNA, 103 bp, Artificial Sequence
  Synthetic Polynucleotide
taatacgactcactatagggaataaaatagcggacacggatactcgtttaaacagaggagataaacgatgatccgtgtcaacctggcggcagcgcaaaagatg

SEQ ID NO: 51939 - DNA, 103 bp, Artificial Sequence
  Synthetic Polynucleotide
taatacgactcactatagggtagttaataaaatagcggacacggatactcaacagaggagagagtatatgtgtccgctaaacctggcggcagcgcaaaagatg

SEQ ID NO: 51940 - DNA, 103 bp, Artificial Sequence
  Synthetic Polynucleotide
taatacgactcactatagggatccgtagttaataaaatagcggacacggaaacagaggagatccgtgatggctattttaaacctggcggcagcgcaaaagatg

SEQ ID NO: 51941 - DNA, 103 bp, Artificial Sequence
  Synthetic Polynucleotide
taatacgactcactatagggttgttatccgtagttaataaaatagcggacaacagaggagagtccgcatgtttattaacaacctggcggcagcgcaaaagatg

SEQ ID NO: 51942 - DNA, 103 bp, Artificial Sequence
  Synthetic Polynucleotide
taatacgactcactatagggatattttgttatccgtagttaataaaatagaacagaggagactatttatgtaactacggaacctggcggcagcgcaaaagatg

SEQ ID NO: 51943 - DNA, 103 bp, Artificial Sequence
  Synthetic Polynucleotide
taatacgactcactatagggtactaatattttgttatccgtagttaataaaacagaggagattattaatgacggataacaacctggcggcagcgcaaaagatg

SEQ ID NO: 51944 - DNA, 103 bp, Artificial Sequence
  Synthetic Polynucleotide
taatacgactcactatagggttacatactaatattttgttatccgtagttaacagaggagaaactacatgtaacaaaataacctggcggcagcgcaaaagatg

SEQ ID NO: 51945 - DNA, 103 bp, Artificial Sequence
  Synthetic Polynucleotide
taatacgactcactataggggtctgttacatactaatattttgttatccgaacagaggagacggataatgaaatattagaacctggcggcagcgcaaaagatg

SEQ ID NO: 51946 - DNA, 103 bp, Artificial Sequence
  Synthetic Polynucleotide
taatacgactcactatagggatctcgtctgttacatactaatattttgttaacagaggagaaacaaaatgttagtatgtaacctggcggcagcgcaaaagatg

SEQ ID NO: 51947 - DNA, 103 bp, Artificial Sequence
  Synthetic Polynucleotide
taatacgactcactatagggaaactatctcgtctgttacatactaatattaacagaggagaaatattatgatgtaacagaacctggcggcagcgcaaaagatg

SEQ ID NO: 51948 - DNA, 103 bp, Artificial Sequence
  Synthetic Polynucleotide
taatacgactcactatagggagatattacgatggtaacatatacgatttaaacagaggagataaatcatgtatgttaccaacctggcggcagcgcaaaagatg

SEQ ID NO: 51949 - DNA, 103 bp, Artificial Sequence
  Synthetic Polynucleotide
taatacgactcactatagggagagaaaactatctcgtctgttacatactaaacagaggagatagtatatgacagacgagaacctggcggcagcgcaaaagatg

SEQ ID NO: 51950 - DNA, 103 bp, Artificial Sequence
  Synthetic Polynucleotide
taatacgactcactatagggagaatagagaaaactatctcgtctgttacaaacagaggagatgtaacatgcgagatagtaacctggcggcagcgcaaaagatg

SEQ ID NO: 51951 - DNA, 103 bp, Artificial Sequence
  Synthetic Polynucleotide
taatacgactcactatagggatttcagaatagagaaaactatctcgtctgaacagaggagacagacgatgtagttttctaacctggcggcagcgcaaaagatg

SEQ ID NO: 51952 - DNA, 103 bp, Artificial Sequence
  Synthetic Polynucleotide
taatacgactcactatagggtaattatttcagaatagagaaaactatctcaacagaggagagagataatgttctctattaacctggcggcagcgcaaaagatg

SEQ ID NO: 51953 - DNA, 103 bp, Artificial Sequence
  Synthetic Polynucleotide
taatacgactcactatagggagttctaattatttcagaatagagaaaactaacagaggagaagttttatgtattctgaaaacctggcggcagcgcaaaagatg

SEQ ID NO: 51954 - DNA, 103 bp, Artificial Sequence
  Synthetic Polynucleotide
taatacgactcactatagggtttctagttctaattatttcagaatagagaaacagaggagatctctaatgtgaaataataacctggcggcagcgcaaaagatg

SEQ ID NO: 51955 - DNA, 103 bp, Artificial Sequence
  Synthetic Polynucleotide
taatacgactcactatagggacatgtttctagttctaattatttcagaataacagaggagaattctgatgtaattagaaaacctggcggcagcgcaaaagatg

SEQ ID NO: 51956 - DNA, 103 bp, Artificial Sequence
  Synthetic Polynucleotide
taatacgactcactatagggtctagacatgtttctagttctaattatttcaacagaggagagaaataatgagaactagaaacctggcggcagcgcaaaagatg

SEQ ID NO: 51957 - DNA, 103 bp, Artificial Sequence
  Synthetic Polynucleotide
taatacgactcactatagggttctttctagacatgtttctagttctaattaacagaggagaaattagatgtagaaacataacctggcggcagcgcaaaagatg

SEQ ID NO: 51958 - DNA, 103 bp, Artificial Sequence
  Synthetic Polynucleotide
taatacgactcactatagggatcgtttctttctagacatgtttctagttcaacagaggagagaactaatgacatgtctaaacctggcggcagcgcaaaagatg

SEQ ID NO: 51959 - DNA, 103 bp, Artificial Sequence
  Synthetic Polynucleotide
taatacgactcactatagggcggttagatattacgatggtaacatatacgaacagaggagacgtataatgtaccatcgtaacctggcggcagcgcaaaagatg

SEQ ID NO: 51960 - DNA, 103 bp, Artificial Sequence
  Synthetic Polynucleotide
taatacgactcactatagggaaataatcgtttctttctagacatgtttctaacagaggagaagaaacatgtctagaaagaacctggcggcagcgcaaaagatg

SEQ ID NO: 51961 - DNA, 103 bp, Artificial Sequence
  Synthetic Polynucleotide
taatacgactcactatagggtttagaaataatcgtttctttctagacatgaacagaggagacatgtcatgaaagaaacgaacctggcggcagcgcaaaagatg

SEQ ID NO: 51962 - DNA, 103 bp, Artificial Sequence
  Synthetic Polynucleotide
taatacgactcactatagggaataatttagaaataatcgtttctttctagaacagaggagactagaaatgaacgattataacctggcggcagcgcaaaagatg

SEQ ID NO: 51963 - DNA, 103 bp, Artificial Sequence
  Synthetic Polynucleotide
taatacgactcactatagggattggaataatttagaaataatcgtttcttaacagaggagaaagaaaatgttatttctaaacctggcggcagcgcaaaagatg

SEQ ID NO: 51964 - DNA, 103 bp, Artificial Sequence
  Synthetic Polynucleotide
taatacgactcactatagggaaataattggaataatttagaaataatcgtaacagaggagaacgattatgtctaaattaaacctggcggcagcgcaaaagatg

SEQ ID NO: 51965 - DNA, 103 bp, Artificial Sequence
  Synthetic Polynucleotide
taatacgactcactatagggtgttcaaataattggaataatttagaaataaacagaggagatatttcatgattattccaaacctggcggcagcgcaaaagatg

SEQ ID NO: 51966 - DNA, 103 bp, Artificial Sequence
  Synthetic Polynucleotide
taatacgactcactatagggctgtttgttcaaataattggaataatttagaacagaggagactaaatatgtccaattataacctggcggcagcgcaaaagatg

SEQ ID NO: 51967 - DNA, 103 bp, Artificial Sequence
  Synthetic Polynucleotide
taatacgactcactatagggctttcctgtttgttcaaataattggaataaaacagaggagattattcatgttatttgaaaacctggcggcagcgcaaaagatg

SEQ ID NO: 51968 - DNA, 103 bp, Artificial Sequence
  Synthetic Polynucleotide
taatacgactcactatagggtacttctttcctgtttgttcaaataattggaacagaggagaccaattatgtgaacaaacaacctggcggcagcgcaaaagatg

SEQ ID NO: 51969 - DNA, 103 bp, Artificial Sequence
  Synthetic Polynucleotide
taatacgactcactatagggtagtatacttctttcctgtttgttcaaataaacagaggagatatttgatgaaacaggaaaacctggcggcagcgcaaaagatg

SEQ ID NO: 51970 - DNA, 103 bp, Artificial Sequence
  Synthetic Polynucleotide
taatacgactcactatagggagacgcggttagatattacgatggtaacataacagaggagaatgttaatgtcgtaatataacctggcggcagcgcaaaagatg

SEQ ID NO: 51971 - DNA, 103 bp, Artificial Sequence
  Synthetic Polynucleotide
taatacgactcactataggggacgatagtatacttctttcctgtttgttcaacagaggagagaacaaatgggaaagaagaacctggcggcagcgcaaaagatg

SEQ ID NO: 51972 - DNA, 103 bp, Artificial Sequence
  Synthetic Polynucleotide
taatacgactcactatagggaaaatgacgatagtatacttctttcctgttaacagaggagaaacaggatggaagtatacaacctggcggcagcgcaaaagatg

SEQ ID NO: 51973 - DNA, 103 bp, Artificial Sequence
  Synthetic Polynucleotide
taatacgactcactatagggagaaaaaaatgacgatagtatacttctttcaacagaggagagaaagaatgatactatcgaacctggcggcagcgcaaaagatg

SEQ ID NO: 51974 - DNA, 103 bp, Artificial Sequence
  Synthetic Polynucleotide
taatacgactcactatagggtctagagaaaaaaatgacgatagtatacttaacagaggagaaagtatatgatcgtcattaacctggcggcagcgcaaaagatg

SEQ ID NO: 51975 - DNA, 103 bp, Artificial Sequence
  Synthetic Polynucleotide
taatacgactcactatagggctggatctagagaaaaaaatgacgatagtaaacagaggagatactatatgcatttttttaacctggcggcagcgcaaaagatg

SEQ ID NO: 51976 - DNA, 103 bp, Artificial Sequence
  Synthetic Polynucleotide
taatacgactcactatagggcgtagctggatctagagaaaaaaatgacgaaacagaggagatcgtcaatgttttctctaaacctggcggcagcgcaaaagatg

SEQ ID NO: 51977 - DNA, 103 bp, Artificial Sequence
  Synthetic Polynucleotide
taatacgactcactatagggtcaatcgtagctggatctagagaaaaaaataacagaggagaatttttatgtctagatccaacctggcggcagcgcaaaagatg

SEQ ID NO: 51978 - DNA, 103 bp, Artificial Sequence
  Synthetic Polynucleotide
taatacgactcactatagggcattatcaatcgtagctggatctagagaaaaacagaggagatttctcatgatccagctaaacctggcggcagcgcaaaagatg

SEQ ID NO: 51979 - DNA, 103 bp, Artificial Sequence
  Synthetic Polynucleotide
taatacgactcactatagggtctatcattatcaatcgtagctggatctagaacagaggagactagatatggctacgattaacctggcggcagcgcaaaagatg

SEQ ID NO: 51980 - DNA, 103 bp, Artificial Sequence
  Synthetic Polynucleotide
taatacgactcactatagggtctattctatcattatcaatcgtagctggaaacagaggagatccagcatggattgataaaacctggcggcagcgcaaaagatg

SEQ ID NO: 51981 - DNA, 103 bp, Artificial Sequence
  Synthetic Polynucleotide
taatacgactcactatagggaagatagacgcggttagatattacgatggtaacagaggagaaccatcatgatatctaacaacctggcggcagcgcaaaagatg

SEQ ID NO: 51982 - DNA, 103 bp, Artificial Sequence
  Synthetic Polynucleotide
taatacgactcactatagggtagcgtctattctatcattatcaatcgtagaacagaggagactacgaatgataatgataaacctggcggcagcgcaaaagatg

SEQ ID NO: 51983 - DNA, 103 bp, Artificial Sequence
  Synthetic Polynucleotide
taatacgactcactatagggataaatagcgtctattctatcattatcaataacagaggagaattgatatggatagaataaacctggcggcagcgcaaaagatg

SEQ ID NO: 51984 - DNA, 103 bp, Artificial Sequence
  Synthetic Polynucleotide
taatacgactcactatagggcccggataaatagcgtctattctatcattaaacagaggagataatgaatgaatagacgcaacctggcggcagcgcaaaagatg

SEQ ID NO: 51985 - DNA, 103 bp, Artificial Sequence
  Synthetic Polynucleotide
taatacgactcactatagggtaccgcccggataaatagcgtctattctataacagaggagaatagaaatgacgctatttaacctggcggcagcgcaaaagatg

SEQ ID NO: 51986 - DNA, 103 bp, Artificial Sequence
  Synthetic Polynucleotide
taatacgactcactataggggagtataccgcccggataaatagcgtctataacagaggagaatagacatgatttatccgaacctggcggcagcgcaaaagatg

SEQ ID NO: 51987 - DNA, 103 bp, Artificial Sequence
  Synthetic Polynucleotide
taatacgactcactatagggcttttgagtataccgcccggataaatagcgaacagaggagacgctatatgtccgggcggaacctggcggcagcgcaaaagatg

SEQ ID NO: 51988 - DNA, 103 bp, Artificial Sequence
  Synthetic Polynucleotide
taatacgactcactatagggcaccccttttgagtataccgcccggataaaaacagaggagatttatcatggcggtatacaacctggcggcagcgcaaaagatg

SEQ ID NO: 51989 - DNA, 103 bp, Artificial Sequence
  Synthetic Polynucleotide
taatacgactcactataggggttctcaccccttttgagtataccgcccggaacagaggagaccgggcatgatactcaaaaacctggcggcagcgcaaaagatg

SEQ ID NO: 51990 - DNA, 103 bp, Artificial Sequence
  Synthetic Polynucleotide
taatacgactcactatagggggaacgttctcaccccttttgagtataccgaacagaggagacggtatatgcaaaaggggaacctggcggcagcgcaaaagatg

SEQ ID NO: 51991 - DNA, 103 bp, Artificial Sequence
  Synthetic Polynucleotide
taatacgactcactatagggactctggaacgttctcaccccttttgagtaaacagaggagatactcaatgggggtgagaaacctggcggcagcgcaaaagatg

SEQ ID NO: 51992 - DNA, 103 bp, Artificial Sequence
  Synthetic Polynucleotide
taatacgactcactatagggcgtttaagatagacgcggttagatattacgaacagaggagacgtaatatgtaaccgcgtaacctggcggcagcgcaaaagatg

SEQ ID NO: 51993 - DNA, 103 bp, Artificial Sequence
  Synthetic Polynucleotide
taatacgactcactatagggtagacactctggaacgttctcaccccttttaacagaggagaaaaaggatggagaacgttaacctggcggcagcgcaaaagatg

SEQ ID NO: 51994 - DNA, 103 bp, Artificial Sequence
  Synthetic Polynucleotide
taatacgactcactatagggctggatagacactctggaacgttctcacccaacagaggagagggtgaatgcgttccagaaacctggcggcagcgcaaaagatg

SEQ ID NO: 51995 - DNA, 103 bp, Artificial Sequence
  Synthetic Polynucleotide
taatacgactcactatagggtttccctggatagacactctggaacgttctaacagaggagaagaacgatgcagagtgtcaacctggcggcagcgcaaaagatg

SEQ ID NO: 51996 - DNA, 103 bp, Artificial Sequence
  Synthetic Polynucleotide
taatacgactcactatagggtttgatttccctggatagacactctggaacaacagaggagagttccaatgtgtctatccaacctggcggcagcgcaaaagatg

SEQ ID NO: 51997 - DNA, 103 bp, Artificial Sequence
  Synthetic Polynucleotide
taatacgactcactatagggtcttctttgatttccctggatagacactctaacagaggagaagagtgatgatccagggaaacctggcggcagcgcaaaagatg

SEQ ID NO: 51998 - DNA, 103 bp, Artificial Sequence
  Synthetic Polynucleotide
taatacgactcactatagggtaacttcttctttgatttccctggatagacaacagaggagagtctatatggggaaatcaaacctggcggcagcgcaaaagatg

SEQ ID NO: 51999 - DNA, 103 bp, Artificial Sequence
  Synthetic Polynucleotide
taatacgactcactatagggtatattaacttcttctttgatttccctggaaacagaggagatccaggatgatcaaagaaaacctggcggcagcgcaaaagatg

SEQ ID NO: 52000 - DNA, 103 bp, Artificial Sequence
  Synthetic Polynucleotide
taatacgactcactatagggttgtctatattaacttcttctttgatttccaacagaggagaggaaatatgagaagaagtaacctggcggcagcgcaaaagatg

SEQ ID NO: 52001 - DNA, 103 bp, Artificial Sequence
  Synthetic Polynucleotide
taatacgactcactatagggaagaattgtctatattaacttcttctttgaaacagaggagatcaaagatgaagttaataaacctggcggcagcgcaaaagatg

SEQ ID NO: 52002 - DNA, 103 bp, Artificial Sequence
  Synthetic Polynucleotide
taatacgactcactatagggtacaaaagaattgtctatattaacttcttcaacagaggagagaagaaatgaatatagacaacctggcggcagcgcaaaagatg

SEQ ID NO: 52003 - DNA, 103 bp, Artificial Sequence
  Synthetic Polynucleotide
taatacgactcactatagggggaaacgtttaagatagacgcggttagataaacagaggagatatctaatggcgtctatcaacctggcggcagcgcaaaagatg

SEQ ID NO: 52004 - DNA, 103 bp, Artificial Sequence
  Synthetic Polynucleotide
taatacgactcactatagggatgaatacaaaagaattgtctatattaactaacagaggagaagttaaatgagacaattcaacctggcggcagcgcaaaagatg

SEQ ID NO: 52005 - DNA, 103 bp, Artificial Sequence
  Synthetic Polynucleotide
taatacgactcactatagggtgtctatgaatacaaaagaattgtctatataacagaggagaatatagatgattcttttgaacctggcggcagcgcaaaagatg

SEQ ID NO: 52006 - DNA, 103 bp, Artificial Sequence
  Synthetic Polynucleotide
taatacgactcactatagggccgagtgtctatgaatacaaaagaattgtcaacagaggagagacaatatgtttgtattcaacctggcggcagcgcaaaagatg

SEQ ID NO: 52007 - DNA, 103 bp, Artificial Sequence
  Synthetic Polynucleotide
taatacgactcactatagggaaaaaccgagtgtctatgaatacaaaagaaaacagaggagattctttatgattcatagaaacctggcggcagcgcaaaagatg

SEQ ID NO: 52008 - DNA, 103 bp, Artificial Sequence
  Synthetic Polynucleotide
taatacgactcactataggggaataaaaaaccgagtgtctatgaatacaaaacagaggagattgtatatgtagacactcaacctggcggcagcgcaaaagatg

SEQ ID NO: 52009 - DNA, 103 bp, Artificial Sequence
  Synthetic Polynucleotide
taatacgactcactatagggaccatgaataaaaaaccgagtgtctatgaaaacagaggagattcataatgactcggtttaacctggcggcagcgcaaaagatg

SEQ ID NO: 52010 - DNA, 103 bp, Artificial Sequence
  Synthetic Polynucleotide
taatacgactcactatagggatgataccatgaataaaaaaccgagtgtctaacagaggagaagacacatggttttttataacctggcggcagcgcaaaagatg

SEQ ID NO: 52011 - DNA, 103 bp, Artificial Sequence
  Synthetic Polynucleotide
taatacgactcactatagggcttctatgataccatgaataaaaaaccgagaacagaggagactcggtatgttattcatgaacctggcggcagcgcaaaagatg

SEQ ID NO: 52012 - DNA, 103 bp, Artificial Sequence
  Synthetic Polynucleotide
taatacgactcactatagggggtatcttctatgataccatgaataaaaaaaacagaggagattttttatgcatggtatcaacctggcggcagcgcaaaagatg

SEQ ID NO: 52013 - DNA, 103 bp, Artificial Sequence
  Synthetic Polynucleotide
taatacgactcactatagggataatggtatcttctatgataccatgaataaacagaggagatattcaatgtatcatagaaacctggcggcagcgcaaaagatg

SEQ ID NO: 52014 - DNA, 103 bp, Artificial Sequence
  Synthetic Polynucleotide
taatacgactcactatagggaccaaggagttagtttagttaataatatacaacagaggagagtatatatgtaactaaacaacctggcggcagcgcaaaagatg

SEQ ID NO: 52015 - DNA, 103 bp, Artificial Sequence
  Synthetic Polynucleotide
taatacgactcactataggggcgatggaaacgtttaagatagacgcggttaacagaggagaaaccgcatgtatcttaaaaacctggcggcagcgcaaaagatg

SEQ ID NO: 52016 - DNA, 103 bp, Artificial Sequence
  Synthetic Polynucleotide
taatacgactcactatagggtgttaataatggtatcttctatgataccataacagaggagaatggtaatgtagaagataaacctggcggcagcgcaaaagatg

SEQ ID NO: 52017 - DNA, 103 bp, Artificial Sequence
  Synthetic Polynucleotide
taatacgactcactatagggaaatttgttaataatggtatcttctatgataacagaggagaatcataatggataccattaacctggcggcagcgcaaaagatg

SEQ ID NO: 52018 - DNA, 103 bp, Artificial Sequence
  Synthetic Polynucleotide
taatacgactcactatagggtcaaaaaatttgttaataatggtatcttctaacagaggagaagaagaatgcattattaaaacctggcggcagcgcaaaagatg

SEQ ID NO: 52019 - DNA, 103 bp, Artificial Sequence
  Synthetic Polynucleotide
taatacgactcactatagggttacttcaaaaaatttgttaataatggtataacagaggagaataccaatgttaacaaataacctggcggcagcgcaaaagatg

SEQ ID NO: 52020 - DNA, 103 bp, Artificial Sequence
  Synthetic Polynucleotide
taatacgactcactataggggaaaattacttcaaaaaatttgttaataataacagaggagaattattatgaaattttttaacctggcggcagcgcaaaagatg

SEQ ID NO: 52021 - DNA, 103 bp, Artificial Sequence
  Synthetic Polynucleotide
taatacgactcactatagggacaaagaaaattacttcaaaaaatttgttaaacagaggagataacaaatgttttgaagtaacctggcggcagcgcaaaagatg

SEQ ID NO: 52022 - DNA, 103 bp, Artificial Sequence
  Synthetic Polynucleotide
taatacgactcactatagggttccaacaaagaaaattacttcaaaaaattaacagaggagaaattttatgaagtaatttaacctggcggcagcgcaaaagatg

SEQ ID NO: 52023 - DNA, 103 bp, Artificial Sequence
  Synthetic Polynucleotide
taatacgactcactatagggtattcttccaacaaagaaaattacttcaaaaacagaggagatttgaaatgattttctttaacctggcggcagcgcaaaagatg

SEQ ID NO: 52024 - DNA, 103 bp, Artificial Sequence
  Synthetic Polynucleotide
taatacgactcactatagggagagatattcttccaacaaagaaaattactaacagaggagaagtaatatgctttgttggaacctggcggcagcgcaaaagatg

SEQ ID NO: 52025 - DNA, 103 bp, Artificial Sequence
  Synthetic Polynucleotide
taatacgactcactatagggtcgttagagatattcttccaacaaagaaaaaacagaggagattttctatgttggaagaaaacctggcggcagcgcaaaagatg

SEQ ID NO: 52026 - DNA, 103 bp, Artificial Sequence
  Synthetic Polynucleotide
taatacgactcactatagggttaaagcgatggaaacgtttaagatagacgaacagaggagacgtctaatgtaaacgtttaacctggcggcagcgcaaaagatg

SEQ ID NO: 52027 - DNA, 103 bp, Artificial Sequence
  Synthetic Polynucleotide
taatacgactcactatagggatcactcgttagagatattcttccaacaaaaacagaggagatttgttatgagaatatctaacctggcggcagcgcaaaagatg

SEQ ID NO: 52028 - DNA, 103 bp, Artificial Sequence
  Synthetic Polynucleotide
taatacgactcactatagggatttgatcactcgttagagatattcttccaaacagaggagatggaagatgatctctaacaacctggcggcagcgcaaaagatg

SEQ ID NO: 52029 - DNA, 103 bp, Artificial Sequence
  Synthetic Polynucleotide
taatacgactcactatagggcaataatttgatcactcgttagagatattcaacagaggagagaatatatgtaacgagtgaacctggcggcagcgcaaaagatg

SEQ ID NO: 52030 - DNA, 103 bp, Artificial Sequence
  Synthetic Polynucleotide
taatacgactcactatagggggtatcaataatttgatcactcgttagagaaacagaggagatctctaatgagtgatcaaaacctggcggcagcgcaaaagatg

SEQ ID NO: 52031 - DNA, 103 bp, Artificial Sequence
  Synthetic Polynucleotide
taatacgactcactatagggttaaaggtatcaataatttgatcactcgttaacagaggagaaacgagatgtcaaattataacctggcggcagcgcaaaagatg

SEQ ID NO: 52032 - DNA, 103 bp, Artificial Sequence
  Synthetic Polynucleotide
taatacgactcactatagggtacttttaaaggtatcaataatttgatcacaacagaggagagtgatcatgttattgataaacctggcggcagcgcaaaagatg

SEQ ID NO: 52033 - DNA, 103 bp, Artificial Sequence
  Synthetic Polynucleotide
taatacgactcactatagggatgattacttttaaaggtatcaataatttgaacagaggagacaaattatggatacctttaacctggcggcagcgcaaaagatg

SEQ ID NO: 52034 - DNA, 103 bp, Artificial Sequence
  Synthetic Polynucleotide
taatacgactcactatagggatttcatgattacttttaaaggtatcaataaacagaggagatattgaatgctttaaaagaacctggcggcagcgcaaaagatg

SEQ ID NO: 52035 - DNA, 103 bp, Artificial Sequence
  Synthetic Polynucleotide
taatacgactcactatagggccttaatttcatgattacttttaaaggtataacagaggagaatacctatgaaagtaatcaacctggcggcagcgcaaaagatg

SEQ ID NO: 52036 - DNA, 103 bp, Artificial Sequence
  Synthetic Polynucleotide
taatacgactcactatagggtagatccttaatttcatgattacttttaaaaacagaggagatttaaaatgaatcatgaaaacctggcggcagcgcaaaagatg

SEQ ID NO: 52037 - DNA, 103 bp, Artificial Sequence
  Synthetic Polynucleotide
taatacgactcactatagggcgtctttaaagcgatggaaacgtttaagataacagaggagaatcttaatggtttccatcaacctggcggcagcgcaaaagatg

SEQ ID NO: 52038 - DNA, 103 bp, Artificial Sequence
  Synthetic Polynucleotide
taatacgactcactatagggaatattagatccttaatttcatgattacttaacagaggagaaagtaaatgtgaaattaaaacctggcggcagcgcaaaagatg

SEQ ID NO: 52039 - DNA, 103 bp, Artificial Sequence
  Synthetic Polynucleotide
taatacgactcactatagggctaaaaatattagatccttaatttcatgataacagaggagaatcatgatgttaaggatcaacctggcggcagcgcaaaagatg

SEQ ID NO: 52040 - DNA, 103 bp, Artificial Sequence
  Synthetic Polynucleotide
taatacgactcactatagggcggatctaaaaatattagatccttaatttcaacagaggagagaaattatggatctaataaacctggcggcagcgcaaaagatg

SEQ ID NO: 52041 - DNA, 103 bp, Artificial Sequence
  Synthetic Polynucleotide
taatacgactcactataggggaattcggatctaaaaatattagatccttaaacagaggagataaggaatgaatatttttaacctggcggcagcgcaaaagatg

SEQ ID NO: 52042 - DNA, 103 bp, Artificial Sequence
  Synthetic Polynucleotide
taatacgactcactatagggtacctgaattcggatctaaaaatattagataacagaggagaatctaaatgttttagatcaacctggcggcagcgcaaaagatg

SEQ ID NO: 52043 - DNA, 103 bp, Artificial Sequence
  Synthetic Polynucleotide
taatacgactcactatagggtccattacctgaattcggatctaaaaatataacagaggagaatatttatggatccgaataacctggcggcagcgcaaaagatg

SEQ ID NO: 52044 - DNA, 103 bp, Artificial Sequence
  Synthetic Polynucleotide
taatacgactcactatagggtggagtccattacctgaattcggatctaaaaacagaggagatttagaatggaattcaggaacctggcggcagcgcaaaagatg

SEQ ID NO: 52045 - DNA, 103 bp, Artificial Sequence
  Synthetic Polynucleotide
taatacgactcactatagggcgtattggagtccattacctgaattcggataacagaggagaatccgaatgcaggtaatgaacctggcggcagcgcaaaagatg

SEQ ID NO: 52046 - DNA, 103 bp, Artificial Sequence
  Synthetic Polynucleotide
taatacgactcactatagggaatttcgtattggagtccattacctgaattaacagaggagaaattcaatgaatggactcaacctggcggcagcgcaaaagatg

SEQ ID NO: 52047 - DNA, 103 bp, Artificial Sequence
  Synthetic Polynucleotide
taatacgactcactatagggtttgcaatttcgtattggagtccattacctaacagaggagaaggtaaatgactccaataaacctggcggcagcgcaaaagatg

SEQ ID NO: 52048 - DNA, 103 bp, Artificial Sequence
  Synthetic Polynucleotide
taatacgactcactatagggggaaacgtctttaaagcgatggaaacgtttaacagaggagaaaacgtatgcatcgctttaacctggcggcagcgcaaaagatg

SEQ ID NO: 52049 - DNA, 103 bp, Artificial Sequence
  Synthetic Polynucleotide
taatacgactcactatagggcatattttgcaatttcgtattggagtccataacagaggagaatggacatgaatacgaaaaacctggcggcagcgcaaaagatg

SEQ ID NO: 52050 - DNA, 103 bp, Artificial Sequence
  Synthetic Polynucleotide
taatacgactcactatagggtagagcatattttgcaatttcgtattggagaacagaggagactccaaatggaaattgcaaacctggcggcagcgcaaaagatg

SEQ ID NO: 52051 - DNA, 103 bp, Artificial Sequence
  Synthetic Polynucleotide
taatacgactcactataggggtatctagagcatattttgcaatttcgtataacagaggagaatacgaatgtgcaaaataaacctggcggcagcgcaaaagatg

SEQ ID NO: 52052 - DNA, 103 bp, Artificial Sequence
  Synthetic Polynucleotide
taatacgactcactatagggttgcagtatctagagcatattttgcaatttaacagaggagaaaattgatgaatatgctcaacctggcggcagcgcaaaagatg

SEQ ID NO: 52053 - DNA, 103 bp, Artificial Sequence
  Synthetic Polynucleotide
taatacgactcactatagggaagttttgcagtatctagagcatattttgcaacagaggagagcaaaaatggctctagataacctggcggcagcgcaaaagatg

SEQ ID NO: 52054 - DNA, 103 bp, Artificial Sequence
  Synthetic Polynucleotide
taatacgactcactatagggcatttaagttttgcagtatctagagcatataacagaggagaatatgcatgagatactgcaacctggcggcagcgcaaaagatg

SEQ ID NO: 52055 - DNA, 103 bp, Artificial Sequence
  Synthetic Polynucleotide
taatacgactcactatagggcataacatttaagttttgcagtatctagagaacagaggagactctagatgctgcaaaacaacctggcggcagcgcaaaagatg

SEQ ID NO: 52056 - DNA, 103 bp, Artificial Sequence
  Synthetic Polynucleotide
taatacgactcactatagggatggccataacatttaagttttgcagtatcaacagaggagagatactatgaaacttaaaaacctggcggcagcgcaaaagatg

SEQ ID NO: 52057 - DNA, 103 bp, Artificial Sequence
  Synthetic Polynucleotide
taatacgactcactatagggcctctatggccataacatttaagttttgcaaacagaggagatgcaaaatgtaaatgttaaacctggcggcagcgcaaaagatg

SEQ ID NO: 52058 - DNA, 103 bp, Artificial Sequence
  Synthetic Polynucleotide
taatacgactcactatagggaacatcctctatggccataacatttaagttaacagaggagaaacttaatggttatggccaacctggcggcagcgcaaaagatg

SEQ ID NO: 52059 - DNA, 103 bp, Artificial Sequence
  Synthetic Polynucleotide
taatacgactcactatagggctatcggaaacgtctttaaagcgatggaaaaacagaggagatttccaatgctttaaagaaacctggcggcagcgcaaaagatg

SEQ ID NO: 52060 - DNA, 103 bp, Artificial Sequence
  Synthetic Polynucleotide
taatacgactcactatagggataataacatcctctatggccataacatttaacagaggagaaaatgtatgggccatagaaacctggcggcagcgcaaaagatg

SEQ ID NO: 52061 - DNA, 103 bp, Artificial Sequence
  Synthetic Polynucleotide
taatacgactcactataggggattcataataacatcctctatggccataaaacagaggagattatggatgtagaggatgaacctggcggcagcgcaaaagatg

SEQ ID NO: 52062 - DNA, 103 bp, Artificial Sequence
  Synthetic Polynucleotide
taatacgactcactatagggttaatgattcataataacatcctctatggcaacagaggagagccataatggatgttattaacctggcggcagcgcaaaagatg

SEQ ID NO: 52063 - DNA, 103 bp, Artificial Sequence
  Synthetic Polynucleotide
taatacgactcactatagggtttttttaatgattcataataacatcctctaacagaggagaagaggaatgtattatgaaaacctggcggcagcgcaaaagatg

SEQ ID NO: 52064 - DNA, 103 bp, Artificial Sequence
  Synthetic Polynucleotide
taatacgactcactataggggttaatttttttaatgattcataataacataacagaggagaatgttaatgtgaatcattaacctggcggcagcgcaaaagatg

SEQ ID NO: 52065 - DNA, 103 bp, Artificial Sequence
  Synthetic Polynucleotide
taatacgactcactatagggcctcagttaatttttttaatgattcataataacagaggagaattatgatgcattaaaaaaacctggcggcagcgcaaaagatg

SEQ ID NO: 52066 - DNA, 103 bp, Artificial Sequence
  Synthetic Polynucleotide
taatacgactcactatagggatcatcctcagttaatttttttaatgattcaacagaggagagaatcaatgaaaaaattaaacctggcggcagcgcaaaagatg

SEQ ID NO: 52067 - DNA, 103 bp, Artificial Sequence
  Synthetic Polynucleotide
taatacgactcactatagggaatcaatcatcctcagttaatttttttaataacagaggagaattaaaatgattaactgaaacctggcggcagcgcaaaagatg

SEQ ID NO: 52068 - DNA, 103 bp, Artificial Sequence
  Synthetic Polynucleotide
taatacgactcactatagggtttctaatcaatcatcctcagttaatttttaacagaggagaaaaaatatgctgaggatgaacctggcggcagcgcaaaagatg

SEQ ID NO: 52069 - DNA, 103 bp, Artificial Sequence
  Synthetic Polynucleotide
taatacgactcactatagggtatattttctaatcaatcatcctcagttaaaacagaggagattaactatggatgattgaaacctggcggcagcgcaaaagatg

SEQ ID NO: 52070 - DNA, 103 bp, Artificial Sequence
  Synthetic Polynucleotide
taatacgactcactatagggaccatctatcggaaacgtctttaaagcgataacagaggagaatcgctatgaagacgtttaacctggcggcagcgcaaaagatg

SEQ ID NO: 52071 - DNA, 103 bp, Artificial Sequence
  Synthetic Polynucleotide
taatacgactcactatagggtaatttatattttctaatcaatcatcctcaaacagaggagatgaggaatgttgattagaaacctggcggcagcgcaaaagatg

SEQ ID NO: 52072 - DNA, 103 bp, Artificial Sequence
  Synthetic Polynucleotide
taatacgactcactatagggtaaattaatttatattttctaatcaatcataacagaggagaatgattatgtagaaaataaacctggcggcagcgcaaaagatg

SEQ ID NO: 52073 - DNA, 103 bp, Artificial Sequence
  Synthetic Polynucleotide
taatacgactcactataggggatggtaaattaatttatattttctaatcaaacagaggagatgattaatgaatataaataacctggcggcagcgcaaaagatg

SEQ ID NO: 52074 - DNA, 103 bp, Artificial Sequence
  Synthetic Polynucleotide
taatacgactcactatagggtacacgatggtaaattaatttatattttctaacagaggagaagaaaaatgaaattaattaacctggcggcagcgcaaaagatg

SEQ ID NO: 52075 - DNA, 103 bp, Artificial Sequence
  Synthetic Polynucleotide
taatacgactcactatagggaaaaatacacgatggtaaattaatttatataacagaggagaatataaatgaatttaccaaacctggcggcagcgcaaaagatg

SEQ ID NO: 52076 - DNA, 103 bp, Artificial Sequence
  Synthetic Polynucleotide
taatacgactcactataggggttataaaaatacacgatggtaaattaattaacagaggagaaattaaatgaccatcgtgaacctggcggcagcgcaaaagatg

SEQ ID NO: 52077 - DNA, 103 bp, Artificial Sequence
  Synthetic Polynucleotide
taatacgactcactatagggatcccgttataaaaatacacgatggtaaataacagaggagaatttacatgcgtgtatttaacctggcggcagcgcaaaagatg

SEQ ID NO: 52078 - DNA, 103 bp, Artificial Sequence
  Synthetic Polynucleotide
taatacgactcactatagggggacaatcccgttataaaaatacacgatggaacagaggagaccatcgatgatttttataaacctggcggcagcgcaaaagatg

SEQ ID NO: 52079 - DNA, 103 bp, Artificial Sequence
  Synthetic Polynucleotide
taatacgactcactatagggatgccggacaatcccgttataaaaatacacaacagaggagagtgtatatgtataacgggaacctggcggcagcgcaaaagatg

SEQ ID NO: 52080 - DNA, 103 bp, Artificial Sequence
  Synthetic Polynucleotide
taatacgactcactatagggatgatatgccggacaatcccgttataaaaaaacagaggagatttttaatgcgggattgtaacctggcggcagcgcaaaagatg

SEQ ID NO: 52081 - DNA, 103 bp, Artificial Sequence
  Synthetic Polynucleotide
taatacgactcactatagggatgagaccatctatcggaaacgtctttaaaaacagaggagatttaaaatggtttccgataacctggcggcagcgcaaaagatg

SEQ ID NO: 52082 - DNA, 103 bp, Artificial Sequence
  Synthetic Polynucleotide
taatacgactcactatagggtctacatgatatgccggacaatcccgttataacagaggagaataacgatgttgtccggcaacctggcggcagcgcaaaagatg

SEQ ID NO: 52083 - DNA, 103 bp, Artificial Sequence
  Synthetic Polynucleotide
taatacgactcactatagggaactatctacatgatatgccggacaatcccaacagaggagagggattatgcggcatatcaacctggcggcagcgcaaaagatg

SEQ ID NO: 52084 - DNA, 103 bp, Artificial Sequence
  Synthetic Polynucleotide
taatacgactcactatagggatggtaactatctacatgatatgccggacaaacagaggagatgtccgatgtatcatgtaaacctggcggcagcgcaaaagatg

SEQ ID NO: 52085 - DNA, 103 bp, Artificial Sequence
  Synthetic Polynucleotide
taatacgactcactatagggtgtagatggtaactatctacatgatatgccaacagaggagaggcataatgtgtagatagaacctggcggcagcgcaaaagatg

SEQ ID NO: 52086 - DNA, 103 bp, Artificial Sequence
  Synthetic Polynucleotide
taatacgactcactatagggtacgatgtagatggtaactatctacatgataacagaggagaatcatgatgatagttaccaacctggcggcagcgcaaaagatg

SEQ ID NO: 52087 - DNA, 103 bp, Artificial Sequence
  Synthetic Polynucleotide
taatacgactcactataggggagtatacgatgtagatggtaactatctacaacagaggagagtagatatgtaccatctaaacctggcggcagcgcaaaagatg

SEQ ID NO: 52088 - DNA, 103 bp, Artificial Sequence
  Synthetic Polynucleotide
taatacgactcactatagggtggtcgagtatacgatgtagatggtaactaaacagaggagatagttaatgtctacatcgaacctggcggcagcgcaaaagatg

SEQ ID NO: 52089 - DNA, 103 bp, Artificial Sequence
  Synthetic Polynucleotide
taatacgactcactataggggtagatggtcgagtatacgatgtagatggtaacagaggagaaccatcatgatcgtatacaacctggcggcagcgcaaaagatg

SEQ ID NO: 52090 - DNA, 103 bp, Artificial Sequence
  Synthetic Polynucleotide
taatacgactcactatagggaaggcgtagatggtcgagtatacgatgtagaacagaggagactacatatgatactcgacaacctggcggcagcgcaaaagatg

SEQ ID NO: 52091 - DNA, 103 bp, Artificial Sequence
  Synthetic Polynucleotide
taatacgactcactatagggatttaaaggcgtagatggtcgagtatacgaaacagaggagatcgtatatgcgaccatctaacctggcggcagcgcaaaagatg

SEQ ID NO: 52092 - DNA, 103 bp, Artificial Sequence
  Synthetic Polynucleotide
taatacgactcactatagggatgaaatgagaccatctatcggaaacgtctaacagaggagaagacgtatgcgatagatgaacctggcggcagcgcaaaagatg

SEQ ID NO: 52093 - DNA, 103 bp, Artificial Sequence
  Synthetic Polynucleotide
taatacgactcactatagggagaggatttaaaggcgtagatggtcgagtaaacagaggagatactcgatgatctacgccaacctggcggcagcgcaaaagatg

SEQ ID NO: 52094 - DNA, 103 bp, Artificial Sequence
  Synthetic Polynucleotide
taatacgactcactatagggtaaatagaggatttaaaggcgtagatggtcaacagaggagagaccatatgcgcctttaaaacctggcggcagcgcaaaagatg

SEQ ID NO: 52095 - DNA, 103 bp, Artificial Sequence
  Synthetic Polynucleotide
taatacgactcactataggggtcaataaatagaggatttaaaggcgtagaaacagaggagatctacgatgttaaatcctaacctggcggcagcgcaaaagatg

SEQ ID NO: 52096 - DNA, 103 bp, Artificial Sequence
  Synthetic Polynucleotide
taatacgactcactatagggttaatgtcaataaatagaggatttaaaggcaacagaggagagcctttatgtcctctattaacctggcggcagcgcaaaagatg

SEQ ID NO: 52097 - DNA, 103 bp, Artificial Sequence
  Synthetic Polynucleotide
taatacgactcactatagggatagattaatgtcaataaatagaggatttaaacagaggagataaatcatgtatttattgaacctggcggcagcgcaaaagatg

SEQ ID NO: 52098 - DNA, 103 bp, Artificial Sequence
  Synthetic Polynucleotide
taatacgactcactatagggttctaatagattaatgtcaataaatagaggaacagaggagacctctaatgattgacattaacctggcggcagcgcaaaagatg

SEQ ID NO: 52099 - DNA, 103 bp, Artificial Sequence
  Synthetic Polynucleotide
taatacgactcactatagggtccaattctaatagattaatgtcaataaataacagaggagaatttatatgcattaatctaacctggcggcagcgcaaaagatg

SEQ ID NO: 52100 - DNA, 103 bp, Artificial Sequence
  Synthetic Polynucleotide
taatacgactcactatagggggtattccaattctaatagattaatgtcaaaacagaggagattgacaatgatctattagaacctggcggcagcgcaaaagatg

SEQ ID NO: 52101 - DNA, 103 bp, Artificial Sequence
  Synthetic Polynucleotide
taatacgactcactatagggtatttggtattccaattctaatagattaataacagaggagaattaatatgttagaattgaacctggcggcagcgcaaaagatg

SEQ ID NO: 52102 - DNA, 103 bp, Artificial Sequence
  Synthetic Polynucleotide
taatacgactcactatagggactaatatttggtattccaattctaatagaaacagaggagatctattatgattggaataaacctggcggcagcgcaaaagatg

SEQ ID NO: 52103 - DNA, 103 bp, Artificial Sequence
  Synthetic Polynucleotide
taatacgactcactataggggactgatgaaatgagaccatctatcggaaaaacagaggagatttccgatggatggtctcaacctggcggcagcgcaaaagatg

SEQ ID NO: 52104 - DNA, 103 bp, Artificial Sequence
  Synthetic Polynucleotide
taatacgactcactatagggagggtactaatatttggtattccaattctaaacagaggagatagaatatgaataccaaaaacctggcggcagcgcaaaagatg

SEQ ID NO: 52105 - DNA, 103 bp, Artificial Sequence
  Synthetic Polynucleotide
taatacgactcactatagggaattgagggtactaatatttggtattccaaaacagaggagattggaaatgcaaatattaaacctggcggcagcgcaaaagatg

SEQ ID NO: 52106 - DNA, 103 bp, Artificial Sequence
  Synthetic Polynucleotide
taatacgactcactatagggaaactaattgagggtactaatatttggtataacagaggagaataccaatgattagtaccaacctggcggcagcgcaaaagatg

SEQ ID NO: 52107 - DNA, 103 bp, Artificial Sequence
  Synthetic Polynucleotide
taatacgactcactatagggccaataaactaattgagggtactaatatttaacagaggagaaaatatatgtaccctcaaaacctggcggcagcgcaaaagatg

SEQ ID NO: 52108 - DNA, 103 bp, Artificial Sequence
  Synthetic Polynucleotide
taatacgactcactatagggtattaccaataaactaattgagggtactaaaacagaggagattagtaatgtcaattagtaacctggcggcagcgcaaaagatg

SEQ ID NO: 52109 - DNA, 103 bp, Artificial Sequence
  Synthetic Polynucleotide
taatacgactcactatagggaaaaatattaccaataaactaattgagggtaacagaggagaaccctcatgtagtttattaacctggcggcagcgcaaaagatg

SEQ ID NO: 52110 - DNA, 103 bp, Artificial Sequence
  Synthetic Polynucleotide
taatacgactcactatagggctaaaaaaaatattaccaataaactaattgaacagaggagacaattaatgtattggtaaaacctggcggcagcgcaaaagatg

SEQ ID NO: 52111 - DNA, 103 bp, Artificial Sequence
  Synthetic Polynucleotide
taatacgactcactatagggatcgtctaaaaaaaatattaccaataaactaacagaggagaagtttaatggtaatatttaacctggcggcagcgcaaaagatg

SEQ ID NO: 52112 - DNA, 103 bp, Artificial Sequence
  Synthetic Polynucleotide
taatacgactcactataggggatctatcgtctaaaaaaaatattaccaataacagaggagaattggtatgattttttttaacctggcggcagcgcaaaagatg

SEQ ID NO: 52113 - DNA, 103 bp, Artificial Sequence
  Synthetic Polynucleotide
taatacgactcactatagggccatcgatctatcgtctaaaaaaaatattaaacagaggagataatatatgttttagacgaacctggcggcagcgcaaaagatg

SEQ ID NO: 52114 - DNA, 103 bp, Artificial Sequence
  Synthetic Polynucleotide
taatacgactcactatagggagtatgactgatgaaatgagaccatctatcaacagaggagagatagaatgtctcatttcaacctggcggcagcgcaaaagatg

SEQ ID NO: 52115 - DNA, 103 bp, Artificial Sequence
  Synthetic Polynucleotide
taatacgactcactatagggaagagccatcgatctatcgtctaaaaaaaaaacagaggagattttttatggacgatagaaacctggcggcagcgcaaaagatg

SEQ ID NO: 52116 - DNA, 103 bp, Artificial Sequence
  Synthetic Polynucleotide
taatacgactcactataggggtttcaagagccatcgatctatcgtctaaaaacagaggagatttagaatgtagatcgataacctggcggcagcgcaaaagatg

SEQ ID NO: 52117 - DNA, 103 bp, Artificial Sequence
  Synthetic Polynucleotide
taatacgactcactatagggccttggtttcaagagccatcgatctatcgtaacagaggagaacgataatgcgatggctcaacctggcggcagcgcaaaagatg

SEQ ID NO: 52118 - DNA, 103 bp, Artificial Sequence
  Synthetic Polynucleotide
taatacgactcactataggggaaaaccttggtttcaagagccatcgatctaacagaggagaagatcgatggctcttgaaaacctggcggcagcgcaaaagatg

SEQ ID NO: 52119 - DNA, 103 bp, Artificial Sequence
  Synthetic Polynucleotide
taatacgactcactatagggggttggaaaaccttggtttcaagagccatcaacagaggagagatggcatgtgaaaccaaaacctggcggcagcgcaaaagatg

SEQ ID NO: 52120 - DNA, 103 bp, Artificial Sequence
  Synthetic Polynucleotide
taatacgactcactatagggagtccggttggaaaaccttggtttcaagagaacagaggagactcttgatgccaaggtttaacctggcggcagcgcaaaagatg

SEQ ID NO: 52121 - DNA, 103 bp, Artificial Sequence
  Synthetic Polynucleotide
taatacgactcactatagggtaacgagtccggttggaaaaccttggtttcaacagaggagagaaaccatggttttccaaaacctggcggcagcgcaaaagatg

SEQ ID NO: 52122 - DNA, 103 bp, Artificial Sequence
  Synthetic Polynucleotide
taatacgactcactatagggatcgataacgagtccggttggaaaaccttgaacagaggagacaaggtatgccaaccggaaacctggcggcagcgcaaaagatg

SEQ ID NO: 52123 - DNA, 103 bp, Artificial Sequence
  Synthetic Polynucleotide
taatacgactcactatagggcaccgatcgataacgagtccggttggaaaaaacagaggagattttccatgcggactcgtaacctggcggcagcgcaaaagatg

SEQ ID NO: 52124 - DNA, 103 bp, Artificial Sequence
  Synthetic Polynucleotide
taatacgactcactatagggcttttcaccgatcgataacgagtccggttgaacagaggagacaaccgatgtcgttatcgaacctggcggcagcgcaaaagatg

SEQ ID NO: 52125 - DNA, 103 bp, Artificial Sequence
  Synthetic Polynucleotide
taatacgactcactatagggttgaaaccaaggagttagtttagttaataaaacagaggagattattaatgaaactaactaacctggcggcagcgcaaaagatg

SEQ ID NO: 52126 - DNA, 103 bp, Artificial Sequence
  Synthetic Polynucleotide
taatacgactcactatagggggcttagtatgactgatgaaatgagaccataacagaggagaatggtcatgtttcatcagaacctggcggcagcgcaaaagatg

SEQ ID NO: 52127 - DNA, 103 bp, Artificial Sequence
  Synthetic Polynucleotide
taatacgactcactatagggaaagacttttcaccgatcgataacgagtccaacagaggagaggactcatgatcgatcggaacctggcggcagcgcaaaagatg

SEQ ID NO: 52128 - DNA, 103 bp, Artificial Sequence
  Synthetic Polynucleotide
taatacgactcactatagggatgaaaaagacttttcaccgatcgataacgaacagaggagacgttatatgtcggtgaaaaacctggcggcagcgcaaaagatg

SEQ ID NO: 52129 - DNA, 103 bp, Artificial Sequence
  Synthetic Polynucleotide
taatacgactcactatagggtgctaatgaaaaagacttttcaccgatcgaaacagaggagatcgatcatggaaaagtctaacctggcggcagcgcaaaagatg

SEQ ID NO: 52130 - DNA, 103 bp, Artificial Sequence
  Synthetic Polynucleotide
taatacgactcactatagggattcatgctaatgaaaaagacttttcaccgaacagaggagacggtgaatggtctttttcaacctggcggcagcgcaaaagatg

SEQ ID NO: 52131 - DNA, 103 bp, Artificial Sequence
  Synthetic Polynucleotide
taatacgactcactatagggaatggattcatgctaatgaaaaagacttttaacagaggagaaaaagtatgtttcattagaacctggcggcagcgcaaaagatg

SEQ ID NO: 52132 - DNA, 103 bp, Artificial Sequence
  Synthetic Polynucleotide
taatacgactcactatagggattagaatggattcatgctaatgaaaaagaaacagaggagatcttttatgttagcatgaaacctggcggcagcgcaaaagatg

SEQ ID NO: 52133 - DNA, 103 bp, Artificial Sequence
  Synthetic Polynucleotide
taatacgactcactatagggacatcattagaatggattcatgctaatgaaaacagaggagattcattatgatgaatccaaacctggcggcagcgcaaaagatg

SEQ ID NO: 52134 - DNA, 103 bp, Artificial Sequence
  Synthetic Polynucleotide
taatacgactcactatagggaacatacatcattagaatggattcatgctaaacagaggagatagcatatgtccattctaaacctggcggcagcgcaaaagatg

SEQ ID NO: 52135 - DNA, 103 bp, Artificial Sequence
  Synthetic Polynucleotide
taatacgactcactataggggtttaaacatacatcattagaatggattcaaacagaggagatgaatcatgtctaatgataacctggcggcagcgcaaaagatg

SEQ ID NO: 52136 - DNA, 103 bp, Artificial Sequence
  Synthetic Polynucleotide
taatacgactcactatagggagagtgtttaaacatacatcattagaatggaacagaggagaccattcatgtgatgtatgaacctggcggcagcgcaaaagatg

SEQ ID NO: 52137 - DNA, 103 bp, Artificial Sequence
  Synthetic Polynucleotide
taatacgactcactatagggttgttggcttagtatgactgatgaaatgagaacagaggagactcattatgtcagtcataaacctggcggcagcgcaaaagatg

SEQ ID NO: 52138 - DNA, 103 bp, Artificial Sequence
  Synthetic Polynucleotide
taatacgactcactatagggtgtttagagtgtttaaacatacatcattagaacagaggagactaatgatgtatgtttaaaacctggcggcagcgcaaaagatg

SEQ ID NO: 52139 - DNA, 103 bp, Artificial Sequence
  Synthetic Polynucleotide
taatacgactcactatagggccaattgtttagagtgtttaaacatacatcaacagaggagagatgtaatgttaaacactaacctggcggcagcgcaaaagatg

SEQ ID NO: 52140 - DNA, 103 bp, Artificial Sequence
  Synthetic Polynucleotide
taatacgactcactatagggtttgtccaattgtttagagtgtttaaacataacagaggagaatgtttatgcactctaaaaacctggcggcagcgcaaaagatg

SEQ ID NO: 52141 - DNA, 103 bp, Artificial Sequence
  Synthetic Polynucleotide
taatacgactcactatagggaagaatttgtccaattgtttagagtgtttaaacagaggagataaacaatgtaaacaattaacctggcggcagcgcaaaagatg

SEQ ID NO: 52142 - DNA, 103 bp, Artificial Sequence
  Synthetic Polynucleotide
taatacgactcactatagggatcaaaagaatttgtccaattgtttagagtaacagaggagaactctaatgaattggacaaacctggcggcagcgcaaaagatg

SEQ ID NO: 52143 - DNA, 103 bp, Artificial Sequence
  Synthetic Polynucleotide
taatacgactcactatagggagcaaatcaaaagaatttgtccaattgtttaacagaggagaaaacaaatggacaaattcaacctggcggcagcgcaaaagatg

SEQ ID NO: 52144 - DNA, 103 bp, Artificial Sequence
  Synthetic Polynucleotide
taatacgactcactatagggttcaaagcaaatcaaaagaatttgtccaataacagaggagaattggaatgattcttttgaacctggcggcagcgcaaaagatg

SEQ ID NO: 52145 - DNA, 103 bp, Artificial Sequence
  Synthetic Polynucleotide
taatacgactcactatagggaattattcaaagcaaatcaaaagaatttgtaacagaggagaacaaatatgtttgatttgaacctggcggcagcgcaaaagatg

SEQ ID NO: 52146 - DNA, 103 bp, Artificial Sequence
  Synthetic Polynucleotide
taatacgactcactatagggtttgaaattattcaaagcaaatcaaaagaaaacagaggagattctttatgtttgctttgaacctggcggcagcgcaaaagatg

SEQ ID NO: 52147 - DNA, 103 bp, Artificial Sequence
  Synthetic Polynucleotide
taatacgactcactatagggacctatttgaaattattcaaagcaaatcaaaacagaggagattgattatgtttgaataaaacctggcggcagcgcaaaagatg

SEQ ID NO: 52148 - DNA, 103 bp, Artificial Sequence
  Synthetic Polynucleotide
taatacgactcactatagggtatatttgttggcttagtatgactgatgaaaacagaggagattcatcatgcatactaagaacctggcggcagcgcaaaagatg

SEQ ID NO: 52149 - DNA, 103 bp, Artificial Sequence
  Synthetic Polynucleotide
taatacgactcactatagggcgaagacctatttgaaattattcaaagcaaaacagaggagattgcttatgataatttcaaacctggcggcagcgcaaaagatg

SEQ ID NO: 52150 - DNA, 103 bp, Artificial Sequence
  Synthetic Polynucleotide
taatacgactcactataggggtagacgaagacctatttgaaattattcaaaacagaggagattgaatatgttcaaatagaacctggcggcagcgcaaaagatg

SEQ ID NO: 52151 - DNA, 103 bp, Artificial Sequence
  Synthetic Polynucleotide
taatacgactcactatagggctactgtagacgaagacctatttgaaattaaacagaggagataatttatgataggtcttaacctggcggcagcgcaaaagatg

SEQ ID NO: 52152 - DNA, 103 bp, Artificial Sequence
  Synthetic Polynucleotide
taatacgactcactatagggtatgcctactgtagacgaagacctatttgaaacagaggagatcaaatatgtcttcgtctaacctggcggcagcgcaaaagatg

SEQ ID NO: 52153 - DNA, 103 bp, Artificial Sequence
  Synthetic Polynucleotide
taatacgactcactatagggaatggtatgcctactgtagacgaagacctaaacagaggagataggtcatggtctacagtaacctggcggcagcgcaaaagatg

SEQ ID NO: 52154 - DNA, 103 bp, Artificial Sequence
  Synthetic Polynucleotide
taatacgactcactatagggtatctaatggtatgcctactgtagacgaagaacagaggagacttcgtatgcagtaggcaaacctggcggcagcgcaaaagatg

SEQ ID NO: 52155 - DNA, 103 bp, Artificial Sequence
  Synthetic Polynucleotide
taatacgactcactatagggtagattatctaatggtatgcctactgtagaaacagaggagatctacaatgggcataccaaacctggcggcagcgcaaaagatg

SEQ ID NO: 52156 - DNA, 103 bp, Artificial Sequence
  Synthetic Polynucleotide
taatacgactcactatagggatggctagattatctaatggtatgcctactaacagaggagaagtaggatgaccattagaaacctggcggcagcgcaaaagatg

SEQ ID NO: 52157 - DNA, 103 bp, Artificial Sequence
  Synthetic Polynucleotide
taatacgactcactatagggttataatggctagattatctaatggtatgcaacagaggagagcatacatgtagataatcaacctggcggcagcgcaaaagatg

SEQ ID NO: 52158 - DNA, 103 bp, Artificial Sequence
  Synthetic Polynucleotide
taatacgactcactataggggcactttataatggctagattatctaatggaacagaggagaccattaatgaatctagccaacctggcggcagcgcaaaagatg

SEQ ID NO: 52159 - DNA, 103 bp, Artificial Sequence
  Synthetic Polynucleotide
taatacgactcactatagggacgattatatttgttggcttagtatgactgaacagaggagacagtcaatgtaagccaacaacctggcggcagcgcaaaagatg

SEQ ID NO: 52160 - DNA, 103 bp, Artificial Sequence
  Synthetic Polynucleotide
taatacgactcactatagggaacgtgcactttataatggctagattatctaacagaggagaagataaatgagccattataacctggcggcagcgcaaaagatg

SEQ ID NO: 52161 - DNA, 103 bp, Artificial Sequence
  Synthetic Polynucleotide
taatacgactcactatagggatgtaaacgtgcactttataatggctagataacagaggagaatctagatgttataaagtaacctggcggcagcgcaaaagatg

SEQ ID NO: 52162 - DNA, 103 bp, Artificial Sequence
  Synthetic Polynucleotide
taatacgactcactatagggtagatatgtaaacgtgcactttataatggcaacagaggagagccattatgaagtgcacgaacctggcggcagcgcaaaagatg

SEQ ID NO: 52163 - DNA, 103 bp, Artificial Sequence
  Synthetic Polynucleotide
taatacgactcactataggggaacgtagatatgtaaacgtgcactttataaacagaggagatataaaatgcacgtttacaacctggcggcagcgcaaaagatg

SEQ ID NO: 52164 - DNA, 103 bp, Artificial Sequence
  Synthetic Polynucleotide
taatacgactcactatagggctccagaacgtagatatgtaaacgtgcactaacagaggagaagtgcaatgttacatatcaacctggcggcagcgcaaaagatg

SEQ ID NO: 52165 - DNA, 103 bp, Artificial Sequence
  Synthetic Polynucleotide
taatacgactcactatagggtactcctccagaacgtagatatgtaaacgtaacagaggagaacgtttatgtatctacgtaacctggcggcagcgcaaaagatg

SEQ ID NO: 52166 - DNA, 103 bp, Artificial Sequence
  Synthetic Polynucleotide
taatacgactcactataggggttcttactcctccagaacgtagatatgtaaacagaggagatacataatgacgttctggaacctggcggcagcgcaaaagatg

SEQ ID NO: 52167 - DNA, 103 bp, Artificial Sequence
  Synthetic Polynucleotide
taatacgactcactataggggtcacgttcttactcctccagaacgtagataacagaggagaatctacatgctggaggagaacctggcggcagcgcaaaagatg

SEQ ID NO: 52168 - DNA, 103 bp, Artificial Sequence
  Synthetic Polynucleotide
taatacgactcactatagggtaatagtcacgttcttactcctccagaacgaacagaggagacgttctatgggagtaagaaacctggcggcagcgcaaaagatg

SEQ ID NO: 52169 - DNA, 103 bp, Artificial Sequence
  Synthetic Polynucleotide
taatacgactcactatagggcgtcttaatagtcacgttcttactcctccaaacagaggagatggaggatgaagaacgtgaacctggcggcagcgcaaaagatg

SEQ ID NO: 52170 - DNA, 103 bp, Artificial Sequence
  Synthetic Polynucleotide
taatacgactcactatagggtatacacgattatatttgttggcttagtataacagaggagaatactaatgcaacaaataaacctggcggcagcgcaaaagatg

SEQ ID NO: 52171 - DNA, 103 bp, Artificial Sequence
  Synthetic Polynucleotide
taatacgactcactatagggccattcgtcttaatagtcacgttcttactcaacagaggagagagtaaatgcgtgactataacctggcggcagcgcaaaagatg

SEQ ID NO: 52172 - DNA, 103 bp, Artificial Sequence
  Synthetic Polynucleotide
taatacgactcactatagggaagagccattcgtcttaatagtcacgttctaacagaggagaagaacgatgctattaagaaacctggcggcagcgcaaaagatg

SEQ ID NO: 52173 - DNA, 103 bp, Artificial Sequence
  Synthetic Polynucleotide
taatacgactcactataggggtaggaagagccattcgtcttaatagtcacaacagaggagagtgactatgaagacgaataacctggcggcagcgcaaaagatg

SEQ ID NO: 52174 - DNA, 103 bp, Artificial Sequence
  Synthetic Polynucleotide
taatacgactcactatagggaaatagtaggaagagccattcgtcttaataaacagaggagatattaaatggaatggctcaacctggcggcagcgcaaaagatg

SEQ ID NO: 52175 - DNA, 103 bp, Artificial Sequence
  Synthetic Polynucleotide
taatacgactcactatagggtcgtcaaatagtaggaagagccattcgtctaacagaggagaagacgaatggctcttcctaacctggcggcagcgcaaaagatg

SEQ ID NO: 52176 - DNA, 103 bp, Artificial Sequence
  Synthetic Polynucleotide
taatacgactcactatagggtctcttcgtcaaatagtaggaagagccattaacagaggagaaatggcatgtcctactataacctggcggcagcgcaaaagatg

SEQ ID NO: 52177 - DNA, 103 bp, Artificial Sequence
  Synthetic Polynucleotide
taatacgactcactatagggaggcatctcttcgtcaaatagtaggaagagaacagaggagactcttcatgctatttgacaacctggcggcagcgcaaaagatg

SEQ ID NO: 52178 - DNA, 103 bp, Artificial Sequence
  Synthetic Polynucleotide
taatacgactcactataggggaacgaggcatctcttcgtcaaatagtaggaacagaggagacctactatgtgacgaagaaacctggcggcagcgcaaaagatg

SEQ ID NO: 52179 - DNA, 103 bp, Artificial Sequence
  Synthetic Polynucleotide
taatacgactcactatagggacttggaacgaggcatctcttcgtcaaataaacagaggagatatttgatgaagagatgcaacctggcggcagcgcaaaagatg

SEQ ID NO: 52180 - DNA, 103 bp, Artificial Sequence
  Synthetic Polynucleotide
taatacgactcactatagggatatgacttggaacgaggcatctcttcgtcaacagaggagagacgaaatgatgcctcgtaacctggcggcagcgcaaaagatg

SEQ ID NO: 52181 - DNA, 103 bp, Artificial Sequence
  Synthetic Polynucleotide
taatacgactcactataggggatgttatacacgattatatttgttggcttaacagaggagaaagccaatgaatataatcaacctggcggcagcgcaaaagatg

SEQ ID NO: 52182 - DNA, 103 bp, Artificial Sequence
  Synthetic Polynucleotide
taatacgactcactatagggtctagatatgacttggaacgaggcatctctaacagaggagaagagatatgtcgttccaaaacctggcggcagcgcaaaagatg

SEQ ID NO: 52183 - DNA, 103 bp, Artificial Sequence
  Synthetic Polynucleotide
taatacgactcactatagggttcattctagatatgacttggaacgaggcaaacagaggagatgcctcatgccaagtcataacctggcggcagcgcaaaagatg

SEQ ID NO: 52184 - DNA, 103 bp, Artificial Sequence
  Synthetic Polynucleotide
taatacgactcactatagggatatcttcattctagatatgacttggaacgaacagaggagacgttccatgtcatatctaaacctggcggcagcgcaaaagatg

SEQ ID NO: 52185 - DNA, 103 bp, Artificial Sequence
  Synthetic Polynucleotide
taatacgactcactatagggtaatgatatcttcattctagatatgacttgaacagaggagacaagtcatgtctagaatgaacctggcggcagcgcaaaagatg

SEQ ID NO: 52186 - DNA, 103 bp, Artificial Sequence
  Synthetic Polynucleotide
taatacgactcactatagggtcaattaatgatatcttcattctagatatgaacagaggagacatatcatgaatgaagataacctggcggcagcgcaaaagatg

SEQ ID NO: 52187 - DNA, 103 bp, Artificial Sequence
  Synthetic Polynucleotide
taatacgactcactatagggttttctcaattaatgatatcttcattctagaacagaggagactagaaatgagatatcataacctggcggcagcgcaaaagatg

SEQ ID NO: 52188 - DNA, 103 bp, Artificial Sequence
  Synthetic Polynucleotide
taatacgactcactatagggtagttttttctcaattaatgatatcttcataacagaggagaatgaagatgtcattaattaacctggcggcagcgcaaaagatg

SEQ ID NO: 52189 - DNA, 103 bp, Artificial Sequence
  Synthetic Polynucleotide
taatacgactcactatagggggtattagttttttctcaattaatgatatcaacagaggagagatatcatgaattgagaaaacctggcggcagcgcaaaagatg

SEQ ID NO: 52190 - DNA, 103 bp, Artificial Sequence
  Synthetic Polynucleotide
taatacgactcactataggggcgagggtattagttttttctcaattaatgaacagaggagacattaaatgagaaaaaacaacctggcggcagcgcaaaagatg

SEQ ID NO: 52191 - DNA, 103 bp, Artificial Sequence
  Synthetic Polynucleotide
taatacgactcactatagggtggaggcgagggtattagttttttctcaataacagaggagaattgagatgaaactaataaacctggcggcagcgcaaaagatg

SEQ ID NO: 52192 - DNA, 103 bp, Artificial Sequence
  Synthetic Polynucleotide
taatacgactcactatagggtcaaagatgttatacacgattatatttgttaacagaggagaaacaaaatgaatcgtgtaaacctggcggcagcgcaaaagatg

SEQ ID NO: 52193 - DNA, 103 bp, Artificial Sequence
  Synthetic Polynucleotide
taatacgactcactatagggtctagtggaggcgagggtattagttttttcaacagaggagagaaaaaatgaataccctcaacctggcggcagcgcaaaagatg

SEQ ID NO: 52194 - DNA, 103 bp, Artificial Sequence
  Synthetic Polynucleotide
taatacgactcactatagggtctcttctagtggaggcgagggtattagttaacagaggagaaactaaatgcctcgcctcaacctggcggcagcgcaaaagatg

SEQ ID NO: 52195 - DNA, 103 bp, Artificial Sequence
  Synthetic Polynucleotide
taatacgactcactatagggtgtattctcttctagtggaggcgagggtataacagaggagaatacccatgcctccactaaacctggcggcagcgcaaaagatg

SEQ ID NO: 52196 - DNA, 103 bp, Artificial Sequence
  Synthetic Polynucleotide
taatacgactcactatagggacatgtgtattctcttctagtggaggcgagaacagaggagactcgccatgactagaagaaacctggcggcagcgcaaaagatg

SEQ ID NO: 52197 - DNA, 103 bp, Artificial Sequence
  Synthetic Polynucleotide
taatacgactcactatagggttaaaacatgtgtattctcttctagtggagaacagaggagactccacatgaagagaataaacctggcggcagcgcaaaagatg

SEQ ID NO: 52198 - DNA, 103 bp, Artificial Sequence
  Synthetic Polynucleotide
taatacgactcactatagggatgcattaaaacatgtgtattctcttctagaacagaggagactagaaatgaatacacataacctggcggcagcgcaaaagatg

SEQ ID NO: 52199 - DNA, 103 bp, Artificial Sequence
  Synthetic Polynucleotide
taatacgactcactatagggggagaatgcattaaaacatgtgtattctctaacagaggagaagagaaatgacatgttttaacctggcggcagcgcaaaagatg

SEQ ID NO: 52200 - DNA, 103 bp, Artificial Sequence
  Synthetic Polynucleotide
taatacgactcactatagggctaacggagaatgcattaaaacatgtgtataacagaggagaatacacatgttttaatgcaacctggcggcagcgcaaaagatg

SEQ ID NO: 52201 - DNA, 103 bp, Artificial Sequence
  Synthetic Polynucleotide
taatacgactcactatagggaaacactaacggagaatgcattaaaacatgaacagaggagacatgttatgatgcattctaacctggcggcagcgcaaaagatg

SEQ ID NO: 52202 - DNA, 103 bp, Artificial Sequence
  Synthetic Polynucleotide
taatacgactcactataggggaatcaaacactaacggagaatgcattaaaaacagaggagatttaatatgttctccgttaacctggcggcagcgcaaaagatg

SEQ ID NO: 52203 - DNA, 103 bp, Artificial Sequence
  Synthetic Polynucleotide
taatacgactcactatagggttctatcaaagatgttatacacgattatataacagaggagaatataaatgtgtataacaaacctggcggcagcgcaaaagatg

SEQ ID NO: 52204 - DNA, 103 bp, Artificial Sequence
  Synthetic Polynucleotide
taatacgactcactatagggaccaagaatcaaacactaacggagaatgcaaacagaggagatgcattatgcgttagtgtaacctggcggcagcgcaaaagatg

SEQ ID NO: 52205 - DNA, 103 bp, Artificial Sequence
  Synthetic Polynucleotide
taatacgactcactataggggtttaaccaagaatcaaacactaacggagaaacagaggagatctccgatggtgtttgataacctggcggcagcgcaaaagatg

SEQ ID NO: 52206 - DNA, 103 bp, Artificial Sequence
  Synthetic Polynucleotide
taatacgactcactataggggctgagtttaaccaagaatcaaacactaacaacagaggagagttagtatgtgattcttgaacctggcggcagcgcaaaagatg

SEQ ID NO: 52207 - DNA, 103 bp, Artificial Sequence
  Synthetic Polynucleotide
taatacgactcactatagggcggtggctgagtttaaccaagaatcaaacaaacagaggagatgtttgatgcttggttaaaacctggcggcagcgcaaaagatg

SEQ ID NO: 52208 - DNA, 103 bp, Artificial Sequence
  Synthetic Polynucleotide
taatacgactcactatagggcaaggcggtggctgagtttaaccaagaatcaacagaggagagattctatgttaaactcaaacctggcggcagcgcaaaagatg

SEQ ID NO: 52209 - DNA, 103 bp, Artificial Sequence
  Synthetic Polynucleotide
taatacgactcactatagggagaatcaaggcggtggctgagtttaaccaaaacagaggagattggttatgctcagccacaacctggcggcagcgcaaaagatg

SEQ ID NO: 52210 - DNA, 103 bp, Artificial Sequence
  Synthetic Polynucleotide
taatacgactcactatagggatactagaatcaaggcggtggctgagtttaaacagaggagataaactatgccaccgcctaacctggcggcagcgcaaaagatg

SEQ ID NO: 52211 - DNA, 103 bp, Artificial Sequence
  Synthetic Polynucleotide
taatacgactcactatagggaaaagatactagaatcaaggcggtggctgaaacagaggagatcagccatggccttgattaacctggcggcagcgcaaaagatg

SEQ ID NO: 52212 - DNA, 103 bp, Artificial Sequence
  Synthetic Polynucleotide
taatacgactcactatagggagaacaaaagatactagaatcaaggcggtgaacagaggagacaccgcatggattctagtaacctggcggcagcgcaaaagatg

SEQ ID NO: 52213 - DNA, 103 bp, Artificial Sequence
  Synthetic Polynucleotide
taatacgactcactatagggcatctagaacaaaagatactagaatcaaggaacagaggagaccttgaatgtagtatcttaacctggcggcagcgcaaaagatg

SEQ ID NO: 52214 - DNA, 103 bp, Artificial Sequence
  Synthetic Polynucleotide
taatacgactcactatagggtctgattctatcaaagatgttatacacgataacagaggagaatcgtgatgaacatctttaacctggcggcagcgcaaaagatg

SEQ ID NO: 52215 - DNA, 103 bp, Artificial Sequence
  Synthetic Polynucleotide
taatacgactcactataggggttctcatctagaacaaaagatactagaataacagaggagaattctaatgtcttttgttaacctggcggcagcgcaaaagatg

SEQ ID NO: 52216 - DNA, 103 bp, Artificial Sequence
  Synthetic Polynucleotide
taatacgactcactatagggatagagttctcatctagaacaaaagatactaacagaggagaagtatcatgtgttctagaaacctggcggcagcgcaaaagatg

SEQ ID NO: 52217 - DNA, 103 bp, Artificial Sequence
  Synthetic Polynucleotide
taatacgactcactatagggctaatatagagttctcatctagaacaaaagaacagaggagacttttgatgtagatgagaaacctggcggcagcgcaaaagatg

SEQ ID NO: 52218 - DNA, 103 bp, Artificial Sequence
  Synthetic Polynucleotide
taatacgactcactatagggtatctctaatatagagttctcatctagaacaacagaggagagttctaatggagaactctaacctggcggcagcgcaaaagatg

SEQ ID NO: 52219 - DNA, 103 bp, Artificial Sequence
  Synthetic Polynucleotide
taatacgactcactatagggtttggtatctctaatatagagttctcatctaacagaggagaagatgaatgctctatattaacctggcggcagcgcaaaagatg

SEQ ID NO: 52220 - DNA, 103 bp, Artificial Sequence
  Synthetic Polynucleotide
taatacgactcactatagggaagtctttggtatctctaatatagagttctaacagaggagaagaactatgtattagagaaacctggcggcagcgcaaaagatg

SEQ ID NO: 52221 - DNA, 103 bp, Artificial Sequence
  Synthetic Polynucleotide
taatacgactcactatagggtttcaaagtctttggtatctctaatatagaaacagaggagatctataatggagataccaaacctggcggcagcgcaaaagatg

SEQ ID NO: 52222 - DNA, 103 bp, Artificial Sequence
  Synthetic Polynucleotide
taatacgactcactatagggctatatttcaaagtctttggtatctctaataacagaggagaattagaatgaccaaagacaacctggcggcagcgcaaaagatg

SEQ ID NO: 52223 - DNA, 103 bp, Artificial Sequence
  Synthetic Polynucleotide
taatacgactcactatagggtattactatatttcaaagtctttggtatctaacagaggagaagatacatgagactttgaaacctggcggcagcgcaaaagatg

SEQ ID NO: 52224 - DNA, 103 bp, Artificial Sequence
  Synthetic Polynucleotide
taatacgactcactatagggaattttattactatatttcaaagtctttggaacagaggagaccaaagatgttgaaatataacctggcggcagcgcaaaagatg

SEQ ID NO: 52225 - DNA, 103 bp, Artificial Sequence
  Synthetic Polynucleotide
taatacgactcactatagggtagagtctgattctatcaaagatgttatacaacagaggagagtataaatgctttgatagaacctggcggcagcgcaaaagatg

SEQ ID NO: 52226 - DNA, 103 bp, Artificial Sequence
  Synthetic Polynucleotide
taatacgactcactatagggatagaaattttattactatatttcaaagtcaacagaggagagactttatgatatagtaaaacctggcggcagcgcaaaagatg

SEQ ID NO: 52227 - DNA, 103 bp, Artificial Sequence
  Synthetic Polynucleotide
taatacgactcactatagggcaggaatagaaattttattactatatttcaaacagaggagatgaaatatggtaataaaaaacctggcggcagcgcaaaagatg

SEQ ID NO: 52228 - DNA, 103 bp, Artificial Sequence
  Synthetic Polynucleotide
taatacgactcactatagggtcagtcaggaatagaaattttattactataaacagaggagatatagtatgaaaatttctaacctggcggcagcgcaaaagatg

SEQ ID NO: 52229 - DNA, 103 bp, Artificial Sequence
  Synthetic Polynucleotide
taatacgactcactataggggttaatcagtcaggaatagaaattttattaaacagaggagataataaatgttctattccaacctggcggcagcgcaaaagatg

SEQ ID NO: 52230 - DNA, 103 bp, Artificial Sequence
  Synthetic Polynucleotide
taatacgactcactatagggcatttgttaatcagtcaggaatagaaatttaacagaggagaaaatttatgttcctgactaacctggcggcagcgcaaaagatg

SEQ ID NO: 52231 - DNA, 103 bp, Artificial Sequence
  Synthetic Polynucleotide
taatacgactcactatagggtgaaccatttgttaatcagtcaggaatagaaacagaggagatctattatggactgattaaacctggcggcagcgcaaaagatg

SEQ ID NO: 52232 - DNA, 103 bp, Artificial Sequence
  Synthetic Polynucleotide
taatacgactcactataggggtctttgaaccatttgttaatcagtcaggaaacagaggagatcctgaatgattaacaaaaacctggcggcagcgcaaaagatg

SEQ ID NO: 52233 - DNA, 103 bp, Artificial Sequence
  Synthetic Polynucleotide
taatacgactcactataggggtctagtctttgaaccatttgttaatcagtaacagaggagaactgatatgcaaatggttaacctggcggcagcgcaaaagatg

SEQ ID NO: 52234 - DNA, 103 bp, Artificial Sequence
  Synthetic Polynucleotide
taatacgactcactatagggtaaatgtctagtctttgaaccatttgttaaaacagaggagattaacaatgggttcaaagaacctggcggcagcgcaaaagatg

SEQ ID NO: 52235 - DNA, 103 bp, Artificial Sequence
  Synthetic Polynucleotide
taatacgactcactatagggcatggtaaatgtctagtctttgaaccatttaacagaggagaaaatggatgaaagactagaacctggcggcagcgcaaaagatg

SEQ ID NO: 52236 - DNA, 103 bp, Artificial Sequence
  Synthetic Polynucleotide
taatacgactcactatagggatgaattgaaaccaaggagttagtttagttaacagaggagaaactaaatgaactccttgaacctggcggcagcgcaaaagatg

SEQ ID NO: 52237 - DNA, 103 bp, Artificial Sequence
  Synthetic Polynucleotide
taatacgactcactatagggttctttagagtctgattctatcaaagatgtaacagaggagaacatctatgatagaatcaaacctggcggcagcgcaaaagatg

SEQ ID NO: 52238 - DNA, 103 bp, Artificial Sequence
  Synthetic Polynucleotide
taatacgactcactatagggcatcacatggtaaatgtctagtctttgaacaacagaggagagttcaaatgctagacattaacctggcggcagcgcaaaagatg

SEQ ID NO: 52239 - DNA, 103 bp, Artificial Sequence
  Synthetic Polynucleotide
taatacgactcactatagggattagcatcacatggtaaatgtctagtcttaacagaggagaaagactatgcatttaccaaacctggcggcagcgcaaaagatg

SEQ ID NO: 52240 - DNA, 103 bp, Artificial Sequence
  Synthetic Polynucleotide
taatacgactcactatagggggaatattagcatcacatggtaaatgtctaaacagaggagatagacaatgaccatgtgaaacctggcggcagcgcaaaagatg

SEQ ID NO: 52241 - DNA, 103 bp, Artificial Sequence
  Synthetic Polynucleotide
taatacgactcactataggggtttgggaatattagcatcacatggtaaataacagaggagaatttacatggtgatgctaaacctggcggcagcgcaaaagatg

SEQ ID NO: 52242 - DNA, 103 bp, Artificial Sequence
  Synthetic Polynucleotide
taatacgactcactatagggtgtatgtttgggaatattagcatcacatggaacagaggagaccatgtatggctaatattaacctggcggcagcgcaaaagatg

SEQ ID NO: 52243 - DNA, 103 bp, Artificial Sequence
  Synthetic Polynucleotide
taatacgactcactatagggatagatgtatgtttgggaatattagcatcaaacagaggagatgatgcatgtattcccaaaacctggcggcagcgcaaaagatg

SEQ ID NO: 52244 - DNA, 103 bp, Artificial Sequence
  Synthetic Polynucleotide
taatacgactcactatagggaattcatagatgtatgtttgggaatattagaacagaggagactaataatgccaaacataaacctggcggcagcgcaaaagatg

SEQ ID NO: 52245 - DNA, 103 bp, Artificial Sequence
  Synthetic Polynucleotide
taatacgactcactatagggcgccaaattcatagatgtatgtttgggaataacagaggagaattcccatgcatacatctaacctggcggcagcgcaaaagatg

SEQ ID NO: 52246 - DNA, 103 bp, Artificial Sequence
  Synthetic Polynucleotide
taatacgactcactatagggaaaagcgccaaattcatagatgtatgtttgaacagaggagacaaacaatgatctatgaaaacctggcggcagcgcaaaagatg

SEQ ID NO: 52247 - DNA, 103 bp, Artificial Sequence
  Synthetic Polynucleotide
taatacgactcactatagggaagagaaaagcgccaaattcatagatgtataacagaggagaatacatatgtgaatttggaacctggcggcagcgcaaaagatg

SEQ ID NO: 52248 - DNA, 103 bp, Artificial Sequence
  Synthetic Polynucleotide
taatacgactcactatagggtcgttttctttagagtctgattctatcaaaaacagaggagatttgatatgatcagactcaacctggcggcagcgcaaaagatg

SEQ ID NO: 52249 - DNA, 103 bp, Artificial Sequence
  Synthetic Polynucleotide
taatacgactcactatagggattaaaagagaaaagcgccaaattcatagaaacagaggagatctatgatgttggcgcttaacctggcggcagcgcaaaagatg

SEQ ID NO: 52250 - DNA, 103 bp, Artificial Sequence
  Synthetic Polynucleotide
taatacgactcactatagggactgaattaaaagagaaaagcgccaaattcaacagaggagagaatttatggcttttctcaacctggcggcagcgcaaaagatg

SEQ ID NO: 52251 - DNA, 103 bp, Artificial Sequence
  Synthetic Polynucleotide
taatacgactcactatagggtatttactgaattaaaagagaaaagcgccaaacagaggagatggcgcatgtctcttttaaacctggcggcagcgcaaaagatg

SEQ ID NO: 52252 - DNA, 103 bp, Artificial Sequence
  Synthetic Polynucleotide
taatacgactcactatagggctctctatttactgaattaaaagagaaaagaacagaggagacttttcatgtttaattcaaacctggcggcagcgcaaaagatg

SEQ ID NO: 52253 - DNA, 103 bp, Artificial Sequence
  Synthetic Polynucleotide
taatacgactcactataggggatatctctctatttactgaattaaaagagaacagaggagactctttatgttcagtaaaaacctggcggcagcgcaaaagatg

SEQ ID NO: 52254 - DNA, 103 bp, Artificial Sequence
  Synthetic Polynucleotide
taatacgactcactatagggcggctgatatctctctatttactgaattaaaacagaggagattaattatgtaaatagagaacctggcggcagcgcaaaagatg

SEQ ID NO: 52255 - DNA, 103 bp, Artificial Sequence
  Synthetic Polynucleotide
taatacgactcactatagggtagtgcggctgatatctctctatttactgaaacagaggagatcagtaatgagagagataaacctggcggcagcgcaaaagatg

SEQ ID NO: 52256 - DNA, 103 bp, Artificial Sequence
  Synthetic Polynucleotide
taatacgactcactataggggacgctagtgcggctgatatctctctatttaacagaggagaaaatagatggatatcagcaacctggcggcagcgcaaaagatg

SEQ ID NO: 52257 - DNA, 103 bp, Artificial Sequence
  Synthetic Polynucleotide
taatacgactcactataggggaggggacgctagtgcggctgatatctctcaacagaggagagagagaatgcagccgcacaacctggcggcagcgcaaaagatg

SEQ ID NO: 52258 - DNA, 103 bp, Artificial Sequence
  Synthetic Polynucleotide
taatacgactcactatagggattgggaggggacgctagtgcggctgatataacagaggagaatatcaatggcactagcgaacctggcggcagcgcaaaagatg

SEQ ID NO: 52259 - DNA, 103 bp, Artificial Sequence
  Synthetic Polynucleotide
taatacgactcactatagggccgattcgttttctttagagtctgattctaaacagaggagatagaatatgactctaaagaacctggcggcagcgcaaaagatg

SEQ ID NO: 52260 - DNA, 103 bp, Artificial Sequence
  Synthetic Polynucleotide
taatacgactcactataggggaactattgggaggggacgctagtgcggctaacagaggagaagccgcatgagcgtccccaacctggcggcagcgcaaaagatg

SEQ ID NO: 52261 - DNA, 103 bp, Artificial Sequence
  Synthetic Polynucleotide
taatacgactcactatagggagggagaactattgggaggggacgctagtgaacagaggagacactagatgcccctcccaaacctggcggcagcgcaaaagatg

SEQ ID NO: 52262 - DNA, 103 bp, Artificial Sequence
  Synthetic Polynucleotide
taatacgactcactatagggtaaaaagggagaactattgggaggggacgcaacagaggagagcgtccatgcccaatagtaacctggcggcagcgcaaaagatg

SEQ ID NO: 52263 - DNA, 103 bp, Artificial Sequence
  Synthetic Polynucleotide
taatacgactcactatagggacctttaaaaagggagaactattgggagggaacagaggagaccctccatgtagttctccaacctggcggcagcgcaaaagatg

SEQ ID NO: 52264 - DNA, 103 bp, Artificial Sequence
  Synthetic Polynucleotide
taatacgactcactatagggtagatacctttaaaaagggagaactattggaacagaggagaccaataatgctcccttttaacctggcggcagcgcaaaagatg

SEQ ID NO: 52265 - DNA, 103 bp, Artificial Sequence
  Synthetic Polynucleotide
taatacgactcactatagggcgcattagatacctttaaaaagggagaactaacagaggagaagttctatgtttttaaagaacctggcggcagcgcaaaagatg

SEQ ID NO: 52266 - DNA, 103 bp, Artificial Sequence
  Synthetic Polynucleotide
taatacgactcactatagggaaatccgcattagatacctttaaaaagggaaacagaggagatcccttatgaaaggtatcaacctggcggcagcgcaaaagatg

SEQ ID NO: 52267 - DNA, 103 bp, Artificial Sequence
  Synthetic Polynucleotide
taatacgactcactatagggtttctaaatccgcattagatacctttaaaaaacagaggagattttaaatgtatctaatgaacctggcggcagcgcaaaagatg

SEQ ID NO: 52268 - DNA, 103 bp, Artificial Sequence
  Synthetic Polynucleotide
taatacgactcactatagggagagttttctaaatccgcattagataccttaacagaggagaaaggtaatgaatgcggataacctggcggcagcgcaaaagatg

SEQ ID NO: 52269 - DNA, 103 bp, Artificial Sequence
  Synthetic Polynucleotide
taatacgactcactataggggatagagagttttctaaatccgcattagataacagaggagaatctaaatgggatttagaaacctggcggcagcgcaaaagatg

SEQ ID NO: 52270 - DNA, 103 bp, Artificial Sequence
  Synthetic Polynucleotide
taatacgactcactatagggtaaagccgattcgttttctttagagtctgaaacagaggagatcagacatgaaagaaaacaacctggcggcagcgcaaaagatg

SEQ ID NO: 52271 - DNA, 103 bp, Artificial Sequence
  Synthetic Polynucleotide
taatacgactcactatagggtaagagatagagagttttctaaatccgcataacagaggagaatgcggatgtagaaaactaacctggcggcagcgcaaaagatg

SEQ ID NO: 52272 - DNA, 103 bp, Artificial Sequence
  Synthetic Polynucleotide
taatacgactcactatagggctcattaagagatagagagttttctaaatcaacagaggagagatttaatgaactctctaaacctggcggcagcgcaaaagatg

SEQ ID NO: 52273 - DNA, 103 bp, Artificial Sequence
  Synthetic Polynucleotide
taatacgactcactatagggaaacgctcattaagagatagagagttttctaacagaggagaagaaaaatgtctatctctaacctggcggcagcgcaaaagatg

SEQ ID NO: 52274 - DNA, 103 bp, Artificial Sequence
  Synthetic Polynucleotide
taatacgactcactatagggactttaaacgctcattaagagatagagagtaacagaggagaactctcatgctcttaatgaacctggcggcagcgcaaaagatg

SEQ ID NO: 52275 - DNA, 103 bp, Artificial Sequence
  Synthetic Polynucleotide
taatacgactcactatagggtaatgactttaaacgctcattaagagatagaacagaggagactatctatgaatgagcgtaacctggcggcagcgcaaaagatg

SEQ ID NO: 52276 - DNA, 103 bp, Artificial Sequence
  Synthetic Polynucleotide
taatacgactcactatagggctatataatgactttaaacgctcattaagaaacagaggagatcttaaatggcgtttaaaaacctggcggcagcgcaaaagatg

SEQ ID NO: 52277 - DNA, 103 bp, Artificial Sequence
  Synthetic Polynucleotide
taatacgactcactatagggcaaccctatataatgactttaaacgctcataacagaggagaatgagcatgtaaagtcataacctggcggcagcgcaaaagatg

SEQ ID NO: 52278 - DNA, 103 bp, Artificial Sequence
  Synthetic Polynucleotide
taatacgactcactataggggatagcaaccctatataatgactttaaacgaacagaggagacgtttaatgtcattatataacctggcggcagcgcaaaagatg

SEQ ID NO: 52279 - DNA, 103 bp, Artificial Sequence
  Synthetic Polynucleotide
taatacgactcactatagggcaagagatagcaaccctatataatgactttaacagaggagaaaagtcatgatatagggtaacctggcggcagcgcaaaagatg

SEQ ID NO: 52280 - DNA, 103 bp, Artificial Sequence
  Synthetic Polynucleotide
taatacgactcactatagggacgcgcaagagatagcaaccctatataatgaacagaggagacattatatggggttgctaaacctggcggcagcgcaaaagatg

SEQ ID NO: 52281 - DNA, 103 bp, Artificial Sequence
  Synthetic Polynucleotide
taatacgactcactatagggtataataaagccgattcgttttctttagagaacagaggagactctaaatgaaacgaatcaacctggcggcagcgcaaaagatg

SEQ ID NO: 52282 - DNA, 103 bp, Artificial Sequence
  Synthetic Polynucleotide
taatacgactcactatagggtgaatacgcgcaagagatagcaaccctataaacagaggagatataggatggctatctctaacctggcggcagcgcaaaagatg

SEQ ID NO: 52283 - DNA, 103 bp, Artificial Sequence
  Synthetic Polynucleotide
taatacgactcactatagggccgggtgaatacgcgcaagagatagcaaccaacagaggagaggttgcatgctcttgcgcaacctggcggcagcgcaaaagatg

SEQ ID NO: 52284 - DNA, 103 bp, Artificial Sequence
  Synthetic Polynucleotide
taatacgactcactataggggtgatccgggtgaatacgcgcaagagatagaacagaggagactatctatggcgcgtattaacctggcggcagcgcaaaagatg

SEQ ID NO: 52285 - DNA, 103 bp, Artificial Sequence
  Synthetic Polynucleotide
taatacgactcactatagggaaatcgtgatccgggtgaatacgcgcaagaaacagaggagatcttgcatgtattcacccaacctggcggcagcgcaaaagatg

SEQ ID NO: 52286 - DNA, 103 bp, Artificial Sequence
  Synthetic Polynucleotide
taatacgactcactatagggagacaaaatcgtgatccgggtgaatacgcgaacagaggagacgcgtaatgacccggatcaacctggcggcagcgcaaaagatg

SEQ ID NO: 52287 - DNA, 103 bp, Artificial Sequence
  Synthetic Polynucleotide
taatacgactcactatagggctgaaagacaaaatcgtgatccgggtgaataacagaggagaattcacatggatcacgataacctggcggcagcgcaaaagatg

SEQ ID NO: 52288 - DNA, 103 bp, Artificial Sequence
  Synthetic Polynucleotide
taatacgactcactatagggctttcctgaaagacaaaatcgtgatccgggaacagaggagacccggaatgcgattttgtaacctggcggcagcgcaaaagatg

SEQ ID NO: 52289 - DNA, 103 bp, Artificial Sequence
  Synthetic Polynucleotide
taatacgactcactataggggatagctttcctgaaagacaaaatcgtgataacagaggagaatcacgatgttgtctttcaacctggcggcagcgcaaaagatg

SEQ ID NO: 52290 - DNA, 103 bp, Artificial Sequence
  Synthetic Polynucleotide
taatacgactcactatagggcgttcgatagctttcctgaaagacaaaatcaacagaggagagattttatgtttcaggaaaacctggcggcagcgcaaaagatg

SEQ ID NO: 52291 - DNA, 103 bp, Artificial Sequence
  Synthetic Polynucleotide
taatacgactcactataggggtttacgttcgatagctttcctgaaagacaaacagaggagatgtcttatgggaaagctaaacctggcggcagcgcaaaagatg

SEQ ID NO: 52292 - DNA, 103 bp, Artificial Sequence
  Synthetic Polynucleotide
taatacgactcactatagggatgtgtataataaagccgattcgttttcttaacagaggagaaagaaaatgaatcggcttaacctggcggcagcgcaaaagatg

SEQ ID NO: 52293 - DNA, 103 bp, Artificial Sequence
  Synthetic Polynucleotide
taatacgactcactatagggactacgtttacgttcgatagctttcctgaaaacagaggagattcaggatggctatcgaaaacctggcggcagcgcaaaagatg

SEQ ID NO: 52294 - DNA, 103 bp, Artificial Sequence
  Synthetic Polynucleotide
taatacgactcactatagggtggctactacgtttacgttcgatagctttcaacagaggagagaaagcatgcgaacgtaaaacctggcggcagcgcaaaagatg

SEQ ID NO: 52295 - DNA, 103 bp, Artificial Sequence
  Synthetic Polynucleotide
taatacgactcactatagggacgtatggctactacgtttacgttcgatagaacagaggagactatcgatggtaaacgtaaacctggcggcagcgcaaaagatg

SEQ ID NO: 52296 - DNA, 103 bp, Artificial Sequence
  Synthetic Polynucleotide
taatacgactcactatagggctgcgacgtatggctactacgtttacgttcaacagaggagagaacgtatgcgtagtagcaacctggcggcagcgcaaaagatg

SEQ ID NO: 52297 - DNA, 103 bp, Artificial Sequence
  Synthetic Polynucleotide
taatacgactcactataggggaattctgcgacgtatggctactacgtttaaacagaggagataaacgatgtagccatacaacctggcggcagcgcaaaagatg

SEQ ID NO: 52298 - DNA, 103 bp, Artificial Sequence
  Synthetic Polynucleotide
taatacgactcactatagggatttagaattctgcgacgtatggctactacaacagaggagagtagtaatgatacgtcgcaacctggcggcagcgcaaaagatg

SEQ ID NO: 52299 - DNA, 103 bp, Artificial Sequence
  Synthetic Polynucleotide
taatacgactcactatagggtcatcatttagaattctgcgacgtatggctaacagaggagaagccatatgtcgcagaataacctggcggcagcgcaaaagatg

SEQ ID NO: 52300 - DNA, 103 bp, Artificial Sequence
  Synthetic Polynucleotide
taatacgactcactataggggtatatcatcatttagaattctgcgacgtaaacagaggagatacgtcatggaattctaaaacctggcggcagcgcaaaagatg

SEQ ID NO: 52301 - DNA, 103 bp, Artificial Sequence
  Synthetic Polynucleotide
taatacgactcactatagggaacaggtatatcatcatttagaattctgcgaacagaggagacgcagaatgctaaatgataacctggcggcagcgcaaaagatg

SEQ ID NO: 52302 - DNA, 103 bp, Artificial Sequence
  Synthetic Polynucleotide
taatacgactcactatagggataaaaacaggtatatcatcatttagaattaacagaggagaaattctatgtgatgatataacctggcggcagcgcaaaagatg

SEQ ID NO: 52303 - DNA, 103 bp, Artificial Sequence
  Synthetic Polynucleotide
taatacgactcactatagggcatgaatgtgtataataaagccgattcgttaacagaggagaaacgaaatggctttattaaacctggcggcagcgcaaaagatg

SEQ ID NO: 52304 - DNA, 103 bp, Artificial Sequence
  Synthetic Polynucleotide
taatacgactcactatagggctgaaataaaaacaggtatatcatcatttaaacagaggagataaatgatgatatacctgaacctggcggcagcgcaaaagatg

SEQ ID NO: 52305 - DNA, 103 bp, Artificial Sequence
  Synthetic Polynucleotide
taatacgactcactatagggacttactgaaataaaaacaggtatatcatcaacagaggagagatgatatgcctgtttttaacctggcggcagcgcaaaagatg

SEQ ID NO: 52306 - DNA, 103 bp, Artificial Sequence
  Synthetic Polynucleotide
taatacgactcactataggggctaaacttactgaaataaaaacaggtataaacagaggagatataccatgttttatttcaacctggcggcagcgcaaaagatg

SEQ ID NO: 52307 - DNA, 103 bp, Artificial Sequence
  Synthetic Polynucleotide
taatacgactcactatagggaaaaggctaaacttactgaaataaaaacagaacagaggagactgtttatgtttcagtaaaacctggcggcagcgcaaaagatg

SEQ ID NO: 52308 - DNA, 103 bp, Artificial Sequence
  Synthetic Polynucleotide
taatacgactcactatagggttatcaaaaggctaaacttactgaaataaaaacagaggagatttattatggtaagtttaaacctggcggcagcgcaaaagatg

SEQ ID NO: 52309 - DNA, 103 bp, Artificial Sequence
  Synthetic Polynucleotide
taatacgactcactataggggagatttatcaaaaggctaaacttactgaaaacagaggagattcagtatgtttagccttaacctggcggcagcgcaaaagatg

SEQ ID NO: 52310 - DNA, 103 bp, Artificial Sequence
  Synthetic Polynucleotide
taatacgactcactatagggaagaagagatttatcaaaaggctaaacttaaacagaggagataagttatgccttttgataacctggcggcagcgcaaaagatg

SEQ ID NO: 52311 - DNA, 103 bp, Artificial Sequence
  Synthetic Polynucleotide
taatacgactcactatagggaaagcaagaagagatttatcaaaaggctaaaacagaggagattagccatgtgataaatcaacctggcggcagcgcaaaagatg

SEQ ID NO: 52312 - DNA, 103 bp, Artificial Sequence
  Synthetic Polynucleotide
taatacgactcactatagggtcaaaaaagcaagaagagatttatcaaaagaacagaggagacttttgatgaatctcttcaacctggcggcagcgcaaaagatg

SEQ ID NO: 52313 - DNA, 103 bp, Artificial Sequence
  Synthetic Polynucleotide
taatacgactcactatagggatatgtcaaaaaagcaagaagagatttatcaacagaggagagataaaatgcttcttgctaacctggcggcagcgcaaaagatg

SEQ ID NO: 52314 - DNA, 103 bp, Artificial Sequence
  Synthetic Polynucleotide
taatacgactcactatagggtttatcatgaatgtgtataataaagccgataacagaggagaatcggcatgattatacacaacctggcggcagcgcaaaagatg

SEQ ID NO: 52315 - DNA, 103 bp, Artificial Sequence
  Synthetic Polynucleotide
taatacgactcactatagggcgttaatatgtcaaaaaagcaagaagagataacagaggagaatctctatgtgcttttttaacctggcggcagcgcaaaagatg

SEQ ID NO: 52316 - DNA, 103 bp, Artificial Sequence
  Synthetic Polynucleotide
taatacgactcactatagggcgatacgttaatatgtcaaaaaagcaagaaaacagaggagattcttgatgttttgacataacctggcggcagcgcaaaagatg

SEQ ID NO: 52317 - DNA, 103 bp, Artificial Sequence
  Synthetic Polynucleotide
taatacgactcactatagggtaatgcgatacgttaatatgtcaaaaaagcaacagaggagagcttttatgacatattaaaacctggcggcagcgcaaaagatg

SEQ ID NO: 52318 - DNA, 103 bp, Artificial Sequence
  Synthetic Polynucleotide
taatacgactcactatagggagtattaatgcgatacgttaatatgtcaaaaacagaggagatttgacatgttaacgtataacctggcggcagcgcaaaagatg

SEQ ID NO: 52319 - DNA, 103 bp, Artificial Sequence
  Synthetic Polynucleotide
taatacgactcactatagggaaaacagtattaatgcgatacgttaatatgaacagaggagacatattatggtatcgcataacctggcggcagcgcaaaagatg

SEQ ID NO: 52320 - DNA, 103 bp, Artificial Sequence
  Synthetic Polynucleotide
taatacgactcactatagggctaagaaaacagtattaatgcgatacgttaaacagaggagataacgtatggcattaataaacctggcggcagcgcaaaagatg

SEQ ID NO: 52321 - DNA, 103 bp, Artificial Sequence
  Synthetic Polynucleotide
taatacgactcactatagggattcgctaagaaaacagtattaatgcgataaacagaggagatatcgcatgaatactgttaacctggcggcagcgcaaaagatg

SEQ ID NO: 52322 - DNA, 103 bp, Artificial Sequence
  Synthetic Polynucleotide
taatacgactcactataggggcatcattcgctaagaaaacagtattaatgaacagaggagacattaaatgtgttttcttaacctggcggcagcgcaaaagatg

SEQ ID NO: 52323 - DNA, 103 bp, Artificial Sequence
  Synthetic Polynucleotide
taatacgactcactatagggggtctgcatcattcgctaagaaaacagtataacagaggagaatactgatgtcttagcgaaacctggcggcagcgcaaaagatg

SEQ ID NO: 52324 - DNA, 103 bp, Artificial Sequence
  Synthetic Polynucleotide
taatacgactcactatagggagaagggtctgcatcattcgctaagaaaacaacagaggagagttttcatggcgaatgataacctggcggcagcgcaaaagatg

SEQ ID NO: 52325 - DNA, 103 bp, Artificial Sequence
  Synthetic Polynucleotide
taatacgactcactatagggttaagtttatcatgaatgtgtataataaagaacagaggagactttatatgacacattcaaacctggcggcagcgcaaaagatg

SEQ ID NO: 52326 - DNA, 103 bp, Artificial Sequence
  Synthetic Polynucleotide
taatacgactcactataggggacgtagaagggtctgcatcattcgctaagaacagaggagacttagcatgtgatgcagaaacctggcggcagcgcaaaagatg

SEQ ID NO: 52327 - DNA, 103 bp, Artificial Sequence
  Synthetic Polynucleotide
taatacgactcactatagggttgatgacgtagaagggtctgcatcattcgaacagaggagacgaatgatgcagacccttaacctggcggcagcgcaaaagatg

SEQ ID NO: 52328 - DNA, 103 bp, Artificial Sequence
  Synthetic Polynucleotide
taatacgactcactatagggtatttttgatgacgtagaagggtctgcatcaacagaggagagatgcaatgccttctacgaacctggcggcagcgcaaaagatg

SEQ ID NO: 52329 - DNA, 103 bp, Artificial Sequence
  Synthetic Polynucleotide
taatacgactcactatagggttttctatttttgatgacgtagaagggtctaacagaggagaagacccatgtacgtcatcaacctggcggcagcgcaaaagatg

SEQ ID NO: 52330 - DNA, 103 bp, Artificial Sequence
  Synthetic Polynucleotide
taatacgactcactatagggacgagttttctatttttgatgacgtagaagaacagaggagacttctaatgcatcaaaaaaacctggcggcagcgcaaaagatg

SEQ ID NO: 52331 - DNA, 103 bp, Artificial Sequence
  Synthetic Polynucleotide
taatacgactcactatagggtaataacgagttttctatttttgatgacgtaacagaggagaacgtcaatgaaaatagaaaacctggcggcagcgcaaaagatg

SEQ ID NO: 52332 - DNA, 103 bp, Artificial Sequence
  Synthetic Polynucleotide
taatacgactcactatagggatagttaataacgagttttctatttttgataacagaggagaatcaaaatgagaaaactcaacctggcggcagcgcaaaagatg

SEQ ID NO: 52333 - DNA, 103 bp, Artificial Sequence
  Synthetic Polynucleotide
taatacgactcactatagggcgtacatagttaataacgagttttctatttaacagaggagaaaatagatgactcgttataacctggcggcagcgcaaaagatg

SEQ ID NO: 52334 - DNA, 103 bp, Artificial Sequence
  Synthetic Polynucleotide
taatacgactcactatagggatgttcgtacatagttaataacgagttttcaacagaggagagaaaacatgttattaactaacctggcggcagcgcaaaagatg

SEQ ID NO: 52335 - DNA, 103 bp, Artificial Sequence
  Synthetic Polynucleotide
taatacgactcactatagggggcctatgttcgtacatagttaataacgagaacagaggagactcgttatgaactatgtaaacctggcggcagcgcaaaagatg

SEQ ID NO: 52336 - DNA, 103 bp, Artificial Sequence
  Synthetic Polynucleotide
taatacgactcactatagggtttcattaagtttatcatgaatgtgtataaaacagaggagattatacatgttcatgataaacctggcggcagcgcaaaagatg

SEQ ID NO: 52337 - DNA, 103 bp, Artificial Sequence
  Synthetic Polynucleotide
taatacgactcactatagggtaggaggcctatgttcgtacatagttaataaacagaggagatattaaatgtgtacgaacaacctggcggcagcgcaaaagatg

SEQ ID NO: 52338 - DNA, 103 bp, Artificial Sequence
  Synthetic Polynucleotide
taatacgactcactatagggcaaactaggaggcctatgttcgtacatagtaacagaggagaactatgatggaacataggaacctggcggcagcgcaaaagatg

SEQ ID NO: 52339 - DNA, 103 bp, Artificial Sequence
  Synthetic Polynucleotide
taatacgactcactataggggtctccaaactaggaggcctatgttcgtacaacagaggagagtacgaatgtaggcctccaacctggcggcagcgcaaaagatg

SEQ ID NO: 52340 - DNA, 103 bp, Artificial Sequence
  Synthetic Polynucleotide
taatacgactcactatagggaattagtctccaaactaggaggcctatgttaacagaggagaaacataatgctcctagttaacctggcggcagcgcaaaagatg

SEQ ID NO: 52341 - DNA, 103 bp, Artificial Sequence
  Synthetic Polynucleotide
taatacgactcactatagggaaaagaattagtctccaaactaggaggcctaacagaggagaaggcctatgagtttggagaacctggcggcagcgcaaaagatg

SEQ ID NO: 52342 - DNA, 103 bp, Artificial Sequence
  Synthetic Polynucleotide
taatacgactcactatagggaatgaaaaagaattagtctccaaactaggaaacagaggagatcctagatgggagactaaaacctggcggcagcgcaaaagatg

SEQ ID NO: 52343 - DNA, 103 bp, Artificial Sequence
  Synthetic Polynucleotide
taatacgactcactatagggtagttaatgaaaaagaattagtctccaaacaacagaggagagtttggatgctaattcttaacctggcggcagcgcaaaagatg

SEQ ID NO: 52344 - DNA, 103 bp, Artificial Sequence
  Synthetic Polynucleotide
taatacgactcactatagggacgtctagttaatgaaaaagaattagtctcaacagaggagagagactatgtctttttcaaacctggcggcagcgcaaaagatg

SEQ ID NO: 52345 - DNA, 103 bp, Artificial Sequence
  Synthetic Polynucleotide
taatacgactcactatagggaataaacgtctagttaatgaaaaagaattaaacagaggagataattcatgttcattaacaacctggcggcagcgcaaaagatg

SEQ ID NO: 52346 - DNA, 103 bp, Artificial Sequence
  Synthetic Polynucleotide
taatacgactcactatagggttgagaataaacgtctagttaatgaaaaagaacagaggagactttttatgtaactagacaacctggcggcagcgcaaaagatg

SEQ ID NO: 52347 - DNA, 103 bp, Artificial Sequence
  Synthetic Polynucleotide
taatacgactcactatagggtaaacatgaattgaaaccaaggagttagttaacagaggagaaactaaatgcttggtttcaacctggcggcagcgcaaaagatg

SEQ ID NO: 52348 - DNA, 103 bp, Artificial Sequence
  Synthetic Polynucleotide
taatacgactcactatagggacatttttcattaagtttatcatgaatgtgaacagaggagacacattatggataaacttaacctggcggcagcgcaaaagatg

SEQ ID NO: 52349 - DNA, 103 bp, Artificial Sequence
  Synthetic Polynucleotide
taatacgactcactataggggctatttgagaataaacgtctagttaatgaaacagaggagatcattaatgagacgtttaaacctggcggcagcgcaaaagatg

SEQ ID NO: 52350 - DNA, 103 bp, Artificial Sequence
  Synthetic Polynucleotide
taatacgactcactatagggcaatcgctatttgagaataaacgtctagttaacagaggagaaactagatgtttattctcaacctggcggcagcgcaaaagatg

SEQ ID NO: 52351 - DNA, 103 bp, Artificial Sequence
  Synthetic Polynucleotide
taatacgactcactatagggaacaccaatcgctatttgagaataaacgtcaacagaggagagacgttatgtctcaaataaacctggcggcagcgcaaaagatg

SEQ ID NO: 52352 - DNA, 103 bp, Artificial Sequence
  Synthetic Polynucleotide
taatacgactcactatagggcttacaacaccaatcgctatttgagaataaaacagaggagattattcatgaatagcgataacctggcggcagcgcaaaagatg

SEQ ID NO: 52353 - DNA, 103 bp, Artificial Sequence
  Synthetic Polynucleotide
taatacgactcactatagggggatccttacaacaccaatcgctatttgagaacagaggagactcaaaatgcgattggtgaacctggcggcagcgcaaaagatg

SEQ ID NO: 52354 - DNA, 103 bp, Artificial Sequence
  Synthetic Polynucleotide
taatacgactcactataggggaccaggatccttacaacaccaatcgctataacagaggagaatagcgatgggtgttgtaaacctggcggcagcgcaaaagatg

SEQ ID NO: 52355 - DNA, 103 bp, Artificial Sequence
  Synthetic Polynucleotide
taatacgactcactatagggactacgaccaggatccttacaacaccaatcaacagaggagagattggatgtgtaaggataacctggcggcagcgcaaaagatg

SEQ ID NO: 52356 - DNA, 103 bp, Artificial Sequence
  Synthetic Polynucleotide
taatacgactcactatagggaacttactacgaccaggatccttacaacacaacagaggagagtgttgatgggatcctggaacctggcggcagcgcaaaagatg

SEQ ID NO: 52357 - DNA, 103 bp, Artificial Sequence
  Synthetic Polynucleotide
taatacgactcactatagggtggttaacttactacgaccaggatccttacaacagaggagagtaaggatgctggtcgtaaacctggcggcagcgcaaaagatg

SEQ ID NO: 52358 - DNA, 103 bp, Artificial Sequence
  Synthetic Polynucleotide
taatacgactcactatagggcatgttggttaacttactacgaccaggatcaacagaggagagatcctatgcgtagtaagaacctggcggcagcgcaaaagatg

SEQ ID NO: 52359 - DNA, 103 bp, Artificial Sequence
  Synthetic Polynucleotide
taatacgactcactatagggcgaaaacatttttcattaagtttatcatgaaacagaggagatcatgaatgacttaatgaaacctggcggcagcgcaaaagatg

SEQ ID NO: 52360 - DNA, 103 bp, Artificial Sequence
  Synthetic Polynucleotide
taatacgactcactatagggttcaccatgttggttaacttactacgaccaaacagaggagatggtcgatgtaagttaacaacctggcggcagcgcaaaagatg

SEQ ID NO: 52361 - DNA, 103 bp, Artificial Sequence
  Synthetic Polynucleotide
taatacgactcactatagggaagaattcaccatgttggttaacttactacaacagaggagagtagtaatgtaaccaacaaacctggcggcagcgcaaaagatg

SEQ ID NO: 52362 - DNA, 103 bp, Artificial Sequence
  Synthetic Polynucleotide
taatacgactcactatagggtgtgcaagaattcaccatgttggttaacttaacagaggagaaagttaatgaacatggtgaacctggcggcagcgcaaaagatg

SEQ ID NO: 52363 - DNA, 103 bp, Artificial Sequence
  Synthetic Polynucleotide
taatacgactcactatagggaatagtgtgcaagaattcaccatgttggttaacagaggagaaaccaaatgggtgaattcaacctggcggcagcgcaaaagatg

SEQ ID NO: 52364 - DNA, 103 bp, Artificial Sequence
  Synthetic Polynucleotide
taatacgactcactatagggtcgtcaatagtgtgcaagaattcaccatgtaacagaggagaacatggatgattcttgcaaacctggcggcagcgcaaaagatg

SEQ ID NO: 52365 - DNA, 103 bp, Artificial Sequence
  Synthetic Polynucleotide
taatacgactcactatagggacctatcgtcaatagtgtgcaagaattcacaacagaggagagtgaatatgtgcacactaaacctggcggcagcgcaaaagatg

SEQ ID NO: 52366 - DNA, 103 bp, Artificial Sequence
  Synthetic Polynucleotide
taatacgactcactataggggctacacctatcgtcaatagtgtgcaagaaaacagaggagattcttgatgactattgacaacctggcggcagcgcaaaagatg

SEQ ID NO: 52367 - DNA, 103 bp, Artificial Sequence
  Synthetic Polynucleotide
taatacgactcactatagggtatcggctacacctatcgtcaatagtgtgcaacagaggagagcacacatgtgacgatagaacctggcggcagcgcaaaagatg

SEQ ID NO: 52368 - DNA, 103 bp, Artificial Sequence
  Synthetic Polynucleotide
taatacgactcactatagggttgtttatcggctacacctatcgtcaatagaacagaggagactattgatgataggtgtaaacctggcggcagcgcaaaagatg

SEQ ID NO: 52369 - DNA, 103 bp, Artificial Sequence
  Synthetic Polynucleotide
taatacgactcactatagggatgatttgtttatcggctacacctatcgtcaacagaggagagacgatatgtgtagccgaaacctggcggcagcgcaaaagatg

SEQ ID NO: 52370 - DNA, 103 bp, Artificial Sequence
  Synthetic Polynucleotide
taatacgactcactatagggaacaacgaaaacatttttcattaagtttataacagaggagaataaacatgatgaaaaataacctggcggcagcgcaaaagatg

SEQ ID NO: 52371 - DNA, 103 bp, Artificial Sequence
  Synthetic Polynucleotide
taatacgactcactatagggataagatgatttgtttatcggctacacctaaacagaggagataggtgatgccgataaacaacctggcggcagcgcaaaagatg

SEQ ID NO: 52372 - DNA, 103 bp, Artificial Sequence
  Synthetic Polynucleotide
taatacgactcactatagggaaaccataagatgatttgtttatcggctacaacagaggagagtagccatgaaacaaatcaacctggcggcagcgcaaaagatg

SEQ ID NO: 52373 - DNA, 103 bp, Artificial Sequence
  Synthetic Polynucleotide
taatacgactcactatagggttaaaaaaccataagatgatttgtttatcgaacagaggagacgataaatgaatcatcttaacctggcggcagcgcaaaagatg

SEQ ID NO: 52374 - DNA, 103 bp, Artificial Sequence
  Synthetic Polynucleotide
taatacgactcactatagggttgcgttaaaaaaccataagatgatttgttaacagaggagaaacaaaatgtcttatggtaacctggcggcagcgcaaaagatg

SEQ ID NO: 52375 - DNA, 103 bp, Artificial Sequence
  Synthetic Polynucleotide
taatacgactcactataggggaccattgcgttaaaaaaccataagatgataacagaggagaatcatcatgtggttttttaacctggcggcagcgcaaaagatg

SEQ ID NO: 52376 - DNA, 103 bp, Artificial Sequence
  Synthetic Polynucleotide
taatacgactcactatagggtctaagaccattgcgttaaaaaaccataagaacagaggagacttatgatgttttaacgcaacctggcggcagcgcaaaagatg

SEQ ID NO: 52377 - DNA, 103 bp, Artificial Sequence
  Synthetic Polynucleotide
taatacgactcactatagggttttatctaagaccattgcgttaaaaaaccaacagaggagaggttttatgacgcaatggaacctggcggcagcgcaaaagatg

SEQ ID NO: 52378 - DNA, 103 bp, Artificial Sequence
  Synthetic Polynucleotide
taatacgactcactatagggtaattttttatctaagaccattgcgttaaaaacagaggagatttaacatgatggtcttaaacctggcggcagcgcaaaagatg

SEQ ID NO: 52379 - DNA, 103 bp, Artificial Sequence
  Synthetic Polynucleotide
taatacgactcactataggggtatataattttttatctaagaccattgcgaacagaggagacgcaatatgcttagataaaacctggcggcagcgcaaaagatg

SEQ ID NO: 52380 - DNA, 103 bp, Artificial Sequence
  Synthetic Polynucleotide
taatacgactcactataggggttcagtatataattttttatctaagaccaaacagaggagatggtctatgataaaaaataacctggcggcagcgcaaaagatg

SEQ ID NO: 52381 - DNA, 103 bp, Artificial Sequence
  Synthetic Polynucleotide
taatacgactcactatagggacttaaacaacgaaaacatttttcattaagaacagaggagacttaatatgaaatgttttaacctggcggcagcgcaaaagatg

SEQ ID NO: 52382 - DNA, 103 bp, Artificial Sequence
  Synthetic Polynucleotide
taatacgactcactatagggtactcgttcagtatataattttttatctaaaacagaggagattagatatgaaattatataacctggcggcagcgcaaaagatg

SEQ ID NO: 52383 - DNA, 103 bp, Artificial Sequence
  Synthetic Polynucleotide
taatacgactcactatagggcgtcctactcgttcagtatataattttttaaacagaggagataaaaaatgatatactgaaacctggcggcagcgcaaaagatg

SEQ ID NO: 52384 - DNA, 103 bp, Artificial Sequence
  Synthetic Polynucleotide
taatacgactcactatagggagatccgtcctactcgttcagtatataattaacagaggagaaattatatgctgaacgagaacctggcggcagcgcaaaagatg

SEQ ID NO: 52385 - DNA, 103 bp, Artificial Sequence
  Synthetic Polynucleotide
taatacgactcactatagggtggtaagatccgtcctactcgttcagtataaacagaggagatatactatgcgagtaggaaacctggcggcagcgcaaaagatg

SEQ ID NO: 52386 - DNA, 103 bp, Artificial Sequence
  Synthetic Polynucleotide
taatacgactcactataggggaagatggtaagatccgtcctactcgttcaaacagaggagatgaacgatgaggacggataacctggcggcagcgcaaaagatg

SEQ ID NO: 52387 - DNA, 103 bp, Artificial Sequence
  Synthetic Polynucleotide
taatacgactcactatagggtcaaagaagatggtaagatccgtcctactcaacagaggagagagtagatgggatcttacaacctggcggcagcgcaaaagatg

SEQ ID NO: 52388 - DNA, 103 bp, Artificial Sequence
  Synthetic Polynucleotide
taatacgactcactatagggattaatcaaagaagatggtaagatccgtccaacagaggagaggacggatgttaccatctaacctggcggcagcgcaaaagatg

SEQ ID NO: 52389 - DNA, 103 bp, Artificial Sequence
  Synthetic Polynucleotide
taatacgactcactatagggaaatcattaatcaaagaagatggtaagatcaacagaggagagatcttatgatcttctttaacctggcggcagcgcaaaagatg

SEQ ID NO: 52390 - DNA, 103 bp, Artificial Sequence
  Synthetic Polynucleotide
taatacgactcactatagggtttctaaatcattaatcaaagaagatggtaaacagaggagataccatatgctttgattaaacctggcggcagcgcaaaagatg

SEQ ID NO: 52391 - DNA, 103 bp, Artificial Sequence
  Synthetic Polynucleotide
taatacgactcactatagggcttcatttctaaatcattaatcaaagaagaaacagaggagatcttctatgattaatgataacctggcggcagcgcaaaagatg

SEQ ID NO: 52392 - DNA, 103 bp, Artificial Sequence
  Synthetic Polynucleotide
taatacgactcactatagggatccaacttaaacaacgaaaacatttttcaaacagaggagatgaaaaatgttttcgttgaacctggcggcagcgcaaaagatg

SEQ ID NO: 52393 - DNA, 103 bp, Artificial Sequence
  Synthetic Polynucleotide
taatacgactcactatagggcataacttcatttctaaatcattaatcaaaaacagaggagatttgatatgtgatttagaaacctggcggcagcgcaaaagatg

SEQ ID NO: 52394 - DNA, 103 bp, Artificial Sequence
  Synthetic Polynucleotide
taatacgactcactatagggaatgtcataacttcatttctaaatcattaaaacagaggagattaatgatgtagaaatgaaacctggcggcagcgcaaaagatg

SEQ ID NO: 52395 - DNA, 103 bp, Artificial Sequence
  Synthetic Polynucleotide
taatacgactcactatagggtgatgaatgtcataacttcatttctaaatcaacagaggagagatttaatgatgaagttaaacctggcggcagcgcaaaagatg

SEQ ID NO: 52396 - DNA, 103 bp, Artificial Sequence
  Synthetic Polynucleotide
taatacgactcactatagggatcattgatgaatgtcataacttcatttctaacagaggagaagaaatatggttatgacaaacctggcggcagcgcaaaagatg

SEQ ID NO: 52397 - DNA, 103 bp, Artificial Sequence
  Synthetic Polynucleotide
taatacgactcactataggggcgtcatcattgatgaatgtcataacttcaaacagaggagatgaagtatggacattcataacctggcggcagcgcaaaagatg

SEQ ID NO: 52398 - DNA, 103 bp, Artificial Sequence
  Synthetic Polynucleotide
taatacgactcactatagggaatatgcgtcatcattgatgaatgtcataaaacagaggagattatgaatgtcatcaatgaacctggcggcagcgcaaaagatg

SEQ ID NO: 52399 - DNA, 103 bp, Artificial Sequence
  Synthetic Polynucleotide
taatacgactcactatagggagtagaatatgcgtcatcattgatgaatgtaacagaggagaacattcatgaatgatgacaacctggcggcagcgcaaaagatg

SEQ ID NO: 52400 - DNA, 103 bp, Artificial Sequence
  Synthetic Polynucleotide
taatacgactcactatagggccaagagtagaatatgcgtcatcattgatgaacagaggagacatcaaatgtgacgcataaacctggcggcagcgcaaaagatg

SEQ ID NO: 52401 - DNA, 103 bp, Artificial Sequence
  Synthetic Polynucleotide
taatacgactcactatagggtaattccaagagtagaatatgcgtcatcataacagaggagaatgatgatgcatattctaaacctggcggcagcgcaaaagatg

SEQ ID NO: 52402 - DNA, 103 bp, Artificial Sequence
  Synthetic Polynucleotide
taatacgactcactatagggactattaattccaagagtagaatatgcgtcaacagaggagagacgcaatgtctactcttaacctggcggcagcgcaaaagatg

SEQ ID NO: 52403 - DNA, 103 bp, Artificial Sequence
  Synthetic Polynucleotide
taatacgactcactatagggtattcatccaacttaaacaacgaaaacattaacagaggagaaatgttatggttgtttaaaacctggcggcagcgcaaaagatg

SEQ ID NO: 52404 - DNA, 103 bp, Artificial Sequence
  Synthetic Polynucleotide
taatacgactcactatagggtcaaaactattaattccaagagtagaatataacagaggagaatattcatgtcttggaataacctggcggcagcgcaaaagatg

SEQ ID NO: 52405 - DNA, 103 bp, Artificial Sequence
  Synthetic Polynucleotide
taatacgactcactatagggtaatatcaaaactattaattccaagagtagaacagaggagactactcatggaattaataaacctggcggcagcgcaaaagatg

SEQ ID NO: 52406 - DNA, 103 bp, Artificial Sequence
  Synthetic Polynucleotide
taatacgactcactatagggtttactaatatcaaaactattaattccaagaacagaggagacttggaatgaatagttttaacctggcggcagcgcaaaagatg

SEQ ID NO: 52407 - DNA, 103 bp, Artificial Sequence
  Synthetic Polynucleotide
taatacgactcactatagggaattttttactaatatcaaaactattaattaacagaggagaaattaaatgttttgatataacctggcggcagcgcaaaagatg

SEQ ID NO: 52408 - DNA, 103 bp, Artificial Sequence
  Synthetic Polynucleotide
taatacgactcactatagggaaataaattttttactaatatcaaaactataacagaggagaatagttatgatattagtaaacctggcggcagcgcaaaagatg

SEQ ID NO: 52409 - DNA, 103 bp, Artificial Sequence
  Synthetic Polynucleotide
taatacgactcactatagggtttagaaataaattttttactaatatcaaaaacagaggagatttgatatgagtaaaaaaaacctggcggcagcgcaaaagatg

SEQ ID NO: 52410 - DNA, 103 bp, Artificial Sequence
  Synthetic Polynucleotide
taatacgactcactatagggaaaattttagaaataaattttttactaataaacagaggagatattagatgaaaatttataacctggcggcagcgcaaaagatg

SEQ ID NO: 52411 - DNA, 103 bp, Artificial Sequence
  Synthetic Polynucleotide
taatacgactcactatagggtgatcaaaattttagaaataaattttttacaacagaggagagtaaaaatgttatttctaaacctggcggcagcgcaaaagatg

SEQ ID NO: 52412 - DNA, 103 bp, Artificial Sequence
  Synthetic Polynucleotide
taatacgactcactatagggtacgatgatcaaaattttagaaataaatttaacagaggagaaaatttatgtctaaaattaacctggcggcagcgcaaaagatg

SEQ ID NO: 52413 - DNA, 103 bp, Artificial Sequence
  Synthetic Polynucleotide
taatacgactcactatagggttaattacgatgatcaaaattttagaaataaacagaggagatatttcatgaattttgataacctggcggcagcgcaaaagatg

SEQ ID NO: 52414 - DNA, 103 bp, Artificial Sequence
  Synthetic Polynucleotide
taatacgactcactatagggcatactattcatccaacttaaacaacgaaaaacagaggagatttcgtatgttaagttggaacctggcggcagcgcaaaagatg

SEQ ID NO: 52415 - DNA, 103 bp, Artificial Sequence
  Synthetic Polynucleotide
taatacgactcactatagggttttattaattacgatgatcaaaattttagaacagaggagactaaaaatgtgatcatcgaacctggcggcagcgcaaaagatg

SEQ ID NO: 52416 - DNA, 103 bp, Artificial Sequence
  Synthetic Polynucleotide
taatacgactcactatagggtgtatttttattaattacgatgatcaaaataacagaggagaattttgatgatcgtaattaacctggcggcagcgcaaaagatg

SEQ ID NO: 52417 - DNA, 103 bp, Artificial Sequence
  Synthetic Polynucleotide
taatacgactcactatagggaggattgtatttttattaattacgatgatcaacagaggagagatcatatgaattaataaaacctggcggcagcgcaaaagatg

SEQ ID NO: 52418 - DNA, 103 bp, Artificial Sequence
  Synthetic Polynucleotide
taatacgactcactatagggaacgaaggattgtatttttattaattacgaaacagaggagatcgtaaatgataaaaataaacctggcggcagcgcaaaagatg

SEQ ID NO: 52419 - DNA, 103 bp, Artificial Sequence
  Synthetic Polynucleotide
taatacgactcactataggggagataacgaaggattgtatttttattaataacagaggagaattaatatgaatacaatcaacctggcggcagcgcaaaagatg

SEQ ID NO: 52420 - DNA, 103 bp, Artificial Sequence
  Synthetic Polynucleotide
taatacgactcactatagggctccagagataacgaaggattgtatttttaaacagaggagataaaaaatgaatccttcgaacctggcggcagcgcaaaagatg

SEQ ID NO: 52421 - DNA, 103 bp, Artificial Sequence
  Synthetic Polynucleotide
taatacgactcactatagggatacgctccagagataacgaaggattgtataacagaggagaatacaaatgttcgttatcaacctggcggcagcgcaaaagatg

SEQ ID NO: 52422 - DNA, 103 bp, Artificial Sequence
  Synthetic Polynucleotide
taatacgactcactatagggctcagatacgctccagagataacgaaggataacagaggagaatccttatgtatctctggaacctggcggcagcgcaaaagatg

SEQ ID NO: 52423 - DNA, 103 bp, Artificial Sequence
  Synthetic Polynucleotide
taatacgactcactatagggctatactcagatacgctccagagataacgaaacagaggagatcgttaatgctggagcgtaacctggcggcagcgcaaaagatg

SEQ ID NO: 52424 - DNA, 103 bp, Artificial Sequence
  Synthetic Polynucleotide
taatacgactcactataggggaacactatactcagatacgctccagagataacagaggagaatctctatggcgtatctgaacctggcggcagcgcaaaagatg

SEQ ID NO: 52425 - DNA, 103 bp, Artificial Sequence
  Synthetic Polynucleotide
taatacgactcactatagggtaagacatactattcatccaacttaaacaaaacagaggagattgtttatgttggatgaaaacctggcggcagcgcaaaagatg

SEQ ID NO: 52426 - DNA, 103 bp, Artificial Sequence
  Synthetic Polynucleotide
taatacgactcactatagggtggatgaacactatactcagatacgctccaaacagaggagatggagcatgtctgagtataacctggcggcagcgcaaaagatg

SEQ ID NO: 52427 - DNA, 103 bp, Artificial Sequence
  Synthetic Polynucleotide
taatacgactcactatagggatccttggatgaacactatactcagatacgaacagaggagacgtatcatggtatagtgtaacctggcggcagcgcaaaagatg

SEQ ID NO: 52428 - DNA, 103 bp, Artificial Sequence
  Synthetic Polynucleotide
taatacgactcactatagggagaagatccttggatgaacactatactcagaacagaggagactgagtatggtgttcatcaacctggcggcagcgcaaaagatg

SEQ ID NO: 52429 - DNA, 103 bp, Artificial Sequence
  Synthetic Polynucleotide
taatacgactcactatagggttgatagaagatccttggatgaacactataaacagaggagatatagtatgcatccaaggaacctggcggcagcgcaaaagatg

SEQ ID NO: 52430 - DNA, 103 bp, Artificial Sequence
  Synthetic Polynucleotide
taatacgactcactatagggaagctttgatagaagatccttggatgaacaaacagaggagatgttcaatgaaggatcttaacctggcggcagcgcaaaagatg

SEQ ID NO: 52431 - DNA, 103 bp, Artificial Sequence
  Synthetic Polynucleotide
taatacgactcactataggggaaaaaagctttgatagaagatccttggataacagaggagaatccaaatgtcttctatcaacctggcggcagcgcaaaagatg

SEQ ID NO: 52432 - DNA, 103 bp, Artificial Sequence
  Synthetic Polynucleotide
taatacgactcactatagggttagtgaaaaaagctttgatagaagatcctaacagaggagaaggatcatgtatcaaagcaacctggcggcagcgcaaaagatg

SEQ ID NO: 52433 - DNA, 103 bp, Artificial Sequence
  Synthetic Polynucleotide
taatacgactcactatagggtcttattagtgaaaaaagctttgatagaagaacagaggagacttctaatgaagctttttaacctggcggcagcgcaaaagatg

SEQ ID NO: 52434 - DNA, 103 bp, Artificial Sequence
  Synthetic Polynucleotide
taatacgactcactatagggtattatcttattagtgaaaaaagctttgataacagaggagaatcaaaatgtttttcactaacctggcggcagcgcaaaagatg

SEQ ID NO: 52435 - DNA, 103 bp, Artificial Sequence
  Synthetic Polynucleotide
taatacgactcactatagggtgggctattatcttattagtgaaaaaagctaacagaggagaagctttatgcactaataaaacctggcggcagcgcaaaagatg

SEQ ID NO: 52436 - DNA, 103 bp, Artificial Sequence
  Synthetic Polynucleotide
taatacgactcactatagggattattaagacatactattcatccaacttaaacagaggagataagttatgtgaatagtaaacctggcggcagcgcaaaagatg

SEQ ID NO: 52437 - DNA, 103 bp, Artificial Sequence
  Synthetic Polynucleotide
taatacgactcactatagggcgaattgggctattatcttattagtgaaaaaacagaggagattttcaatgataagataaaacctggcggcagcgcaaaagatg

SEQ ID NO: 52438 - DNA, 103 bp, Artificial Sequence
  Synthetic Polynucleotide
taatacgactcactatagggttatacgaattgggctattatcttattagtaacagaggagaactaatatgataatagccaacctggcggcagcgcaaaagatg

SEQ ID NO: 52439 - DNA, 103 bp, Artificial Sequence
  Synthetic Polynucleotide
taatacgactcactataggggatatttatacgaattgggctattatcttaaacagaggagataagatatgagcccaattaacctggcggcagcgcaaaagatg

SEQ ID NO: 52440 - DNA, 103 bp, Artificial Sequence
  Synthetic Polynucleotide
taatacgactcactatagggttaaggatatttatacgaattgggctattaaacagaggagataatagatgaattcgtataacctggcggcagcgcaaaagatg

SEQ ID NO: 52441 - DNA, 103 bp, Artificial Sequence
  Synthetic Polynucleotide
taatacgactcactatagggacatcttaaggatatttatacgaattgggcaacagaggagagcccaaatggtataaataaacctggcggcagcgcaaaagatg

SEQ ID NO: 52442 - DNA, 103 bp, Artificial Sequence
  Synthetic Polynucleotide
taatacgactcactatagggctcaaacatcttaaggatatttatacgaataacagaggagaattcgtatgaatatccttaacctggcggcagcgcaaaagatg

SEQ ID NO: 52443 - DNA, 103 bp, Artificial Sequence
  Synthetic Polynucleotide
taatacgactcactatagggatattctcaaacatcttaaggatatttataaacagaggagatataaaatgccttaagataacctggcggcagcgcaaaagatg

SEQ ID NO: 52444 - DNA, 103 bp, Artificial Sequence
  Synthetic Polynucleotide
taatacgactcactatagggtgtatatattctcaaacatcttaaggatataacagaggagaatatccatgagatgtttgaacctggcggcagcgcaaaagatg

SEQ ID NO: 52445 - DNA, 103 bp, Artificial Sequence
  Synthetic Polynucleotide
taatacgactcactatagggactactgtatatattctcaaacatcttaagaacagaggagacttaagatgtttgagaataacctggcggcagcgcaaaagatg

SEQ ID NO: 52446 - DNA, 103 bp, Artificial Sequence
  Synthetic Polynucleotide
taatacgactcactatagggcaatgactactgtatatattctcaaacatcaacagaggagagatgttatggaatatataaacctggcggcagcgcaaaagatg

SEQ ID NO: 52447 - DNA, 103 bp, Artificial Sequence
  Synthetic Polynucleotide
taatacgactcactatagggtaacaattattaagacatactattcatccaaacagaggagatggatgatgagtatgtctaacctggcggcagcgcaaaagatg

SEQ ID NO: 52448 - DNA, 103 bp, Artificial Sequence
  Synthetic Polynucleotide
taatacgactcactatagggtaaaacaatgactactgtatatattctcaaaacagaggagattgagaatgtatacagtaaacctggcggcagcgcaaaagatg

SEQ ID NO: 52449 - DNA, 103 bp, Artificial Sequence
  Synthetic Polynucleotide
taatacgactcactataggggtcggtaaaacaatgactactgtatatattaacagaggagaaatataatgagtagtcataacctggcggcagcgcaaaagatg

SEQ ID NO: 52450 - DNA, 103 bp, Artificial Sequence
  Synthetic Polynucleotide
taatacgactcactatagggcaggtgtcggtaaaacaatgactactgtataacagaggagaatacagatgtcattgtttaacctggcggcagcgcaaaagatg

SEQ ID NO: 52451 - DNA, 103 bp, Artificial Sequence
  Synthetic Polynucleotide
taatacgactcactatagggtgaaacaggtgtcggtaaaacaatgactacaacagaggagagtagtcatggttttaccgaacctggcggcagcgcaaaagatg

SEQ ID NO: 52452 - DNA, 103 bp, Artificial Sequence
  Synthetic Polynucleotide
taatacgactcactatagggttccatgaaacaggtgtcggtaaaacaatgaacagaggagacattgtatgaccgacaccaacctggcggcagcgcaaaagatg

SEQ ID NO: 52453 - DNA, 103 bp, Artificial Sequence
  Synthetic Polynucleotide
taatacgactcactatagggtattgttccatgaaacaggtgtcggtaaaaaacagaggagattttacatgcacctgtttaacctggcggcagcgcaaaagatg

SEQ ID NO: 52454 - DNA, 103 bp, Artificial Sequence
  Synthetic Polynucleotide
taatacgactcactatagggtcttttattgttccatgaaacaggtgtcggaacagaggagaccgacaatggtttcatggaacctggcggcagcgcaaaagatg

SEQ ID NO: 52455 - DNA, 103 bp, Artificial Sequence
  Synthetic Polynucleotide
taatacgactcactatagggcattctcttttattgttccatgaaacaggtaacagaggagaacctgtatgatggaacaaaacctggcggcagcgcaaaagatg

SEQ ID NO: 52456 - DNA, 103 bp, Artificial Sequence
  Synthetic Polynucleotide
taatacgactcactataggggtatgcattctcttttattgttccatgaaaaacagaggagatttcatatgacaataaaaaacctggcggcagcgcaaaagatg

SEQ ID NO: 52457 - DNA, 103 bp, Artificial Sequence
  Synthetic Polynucleotide
taatacgactcactatagggagacagtatgcattctcttttattgttccaaacagaggagatggaacatgaaaagagaaaacctggcggcagcgcaaaagatg

SEQ ID NO: 52458 - DNA, 103 bp, Artificial Sequence
  Synthetic Polynucleotide
taatacgactcactatagggcattttaaacatgaattgaaaccaaggagtaacagaggagaactcctatgtttcaattcaacctggcggcagcgcaaaagatg

SEQ ID NO: 52459 - DNA, 103 bp, Artificial Sequence
  Synthetic Polynucleotide
taatacgactcactatagggaataataacaattattaagacatactattcaacagaggagagaatagatggtcttaataaacctggcggcagcgcaaaagatg

SEQ ID NO: 52460 - DNA, 103 bp, Artificial Sequence
  Synthetic Polynucleotide
taatacgactcactatagggggattagacagtatgcattctcttttattgaacagaggagacaataaatgagaatgcataacctggcggcagcgcaaaagatg

SEQ ID NO: 52461 - DNA, 103 bp, Artificial Sequence
  Synthetic Polynucleotide
taatacgactcactatagggtcttaggattagacagtatgcattctctttaacagaggagaaaagagatggcatactgtaacctggcggcagcgcaaaagatg

SEQ ID NO: 52462 - DNA, 103 bp, Artificial Sequence
  Synthetic Polynucleotide
taatacgactcactatagggagttttcttaggattagacagtatgcattcaacagaggagagaatgcatgctgtctaataacctggcggcagcgcaaaagatg

SEQ ID NO: 52463 - DNA, 103 bp, Artificial Sequence
  Synthetic Polynucleotide
taatacgactcactataggggcaagagttttcttaggattagacagtatgaacagaggagacatactatgtaatcctaaaacctggcggcagcgcaaaagatg

SEQ ID NO: 52464 - DNA, 103 bp, Artificial Sequence
  Synthetic Polynucleotide
taatacgactcactatagggttgtagcaagagttttcttaggattagacaaacagaggagatgtctaatgctaagaaaaaacctggcggcagcgcaaaagatg

SEQ ID NO: 52465 - DNA, 103 bp, Artificial Sequence
  Synthetic Polynucleotide
taatacgactcactatagggacattttgtagcaagagttttcttaggattaacagaggagaaatcctatgaaaactcttaacctggcggcagcgcaaaagatg

SEQ ID NO: 52466 - DNA, 103 bp, Artificial Sequence
  Synthetic Polynucleotide
taatacgactcactatagggtatcaacattttgtagcaagagttttcttaaacagaggagataagaaatgtcttgctacaacctggcggcagcgcaaaagatg

SEQ ID NO: 52467 - DNA, 103 bp, Artificial Sequence
  Synthetic Polynucleotide
taatacgactcactatagggaggattatcaacattttgtagcaagagtttaacagaggagaaaactcatgctacaaaataacctggcggcagcgcaaaagatg

SEQ ID NO: 52468 - DNA, 103 bp, Artificial Sequence
  Synthetic Polynucleotide
taatacgactcactatagggcctcaaggattatcaacattttgtagcaagaacagaggagacttgctatgaaatgttgaaacctggcggcagcgcaaaagatg

SEQ ID NO: 52469 - DNA, 103 bp, Artificial Sequence
  Synthetic Polynucleotide
taatacgactcactataggggtacgcctcaaggattatcaacattttgtaaacagaggagatacaaaatgttgataatcaacctggcggcagcgcaaaagatg

SEQ ID NO: 52470 - DNA, 103 bp, Artificial Sequence
  Synthetic Polynucleotide
taatacgactcactatagggagtgaaataataacaattattaagacatacaacagaggagagtatgtatgaataattgtaacctggcggcagcgcaaaagatg

SEQ ID NO: 52471 - DNA, 103 bp, Artificial Sequence
  Synthetic Polynucleotide
taatacgactcactatagggacgtagtacgcctcaaggattatcaacattaacagaggagaaatgttatgaatccttgaaacctggcggcagcgcaaaagatg

SEQ ID NO: 52472 - DNA, 103 bp, Artificial Sequence
  Synthetic Polynucleotide
taatacgactcactatagggaacagacgtagtacgcctcaaggattatcaaacagaggagatgataaatgttgaggcgtaacctggcggcagcgcaaaagatg

SEQ ID NO: 52473 - DNA, 103 bp, Artificial Sequence
  Synthetic Polynucleotide
taatacgactcactatagggatgggaacagacgtagtacgcctcaaggataacagaggagaatccttatggcgtactacaacctggcggcagcgcaaaagatg

SEQ ID NO: 52474 - DNA, 103 bp, Artificial Sequence
  Synthetic Polynucleotide
taatacgactcactatagggaaatgatgggaacagacgtagtacgcctcaaacagaggagatgaggcatgctacgtctgaacctggcggcagcgcaaaagatg

SEQ ID NO: 52475 - DNA, 103 bp, Artificial Sequence
  Synthetic Polynucleotide
taatacgactcactatagggtgttgaaatgatgggaacagacgtagtacgaacagaggagacgtactatgtctgttcccaacctggcggcagcgcaaaagatg

SEQ ID NO: 52476 - DNA, 103 bp, Artificial Sequence
  Synthetic Polynucleotide
taatacgactcactatagggatgcctgttgaaatgatgggaacagacgtaaacagaggagatacgtcatgtcccatcataacctggcggcagcgcaaaagatg

SEQ ID NO: 52477 - DNA, 103 bp, Artificial Sequence
  Synthetic Polynucleotide
taatacgactcactatagggctaatatgcctgttgaaatgatgggaacagaacagaggagactgttcatgtcatttcaaaacctggcggcagcgcaaaagatg

SEQ ID NO: 52478 - DNA, 103 bp, Artificial Sequence
  Synthetic Polynucleotide
taatacgactcactatagggaactactaatatgcctgttgaaatgatgggaacagaggagacccatcatgtcaacaggcaacctggcggcagcgcaaaagatg

SEQ ID NO: 52479 - DNA, 103 bp, Artificial Sequence
  Synthetic Polynucleotide
taatacgactcactatagggcgcagaactactaatatgcctgttgaaatgaacagaggagacatttcatgaggcatattaacctggcggcagcgcaaaagatg

SEQ ID NO: 52480 - DNA, 103 bp, Artificial Sequence
  Synthetic Polynucleotide
taatacgactcactatagggccttgcgcagaactactaatatgcctgttgaacagaggagacaacagatgtattagtagaacctggcggcagcgcaaaagatg

SEQ ID NO: 52481 - DNA, 103 bp, Artificial Sequence
  Synthetic Polynucleotide
taatacgactcactatagggtaattagtgaaataataacaattattaagaaacagaggagatcttaaatgttgttattaaacctggcggcagcgcaaaagatg

SEQ ID NO: 52482 - DNA, 103 bp, Artificial Sequence
  Synthetic Polynucleotide
taatacgactcactatagggttatgccttgcgcagaactactaatatgccaacagaggagaggcataatggtagttctgaacctggcggcagcgcaaaagatg

SEQ ID NO: 52483 - DNA, 103 bp, Artificial Sequence
  Synthetic Polynucleotide
taatacgactcactatagggatcgattatgccttgcgcagaactactaataacagaggagaattagtatgtctgcgcaaaacctggcggcagcgcaaaagatg

SEQ ID NO: 52484 - DNA, 103 bp, Artificial Sequence
  Synthetic Polynucleotide
taatacgactcactatagggcctatatcgattatgccttgcgcagaactaaacagaggagatagttcatggcaaggcataacctggcggcagcgcaaaagatg

SEQ ID NO: 52485 - DNA, 103 bp, Artificial Sequence
  Synthetic Polynucleotide
taatacgactcactatagggtgcggcctatatcgattatgccttgcgcagaacagaggagactgcgcatggcataatcgaacctggcggcagcgcaaaagatg

SEQ ID NO: 52486 - DNA, 103 bp, Artificial Sequence
  Synthetic Polynucleotide
taatacgactcactatagggtcacatgcggcctatatcgattatgccttgaacagaggagacaaggcatgatcgatataaacctggcggcagcgcaaaagatg

SEQ ID NO: 52487 - DNA, 103 bp, Artificial Sequence
  Synthetic Polynucleotide
taatacgactcactataggggtaaatcacatgcggcctatatcgattatgaacagaggagacataatatgtataggccgaacctggcggcagcgcaaaagatg

SEQ ID NO: 52488 - DNA, 103 bp, Artificial Sequence
  Synthetic Polynucleotide
taatacgactcactatagggaatgagtaaatcacatgcggcctatatcgaaacagaggagatcgataatggccgcatgtaacctggcggcagcgcaaaagatg

SEQ ID NO: 52489 - DNA, 103 bp, Artificial Sequence
  Synthetic Polynucleotide
taatacgactcactatagggctataaatgagtaaatcacatgcggcctataacagaggagaataggcatgatgtgatttaacctggcggcagcgcaaaagatg

SEQ ID NO: 52490 - DNA, 103 bp, Artificial Sequence
  Synthetic Polynucleotide
taatacgactcactatagggtatcactataaatgagtaaatcacatgcggaacagaggagaccgcatatgatttactcaaacctggcggcagcgcaaaagatg

SEQ ID NO: 52491 - DNA, 103 bp, Artificial Sequence
  Synthetic Polynucleotide
taatacgactcactatagggttacttatcactataaatgagtaaatcacaaacagaggagatgtgatatgctcatttataacctggcggcagcgcaaaagatg

SEQ ID NO: 52492 - DNA, 103 bp, Artificial Sequence
  Synthetic Polynucleotide
taatacgactcactatagggaatattaattagtgaaataataacaattataacagaggagaataattatgattatttcaaacctggcggcagcgcaaaagatg

SEQ ID NO: 52493 - DNA, 103 bp, Artificial Sequence
  Synthetic Polynucleotide
taatacgactcactatagggagttattacttatcactataaatgagtaaaaacagaggagatttactatgttatagtgaaacctggcggcagcgcaaaagatg

SEQ ID NO: 52494 - DNA, 103 bp, Artificial Sequence
  Synthetic Polynucleotide
taatacgactcactatagggaacatagttattacttatcactataaatgaaacagaggagatcatttatggtgataagtaacctggcggcagcgcaaaagatg

SEQ ID NO: 52495 - DNA, 103 bp, Artificial Sequence
  Synthetic Polynucleotide
taatacgactcactatagggtttaaaacatagttattacttatcactataaacagaggagatatagtatgaagtaataaaacctggcggcagcgcaaaagatg

SEQ ID NO: 52496 - DNA, 103 bp, Artificial Sequence
  Synthetic Polynucleotide
taatacgactcactatagggtgatttttaaaacatagttattacttatcaaacagaggagatgataaatgataactatgaacctggcggcagcgcaaaagatg

SEQ ID NO: 52497 - DNA, 103 bp, Artificial Sequence
  Synthetic Polynucleotide
taatacgactcactatagggtgttatgatttttaaaacatagttattactaacagaggagaagtaatatgtatgttttaaacctggcggcagcgcaaaagatg

SEQ ID NO: 52498 - DNA, 103 bp, Artificial Sequence
  Synthetic Polynucleotide
taatacgactcactatagggactactgttatgatttttaaaacatagttaaacagaggagataactaatgtttaaaaataacctggcggcagcgcaaaagatg

SEQ ID NO: 52499 - DNA, 103 bp, Artificial Sequence
  Synthetic Polynucleotide
taatacgactcactataggggttaaactactgttatgatttttaaaacataacagaggagaatgtttatgaaatcataaaacctggcggcagcgcaaaagatg

SEQ ID NO: 52500 - DNA, 103 bp, Artificial Sequence
  Synthetic Polynucleotide
taatacgactcactataggggactagttaaactactgttatgatttttaaaacagaggagattaaaaatgataacagtaaacctggcggcagcgcaaaagatg

SEQ ID NO: 52501 - DNA, 103 bp, Artificial Sequence
  Synthetic Polynucleotide
taatacgactcactataggggagaagactagttaaactactgttatgattaacagaggagaaatcatatgagtagtttaaacctggcggcagcgcaaaagatg

SEQ ID NO: 52502 - DNA, 103 bp, Artificial Sequence
  Synthetic Polynucleotide
taatacgactcactatagggcatcagagaagactagttaaactactgttaaacagaggagataacagatgtttaactagaacctggcggcagcgcaaaagatg

SEQ ID NO: 52503 - DNA, 103 bp, Artificial Sequence
  Synthetic Polynucleotide
taatacgactcactatagggtactaaatattaattagtgaaataataacaaacagaggagatgttatatgttcactaataacctggcggcagcgcaaaagatg

SEQ ID NO: 52504 - DNA, 103 bp, Artificial Sequence
  Synthetic Polynucleotide
taatacgactcactatagggacaaacatcagagaagactagttaaactacaacagaggagagtagttatgctagtcttcaacctggcggcagcgcaaaagatg

SEQ ID NO: 52505 - DNA, 103 bp, Artificial Sequence
  Synthetic Polynucleotide
taatacgactcactatagggcgaaaacaaacatcagagaagactagttaaaacagaggagattaactatgcttctctgaaacctggcggcagcgcaaaagatg

SEQ ID NO: 52506 - DNA, 103 bp, Artificial Sequence
  Synthetic Polynucleotide
taatacgactcactatagggagtatcgaaaacaaacatcagagaagactaaacagaggagatagtctatgctgatgtttaacctggcggcagcgcaaaagatg

SEQ ID NO: 52507 - DNA, 103 bp, Artificial Sequence
  Synthetic Polynucleotide
taatacgactcactatagggcgaaaagtatcgaaaacaaacatcagagaaaacagaggagattctctatggtttgttttaacctggcggcagcgcaaaagatg

SEQ ID NO: 52508 - DNA, 103 bp, Artificial Sequence
  Synthetic Polynucleotide
taatacgactcactatagggtgattcgaaaagtatcgaaaacaaacatcaaacagaggagatgatgtatgttttcgataaacctggcggcagcgcaaaagatg

SEQ ID NO: 52509 - DNA, 103 bp, Artificial Sequence
  Synthetic Polynucleotide
taatacgactcactatagggacttctgattcgaaaagtatcgaaaacaaaaacagaggagatttgttatggatacttttaacctggcggcagcgcaaaagatg

SEQ ID NO: 52510 - DNA, 103 bp, Artificial Sequence
  Synthetic Polynucleotide
taatacgactcactataggggtatgacttctgattcgaaaagtatcgaaaaacagaggagatttcgaatgttttcgaataacctggcggcagcgcaaaagatg

SEQ ID NO: 52511 - DNA, 103 bp, Artificial Sequence
  Synthetic Polynucleotide
taatacgactcactatagggttctagtatgacttctgattcgaaaagtataacagaggagaatacttatggaatcagaaaacctggcggcagcgcaaaagatg

SEQ ID NO: 52512 - DNA, 103 bp, Artificial Sequence
  Synthetic Polynucleotide
taatacgactcactatagggctttattctagtatgacttctgattcgaaaaacagaggagatttcgaatgagaagtcataacctggcggcagcgcaaaagatg

SEQ ID NO: 52513 - DNA, 103 bp, Artificial Sequence
  Synthetic Polynucleotide
taatacgactcactatagggcgttgctttattctagtatgacttctgattaacagaggagaaatcagatgtcatactagaacctggcggcagcgcaaaagatg

SEQ ID NO: 52514 - DNA, 103 bp, Artificial Sequence
  Synthetic Polynucleotide
taatacgactcactatagggctaattactaaatattaattagtgaaataaaacagaggagattatttatgtaattaataaacctggcggcagcgcaaaagatg

SEQ ID NO: 52515 - DNA, 103 bp, Artificial Sequence
  Synthetic Polynucleotide
taatacgactcactatagggtcactcgttgctttattctagtatgacttcaacagaggagagaagtcatgctagaataaaacctggcggcagcgcaaaagatg

SEQ ID NO: 52516 - DNA, 103 bp, Artificial Sequence
  Synthetic Polynucleotide
taatacgactcactatagggtacgttcactcgttgctttattctagtatgaacagaggagacatactatgataaagcaaaacctggcggcagcgcaaaagatg

SEQ ID NO: 52517 - DNA, 103 bp, Artificial Sequence
  Synthetic Polynucleotide
taatacgactcactatagggtctattacgttcactcgttgctttattctaaacagaggagatagaatatggcaacgagtaacctggcggcagcgcaaaagatg

SEQ ID NO: 52518 - DNA, 103 bp, Artificial Sequence
  Synthetic Polynucleotide
taatacgactcactatagggagctctctattacgttcactcgttgctttaaacagaggagataaagcatggagtgaacgaacctggcggcagcgcaaaagatg

SEQ ID NO: 52519 - DNA, 103 bp, Artificial Sequence
  Synthetic Polynucleotide
taatacgactcactatagggtacgaagctctctattacgttcactcgttgaacagaggagacaacgaatgaacgtaataaacctggcggcagcgcaaaagatg

SEQ ID NO: 52520 - DNA, 103 bp, Artificial Sequence
  Synthetic Polynucleotide
taatacgactcactataggggagtatacgaagctctctattacgttcactaacagaggagaagtgaaatgaatagagagaacctggcggcagcgcaaaagatg

SEQ ID NO: 52521 - DNA, 103 bp, Artificial Sequence
  Synthetic Polynucleotide
taatacgactcactataggggaatagagtatacgaagctctctattacgtaacagaggagaacgtaaatgagagcttcgaacctggcggcagcgcaaaagatg

SEQ ID NO: 52522 - DNA, 103 bp, Artificial Sequence
  Synthetic Polynucleotide
taatacgactcactatagggttttcgaatagagtatacgaagctctctataacagaggagaatagagatgttcgtatacaacctggcggcagcgcaaaagatg

SEQ ID NO: 52523 - DNA, 103 bp, Artificial Sequence
  Synthetic Polynucleotide
taatacgactcactatagggtagagttttcgaatagagtatacgaagctcaacagaggagagagcttatgatactctataacctggcggcagcgcaaaagatg

SEQ ID NO: 52524 - DNA, 103 bp, Artificial Sequence
  Synthetic Polynucleotide
taatacgactcactataggggttcttagagttttcgaatagagtatacgaaacagaggagatcgtatatgctattcgaaaacctggcggcagcgcaaaagatg

SEQ ID NO: 52525 - DNA, 103 bp, Artificial Sequence
  Synthetic Polynucleotide
taatacgactcactataggggtgcactaattactaaatattaattagtgaaacagaggagatcactaatgaatatttagaacctggcggcagcgcaaaagatg

SEQ ID NO: 52526 - DNA, 103 bp, Artificial Sequence
  Synthetic Polynucleotide
taatacgactcactatagggaataagttcttagagttttcgaatagagtaaacagaggagatactctatgcgaaaactcaacctggcggcagcgcaaaagatg

SEQ ID NO: 52527 - DNA, 103 bp, Artificial Sequence
  Synthetic Polynucleotide
taatacgactcactatagggtcattaataagttcttagagttttcgaataaacagaggagatattcgatgactctaagaaacctggcggcagcgcaaaagatg

SEQ ID NO: 52528 - DNA, 103 bp, Artificial Sequence
  Synthetic Polynucleotide
taatacgactcactatagggggaattcattaataagttcttagagttttcaacagaggagagaaaacatgaagaacttaaacctggcggcagcgcaaaagatg

SEQ ID NO: 52529 - DNA, 103 bp, Artificial Sequence
  Synthetic Polynucleotide
taatacgactcactataggggatacggaattcattaataagttcttagagaacagaggagactctaaatgcttattaataacctggcggcagcgcaaaagatg

SEQ ID NO: 52530 - DNA, 103 bp, Artificial Sequence
  Synthetic Polynucleotide
taatacgactcactatagggcagtggatacggaattcattaataagttctaacagaggagaagaactatgtaatgaattaacctggcggcagcgcaaaagatg

SEQ ID NO: 52531 - DNA, 103 bp, Artificial Sequence
  Synthetic Polynucleotide
taatacgactcactatagggcgatccagtggatacggaattcattaataaaacagaggagattattaatgaattccgtaaacctggcggcagcgcaaaagatg

SEQ ID NO: 52532 - DNA, 103 bp, Artificial Sequence
  Synthetic Polynucleotide
taatacgactcactatagggctaaacgatccagtggatacggaattcattaacagaggagaaatgaaatgcgtatccacaacctggcggcagcgcaaaagatg

SEQ ID NO: 52533 - DNA, 103 bp, Artificial Sequence
  Synthetic Polynucleotide
taatacgactcactataggggtattctaaacgatccagtggatacggaataacagaggagaattccgatgccactggataacctggcggcagcgcaaaagatg

SEQ ID NO: 52534 - DNA, 103 bp, Artificial Sequence
  Synthetic Polynucleotide
taatacgactcactatagggatttagtattctaaacgatccagtggatacaacagaggagagtatccatgggatcgtttaacctggcggcagcgcaaaagatg

SEQ ID NO: 52535 - DNA, 103 bp, Artificial Sequence
  Synthetic Polynucleotide
taatacgactcactataggggttcaatttagtattctaaacgatccagtgaacagaggagacactggatggtttagaataacctggcggcagcgcaaaagatg

SEQ ID NO: 52536 - DNA, 103 bp, Artificial Sequence
  Synthetic Polynucleotide
taatacgactcactatagggatagagtgcactaattactaaatattaattaacagaggagaaattaaatgttagtaattaacctggcggcagcgcaaaagatg

SEQ ID NO: 52537 - DNA, 103 bp, Artificial Sequence
  Synthetic Polynucleotide
taatacgactcactatagggacagtgttcaatttagtattctaaacgatcaacagaggagagatcgtatggaatactaaaacctggcggcagcgcaaaagatg

SEQ ID NO: 52538 - DNA, 103 bp, Artificial Sequence
  Synthetic Polynucleotide
taatacgactcactatagggtgtgaacagtgttcaatttagtattctaaaaacagaggagatttagaatgctaaattgaaacctggcggcagcgcaaaagatg

SEQ ID NO: 52539 - DNA, 103 bp, Artificial Sequence
  Synthetic Polynucleotide
taatacgactcactatagggaaggatgtgaacagtgttcaatttagtattaacagaggagaaatactatgttgaacactaacctggcggcagcgcaaaagatg

SEQ ID NO: 52540 - DNA, 103 bp, Artificial Sequence
  Synthetic Polynucleotide
taatacgactcactatagggcttggaaggatgtgaacagtgttcaatttaaacagaggagataaattatgcactgttcaaacctggcggcagcgcaaaagatg

SEQ ID NO: 52541 - DNA, 103 bp, Artificial Sequence
  Synthetic Polynucleotide
taatacgactcactatagggttcttcttggaaggatgtgaacagtgttcaaacagaggagatgaacaatgttcacatccaacctggcggcagcgcaaaagatg

SEQ ID NO: 52542 - DNA, 103 bp, Artificial Sequence
  Synthetic Polynucleotide
taatacgactcactatagggaagtcttcttcttggaaggatgtgaacagtaacagaggagaactgttatgatccttccaaacctggcggcagcgcaaaagatg

SEQ ID NO: 52543 - DNA, 103 bp, Artificial Sequence
  Synthetic Polynucleotide
taatacgactcactatagggttactaagtcttcttcttggaaggatgtgaaacagaggagatcacatatgtccaagaagaacctggcggcagcgcaaaagatg

SEQ ID NO: 52544 - DNA, 103 bp, Artificial Sequence
  Synthetic Polynucleotide
taatacgactcactataggggtccgttactaagtcttcttcttggaaggaaacagaggagatccttcatggaagaagacaacctggcggcagcgcaaaagatg

SEQ ID NO: 52545 - DNA, 103 bp, Artificial Sequence
  Synthetic Polynucleotide
taatacgactcactataggggttaagtccgttactaagtcttcttcttggaacagaggagaccaagaatgagacttagtaacctggcggcagcgcaaaagatg

SEQ ID NO: 52546 - DNA, 103 bp, Artificial Sequence
  Synthetic Polynucleotide
taatacgactcactatagggctcatgttaagtccgttactaagtcttcttaacagaggagaaagaagatgtagtaacggaacctggcggcagcgcaaaagatg

SEQ ID NO: 52547 - DNA, 103 bp, Artificial Sequence
  Synthetic Polynucleotide
taatacgactcactatagggtttttatagagtgcactaattactaaatataacagaggagaatatttatgaattagtgcaacctggcggcagcgcaaaagatg

SEQ ID NO: 52548 - DNA, 103 bp, Artificial Sequence
  Synthetic Polynucleotide
taatacgactcactatagggtatgtctcatgttaagtccgttactaagtcaacagaggagagacttaatgacggacttaaacctggcggcagcgcaaaagatg

SEQ ID NO: 52549 - DNA, 103 bp, Artificial Sequence
  Synthetic Polynucleotide
taatacgactcactatagggttatttatgtctcatgttaagtccgttactaacagaggagaagtaacatgcttaacatgaacctggcggcagcgcaaaagatg

SEQ ID NO: 52550 - DNA, 103 bp, Artificial Sequence
  Synthetic Polynucleotide
taatacgactcactatagggtggatttatttatgtctcatgttaagtccgaacagaggagacggactatgcatgagacaaacctggcggcagcgcaaaagatg

SEQ ID NO: 52551 - DNA, 103 bp, Artificial Sequence
  Synthetic Polynucleotide
taatacgactcactatagggaaatttggatttatttatgtctcatgttaaaacagaggagattaacaatggacataaataacctggcggcagcgcaaaagatg

SEQ ID NO: 52552 - DNA, 103 bp, Artificial Sequence
  Synthetic Polynucleotide
taatacgactcactatagggaaaaaaaatttggatttatttatgtctcataacagaggagaatgagaatgaaataaatcaacctggcggcagcgcaaaagatg

SEQ ID NO: 52553 - DNA, 103 bp, Artificial Sequence
  Synthetic Polynucleotide
taatacgactcactatagggtttgtaaaaaaaatttggatttatttatgtaacagaggagaacataaatgaatccaaataacctggcggcagcgcaaaagatg

SEQ ID NO: 52554 - DNA, 103 bp, Artificial Sequence
  Synthetic Polynucleotide
taatacgactcactatagggtaatgtttgtaaaaaaaatttggatttattaacagaggagaaataaaatgaaattttttaacctggcggcagcgcaaaagatg

SEQ ID NO: 52555 - DNA, 103 bp, Artificial Sequence
  Synthetic Polynucleotide
taatacgactcactataggggctagtaatgtttgtaaaaaaaatttggataacagaggagaatccaaatgttttttacaaacctggcggcagcgcaaaagatg

SEQ ID NO: 52556 - DNA, 103 bp, Artificial Sequence
  Synthetic Polynucleotide
taatacgactcactatagggtggtggctagtaatgtttgtaaaaaaaattaacagaggagaaattttatgtacaaacataacctggcggcagcgcaaaagatg

SEQ ID NO: 52557 - DNA, 103 bp, Artificial Sequence
  Synthetic Polynucleotide
taatacgactcactatagggcattatggtggctagtaatgtttgtaaaaaaacagaggagatttttaatgacattactaaacctggcggcagcgcaaaagatg

SEQ ID NO: 52558 - DNA, 103 bp, Artificial Sequence
  Synthetic Polynucleotide
taatacgactcactatagggtctcgtttttatagagtgcactaattactaaacagaggagatagtaaatggtgcactctaacctggcggcagcgcaaaagatg

SEQ ID NO: 52559 - DNA, 103 bp, Artificial Sequence
  Synthetic Polynucleotide
taatacgactcactatagggagcgccattatggtggctagtaatgtttgtaacagaggagaacaaacatgactagccacaacctggcggcagcgcaaaagatg

SEQ ID NO: 52560 - DNA, 103 bp, Artificial Sequence
  Synthetic Polynucleotide
taatacgactcactatagggaagatagcgccattatggtggctagtaatgaacagaggagacattacatgccaccataaaacctggcggcagcgcaaaagatg

SEQ ID NO: 52561 - DNA, 103 bp, Artificial Sequence
  Synthetic Polynucleotide
taatacgactcactataggggttaaaagatagcgccattatggtggctagaacagaggagactagccatgataatggcgaacctggcggcagcgcaaaagatg

SEQ ID NO: 52562 - DNA, 103 bp, Artificial Sequence
  Synthetic Polynucleotide
taatacgactcactatagggagctggttaaaagatagcgccattatggtgaacagaggagacaccatatgggcgctatcaacctggcggcagcgcaaaagatg

SEQ ID NO: 52563 - DNA, 103 bp, Artificial Sequence
  Synthetic Polynucleotide
taatacgactcactataggggcgatagctggttaaaagatagcgccattaaacagaggagataatggatgtatcttttaaacctggcggcagcgcaaaagatg

SEQ ID NO: 52564 - DNA, 103 bp, Artificial Sequence
  Synthetic Polynucleotide
taatacgactcactatagggtgtaagcgatagctggttaaaagatagcgcaacagaggagagcgctaatgtttaaccagaacctggcggcagcgcaaaagatg

SEQ ID NO: 52565 - DNA, 103 bp, Artificial Sequence
  Synthetic Polynucleotide
taatacgactcactatagggaaatgtgtaagcgatagctggttaaaagataacagaggagaatctttatgccagctatcaacctggcggcagcgcaaaagatg

SEQ ID NO: 52566 - DNA, 103 bp, Artificial Sequence
  Synthetic Polynucleotide
taatacgactcactatagggtgctgaaatgtgtaagcgatagctggttaaaacagaggagattaaccatgtatcgcttaaacctggcggcagcgcaaaagatg

SEQ ID NO: 52567 - DNA, 103 bp, Artificial Sequence
  Synthetic Polynucleotide
taatacgactcactatagggtagattgctgaaatgtgtaagcgatagctgaacagaggagacagctaatgcttacacataacctggcggcagcgcaaaagatg

SEQ ID NO: 52568 - DNA, 103 bp, Artificial Sequence
  Synthetic Polynucleotide
taatacgactcactatagggaatgttagattgctgaaatgtgtaagcgataacagaggagaatcgctatgacatttcagaacctggcggcagcgcaaaagatg

SEQ ID NO: 52569 - DNA, 103 bp, Artificial Sequence
  Synthetic Polynucleotide
taatacgactcactatagggtagatcattttaaacatgaattgaaaccaaaacagaggagattggttatgattcatgttaacctggcggcagcgcaaaagatg

SEQ ID NO: 52570 - DNA, 103 bp, Artificial Sequence
  Synthetic Polynucleotide
taatacgactcactataggggtcattctcgtttttatagagtgcactaataacagaggagaattagtatgctctataaaaacctggcggcagcgcaaaagatg

SEQ ID NO: 52571 - DNA, 103 bp, Artificial Sequence
  Synthetic Polynucleotide
taatacgactcactatagggttaaaaatgttagattgctgaaatgtgtaaaacagaggagattacacatgtcagcaatcaacctggcggcagcgcaaaagatg

SEQ ID NO: 52572 - DNA, 103 bp, Artificial Sequence
  Synthetic Polynucleotide
taatacgactcactatagggtctctttaaaaatgttagattgctgaaatgaacagaggagacatttcatgaatctaacaaacctggcggcagcgcaaaagatg

SEQ ID NO: 52573 - DNA, 103 bp, Artificial Sequence
  Synthetic Polynucleotide
taatacgactcactatagggtgtagtctctttaaaaatgttagattgctgaacagaggagacagcaaatgaacatttttaacctggcggcagcgcaaaagatg

SEQ ID NO: 52574 - DNA, 103 bp, Artificial Sequence
  Synthetic Polynucleotide
taatacgactcactatagggtatattgtagtctctttaaaaatgttagataacagaggagaatctaaatgttttaaagaaacctggcggcagcgcaaaagatg

SEQ ID NO: 52575 - DNA, 103 bp, Artificial Sequence
  Synthetic Polynucleotide
taatacgactcactataggggagaatatattgtagtctctttaaaaatgtaacagaggagaacatttatgaagagactaaacctggcggcagcgcaaaagatg

SEQ ID NO: 52576 - DNA, 103 bp, Artificial Sequence
  Synthetic Polynucleotide
taatacgactcactatagggaccatgagaatatattgtagtctctttaaaaacagaggagatttaaaatgactacaataaacctggcggcagcgcaaaagatg

SEQ ID NO: 52577 - DNA, 103 bp, Artificial Sequence
  Synthetic Polynucleotide
taatacgactcactatagggtcgataccatgagaatatattgtagtctctaacagaggagaagagacatgaatatattcaacctggcggcagcgcaaaagatg

SEQ ID NO: 52578 - DNA, 103 bp, Artificial Sequence
  Synthetic Polynucleotide
taatacgactcactatagggtgtaatcgataccatgagaatatattgtagaacagaggagactacaaatgattctcatgaacctggcggcagcgcaaaagatg

SEQ ID NO: 52579 - DNA, 103 bp, Artificial Sequence
  Synthetic Polynucleotide
taatacgactcactatagggagaggtgtaatcgataccatgagaatatataacagaggagaatatatatgcatggtatcaacctggcggcagcgcaaaagatg

SEQ ID NO: 52580 - DNA, 103 bp, Artificial Sequence
  Synthetic Polynucleotide
taatacgactcactatagggtcggtagaggtgtaatcgataccatgagaaaacagaggagattctcaatgtatcgattaaacctggcggcagcgcaaaagatg

SEQ ID NO: 52581 - DNA, 103 bp, Artificial Sequence
  Synthetic Polynucleotide
taatacgactcactataggggttatgtcattctcgtttttatagagtgcaaacagaggagatgcactatgtaaaaacgaaacctggcggcagcgcaaaagatg

SEQ ID NO: 52582 - DNA, 103 bp, Artificial Sequence
  Synthetic Polynucleotide
taatacgactcactatagggtctattcggtagaggtgtaatcgataccataacagaggagaatggtaatgattacacctaacctggcggcagcgcaaaagatg

SEQ ID NO: 52583 - DNA, 103 bp, Artificial Sequence
  Synthetic Polynucleotide
taatacgactcactatagggcctactctattcggtagaggtgtaatcgataacagaggagaatcgatatgacctctaccaacctggcggcagcgcaaaagatg

SEQ ID NO: 52584 - DNA, 103 bp, Artificial Sequence
  Synthetic Polynucleotide
taatacgactcactatagggaacttcctactctattcggtagaggtgtaaaacagaggagattacacatgtaccgaataaacctggcggcagcgcaaaagatg

SEQ ID NO: 52585 - DNA, 103 bp, Artificial Sequence
  Synthetic Polynucleotide
taatacgactcactatagggtattaaacttcctactctattcggtagaggaacagaggagacctctaatgaatagagtaaacctggcggcagcgcaaaagatg

SEQ ID NO: 52586 - DNA, 103 bp, Artificial Sequence
  Synthetic Polynucleotide
taatacgactcactatagggtgtattattaaacttcctactctattcggtaacagaggagaaccgaaatgagtaggaagaacctggcggcagcgcaaaagatg

SEQ ID NO: 52587 - DNA, 103 bp, Artificial Sequence
  Synthetic Polynucleotide
taatacgactcactatagggaatattgtattattaaacttcctactctataacagaggagaatagagatggaagtttaaaacctggcggcagcgcaaaagatg

SEQ ID NO: 52588 - DNA, 103 bp, Artificial Sequence
  Synthetic Polynucleotide
taatacgactcactatagggcgaaaaatattgtattattaaacttcctacaacagaggagagtaggaatgttaataataaacctggcggcagcgcaaaagatg

SEQ ID NO: 52589 - DNA, 103 bp, Artificial Sequence
  Synthetic Polynucleotide
taatacgactcactataggggtaaacgaaaaatattgtattattaaacttaacagaggagaaagtttatgaatacaataaacctggcggcagcgcaaaagatg

SEQ ID NO: 52590 - DNA, 103 bp, Artificial Sequence
  Synthetic Polynucleotide
taatacgactcactatagggattttgtaaacgaaaaatattgtattattaaacagaggagataataaatgaatatttttaacctggcggcagcgcaaaagatg

SEQ ID NO: 52591 - DNA, 103 bp, Artificial Sequence
  Synthetic Polynucleotide
taatacgactcactatagggatttgattttgtaaacgaaaaatattgtataacagaggagaatacaaatgttttcgtttaacctggcggcagcgcaaaagatg

SEQ ID NO: 52592 - DNA, 103 bp, Artificial Sequence
  Synthetic Polynucleotide
taatacgactcactataggggattagttatgtcattctcgtttttatagaaacagaggagatctataatgacgagaatgaacctggcggcagcgcaaaagatg

SEQ ID NO: 52593 - DNA, 103 bp, Artificial Sequence
  Synthetic Polynucleotide
taatacgactcactatagggccattatttgattttgtaaacgaaaaatataacagaggagaatatttatggtttacaaaaacctggcggcagcgcaaaagatg

SEQ ID NO: 52594 - DNA, 103 bp, Artificial Sequence
  Synthetic Polynucleotide
taatacgactcactatagggttcgaccattatttgattttgtaaacgaaaaacagaggagatttcgtatgcaaaatcaaaacctggcggcagcgcaaaagatg

SEQ ID NO: 52595 - DNA, 103 bp, Artificial Sequence
  Synthetic Polynucleotide
taatacgactcactatagggcgtgtttcgaccattatttgattttgtaaaaacagaggagatttacaatgtcaaataataacctggcggcagcgcaaaagatg

SEQ ID NO: 52596 - DNA, 103 bp, Artificial Sequence
  Synthetic Polynucleotide
taatacgactcactatagggtttgacgtgtttcgaccattatttgattttaacagaggagaaaaatcatgtaatggtcgaacctggcggcagcgcaaaagatg

SEQ ID NO: 52597 - DNA, 103 bp, Artificial Sequence
  Synthetic Polynucleotide
taatacgactcactatagggtaacctttgacgtgtttcgaccattatttgaacagaggagacaaataatggtcgaaacaaacctggcggcagcgcaaaagatg

SEQ ID NO: 52598 - DNA, 103 bp, Artificial Sequence
  Synthetic Polynucleotide
taatacgactcactataggggatgttaacctttgacgtgtttcgaccattaacagaggagaaatggtatgaacacgtcaaacctggcggcagcgcaaaagatg

SEQ ID NO: 52599 - DNA, 103 bp, Artificial Sequence
  Synthetic Polynucleotide
taatacgactcactatagggtataagatgttaacctttgacgtgtttcgaaacagaggagatcgaaaatggtcaaaggtaacctggcggcagcgcaaaagatg

SEQ ID NO: 52600 - DNA, 103 bp, Artificial Sequence
  Synthetic Polynucleotide
taatacgactcactataggggcgattataagatgttaacctttgacgtgtaacagaggagaacacgtatgaggttaacaaacctggcggcagcgcaaaagatg

SEQ ID NO: 52601 - DNA, 103 bp, Artificial Sequence
  Synthetic Polynucleotide
taatacgactcactatagggcattagcgattataagatgttaacctttgaaacagaggagatcaaagatgaacatcttaaacctggcggcagcgcaaaagatg

SEQ ID NO: 52602 - DNA, 103 bp, Artificial Sequence
  Synthetic Polynucleotide
taatacgactcactatagggctatacattagcgattataagatgttaaccaacagaggagaggttaaatgcttataatcaacctggcggcagcgcaaaagatg

SEQ ID NO: 52603 - DNA, 103 bp, Artificial Sequence
  Synthetic Polynucleotide
taatacgactcactataggggttatgattagttatgtcattctcgtttttaacagaggagaaaaaacatgaatgacataaacctggcggcagcgcaaaagatg

SEQ ID NO: 52604 - DNA, 103 bp, Artificial Sequence
  Synthetic Polynucleotide
taatacgactcactatagggacaatctatacattagcgattataagatgtaacagaggagaacatctatgaatcgctaaaacctggcggcagcgcaaaagatg

SEQ ID NO: 52605 - DNA, 103 bp, Artificial Sequence
  Synthetic Polynucleotide
taatacgactcactatagggtgaaaacaatctatacattagcgattataaaacagaggagattataaatgctaatgtataacctggcggcagcgcaaaagatg

SEQ ID NO: 52606 - DNA, 103 bp, Artificial Sequence
  Synthetic Polynucleotide
taatacgactcactatagggcttactgaaaacaatctatacattagcgataacagaggagaatcgctatggtatagattaacctggcggcagcgcaaaagatg

SEQ ID NO: 52607 - DNA, 103 bp, Artificial Sequence
  Synthetic Polynucleotide
taatacgactcactatagggatcatcttactgaaaacaatctatacattaaacagaggagataatgtatggattgttttaacctggcggcagcgcaaaagatg

SEQ ID NO: 52608 - DNA, 103 bp, Artificial Sequence
  Synthetic Polynucleotide
taatacgactcactatagggtaataatcatcttactgaaaacaatctataaacagaggagatatagaatgttttcagtaaacctggcggcagcgcaaaagatg

SEQ ID NO: 52609 - DNA, 103 bp, Artificial Sequence
  Synthetic Polynucleotide
taatacgactcactatagggaaatctaataatcatcttactgaaaacaataacagaggagaattgttatgagtaagatgaacctggcggcagcgcaaaagatg

SEQ ID NO: 52610 - DNA, 103 bp, Artificial Sequence
  Synthetic Polynucleotide
taatacgactcactatagggctattaaatctaataatcatcttactgaaaaacagaggagatttcagatggatgattataacctggcggcagcgcaaaagatg

SEQ ID NO: 52611 - DNA, 103 bp, Artificial Sequence
  Synthetic Polynucleotide
taatacgactcactatagggagatgctattaaatctaataatcatcttacaacagaggagagtaagaatgttattagataacctggcggcagcgcaaaagatg

SEQ ID NO: 52612 - DNA, 103 bp, Artificial Sequence
  Synthetic Polynucleotide
taatacgactcactataggggaacgagatgctattaaatctaataatcataacagaggagaatgattatgagatttaataacctggcggcagcgcaaaagatg

SEQ ID NO: 52613 - DNA, 103 bp, Artificial Sequence
  Synthetic Polynucleotide
taatacgactcactatagggaacgcgaacgagatgctattaaatctaataaacagaggagatattagatgtaatagcataacctggcggcagcgcaaaagatg

SEQ ID NO: 52614 - DNA, 103 bp, Artificial Sequence
  Synthetic Polynucleotide
taatacgactcactatagggaactagttatgattagttatgtcattctcgaacagaggagacgagaaatgcataactaaaacctggcggcagcgcaaaagatg

SEQ ID NO: 52615 - DNA, 103 bp, Artificial Sequence
  Synthetic Polynucleotide
taatacgactcactataggggtttaaacgcgaacgagatgctattaaatcaacagaggagagatttaatggcatctcgtaacctggcggcagcgcaaaagatg

SEQ ID NO: 52616 - DNA, 103 bp, Artificial Sequence
  Synthetic Polynucleotide
taatacgactcactatagggaaactgtttaaacgcgaacgagatgctattaacagaggagaaatagcatgtcgttcgcgaacctggcggcagcgcaaaagatg

SEQ ID NO: 52617 - DNA, 103 bp, Artificial Sequence
  Synthetic Polynucleotide
taatacgactcactataggggcaataaactgtttaaacgcgaacgagatgaacagaggagacatctcatgcgcgtttaaaacctggcggcagcgcaaaagatg

SEQ ID NO: 52618 - DNA, 103 bp, Artificial Sequence
  Synthetic Polynucleotide
taatacgactcactatagggcgcacgcaataaactgtttaaacgcgaacgaacagaggagacgttcgatgttaaacagtaacctggcggcagcgcaaaagatg

SEQ ID NO: 52619 - DNA, 103 bp, Artificial Sequence
  Synthetic Polynucleotide
taatacgactcactatagggcttagcgcacgcaataaactgtttaaacgcaacagaggagagcgtttatgcagtttattaacctggcggcagcgcaaaagatg

SEQ ID NO: 52620 - DNA, 103 bp, Artificial Sequence
  Synthetic Polynucleotide
taatacgactcactatagggccgatcttagcgcacgcaataaactgtttaaacagaggagataaacaatgtattgcgtgaacctggcggcagcgcaaaagatg

SEQ ID NO: 52621 - DNA, 103 bp, Artificial Sequence
  Synthetic Polynucleotide
taatacgactcactatagggagttgccgatcttagcgcacgcaataaactaacagaggagaagtttaatgcgtgcgctaaacctggcggcagcgcaaaagatg

SEQ ID NO: 52622 - DNA, 103 bp, Artificial Sequence
  Synthetic Polynucleotide
taatacgactcactataggggcagtagttgccgatcttagcgcacgcaataacagaggagaattgcgatggctaagatcaacctggcggcagcgcaaaagatg

SEQ ID NO: 52623 - DNA, 103 bp, Artificial Sequence
  Synthetic Polynucleotide
taatacgactcactatagggcggacgcagtagttgccgatcttagcgcacaacagaggagagtgcgcatggatcggcaaaacctggcggcagcgcaaaagatg

SEQ ID NO: 52624 - DNA, 103 bp, Artificial Sequence
  Synthetic Polynucleotide
taatacgactcactatagggtaaagcggacgcagtagttgccgatcttagaacagaggagactaagaatggcaactactaacctggcggcagcgcaaaagatg

SEQ ID NO: 52625 - DNA, 103 bp, Artificial Sequence
  Synthetic Polynucleotide
taatacgactcactatagggttgataactagttatgattagttatgtcataacagaggagaatgacaatgctaatcataaacctggcggcagcgcaaaagatg

SEQ ID NO: 52626 - DNA, 103 bp, Artificial Sequence
  Synthetic Polynucleotide
taatacgactcactatagggagtactaaagcggacgcagtagttgccgataacagaggagaatcggcatgtactgcgtcaacctggcggcagcgcaaaagatg

SEQ ID NO: 52627 - DNA, 103 bp, Artificial Sequence
  Synthetic Polynucleotide
taatacgactcactatagggggagaagtactaaagcggacgcagtagttgaacagaggagacaactaatgcgtccgcttaacctggcggcagcgcaaaagatg

SEQ ID NO: 52628 - DNA, 103 bp, Artificial Sequence
  Synthetic Polynucleotide
taatacgactcactatagggttatgggagaagtactaaagcggacgcagtaacagaggagaactgcgatggctttagtaaacctggcggcagcgcaaaagatg

SEQ ID NO: 52629 - DNA, 103 bp, Artificial Sequence
  Synthetic Polynucleotide
taatacgactcactatagggaagtattatgggagaagtactaaagcggacaacagaggagagtccgcatgagtacttctaacctggcggcagcgcaaaagatg

SEQ ID NO: 52630 - DNA, 103 bp, Artificial Sequence
  Synthetic Polynucleotide
taatacgactcactataggggcgtaaagtattatgggagaagtactaaagaacagaggagactttagatgttctcccataacctggcggcagcgcaaaagatg

SEQ ID NO: 52631 - DNA, 103 bp, Artificial Sequence
  Synthetic Polynucleotide
taatacgactcactatagggtaatagcgtaaagtattatgggagaagtacaacagaggagagtacttatgccataatacaacctggcggcagcgcaaaagatg

SEQ ID NO: 52632 - DNA, 103 bp, Artificial Sequence
  Synthetic Polynucleotide
taatacgactcactatagggaagattaatagcgtaaagtattatgggagaaacagaggagatctcccatgatactttacaacctggcggcagcgcaaaagatg

SEQ ID NO: 52633 - DNA, 103 bp, Artificial Sequence
  Synthetic Polynucleotide
taatacgactcactatagggttttaaagattaatagcgtaaagtattatgaacagaggagacataatatgttacgctataacctggcggcagcgcaaaagatg

SEQ ID NO: 52634 - DNA, 103 bp, Artificial Sequence
  Synthetic Polynucleotide
taatacgactcactatagggtgaaattttaaagattaatagcgtaaagtaaacagaggagatactttatgctattaatcaacctggcggcagcgcaaaagatg

SEQ ID NO: 52635 - DNA, 103 bp, Artificial Sequence
  Synthetic Polynucleotide
taatacgactcactataggggtctatgaaattttaaagattaatagcgtaaacagaggagatacgctatgaatctttaaaacctggcggcagcgcaaaagatg

SEQ ID NO: 52636 - DNA, 103 bp, Artificial Sequence
  Synthetic Polynucleotide
taatacgactcactatagggacactttgataactagttatgattagttataacagaggagaataactatgcataactagaacctggcggcagcgcaaaagatg

SEQ ID NO: 52637 - DNA, 103 bp, Artificial Sequence
  Synthetic Polynucleotide
taatacgactcactatagggataaagtctatgaaattttaaagattaataaacagaggagatattaaatgttaaaatttaacctggcggcagcgcaaaagatg

SEQ ID NO: 52638 - DNA, 103 bp, Artificial Sequence
  Synthetic Polynucleotide
taatacgactcactatagggtctagataaagtctatgaaattttaaagataacagaggagaatctttatgatttcatagaacctggcggcagcgcaaaagatg

SEQ ID NO: 52639 - DNA, 103 bp, Artificial Sequence
  Synthetic Polynucleotide
taatacgactcactatagggagcgatctagataaagtctatgaaattttaaacagaggagataaaatatgatagactttaacctggcggcagcgcaaaagatg

SEQ ID NO: 52640 - DNA, 103 bp, Artificial Sequence
  Synthetic Polynucleotide
taatacgactcactatagggcagaaagcgatctagataaagtctatgaaaaacagaggagatttcatatgctttatctaaacctggcggcagcgcaaaagatg

SEQ ID NO: 52641 - DNA, 103 bp, Artificial Sequence
  Synthetic Polynucleotide
taatacgactcactataggggttaccagaaagcgatctagataaagtctaaacagaggagatagactatgtctagatcgaacctggcggcagcgcaaaagatg

SEQ ID NO: 52642 - DNA, 103 bp, Artificial Sequence
  Synthetic Polynucleotide
taatacgactcactatagggatcatgttaccagaaagcgatctagataaaaacagaggagatttatcatgatcgctttcaacctggcggcagcgcaaaagatg

SEQ ID NO: 52643 - DNA, 103 bp, Artificial Sequence
  Synthetic Polynucleotide
taatacgactcactatagggatgatatcatgttaccagaaagcgatctagaacagaggagactagatatgtttctggtaaacctggcggcagcgcaaaagatg

SEQ ID NO: 52644 - DNA, 103 bp, Artificial Sequence
  Synthetic Polynucleotide
taatacgactcactatagggtacacatgatatcatgttaccagaaagcgaaacagaggagatcgcttatgggtaacatgaacctggcggcagcgcaaaagatg

SEQ ID NO: 52645 - DNA, 103 bp, Artificial Sequence
  Synthetic Polynucleotide
taatacgactcactatagggctttttacacatgatatcatgttaccagaaaacagaggagattctggatgcatgatatcaacctggcggcagcgcaaaagatg

SEQ ID NO: 52646 - DNA, 103 bp, Artificial Sequence
  Synthetic Polynucleotide
taatacgactcactatagggtaaaactttttacacatgatatcatgttacaacagaggagagtaacaatgtatcatgtgaacctggcggcagcgcaaaagatg

SEQ ID NO: 52647 - DNA, 103 bp, Artificial Sequence
  Synthetic Polynucleotide
taatacgactcactatagggcctagacactttgataactagttatgattaaacagaggagataatcaatgctagttatcaacctggcggcagcgcaaaagatg

SEQ ID NO: 52648 - DNA, 103 bp, Artificial Sequence
  Synthetic Polynucleotide
taatacgactcactatagggcatgttaaaactttttacacatgatatcataacagaggagaatgataatgtgtgtaaaaaacctggcggcagcgcaaaagatg

SEQ ID NO: 52649 - DNA, 103 bp, Artificial Sequence
  Synthetic Polynucleotide
taatacgactcactatagggaccgacatgttaaaactttttacacatgataacagaggagaatcatgatgaaaaagtttaacctggcggcagcgcaaaagatg

SEQ ID NO: 52650 - DNA, 103 bp, Artificial Sequence
  Synthetic Polynucleotide
taatacgactcactatagggtgccaaccgacatgttaaaactttttacacaacagaggagagtgtaaatggttttaacaaacctggcggcagcgcaaaagatg

SEQ ID NO: 52651 - DNA, 103 bp, Artificial Sequence
  Synthetic Polynucleotide
taatacgactcactatagggtagaatgccaaccgacatgttaaaacttttaacagaggagaaaaagtatgaacatgtcgaacctggcggcagcgcaaaagatg

SEQ ID NO: 52652 - DNA, 103 bp, Artificial Sequence
  Synthetic Polynucleotide
taatacgactcactatagggctaaatagaatgccaaccgacatgttaaaaaacagaggagattttaaatggtcggttggaacctggcggcagcgcaaaagatg

SEQ ID NO: 52653 - DNA, 103 bp, Artificial Sequence
  Synthetic Polynucleotide
taatacgactcactatagggatgatctaaatagaatgccaaccgacatgtaacagaggagaacatgtatgttggcattcaacctggcggcagcgcaaaagatg

SEQ ID NO: 52654 - DNA, 103 bp, Artificial Sequence
  Synthetic Polynucleotide
taatacgactcactatagggagttaatgatctaaatagaatgccaaccgaaacagaggagatcggttatgattctatttaacctggcggcagcgcaaaagatg

SEQ ID NO: 52655 - DNA, 103 bp, Artificial Sequence
  Synthetic Polynucleotide
taatacgactcactatagggtctagagttaatgatctaaatagaatgccaaacagaggagatggcatatgatttagatcaacctggcggcagcgcaaaagatg

SEQ ID NO: 52656 - DNA, 103 bp, Artificial Sequence
  Synthetic Polynucleotide
taatacgactcactatagggagatttctagagttaatgatctaaatagaaaacagaggagattctatatggatcattaaaacctggcggcagcgcaaaagatg

SEQ ID NO: 52657 - DNA, 103 bp, Artificial Sequence
  Synthetic Polynucleotide
taatacgactcactatagggtcttcagatttctagagttaatgatctaaaaacagaggagatttagaatgttaactctaaacctggcggcagcgcaaaagatg

SEQ ID NO: 52658 - DNA, 103 bp, Artificial Sequence
  Synthetic Polynucleotide
taatacgactcactatagggcgcatcctagacactttgataactagttataacagaggagaataactatgtatcaaagtaacctggcggcagcgcaaaagatg

SEQ ID NO: 52659 - DNA, 103 bp, Artificial Sequence
  Synthetic Polynucleotide
taatacgactcactatagggtactttcttcagatttctagagttaatgataacagaggagaatcattatgtctagaaataacctggcggcagcgcaaaagatg

SEQ ID NO: 52660 - DNA, 103 bp, Artificial Sequence
  Synthetic Polynucleotide
taatacgactcactatagggctaattactttcttcagatttctagagttaaacagaggagataactcatgaaatctgaaaacctggcggcagcgcaaaagatg

SEQ ID NO: 52661 - DNA, 103 bp, Artificial Sequence
  Synthetic Polynucleotide
taatacgactcactatagggcggagctaattactttcttcagatttctagaacagaggagactagaaatgtgaagaaagaacctggcggcagcgcaaaagatg

SEQ ID NO: 52662 - DNA, 103 bp, Artificial Sequence
  Synthetic Polynucleotide
taatacgactcactataggggaatacggagctaattactttcttcagattaacagaggagaaatctgatgaaagtaattaacctggcggcagcgcaaaagatg

SEQ ID NO: 52663 - DNA, 103 bp, Artificial Sequence
  Synthetic Polynucleotide
taatacgactcactataggggtttggaatacggagctaattactttcttcaacagaggagagaagaaatgaattagctcaacctggcggcagcgcaaaagatg

SEQ ID NO: 52664 - DNA, 103 bp, Artificial Sequence
  Synthetic Polynucleotide
taatacgactcactatagggacctagtttggaatacggagctaattacttaacagaggagaaagtaaatggctccgtataacctggcggcagcgcaaaagatg

SEQ ID NO: 52665 - DNA, 103 bp, Artificial Sequence
  Synthetic Polynucleotide
taatacgactcactatagggccattacctagtttggaatacggagctaataacagaggagaattagcatggtattccaaaacctggcggcagcgcaaaagatg

SEQ ID NO: 52666 - DNA, 103 bp, Artificial Sequence
  Synthetic Polynucleotide
taatacgactcactatagggaaagcccattacctagtttggaatacggagaacagaggagactccgtatgccaaactagaacctggcggcagcgcaaaagatg

SEQ ID NO: 52667 - DNA, 103 bp, Artificial Sequence
  Synthetic Polynucleotide
taatacgactcactatagggaggtaaaagcccattacctagtttggaataaacagaggagatattccatgctaggtaataacctggcggcagcgcaaaagatg

SEQ ID NO: 52668 - DNA, 103 bp, Artificial Sequence
  Synthetic Polynucleotide
taatacgactcactatagggtctctaggtaaaagcccattacctagtttgaacagaggagacaaactatgtaatgggctaacctggcggcagcgcaaaagatg

SEQ ID NO: 52669 - DNA, 103 bp, Artificial Sequence
  Synthetic Polynucleotide
taatacgactcactatagggaattacgcatcctagacactttgataactaaacagaggagatagttaatgaagtgtctaaacctggcggcagcgcaaaagatg

SEQ ID NO: 52670 - DNA, 103 bp, Artificial Sequence
  Synthetic Polynucleotide
taatacgactcactatagggatctgtctctaggtaaaagcccattacctaaacagaggagataggtaatgggcttttacaacctggcggcagcgcaaaagatg

SEQ ID NO: 52671 - DNA, 103 bp, Artificial Sequence
  Synthetic Polynucleotide
taatacgactcactatagggacttaatctgtctctaggtaaaagcccattaacagaggagaaatgggatgttacctagaaacctggcggcagcgcaaaagatg

SEQ ID NO: 52672 - DNA, 103 bp, Artificial Sequence
  Synthetic Polynucleotide
taatacgactcactatagggccagaacttaatctgtctctaggtaaaagcaacagaggagagcttttatgtagagacagaacctggcggcagcgcaaaagatg

SEQ ID NO: 52673 - DNA, 103 bp, Artificial Sequence
  Synthetic Polynucleotide
taatacgactcactatagggcattgccagaacttaatctgtctctaggtaaacagaggagatacctaatgacagattaaaacctggcggcagcgcaaaagatg

SEQ ID NO: 52674 - DNA, 103 bp, Artificial Sequence
  Synthetic Polynucleotide
taatacgactcactatagggtgaaacattgccagaacttaatctgtctctaacagaggagaagagacatgttaagttctaacctggcggcagcgcaaaagatg

SEQ ID NO: 52675 - DNA, 103 bp, Artificial Sequence
  Synthetic Polynucleotide
taatacgactcactatagggttttatgaaacattgccagaacttaatctgaacagaggagacagattatgttctggcaaaacctggcggcagcgcaaaagatg

SEQ ID NO: 52676 - DNA, 103 bp, Artificial Sequence
  Synthetic Polynucleotide
taatacgactcactatagggttccattttatgaaacattgccagaacttaaacagaggagataagttatggcaatgtttaacctggcggcagcgcaaaagatg

SEQ ID NO: 52677 - DNA, 103 bp, Artificial Sequence
  Synthetic Polynucleotide
taatacgactcactatagggccttcttccattttatgaaacattgccagaaacagaggagatctggcatggtttcataaaacctggcggcagcgcaaaagatg

SEQ ID NO: 52678 - DNA, 103 bp, Artificial Sequence
  Synthetic Polynucleotide
taatacgactcactatagggcatgtccttcttccattttatgaaacattgaacagaggagacaatgtatgataaaatggaacctggcggcagcgcaaaagatg

SEQ ID NO: 52679 - DNA, 103 bp, Artificial Sequence
  Synthetic Polynucleotide
taatacgactcactatagggggacgcatgtccttcttccattttatgaaaaacagaggagatttcatatgatggaagaaaacctggcggcagcgcaaaagatg

SEQ ID NO: 52680 - DNA, 103 bp, Artificial Sequence
  Synthetic Polynucleotide
taatacgactcactatagggacatatagatcattttaaacatgaattgaaaacagaggagattcaatatgtgtttaaaaaacctggcggcagcgcaaaagatg

SEQ ID NO: 52681 - DNA, 103 bp, Artificial Sequence
  Synthetic Polynucleotide
taatacgactcactatagggtaaaaaattacgcatcctagacactttgataacagaggagaatcaaaatgtctaggatgaacctggcggcagcgcaaaagatg

SEQ ID NO: 52682 - DNA, 103 bp, Artificial Sequence
  Synthetic Polynucleotide
taatacgactcactatagggggaggggacgcatgtccttcttccattttaaacagaggagataaaatatgagaaggacaaacctggcggcagcgcaaaagatg

SEQ ID NO: 52683 - DNA, 103 bp, Artificial Sequence
  Synthetic Polynucleotide
taatacgactcactatagggatccgggaggggacgcatgtccttcttccaaacagaggagatggaagatggacatgcgtaacctggcggcagcgcaaaagatg

SEQ ID NO: 52684 - DNA, 103 bp, Artificial Sequence
  Synthetic Polynucleotide
taatacgactcactatagggaaaatatccgggaggggacgcatgtccttcaacagaggagagaaggaatggcgtcccctaacctggcggcagcgcaaaagatg

SEQ ID NO: 52685 - DNA, 103 bp, Artificial Sequence
  Synthetic Polynucleotide
taatacgactcactatagggtgtaaaaaatatccgggaggggacgcatgtaacagaggagaacatgcatgccctcccggaacctggcggcagcgcaaaagatg

SEQ ID NO: 52686 - DNA, 103 bp, Artificial Sequence
  Synthetic Polynucleotide
taatacgactcactataggggaaattgtaaaaaatatccgggaggggacgaacagaggagacgtcccatgccggatattaacctggcggcagcgcaaaagatg

SEQ ID NO: 52687 - DNA, 103 bp, Artificial Sequence
  Synthetic Polynucleotide
taatacgactcactatagggtggatgaaattgtaaaaaatatccgggaggaacagaggagacctcccatgtattttttaaacctggcggcagcgcaaaagatg

SEQ ID NO: 52688 - DNA, 103 bp, Artificial Sequence
  Synthetic Polynucleotide
taatacgactcactataggggtaaatggatgaaattgtaaaaaatatccgaacagaggagacggataatgtttacaattaacctggcggcagcgcaaaagatg

SEQ ID NO: 52689 - DNA, 103 bp, Artificial Sequence
  Synthetic Polynucleotide
taatacgactcactataggggagttgtaaatggatgaaattgtaaaaaataacagaggagaatttttatgaatttcatcaacctggcggcagcgcaaaagatg

SEQ ID NO: 52690 - DNA, 103 bp, Artificial Sequence
  Synthetic Polynucleotide
taatacgactcactatagggctatagagttgtaaatggatgaaattgtaaaacagaggagattacaaatgcatccatttaacctggcggcagcgcaaaagatg

SEQ ID NO: 52691 - DNA, 103 bp, Artificial Sequence
  Synthetic Polynucleotide
taatacgactcactatagggacaaactatagagttgtaaatggatgaaataacagaggagaatttcaatgatttacaacaacctggcggcagcgcaaaagatg

SEQ ID NO: 52692 - DNA, 103 bp, Artificial Sequence
  Synthetic Polynucleotide
taatacgactcactatagggccatataaaaaattacgcatcctagacactaacagaggagaagtgtcatggatgcgtaaaacctggcggcagcgcaaaagatg

SEQ ID NO: 52693 - DNA, 103 bp, Artificial Sequence
  Synthetic Polynucleotide
taatacgactcactatagggtgaaaacaaactatagagttgtaaatggataacagaggagaatccatatgcaactctataacctggcggcagcgcaaaagatg

SEQ ID NO: 52694 - DNA, 103 bp, Artificial Sequence
  Synthetic Polynucleotide
taatacgactcactatagggaataatgaaaacaaactatagagttgtaaaaacagaggagatttacaatgctatagtttaacctggcggcagcgcaaaagatg

SEQ ID NO: 52695 - DNA, 103 bp, Artificial Sequence
  Synthetic Polynucleotide
taatacgactcactatagggctaataataatgaaaacaaactatagagttaacagaggagaaactctatggtttgttttaacctggcggcagcgcaaaagatg

SEQ ID NO: 52696 - DNA, 103 bp, Artificial Sequence
  Synthetic Polynucleotide
taatacgactcactatagggaataactaataataatgaaaacaaactataaacagaggagatatagtatgttttcattaaacctggcggcagcgcaaaagatg

SEQ ID NO: 52697 - DNA, 103 bp, Artificial Sequence
  Synthetic Polynucleotide
taatacgactcactataggggagataataactaataataatgaaaacaaaaacagaggagatttgttatgattattattaacctggcggcagcgcaaaagatg

SEQ ID NO: 52698 - DNA, 103 bp, Artificial Sequence
  Synthetic Polynucleotide
taatacgactcactatagggaatgggagataataactaataataatgaaaaacagaggagatttcatatgtattagttaaacctggcggcagcgcaaaagatg

SEQ ID NO: 52699 - DNA, 103 bp, Artificial Sequence
  Synthetic Polynucleotide
taatacgactcactatagggaagataatgggagataataactaataataaaacagaggagattattaatggttattatcaacctggcggcagcgcaaaagatg

SEQ ID NO: 52700 - DNA, 103 bp, Artificial Sequence
  Synthetic Polynucleotide
taatacgactcactatagggttaccaagataatgggagataataactaataacagaggagaattagtatgtatctcccaaacctggcggcagcgcaaaagatg

SEQ ID NO: 52701 - DNA, 103 bp, Artificial Sequence
  Synthetic Polynucleotide
taatacgactcactatagggaagtattaccaagataatgggagataataaaacagaggagattattaatgcccattatcaacctggcggcagcgcaaaagatg

SEQ ID NO: 52702 - DNA, 103 bp, Artificial Sequence
  Synthetic Polynucleotide
taatacgactcactatagggggggtaagtattaccaagataatgggagataacagaggagaatctccatgtatcttggtaacctggcggcagcgcaaaagatg

SEQ ID NO: 52703 - DNA, 103 bp, Artificial Sequence
  Synthetic Polynucleotide
taatacgactcactatagggctataccatataaaaaattacgcatcctagaacagaggagactaggaatggtaatttttaacctggcggcagcgcaaaagatg

SEQ ID NO: 52704 - DNA, 103 bp, Artificial Sequence
  Synthetic Polynucleotide
taatacgactcactatagggatcaaggggtaagtattaccaagataatggaacagaggagaccattaatgtggtaatacaacctggcggcagcgcaaaagatg

SEQ ID NO: 52705 - DNA, 103 bp, Artificial Sequence
  Synthetic Polynucleotide
taatacgactcactatagggttacgatcaaggggtaagtattaccaagataacagaggagaatcttgatgatacttaccaacctggcggcagcgcaaaagatg

SEQ ID NO: 52706 - DNA, 103 bp, Artificial Sequence
  Synthetic Polynucleotide
taatacgactcactataggggtatcttacgatcaaggggtaagtattaccaacagaggagaggtaatatgtaccccttgaacctggcggcagcgcaaaagatg

SEQ ID NO: 52707 - DNA, 103 bp, Artificial Sequence
  Synthetic Polynucleotide
taatacgactcactatagggataaggtatcttacgatcaaggggtaagtaaacagaggagatacttaatgcttgatcgtaacctggcggcagcgcaaaagatg

SEQ ID NO: 52708 - DNA, 103 bp, Artificial Sequence
  Synthetic Polynucleotide
taatacgactcactatagggcctgtataaggtatcttacgatcaaggggtaacagaggagaacccctatgtcgtaagataacctggcggcagcgcaaaagatg

SEQ ID NO: 52709 - DNA, 103 bp, Artificial Sequence
  Synthetic Polynucleotide
taatacgactcactatagggaatgacctgtataaggtatcttacgatcaaaacagaggagattgatcatgagataccttaacctggcggcagcgcaaaagatg

SEQ ID NO: 52710 - DNA, 103 bp, Artificial Sequence
  Synthetic Polynucleotide
taatacgactcactatagggtatgtaatgacctgtataaggtatcttacgaacagaggagacgtaagatgccttatacaaacctggcggcagcgcaaaagatg

SEQ ID NO: 52711 - DNA, 103 bp, Artificial Sequence
  Synthetic Polynucleotide
taatacgactcactatagggagttgtatgtaatgacctgtataaggtatcaacagaggagagataccatgtacaggtcaaacctggcggcagcgcaaaagatg

SEQ ID NO: 52712 - DNA, 103 bp, Artificial Sequence
  Synthetic Polynucleotide
taatacgactcactatagggttggtagttgtatgtaatgacctgtataagaacagaggagacttataatggtcattacaaacctggcggcagcgcaaaagatg

SEQ ID NO: 52713 - DNA, 103 bp, Artificial Sequence
  Synthetic Polynucleotide
taatacgactcactatagggaacaattggtagttgtatgtaatgacctgtaacagaggagaacaggtatgtacatacaaaacctggcggcagcgcaaaagatg

SEQ ID NO: 52714 - DNA, 103 bp, Artificial Sequence
  Synthetic Polynucleotide
taatacgactcactatagggaggatctataccatataaaaaattacgcataacagaggagaatgcgtatgtttttatataacctggcggcagcgcaaaagatg

SEQ ID NO: 52715 - DNA, 103 bp, Artificial Sequence
  Synthetic Polynucleotide
taatacgactcactatagggacaaaaacaattggtagttgtatgtaatgaaacagaggagatcattaatgacaactaccaacctggcggcagcgcaaaagatg

SEQ ID NO: 52716 - DNA, 103 bp, Artificial Sequence
  Synthetic Polynucleotide
taatacgactcactatagggtatgtacaaaaacaattggtagttgtatgtaacagaggagaacatacatgtaccaattgaacctggcggcagcgcaaaagatg

SEQ ID NO: 52717 - DNA, 103 bp, Artificial Sequence
  Synthetic Polynucleotide
taatacgactcactatagggtctattatgtacaaaaacaattggtagttgaacagaggagacaactaatgattgtttttaacctggcggcagcgcaaaagatg

SEQ ID NO: 52718 - DNA, 103 bp, Artificial Sequence
  Synthetic Polynucleotide
taatacgactcactatagggtccaatctattatgtacaaaaacaattggtaacagaggagaaccaatatgttttgtacaaacctggcggcagcgcaaaagatg

SEQ ID NO: 52719 - DNA, 103 bp, Artificial Sequence
  Synthetic Polynucleotide
taatacgactcactatagggaaccatccaatctattatgtacaaaaacaaaacagaggagattgtttatgtacataataaacctggcggcagcgcaaaagatg

SEQ ID NO: 52720 - DNA, 103 bp, Artificial Sequence
  Synthetic Polynucleotide
taatacgactcactatagggatgtcaaccatccaatctattatgtacaaaaacagaggagatttgtaatgaatagattgaacctggcggcagcgcaaaagatg

SEQ ID NO: 52721 - DNA, 103 bp, Artificial Sequence
  Synthetic Polynucleotide
taatacgactcactatagggcatggatgtcaaccatccaatctattatgtaacagaggagaacataaatgattggatggaacctggcggcagcgcaaaagatg

SEQ ID NO: 52722 - DNA, 103 bp, Artificial Sequence
  Synthetic Polynucleotide
taatacgactcactatagggtccaccatggatgtcaaccatccaatctataacagaggagaatagatatgatggttgacaacctggcggcagcgcaaaagatg

SEQ ID NO: 52723 - DNA, 103 bp, Artificial Sequence
  Synthetic Polynucleotide
taatacgactcactatagggtttattccaccatggatgtcaaccatccaaaacagaggagattggatatgtgacatccaaacctggcggcagcgcaaaagatg

SEQ ID NO: 52724 - DNA, 103 bp, Artificial Sequence
  Synthetic Polynucleotide
taatacgactcactatagggagtagtttattccaccatggatgtcaaccaaacagaggagatggttgatgtccatggtgaacctggcggcagcgcaaaagatg

SEQ ID NO: 52725 - DNA, 103 bp, Artificial Sequence
  Synthetic Polynucleotide
taatacgactcactatagggcttacaggatctataccatataaaaaattaaacagaggagataatttatgatatggtataacctggcggcagcgcaaaagatg

SEQ ID NO: 52726 - DNA, 103 bp, Artificial Sequence
  Synthetic Polynucleotide
taatacgactcactataggggttcgagtagtttattccaccatggatgtcaacagaggagagacatcatgggtggaataaacctggcggcagcgcaaaagatg

SEQ ID NO: 52727 - DNA, 103 bp, Artificial Sequence
  Synthetic Polynucleotide
taatacgactcactatagggtatctgttcgagtagtttattccaccatggaacagaggagaccatggatgaataaactaaacctggcggcagcgcaaaagatg

SEQ ID NO: 52728 - DNA, 103 bp, Artificial Sequence
  Synthetic Polynucleotide
taatacgactcactatagggtaaactatctgttcgagtagtttattccacaacagaggagagtggaaatgactactcgaaacctggcggcagcgcaaaagatg

SEQ ID NO: 52729 - DNA, 103 bp, Artificial Sequence
  Synthetic Polynucleotide
taatacgactcactatagggaaagataaactatctgttcgagtagtttataacagaggagaataaacatgtcgaacagaaacctggcggcagcgcaaaagatg

SEQ ID NO: 52730 - DNA, 103 bp, Artificial Sequence
  Synthetic Polynucleotide
taatacgactcactataggggggggaaagataaactatctgttcgagtagaacagaggagactactcatgcagatagttaacctggcggcagcgcaaaagatg

SEQ ID NO: 52731 - DNA, 103 bp, Artificial Sequence
  Synthetic Polynucleotide
taatacgactcactatagggatctagggggaaagataaactatctgttcgaacagaggagacgaacaatgagtttatctaacctggcggcagcgcaaaagatg

SEQ ID NO: 52732 - DNA, 103 bp, Artificial Sequence
  Synthetic Polynucleotide
taatacgactcactatagggaatgtatctagggggaaagataaactatctaacagaggagaagatagatgatctttcccaacctggcggcagcgcaaaagatg

SEQ ID NO: 52733 - DNA, 103 bp, Artificial Sequence
  Synthetic Polynucleotide
taatacgactcactatagggcggccaatgtatctagggggaaagataaacaacagaggagagtttatatgtccccctagaacctggcggcagcgcaaaagatg

SEQ ID NO: 52734 - DNA, 103 bp, Artificial Sequence
  Synthetic Polynucleotide
taatacgactcactatagggtattacggccaatgtatctagggggaaagaaacagaggagatctttcatgctagatacaaacctggcggcagcgcaaaagatg

SEQ ID NO: 52735 - DNA, 103 bp, Artificial Sequence
  Synthetic Polynucleotide
taatacgactcactatagggacaactattacggccaatgtatctagggggaacagaggagaccccctatgtacattggcaacctggcggcagcgcaaaagatg

SEQ ID NO: 52736 - DNA, 103 bp, Artificial Sequence
  Synthetic Polynucleotide
taatacgactcactatagggcaacgcttacaggatctataccatataaaaaacagaggagattttatatggtatagatcaacctggcggcagcgcaaaagatg

SEQ ID NO: 52737 - DNA, 103 bp, Artificial Sequence
  Synthetic Polynucleotide
taatacgactcactataggggaccgacaactattacggccaatgtatctaaacagaggagatagataatgtggccgtaaaacctggcggcagcgcaaaagatg

SEQ ID NO: 52738 - DNA, 103 bp, Artificial Sequence
  Synthetic Polynucleotide
taatacgactcactatagggctttagaccgacaactattacggccaatgtaacagaggagaacattgatggtaatagttaacctggcggcagcgcaaaagatg

SEQ ID NO: 52739 - DNA, 103 bp, Artificial Sequence
  Synthetic Polynucleotide
taatacgactcactatagggatattctttagaccgacaactattacggccaacagaggagaggccgtatgagttgtcggaacctggcggcagcgcaaaagatg

SEQ ID NO: 52740 - DNA, 103 bp, Artificial Sequence
  Synthetic Polynucleotide
taatacgactcactatagggcaaagatattctttagaccgacaactattaaacagaggagataatagatgtcggtctaaaacctggcggcagcgcaaaagatg

SEQ ID NO: 52741 - DNA, 103 bp, Artificial Sequence
  Synthetic Polynucleotide
taatacgactcactatagggtacaccaaagatattctttagaccgacaacaacagaggagagttgtcatgctaaagaataacctggcggcagcgcaaaagatg

SEQ ID NO: 52742 - DNA, 103 bp, Artificial Sequence
  Synthetic Polynucleotide
taatacgactcactatagggaactttacaccaaagatattctttagaccgaacagaggagacggtctatggaatatcttaacctggcggcagcgcaaaagatg

SEQ ID NO: 52743 - DNA, 103 bp, Artificial Sequence
  Synthetic Polynucleotide
taatacgactcactatagggcttttaactttacaccaaagatattctttaaacagaggagataaagaatgtctttggtgaacctggcggcagcgcaaaagatg

SEQ ID NO: 52744 - DNA, 103 bp, Artificial Sequence
  Synthetic Polynucleotide
taatacgactcactatagggcctaacttttaactttacaccaaagatattaacagaggagaaatatcatgggtgtaaagaacctggcggcagcgcaaaagatg

SEQ ID NO: 52745 - DNA, 103 bp, Artificial Sequence
  Synthetic Polynucleotide
taatacgactcactatagggagaaccctaacttttaactttacaccaaagaacagaggagactttggatgaaagttaaaaacctggcggcagcgcaaaagatg

SEQ ID NO: 52746 - DNA, 103 bp, Artificial Sequence
  Synthetic Polynucleotide
taatacgactcactataggggaacaagaaccctaacttttaactttacacaacagaggagagtgtaaatgtaaaagttaaacctggcggcagcgcaaaagatg

SEQ ID NO: 52747 - DNA, 103 bp, Artificial Sequence
  Synthetic Polynucleotide
taatacgactcactatagggacagacaacgcttacaggatctataccataaacagaggagatatggtatggatcctgtaaacctggcggcagcgcaaaagatg

SEQ ID NO: 52748 - DNA, 103 bp, Artificial Sequence
  Synthetic Polynucleotide
taatacgactcactatagggtaatggaacaagaaccctaacttttaacttaacagaggagaaagttaatggttagggttaacctggcggcagcgcaaaagatg

SEQ ID NO: 52749 - DNA, 103 bp, Artificial Sequence
  Synthetic Polynucleotide
taatacgactcactatagggagcaataatggaacaagaaccctaacttttaacagaggagaaaaagtatgggttcttgtaacctggcggcagcgcaaaagatg

SEQ ID NO: 52750 - DNA, 103 bp, Artificial Sequence
  Synthetic Polynucleotide
taatacgactcactatagggcaaaaagcaataatggaacaagaaccctaaaacagaggagattagggatgttgttccataacctggcggcagcgcaaaagatg

SEQ ID NO: 52751 - DNA, 103 bp, Artificial Sequence
  Synthetic Polynucleotide
taatacgactcactatagggactgacaaaaagcaataatggaacaagaacaacagaggagagttcttatgccattattgaacctggcggcagcgcaaaagatg

SEQ ID NO: 52752 - DNA, 103 bp, Artificial Sequence
  Synthetic Polynucleotide
taatacgactcactataggggaactactgacaaaaagcaataatggaacaaacagaggagatgttccatgattgcttttaacctggcggcagcgcaaaagatg

SEQ ID NO: 52753 - DNA, 103 bp, Artificial Sequence
  Synthetic Polynucleotide
taatacgactcactatagggataatgaactactgacaaaaagcaataatgaacagaggagacattatatgtttttgtcaaacctggcggcagcgcaaaagatg

SEQ ID NO: 52754 - DNA, 103 bp, Artificial Sequence
  Synthetic Polynucleotide
taatacgactcactatagggaatttataatgaactactgacaaaaagcaaaacagaggagattgcttatggtcagtagtaacctggcggcagcgcaaaagatg

SEQ ID NO: 52755 - DNA, 103 bp, Artificial Sequence
  Synthetic Polynucleotide
taatacgactcactatagggtcgagaatttataatgaactactgacaaaaaacagaggagattttgtatgtagttcattaacctggcggcagcgcaaaagatg

SEQ ID NO: 52756 - DNA, 103 bp, Artificial Sequence
  Synthetic Polynucleotide
taatacgactcactatagggccatctcgagaatttataatgaactactgaaacagaggagatcagtaatgcattataaaaacctggcggcagcgcaaaagatg

SEQ ID NO: 52757 - DNA, 103 bp, Artificial Sequence
  Synthetic Polynucleotide
taatacgactcactatagggcgggcccatctcgagaatttataatgaactaacagaggagaagttcaatgtaaattctcaacctggcggcagcgcaaaagatg

SEQ ID NO: 52758 - DNA, 103 bp, Artificial Sequence
  Synthetic Polynucleotide
taatacgactcactatagggagaatacagacaacgcttacaggatctataaacagaggagatatagaatgtgtaagcgtaacctggcggcagcgcaaaagatg

SEQ ID NO: 52759 - DNA, 103 bp, Artificial Sequence
  Synthetic Polynucleotide
taatacgactcactataggggagaacgggcccatctcgagaatttataataacagaggagaattataatgtctcgagataacctggcggcagcgcaaaagatg

SEQ ID NO: 52760 - DNA, 103 bp, Artificial Sequence
  Synthetic Polynucleotide
taatacgactcactatagggattcagagaacgggcccatctcgagaatttaacagaggagaaaattcatgagatgggccaacctggcggcagcgcaaaagatg

SEQ ID NO: 52761 - DNA, 103 bp, Artificial Sequence
  Synthetic Polynucleotide
taatacgactcactatagggtctatattcagagaacgggcccatctcgagaacagaggagactcgagatgggcccgttcaacctggcggcagcgcaaaagatg

SEQ ID NO: 52762 - DNA, 103 bp, Artificial Sequence
  Synthetic Polynucleotide
taatacgactcactataggggatgttctatattcagagaacgggcccatcaacagaggagagatgggatggttctctgaaacctggcggcagcgcaaaagatg

SEQ ID NO: 52763 - DNA, 103 bp, Artificial Sequence
  Synthetic Polynucleotide
taatacgactcactataggggaaatgatgttctatattcagagaacgggcaacagaggagagcccgtatgctgaatataaacctggcggcagcgcaaaagatg

SEQ ID NO: 52764 - DNA, 103 bp, Artificial Sequence
  Synthetic Polynucleotide
taatacgactcactatagggatttggaaatgatgttctatattcagagaaaacagaggagattctctatgtatagaacaaacctggcggcagcgcaaaagatg

SEQ ID NO: 52765 - DNA, 103 bp, Artificial Sequence
  Synthetic Polynucleotide
taatacgactcactataggggttagatttggaaatgatgttctatattcaaacagaggagatgaataatgaacatcattaacctggcggcagcgcaaaagatg

SEQ ID NO: 52766 - DNA, 103 bp, Artificial Sequence
  Synthetic Polynucleotide
taatacgactcactatagggtagaagttagatttggaaatgatgttctataacagaggagaatagaaatgcatttccaaaacctggcggcagcgcaaaagatg

SEQ ID NO: 52767 - DNA, 103 bp, Artificial Sequence
  Synthetic Polynucleotide
taatacgactcactatagggtagactagaagttagatttggaaatgatgtaacagaggagaacatcaatgccaaatctaaacctggcggcagcgcaaaagatg

SEQ ID NO: 52768 - DNA, 103 bp, Artificial Sequence
  Synthetic Polynucleotide
taatacgactcactatagggatttctagactagaagttagatttggaaataacagaggagaatttccatgtctaacttcaacctggcggcagcgcaaaagatg

SEQ ID NO: 52769 - DNA, 103 bp, Artificial Sequence
  Synthetic Polynucleotide
taatacgactcactataggggctccagaatacagacaacgcttacaggataacagaggagaatcctgatggcgttgtctaacctggcggcagcgcaaaagatg

SEQ ID NO: 52770 - DNA, 103 bp, Artificial Sequence
  Synthetic Polynucleotide
taatacgactcactatagggatattatttctagactagaagttagatttgaacagaggagacaaatcatgcttctagtcaacctggcggcagcgcaaaagatg

SEQ ID NO: 52771 - DNA, 103 bp, Artificial Sequence
  Synthetic Polynucleotide
taatacgactcactataggggaccgatattatttctagactagaagttagaacagaggagactaactatgagtctagaaaacctggcggcagcgcaaaagatg

SEQ ID NO: 52772 - DNA, 103 bp, Artificial Sequence
  Synthetic Polynucleotide
taatacgactcactatagggaataagaccgatattatttctagactagaaaacagaggagattctagatgagaaataataacctggcggcagcgcaaaagatg

SEQ ID NO: 52773 - DNA, 103 bp, Artificial Sequence
  Synthetic Polynucleotide
taatacgactcactatagggttaagaataagaccgatattatttctagacaacagaggagagtctagatgtaatatcggaacctggcggcagcgcaaaagatg

SEQ ID NO: 52774 - DNA, 103 bp, Artificial Sequence
  Synthetic Polynucleotide
taatacgactcactatagggagattttaagaataagaccgatattatttcaacagaggagagaaataatgtcggtcttaaacctggcggcagcgcaaaagatg

SEQ ID NO: 52775 - DNA, 103 bp, Artificial Sequence
  Synthetic Polynucleotide
taatacgactcactatagggggaatagattttaagaataagaccgatattaacagaggagaaatatcatgcttattcttaacctggcggcagcgcaaaagatg

SEQ ID NO: 52776 - DNA, 103 bp, Artificial Sequence
  Synthetic Polynucleotide
taatacgactcactatagggtcaagggaatagattttaagaataagaccgaacagaggagacggtctatgtcttaaaataacctggcggcagcgcaaaagatg

SEQ ID NO: 52777 - DNA, 103 bp, Artificial Sequence
  Synthetic Polynucleotide
taatacgactcactatagggcttcatcaagggaatagattttaagaataaaacagaggagattattcatgaaatctattaacctggcggcagcgcaaaagatg

SEQ ID NO: 52778 - DNA, 103 bp, Artificial Sequence
  Synthetic Polynucleotide
taatacgactcactataggggatcccttcatcaagggaatagattttaagaacagaggagacttaaaatgtattcccttaacctggcggcagcgcaaaagatg

SEQ ID NO: 52779 - DNA, 103 bp, Artificial Sequence
  Synthetic Polynucleotide
taatacgactcactatagggttaacgatcccttcatcaagggaatagattaacagaggagaaatctaatgccttgatgaaacctggcggcagcgcaaaagatg

SEQ ID NO: 52780 - DNA, 103 bp, Artificial Sequence
  Synthetic Polynucleotide
taatacgactcactatagggaaatagctccagaatacagacaacgcttacaacagaggagagtaagcatggtctgtattaacctggcggcagcgcaaaagatg

SEQ ID NO: 52781 - DNA, 103 bp, Artificial Sequence
  Synthetic Polynucleotide
taatacgactcactataggggttcattaacgatcccttcatcaagggaataacagaggagaattcccatgatgaagggaaacctggcggcagcgcaaaagatg

SEQ ID NO: 52782 - DNA, 103 bp, Artificial Sequence
  Synthetic Polynucleotide
taatacgactcactataggggatttgttcattaacgatcccttcatcaagaacagaggagacttgatatggggatcgttaacctggcggcagcgcaaaagatg

SEQ ID NO: 52783 - DNA, 103 bp, Artificial Sequence
  Synthetic Polynucleotide
taatacgactcactatagggccaaggatttgttcattaacgatcccttcaaacagaggagatgaaggatgcgttaatgaaacctggcggcagcgcaaaagatg

SEQ ID NO: 52784 - DNA, 103 bp, Artificial Sequence
  Synthetic Polynucleotide
taatacgactcactatagggaaaggccaaggatttgttcattaacgatccaacagaggagaggatcgatgatgaacaaaaacctggcggcagcgcaaaagatg

SEQ ID NO: 52785 - DNA, 103 bp, Artificial Sequence
  Synthetic Polynucleotide
taatacgactcactataggggaatcaaaggccaaggatttgttcattaacaacagaggagagttaatatgcaaatccttaacctggcggcagcgcaaaagatg

SEQ ID NO: 52786 - DNA, 103 bp, Artificial Sequence
  Synthetic Polynucleotide
taatacgactcactatagggcagccgaatcaaaggccaaggatttgttcaaacagaggagatgaacaatgccttggcctaacctggcggcagcgcaaaagatg

SEQ ID NO: 52787 - DNA, 103 bp, Artificial Sequence
  Synthetic Polynucleotide
taatacgactcactatagggtagatcagccgaatcaaaggccaaggatttaacagaggagaaaatccatggcctttgataacctggcggcagcgcaaaagatg

SEQ ID NO: 52788 - DNA, 103 bp, Artificial Sequence
  Synthetic Polynucleotide
taatacgactcactataggggataatagatcagccgaatcaaaggccaagaacagaggagacttggcatgtgattcggcaacctggcggcagcgcaaaagatg

SEQ ID NO: 52789 - DNA, 103 bp, Artificial Sequence
  Synthetic Polynucleotide
taatacgactcactatagggacggagataatagatcagccgaatcaaaggaacagaggagacctttgatgcggctgatcaacctggcggcagcgcaaaagatg

SEQ ID NO: 52790 - DNA, 103 bp, Artificial Sequence
  Synthetic Polynucleotide
taatacgactcactatagggctataacggagataatagatcagccgaatcaacagaggagagattcgatggatctattaaacctggcggcagcgcaaaagatg

SEQ ID NO: 52791 - DNA, 103 bp, Artificial Sequence
  Synthetic Polynucleotide
taatacgactcactatagggataaaacatatagatcattttaaacatgaaaacagaggagattcatgatgaaaatgatcaacctggcggcagcgcaaaagatg

SEQ ID NO: 52792 - DNA, 103 bp, Artificial Sequence
  Synthetic Polynucleotide
taatacgactcactatagggagagaaaatagctccagaatacagacaacgaacagaggagacgttgtatgtattctggaaacctggcggcagcgcaaaagatg

SEQ ID NO: 52793 - DNA, 103 bp, Artificial Sequence
  Synthetic Polynucleotide
taatacgactcactatagggaacgtctataacggagataatagatcagccaacagaggagaggctgaatgattatctccaacctggcggcagcgcaaaagatg

SEQ ID NO: 52794 - DNA, 103 bp, Artificial Sequence
  Synthetic Polynucleotide
taatacgactcactatagggaacgtaacgtctataacggagataatagataacagaggagaatctatatgctccgttataacctggcggcagcgcaaaagatg

SEQ ID NO: 52795 - DNA, 103 bp, Artificial Sequence
  Synthetic Polynucleotide
taatacgactcactatagggtagtcaacgtaacgtctataacggagataaaacagaggagattatctatgttatagacgaacctggcggcagcgcaaaagatg

SEQ ID NO: 52796 - DNA, 103 bp, Artificial Sequence
  Synthetic Polynucleotide
taatacgactcactatagggtggactagtcaacgtaacgtctataacggaaacagaggagatccgttatggacgttacgaacctggcggcagcgcaaaagatg

SEQ ID NO: 52797 - DNA, 103 bp, Artificial Sequence
  Synthetic Polynucleotide
taatacgactcactataggggtctttggactagtcaacgtaacgtctataaacagaggagatatagaatgtacgttgacaacctggcggcagcgcaaaagatg

SEQ ID NO: 52798 - DNA, 103 bp, Artificial Sequence
  Synthetic Polynucleotide
taatacgactcactatagggtgtaagtctttggactagtcaacgtaacgtaacagaggagaacgttaatgtgactagtcaacctggcggcagcgcaaaagatg

SEQ ID NO: 52799 - DNA, 103 bp, Artificial Sequence
  Synthetic Polynucleotide
taatacgactcactatagggattcctgtaagtctttggactagtcaacgtaacagaggagaacgttgatgagtccaaagaacctggcggcagcgcaaaagatg

SEQ ID NO: 52800 - DNA, 103 bp, Artificial Sequence
  Synthetic Polynucleotide
taatacgactcactatagggcatctattcctgtaagtctttggactagtcaacagaggagagactagatgaaagacttaaacctggcggcagcgcaaaagatg

SEQ ID NO: 52801 - DNA, 103 bp, Artificial Sequence
  Synthetic Polynucleotide
taatacgactcactatagggcgatacatctattcctgtaagtctttggacaacagaggagagtccaaatgcttacaggaaacctggcggcagcgcaaaagatg

SEQ ID NO: 52802 - DNA, 103 bp, Artificial Sequence
  Synthetic Polynucleotide
taatacgactcactatagggatcatcgatacatctattcctgtaagtcttaacagaggagaaagactatgaggaatagaaacctggcggcagcgcaaaagatg

SEQ ID NO: 52803 - DNA, 103 bp, Artificial Sequence
  Synthetic Polynucleotide
taatacgactcactataggggcgatagagaaaatagctccagaatacagaaacagaggagatctgtaatgtggagctataacctggcggcagcgcaaaagatg

SEQ ID NO: 52804 - DNA, 103 bp, Artificial Sequence
  Synthetic Polynucleotide
taatacgactcactatagggtcaacatcatcgatacatctattcctgtaaaacagaggagattacagatgtagatgtataacctggcggcagcgcaaaagatg

SEQ ID NO: 52805 - DNA, 103 bp, Artificial Sequence
  Synthetic Polynucleotide
taatacgactcactatagggtagtatcaacatcatcgatacatctattccaacagaggagaggaataatggtatcgatgaacctggcggcagcgcaaaagatg

SEQ ID NO: 52806 - DNA, 103 bp, Artificial Sequence
  Synthetic Polynucleotide
taatacgactcactatagggtcacatagtatcaacatcatcgatacatctaacagaggagaagatgtatggatgatgttaacctggcggcagcgcaaaagatg

SEQ ID NO: 52807 - DNA, 103 bp, Artificial Sequence
  Synthetic Polynucleotide
taatacgactcactatagggacatatcacatagtatcaacatcatcgataaacagaggagatatcgaatgtgttgatacaacctggcggcagcgcaaaagatg

SEQ ID NO: 52808 - DNA, 103 bp, Artificial Sequence
  Synthetic Polynucleotide
taatacgactcactatagggtgcacacatatcacatagtatcaacatcataacagaggagaatgatgatgatactatgtaacctggcggcagcgcaaaagatg

SEQ ID NO: 52809 - DNA, 103 bp, Artificial Sequence
  Synthetic Polynucleotide
taatacgactcactataggggtctttgcacacatatcacatagtatcaacaacagaggagagttgatatgatgtgatataacctggcggcagcgcaaaagatg

SEQ ID NO: 52810 - DNA, 103 bp, Artificial Sequence
  Synthetic Polynucleotide
taatacgactcactataggggaacagtctttgcacacatatcacatagtaaacagaggagatactatatgatatgtgtgaacctggcggcagcgcaaaagatg

SEQ ID NO: 52811 - DNA, 103 bp, Artificial Sequence
  Synthetic Polynucleotide
taatacgactcactatagggcaagagaacagtctttgcacacatatcacaaacagaggagatgtgatatgtgtgcaaagaacctggcggcagcgcaaaagatg

SEQ ID NO: 52812 - DNA, 103 bp, Artificial Sequence
  Synthetic Polynucleotide
taatacgactcactataggggccaccaagagaacagtctttgcacacataaacagaggagatatgtgatgaaagactgtaacctggcggcagcgcaaaagatg

SEQ ID NO: 52813 - DNA, 103 bp, Artificial Sequence
  Synthetic Polynucleotide
taatacgactcactataggggcgacgccaccaagagaacagtctttgcacaacagaggagagtgcaaatgctgttctctaacctggcggcagcgcaaaagatg

SEQ ID NO: 52814 - DNA, 103 bp, Artificial Sequence
  Synthetic Polynucleotide
taatacgactcactatagggctaatgcgatagagaaaatagctccagaataacagaggagaattctgatgctattttctaacctggcggcagcgcaaaagatg

SEQ ID NO: 52815 - DNA, 103 bp, Artificial Sequence
  Synthetic Polynucleotide
taatacgactcactatagggatatagcgacgccaccaagagaacagtcttaacagaggagaaagactatgctcttggtgaacctggcggcagcgcaaaagatg

SEQ ID NO: 52816 - DNA, 103 bp, Artificial Sequence
  Synthetic Polynucleotide
taatacgactcactatagggggaacatatagcgacgccaccaagagaacaaacagaggagatgttctatgggtggcgtcaacctggcggcagcgcaaaagatg

SEQ ID NO: 52817 - DNA, 103 bp, Artificial Sequence
  Synthetic Polynucleotide
taatacgactcactatagggttactggaacatatagcgacgccaccaagaaacagaggagatcttggatgcgtcgctataacctggcggcagcgcaaaagatg

SEQ ID NO: 52818 - DNA, 103 bp, Artificial Sequence
  Synthetic Polynucleotide
taatacgactcactatagggcgccattactggaacatatagcgacgccacaacagaggagagtggcgatgctatatgttaacctggcggcagcgcaaaagatg

SEQ ID NO: 52819 - DNA, 103 bp, Artificial Sequence
  Synthetic Polynucleotide
taatacgactcactatagggttttccgccattactggaacatatagcgacaacagaggagagtcgctatgtgttccagtaacctggcggcagcgcaaaagatg

SEQ ID NO: 52820 - DNA, 103 bp, Artificial Sequence
  Synthetic Polynucleotide
taatacgactcactatagggaaaagttttccgccattactggaacatataaacagaggagatatatgatgcagtaatggaacctggcggcagcgcaaaagatg

SEQ ID NO: 52821 - DNA, 103 bp, Artificial Sequence
  Synthetic Polynucleotide
taatacgactcactatagggttctaaaaagttttccgccattactggaacaacagaggagagttccaatgatggcggaaaacctggcggcagcgcaaaagatg

SEQ ID NO: 52822 - DNA, 103 bp, Artificial Sequence
  Synthetic Polynucleotide
taatacgactcactatagggaacatttctaaaaagttttccgccattactaacagaggagaagtaatatgggaaaacttaacctggcggcagcgcaaaagatg

SEQ ID NO: 52823 - DNA, 103 bp, Artificial Sequence
  Synthetic Polynucleotide
taatacgactcactatagggtatataacatttctaaaaagttttccgccaaacagaggagatggcggatgactttttagaacctggcggcagcgcaaaagatg

SEQ ID NO: 52824 - DNA, 103 bp, Artificial Sequence
  Synthetic Polynucleotide
taatacgactcactatagggttttatatataacatttctaaaaagttttcaacagaggagagaaaacatgttagaaatgaacctggcggcagcgcaaaagatg

SEQ ID NO: 52825 - DNA, 103 bp, Artificial Sequence
  Synthetic Polynucleotide
taatacgactcactatagggactcactaatgcgatagagaaaatagctccaacagaggagaggagctatgttctctatcaacctggcggcagcgcaaaagatg

SEQ ID NO: 52826 - DNA, 103 bp, Artificial Sequence
  Synthetic Polynucleotide
taatacgactcactatagggaattcttttatatataacatttctaaaaagaacagaggagactttttatgaatgttataaacctggcggcagcgcaaaagatg

SEQ ID NO: 52827 - DNA, 103 bp, Artificial Sequence
  Synthetic Polynucleotide
taatacgactcactataggggaaaaaattcttttatatataacatttctaaacagaggagatagaaaatgtatatataaaacctggcggcagcgcaaaagatg

SEQ ID NO: 52828 - DNA, 103 bp, Artificial Sequence
  Synthetic Polynucleotide
taatacgactcactatagggaacccgaaaaaattcttttatatataacataacagaggagaatgttaatgataaaagaaaacctggcggcagcgcaaaagatg

SEQ ID NO: 52829 - DNA, 103 bp, Artificial Sequence
  Synthetic Polynucleotide
taatacgactcactatagggtttggaacccgaaaaaattcttttatatataacagaggagaatatatatgagaatttttaacctggcggcagcgcaaaagatg

SEQ ID NO: 52830 - DNA, 103 bp, Artificial Sequence
  Synthetic Polynucleotide
taatacgactcactatagggtaatgtttggaacccgaaaaaattcttttaaacagaggagataaaagatgtttttcgggaacctggcggcagcgcaaaagatg

SEQ ID NO: 52831 - DNA, 103 bp, Artificial Sequence
  Synthetic Polynucleotide
taatacgactcactatagggtctgttaatgtttggaacccgaaaaaattcaacagaggagagaatttatgcgggttccaaacctggcggcagcgcaaaagatg

SEQ ID NO: 52832 - DNA, 103 bp, Artificial Sequence
  Synthetic Polynucleotide
taatacgactcactatagggactaatctgttaatgtttggaacccgaaaaaacagaggagattttcgatgtccaaacataacctggcggcagcgcaaaagatg

SEQ ID NO: 52833 - DNA, 103 bp, Artificial Sequence
  Synthetic Polynucleotide
taatacgactcactatagggttcatactaatctgttaatgtttggaacccaacagaggagagggttcatgacattaacaaacctggcggcagcgcaaaagatg

SEQ ID NO: 52834 - DNA, 103 bp, Artificial Sequence
  Synthetic Polynucleotide
taatacgactcactatagggttatcttcatactaatctgttaatgtttggaacagaggagaccaaacatgaacagattaaacctggcggcagcgcaaaagatg

SEQ ID NO: 52835 - DNA, 103 bp, Artificial Sequence
  Synthetic Polynucleotide
taatacgactcactatagggagtgtttatcttcatactaatctgttaatgaacagaggagacattaaatgattagtatgaacctggcggcagcgcaaaagatg

SEQ ID NO: 52836 - DNA, 103 bp, Artificial Sequence
  Synthetic Polynucleotide
taatacgactcactatagggtctgaactcactaatgcgatagagaaaataaacagaggagatattttatgtatcgcattaacctggcggcagcgcaaaagatg

SEQ ID NO: 52837 - DNA, 103 bp, Artificial Sequence
  Synthetic Polynucleotide
taatacgactcactatagggatatgagtgtttatcttcatactaatctgtaacagaggagaacagatatgtatgaagataacctggcggcagcgcaaaagatg

SEQ ID NO: 52838 - DNA, 103 bp, Artificial Sequence
  Synthetic Polynucleotide
taatacgactcactatagggtgataatatgagtgtttatcttcatactaaaacagaggagattagtaatgagataaacaaacctggcggcagcgcaaaagatg

SEQ ID NO: 52839 - DNA, 103 bp, Artificial Sequence
  Synthetic Polynucleotide
taatacgactcactataggggttcctgataatatgagtgtttatcttcataacagaggagaatgaagatgaacactcataacctggcggcagcgcaaaagatg

SEQ ID NO: 52840 - DNA, 103 bp, Artificial Sequence
  Synthetic Polynucleotide
taatacgactcactatagggataatgttcctgataatatgagtgtttatcaacagaggagagataaaatgtcatattataacctggcggcagcgcaaaagatg

SEQ ID NO: 52841 - DNA, 103 bp, Artificial Sequence
  Synthetic Polynucleotide
taatacgactcactatagggaattgataatgttcctgataatatgagtgtaacagaggagaacactcatgttatcaggaaacctggcggcagcgcaaaagatg

SEQ ID NO: 52842 - DNA, 103 bp, Artificial Sequence
  Synthetic Polynucleotide
taatacgactcactataggggtaaaaattgataatgttcctgataatatgaacagaggagacatattatgaggaacattaacctggcggcagcgcaaaagatg

SEQ ID NO: 52843 - DNA, 103 bp, Artificial Sequence
  Synthetic Polynucleotide
taatacgactcactatagggtgtatgtaaaaattgataatgttcctgataaacagaggagatatcagatgcattatcaaaacctggcggcagcgcaaaagatg

SEQ ID NO: 52844 - DNA, 103 bp, Artificial Sequence
  Synthetic Polynucleotide
taatacgactcactatagggtgatgtgtatgtaaaaattgataatgttccaacagaggagaggaacaatgtcaatttttaacctggcggcagcgcaaaagatg

SEQ ID NO: 52845 - DNA, 103 bp, Artificial Sequence
  Synthetic Polynucleotide
taatacgactcactataggggatgctgatgtgtatgtaaaaattgataataacagaggagaattatcatgttttacataaacctggcggcagcgcaaaagatg

SEQ ID NO: 52846 - DNA, 103 bp, Artificial Sequence
  Synthetic Polynucleotide
taatacgactcactatagggttcaagatgctgatgtgtatgtaaaaattgaacagaggagacaatttatgcatacacataacctggcggcagcgcaaaagatg

SEQ ID NO: 52847 - DNA, 103 bp, Artificial Sequence
  Synthetic Polynucleotide
taatacgactcactatagggcatattctgaactcactaatgcgatagagaaacagaggagatctctaatgcattagtgaaacctggcggcagcgcaaaagatg

SEQ ID NO: 52848 - DNA, 103 bp, Artificial Sequence
  Synthetic Polynucleotide
taatacgactcactatagggttctattcaagatgctgatgtgtatgtaaaaacagaggagatttacaatgacatcagcaaacctggcggcagcgcaaaagatg

SEQ ID NO: 52849 - DNA, 103 bp, Artificial Sequence
  Synthetic Polynucleotide
taatacgactcactatagggatcgtttctattcaagatgctgatgtgtataacagaggagaatacacatgagcatcttgaacctggcggcagcgcaaaagatg

SEQ ID NO: 52850 - DNA, 103 bp, Artificial Sequence
  Synthetic Polynucleotide
taatacgactcactatagggatggtatcgtttctattcaagatgctgatgaacagaggagacatcagatgcttgaatagaacctggcggcagcgcaaaagatg

SEQ ID NO: 52851 - DNA, 103 bp, Artificial Sequence
  Synthetic Polynucleotide
taatacgactcactatagggagaagatggtatcgtttctattcaagatgcaacagaggagagcatctatgatagaaacgaacctggcggcagcgcaaaagatg

SEQ ID NO: 52852 - DNA, 103 bp, Artificial Sequence
  Synthetic Polynucleotide
taatacgactcactataggggttccagaagatggtatcgtttctattcaaaacagaggagattgaatatgaacgataccaacctggcggcagcgcaaaagatg

SEQ ID NO: 52853 - DNA, 103 bp, Artificial Sequence
  Synthetic Polynucleotide
taatacgactcactatagggttgaggttccagaagatggtatcgtttctaaacagaggagatagaaaatgtaccatcttaacctggcggcagcgcaaaagatg

SEQ ID NO: 52854 - DNA, 103 bp, Artificial Sequence
  Synthetic Polynucleotide
taatacgactcactataggggattgttgaggttccagaagatggtatcgtaacagaggagaacgataatgtcttctggaaacctggcggcagcgcaaaagatg

SEQ ID NO: 52855 - DNA, 103 bp, Artificial Sequence
  Synthetic Polynucleotide
taatacgactcactataggggccgagattgttgaggttccagaagatggtaacagaggagaaccatcatgtggaacctcaacctggcggcagcgcaaaagatg

SEQ ID NO: 52856 - DNA, 103 bp, Artificial Sequence
  Synthetic Polynucleotide
taatacgactcactatagggagtctgccgagattgttgaggttccagaagaacagaggagacttctgatgcctcaacaaaacctggcggcagcgcaaaagatg

SEQ ID NO: 52857 - DNA, 103 bp, Artificial Sequence
  Synthetic Polynucleotide
taatacgactcactatagggtccggagtctgccgagattgttgaggttccaacagaggagaggaaccatgacaatctcgaacctggcggcagcgcaaaagatg

SEQ ID NO: 52858 - DNA, 103 bp, Artificial Sequence
  Synthetic Polynucleotide
taatacgactcactatagggtataacatattctgaactcactaatgcgataacagaggagaatcgcaatggtgagttcaaacctggcggcagcgcaaaagatg

SEQ ID NO: 52859 - DNA, 103 bp, Artificial Sequence
  Synthetic Polynucleotide
taatacgactcactatagggggttatccggagtctgccgagattgttgagaacagaggagactcaacatgctcggcagaaacctggcggcagcgcaaaagatg

SEQ ID NO: 52860 - DNA, 103 bp, Artificial Sequence
  Synthetic Polynucleotide
taatacgactcactatagggcaactggttatccggagtctgccgagattgaacagaggagacaatctatgcagactccgaacctggcggcagcgcaaaagatg

SEQ ID NO: 52861 - DNA, 103 bp, Artificial Sequence
  Synthetic Polynucleotide
taatacgactcactatagggcccaccaactggttatccggagtctgccgaaacagaggagatcggcaatgtccggataaaacctggcggcagcgcaaaagatg

SEQ ID NO: 52862 - DNA, 103 bp, Artificial Sequence
  Synthetic Polynucleotide
taatacgactcactataggggatggcccaccaactggttatccggagtctaacagaggagaagactcatgataaccagtaacctggcggcagcgcaaaagatg

SEQ ID NO: 52863 - DNA, 103 bp, Artificial Sequence
  Synthetic Polynucleotide
taatacgactcactatagggttagtgatggcccaccaactggttatccggaacagaggagaccggatatgcagttggtgaacctggcggcagcgcaaaagatg

SEQ ID NO: 52864 - DNA, 103 bp, Artificial Sequence
  Synthetic Polynucleotide
taatacgactcactatagggtattgttagtgatggcccaccaactggttaaacagaggagataaccaatgggtgggccaaacctggcggcagcgcaaaagatg

SEQ ID NO: 52865 - DNA, 103 bp, Artificial Sequence
  Synthetic Polynucleotide
taatacgactcactatagggctagttattgttagtgatggcccaccaactaacagaggagaagttggatggccatcactaacctggcggcagcgcaaaagatg

SEQ ID NO: 52866 - DNA, 103 bp, Artificial Sequence
  Synthetic Polynucleotide
taatacgactcactatagggatgatctagttattgttagtgatggcccacaacagaggagagtgggcatgcactaacaaaacctggcggcagcgcaaaagatg

SEQ ID NO: 52867 - DNA, 103 bp, Artificial Sequence
  Synthetic Polynucleotide
taatacgactcactataggggttggatgatctagttattgttagtgatggaacagaggagaccatcaatgacaataactaacctggcggcagcgcaaaagatg

SEQ ID NO: 52868 - DNA, 103 bp, Artificial Sequence
  Synthetic Polynucleotide
taatacgactcactatagggagattgttggatgatctagttattgttagtaacagaggagaactaacatgaactagatcaacctggcggcagcgcaaaagatg

SEQ ID NO: 52869 - DNA, 103 bp, Artificial Sequence
  Synthetic Polynucleotide
taatacgactcactatagggaaatttataacatattctgaactcactaataacagaggagaattagtatgttcagaataaacctggcggcagcgcaaaagatg

SEQ ID NO: 52870 - DNA, 103 bp, Artificial Sequence
  Synthetic Polynucleotide
taatacgactcactatagggtgagtagattgttggatgatctagttattgaacagaggagacaataaatggatcatccaaacctggcggcagcgcaaaagatg

SEQ ID NO: 52871 - DNA, 103 bp, Artificial Sequence
  Synthetic Polynucleotide
taatacgactcactatagggatatgtgagtagattgttggatgatctagtaacagaggagaactagaatgtccaacaataacctggcggcagcgcaaaagatg

SEQ ID NO: 52872 - DNA, 103 bp, Artificial Sequence
  Synthetic Polynucleotide
taatacgactcactataggggatgcatatgtgagtagattgttggatgataacagaggagaatcatcatgcaatctactaacctggcggcagcgcaaaagatg

SEQ ID NO: 52873 - DNA, 103 bp, Artificial Sequence
  Synthetic Polynucleotide
taatacgactcactatagggatatagatgcatatgtgagtagattgttggaacagaggagaccaacaatgtactcacataacctggcggcagcgcaaaagatg

SEQ ID NO: 52874 - DNA, 103 bp, Artificial Sequence
  Synthetic Polynucleotide
taatacgactcactatagggagattatatagatgcatatgtgagtagattaacagaggagaaatctaatgacatatgcaaacctggcggcagcgcaaaagatg

SEQ ID NO: 52875 - DNA, 103 bp, Artificial Sequence
  Synthetic Polynucleotide
taatacgactcactataggggaaaaagattatatagatgcatatgtgagtaacagaggagaactcacatgtgcatctataacctggcggcagcgcaaaagatg

SEQ ID NO: 52876 - DNA, 103 bp, Artificial Sequence
  Synthetic Polynucleotide
taatacgactcactatagggaagatgaaaaagattatatagatgcatatgaacagaggagacatatgatgctatataataacctggcggcagcgcaaaagatg

SEQ ID NO: 52877 - DNA, 103 bp, Artificial Sequence
  Synthetic Polynucleotide
taatacgactcactatagggctcacaagatgaaaaagattatatagatgcaacagaggagagcatctatgtaatcttttaacctggcggcagcgcaaaagatg

SEQ ID NO: 52878 - DNA, 103 bp, Artificial Sequence
  Synthetic Polynucleotide
taatacgactcactataggggggtactcacaagatgaaaaagattatataaacagaggagatatataatgtttttcatcaacctggcggcagcgcaaaagatg

SEQ ID NO: 52879 - DNA, 103 bp, Artificial Sequence
  Synthetic Polynucleotide
taatacgactcactatagggatccagggtactcacaagatgaaaaagattaacagaggagaaatcttatgcatcttgtgaacctggcggcagcgcaaaagatg

SEQ ID NO: 52880 - DNA, 103 bp, Artificial Sequence
  Synthetic Polynucleotide
taatacgactcactataggggatttaaatttataacatattctgaactcaaacagaggagatgagttatgaatatgttaaacctggcggcagcgcaaaagatg

SEQ ID NO: 52881 - DNA, 103 bp, Artificial Sequence
  Synthetic Polynucleotide
taatacgactcactatagggttcgtatccagggtactcacaagatgaaaaaacagaggagattttcaatgtgtgagtacaacctggcggcagcgcaaaagatg

SEQ ID NO: 52882 - DNA, 103 bp, Artificial Sequence
  Synthetic Polynucleotide
taatacgactcactatagggtttatttcgtatccagggtactcacaagataacagaggagaatcttgatggtaccctggaacctggcggcagcgcaaaagatg

SEQ ID NO: 52883 - DNA, 103 bp, Artificial Sequence
  Synthetic Polynucleotide
taatacgactcactatagggataaatttatttcgtatccagggtactcacaacagaggagagtgagtatgctggatacgaacctggcggcagcgcaaaagatg

SEQ ID NO: 52884 - DNA, 103 bp, Artificial Sequence
  Synthetic Polynucleotide
taatacgactcactatagggggataataaatttatttcgtatccagggtaaacagaggagataccctatgtacgaaataaacctggcggcagcgcaaaagatg

SEQ ID NO: 52885 - DNA, 103 bp, Artificial Sequence
  Synthetic Polynucleotide
taatacgactcactatagggaatacggataataaatttatttcgtatccaaacagaggagatggataatgaataaatttaacctggcggcagcgcaaaagatg

SEQ ID NO: 52886 - DNA, 103 bp, Artificial Sequence
  Synthetic Polynucleotide
taatacgactcactatagggatggaaatacggataataaatttatttcgtaacagaggagaacgaaaatgatttattataacctggcggcagcgcaaaagatg

SEQ ID NO: 52887 - DNA, 103 bp, Artificial Sequence
  Synthetic Polynucleotide
taatacgactcactatagggttattatggaaatacggataataaatttataacagaggagaataaatatgttatccgtaaacctggcggcagcgcaaaagatg

SEQ ID NO: 52888 - DNA, 103 bp, Artificial Sequence
  Synthetic Polynucleotide
taatacgactcactatagggaaaccttattatggaaatacggataataaaaacagaggagatttattatgcgtatttccaacctggcggcagcgcaaaagatg

SEQ ID NO: 52889 - DNA, 103 bp, Artificial Sequence
  Synthetic Polynucleotide
taatacgactcactatagggatactaaaccttattatggaaatacggataaacagaggagatatccgatgttccataataacctggcggcagcgcaaaagatg

SEQ ID NO: 52890 - DNA, 103 bp, Artificial Sequence
  Synthetic Polynucleotide
taatacgactcactatagggtgtttatactaaaccttattatggaaatacaacagaggagagtatttatgtaataaggtaacctggcggcagcgcaaaagatg

SEQ ID NO: 52891 - DNA, 103 bp, Artificial Sequence
  Synthetic Polynucleotide
taatacgactcactatagggtattcgatttaaatttataacatattctgaaacagaggagatcagaaatggttataaataacctggcggcagcgcaaaagatg

SEQ ID NO: 52892 - DNA, 103 bp, Artificial Sequence
  Synthetic Polynucleotide
taatacgactcactatagggctctctgtttatactaaaccttattatggaaacagaggagatccataatgaggtttagtaacctggcggcagcgcaaaagatg

SEQ ID NO: 52893 - DNA, 103 bp, Artificial Sequence
  Synthetic Polynucleotide
taatacgactcactatagggcatcgctctctgtttatactaaaccttattaacagaggagaaataagatgtagtataaaaacctggcggcagcgcaaaagatg

SEQ ID NO: 52894 - DNA, 103 bp, Artificial Sequence
  Synthetic Polynucleotide
taatacgactcactatagggggcaacatcgctctctgtttatactaaaccaacagaggagaggtttaatgtaaacagagaacctggcggcagcgcaaaagatg

SEQ ID NO: 52895 - DNA, 103 bp, Artificial Sequence
  Synthetic Polynucleotide
taatacgactcactatagggcatgcggcaacatcgctctctgtttatactaacagaggagaagtataatgagagagcgaaacctggcggcagcgcaaaagatg

SEQ ID NO: 52896 - DNA, 103 bp, Artificial Sequence
  Synthetic Polynucleotide
taatacgactcactatagggaagttcatgcggcaacatcgctctctgtttaacagaggagaaaacagatggcgatgttgaacctggcggcagcgcaaaagatg

SEQ ID NO: 52897 - DNA, 103 bp, Artificial Sequence
  Synthetic Polynucleotide
taatacgactcactatagggaactgaagttcatgcggcaacatcgctctcaacagaggagagagagcatggttgccgcaaacctggcggcagcgcaaaagatg

SEQ ID NO: 52898 - DNA, 103 bp, Artificial Sequence
  Synthetic Polynucleotide
taatacgactcactatagggactgtaactgaagttcatgcggcaacatcgaacagaggagacgatgtatgcgcatgaacaacctggcggcagcgcaaaagatg

SEQ ID NO: 52899 - DNA, 103 bp, Artificial Sequence
  Synthetic Polynucleotide
taatacgactcactatagggcggcgactgtaactgaagttcatgcggcaaaacagaggagattgccgatggaacttcagaacctggcggcagcgcaaaagatg

SEQ ID NO: 52900 - DNA, 103 bp, Artificial Sequence
  Synthetic Polynucleotide
taatacgactcactatagggaccaacggcgactgtaactgaagttcatgcaacagaggagagcatgaatgtcagttacaaacctggcggcagcgcaaaagatg

SEQ ID NO: 52901 - DNA, 103 bp, Artificial Sequence
  Synthetic Polynucleotide
taatacgactcactatagggaaccaaccaacggcgactgtaactgaagttaacagaggagaaacttcatgtacagtcgcaacctggcggcagcgcaaaagatg

SEQ ID NO: 52902 - DNA, 103 bp, Artificial Sequence
  Synthetic Polynucleotide
taatacgactcactatagggtcaaacaataacgttcaacaacatatactcaacagaggagagagtatatgttgttgaacaacctggcggcagcgcaaaagatg

SEQ ID NO: 52903 - DNA, 103 bp, Artificial Sequence
  Synthetic Polynucleotide
taatacgactcactatagggttatcaaaacatatagatagacgaggaaacaacagaggagagtttccatgtctatctataacctggcggcagcgcaaaagatg

SEQ ID NO: 52904 - DNA, 103 bp, Artificial Sequence
  Synthetic Polynucleotide
taatacgactcactatagggaattaataaaacatatagatcattttaaacaacagaggagagtttaaatggatctatataacctggcggcagcgcaaaagatg

SEQ ID NO: 52905 - DNA, 103 bp, Artificial Sequence
  Synthetic Polynucleotide
taatacgactcactatagggttcgttattcgatttaaatttataacatataacagaggagaatatgtatgaaatttaaaaacctggcggcagcgcaaaagatg

SEQ ID NO: 52906 - DNA, 103 bp, Artificial Sequence
  Synthetic Polynucleotide
taatacgactcactatagggaaataaaccaaccaacggcgactgtaactgaacagaggagacagttaatgtcgccgttgaacctggcggcagcgcaaaagatg

SEQ ID NO: 52907 - DNA, 103 bp, Artificial Sequence
  Synthetic Polynucleotide
taatacgactcactatagggaggtcaaataaaccaaccaacggcgactgtaacagaggagaacagtcatggttggttggaacctggcggcagcgcaaaagatg

SEQ ID NO: 52908 - DNA, 103 bp, Artificial Sequence
  Synthetic Polynucleotide
taatacgactcactataggggtaataggtcaaataaaccaaccaacggcgaacagaggagacgccgtatgttggtttataacctggcggcagcgcaaaagatg

SEQ ID NO: 52909 - DNA, 103 bp, Artificial Sequence
  Synthetic Polynucleotide
taatacgactcactatagggggagagtaataggtcaaataaaccaaccaaaacagaggagattggttatgttatttgacaacctggcggcagcgcaaaagatg

SEQ ID NO: 52910 - DNA, 103 bp, Artificial Sequence
  Synthetic Polynucleotide
taatacgactcactatagggacctaggagagtaataggtcaaataaaccaaacagaggagatggtttatgtgacctattaacctggcggcagcgcaaaagatg

SEQ ID NO: 52911 - DNA, 103 bp, Artificial Sequence
  Synthetic Polynucleotide
taatacgactcactataggggagaaacctaggagagtaataggtcaaataaacagaggagatatttgatgtattactctaacctggcggcagcgcaaaagatg

SEQ ID NO: 52912 - DNA, 103 bp, Artificial Sequence
  Synthetic Polynucleotide
taatacgactcactatagggttatagagaaacctaggagagtaataggtcaacagaggagagacctaatgctctcctagaacctggcggcagcgcaaaagatg

SEQ ID NO: 52913 - DNA, 103 bp, Artificial Sequence
  Synthetic Polynucleotide
taatacgactcactatagggatcgtttatagagaaacctaggagagtaataacagaggagaattactatgctaggtttcaacctggcggcagcgcaaaagatg

SEQ ID NO: 52914 - DNA, 103 bp, Artificial Sequence
  Synthetic Polynucleotide
taatacgactcactatagggaaaccatcgtttatagagaaacctaggagaaacagaggagatctcctatgtttctctataacctggcggcagcgcaaaagatg

SEQ ID NO: 52915 - DNA, 103 bp, Artificial Sequence
  Synthetic Polynucleotide
taatacgactcactatagggaaattaaaccatcgtttatagagaaacctaaacagaggagataggttatgctataaacgaacctggcggcagcgcaaaagatg

SEQ ID NO: 52916 - DNA, 103 bp, Artificial Sequence
  Synthetic Polynucleotide
taatacgactcactatagggttatgttcgttattcgatttaaatttataaaacagaggagattataaatgtaaatcgaaaacctggcggcagcgcaaaagatg

SEQ ID NO: 52917 - DNA, 103 bp, Artificial Sequence
  Synthetic Polynucleotide
taatacgactcactatagggtgtacaaattaaaccatcgtttatagagaaaacagaggagattctctatgaacgatggtaacctggcggcagcgcaaaagatg

SEQ ID NO: 52918 - DNA, 103 bp, Artificial Sequence
  Synthetic Polynucleotide
taatacgactcactatagggaagaatgtacaaattaaaccatcgtttataaacagaggagatataaaatgtggtttaataacctggcggcagcgcaaaagatg

SEQ ID NO: 52919 - DNA, 103 bp, Artificial Sequence
  Synthetic Polynucleotide
taatacgactcactatagggtggttaagaatgtacaaattaaaccatcgtaacagaggagaacgatgatgtaatttgtaaacctggcggcagcgcaaaagatg

SEQ ID NO: 52920 - DNA, 103 bp, Artificial Sequence
  Synthetic Polynucleotide
taatacgactcactatagggatatatggttaagaatgtacaaattaaaccaacagaggagaggtttaatgtgtacattcaacctggcggcagcgcaaaagatg

SEQ ID NO: 52921 - DNA, 103 bp, Artificial Sequence
  Synthetic Polynucleotide
taatacgactcactatagggattggatatatggttaagaatgtacaaattaacagaggagaaatttgatgattcttaacaacctggcggcagcgcaaaagatg

SEQ ID NO: 52922 - DNA, 103 bp, Artificial Sequence
  Synthetic Polynucleotide
taatacgactcactataggggctttattggatatatggttaagaatgtacaacagaggagagtacatatgtaaccatataacctggcggcagcgcaaaagatg

SEQ ID NO: 52923 - DNA, 103 bp, Artificial Sequence
  Synthetic Polynucleotide
taatacgactcactatagggattgagctttattggatatatggttaagaaaacagaggagattcttaatgatatatccaaacctggcggcagcgcaaaagatg

SEQ ID NO: 52924 - DNA, 103 bp, Artificial Sequence
  Synthetic Polynucleotide
taatacgactcactatagggcctgaattgagctttattggatatatggttaacagaggagaaaccatatgtccaataaaaacctggcggcagcgcaaaagatg

SEQ ID NO: 52925 - DNA, 103 bp, Artificial Sequence
  Synthetic Polynucleotide
taatacgactcactatagggatgttcctgaattgagctttattggatataaacagaggagatatatcatgtaaagctcaaacctggcggcagcgcaaaagatg

SEQ ID NO: 52926 - DNA, 103 bp, Artificial Sequence
  Synthetic Polynucleotide
taatacgactcactatagggtgtttatgttcctgaattgagctttattggaacagaggagaccaataatgctcaattcaaacctggcggcagcgcaaaagatg

SEQ ID NO: 52927 - DNA, 103 bp, Artificial Sequence
  Synthetic Polynucleotide
taatacgactcactatagggtaaagttatgttcgttattcgatttaaattaacagaggagaaatttaatgcgaataacgaacctggcggcagcgcaaaagatg

SEQ ID NO: 52928 - DNA, 103 bp, Artificial Sequence
  Synthetic Polynucleotide
taatacgactcactataggggaatttgtttatgttcctgaattgagctttaacagaggagaaaagctatgttcaggaacaacctggcggcagcgcaaaagatg

SEQ ID NO: 52929 - DNA, 103 bp, Artificial Sequence
  Synthetic Polynucleotide
taatacgactcactatagggacaaagaatttgtttatgttcctgaattgaaacagaggagatcaattatggaacataaaaacctggcggcagcgcaaaagatg

SEQ ID NO: 52930 - DNA, 103 bp, Artificial Sequence
  Synthetic Polynucleotide
taatacgactcactataggggttcaacaaagaatttgtttatgttcctgaaacagaggagatcaggaatgtaaacaaataacctggcggcagcgcaaaagatg

SEQ ID NO: 52931 - DNA, 103 bp, Artificial Sequence
  Synthetic Polynucleotide
taatacgactcactataggggaaacgttcaacaaagaatttgtttatgttaacagaggagaaacataatgaaattctttaacctggcggcagcgcaaaagatg

SEQ ID NO: 52932 - DNA, 103 bp, Artificial Sequence
  Synthetic Polynucleotide
taatacgactcactatagggactttgaaacgttcaacaaagaatttgtttaacagaggagaaaacaaatgctttgttgaaacctggcggcagcgcaaaagatg

SEQ ID NO: 52933 - DNA, 103 bp, Artificial Sequence
  Synthetic Polynucleotide
taatacgactcactataggggttcgactttgaaacgttcaacaaagaattaacagaggagaaattctatgttgaacgttaacctggcggcagcgcaaaagatg

SEQ ID NO: 52934 - DNA, 103 bp, Artificial Sequence
  Synthetic Polynucleotide
taatacgactcactatagggtcttcgttcgactttgaaacgttcaacaaaaacagaggagatttgttatgcgtttcaaaaacctggcggcagcgcaaaagatg

SEQ ID NO: 52935 - DNA, 103 bp, Artificial Sequence
  Synthetic Polynucleotide
taatacgactcactataggggcgactcttcgttcgactttgaaacgttcaaacagaggagatgaacgatgcaaagtcgaaacctggcggcagcgcaaaagatg

SEQ ID NO: 52936 - DNA, 103 bp, Artificial Sequence
  Synthetic Polynucleotide
taatacgactcactatagggtattcgcgactcttcgttcgactttgaaacaacagaggagagtttcaatgtcgaacgaaaacctggcggcagcgcaaaagatg

SEQ ID NO: 52937 - DNA, 103 bp, Artificial Sequence
  Synthetic Polynucleotide
taatacgactcactatagggatcgttattcgcgactcttcgttcgactttaacagaggagaaaagtcatgcgaagagtcaacctggcggcagcgcaaaagatg

SEQ ID NO: 52938 - DNA, 103 bp, Artificial Sequence
  Synthetic Polynucleotide
taatacgactcactatagggtttactaaagttatgttcgttattcgatttaacagaggagaaaatcgatgaacgaacataacctggcggcagcgcaaaagatg

SEQ ID NO: 52939 - DNA, 103 bp, Artificial Sequence
  Synthetic Polynucleotide
taatacgactcactatagggccgatatcgttattcgcgactcttcgttcgaacagaggagacgaacgatgagtcgcgaaaacctggcggcagcgcaaaagatg

SEQ ID NO: 52940 - DNA, 103 bp, Artificial Sequence
  Synthetic Polynucleotide
taatacgactcactatagggagtatccgatatcgttattcgcgactcttcaacagaggagagaagagatgcgaataacgaacctggcggcagcgcaaaagatg

SEQ ID NO: 52941 - DNA, 103 bp, Artificial Sequence
  Synthetic Polynucleotide
taatacgactcactatagggaatccagtatccgatatcgttattcgcgacaacagaggagagtcgcgatgaacgatatcaacctggcggcagcgcaaaagatg

SEQ ID NO: 52942 - DNA, 103 bp, Artificial Sequence
  Synthetic Polynucleotide
taatacgactcactatagggccttcaatccagtatccgatatcgttattcaacagaggagagaataaatgtatcggataaacctggcggcagcgcaaaagatg

SEQ ID NO: 52943 - DNA, 103 bp, Artificial Sequence
  Synthetic Polynucleotide
taatacgactcactatagggggtgaccttcaatccagtatccgatatcgtaacagaggagaacgataatggatactggaaacctggcggcagcgcaaaagatg

SEQ ID NO: 52944 - DNA, 103 bp, Artificial Sequence
  Synthetic Polynucleotide
taatacgactcactataggggtaacggtgaccttcaatccagtatccgataacagaggagaatcggaatgtggattgaaaacctggcggcagcgcaaaagatg

SEQ ID NO: 52945 - DNA, 103 bp, Artificial Sequence
  Synthetic Polynucleotide
taatacgactcactatagggttaccgtaacggtgaccttcaatccagtataacagaggagaatactgatgtgaaggtcaaacctggcggcagcgcaaaagatg

SEQ ID NO: 52946 - DNA, 103 bp, Artificial Sequence
  Synthetic Polynucleotide
taatacgactcactatagggaaaaattaccgtaacggtgaccttcaatccaacagaggagaggattgatggtcaccgttaacctggcggcagcgcaaaagatg

SEQ ID NO: 52947 - DNA, 103 bp, Artificial Sequence
  Synthetic Polynucleotide
taatacgactcactataggggattcaaaaattaccgtaacggtgaccttcaacagaggagagaaggtatgcgttacggtaacctggcggcagcgcaaaagatg

SEQ ID NO: 52948 - DNA, 103 bp, Artificial Sequence
  Synthetic Polynucleotide
taatacgactcactatagggtatccgattcaaaaattaccgtaacggtgaaacagaggagatcaccgatgcggtaatttaacctggcggcagcgcaaaagatg

SEQ ID NO: 52949 - DNA, 103 bp, Artificial Sequence
  Synthetic Polynucleotide
taatacgactcactatagggacaactttactaaagttatgttcgttattcaacagaggagagaataaatgacataacttaacctggcggcagcgcaaaagatg

SEQ ID NO: 52950 - DNA, 103 bp, Artificial Sequence
  Synthetic Polynucleotide
taatacgactcactatagggtaaactatccgattcaaaaattaccgtaacaacagaggagagttacgatgatttttgaaaacctggcggcagcgcaaaagatg

SEQ ID NO: 52951 - DNA, 103 bp, Artificial Sequence
  Synthetic Polynucleotide
taatacgactcactatagggagtcttaaactatccgattcaaaaattaccaacagaggagaggtaatatgtgaatcggaaacctggcggcagcgcaaaagatg

SEQ ID NO: 52952 - DNA, 103 bp, Artificial Sequence
  Synthetic Polynucleotide
taatacgactcactatagggttagcagtcttaaactatccgattcaaaaaaacagaggagatttttgatgcggatagttaacctggcggcagcgcaaaagatg

SEQ ID NO: 52953 - DNA, 103 bp, Artificial Sequence
  Synthetic Polynucleotide
taatacgactcactatagggtacatttagcagtcttaaactatccgattcaacagaggagagaatcgatgagtttaagaaacctggcggcagcgcaaaagatg

SEQ ID NO: 52954 - DNA, 103 bp, Artificial Sequence
  Synthetic Polynucleotide
taatacgactcactataggggaagatacatttagcagtcttaaactatccaacagaggagaggatagatgaagactgctaacctggcggcagcgcaaaagatg

SEQ ID NO: 52955 - DNA, 103 bp, Artificial Sequence
  Synthetic Polynucleotide
taatacgactcactatagggatgtggaagatacatttagcagtcttaaacaacagaggagagtttaaatgtgctaaatgaacctggcggcagcgcaaaagatg

SEQ ID NO: 52956 - DNA, 103 bp, Artificial Sequence
  Synthetic Polynucleotide
taatacgactcactataggggtttgatgtggaagatacatttagcagtctaacagaggagaagactgatgaatgtatctaacctggcggcagcgcaaaagatg

SEQ ID NO: 52957 - DNA, 103 bp, Artificial Sequence
  Synthetic Polynucleotide
taatacgactcactatagggactccgtttgatgtggaagatacatttagcaacagaggagagctaaaatgatcttccacaacctggcggcagcgcaaaagatg

SEQ ID NO: 52958 - DNA, 103 bp, Artificial Sequence
  Synthetic Polynucleotide
taatacgactcactatagggttaaaactccgtttgatgtggaagatacataacagaggagaatgtatatgccacatcaaaacctggcggcagcgcaaaagatg

SEQ ID NO: 52959 - DNA, 103 bp, Artificial Sequence
  Synthetic Polynucleotide
taatacgactcactatagggttatattaaaactccgtttgatgtggaagaaacagaggagatcttccatgtcaaacggaaacctggcggcagcgcaaaagatg

SEQ ID NO: 52960 - DNA, 103 bp, Artificial Sequence
  Synthetic Polynucleotide
taatacgactcactatagggtatagacaactttactaaagttatgttcgtaacagaggagaacgaacatgactttagtaaacctggcggcagcgcaaaagatg

SEQ ID NO: 52961 - DNA, 103 bp, Artificial Sequence
  Synthetic Polynucleotide
taatacgactcactatagggtacgtttatattaaaactccgtttgatgtgaacagaggagacacatcatgcggagttttaacctggcggcagcgcaaaagatg

SEQ ID NO: 52962 - DNA, 103 bp, Artificial Sequence
  Synthetic Polynucleotide
taatacgactcactatagggcagtatacgtttatattaaaactccgtttgaacagaggagacaaacgatgttttaatataacctggcggcagcgcaaaagatg

SEQ ID NO: 52963 - DNA, 103 bp, Artificial Sequence
  Synthetic Polynucleotide
taatacgactcactatagggatctacagtatacgtttatattaaaactccaacagaggagaggagttatgatataaacgaacctggcggcagcgcaaaagatg

SEQ ID NO: 52964 - DNA, 103 bp, Artificial Sequence
  Synthetic Polynucleotide
taatacgactcactataggggaaccatctacagtatacgtttatattaaaaacagaggagatttaatatgaacgtatacaacctggcggcagcgcaaaagatg

SEQ ID NO: 52965 - DNA, 103 bp, Artificial Sequence
  Synthetic Polynucleotide
taatacgactcactatagggttaaagaaccatctacagtatacgtttataaacagaggagatataaaatgatactgtagaacctggcggcagcgcaaaagatg

SEQ ID NO: 52966 - DNA, 103 bp, Artificial Sequence
  Synthetic Polynucleotide
taatacgactcactatagggcactattaaagaaccatctacagtatacgtaacagaggagaacgtatatggtagatggtaacctggcggcagcgcaaaagatg

SEQ ID NO: 52967 - DNA, 103 bp, Artificial Sequence
  Synthetic Polynucleotide
taatacgactcactatagggaatgacactattaaagaaccatctacagtaaacagaggagatactgtatgtggttctttaacctggcggcagcgcaaaagatg

SEQ ID NO: 52968 - DNA, 103 bp, Artificial Sequence
  Synthetic Polynucleotide
taatacgactcactatagggctcctaatgacactattaaagaaccatctaaacagaggagatagatgatgctttaatagaacctggcggcagcgcaaaagatg

SEQ ID NO: 52969 - DNA, 103 bp, Artificial Sequence
  Synthetic Polynucleotide
taatacgactcactatagggcttaactcctaatgacactattaaagaaccaacagaggagaggttctatgatagtgtcaaacctggcggcagcgcaaaagatg

SEQ ID NO: 52970 - DNA, 103 bp, Artificial Sequence
  Synthetic Polynucleotide
taatacgactcactatagggattggcttaactcctaatgacactattaaaaacagaggagatttaatatggtcattaggaacctggcggcagcgcaaaagatg

SEQ ID NO: 52971 - DNA, 103 bp, Artificial Sequence
  Synthetic Polynucleotide
taatacgactcactataggggttaatatagacaactttactaaagttatgaacagaggagacataacatgagtaaagttaacctggcggcagcgcaaaagatg

SEQ ID NO: 52972 - DNA, 103 bp, Artificial Sequence
  Synthetic Polynucleotide
taatacgactcactatagggtttctattggcttaactcctaatgacactaaacagaggagatagtgtatgtaggagttaaacctggcggcagcgcaaaagatg

SEQ ID NO: 52973 - DNA, 103 bp, Artificial Sequence
  Synthetic Polynucleotide
taatacgactcactatagggtgatatttctattggcttaactcctaatgaaacagaggagatcattaatggttaagccaaacctggcggcagcgcaaaagatg

SEQ ID NO: 52974 - DNA, 103 bp, Artificial Sequence
  Synthetic Polynucleotide
taatacgactcactatagggcttaatgatatttctattggcttaactcctaacagaggagaaggagtatggccaatagaaacctggcggcagcgcaaaagatg

SEQ ID NO: 52975 - DNA, 103 bp, Artificial Sequence
  Synthetic Polynucleotide
taatacgactcactataggggtgaacttaatgatatttctattggcttaaaacagaggagattaagcatgtagaaatataacctggcggcagcgcaaaagatg

SEQ ID NO: 52976 - DNA, 103 bp, Artificial Sequence
  Synthetic Polynucleotide
taatacgactcactatagggttctagtgaacttaatgatatttctattggaacagaggagaccaataatgatatcattaaacctggcggcagcgcaaaagatg

SEQ ID NO: 52977 - DNA, 103 bp, Artificial Sequence
  Synthetic Polynucleotide
taatacgactcactatagggggatattctagtgaacttaatgatatttctaacagaggagaagaaatatgattaagttcaacctggcggcagcgcaaaagatg

SEQ ID NO: 52978 - DNA, 103 bp, Artificial Sequence
  Synthetic Polynucleotide
taatacgactcactatagggattctggatattctagtgaacttaatgataaacagaggagatatcatatggttcactagaacctggcggcagcgcaaaagatg

SEQ ID NO: 52979 - DNA, 103 bp, Artificial Sequence
  Synthetic Polynucleotide
taatacgactcactataggggaaacattctggatattctagtgaacttaaaacagaggagattaagtatgctagaatataacctggcggcagcgcaaaagatg

SEQ ID NO: 52980 - DNA, 103 bp, Artificial Sequence
  Synthetic Polynucleotide
taatacgactcactataggggctttgaaacattctggatattctagtgaaaacagaggagattcactatgatatccagaaacctggcggcagcgcaaaagatg

SEQ ID NO: 52981 - DNA, 103 bp, Artificial Sequence
  Synthetic Polynucleotide
taatacgactcactatagggcaattgctttgaaacattctggatattctaaacagaggagatagaatatgcagaatgttaacctggcggcagcgcaaaagatg

SEQ ID NO: 52982 - DNA, 103 bp, Artificial Sequence
  Synthetic Polynucleotide
taatacgactcactatagggaaagagttaatatagacaactttactaaagaacagaggagactttagatgagttgtctaaacctggcggcagcgcaaaagatg

SEQ ID NO: 52983 - DNA, 103 bp, Artificial Sequence
  Synthetic Polynucleotide
taatacgactcactatagggtaatacaattgctttgaaacattctggataaacagaggagatatccaatgtgtttcaaaaacctggcggcagcgcaaaagatg

SEQ ID NO: 52984 - DNA, 103 bp, Artificial Sequence
  Synthetic Polynucleotide
taatacgactcactatagggatcaataatacaattgctttgaaacattctaacagaggagaagaatgatgcaaagcaataacctggcggcagcgcaaaagatg

SEQ ID NO: 52985 - DNA, 103 bp, Artificial Sequence
  Synthetic Polynucleotide
taatacgactcactatagggattgtatcaataatacaattgctttgaaacaacagaggagagtttcaatgcaattgtataacctggcggcagcgcaaaagatg

SEQ ID NO: 52986 - DNA, 103 bp, Artificial Sequence
  Synthetic Polynucleotide
taatacgactcactatagggtaataattgtatcaataatacaattgctttaacagaggagaaaagcaatggtattattgaacctggcggcagcgcaaaagatg

SEQ ID NO: 52987 - DNA, 103 bp, Artificial Sequence
  Synthetic Polynucleotide
taatacgactcactatagggttatataataattgtatcaataatacaattaacagaggagaaattgtatgattgatacaaacctggcggcagcgcaaaagatg

SEQ ID NO: 52988 - DNA, 103 bp, Artificial Sequence
  Synthetic Polynucleotide
taatacgactcactatagggaagaattatataataattgtatcaataataaacagaggagatattatatgtacaattataacctggcggcagcgcaaaagatg

SEQ ID NO: 52989 - DNA, 103 bp, Artificial Sequence
  Synthetic Polynucleotide
taatacgactcactataggggggcgaagaattatataataattgtatcaaaacagaggagattgataatgttattatataacctggcggcagcgcaaaagatg

SEQ ID NO: 52990 - DNA, 103 bp, Artificial Sequence
  Synthetic Polynucleotide
taatacgactcactatagggattgagggcgaagaattatataataattgtaacagaggagaacaattatgatataattcaacctggcggcagcgcaaaagatg

SEQ ID NO: 52991 - DNA, 103 bp, Artificial Sequence
  Synthetic Polynucleotide
taatacgactcactataggggggaaattgagggcgaagaattatataataaacagaggagatattatatgattcttcgcaacctggcggcagcgcaaaagatg

SEQ ID NO: 52992 - DNA, 103 bp, Artificial Sequence
  Synthetic Polynucleotide
taatacgactcactatagggtatttgggaaattgagggcgaagaattataaacagaggagatataatatgtcgccctcaaacctggcggcagcgcaaaagatg

SEQ ID NO: 52993 - DNA, 103 bp, Artificial Sequence
  Synthetic Polynucleotide
taatacgactcactatagggaaataaaagagttaatatagacaactttacaacagaggagagtaaagatgtctatattaaacctggcggcagcgcaaaagatg

SEQ ID NO: 52994 - DNA, 103 bp, Artificial Sequence
  Synthetic Polynucleotide
taatacgactcactatagggggtgttatttgggaaattgagggcgaagaaaacagaggagattcttcatgctcaatttcaacctggcggcagcgcaaaagatg

SEQ ID NO: 52995 - DNA, 103 bp, Artificial Sequence
  Synthetic Polynucleotide
taatacgactcactataggggtaatggtgttatttgggaaattgagggcgaacagaggagacgccctatgtttcccaaaaacctggcggcagcgcaaaagatg

SEQ ID NO: 52996 - DNA, 103 bp, Artificial Sequence
  Synthetic Polynucleotide
taatacgactcactatagggttcgtgtaatggtgttatttgggaaattgaaacagaggagatcaattatgcaaataacaaacctggcggcagcgcaaaagatg

SEQ ID NO: 52997 - DNA, 103 bp, Artificial Sequence
  Synthetic Polynucleotide
taatacgactcactataggggtctcttcgtgtaatggtgttatttgggaaaacagaggagattcccaatgaacaccattaacctggcggcagcgcaaaagatg

SEQ ID NO: 52998 - DNA, 103 bp, Artificial Sequence
  Synthetic Polynucleotide
taatacgactcactatagggtatcggtctcttcgtgtaatggtgttatttaacagaggagaaaataaatgcattacacgaacctggcggcagcgcaaaagatg

SEQ ID NO: 52999 - DNA, 103 bp, Artificial Sequence
  Synthetic Polynucleotide
taatacgactcactatagggtcatgtatcggtctcttcgtgtaatggtgtaacagaggagaacaccaatgcacgaagagaacctggcggcagcgcaaaagatg

SEQ ID NO: 53000 - DNA, 103 bp, Artificial Sequence
  Synthetic Polynucleotide
taatacgactcactatagggattaatcatgtatcggtctcttcgtgtaataacagaggagaattacaatgagagaccgaaacctggcggcagcgcaaaagatg

SEQ ID NO: 53001 - DNA, 103 bp, Artificial Sequence
  Synthetic Polynucleotide
taatacgactcactatagggaatgtattaatcatgtatcggtctcttcgtaacagaggagaacgaagatgccgatacataacctggcggcagcgcaaaagatg

SEQ ID NO: 53002 - DNA, 103 bp, Artificial Sequence
  Synthetic Polynucleotide
taatacgactcactatagggatataaatgtattaatcatgtatcggtctcaacagaggagagagaccatgacatgattaaacctggcggcagcgcaaaagatg

SEQ ID NO: 53003 - DNA, 103 bp, Artificial Sequence
  Synthetic Polynucleotide
taatacgactcactataggggttggatataaatgtattaatcatgtatcgaacagaggagacgatacatgattaatacaaacctggcggcagcgcaaaagatg

SEQ ID NO: 53004 - DNA, 103 bp, Artificial Sequence
  Synthetic Polynucleotide
taatacgactcactatagggctggaaaataaaagagttaatatagacaacaacagaggagagttgtcatgattaactctaacctggcggcagcgcaaaagatg

SEQ ID NO: 53005 - DNA, 103 bp, Artificial Sequence
  Synthetic Polynucleotide
taatacgactcactatagggcatatgttggatataaatgtattaatcatgaacagaggagacatgatatgtacatttataacctggcggcagcgcaaaagatg

SEQ ID NO: 53006 - DNA, 103 bp, Artificial Sequence
  Synthetic Polynucleotide
taatacgactcactatagggcgtaccatatgttggatataaatgtattaaaacagaggagattaataatgttatatccaaacctggcggcagcgcaaaagatg

SEQ ID NO: 53007 - DNA, 103 bp, Artificial Sequence
  Synthetic Polynucleotide
taatacgactcactatagggggttacgtaccatatgttggatataaatgtaacagaggagaacatttatgtccaacataaacctggcggcagcgcaaaagatg

SEQ ID NO: 53008 - DNA, 103 bp, Artificial Sequence
  Synthetic Polynucleotide
taatacgactcactataggggattcggttacgtaccatatgttggatataaacagaggagatatatcatgcatatggtaaacctggcggcagcgcaaaagatg

SEQ ID NO: 53009 - DNA, 103 bp, Artificial Sequence
  Synthetic Polynucleotide
taatacgactcactataggggggaagattcggttacgtaccatatgttggaacagaggagaccaacaatgggtacgtaaaacctggcggcagcgcaaaagatg

SEQ ID NO: 53010 - DNA, 103 bp, Artificial Sequence
  Synthetic Polynucleotide
taatacgactcactatagggggtatgggaagattcggttacgtaccatataacagaggagaatatggatggtaaccgaaaacctggcggcagcgcaaaagatg

SEQ ID NO: 53011 - DNA, 103 bp, Artificial Sequence
  Synthetic Polynucleotide
taatacgactcactatagggttaaaggtatgggaagattcggttacgtacaacagaggagagtacgtatgcgaatcttcaacctggcggcagcgcaaaagatg

SEQ ID NO: 53012 - DNA, 103 bp, Artificial Sequence
  Synthetic Polynucleotide
taatacgactcactatagggagaagttaaaggtatgggaagattcggttaaacagaggagataaccgatgcttcccataaacctggcggcagcgcaaaagatg

SEQ ID NO: 53013 - DNA, 103 bp, Artificial Sequence
  Synthetic Polynucleotide
taatacgactcactatagggcttccagaagttaaaggtatgggaagattcaacagaggagagaatctatgcatacctttaacctggcggcagcgcaaaagatg

SEQ ID NO: 53014 - DNA, 103 bp, Artificial Sequence
  Synthetic Polynucleotide
taatacgactcactatagggtggaacttccagaagttaaaggtatgggaaaacagaggagattcccaatgctttaacttaacctggcggcagcgcaaaagatg

SEQ ID NO: 53015 - DNA, 103 bp, Artificial Sequence
  Synthetic Polynucleotide
taatacgactcactatagggtaataaattaataaaacatatagatcatttaacagaggagaaaatgaatgatatgttttaacctggcggcagcgcaaaagatg

SEQ ID NO: 53016 - DNA, 103 bp, Artificial Sequence
  Synthetic Polynucleotide
taatacgactcactataggggatggctggaaaataaaagagttaatatagaacagaggagactatatatgctcttttataacctggcggcagcgcaaaagatg

SEQ ID NO: 53017 - DNA, 103 bp, Artificial Sequence
  Synthetic Polynucleotide
taatacgactcactatagggaagtttggaacttccagaagttaaaggtataacagaggagaatacctatgacttctggaaacctggcggcagcgcaaaagatg

SEQ ID NO: 53018 - DNA, 103 bp, Artificial Sequence
  Synthetic Polynucleotide
taatacgactcactataggggttctaagtttggaacttccagaagttaaaaacagaggagatttaacatgtggaagttcaacctggcggcagcgcaaaagatg

SEQ ID NO: 53019 - DNA, 103 bp, Artificial Sequence
  Synthetic Polynucleotide
taatacgactcactatagggatttggttctaagtttggaacttccagaagaacagaggagacttctgatggttccaaacaacctggcggcagcgcaaaagatg

SEQ ID NO: 53020 - DNA, 103 bp, Artificial Sequence
  Synthetic Polynucleotide
taatacgactcactatagggtaatcatttggttctaagtttggaacttccaacagaggagaggaagtatgaaacttagaaacctggcggcagcgcaaaagatg

SEQ ID NO: 53021 - DNA, 103 bp, Artificial Sequence
  Synthetic Polynucleotide
taatacgactcactataggggcgcttaatcatttggttctaagtttggaaaacagaggagattccaaatgtagaaccaaaacctggcggcagcgcaaaagatg

SEQ ID NO: 53022 - DNA, 103 bp, Artificial Sequence
  Synthetic Polynucleotide
taatacgactcactatagggttactgcgcttaatcatttggttctaagttaacagaggagaaacttaatgccaaatgataacctggcggcagcgcaaaagatg

SEQ ID NO: 53023 - DNA, 103 bp, Artificial Sequence
  Synthetic Polynucleotide
taatacgactcactataggggtatattactgcgcttaatcatttggttctaacagaggagaagaaccatgtgattaagcaacctggcggcagcgcaaaagatg

SEQ ID NO: 53024 - DNA, 103 bp, Artificial Sequence
  Synthetic Polynucleotide
taatacgactcactataggggatcagtatattactgcgcttaatcatttgaacagaggagacaaatgatgaagcgcagtaacctggcggcagcgcaaaagatg

SEQ ID NO: 53025 - DNA, 103 bp, Artificial Sequence
  Synthetic Polynucleotide
taatacgactcactatagggttagggatcagtatattactgcgcttaatcaacagaggagagattaaatgcagtaatataacctggcggcagcgcaaaagatg

SEQ ID NO: 53026 - DNA, 103 bp, Artificial Sequence
  Synthetic Polynucleotide
taatacgactcactatagggcgaaattagggatcagtatattactgcgctaacagaggagaagcgcaatgatatactgaaacctggcggcagcgcaaaagatg

SEQ ID NO: 53027 - DNA, 103 bp, Artificial Sequence
  Synthetic Polynucleotide
taatacgactcactatagggattacgatggctggaaaataaaagagttaaaacagaggagattaactatgttattttccaacctggcggcagcgcaaaagatg

SEQ ID NO: 53028 - DNA, 103 bp, Artificial Sequence
  Synthetic Polynucleotide
taatacgactcactatagggagcttcgaaattagggatcagtatattactaacagaggagaagtaatatgctgatccctaacctggcggcagcgcaaaagatg

SEQ ID NO: 53029 - DNA, 103 bp, Artificial Sequence
  Synthetic Polynucleotide
taatacgactcactatagggtcgctagcttcgaaattagggatcagtataaacagaggagatatactatgccctaatttaacctggcggcagcgcaaaagatg

SEQ ID NO: 53030 - DNA, 103 bp, Artificial Sequence
  Synthetic Polynucleotide
taatacgactcactataggggactatcgctagcttcgaaattagggatcaaacagaggagatgatccatgatttcgaagaacctggcggcagcgcaaaagatg

SEQ ID NO: 53031 - DNA, 103 bp, Artificial Sequence
  Synthetic Polynucleotide
taatacgactcactatagggaatcagactatcgctagcttcgaaattaggaacagaggagacctaatatggaagctagcaacctggcggcagcgcaaaagatg

SEQ ID NO: 53032 - DNA, 103 bp, Artificial Sequence
  Synthetic Polynucleotide
taatacgactcactatagggccgacaatcagactatcgctagcttcgaaaaacagaggagatttcgaatgtagcgatagaacctggcggcagcgcaaaagatg

SEQ ID NO: 53033 - DNA, 103 bp, Artificial Sequence
  Synthetic Polynucleotide
taatacgactcactatagggtggtcccgacaatcagactatcgctagcttaacagaggagaaagctaatgatagtctgaaacctggcggcagcgcaaaagatg

SEQ ID NO: 53034 - DNA, 103 bp, Artificial Sequence
  Synthetic Polynucleotide
taatacgactcactatagggaacaatggtcccgacaatcagactatcgctaacagaggagaagcgatatgctgattgtcaacctggcggcagcgcaaaagatg

SEQ ID NO: 53035 - DNA, 103 bp, Artificial Sequence
  Synthetic Polynucleotide
taatacgactcactatagggtgacaaacaatggtcccgacaatcagactaaacagaggagatagtctatgtgtcgggacaacctggcggcagcgcaaaagatg

SEQ ID NO: 53036 - DNA, 103 bp, Artificial Sequence
  Synthetic Polynucleotide
taatacgactcactatagggagttatgacaaacaatggtcccgacaatcaaacagaggagatgattgatgggaccattgaacctggcggcagcgcaaaagatg

SEQ ID NO: 53037 - DNA, 103 bp, Artificial Sequence
  Synthetic Polynucleotide
taatacgactcactatagggtccggagttatgacaaacaatggtcccgacaacagaggagagtcgggatgattgtttgtaacctggcggcagcgcaaaagatg

SEQ ID NO: 53038 - DNA, 103 bp, Artificial Sequence
  Synthetic Polynucleotide
taatacgactcactatagggtgggtattacgatggctggaaaataaaagaaacagaggagatcttttatgttccagccaaacctggcggcagcgcaaaagatg

SEQ ID NO: 53039 - DNA, 103 bp, Artificial Sequence
  Synthetic Polynucleotide
taatacgactcactatagggctctatccggagttatgacaaacaatggtcaacagaggagagaccatatgttgtcataaaacctggcggcagcgcaaaagatg

SEQ ID NO: 53040 - DNA, 103 bp, Artificial Sequence
  Synthetic Polynucleotide
taatacgactcactatagggtatttctctatccggagttatgacaaacaaaacagaggagattgtttatgataactccgaacctggcggcagcgcaaaagatg

SEQ ID NO: 53041 - DNA, 103 bp, Artificial Sequence
  Synthetic Polynucleotide
taatacgactcactatagggcaatatatttctctatccggagttatgacaaacagaggagatgtcatatgtccggatagaacctggcggcagcgcaaaagatg

SEQ ID NO: 53042 - DNA, 103 bp, Artificial Sequence
  Synthetic Polynucleotide
taatacgactcactatagggtgccgcaatatatttctctatccggagttaaacagaggagataactcatgatagagaaaaacctggcggcagcgcaaaagatg

SEQ ID NO: 53043 - DNA, 103 bp, Artificial Sequence
  Synthetic Polynucleotide
taatacgactcactatagggatatatgccgcaatatatttctctatccggaacagaggagaccggatatggaaatatataacctggcggcagcgcaaaagatg

SEQ ID NO: 53044 - DNA, 103 bp, Artificial Sequence
  Synthetic Polynucleotide
taatacgactcactatagggactttatatatgccgcaatatatttctctaaacagaggagatagagaatgatattgcggaacctggcggcagcgcaaaagatg

SEQ ID NO: 53045 - DNA, 103 bp, Artificial Sequence
  Synthetic Polynucleotide
taatacgactcactatagggttccaactttatatatgccgcaatatatttaacagaggagaaaatatatggcggcatataacctggcggcagcgcaaaagatg

SEQ ID NO: 53046 - DNA, 103 bp, Artificial Sequence
  Synthetic Polynucleotide
taatacgactcactatagggtcaaattccaactttatatatgccgcaataaacagaggagatattgcatgatatataaaaacctggcggcagcgcaaaagatg

SEQ ID NO: 53047 - DNA, 103 bp, Artificial Sequence
  Synthetic Polynucleotide
taatacgactcactataggggatagtcaaattccaactttatatatgccgaacagaggagacggcatatgtaaagttggaacctggcggcagcgcaaaagatg

SEQ ID NO: 53048 - DNA, 103 bp, Artificial Sequence
  Synthetic Polynucleotide
taatacgactcactatagggcagtcgatagtcaaattccaactttatataaacagaggagatatataatgttggaatttaacctggcggcagcgcaaaagatg

SEQ ID NO: 53049 - DNA, 103 bp, Artificial Sequence
  Synthetic Polynucleotide
taatacgactcactatagggaaacatgggtattacgatggctggaaaataaacagaggagatattttatggccatcgtaaacctggcggcagcgcaaaagatg

SEQ ID NO: 53050 - DNA, 103 bp, Artificial Sequence
  Synthetic Polynucleotide
taatacgactcactatagggcttcgcagtcgatagtcaaattccaactttaacagaggagaaaagttatgatttgactaaacctggcggcagcgcaaaagatg

SEQ ID NO: 53051 - DNA, 103 bp, Artificial Sequence
  Synthetic Polynucleotide
taatacgactcactatagggaatgtcttcgcagtcgatagtcaaattccaaacagaggagatggaatatgactatcgacaacctggcggcagcgcaaaagatg

SEQ ID NO: 53052 - DNA, 103 bp, Artificial Sequence
  Synthetic Polynucleotide
taatacgactcactatagggggtctaatgtcttcgcagtcgatagtcaaaaacagaggagatttgacatgcgactgcgaaacctggcggcagcgcaaaagatg

SEQ ID NO: 53053 - DNA, 103 bp, Artificial Sequence
  Synthetic Polynucleotide
taatacgactcactatagggtaaacggtctaatgtcttcgcagtcgatagaacagaggagactatcgatggcgaagacaaacctggcggcagcgcaaaagatg

SEQ ID NO: 53054 - DNA, 103 bp, Artificial Sequence
  Synthetic Polynucleotide
taatacgactcactatagggtctattaaacggtctaatgtcttcgcagtcaacagaggagagactgcatggacattagaaacctggcggcagcgcaaaagatg

SEQ ID NO: 53055 - DNA, 103 bp, Artificial Sequence
  Synthetic Polynucleotide
taatacgactcactatagggatgactctattaaacggtctaatgtcttcgaacagaggagacgaagaatgtagaccgttaacctggcggcagcgcaaaagatg

SEQ ID NO: 53056 - DNA, 103 bp, Artificial Sequence
  Synthetic Polynucleotide
taatacgactcactatagggtggggatgactctattaaacggtctaatgtaacagaggagaacattaatgcgtttaataaacctggcggcagcgcaaaagatg

SEQ ID NO: 53057 - DNA, 103 bp, Artificial Sequence
  Synthetic Polynucleotide
taatacgactcactatagggattggtggggatgactctattaaacggtctaacagaggagaagaccgatgaatagagtcaacctggcggcagcgcaaaagatg

SEQ ID NO: 53058 - DNA, 103 bp, Artificial Sequence
  Synthetic Polynucleotide
taatacgactcactatagggcgttgattggtggggatgactctattaaacaacagaggagagtttaaatgagtcatcccaacctggcggcagcgcaaaagatg

SEQ ID NO: 53059 - DNA, 103 bp, Artificial Sequence
  Synthetic Polynucleotide
taatacgactcactatagggtaattcgttgattggtggggatgactctataacagaggagaatagagatgtccccaccaaacctggcggcagcgcaaaagatg

SEQ ID NO: 53060 - DNA, 103 bp, Artificial Sequence
  Synthetic Polynucleotide
taatacgactcactatagggatcttaaacatgggtattacgatggctggaaacagaggagatccagcatgcgtaataccaacctggcggcagcgcaaaagatg

SEQ ID NO: 53061 - DNA, 103 bp, Artificial Sequence
  Synthetic Polynucleotide
taatacgactcactatagggatcattaattcgttgattggtggggatgacaacagaggagagtcatcatgaccaatcaaaacctggcggcagcgcaaaagatg

SEQ ID NO: 53062 - DNA, 103 bp, Artificial Sequence
  Synthetic Polynucleotide
taatacgactcactatagggatactatcattaattcgttgattggtggggaacagaggagaccccacatgtcaacgaataacctggcggcagcgcaaaagatg

SEQ ID NO: 53063 - DNA, 103 bp, Artificial Sequence
  Synthetic Polynucleotide
taatacgactcactataggggaataatactatcattaattcgttgattggaacagaggagaccaatcatggaattaatgaacctggcggcagcgcaaaagatg

SEQ ID NO: 53064 - DNA, 103 bp, Artificial Sequence
  Synthetic Polynucleotide
taatacgactcactatagggaaaatgaataatactatcattaattcgttgaacagaggagacaacgaatgaatgatagtaacctggcggcagcgcaaaagatg

SEQ ID NO: 53065 - DNA, 103 bp, Artificial Sequence
  Synthetic Polynucleotide
taatacgactcactatagggaatagaaaatgaataatactatcattaattaacagaggagaaattaaatgtagtattataacctggcggcagcgcaaaagatg

SEQ ID NO: 53066 - DNA, 103 bp, Artificial Sequence
  Synthetic Polynucleotide
taatacgactcactatagggttttaaatagaaaatgaataatactatcataacagaggagaatgataatgttattcattaacctggcggcagcgcaaaagatg

SEQ ID NO: 53067 - DNA, 103 bp, Artificial Sequence
  Synthetic Polynucleotide
taatacgactcactatagggttccattttaaatagaaaatgaataatactaacagaggagaagtattatgcattttctaaacctggcggcagcgcaaaagatg

SEQ ID NO: 53068 - DNA, 103 bp, Artificial Sequence
  Synthetic Polynucleotide
taatacgactcactataggggctttttccattttaaatagaaaatgaataaacagaggagatattcaatgtctatttaaaacctggcggcagcgcaaaagatg

SEQ ID NO: 53069 - DNA, 103 bp, Artificial Sequence
  Synthetic Polynucleotide
taatacgactcactatagggtgtaagctttttccattttaaatagaaaataacagaggagaattttcatgttaaaatggaacctggcggcagcgcaaaagatg

SEQ ID NO: 53070 - DNA, 103 bp, Artificial Sequence
  Synthetic Polynucleotide
taatacgactcactatagggtttattgtaagctttttccattttaaatagaacagaggagactatttatgatggaaaaaaacctggcggcagcgcaaaagatg

SEQ ID NO: 53071 - DNA, 103 bp, Artificial Sequence
  Synthetic Polynucleotide
taatacgactcactatagggatactatcttaaacatgggtattacgatggaacagaggagaccatcgatgtacccatgtaacctggcggcagcgcaaaagatg

SEQ ID NO: 53072 - DNA, 103 bp, Artificial Sequence
  Synthetic Polynucleotide
taatacgactcactatagggcggagtttattgtaagctttttccattttaaacagaggagataaaatatgaaaagcttaaacctggcggcagcgcaaaagatg

SEQ ID NO: 53073 - DNA, 103 bp, Artificial Sequence
  Synthetic Polynucleotide
taatacgactcactatagggctctacggagtttattgtaagctttttccaaacagaggagatggaaaatgcttacaataaacctggcggcagcgcaaaagatg

SEQ ID NO: 53074 - DNA, 103 bp, Artificial Sequence
  Synthetic Polynucleotide
taatacgactcactatagggtatttctctacggagtttattgtaagctttaacagaggagaaaagctatgaataaactcaacctggcggcagcgcaaaagatg

SEQ ID NO: 53075 - DNA, 103 bp, Artificial Sequence
  Synthetic Polynucleotide
taatacgactcactatagggatagatatttctctacggagtttattgtaaaacagaggagattacaaatgactccgtagaacctggcggcagcgcaaaagatg

SEQ ID NO: 53076 - DNA, 103 bp, Artificial Sequence
  Synthetic Polynucleotide
taatacgactcactatagggaaattatagatatttctctacggagtttataacagaggagaataaacatggtagagaaaaacctggcggcagcgcaaaagatg

SEQ ID NO: 53077 - DNA, 103 bp, Artificial Sequence
  Synthetic Polynucleotide
taatacgactcactatagggctcacaaattatagatatttctctacggagaacagaggagactccgtatggaaatatctaacctggcggcagcgcaaaagatg

SEQ ID NO: 53078 - DNA, 103 bp, Artificial Sequence
  Synthetic Polynucleotide
taatacgactcactataggggaaaactcacaaattatagatatttctctaaacagaggagatagagaatgatctataataacctggcggcagcgcaaaagatg

SEQ ID NO: 53079 - DNA, 103 bp, Artificial Sequence
  Synthetic Polynucleotide
taatacgactcactatagggttaaggaaaactcacaaattatagatatttaacagaggagaaaatatatgtaatttgtgaacctggcggcagcgcaaaagatg

SEQ ID NO: 53080 - DNA, 103 bp, Artificial Sequence
  Synthetic Polynucleotide
taatacgactcactatagggttactttaaggaaaactcacaaattatagaaacagaggagatctataatgtgtgagtttaacctggcggcagcgcaaaagatg

SEQ ID NO: 53081 - DNA, 103 bp, Artificial Sequence
  Synthetic Polynucleotide
taatacgactcactatagggagttgttactttaaggaaaactcacaaattaacagaggagaaatttgatggttttccttaacctggcggcagcgcaaaagatg

SEQ ID NO: 53082 - DNA, 103 bp, Artificial Sequence
  Synthetic Polynucleotide
taatacgactcactatagggagaatatactatcttaaacatgggtattacaacagaggagagtaataatgatgtttaagaacctggcggcagcgcaaaagatg

SEQ ID NO: 53083 - DNA, 103 bp, Artificial Sequence
  Synthetic Polynucleotide
taatacgactcactatagggacggaagttgttactttaaggaaaactcacaacagaggagagtgagtatgccttaaagtaacctggcggcagcgcaaaagatg

SEQ ID NO: 53084 - DNA, 103 bp, Artificial Sequence
  Synthetic Polynucleotide
taatacgactcactatagggcgtttacggaagttgttactttaaggaaaaaacagaggagattttccatgaagtaacaaaacctggcggcagcgcaaaagatg

SEQ ID NO: 53085 - DNA, 103 bp, Artificial Sequence
  Synthetic Polynucleotide
taatacgactcactataggggacggcgtttacggaagttgttactttaagaacagaggagacttaaaatgacaacttccaacctggcggcagcgcaaaagatg

SEQ ID NO: 53086 - DNA, 103 bp, Artificial Sequence
  Synthetic Polynucleotide
taatacgactcactatagggataaagacggcgtttacggaagttgttactaacagaggagaagtaacatgttccgtaaaaacctggcggcagcgcaaaagatg

SEQ ID NO: 53087 - DNA, 103 bp, Artificial Sequence
  Synthetic Polynucleotide
taatacgactcactatagggaagagataaagacggcgtttacggaagttgaacagaggagacaacttatgtaaacgccgaacctggcggcagcgcaaaagatg

SEQ ID NO: 53088 - DNA, 103 bp, Artificial Sequence
  Synthetic Polynucleotide
taatacgactcactatagggttactaagagataaagacggcgtttacggaaacagaggagatccgtaatggccgtctttaacctggcggcagcgcaaaagatg

SEQ ID NO: 53089 - DNA, 103 bp, Artificial Sequence
  Synthetic Polynucleotide
taatacgactcactatagggtaaacttactaagagataaagacggcgtttaacagaggagaaaacgcatgctttatctcaacctggcggcagcgcaaaagatg

SEQ ID NO: 53090 - DNA, 103 bp, Artificial Sequence
  Synthetic Polynucleotide
taatacgactcactatagggtacaataaacttactaagagataaagacggaacagaggagaccgtctatgtctcttagtaacctggcggcagcgcaaaagatg

SEQ ID NO: 53091 - DNA, 103 bp, Artificial Sequence
  Synthetic Polynucleotide
taatacgactcactatagggataaatacaataaacttactaagagataaaaacagaggagatttatcatgtagtaagttaacctggcggcagcgcaaaagatg

SEQ ID NO: 53092 - DNA, 103 bp, Artificial Sequence
  Synthetic Polynucleotide
taatacgactcactatagggaggtcataaatacaataaacttactaagagaacagaggagactcttaatgagtttattgaacctggcggcagcgcaaaagatg

SEQ ID NO: 53093 - DNA, 103 bp, Artificial Sequence
  Synthetic Polynucleotide
taatacgactcactatagggactagagaatatactatcttaaacatgggtaacagaggagaacccatatgtaagatagtaacctggcggcagcgcaaaagatg

SEQ ID NO: 53094 - DNA, 103 bp, Artificial Sequence
  Synthetic Polynucleotide
taatacgactcactatagggggaaaaggtcataaatacaataaacttactaacagaggagaagtaagatgattgtatttaacctggcggcagcgcaaaagatg

SEQ ID NO: 53095 - DNA, 103 bp, Artificial Sequence
  Synthetic Polynucleotide
taatacgactcactataggggataaggaaaaggtcataaatacaataaacaacagaggagagtttatatgatttatgacaacctggcggcagcgcaaaagatg

SEQ ID NO: 53096 - DNA, 103 bp, Artificial Sequence
  Synthetic Polynucleotide
taatacgactcactatagggatgaagataaggaaaaggtcataaatacaaaacagaggagattgtatatgtgaccttttaacctggcggcagcgcaaaagatg

SEQ ID NO: 53097 - DNA, 103 bp, Artificial Sequence
  Synthetic Polynucleotide
taatacgactcactatagggattttatgaagataaggaaaaggtcataaaaacagaggagatttatgatgttttccttaaacctggcggcagcgcaaaagatg

SEQ ID NO: 53098 - DNA, 103 bp, Artificial Sequence
  Synthetic Polynucleotide
taatacgactcactatagggttagtattttatgaagataaggaaaaggtcaacagaggagagaccttatgcttatcttcaacctggcggcagcgcaaaagatg

SEQ ID NO: 53099 - DNA, 103 bp, Artificial Sequence
  Synthetic Polynucleotide
taatacgactcactatagggtgcctttagtattttatgaagataaggaaaaacagaggagatttcctatgcttcataaaaacctggcggcagcgcaaaagatg

SEQ ID NO: 53100 - DNA, 103 bp, Artificial Sequence
  Synthetic Polynucleotide
taatacgactcactatagggtttgttgcctttagtattttatgaagataaaacagaggagattatctatgtaaaatactaacctggcggcagcgcaaaagatg

SEQ ID NO: 53101 - DNA, 103 bp, Artificial Sequence
  Synthetic Polynucleotide
taatacgactcactatagggatttctttgttgcctttagtattttatgaaaacagaggagattcataatgtactaaaggaacctggcggcagcgcaaaagatg

SEQ ID NO: 53102 - DNA, 103 bp, Artificial Sequence
  Synthetic Polynucleotide
taatacgactcactatagggcaaaaatttctttgttgcctttagtattttaacagaggagaaaaataatgaaggcaacaaacctggcggcagcgcaaaagatg

SEQ ID NO: 53103 - DNA, 103 bp, Artificial Sequence
  Synthetic Polynucleotide
taatacgactcactatagggagaaccaaaaatttctttgttgcctttagtaacagaggagaactaaaatgaacaaagaaaacctggcggcagcgcaaaagatg

SEQ ID NO: 53104 - DNA, 103 bp, Artificial Sequence
  Synthetic Polynucleotide
taatacgactcactataggggtgtaactagagaatatactatcttaaacaaacagaggagatgtttaatgtagtatattaacctggcggcagcgcaaaagatg

SEQ ID NO: 53105 - DNA, 103 bp, Artificial Sequence
  Synthetic Polynucleotide
taatacgactcactatagggagagaagaaccaaaaatttctttgttgcctaacagaggagaaggcaaatgagaaattttaacctggcggcagcgcaaaagatg

SEQ ID NO: 53106 - DNA, 103 bp, Artificial Sequence
  Synthetic Polynucleotide
taatacgactcactatagggctcttagagaagaaccaaaaatttctttgtaacagaggagaacaaagatgtttttggttaacctggcggcagcgcaaaagatg

SEQ ID NO: 53107 - DNA, 103 bp, Artificial Sequence
  Synthetic Polynucleotide
taatacgactcactatagggcgtagctcttagagaagaaccaaaaatttcaacagaggagagaaattatgggttcttctaacctggcggcagcgcaaaagatg

SEQ ID NO: 53108 - DNA, 103 bp, Artificial Sequence
  Synthetic Polynucleotide
taatacgactcactatagggtctcacgtagctcttagagaagaaccaaaaaacagaggagattttggatgttctctaagaacctggcggcagcgcaaaagatg

SEQ ID NO: 53109 - DNA, 103 bp, Artificial Sequence
  Synthetic Polynucleotide
taatacgactcactatagggttaagtctcacgtagctcttagagaagaacaacagaggagagttcttatgtaagagctaaacctggcggcagcgcaaaagatg

SEQ ID NO: 53110 - DNA, 103 bp, Artificial Sequence
  Synthetic Polynucleotide
taatacgactcactatagggtatggttaagtctcacgtagctcttagagaaacagaggagatctctaatggctacgtgaaacctggcggcagcgcaaaagatg

SEQ ID NO: 53111 - DNA, 103 bp, Artificial Sequence
  Synthetic Polynucleotide
taatacgactcactataggggcgtctatggttaagtctcacgtagctcttaacagaggagaaagagcatggtgagacttaacctggcggcagcgcaaaagatg

SEQ ID NO: 53112 - DNA, 103 bp, Artificial Sequence
  Synthetic Polynucleotide
taatacgactcactatagggcgttggcgtctatggttaagtctcacgtagaacagaggagactacgtatgacttaaccaaacctggcggcagcgcaaaagatg

SEQ ID NO: 53113 - DNA, 103 bp, Artificial Sequence
  Synthetic Polynucleotide
taatacgactcactatagggggattcgttggcgtctatggttaagtctcaaacagaggagatgagacatgaccatagacaacctggcggcagcgcaaaagatg

SEQ ID NO: 53114 - DNA, 103 bp, Artificial Sequence
  Synthetic Polynucleotide
taatacgactcactatagggtgtagggattcgttggcgtctatggttaagaacagaggagacttaacatgagacgccaaaacctggcggcagcgcaaaagatg

SEQ ID NO: 53115 - DNA, 103 bp, Artificial Sequence
  Synthetic Polynucleotide
taatacgactcactatagggccatagtgtaactagagaatatactatcttaacagaggagaaagataatgtattctctaaacctggcggcagcgcaaaagatg

SEQ ID NO: 53116 - DNA, 103 bp, Artificial Sequence
  Synthetic Polynucleotide
taatacgactcactatagggaaatatgtagggattcgttggcgtctatggaacagaggagaccatagatgccaacgaataacctggcggcagcgcaaaagatg

SEQ ID NO: 53117 - DNA, 103 bp, Artificial Sequence
  Synthetic Polynucleotide
taatacgactcactatagggttctaaaatatgtagggattcgttggcgtcaacagaggagagacgccatggaatccctaaacctggcggcagcgcaaaagatg

SEQ ID NO: 53118 - DNA, 103 bp, Artificial Sequence
  Synthetic Polynucleotide
taatacgactcactatagggttctgttctaaaatatgtagggattcgttgaacagaggagacaacgaatgcctacatataacctggcggcagcgcaaaagatg

SEQ ID NO: 53119 - DNA, 103 bp, Artificial Sequence
  Synthetic Polynucleotide
taatacgactcactatagggggtatttctgttctaaaatatgtagggattaacagaggagaaatcccatgatattttagaacctggcggcagcgcaaaagatg

SEQ ID NO: 53120 - DNA, 103 bp, Artificial Sequence
  Synthetic Polynucleotide
taatacgactcactatagggagttgggtatttctgttctaaaatatgtagaacagaggagactacatatgttagaacagaacctggcggcagcgcaaaagatg

SEQ ID NO: 53121 - DNA, 103 bp, Artificial Sequence
  Synthetic Polynucleotide
taatacgactcactatagggggcgaagttgggtatttctgttctaaaataaacagaggagatattttatgacagaaataaacctggcggcagcgcaaaagatg

SEQ ID NO: 53122 - DNA, 103 bp, Artificial Sequence
  Synthetic Polynucleotide
taatacgactcactatagggagggtggcgaagttgggtatttctgttctaaacagaggagatagaacatgaatacccaaaacctggcggcagcgcaaaagatg

SEQ ID NO: 53123 - DNA, 103 bp, Artificial Sequence
  Synthetic Polynucleotide
taatacgactcactatagggattcaagggtggcgaagttgggtatttctgaacagaggagacagaaaatgccaacttcgaacctggcggcagcgcaaaagatg

SEQ ID NO: 53124 - DNA, 103 bp, Artificial Sequence
  Synthetic Polynucleotide
taatacgactcactataggggagacattcaagggtggcgaagttgggtataacagaggagaatacccatgttcgccaccaacctggcggcagcgcaaaagatg

SEQ ID NO: 53125 - DNA, 103 bp, Artificial Sequence
  Synthetic Polynucleotide
taatacgactcactataggggtattgagacattcaagggtggcgaagttgaacagaggagacaacttatgcacccttgaaacctggcggcagcgcaaaagatg

SEQ ID NO: 53126 - DNA, 103 bp, Artificial Sequence
  Synthetic Polynucleotide
taatacgactcactatagggcagtataataaattaataaaacatatagataacagaggagaatctatatgttttattaaaacctggcggcagcgcaaaagatg

SEQ ID NO: 53127 - DNA, 103 bp, Artificial Sequence
  Synthetic Polynucleotide
taatacgactcactatagggtgagaccatagtgtaactagagaatatactaacagaggagaagtataatgtctagttacaacctggcggcagcgcaaaagatg

SEQ ID NO: 53128 - DNA, 103 bp, Artificial Sequence
  Synthetic Polynucleotide
taatacgactcactatagggtattagtattgagacattcaagggtggcgaaacagaggagatcgccaatgttgaatgtcaacctggcggcagcgcaaaagatg

SEQ ID NO: 53129 - DNA, 103 bp, Artificial Sequence
  Synthetic Polynucleotide
taatacgactcactatagggagacctattagtattgagacattcaagggtaacagaggagaacccttatgtgtctcaataacctggcggcagcgcaaaagatg

SEQ ID NO: 53130 - DNA, 103 bp, Artificial Sequence
  Synthetic Polynucleotide
taatacgactcactatagggtttttagacctattagtattgagacattcaaacagaggagatgaatgatgcaatactaaaacctggcggcagcgcaaaagatg

SEQ ID NO: 53131 - DNA, 103 bp, Artificial Sequence
  Synthetic Polynucleotide
taatacgactcactatagggtttggtttttagacctattagtattgagacaacagaggagagtctcaatgctaataggtaacctggcggcagcgcaaaagatg

SEQ ID NO: 53132 - DNA, 103 bp, Artificial Sequence
  Synthetic Polynucleotide
taatacgactcactatagggcaagatttggtttttagacctattagtattaacagaggagaaatactatgaggtctaaaaacctggcggcagcgcaaaagatg

SEQ ID NO: 53133 - DNA, 103 bp, Artificial Sequence
  Synthetic Polynucleotide
taatacgactcactataggggtaatcaagatttggtttttagacctattaaacagaggagataatagatgtaaaaaccaaacctggcggcagcgcaaaagatg

SEQ ID NO: 53134 - DNA, 103 bp, Artificial Sequence
  Synthetic Polynucleotide
taatacgactcactataggggttttgtaatcaagatttggtttttagaccaacagaggagaggtctaatgaccaaatctaacctggcggcagcgcaaaagatg

SEQ ID NO: 53135 - DNA, 103 bp, Artificial Sequence
  Synthetic Polynucleotide
taatacgactcactatagggtgttggttttgtaatcaagatttggtttttaacagaggagaaaaaacatgatcttgattaacctggcggcagcgcaaaagatg

SEQ ID NO: 53136 - DNA, 103 bp, Artificial Sequence
  Synthetic Polynucleotide
taatacgactcactatagggataagtgttggttttgtaatcaagatttggaacagaggagaccaaatatggattacaaaaacctggcggcagcgcaaaagatg

SEQ ID NO: 53137 - DNA, 103 bp, Artificial Sequence
  Synthetic Polynucleotide
taatacgactcactatagggaattgataagtgttggttttgtaatcaagaaacagaggagatcttgaatgcaaaaccaaaacctggcggcagcgcaaaagatg

SEQ ID NO: 53138 - DNA, 103 bp, Artificial Sequence
  Synthetic Polynucleotide
taatacgactcactatagggaacgatgagaccatagtgtaactagagaataacagaggagaattctcatgttacactataacctggcggcagcgcaaaagatg

SEQ ID NO: 53139 - DNA, 103 bp, Artificial Sequence
  Synthetic Polynucleotide
taatacgactcactatagggagtgtaattgataagtgttggttttgtaataacagaggagaattacaatgccaacacttaacctggcggcagcgcaaaagatg

SEQ ID NO: 53140 - DNA, 103 bp, Artificial Sequence
  Synthetic Polynucleotide
taatacgactcactatagggcaaatagtgtaattgataagtgttggttttaacagaggagaaaaaccatgacttatcaaaacctggcggcagcgcaaaagatg

SEQ ID NO: 53141 - DNA, 103 bp, Artificial Sequence
  Synthetic Polynucleotide
taatacgactcactatagggtaagacaaatagtgtaattgataagtgttgaacagaggagacaacacatgtcaattacaaacctggcggcagcgcaaaagatg

SEQ ID NO: 53142 - DNA, 103 bp, Artificial Sequence
  Synthetic Polynucleotide
taatacgactcactatagggtctattaagacaaatagtgtaattgataagaacagaggagacttatcatgtacactattaacctggcggcagcgcaaaagatg

SEQ ID NO: 53143 - DNA, 103 bp, Artificial Sequence
  Synthetic Polynucleotide
taatacgactcactatagggatatgtctattaagacaaatagtgtaattgaacagaggagacaattaatgtatttgtctaacctggcggcagcgcaaaagatg

SEQ ID NO: 53144 - DNA, 103 bp, Artificial Sequence
  Synthetic Polynucleotide
taatacgactcactatagggggcagatatgtctattaagacaaatagtgtaacagaggagaacactaatggtcttaataaacctggcggcagcgcaaaagatg

SEQ ID NO: 53145 - DNA, 103 bp, Artificial Sequence
  Synthetic Polynucleotide
taatacgactcactatagggtctatggcagatatgtctattaagacaaataacagaggagaatttgtatgaatagacataacctggcggcagcgcaaaagatg

SEQ ID NO: 53146 - DNA, 103 bp, Artificial Sequence
  Synthetic Polynucleotide
taatacgactcactatagggataaatctatggcagatatgtctattaagaaacagaggagatcttaaatgacatatctgaacctggcggcagcgcaaaagatg

SEQ ID NO: 53147 - DNA, 103 bp, Artificial Sequence
  Synthetic Polynucleotide
taatacgactcactataggggtattataaatctatggcagatatgtctataacagaggagaatagacatgtctgccataaacctggcggcagcgcaaaagatg

SEQ ID NO: 53148 - DNA, 103 bp, Artificial Sequence
  Synthetic Polynucleotide
taatacgactcactatagggccaaagtattataaatctatggcagatatgaacagaggagacatatcatgcatagatttaacctggcggcagcgcaaaagatg

SEQ ID NO: 53149 - DNA, 103 bp, Artificial Sequence
  Synthetic Polynucleotide
taatacgactcactatagggtaaacaacgatgagaccatagtgtaactagaacagaggagactagttatgctatggtctaacctggcggcagcgcaaaagatg

SEQ ID NO: 53150 - DNA, 103 bp, Artificial Sequence
  Synthetic Polynucleotide
taatacgactcactatagggtactaccaaagtattataaatctatggcagaacagaggagactgccaatgatttataataacctggcggcagcgcaaaagatg

SEQ ID NO: 53151 - DNA, 103 bp, Artificial Sequence
  Synthetic Polynucleotide
taatacgactcactatagggttgtatactaccaaagtattataaatctataacagaggagaatagatatgtaatactttaacctggcggcagcgcaaaagatg

SEQ ID NO: 53152 - DNA, 103 bp, Artificial Sequence
  Synthetic Polynucleotide
taatacgactcactatagggctcgcttgtatactaccaaagtattataaaaacagaggagatttataatgctttggtagaacctggcggcagcgcaaaagatg

SEQ ID NO: 53153 - DNA, 103 bp, Artificial Sequence
  Synthetic Polynucleotide
taatacgactcactatagggaagcactcgcttgtatactaccaaagtattaacagaggagaaatactatggtagtatacaacctggcggcagcgcaaaagatg

SEQ ID NO: 53154 - DNA, 103 bp, Artificial Sequence
  Synthetic Polynucleotide
taatacgactcactatagggagaagaagcactcgcttgtatactaccaaaaacagaggagatttggtatgatacaagcgaacctggcggcagcgcaaaagatg

SEQ ID NO: 53155 - DNA, 103 bp, Artificial Sequence
  Synthetic Polynucleotide
taatacgactcactataggggctaaagaagaagcactcgcttgtatactaaacagaggagatagtatatgagcgagtgcaacctggcggcagcgcaaaagatg

SEQ ID NO: 53156 - DNA, 103 bp, Artificial Sequence
  Synthetic Polynucleotide
taatacgactcactatagggagcccgctaaagaagaagcactcgcttgtaaacagaggagatacaagatggtgcttcttaacctggcggcagcgcaaaagatg

SEQ ID NO: 53157 - DNA, 103 bp, Artificial Sequence
  Synthetic Polynucleotide
taatacgactcactatagggctttaagcccgctaaagaagaagcactcgcaacagaggagagcgagtatgtcttctttaaacctggcggcagcgcaaaagatg

SEQ ID NO: 53158 - DNA, 103 bp, Artificial Sequence
  Synthetic Polynucleotide
taatacgactcactataggggcagtctttaagcccgctaaagaagaagcaaacagaggagatgcttcatgtttagcgggaacctggcggcagcgcaaaagatg

SEQ ID NO: 53159 - DNA, 103 bp, Artificial Sequence
  Synthetic Polynucleotide
taatacgactcactatagggctaaagcagtctttaagcccgctaaagaagaacagaggagacttcttatgcgggcttaaaacctggcggcagcgcaaaagatg

SEQ ID NO: 53160 - DNA, 103 bp, Artificial Sequence
  Synthetic Polynucleotide
taatacgactcactatagggtattctaaacaacgatgagaccatagtgtaaacagaggagatacactatggtctcatcgaacctggcggcagcgcaaaagatg

SEQ ID NO: 53161 - DNA, 103 bp, Artificial Sequence
  Synthetic Polynucleotide
taatacgactcactatagggagcacctaaagcagtctttaagcccgctaaaacagaggagattagcgatgttaaagactaacctggcggcagcgcaaaagatg

SEQ ID NO: 53162 - DNA, 103 bp, Artificial Sequence
  Synthetic Polynucleotide
taatacgactcactatagggatttcagcacctaaagcagtctttaagcccaacagaggagagggcttatggactgctttaacctggcggcagcgcaaaagatg

SEQ ID NO: 53163 - DNA, 103 bp, Artificial Sequence
  Synthetic Polynucleotide
taatacgactcactatagggtggttatttcagcacctaaagcagtctttaaacagaggagataaagaatgctttaggtgaacctggcggcagcgcaaaagatg

SEQ ID NO: 53164 - DNA, 103 bp, Artificial Sequence
  Synthetic Polynucleotide
taatacgactcactatagggagatgtggttatttcagcacctaaagcagtaacagaggagaactgctatgggtgctgaaaacctggcggcagcgcaaaagatg

SEQ ID NO: 53165 - DNA, 103 bp, Artificial Sequence
  Synthetic Polynucleotide
taatacgactcactatagggcttccagatgtggttatttcagcacctaaaaacagaggagatttaggatgtgaaataacaacctggcggcagcgcaaaagatg

SEQ ID NO: 53166 - DNA, 103 bp, Artificial Sequence
  Synthetic Polynucleotide
taatacgactcactatagggtaagccttccagatgtggttatttcagcacaacagaggagagtgctgatgtaaccacataacctggcggcagcgcaaaagatg

SEQ ID NO: 53167 - DNA, 103 bp, Artificial Sequence
  Synthetic Polynucleotide
taatacgactcactataggggcgagtaagccttccagatgtggttatttcaacagaggagagaaataatgacatctggaaacctggcggcagcgcaaaagatg

SEQ ID NO: 53168 - DNA, 103 bp, Artificial Sequence
  Synthetic Polynucleotide
taatacgactcactataggggctaagcgagtaagccttccagatgtggttaacagaggagaaaccacatgtggaaggctaacctggcggcagcgcaaaagatg

SEQ ID NO: 53169 - DNA, 103 bp, Artificial Sequence
  Synthetic Polynucleotide
taatacgactcactatagggaaatggctaagcgagtaagccttccagatgaacagaggagacatctgatgggcttactcaacctggcggcagcgcaaaagatg

SEQ ID NO: 53170 - DNA, 103 bp, Artificial Sequence
  Synthetic Polynucleotide
taatacgactcactatagggtaattaaatggctaagcgagtaagccttccaacagaggagaggaaggatgactcgcttaaacctggcggcagcgcaaaagatg

SEQ ID NO: 53171 - DNA, 103 bp, Artificial Sequence
  Synthetic Polynucleotide
taatacgactcactatagggtgtgatattctaaacaacgatgagaccataaacagaggagatatggtatgatcgttgttaacctggcggcagcgcaaaagatg

SEQ ID NO: 53172 - DNA, 103 bp, Artificial Sequence
  Synthetic Polynucleotide
taatacgactcactatagggttccgtaattaaatggctaagcgagtaagcaacagaggagagcttacatgcttagccataacctggcggcagcgcaaaagatg

SEQ ID NO: 53173 - DNA, 103 bp, Artificial Sequence
  Synthetic Polynucleotide
taatacgactcactatagggaatagttccgtaattaaatggctaagcgagaacagaggagactcgctatgccatttaataacctggcggcagcgcaaaagatg

SEQ ID NO: 53174 - DNA, 103 bp, Artificial Sequence
  Synthetic Polynucleotide
taatacgactcactatagggaaaaaaatagttccgtaattaaatggctaaaacagaggagattagccatgtaattacggaacctggcggcagcgcaaaagatg

SEQ ID NO: 53175 - DNA, 103 bp, Artificial Sequence
  Synthetic Polynucleotide
taatacgactcactatagggagtataaaaaaatagttccgtaattaaatgaacagaggagacatttaatgacggaactaaacctggcggcagcgcaaaagatg

SEQ ID NO: 53176 - DNA, 103 bp, Artificial Sequence
  Synthetic Polynucleotide
taatacgactcactatagggttagaagtataaaaaaatagttccgtaattaacagaggagaaattacatgactatttttaacctggcggcagcgcaaaagatg

SEQ ID NO: 53177 - DNA, 103 bp, Artificial Sequence
  Synthetic Polynucleotide
taatacgactcactataggggctcattagaagtataaaaaaatagttccgaacagaggagacggaacatgttttttataaacctggcggcagcgcaaaagatg

SEQ ID NO: 53178 - DNA, 103 bp, Artificial Sequence
  Synthetic Polynucleotide
taatacgactcactatagggtacttgctcattagaagtataaaaaaatagaacagaggagactatttatgtatacttctaacctggcggcagcgcaaaagatg

SEQ ID NO: 53179 - DNA, 103 bp, Artificial Sequence
  Synthetic Polynucleotide
taatacgactcactatagggttttctacttgctcattagaagtataaaaaaacagaggagatttttaatgttctaatgaaacctggcggcagcgcaaaagatg

SEQ ID NO: 53180 - DNA, 103 bp, Artificial Sequence
  Synthetic Polynucleotide
taatacgactcactatagggagaggttttctacttgctcattagaagtataacagaggagaatacttatgatgagcaagaacctggcggcagcgcaaaagatg

SEQ ID NO: 53181 - DNA, 103 bp, Artificial Sequence
  Synthetic Polynucleotide
taatacgactcactatagggagatgagaggttttctacttgctcattagaaacagaggagatctaatatgcaagtagaaaacctggcggcagcgcaaaagatg

SEQ ID NO: 53182 - DNA, 103 bp, Artificial Sequence
  Synthetic Polynucleotide
taatacgactcactatagggcggtatgtgatattctaaacaacgatgagaaacagaggagatctcatatgtgtttagaaaacctggcggcagcgcaaaagatg

SEQ ID NO: 53183 - DNA, 103 bp, Artificial Sequence
  Synthetic Polynucleotide
taatacgactcactatagggtttgtagatgagaggttttctacttgctcaaacagaggagatgagcaatgagaaaacctaacctggcggcagcgcaaaagatg

SEQ ID NO: 53184 - DNA, 103 bp, Artificial Sequence
  Synthetic Polynucleotide
taatacgactcactatagggatgtttttgtagatgagaggttttctacttaacagaggagaaagtagatgacctctcataacctggcggcagcgcaaaagatg

SEQ ID NO: 53185 - DNA, 103 bp, Artificial Sequence
  Synthetic Polynucleotide
taatacgactcactatagggcgagtatgtttttgtagatgagaggttttcaacagaggagagaaaacatgtcatctacaaacctggcggcagcgcaaaagatg

SEQ ID NO: 53186 - DNA, 103 bp, Artificial Sequence
  Synthetic Polynucleotide
taatacgactcactatagggggacacgagtatgtttttgtagatgagaggaacagaggagacctctcatgtacaaaaacaacctggcggcagcgcaaaagatg

SEQ ID NO: 53187 - DNA, 103 bp, Artificial Sequence
  Synthetic Polynucleotide
taatacgactcactatagggattatggacacgagtatgtttttgtagatgaacagaggagacatctaatgaaacatactaacctggcggcagcgcaaaagatg

SEQ ID NO: 53188 - DNA, 103 bp, Artificial Sequence
  Synthetic Polynucleotide
taatacgactcactatagggagaggattatggacacgagtatgtttttgtaacagaggagaacaaaaatgtactcgtgtaacctggcggcagcgcaaaagatg

SEQ ID NO: 53189 - DNA, 103 bp, Artificial Sequence
  Synthetic Polynucleotide
taatacgactcactatagggatggtagaggattatggacacgagtatgttaacagaggagaaacataatggtgtccataaacctggcggcagcgcaaaagatg

SEQ ID NO: 53190 - DNA, 103 bp, Artificial Sequence
  Synthetic Polynucleotide
taatacgactcactatagggttactatggtagaggattatggacacgagtaacagaggagaactcgtatgcataatcctaacctggcggcagcgcaaaagatg

SEQ ID NO: 53191 - DNA, 103 bp, Artificial Sequence
  Synthetic Polynucleotide
taatacgactcactatagggacgtgttactatggtagaggattatggacaaacagaggagatgtccaatgtcctctaccaacctggcggcagcgcaaaagatg

SEQ ID NO: 53192 - DNA, 103 bp, Artificial Sequence
  Synthetic Polynucleotide
taatacgactcactatagggaaaaaacgtgttactatggtagaggattataacagaggagaataatcatgtaccatagtaacctggcggcagcgcaaaagatg

SEQ ID NO: 53193 - DNA, 103 bp, Artificial Sequence
  Synthetic Polynucleotide
taatacgactcactatagggagattcggtatgtgatattctaaacaacgaaacagaggagatcgttgatgagaatatcaaacctggcggcagcgcaaaagatg

SEQ ID NO: 53194 - DNA, 103 bp, Artificial Sequence
  Synthetic Polynucleotide
taatacgactcactataggggatctaaaaaacgtgttactatggtagaggaacagaggagacctctaatgtagtaacacaacctggcggcagcgcaaaagatg

SEQ ID NO: 53195 - DNA, 103 bp, Artificial Sequence
  Synthetic Polynucleotide
taatacgactcactatagggtatgagatctaaaaaacgtgttactatggtaacagaggagaaccataatgacacgttttaacctggcggcagcgcaaaagatg

SEQ ID NO: 53196 - DNA, 103 bp, Artificial Sequence
  Synthetic Polynucleotide
taatacgactcactataggggcacatatgagatctaaaaaacgtgttactaacagaggagaagtaacatgttttttagaaacctggcggcagcgcaaaagatg

SEQ ID NO: 53197 - DNA, 103 bp, Artificial Sequence
  Synthetic Polynucleotide
taatacgactcactatagggttttagcacatatgagatctaaaaaacgtgaacagaggagacacgttatgtagatctcaaacctggcggcagcgcaaaagatg

SEQ ID NO: 53198 - DNA, 103 bp, Artificial Sequence
  Synthetic Polynucleotide
taatacgactcactatagggaaactttttagcacatatgagatctaaaaaaacagaggagatttttaatgctcatatgtaacctggcggcagcgcaaaagatg

SEQ ID NO: 53199 - DNA, 103 bp, Artificial Sequence
  Synthetic Polynucleotide
taatacgactcactatagggtgggaaaactttttagcacatatgagatctaacagaggagaagatctatgatgtgctaaaacctggcggcagcgcaaaagatg

SEQ ID NO: 53200 - DNA, 103 bp, Artificial Sequence
  Synthetic Polynucleotide
taatacgactcactatagggtagtatgggaaaactttttagcacatatgaaacagaggagatcatatatgctaaaaagtaacctggcggcagcgcaaaagatg

SEQ ID NO: 53201 - DNA, 103 bp, Artificial Sequence
  Synthetic Polynucleotide
taatacgactcactatagggtcagttagtatgggaaaactttttagcacaaacagaggagatgtgctatgaagttttccaacctggcggcagcgcaaaagatg

SEQ ID NO: 53202 - DNA, 103 bp, Artificial Sequence
  Synthetic Polynucleotide
taatacgactcactatagggagtaatcagttagtatgggaaaactttttaaacagaggagataaaaaatgttcccatacaacctggcggcagcgcaaaagatg

SEQ ID NO: 53203 - DNA, 103 bp, Artificial Sequence
  Synthetic Polynucleotide
taatacgactcactatagggataatagtaatcagttagtatgggaaaactaacagaggagaagttttatgatactaactaacctggcggcagcgcaaaagatg

SEQ ID NO: 53204 - DNA, 103 bp, Artificial Sequence
  Synthetic Polynucleotide
taatacgactcactataggggatgtagattcggtatgtgatattctaaacaacagaggagagtttagatgatcacatacaacctggcggcagcgcaaaagatg

SEQ ID NO: 53205 - DNA, 103 bp, Artificial Sequence
  Synthetic Polynucleotide
taatacgactcactataggggaaaaataatagtaatcagttagtatgggaaacagaggagatcccatatgaactgattaaacctggcggcagcgcaaaagatg

SEQ ID NO: 53206 - DNA, 103 bp, Artificial Sequence
  Synthetic Polynucleotide
taatacgactcactatagggtatacgaaaaataatagtaatcagttagtaaacagaggagatactaaatgattactattaacctggcggcagcgcaaaagatg

SEQ ID NO: 53207 - DNA, 103 bp, Artificial Sequence
  Synthetic Polynucleotide
taatacgactcactatagggaaaattatacgaaaaataatagtaatcagtaacagaggagaactgatatgtattattttaacctggcggcagcgcaaaagatg

SEQ ID NO: 53208 - DNA, 103 bp, Artificial Sequence
  Synthetic Polynucleotide
taatacgactcactatagggagttaaaaattatacgaaaaataatagtaaaacagaggagattactaatgtttttcgtaaacctggcggcagcgcaaaagatg

SEQ ID NO: 53209 - DNA, 103 bp, Artificial Sequence
  Synthetic Polynucleotide
taatacgactcactatagggcaaacagttaaaaattatacgaaaaataataacagaggagaattattatgcgtataattaacctggcggcagcgcaaaagatg

SEQ ID NO: 53210 - DNA, 103 bp, Artificial Sequence
  Synthetic Polynucleotide
taatacgactcactatagggaacctcaaacagttaaaaattatacgaaaaaacagaggagattttcgatgaatttttaaaacctggcggcagcgcaaaagatg

SEQ ID NO: 53211 - DNA, 103 bp, Artificial Sequence
  Synthetic Polynucleotide
taatacgactcactatagggtctaaaacctcaaacagttaaaaattatacaacagaggagagtataaatgttaactgttaacctggcggcagcgcaaaagatg

SEQ ID NO: 53212 - DNA, 103 bp, Artificial Sequence
  Synthetic Polynucleotide
taatacgactcactatagggaaaaatctaaaacctcaaacagttaaaaataacagaggagaatttttatgtgtttgaggaacctggcggcagcgcaaaagatg

SEQ ID NO: 53213 - DNA, 103 bp, Artificial Sequence
  Synthetic Polynucleotide
taatacgactcactatagggtaactaaaaatctaaaacctcaaacagttaaacagaggagataactgatggaggttttaaacctggcggcagcgcaaaagatg

SEQ ID NO: 53214 - DNA, 103 bp, Artificial Sequence
  Synthetic Polynucleotide
taatacgactcactatagggttctgtaactaaaaatctaaaacctcaaacaacagaggagagtttgaatgtttagatttaacctggcggcagcgcaaaagatg

SEQ ID NO: 53215 - DNA, 103 bp, Artificial Sequence
  Synthetic Polynucleotide
taatacgactcactatagggaatttgatgtagattcggtatgtgatattcaacagaggagagaatatatgataccgaataacctggcggcagcgcaaaagatg

SEQ ID NO: 53216 - DNA, 103 bp, Artificial Sequence
  Synthetic Polynucleotide
taatacgactcactatagggattacttctgtaactaaaaatctaaaacctaacagaggagaaggtttatgatttttagtaacctggcggcagcgcaaaagatg

SEQ ID NO: 53217 - DNA, 103 bp, Artificial Sequence
  Synthetic Polynucleotide
taatacgactcactatagggtcgatattacttctgtaactaaaaatctaaaacagaggagattagatatgtagttacagaacctggcggcagcgcaaaagatg

SEQ ID NO: 53218 - DNA, 103 bp, Artificial Sequence
  Synthetic Polynucleotide
taatacgactcactatagggaatattcgatattacttctgtaactaaaaaaacagaggagatttttaatgacagaagtaaacctggcggcagcgcaaaagatg

SEQ ID NO: 53219 - DNA, 103 bp, Artificial Sequence
  Synthetic Polynucleotide
taatacgactcactataggggataaaatattcgatattacttctgtaactaacagaggagaagttacatgagtaatatcaacctggcggcagcgcaaaagatg

SEQ ID NO: 53220 - DNA, 103 bp, Artificial Sequence
  Synthetic Polynucleotide
taatacgactcactatagggttttggataaaatattcgatattacttctgaacagaggagacagaagatgtatcgaataaacctggcggcagcgcaaaagatg

SEQ ID NO: 53221 - DNA, 103 bp, Artificial Sequence
  Synthetic Polynucleotide
taatacgactcactatagggattctttttggataaaatattcgatattacaacagaggagagtaataatgaatattttaaacctggcggcagcgcaaaagatg

SEQ ID NO: 53222 - DNA, 103 bp, Artificial Sequence
  Synthetic Polynucleotide
taatacgactcactatagggtactcattctttttggataaaatattcgataacagaggagaatcgaaatgtttatccaaaacctggcggcagcgcaaaagatg

SEQ ID NO: 53223 - DNA, 103 bp, Artificial Sequence
  Synthetic Polynucleotide
taatacgactcactatagggttaattactcattctttttggataaaatataacagaggagaatatttatgccaaaaagaaacctggcggcagcgcaaaagatg

SEQ ID NO: 53224 - DNA, 103 bp, Artificial Sequence
  Synthetic Polynucleotide
taatacgactcactatagggaacaattaattactcattctttttggataaaacagaggagattatccatgaagaatgagaacctggcggcagcgcaaaagatg

SEQ ID NO: 53225 - DNA, 103 bp, Artificial Sequence
  Synthetic Polynucleotide
taatacgactcactatagggtctaaaacaattaattactcattctttttgaacagaggagacaaaaaatgtgagtaattaacctggcggcagcgcaaaagatg

SEQ ID NO: 53226 - DNA, 103 bp, Artificial Sequence
  Synthetic Polynucleotide
taatacgactcactatagggtctaaaatttgatgtagattcggtatgtgaaacagaggagatcacatatggaatctacaaacctggcggcagcgcaaaagatg

SEQ ID NO: 53227 - DNA, 103 bp, Artificial Sequence
  Synthetic Polynucleotide
taatacgactcactatagggctccttctaaaacaattaattactcattctaacagaggagaagaatgatgaattaattgaacctggcggcagcgcaaaagatg

SEQ ID NO: 53228 - DNA, 103 bp, Artificial Sequence
  Synthetic Polynucleotide
taatacgactcactatagggaaacactccttctaaaacaattaattactcaacagaggagagagtaaatgattgttttaaacctggcggcagcgcaaaagatg

SEQ ID NO: 53229 - DNA, 103 bp, Artificial Sequence
  Synthetic Polynucleotide
taatacgactcactatagggcaagaaaacactccttctaaaacaattaataacagaggagaattaatatgtttagaaggaacctggcggcagcgcaaaagatg

SEQ ID NO: 53230 - DNA, 103 bp, Artificial Sequence
  Synthetic Polynucleotide
taatacgactcactatagggtttgccaagaaaacactccttctaaaacaaaacagaggagattgtttatgaaggagtgtaacctggcggcagcgcaaaagatg

SEQ ID NO: 53231 - DNA, 103 bp, Artificial Sequence
  Synthetic Polynucleotide
taatacgactcactatagggattcttttgccaagaaaacactccttctaaaacagaggagattagaaatggtgttttctaacctggcggcagcgcaaaagatg

SEQ ID NO: 53232 - DNA, 103 bp, Artificial Sequence
  Synthetic Polynucleotide
taatacgactcactatagggttggtattcttttgccaagaaaacactcctaacagaggagaaggagtatgttcttggcaaacctggcggcagcgcaaaagatg

SEQ ID NO: 53233 - DNA, 103 bp, Artificial Sequence
  Synthetic Polynucleotide
taatacgactcactatagggagcacttggtattcttttgccaagaaaacaaacagaggagatgttttatgggcaaaagaaacctggcggcagcgcaaaagatg

SEQ ID NO: 53234 - DNA, 103 bp, Artificial Sequence
  Synthetic Polynucleotide
taatacgactcactatagggatttaagcacttggtattcttttgccaagaaacagaggagatcttggatgaagaataccaacctggcggcagcgcaaaagatg

SEQ ID NO: 53235 - DNA, 103 bp, Artificial Sequence
  Synthetic Polynucleotide
taatacgactcactataggggaaatatttaagcacttggtattcttttgcaacagaggagagcaaaaatgtaccaagtgaacctggcggcagcgcaaaagatg

SEQ ID NO: 53236 - DNA, 103 bp, Artificial Sequence
  Synthetic Polynucleotide
taatacgactcactatagggtagtagaaatatttaagcacttggtattctaacagaggagaagaataatgagtgcttaaaacctggcggcagcgcaaaagatg

SEQ ID NO: 53237 - DNA, 103 bp, Artificial Sequence
  Synthetic Polynucleotide
taatacgactcactatagggtttaacagtataataaattaataaaacataaacagaggagatatgttatgttaatttataacctggcggcagcgcaaaagatg

SEQ ID NO: 53238 - DNA, 103 bp, Artificial Sequence
  Synthetic Polynucleotide
taatacgactcactatagggcaatttctaaaatttgatgtagattcggtaaacagaggagataccgaatgtacatcaaaaacctggcggcagcgcaaaagatg

SEQ ID NO: 53239 - DNA, 103 bp, Artificial Sequence
  Synthetic Polynucleotide
taatacgactcactatagggtgaagtagtagaaatatttaagcacttggtaacagaggagaaccaagatgttaaatattaacctggcggcagcgcaaaagatg

SEQ ID NO: 53240 - DNA, 103 bp, Artificial Sequence
  Synthetic Polynucleotide
taatacgactcactatagggattaatgaagtagtagaaatatttaagcacaacagaggagagtgcttatgtatttctacaacctggcggcagcgcaaaagatg

SEQ ID NO: 53241 - DNA, 103 bp, Artificial Sequence
  Synthetic Polynucleotide
taatacgactcactatagggaaaagattaatgaagtagtagaaatatttaaacagaggagataaataatgctactacttaacctggcggcagcgcaaaagatg

SEQ ID NO: 53242 - DNA, 103 bp, Artificial Sequence
  Synthetic Polynucleotide
taatacgactcactatagggtaccgaaaagattaatgaagtagtagaaataacagaggagaatttctatgacttcattaaacctggcggcagcgcaaaagatg

SEQ ID NO: 53243 - DNA, 103 bp, Artificial Sequence
  Synthetic Polynucleotide
taatacgactcactatagggctgagtaccgaaaagattaatgaagtagtaaacagaggagatactacatgattaatcttaacctggcggcagcgcaaaagatg

SEQ ID NO: 53244 - DNA, 103 bp, Artificial Sequence
  Synthetic Polynucleotide
taatacgactcactatagggtgaatctgagtaccgaaaagattaatgaagaacagaggagacttcatatgtcttttcggaacctggcggcagcgcaaaagatg

SEQ ID NO: 53245 - DNA, 103 bp, Artificial Sequence
  Synthetic Polynucleotide
taatacgactcactataggggaaactgaatctgagtaccgaaaagattaaaacagaggagattaatcatgtcggtactcaacctggcggcagcgcaaaagatg

SEQ ID NO: 53246 - DNA, 103 bp, Artificial Sequence
  Synthetic Polynucleotide
taatacgactcactataggggatgagaaactgaatctgagtaccgaaaagaacagaggagacttttcatgactcagattaacctggcggcagcgcaaaagatg

SEQ ID NO: 53247 - DNA, 103 bp, Artificial Sequence
  Synthetic Polynucleotide
taatacgactcactatagggtaaaagatgagaaactgaatctgagtaccgaacagaggagacggtacatggattcagttaacctggcggcagcgcaaaagatg

SEQ ID NO: 53248 - DNA, 103 bp, Artificial Sequence
  Synthetic Polynucleotide
taatacgactcactatagggtcaagtaaaagatgagaaactgaatctgagaacagaggagactcagaatgagtttctcaaacctggcggcagcgcaaaagatg

SEQ ID NO: 53249 - DNA, 103 bp, Artificial Sequence
  Synthetic Polynucleotide
taatacgactcactatagggcagaccaatttctaaaatttgatgtagattaacagaggagaaatctaatgcaaattttaaacctggcggcagcgcaaaagatg

SEQ ID NO: 53250 - DNA, 103 bp, Artificial Sequence
  Synthetic Polynucleotide
taatacgactcactatagggatcaatcaagtaaaagatgagaaactgaataacagaggagaattcagatgctcatctttaacctggcggcagcgcaaaagatg

SEQ ID NO: 53251 - DNA, 103 bp, Artificial Sequence
  Synthetic Polynucleotide
taatacgactcactatagggaaataatcaatcaagtaaaagatgagaaacaacagaggagagtttctatgcttttacttaacctggcggcagcgcaaaagatg

SEQ ID NO: 53252 - DNA, 103 bp, Artificial Sequence
  Synthetic Polynucleotide
taatacgactcactatagggctttgaaataatcaatcaagtaaaagatgaaacagaggagatcatctatgacttgattgaacctggcggcagcgcaaaagatg

SEQ ID NO: 53253 - DNA, 103 bp, Artificial Sequence
  Synthetic Polynucleotide
taatacgactcactatagggttagtctttgaaataatcaatcaagtaaaaaacagaggagattttacatgattgattataacctggcggcagcgcaaaagatg

SEQ ID NO: 53254 - DNA, 103 bp, Artificial Sequence
  Synthetic Polynucleotide
taatacgactcactatagggataagttagtctttgaaataatcaatcaagaacagaggagacttgatatgttatttcaaaacctggcggcagcgcaaaagatg

SEQ ID NO: 53255 - DNA, 103 bp, Artificial Sequence
  Synthetic Polynucleotide
taatacgactcactatagggggattataagttagtctttgaaataatcaaaacagaggagattgattatgtcaaagactaacctggcggcagcgcaaaagatg

SEQ ID NO: 53256 - DNA, 103 bp, Artificial Sequence
  Synthetic Polynucleotide
taatacgactcactatagggaaaaaggattataagttagtctttgaaataaacagaggagatatttcatggactaacttaacctggcggcagcgcaaaagatg

SEQ ID NO: 53257 - DNA, 103 bp, Artificial Sequence
  Synthetic Polynucleotide
taatacgactcactatagggtaaataaaaaggattataagttagtctttgaacagaggagacaaagaatgacttataataacctggcggcagcgcaaaagatg

SEQ ID NO: 53258 - DNA, 103 bp, Artificial Sequence
  Synthetic Polynucleotide
taatacgactcactataggggaggataaataaaaaggattataagttagtaacagaggagaactaacatgtaatcctttaacctggcggcagcgcaaaagatg

SEQ ID NO: 53259 - DNA, 103 bp, Artificial Sequence
  Synthetic Polynucleotide
taatacgactcactatagggaacgagaggataaataaaaaggattataagaacagaggagacttataatgctttttattaacctggcggcagcgcaaaagatg

SEQ ID NO: 53260 - DNA, 103 bp, Artificial Sequence
  Synthetic Polynucleotide
taatacgactcactatagggtaacacagaccaatttctaaaatttgatgtaacagaggagaacatcaatgtttagaaataacctggcggcagcgcaaaagatg

SEQ ID NO: 53261 - DNA, 103 bp, Artificial Sequence
  Synthetic Polynucleotide
taatacgactcactatagggaggctaacgagaggataaataaaaaggattaacagaggagaaatcctatgtatttatccaacctggcggcagcgcaaaagatg

SEQ ID NO: 53262 - DNA, 103 bp, Artificial Sequence
  Synthetic Polynucleotide
taatacgactcactatagggtcttaaggctaacgagaggataaataaaaaaacagaggagatttttaatgatcctctcgaacctggcggcagcgcaaaagatg

SEQ ID NO: 53263 - DNA, 103 bp, Artificial Sequence
  Synthetic Polynucleotide
taatacgactcactatagggagttttcttaaggctaacgagaggataaataacagaggagaatttatatgctcgttagcaacctggcggcagcgcaaaagatg

SEQ ID NO: 53264 - DNA, 103 bp, Artificial Sequence
  Synthetic Polynucleotide
taatacgactcactatagggtatctagttttcttaaggctaacgagaggaaacagaggagatcctctatgtagccttaaaacctggcggcagcgcaaaagatg

SEQ ID NO: 53265 - DNA, 103 bp, Artificial Sequence
  Synthetic Polynucleotide
taatacgactcactatagggttttgtatctagttttcttaaggctaacgaaacagaggagatcgttaatgttaagaaaaaacctggcggcagcgcaaaagatg

SEQ ID NO: 53266 - DNA, 103 bp, Artificial Sequence
  Synthetic Polynucleotide
taatacgactcactataggggcaaattttgtatctagttttcttaaggctaacagaggagaagccttatgaaaactagaaacctggcggcagcgcaaaagatg

SEQ ID NO: 53267 - DNA, 103 bp, Artificial Sequence
  Synthetic Polynucleotide
taatacgactcactatagggtagatgcaaattttgtatctagttttcttaaacagaggagataagaaatgtagatacaaaacctggcggcagcgcaaaagatg

SEQ ID NO: 53268 - DNA, 103 bp, Artificial Sequence
  Synthetic Polynucleotide
taatacgactcactatagggtgatgtagatgcaaattttgtatctagtttaacagaggagaaaactaatgacaaaatttaacctggcggcagcgcaaaagatg

SEQ ID NO: 53269 - DNA, 103 bp, Artificial Sequence
  Synthetic Polynucleotide
taatacgactcactatagggacggatgatgtagatgcaaattttgtatctaacagaggagaagatacatgatttgcatcaacctggcggcagcgcaaaagatg

SEQ ID NO: 53270 - DNA, 103 bp, Artificial Sequence
  Synthetic Polynucleotide
taatacgactcactatagggtatccacggatgatgtagatgcaaattttgaacagaggagacaaaatatgcatctacataacctggcggcagcgcaaaagatg

SEQ ID NO: 53271 - DNA, 103 bp, Artificial Sequence
  Synthetic Polynucleotide
taatacgactcactatagggatacgtaacacagaccaatttctaaaatttaacagaggagaaaatttatgaaattggtcaacctggcggcagcgcaaaagatg

SEQ ID NO: 53272 - DNA, 103 bp, Artificial Sequence
  Synthetic Polynucleotide
taatacgactcactatagggtcaaatatccacggatgatgtagatgcaaaaacagaggagatttgcaatgacatcatccaacctggcggcagcgcaaaagatg

SEQ ID NO: 53273 - DNA, 103 bp, Artificial Sequence
  Synthetic Polynucleotide
taatacgactcactatagggaaaaatcaaatatccacggatgatgtagataacagaggagaatctacatgatccgtggaaacctggcggcagcgcaaaagatg

SEQ ID NO: 53274 - DNA, 103 bp, Artificial Sequence
  Synthetic Polynucleotide
taatacgactcactatagggtggaaaaaaatcaaatatccacggatgatgaacagaggagacatcatatgtggatatttaacctggcggcagcgcaaaagatg

SEQ ID NO: 53275 - DNA, 103 bp, Artificial Sequence
  Synthetic Polynucleotide
taatacgactcactatagggtatcatggaaaaaaatcaaatatccacggaaacagaggagatccgtgatgatttgatttaacctggcggcagcgcaaaagatg

SEQ ID NO: 53276 - DNA, 103 bp, Artificial Sequence
  Synthetic Polynucleotide
taatacgactcactatagggttggatatcatggaaaaaaatcaaatatccaacagaggagaggatatatgatttttttcaacctggcggcagcgcaaaagatg

SEQ ID NO: 53277 - DNA, 103 bp, Artificial Sequence
  Synthetic Polynucleotide
taatacgactcactatagggaacttttggatatcatggaaaaaaatcaaaaacagaggagatttgatatgtttccatgaaacctggcggcagcgcaaaagatg

SEQ ID NO: 53278 - DNA, 103 bp, Artificial Sequence
  Synthetic Polynucleotide
taatacgactcactatagggctcggaacttttggatatcatggaaaaaaaaacagaggagattttttatgatgatatccaacctggcggcagcgcaaaagatg

SEQ ID NO: 53279 - DNA, 103 bp, Artificial Sequence
  Synthetic Polynucleotide
taatacgactcactatagggattatctcggaacttttggatatcatggaaaacagaggagattccatatgatccaaaagaacctggcggcagcgcaaaagatg

SEQ ID NO: 53280 - DNA, 103 bp, Artificial Sequence
  Synthetic Polynucleotide
taatacgactcactataggggagaaattatctcggaacttttggatatcaaacagaggagatgatatatgaaagttccgaacctggcggcagcgcaaaagatg

SEQ ID NO: 53281 - DNA, 103 bp, Artificial Sequence
  Synthetic Polynucleotide
taatacgactcactatagggttctggagaaattatctcggaacttttggaaacagaggagatccaaaatgtccgagataaacctggcggcagcgcaaaagatg

SEQ ID NO: 53282 - DNA, 103 bp, Artificial Sequence
  Synthetic Polynucleotide
taatacgactcactatagggaagagatacgtaacacagaccaatttctaaaacagaggagattagaaatgggtctgtgtaacctggcggcagcgcaaaagatg

SEQ ID NO: 53283 - DNA, 103 bp, Artificial Sequence
  Synthetic Polynucleotide
taatacgactcactatagggcaatgttctggagaaattatctcggaacttaacagaggagaaagttcatggataatttcaacctggcggcagcgcaaaagatg

SEQ ID NO: 53284 - DNA, 103 bp, Artificial Sequence
  Synthetic Polynucleotide
taatacgactcactatagggctcatcaatgttctggagaaattatctcggaacagaggagaccgagaatgtttctccagaacctggcggcagcgcaaaagatg

SEQ ID NO: 53285 - DNA, 103 bp, Artificial Sequence
  Synthetic Polynucleotide
taatacgactcactatagggattgtctcatcaatgttctggagaaattataacagaggagaataattatgccagaacataacctggcggcagcgcaaaagatg

SEQ ID NO: 53286 - DNA, 103 bp, Artificial Sequence
  Synthetic Polynucleotide
taatacgactcactatagggagattattgtctcatcaatgttctggagaaaacagaggagattctccatgacattgatgaacctggcggcagcgcaaaagatg

SEQ ID NO: 53287 - DNA, 103 bp, Artificial Sequence
  Synthetic Polynucleotide
taatacgactcactatagggtgcggagattattgtctcatcaatgttctgaacagaggagacagaacatggatgagacaaacctggcggcagcgcaaaagatg

SEQ ID NO: 53288 - DNA, 103 bp, Artificial Sequence
  Synthetic Polynucleotide
taatacgactcactatagggtgtattgcggagattattgtctcatcaatgaacagaggagacattgaatggacaataataacctggcggcagcgcaaaagatg

SEQ ID NO: 53289 - DNA, 103 bp, Artificial Sequence
  Synthetic Polynucleotide
taatacgactcactatagggagaaatgtattgcggagattattgtctcataacagaggagaatgagaatgtaatctccgaacctggcggcagcgcaaaagatg

SEQ ID NO: 53290 - DNA, 103 bp, Artificial Sequence
  Synthetic Polynucleotide
taatacgactcactatagggatttgagaaatgtattgcggagattattgtaacagaggagaacaataatgtccgcaataaacctggcggcagcgcaaaagatg

SEQ ID NO: 53291 - DNA, 103 bp, Artificial Sequence
  Synthetic Polynucleotide
taatacgactcactatagggtattcatttgagaaatgtattgcggagattaacagaggagaaatctcatgaatacatttaacctggcggcagcgcaaaagatg

SEQ ID NO: 53292 - DNA, 103 bp, Artificial Sequence
  Synthetic Polynucleotide
taatacgactcactatagggaaacttattcatttgagaaatgtattgcggaacagaggagaccgcaaatgatttctcaaaacctggcggcagcgcaaaagatg

SEQ ID NO: 53293 - DNA, 103 bp, Artificial Sequence
  Synthetic Polynucleotide
taatacgactcactatagggtatagaagagatacgtaacacagaccaattaacagaggagaaattggatggtgttacgtaacctggcggcagcgcaaaagatg

SEQ ID NO: 53294 - DNA, 103 bp, Artificial Sequence
  Synthetic Polynucleotide
taatacgactcactatagggctaataaacttattcatttgagaaatgtataacagaggagaatacatatgtcaaatgaaaacctggcggcagcgcaaaagatg

SEQ ID NO: 53295 - DNA, 103 bp, Artificial Sequence
  Synthetic Polynucleotide
taatacgactcactatagggcgtgtctaataaacttattcatttgagaaaaacagaggagatttctcatgtgaataagtaacctggcggcagcgcaaaagatg

SEQ ID NO: 53296 - DNA, 103 bp, Artificial Sequence
  Synthetic Polynucleotide
taatacgactcactatagggttccacgtgtctaataaacttattcatttgaacagaggagacaaatgatgaagtttattaacctggcggcagcgcaaaagatg

SEQ ID NO: 53297 - DNA, 103 bp, Artificial Sequence
  Synthetic Polynucleotide
taatacgactcactatagggcaaacttccacgtgtctaataaacttattcaacagaggagagaataaatgtattagacaaacctggcggcagcgcaaaagatg

SEQ ID NO: 53298 - DNA, 103 bp, Artificial Sequence
  Synthetic Polynucleotide
taatacgactcactatagggaaagtcaaacttccacgtgtctaataaactaacagaggagaagtttaatggacacgtggaacctggcggcagcgcaaaagatg

SEQ ID NO: 53299 - DNA, 103 bp, Artificial Sequence
  Synthetic Polynucleotide
taatacgactcactatagggcaaaaaaagtcaaacttccacgtgtctaataacagaggagaattagaatggtggaagttaacctggcggcagcgcaaaagatg

SEQ ID NO: 53300 - DNA, 103 bp, Artificial Sequence
  Synthetic Polynucleotide
taatacgactcactatagggaggtacaaaaaaagtcaaacttccacgtgtaacagaggagaacacgtatgagtttgactaacctggcggcagcgcaaaagatg

SEQ ID NO: 53301 - DNA, 103 bp, Artificial Sequence
  Synthetic Polynucleotide
taatacgactcactatagggtacaaaggtacaaaaaaagtcaaacttccaaacagaggagatggaagatggacttttttaacctggcggcagcgcaaaagatg

SEQ ID NO: 53302 - DNA, 103 bp, Artificial Sequence
  Synthetic Polynucleotide
taatacgactcactatagggaaatgtacaaaggtacaaaaaaagtcaaacaacagaggagagtttgaatgtttttgtacaacctggcggcagcgcaaaagatg

SEQ ID NO: 53303 - DNA, 103 bp, Artificial Sequence
  Synthetic Polynucleotide
taatacgactcactatagggttcaaaaatgtacaaaggtacaaaaaaagtaacagaggagaacttttatggtacctttgaacctggcggcagcgcaaaagatg

SEQ ID NO: 53304 - DNA, 103 bp, Artificial Sequence
  Synthetic Polynucleotide
taatacgactcactatagggaataatatagaagagatacgtaacacagacaacagaggagagtctgtatgacgtatctcaacctggcggcagcgcaaaagatg

SEQ ID NO: 53305 - DNA, 103 bp, Artificial Sequence
  Synthetic Polynucleotide
taatacgactcactatagggtgtatttcaaaaatgtacaaaggtacaaaaaacagaggagattttgtatgtttgtacataacctggcggcagcgcaaaagatg

SEQ ID NO: 53306 - DNA, 103 bp, Artificial Sequence
  Synthetic Polynucleotide
taatacgactcactataggggagtctgtatttcaaaaatgtacaaaggtaaacagaggagataccttatgacatttttgaacctggcggcagcgcaaaagatg

SEQ ID NO: 53307 - DNA, 103 bp, Artificial Sequence
  Synthetic Polynucleotide
taatacgactcactatagggtttgcgagtctgtatttcaaaaatgtacaaaacagaggagattgtacatgtttgaaataaacctggcggcagcgcaaaagatg

SEQ ID NO: 53308 - DNA, 103 bp, Artificial Sequence
  Synthetic Polynucleotide
taatacgactcactatagggtattttttgcgagtctgtatttcaaaaatgaacagaggagacattttatgaatacagacaacctggcggcagcgcaaaagatg

SEQ ID NO: 53309 - DNA, 103 bp, Artificial Sequence
  Synthetic Polynucleotide
taatacgactcactatagggtattgtattttttgcgagtctgtatttcaaaacagaggagattgaaaatgagactcgcaaacctggcggcagcgcaaaagatg

SEQ ID NO: 53310 - DNA, 103 bp, Artificial Sequence
  Synthetic Polynucleotide
taatacgactcactatagggatgaatattgtattttttgcgagtctgtataacagaggagaatacagatgcgcaaaaaaaacctggcggcagcgcaaaagatg

SEQ ID NO: 53311 - DNA, 103 bp, Artificial Sequence
  Synthetic Polynucleotide
taatacgactcactatagggaggatatgaatattgtattttttgcgagtcaacagaggagagactcgatgaaaatacaaaacctggcggcagcgcaaaagatg

SEQ ID NO: 53312 - DNA, 103 bp, Artificial Sequence
  Synthetic Polynucleotide
taatacgactcactataggggaacaaggatatgaatattgtattttttgcaacagaggagagcaaaaatgacaatattcaacctggcggcagcgcaaaagatg

SEQ ID NO: 53313 - DNA, 103 bp, Artificial Sequence
  Synthetic Polynucleotide
taatacgactcactatagggtatctgaacaaggatatgaatattgtatttaacagaggagaaaatacatgattcatatcaacctggcggcagcgcaaaagatg

SEQ ID NO: 53314 - DNA, 103 bp, Artificial Sequence
  Synthetic Polynucleotide
taatacgactcactatagggtatagtatctgaacaaggatatgaatattgaacagaggagacaatatatgtatccttgtaacctggcggcagcgcaaaagatg

SEQ ID NO: 53315 - DNA, 103 bp, Artificial Sequence
  Synthetic Polynucleotide
taatacgactcactatagggtcaacaataatatagaagagatacgtaacaaacagaggagatgttacatgtctcttctaaacctggcggcagcgcaaaagatg

SEQ ID NO: 53316 - DNA, 103 bp, Artificial Sequence
  Synthetic Polynucleotide
taatacgactcactatagggaacggtatagtatctgaacaaggatatgaaaacagaggagattcataatgttgttcagaaacctggcggcagcgcaaaagatg

SEQ ID NO: 53317 - DNA, 103 bp, Artificial Sequence
  Synthetic Polynucleotide
taatacgactcactataggggacacaacggtatagtatctgaacaaggataacagaggagaatccttatgcagatactaaacctggcggcagcgcaaaagatg

SEQ ID NO: 53318 - DNA, 103 bp, Artificial Sequence
  Synthetic Polynucleotide
taatacgactcactatagggttgtagacacaacggtatagtatctgaacaaacagaggagatgttcaatgactataccgaacctggcggcagcgcaaaagatg

SEQ ID NO: 53319 - DNA, 103 bp, Artificial Sequence
  Synthetic Polynucleotide
taatacgactcactatagggagcggttgtagacacaacggtatagtatctaacagaggagaagatacatgaccgttgtgaacctggcggcagcgcaaaagatg

SEQ ID NO: 53320 - DNA, 103 bp, Artificial Sequence
  Synthetic Polynucleotide
taatacgactcactatagggtatgtagcggttgtagacacaacggtatagaacagaggagactatacatgtgtgtctacaacctggcggcagcgcaaaagatg

SEQ ID NO: 53321 - DNA, 103 bp, Artificial Sequence
  Synthetic Polynucleotide
taatacgactcactatagggacgattatgtagcggttgtagacacaacggaacagaggagaccgttgatgctacaaccgaacctggcggcagcgcaaaagatg

SEQ ID NO: 53322 - DNA, 103 bp, Artificial Sequence
  Synthetic Polynucleotide
taatacgactcactatagggaatctacgattatgtagcggttgtagacacaacagaggagagtgtctatgaccgctacaaacctggcggcagcgcaaaagatg

SEQ ID NO: 53323 - DNA, 103 bp, Artificial Sequence
  Synthetic Polynucleotide
taatacgactcactatagggacatgaatctacgattatgtagcggttgtaaacagaggagatacaacatgtacataatcaacctggcggcagcgcaaaagatg

SEQ ID NO: 53324 - DNA, 103 bp, Artificial Sequence
  Synthetic Polynucleotide
taatacgactcactatagggtgttaacatgaatctacgattatgtagcggaacagaggagaccgctaatgaatcgtagaaacctggcggcagcgcaaaagatg

SEQ ID NO: 53325 - DNA, 103 bp, Artificial Sequence
  Synthetic Polynucleotide
taatacgactcactatagggtagagtgttaacatgaatctacgattatgtaacagaggagaacataaatgtagattcataacctggcggcagcgcaaaagatg

SEQ ID NO: 53326 - DNA, 103 bp, Artificial Sequence
  Synthetic Polynucleotide
taatacgactcactatagggatacatcaacaataatatagaagagatacgaacagaggagacgtatcatgtctatattaaacctggcggcagcgcaaaagatg

SEQ ID NO: 53327 - DNA, 103 bp, Artificial Sequence
  Synthetic Polynucleotide
taatacgactcactatagggatacgtagagtgttaacatgaatctacgataacagaggagaatcgtaatgtcatgttaaaacctggcggcagcgcaaaagatg

SEQ ID NO: 53328 - DNA, 103 bp, Artificial Sequence
  Synthetic Polynucleotide
taatacgactcactatagggacgagatacgtagagtgttaacatgaatctaacagaggagaagattcatgttaacactcaacctggcggcagcgcaaaagatg

SEQ ID NO: 53329 - DNA, 103 bp, Artificial Sequence
  Synthetic Polynucleotide
taatacgactcactatagggggacgacgagatacgtagagtgttaacatgaacagaggagacatgttatgactctacgtaacctggcggcagcgcaaaagatg

SEQ ID NO: 53330 - DNA, 103 bp, Artificial Sequence
  Synthetic Polynucleotide
taatacgactcactatagggatattggacgacgagatacgtagagtgttaaacagaggagataacacatgacgtatctcaacctggcggcagcgcaaaagatg

SEQ ID NO: 53331 - DNA, 103 bp, Artificial Sequence
  Synthetic Polynucleotide
taatacgactcactatagggataaaatattggacgacgagatacgtagagaacagaggagactctacatgtctcgtcgtaacctggcggcagcgcaaaagatg

SEQ ID NO: 53332 - DNA, 103 bp, Artificial Sequence
  Synthetic Polynucleotide
taatacgactcactatagggtttatataaaatattggacgacgagatacgaacagaggagacgtatcatgtcgtccaataacctggcggcagcgcaaaagatg

SEQ ID NO: 53333 - DNA, 103 bp, Artificial Sequence
  Synthetic Polynucleotide
taatacgactcactatagggatgtttttatataaaatattggacgacgagaacagaggagactcgtcatgcaatattttaacctggcggcagcgcaaaagatg

SEQ ID NO: 53334 - DNA, 103 bp, Artificial Sequence
  Synthetic Polynucleotide
taatacgactcactatagggataaaatgtttttatataaaatattggacgaacagaggagacgtccaatgttttatataaacctggcggcagcgcaaaagatg

SEQ ID NO: 53335 - DNA, 103 bp, Artificial Sequence
  Synthetic Polynucleotide
taatacgactcactatagggtagaaataaaatgtttttatataaaatattaacagaggagaaatattatgtataaaaacaacctggcggcagcgcaaaagatg

SEQ ID NO: 53336 - DNA, 103 bp, Artificial Sequence
  Synthetic Polynucleotide
taatacgactcactatagggacgtctagaaataaaatgtttttatataaaaacagaggagatttataatgaaacattttaacctggcggcagcgcaaaagatg

SEQ ID NO: 53337 - DNA, 103 bp, Artificial Sequence
  Synthetic Polynucleotide
taatacgactcactatagggcgacaatacatcaacaataatatagaagagaacagaggagactcttcatgattattgttaacctggcggcagcgcaaaagatg

SEQ ID NO: 53338 - DNA, 103 bp, Artificial Sequence
  Synthetic Polynucleotide
taatacgactcactatagggtggcaacgtctagaaataaaatgtttttataacagaggagaataaaaatgttttatttcaacctggcggcagcgcaaaagatg

SEQ ID NO: 53339 - DNA, 103 bp, Artificial Sequence
  Synthetic Polynucleotide
taatacgactcactatagggttttttggcaacgtctagaaataaaatgttaacagaggagaaacattatgtttctagacaacctggcggcagcgcaaaagatg

SEQ ID NO: 53340 - DNA, 103 bp, Artificial Sequence
  Synthetic Polynucleotide
taatacgactcactatagggcaggattttttggcaacgtctagaaataaaaacagaggagatttattatgagacgttgcaacctggcggcagcgcaaaagatg

SEQ ID NO: 53341 - DNA, 103 bp, Artificial Sequence
  Synthetic Polynucleotide
taatacgactcactatagggtattacaggattttttggcaacgtctagaaaacagaggagattctagatgttgccaaaaaacctggcggcagcgcaaaagatg

SEQ ID NO: 53342 - DNA, 103 bp, Artificial Sequence
  Synthetic Polynucleotide
taatacgactcactatagggaaaagtattacaggattttttggcaacgtcaacagaggagagacgttatgaaaaaatccaacctggcggcagcgcaaaagatg

SEQ ID NO: 53343 - DNA, 103 bp, Artificial Sequence
  Synthetic Polynucleotide
taatacgactcactatagggaaactaaaagtattacaggattttttggcaaacagaggagatgccaaatgatcctgtaaaacctggcggcagcgcaaaagatg

SEQ ID NO: 53344 - DNA, 103 bp, Artificial Sequence
  Synthetic Polynucleotide
taatacgactcactatagggcccaaaaactaaaagtattacaggatttttaacagaggagaaaaaatatggtaatacttaacctggcggcagcgcaaaagatg

SEQ ID NO: 53345 - DNA, 103 bp, Artificial Sequence
  Synthetic Polynucleotide
taatacgactcactatagggacaaccccaaaaactaaaagtattacaggaaacagaggagatcctgtatgacttttagtaacctggcggcagcgcaaaagatg

SEQ ID NO: 53346 - DNA, 103 bp, Artificial Sequence
  Synthetic Polynucleotide
taatacgactcactatagggtattcacaaccccaaaaactaaaagtattaaacagaggagataatacatgtagtttttgaacctggcggcagcgcaaaagatg

SEQ ID NO: 53347 - DNA, 103 bp, Artificial Sequence
  Synthetic Polynucleotide
taatacgactcactatagggtactttattcacaaccccaaaaactaaaagaacagaggagacttttaatgtttggggttaacctggcggcagcgcaaaagatg

SEQ ID NO: 53348 - DNA, 103 bp, Artificial Sequence
  Synthetic Polynucleotide
taatacgactcactataggggtacatttaacagtataataaattaataaaaacagaggagatttattatgttattatacaacctggcggcagcgcaaaagatg

SEQ ID NO: 53349 - DNA, 103 bp, Artificial Sequence
  Synthetic Polynucleotide
taatacgactcactatagggttctacgacaatacatcaacaataatatagaacagaggagactatatatgtgttgatgtaacctggcggcagcgcaaaagatg

SEQ ID NO: 53350 - DNA, 103 bp, Artificial Sequence
  Synthetic Polynucleotide
taatacgactcactatagggggcgatactttattcacaaccccaaaaactaacagaggagaagttttatgggttgtgaaaacctggcggcagcgcaaaagatg

SEQ ID NO: 53351 - DNA, 103 bp, Artificial Sequence
  Synthetic Polynucleotide
taatacgactcactatagggattagggcgatactttattcacaaccccaaaacagaggagattggggatgtgaataaagaacctggcggcagcgcaaaagatg

SEQ ID NO: 53352 - DNA, 103 bp, Artificial Sequence
  Synthetic Polynucleotide
taatacgactcactatagggataatattagggcgatactttattcacaacaacagaggagagttgtgatgaaagtatcgaacctggcggcagcgcaaaagatg

SEQ ID NO: 53353 - DNA, 103 bp, Artificial Sequence
  Synthetic Polynucleotide
taatacgactcactatagggtggtaataatattagggcgatactttattcaacagaggagagaataaatgatcgccctaaacctggcggcagcgcaaaagatg

SEQ ID NO: 53354 - DNA, 103 bp, Artificial Sequence
  Synthetic Polynucleotide
taatacgactcactataggggaagatggtaataatattagggcgatacttaacagaggagaaagtatatgcctaatattaacctggcggcagcgcaaaagatg

SEQ ID NO: 53355 - DNA, 103 bp, Artificial Sequence
  Synthetic Polynucleotide
taatacgactcactatagggtggcggaagatggtaataatattagggcgaaacagaggagatcgcccatgtattattacaacctggcggcagcgcaaaagatg

SEQ ID NO: 53356 - DNA, 103 bp, Artificial Sequence
  Synthetic Polynucleotide
taatacgactcactatagggtatattggcggaagatggtaataatattagaacagaggagactaataatgttaccatctaacctggcggcagcgcaaaagatg

SEQ ID NO: 53357 - DNA, 103 bp, Artificial Sequence
  Synthetic Polynucleotide
taatacgactcactatagggactactatattggcggaagatggtaataataacagaggagaattattatgatcttccgcaacctggcggcagcgcaaaagatg

SEQ ID NO: 53358 - DNA, 103 bp, Artificial Sequence
  Synthetic Polynucleotide
taatacgactcactatagggatctaactactatattggcggaagatggtaaacagaggagataccatatgccgccaataaacctggcggcagcgcaaaagatg

SEQ ID NO: 53359 - DNA, 103 bp, Artificial Sequence
  Synthetic Polynucleotide
taatacgactcactatagggtgataatctaactactatattggcggaagaaacagaggagatcttccatgaatatagtaaacctggcggcagcgcaaaagatg

SEQ ID NO: 53360 - DNA, 103 bp, Artificial Sequence
  Synthetic Polynucleotide
taatacgactcactatagggtagttttctacgacaatacatcaacaataaaacagaggagattattgatgatgtattgtaacctggcggcagcgcaaaagatg

SEQ ID NO: 53361 - DNA, 103 bp, Artificial Sequence
  Synthetic Polynucleotide
taatacgactcactatagggtgtgctgataatctaactactatattggcgaacagaggagacgccaaatgagtagttagaacctggcggcagcgcaaaagatg

SEQ ID NO: 53362 - DNA, 103 bp, Artificial Sequence
  Synthetic Polynucleotide
taatacgactcactatagggcttcatgtgctgataatctaactactatataacagaggagaatatagatgttagattataacctggcggcagcgcaaaagatg

SEQ ID NO: 53363 - DNA, 103 bp, Artificial Sequence
  Synthetic Polynucleotide
taatacgactcactatagggtttttcttcatgtgctgataatctaactacaacagaggagagtagttatgttatcagcaaacctggcggcagcgcaaaagatg

SEQ ID NO: 53364 - DNA, 103 bp, Artificial Sequence
  Synthetic Polynucleotide
taatacgactcactatagggaggtgtttttcttcatgtgctgataatctaaacagaggagatagattatgagcacatgaaacctggcggcagcgcaaaagatg

SEQ ID NO: 53365 - DNA, 103 bp, Artificial Sequence
  Synthetic Polynucleotide
taatacgactcactatagggctaagaggtgtttttcttcatgtgctgataaacagaggagatatcagatgatgaagaaaaacctggcggcagcgcaaaagatg

SEQ ID NO: 53366 - DNA, 103 bp, Artificial Sequence
  Synthetic Polynucleotide
taatacgactcactatagggtccacctaagaggtgtttttcttcatgtgcaacagaggagagcacatatggaaaaacacaacctggcggcagcgcaaaagatg

SEQ ID NO: 53367 - DNA, 103 bp, Artificial Sequence
  Synthetic Polynucleotide
taatacgactcactatagggctgaatccacctaagaggtgtttttcttcaaacagaggagatgaagaatgacacctcttaacctggcggcagcgcaaaagatg

SEQ ID NO: 53368 - DNA, 103 bp, Artificial Sequence
  Synthetic Polynucleotide
taatacgactcactatagggttgtactgaatccacctaagaggtgtttttaacagaggagaaaaaacatgtcttaggtgaacctggcggcagcgcaaaagatg

SEQ ID NO: 53369 - DNA, 103 bp, Artificial Sequence
  Synthetic Polynucleotide
taatacgactcactatagggtaacattgtactgaatccacctaagaggtgaacagaggagacacctcatgggtggattcaacctggcggcagcgcaaaagatg

SEQ ID NO: 53370 - DNA, 103 bp, Artificial Sequence
  Synthetic Polynucleotide
taatacgactcactatagggaaatataacattgtactgaatccacctaagaacagaggagacttaggatgattcagtacaacctggcggcagcgcaaaagatg

SEQ ID NO: 53371 - DNA, 103 bp, Artificial Sequence
  Synthetic Polynucleotide
taatacgactcactatagggcgtaatagttttctacgacaatacatcaacaacagaggagagttgatatgttgtcgtagaacctggcggcagcgcaaaagatg

SEQ ID NO: 53372 - DNA, 103 bp, Artificial Sequence
  Synthetic Polynucleotide
taatacgactcactatagggacgaaaaatataacattgtactgaatccacaacagaggagagtggatatggtacaatgtaacctggcggcagcgcaaaagatg

SEQ ID NO: 53373 - DNA, 103 bp, Artificial Sequence
  Synthetic Polynucleotide
taatacgactcactatagggttggtacgaaaaatataacattgtactgaaaacagaggagattcagtatgatgttatataacctggcggcagcgcaaaagatg

SEQ ID NO: 53374 - DNA, 103 bp, Artificial Sequence
  Synthetic Polynucleotide
taatacgactcactatagggatgagttggtacgaaaaatataacattgtaaacagaggagatacaatatgatatttttcaacctggcggcagcgcaaaagatg

SEQ ID NO: 53375 - DNA, 103 bp, Artificial Sequence
  Synthetic Polynucleotide
taatacgactcactatagggtttaaatgagttggtacgaaaaatataacaaacagaggagatgttatatgtttcgtaccaacctggcggcagcgcaaaagatg

SEQ ID NO: 53376 - DNA, 103 bp, Artificial Sequence
  Synthetic Polynucleotide
taatacgactcactatagggtgatatttaaatgagttggtacgaaaaataaacagaggagatattttatgtaccaactcaacctggcggcagcgcaaaagatg

SEQ ID NO: 53377 - DNA, 103 bp, Artificial Sequence
  Synthetic Polynucleotide
taatacgactcactataggggattatgatatttaaatgagttggtacgaaaacagaggagattcgtaatgactcatttaaacctggcggcagcgcaaaagatg

SEQ ID NO: 53378 - DNA, 103 bp, Artificial Sequence
  Synthetic Polynucleotide
taatacgactcactatagggttttagattatgatatttaaatgagttggtaacagaggagaaccaacatgtttaaatataacctggcggcagcgcaaaagatg

SEQ ID NO: 53379 - DNA, 103 bp, Artificial Sequence
  Synthetic Polynucleotide
taatacgactcactatagggaactattttagattatgatatttaaatgagaacagaggagactcattatgatatcataaaacctggcggcagcgcaaaagatg

SEQ ID NO: 53380 - DNA, 103 bp, Artificial Sequence
  Synthetic Polynucleotide
taatacgactcactatagggtacagaactattttagattatgatatttaaaacagaggagattaaatatgataatctaaaacctggcggcagcgcaaaagatg

SEQ ID NO: 53381 - DNA, 103 bp, Artificial Sequence
  Synthetic Polynucleotide
taatacgactcactatagggcatattacagaactattttagattatgataaacagaggagatatcatatgctaaaatagaacctggcggcagcgcaaaagatg

SEQ ID NO: 53382 - DNA, 103 bp, Artificial Sequence
  Synthetic Polynucleotide
taatacgactcactataggggtctacgtaatagttttctacgacaatacaaacagaggagatgtattatggtagaaaacaacctggcggcagcgcaaaagatg

SEQ ID NO: 53383 - DNA, 103 bp, Artificial Sequence
  Synthetic Polynucleotide
taatacgactcactatagggctagacatattacagaactattttagattaaacagaggagataatctatgatagttctgaacctggcggcagcgcaaaagatg

SEQ ID NO: 53384 - DNA, 103 bp, Artificial Sequence
  Synthetic Polynucleotide
taatacgactcactatagggtagcgctagacatattacagaactattttaaacagaggagataaaatatgtctgtaataaacctggcggcagcgcaaaagatg

SEQ ID NO: 53385 - DNA, 103 bp, Artificial Sequence
  Synthetic Polynucleotide
taatacgactcactatagggtatattagcgctagacatattacagaactaaacagaggagatagttcatgaatatgtctaacctggcggcagcgcaaaagatg

SEQ ID NO: 53386 - DNA, 103 bp, Artificial Sequence
  Synthetic Polynucleotide
taatacgactcactatagggatcaatatattagcgctagacatattacagaacagaggagactgtaaatggtctagcgcaacctggcggcagcgcaaaagatg

SEQ ID NO: 53387 - DNA, 103 bp, Artificial Sequence
  Synthetic Polynucleotide
taatacgactcactatagggttatgatcaatatattagcgctagacatataacagaggagaatatgtatggcgctaataaacctggcggcagcgcaaaagatg

SEQ ID NO: 53388 - DNA, 103 bp, Artificial Sequence
  Synthetic Polynucleotide
taatacgactcactatagggcaggattatgatcaatatattagcgctagaaacagaggagatctagcatgaatatattgaacctggcggcagcgcaaaagatg

SEQ ID NO: 53389 - DNA, 103 bp, Artificial Sequence
  Synthetic Polynucleotide
taatacgactcactatagggatgcacaggattatgatcaatatattagcgaacagaggagacgctaaatgattgatcataacctggcggcagcgcaaaagatg

SEQ ID NO: 53390 - DNA, 103 bp, Artificial Sequence
  Synthetic Polynucleotide
taatacgactcactatagggaatttatgcacaggattatgatcaatatataacagaggagaatatatatgtcataatccaacctggcggcagcgcaaaagatg

SEQ ID NO: 53391 - DNA, 103 bp, Artificial Sequence
  Synthetic Polynucleotide
taatacgactcactatagggattttaatttatgcacaggattatgatcaaaacagaggagattgatcatgatcctgtgcaacctggcggcagcgcaaaagatg

SEQ ID NO: 53392 - DNA, 103 bp, Artificial Sequence
  Synthetic Polynucleotide
taatacgactcactataggggttgtattttaatttatgcacaggattatgaacagaggagacataatatggtgcataaaaacctggcggcagcgcaaaagatg

SEQ ID NO: 53393 - DNA, 103 bp, Artificial Sequence
  Synthetic Polynucleotide
taatacgactcactatagggaaatggtctacgtaatagttttctacgacaaacagaggagatgtcgtatgaaactattaaacctggcggcagcgcaaaagatg

SEQ ID NO: 53394 - DNA, 103 bp, Artificial Sequence
  Synthetic Polynucleotide
taatacgactcactatagggacattgttgtattttaatttatgcacaggaaacagaggagatcctgtatgtaaattaaaaacctggcggcagcgcaaaagatg

SEQ ID NO: 53395 - DNA, 103 bp, Artificial Sequence
  Synthetic Polynucleotide
taatacgactcactatagggtcgagacattgttgtattttaatttatgcaaacagaggagatgcataatgtaaaatacaaacctggcggcagcgcaaaagatg

SEQ ID NO: 53396 - DNA, 103 bp, Artificial Sequence
  Synthetic Polynucleotide
taatacgactcactatagggtgatttcgagacattgttgtattttaatttaacagaggagaaaattaatgtacaacaataacctggcggcagcgcaaaagatg

SEQ ID NO: 53397 - DNA, 103 bp, Artificial Sequence
  Synthetic Polynucleotide
taatacgactcactataggggtcaatgatttcgagacattgttgtattttaacagaggagaaaaataatgcaatgtctcaacctggcggcagcgcaaaagatg

SEQ ID NO: 53398 - DNA, 103 bp, Artificial Sequence
  Synthetic Polynucleotide
taatacgactcactataggggccatgtcaatgatttcgagacattgttgtaacagaggagaacaacaatgtctcgaaataacctggcggcagcgcaaaagatg

SEQ ID NO: 53399 - DNA, 103 bp, Artificial Sequence
  Synthetic Polynucleotide
taatacgactcactatagggaagaagccatgtcaatgatttcgagacattaacagaggagaaatgtcatgaaatcattgaacctggcggcagcgcaaaagatg

SEQ ID NO: 53400 - DNA, 103 bp, Artificial Sequence
  Synthetic Polynucleotide
taatacgactcactatagggtatggaagaagccatgtcaatgatttcgagaacagaggagactcgaaatgattgacatgaacctggcggcagcgcaaaagatg

SEQ ID NO: 53401 - DNA, 103 bp, Artificial Sequence
  Synthetic Polynucleotide
taatacgactcactatagggctaactatggaagaagccatgtcaatgattaacagaggagaaatcatatgcatggcttcaacctggcggcagcgcaaaagatg

SEQ ID NO: 53402 - DNA, 103 bp, Artificial Sequence
  Synthetic Polynucleotide
taatacgactcactatagggatcttctaactatggaagaagccatgtcaaaacagaggagattgacaatgcttcttccaaacctggcggcagcgcaaaagatg

SEQ ID NO: 53403 - DNA, 103 bp, Artificial Sequence
  Synthetic Polynucleotide
taatacgactcactatagggcgacgatcttctaactatggaagaagccataacagaggagaatggctatgtccatagttaacctggcggcagcgcaaaagatg

SEQ ID NO: 53404 - DNA, 103 bp, Artificial Sequence
  Synthetic Polynucleotide
taatacgactcactatagggaaagaaaatggtctacgtaatagttttctaaacagaggagatagaaaatgattacgtagaacctggcggcagcgcaaaagatg

SEQ ID NO: 53405 - DNA, 103 bp, Artificial Sequence
  Synthetic Polynucleotide
taatacgactcactatagggtttgacgacgatcttctaactatggaagaaaacagaggagattcttcatgagttagaagaacctggcggcagcgcaaaagatg

SEQ ID NO: 53406 - DNA, 103 bp, Artificial Sequence
  Synthetic Polynucleotide
taatacgactcactatagggctaactttgacgacgatcttctaactatggaacagaggagaccatagatggaagatcgtaacctggcggcagcgcaaaagatg

SEQ ID NO: 53407 - DNA, 103 bp, Artificial Sequence
  Synthetic Polynucleotide
taatacgactcactatagggcgttgctaactttgacgacgatcttctaacaacagaggagagttagaatgtcgtcgtcaaacctggcggcagcgcaaaagatg

SEQ ID NO: 53408 - DNA, 103 bp, Artificial Sequence
  Synthetic Polynucleotide
taatacgactcactatagggaatcacgttgctaactttgacgacgatcttaacagaggagaaagatcatggtcaaagttaacctggcggcagcgcaaaagatg

SEQ ID NO: 53409 - DNA, 103 bp, Artificial Sequence
  Synthetic Polynucleotide
taatacgactcactatagggtgatgaatcacgttgctaactttgacgacgaacagaggagacgtcgtatgagttagcaaaacctggcggcagcgcaaaagatg

SEQ ID NO: 53410 - DNA, 103 bp, Artificial Sequence
  Synthetic Polynucleotide
taatacgactcactatagggaatgttgatgaatcacgttgctaactttgaaacagaggagatcaaagatggcaacgtgaaacctggcggcagcgcaaaagatg

SEQ ID NO: 53411 - DNA, 103 bp, Artificial Sequence
  Synthetic Polynucleotide
taatacgactcactatagggcagcaaatgttgatgaatcacgttgctaacaacagaggagagttagcatggtgattcataacctggcggcagcgcaaaagatg

SEQ ID NO: 53412 - DNA, 103 bp, Artificial Sequence
  Synthetic Polynucleotide
taatacgactcactatagggcaaaacagcaaatgttgatgaatcacgttgaacagaggagacaacgtatgtcatcaacaaacctggcggcagcgcaaaagatg

SEQ ID NO: 53413 - DNA, 103 bp, Artificial Sequence
  Synthetic Polynucleotide
taatacgactcactatagggtgcctcaaaacagcaaatgttgatgaatcaaacagaggagatgattcatgaacatttgcaacctggcggcagcgcaaaagatg

SEQ ID NO: 53414 - DNA, 103 bp, Artificial Sequence
  Synthetic Polynucleotide
taatacgactcactatagggtttgctgcctcaaaacagcaaatgttgatgaacagaggagacatcaaatgttgctgtttaacctggcggcagcgcaaaagatg

SEQ ID NO: 53415 - DNA, 103 bp, Artificial Sequence
  Synthetic Polynucleotide
taatacgactcactatagggtttataaagaaaatggtctacgtaatagttaacagaggagaaactatatggtagaccataacctggcggcagcgcaaaagatg

SEQ ID NO: 53416 - DNA, 103 bp, Artificial Sequence
  Synthetic Polynucleotide
taatacgactcactatagggcagtatttgctgcctcaaaacagcaaatgtaacagaggagaacatttatggttttgaggaacctggcggcagcgcaaaagatg

SEQ ID NO: 53417 - DNA, 103 bp, Artificial Sequence
  Synthetic Polynucleotide
taatacgactcactatagggcggttcagtatttgctgcctcaaaacagcaaacagaggagatgctgtatggaggcagcaaacctggcggcagcgcaaaagatg

SEQ ID NO: 53418 - DNA, 103 bp, Artificial Sequence
  Synthetic Polynucleotide
taatacgactcactatagggggtgacggttcagtatttgctgcctcaaaaaacagaggagattttgaatgagcaaatacaacctggcggcagcgcaaaagatg

SEQ ID NO: 53419 - DNA, 103 bp, Artificial Sequence
  Synthetic Polynucleotide
taatacgactcactatagggtgaatggtgacggttcagtatttgctgcctaacagaggagaaggcagatgatactgaacaacctggcggcagcgcaaaagatg

SEQ ID NO: 53420 - DNA, 103 bp, Artificial Sequence
  Synthetic Polynucleotide
taatacgactcactatagggatggttgaatggtgacggttcagtatttgcaacagaggagagcaaatatggaaccgtcaaacctggcggcagcgcaaaagatg

SEQ ID NO: 53421 - DNA, 103 bp, Artificial Sequence
  Synthetic Polynucleotide
taatacgactcactatagggtatgaatggttgaatggtgacggttcagtaaacagaggagatactgaatggtcaccattaacctggcggcagcgcaaaagatg

SEQ ID NO: 53422 - DNA, 103 bp, Artificial Sequence
  Synthetic Polynucleotide
taatacgactcactataggggtttttatgaatggttgaatggtgacggttaacagaggagaaaccgtatgcattcaaccaacctggcggcagcgcaaaagatg

SEQ ID NO: 53423 - DNA, 103 bp, Artificial Sequence
  Synthetic Polynucleotide
taatacgactcactatagggcgatggtttttatgaatggttgaatggtgaaacagaggagatcaccaatgaaccattcaaacctggcggcagcgcaaaagatg

SEQ ID NO: 53424 - DNA, 103 bp, Artificial Sequence
  Synthetic Polynucleotide
taatacgactcactatagggtcagacgatggtttttatgaatggttgaataacagaggagaattcaaatgttcataaaaaacctggcggcagcgcaaaagatg

SEQ ID NO: 53425 - DNA, 103 bp, Artificial Sequence
  Synthetic Polynucleotide
taatacgactcactatagggtggattcagacgatggtttttatgaatggtaacagaggagaaccattatgaaaaaccataacctggcggcagcgcaaaagatg

SEQ ID NO: 53426 - DNA, 103 bp, Artificial Sequence
  Synthetic Polynucleotide
taatacgactcactatagggttcgttttataaagaaaatggtctacgtaaaacagaggagattacgtatgccattttctaacctggcggcagcgcaaaagatg

SEQ ID NO: 53427 - DNA, 103 bp, Artificial Sequence
  Synthetic Polynucleotide
taatacgactcactatagggatcaatggattcagacgatggtttttatgaaacagaggagatcataaatgccatcgtctaacctggcggcagcgcaaaagatg

SEQ ID NO: 53428 - DNA, 103 bp, Artificial Sequence
  Synthetic Polynucleotide
taatacgactcactatagggaaattatcaatggattcagacgatggttttaacagaggagaaaaaccatggtctgaatcaacctggcggcagcgcaaaagatg

SEQ ID NO: 53429 - DNA, 103 bp, Artificial Sequence
  Synthetic Polynucleotide
taatacgactcactatagggacaagaaattatcaatggattcagacgatgaacagaggagacatcgtatgaatccattgaacctggcggcagcgcaaaagatg

SEQ ID NO: 53430 - DNA, 103 bp, Artificial Sequence
  Synthetic Polynucleotide
taatacgactcactatagggccagtacaagaaattatcaatggattcagaaacagaggagatctgaaatgattgataataacctggcggcagcgcaaaagatg

SEQ ID NO: 53431 - DNA, 103 bp, Artificial Sequence
  Synthetic Polynucleotide
taatacgactcactatagggaaaaaccagtacaagaaattatcaatggataacagaggagaatccatatgtaatttcttaacctggcggcagcgcaaaagatg

SEQ ID NO: 53432 - DNA, 103 bp, Artificial Sequence
  Synthetic Polynucleotide
taatacgactcactatagggctctcaaaaaccagtacaagaaattatcaaaacagaggagattgataatgtcttgtactaacctggcggcagcgcaaaagatg

SEQ ID NO: 53433 - DNA, 103 bp, Artificial Sequence
  Synthetic Polynucleotide
taatacgactcactataggggcgagctctcaaaaaccagtacaagaaattaacagaggagaaatttcatgtactggtttaacctggcggcagcgcaaaagatg

SEQ ID NO: 53434 - DNA, 103 bp, Artificial Sequence
  Synthetic Polynucleotide
taatacgactcactatagggttgatgcgagctctcaaaaaccagtacaagaacagaggagacttgtaatggtttttgagaacctggcggcagcgcaaaagatg

SEQ ID NO: 53435 - DNA, 103 bp, Artificial Sequence
  Synthetic Polynucleotide
taatacgactcactatagggctagattgatgcgagctctcaaaaaccagtaacagaggagaactggtatgtgagagctcaacctggcggcagcgcaaaagatg

SEQ ID NO: 53436 - DNA, 103 bp, Artificial Sequence
  Synthetic Polynucleotide
taatacgactcactatagggaaatgctagattgatgcgagctctcaaaaaaacagaggagatttttgatggctcgcatcaacctggcggcagcgcaaaagatg

SEQ ID NO: 53437 - DNA, 103 bp, Artificial Sequence
  Synthetic Polynucleotide
taatacgactcactatagggatatattcgttttataaagaaaatggtctaaacagaggagatagaccatgttctttataaacctggcggcagcgcaaaagatg

SEQ ID NO: 53438 - DNA, 103 bp, Artificial Sequence
  Synthetic Polynucleotide
taatacgactcactataggggctagaaatgctagattgatgcgagctctcaacagaggagagagagcatgcatcaatctaacctggcggcagcgcaaaagatg

SEQ ID NO: 53439 - DNA, 103 bp, Artificial Sequence
  Synthetic Polynucleotide
taatacgactcactatagggcgggagctagaaatgctagattgatgcgagaacagaggagactcgcaatgatctagcataacctggcggcagcgcaaaagatg

SEQ ID NO: 53440 - DNA, 103 bp, Artificial Sequence
  Synthetic Polynucleotide
taatacgactcactatagggcaatccgggagctagaaatgctagattgataacagaggagaatcaatatggcatttctaaacctggcggcagcgcaaaagatg

SEQ ID NO: 53441 - DNA, 103 bp, Artificial Sequence
  Synthetic Polynucleotide
taatacgactcactataggggttttcaatccgggagctagaaatgctagaaacagaggagatctagcatgtctagctccaacctggcggcagcgcaaaagatg

SEQ ID NO: 53442 - DNA, 103 bp, Artificial Sequence
  Synthetic Polynucleotide
taatacgactcactatagggtttctgttttcaatccgggagctagaaatgaacagaggagacatttcatgctcccggataacctggcggcagcgcaaaagatg

SEQ ID NO: 53443 - DNA, 103 bp, Artificial Sequence
  Synthetic Polynucleotide
taatacgactcactatagggtcctctttctgttttcaatccgggagctagaacagaggagactagctatgggattgaaaaacctggcggcagcgcaaaagatg

SEQ ID NO: 53444 - DNA, 103 bp, Artificial Sequence
  Synthetic Polynucleotide
taatacgactcactatagggtacgatcctctttctgttttcaatccgggaaacagaggagatcccggatggaaaacagaaacctggcggcagcgcaaaagatg

SEQ ID NO: 53445 - DNA, 103 bp, Artificial Sequence
  Synthetic Polynucleotide
taatacgactcactatagggggatgtacgatcctctttctgttttcaatcaacagaggagagattgaatgcagaaagagaacctggcggcagcgcaaaagatg

SEQ ID NO: 53446 - DNA, 103 bp, Artificial Sequence
  Synthetic Polynucleotide
taatacgactcactatagggaccctggatgtacgatcctctttctgttttaacagaggagaaaaacaatgagaggatcgaacctggcggcagcgcaaaagatg

SEQ ID NO: 53447 - DNA, 103 bp, Artificial Sequence
  Synthetic Polynucleotide
taatacgactcactatagggaatggaccctggatgtacgatcctctttctaacagaggagaagaaagatgatcgtacataacctggcggcagcgcaaaagatg

SEQ ID NO: 53448 - DNA, 103 bp, Artificial Sequence
  Synthetic Polynucleotide
taatacgactcactatagggatactatatattcgttttataaagaaaatgaacagaggagacattttatgtataaaacgaacctggcggcagcgcaaaagatg

SEQ ID NO: 53449 - DNA, 103 bp, Artificial Sequence
  Synthetic Polynucleotide
taatacgactcactatagggcagaaaatggaccctggatgtacgatcctcaacagaggagagaggatatgacatccaggaacctggcggcagcgcaaaagatg

SEQ ID NO: 53450 - DNA, 103 bp, Artificial Sequence
  Synthetic Polynucleotide
taatacgactcactatagggatttacagaaaatggaccctggatgtacgaaacagaggagatcgtacatgcagggtccaaacctggcggcagcgcaaaagatg

SEQ ID NO: 53451 - DNA, 103 bp, Artificial Sequence
  Synthetic Polynucleotide
taatacgactcactatagggattctatttacagaaaatggaccctggatgaacagaggagacatccaatgtccattttcaacctggcggcagcgcaaaagatg

SEQ ID NO: 53452 - DNA, 103 bp, Artificial Sequence
  Synthetic Polynucleotide
taatacgactcactatagggatactattctatttacagaaaatggaccctaacagaggagaagggtcatgtttctgtaaaacctggcggcagcgcaaaagatg

SEQ ID NO: 53453 - DNA, 103 bp, Artificial Sequence
  Synthetic Polynucleotide
taatacgactcactatagggacattatactattctatttacagaaaatggaacagaggagaccatttatggtaaatagaaacctggcggcagcgcaaaagatg

SEQ ID NO: 53454 - DNA, 103 bp, Artificial Sequence
  Synthetic Polynucleotide
taatacgactcactatagggaagggacattatactattctatttacagaaaacagaggagattctgtatgtagaatagtaacctggcggcagcgcaaaagatg

SEQ ID NO: 53455 - DNA, 103 bp, Artificial Sequence
  Synthetic Polynucleotide
taatacgactcactatagggtcttaaagggacattatactattctatttaaacagaggagataaataatgtagtataataacctggcggcagcgcaaaagatg

SEQ ID NO: 53456 - DNA, 103 bp, Artificial Sequence
  Synthetic Polynucleotide
taatacgactcactatagggtatcttcttaaagggacattatactattctaacagaggagaagaataatgtaatgtcccaacctggcggcagcgcaaaagatg

SEQ ID NO: 53457 - DNA, 103 bp, Artificial Sequence
  Synthetic Polynucleotide
taatacgactcactatagggtctgatatcttcttaaagggacattatactaacagaggagaagtataatgtccctttaaaacctggcggcagcgcaaaagatg

SEQ ID NO: 53458 - DNA, 103 bp, Artificial Sequence
  Synthetic Polynucleotide
taatacgactcactataggggatcgtctgatatcttcttaaagggacattaacagaggagaaatgtcatgttaagaagaaacctggcggcagcgcaaaagatg

SEQ ID NO: 53459 - DNA, 103 bp, Artificial Sequence
  Synthetic Polynucleotide
taatacgactcactatagggatacagtacatttaacagtataataaattaaacagaggagataatttatgatactgttaaacctggcggcagcgcaaaagatg

SEQ ID NO: 53460 - DNA, 103 bp, Artificial Sequence
  Synthetic Polynucleotide
taatacgactcactatagggttggtatactatatattcgttttataaagaaacagaggagatctttaatgaacgaatataacctggcggcagcgcaaaagatg

SEQ ID NO: 53461 - DNA, 103 bp, Artificial Sequence
  Synthetic Polynucleotide
taatacgactcactatagggttgtggatcgtctgatatcttcttaaagggaacagaggagaccctttatgaagatatcaaacctggcggcagcgcaaaagatg

SEQ ID NO: 53462 - DNA, 103 bp, Artificial Sequence
  Synthetic Polynucleotide
taatacgactcactatagggtttgattgtggatcgtctgatatcttcttaaacagaggagataagaaatgatcagacgaaacctggcggcagcgcaaaagatg

SEQ ID NO: 53463 - DNA, 103 bp, Artificial Sequence
  Synthetic Polynucleotide
taatacgactcactatagggaattttttgattgtggatcgtctgatatctaacagaggagaagatatatgacgatccacaacctggcggcagcgcaaaagatg

SEQ ID NO: 53464 - DNA, 103 bp, Artificial Sequence
  Synthetic Polynucleotide
taatacgactcactatagggagaccaattttttgattgtggatcgtctgaaacagaggagatcagacatgccacaatcaaacctggcggcagcgcaaaagatg

SEQ ID NO: 53465 - DNA, 103 bp, Artificial Sequence
  Synthetic Polynucleotide
taatacgactcactatagggctcggagaccaattttttgattgtggatcgaacagaggagacgatccatgatcaaaaaaaacctggcggcagcgcaaaagatg

SEQ ID NO: 53466 - DNA, 103 bp, Artificial Sequence
  Synthetic Polynucleotide
taatacgactcactatagggacaaactcggagaccaattttttgattgtgaacagaggagacacaatatgaaaattggtaacctggcggcagcgcaaaagatg

SEQ ID NO: 53467 - DNA, 103 bp, Artificial Sequence
  Synthetic Polynucleotide
taatacgactcactatagggctgttacaaactcggagaccaattttttgaaacagaggagatcaaaaatgtggtctccgaacctggcggcagcgcaaaagatg

SEQ ID NO: 53468 - DNA, 103 bp, Artificial Sequence
  Synthetic Polynucleotide
taatacgactcactataggggcagtctgttacaaactcggagaccaatttaacagaggagaaaattgatgtccgagtttaacctggcggcagcgcaaaagatg

SEQ ID NO: 53469 - DNA, 103 bp, Artificial Sequence
  Synthetic Polynucleotide
taatacgactcactatagggagtccgcagtctgttacaaactcggagaccaacagaggagaggtctcatggtttgtaacaacctggcggcagcgcaaaagatg

SEQ ID NO: 53470 - DNA, 103 bp, Artificial Sequence
  Synthetic Polynucleotide
taatacgactcactataggggttaaagtccgcagtctgttacaaactcggaacagaggagaccgagtatgtaacagactaacctggcggcagcgcaaaagatg

SEQ ID NO: 53471 - DNA, 103 bp, Artificial Sequence
  Synthetic Polynucleotide
taatacgactcactataggggataattggtatactatatattcgttttataacagaggagaataaaaatgatatatagtaacctggcggcagcgcaaaagatg

SEQ ID NO: 53472 - DNA, 103 bp, Artificial Sequence
  Synthetic Polynucleotide
taatacgactcactatagggtataggttaaagtccgcagtctgttacaaaaacagaggagatttgtaatggactgcggaaacctggcggcagcgcaaaagatg

SEQ ID NO: 53473 - DNA, 103 bp, Artificial Sequence
  Synthetic Polynucleotide
taatacgactcactatagggtcatgtataggttaaagtccgcagtctgttaacagaggagaaacagaatgcggactttaaacctggcggcagcgcaaaagatg

SEQ ID NO: 53474 - DNA, 103 bp, Artificial Sequence
  Synthetic Polynucleotide
taatacgactcactatagggcggtatcatgtataggttaaagtccgcagtaacagaggagaactgcgatgtttaacctaaacctggcggcagcgcaaaagatg

SEQ ID NO: 53475 - DNA, 103 bp, Artificial Sequence
  Synthetic Polynucleotide
taatacgactcactatagggctaaacggtatcatgtataggttaaagtccaacagaggagaggacttatgcctatacataacctggcggcagcgcaaaagatg

SEQ ID NO: 53476 - DNA, 103 bp, Artificial Sequence
  Synthetic Polynucleotide
taatacgactcactatagggtcatgctaaacggtatcatgtataggttaaaacagaggagattaaccatgacatgatacaacctggcggcagcgcaaaagatg

SEQ ID NO: 53477 - DNA, 103 bp, Artificial Sequence
  Synthetic Polynucleotide
taatacgactcactatagggagaaatcatgctaaacggtatcatgtatagaacagaggagactatacatgataccgtttaacctggcggcagcgcaaaagatg

SEQ ID NO: 53478 - DNA, 103 bp, Artificial Sequence
  Synthetic Polynucleotide
taatacgactcactatagggtcaccagaaatcatgctaaacggtatcatgaacagaggagacatgatatggtttagcataacctggcggcagcgcaaaagatg

SEQ ID NO: 53479 - DNA, 103 bp, Artificial Sequence
  Synthetic Polynucleotide
taatacgactcactatagggacgtatcaccagaaatcatgctaaacggtaaacagaggagataccgtatggcatgatttaacctggcggcagcgcaaaagatg

SEQ ID NO: 53480 - DNA, 103 bp, Artificial Sequence
  Synthetic Polynucleotide
taatacgactcactatagggaattgacgtatcaccagaaatcatgctaaaaacagaggagatttagcatgatttctggtaacctggcggcagcgcaaaagatg

SEQ ID NO: 53481 - DNA, 103 bp, Artificial Sequence
  Synthetic Polynucleotide
taatacgactcactatagggactccaattgacgtatcaccagaaatcatgaacagaggagacatgatatgtggtgatacaacctggcggcagcgcaaaagatg

SEQ ID NO: 53482 - DNA, 103 bp, Artificial Sequence
  Synthetic Polynucleotide
taatacgactcactataggggaaaagataattggtatactatatattcgtaacagaggagaacgaatatgtagtataccaacctggcggcagcgcaaaagatg

SEQ ID NO: 53483 - DNA, 103 bp, Artificial Sequence
  Synthetic Polynucleotide
taatacgactcactatagggatgatactccaattgacgtatcaccagaaaaacagaggagatttctgatgatacgtcaaaacctggcggcagcgcaaaagatg

SEQ ID NO: 53484 - DNA, 103 bp, Artificial Sequence
  Synthetic Polynucleotide
taatacgactcactatagggaatagatgatactccaattgacgtatcaccaacagaggagaggtgatatgtcaattggaaacctggcggcagcgcaaaagatg

SEQ ID NO: 53485 - DNA, 103 bp, Artificial Sequence
  Synthetic Polynucleotide
taatacgactcactatagggtctctaatagatgatactccaattgacgtaaacagaggagatacgtcatgtggagtatcaacctggcggcagcgcaaaagatg

SEQ ID NO: 53486 - DNA, 103 bp, Artificial Sequence
  Synthetic Polynucleotide
taatacgactcactatagggttagatctctaatagatgatactccaattgaacagaggagacaattgatgtatcatctaaacctggcggcagcgcaaaagatg

SEQ ID NO: 53487 - DNA, 103 bp, Artificial Sequence
  Synthetic Polynucleotide
taatacgactcactatagggcggctttagatctctaatagatgatactccaacagaggagaggagtaatgtctattagaaacctggcggcagcgcaaaagatg

SEQ ID NO: 53488 - DNA, 103 bp, Artificial Sequence
  Synthetic Polynucleotide
taatacgactcactatagggtacaccggctttagatctctaatagatgataacagaggagaatcatcatgtagagatctaacctggcggcagcgcaaaagatg

SEQ ID NO: 53489 - DNA, 103 bp, Artificial Sequence
  Synthetic Polynucleotide
taatacgactcactatagggaatgttacaccggctttagatctctaatagaacagaggagactattaatgatctaaagcaacctggcggcagcgcaaaagatg

SEQ ID NO: 53490 - DNA, 103 bp, Artificial Sequence
  Synthetic Polynucleotide
taatacgactcactatagggtggagaatgttacaccggctttagatctctaacagaggagaagagatatgaagccggtgaacctggcggcagcgcaaaagatg

SEQ ID NO: 53491 - DNA, 103 bp, Artificial Sequence
  Synthetic Polynucleotide
taatacgactcactatagggtttggtggagaatgttacaccggctttagaaacagaggagatctaaaatgggtgtaacaaacctggcggcagcgcaaaagatg

SEQ ID NO: 53492 - DNA, 103 bp, Artificial Sequence
  Synthetic Polynucleotide
taatacgactcactatagggatatgtttggtggagaatgttacaccggctaacagaggagaagccggatgaacattctcaacctggcggcagcgcaaaagatg

SEQ ID NO: 53493 - DNA, 103 bp, Artificial Sequence
  Synthetic Polynucleotide
taatacgactcactatagggtatcggaaaagataattggtatactatataaacagaggagatatataatgtaccaattaaacctggcggcagcgcaaaagatg

SEQ ID NO: 53494 - DNA, 103 bp, Artificial Sequence
  Synthetic Polynucleotide
taatacgactcactatagggtaagaatatgtttggtggagaatgttacacaacagaggagagtgtaaatgtctccaccaaacctggcggcagcgcaaaagatg

SEQ ID NO: 53495 - DNA, 103 bp, Artificial Sequence
  Synthetic Polynucleotide
taatacgactcactatagggcagaataagaatatgtttggtggagaatgtaacagaggagaacattcatgaccaaacataacctggcggcagcgcaaaagatg

SEQ ID NO: 53496 - DNA, 103 bp, Artificial Sequence
  Synthetic Polynucleotide
taatacgactcactataggggacgtcagaataagaatatgtttggtggagaacagaggagactccacatgacatattctaacctggcggcagcgcaaaagatg

SEQ ID NO: 53497 - DNA, 103 bp, Artificial Sequence
  Synthetic Polynucleotide
taatacgactcactatagggagaacgacgtcagaataagaatatgtttggaacagaggagaccaaacatgttcttattcaacctggcggcagcgcaaaagatg

SEQ ID NO: 53498 - DNA, 103 bp, Artificial Sequence
  Synthetic Polynucleotide
taatacgactcactatagggtatgtagaacgacgtcagaataagaatatgaacagaggagacatattatgattctgacgaacctggcggcagcgcaaaagatg

SEQ ID NO: 53499 - DNA, 103 bp, Artificial Sequence
  Synthetic Polynucleotide
taatacgactcactatagggtgttttatgtagaacgacgtcagaataagaaacagaggagatcttatatggacgtcgttaacctggcggcagcgcaaaagatg

SEQ ID NO: 53500 - DNA, 103 bp, Artificial Sequence
  Synthetic Polynucleotide
taatacgactcactatagggaatgatgttttatgtagaacgacgtcagaaaacagaggagattctgaatgcgttctacaaacctggcggcagcgcaaaagatg

SEQ ID NO: 53501 - DNA, 103 bp, Artificial Sequence
  Synthetic Polynucleotide
taatacgactcactatagggggagcaatgatgttttatgtagaacgacgtaacagaggagaacgtcgatgtacataaaaaacctggcggcagcgcaaaagatg

SEQ ID NO: 53502 - DNA, 103 bp, Artificial Sequence
  Synthetic Polynucleotide
taatacgactcactatagggttaatggagcaatgatgttttatgtagaacaacagaggagagttctaatgaaaacatcaaacctggcggcagcgcaaaagatg

SEQ ID NO: 53503 - DNA, 103 bp, Artificial Sequence
  Synthetic Polynucleotide
taatacgactcactatagggtatcgttaatggagcaatgatgttttatgtaacagaggagaacataaatgatcattgctaacctggcggcagcgcaaaagatg

SEQ ID NO: 53504 - DNA, 103 bp, Artificial Sequence
  Synthetic Polynucleotide
taatacgactcactatagggtatattatcggaaaagataattggtatactaacagaggagaagtataatgattatctttaacctggcggcagcgcaaaagatg

SEQ ID NO: 53505 - DNA, 103 bp, Artificial Sequence
  Synthetic Polynucleotide
taatacgactcactatagggcctgttatcgttaatggagcaatgatgtttaacagaggagaaaacatatgtgctccattaacctggcggcagcgcaaaagatg

SEQ ID NO: 53506 - DNA, 103 bp, Artificial Sequence
  Synthetic Polynucleotide
taatacgactcactatagggattcccctgttatcgttaatggagcaatgaaacagaggagatcattgatgcattaacgaaacctggcggcagcgcaaaagatg

SEQ ID NO: 53507 - DNA, 103 bp, Artificial Sequence
  Synthetic Polynucleotide
taatacgactcactatagggtgttcattcccctgttatcgttaatggagcaacagaggagagctccaatgacgataacaaacctggcggcagcgcaaaagatg

SEQ ID NO: 53508 - DNA, 103 bp, Artificial Sequence
  Synthetic Polynucleotide
taatacgactcactatagggagtgctgttcattcccctgttatcgttaataacagaggagaattaacatgaacaggggaaacctggcggcagcgcaaaagatg

SEQ ID NO: 53509 - DNA, 103 bp, Artificial Sequence
  Synthetic Polynucleotide
taatacgactcactatagggtgggtagtgctgttcattcccctgttatcgaacagaggagacgataaatggggaatgaaaacctggcggcagcgcaaaagatg

SEQ ID NO: 53510 - DNA, 103 bp, Artificial Sequence
  Synthetic Polynucleotide
taatacgactcactatagggtgtgatgggtagtgctgttcattcccctgtaacagaggagaacagggatgtgaacagcaaacctggcggcagcgcaaaagatg

SEQ ID NO: 53511 - DNA, 103 bp, Artificial Sequence
  Synthetic Polynucleotide
taatacgactcactatagggactaatgtgatgggtagtgctgttcattccaacagaggagaggaatgatgagcactaccaacctggcggcagcgcaaaagatg

SEQ ID NO: 53512 - DNA, 103 bp, Artificial Sequence
  Synthetic Polynucleotide
taatacgactcactatagggtgggaactaatgtgatgggtagtgctgttcaacagaggagagaacagatgtacccatcaaacctggcggcagcgcaaaagatg

SEQ ID NO: 53513 - DNA, 103 bp, Artificial Sequence
  Synthetic Polynucleotide
taatacgactcactatagggttcattgggaactaatgtgatgggtagtgcaacagaggagagcactaatgatcacattaaacctggcggcagcgcaaaagatg

SEQ ID NO: 53514 - DNA, 103 bp, Artificial Sequence
  Synthetic Polynucleotide
taatacgactcactatagggattgattcattgggaactaatgtgatgggtaacagaggagaacccatatgattagttccaacctggcggcagcgcaaaagatg

SEQ ID NO: 53515 - DNA, 103 bp, Artificial Sequence
  Synthetic Polynucleotide
taatacgactcactataggggtaaatatattatcggaaaagataattggtaacagaggagaaccaatatgcttttccgaaacctggcggcagcgcaaaagatg

SEQ ID NO: 53516 - DNA, 103 bp, Artificial Sequence
  Synthetic Polynucleotide
taatacgactcactatagggcacacattgattcattgggaactaatgtgaaacagaggagatcacatatgttcccaatgaacctggcggcagcgcaaaagatg

SEQ ID NO: 53517 - DNA, 103 bp, Artificial Sequence
  Synthetic Polynucleotide
taatacgactcactatagggagttacacacattgattcattgggaactaaaacagaggagattagttatgaatgaatcaaacctggcggcagcgcaaaagatg

SEQ ID NO: 53518 - DNA, 103 bp, Artificial Sequence
  Synthetic Polynucleotide
taatacgactcactatagggtctggagttacacacattgattcattgggaaacagaggagatcccaaatgatcaatgtgaacctggcggcagcgcaaaagatg

SEQ ID NO: 53519 - DNA, 103 bp, Artificial Sequence
  Synthetic Polynucleotide
taatacgactcactataggggatgttctggagttacacacattgattcataacagaggagaatgaatatgtgtgtgtaaaacctggcggcagcgcaaaagatg

SEQ ID NO: 53520 - DNA, 103 bp, Artificial Sequence
  Synthetic Polynucleotide
taatacgactcactatagggtggaagatgttctggagttacacacattgaaacagaggagatcaatgatggtaactccaaacctggcggcagcgcaaaagatg

SEQ ID NO: 53521 - DNA, 103 bp, Artificial Sequence
  Synthetic Polynucleotide
taatacgactcactatagggggctatggaagatgttctggagttacacacaacagaggagagtgtgtatgtccagaacaaacctggcggcagcgcaaaagatg

SEQ ID NO: 53522 - DNA, 103 bp, Artificial Sequence
  Synthetic Polynucleotide
taatacgactcactatagggacataggctatggaagatgttctggagttaaacagaggagataactcatgaacatcttcaacctggcggcagcgcaaaagatg

SEQ ID NO: 53523 - DNA, 103 bp, Artificial Sequence
  Synthetic Polynucleotide
taatacgactcactatagggtcctaacataggctatggaagatgttctggaacagaggagaccagaaatgcttccatagaacctggcggcagcgcaaaagatg

SEQ ID NO: 53524 - DNA, 103 bp, Artificial Sequence
  Synthetic Polynucleotide
taatacgactcactataggggctcctcctaacataggctatggaagatgtaacagaggagaacatctatgatagcctataacctggcggcagcgcaaaagatg

SEQ ID NO: 53525 - DNA, 103 bp, Artificial Sequence
  Synthetic Polynucleotide
taatacgactcactatagggtgttcgctcctcctaacataggctatggaaaacagaggagattccatatgctatgttagaacctggcggcagcgcaaaagatg

SEQ ID NO: 53526 - DNA, 103 bp, Artificial Sequence
  Synthetic Polynucleotide
taatacgactcactatagggtgtgtgtaaatatattatcggaaaagataaaacagaggagattatctatgccgataataaacctggcggcagcgcaaaagatg

SEQ ID NO: 53527 - DNA, 103 bp, Artificial Sequence
  Synthetic Polynucleotide
taatacgactcactatagggagtagtgttcgctcctcctaacataggctaaacagaggagatagcctatgttaggaggaaacctggcggcagcgcaaaagatg

SEQ ID NO: 53528 - DNA, 103 bp, Artificial Sequence
  Synthetic Polynucleotide
taatacgactcactatagggggaagagtagtgttcgctcctcctaacataaacagaggagatatgttatgaggagcgaaaacctggcggcagcgcaaaagatg

SEQ ID NO: 53529 - DNA, 103 bp, Artificial Sequence
  Synthetic Polynucleotide
taatacgactcactatagggatagtggaagagtagtgttcgctcctcctaaacagaggagataggagatgcgaacactaaacctggcggcagcgcaaaagatg

SEQ ID NO: 53530 - DNA, 103 bp, Artificial Sequence
  Synthetic Polynucleotide
taatacgactcactatagggtggcaatagtggaagagtagtgttcgctccaacagaggagaggagcgatgactactcttaacctggcggcagcgcaaaagatg

SEQ ID NO: 53531 - DNA, 103 bp, Artificial Sequence
  Synthetic Polynucleotide
taatacgactcactatagggttcgatggcaatagtggaagagtagtgttcaacagaggagagaacacatgtcttccactaacctggcggcagcgcaaaagatg

SEQ ID NO: 53532 - DNA, 103 bp, Artificial Sequence
  Synthetic Polynucleotide
taatacgactcactatagggtggcattcgatggcaatagtggaagagtagaacagaggagactactcatgcactattgcaacctggcggcagcgcaaaagatg

SEQ ID NO: 53533 - DNA, 103 bp, Artificial Sequence
  Synthetic Polynucleotide
taatacgactcactatagggttctatggcattcgatggcaatagtggaagaacagaggagacttccaatgttgccatcgaacctggcggcagcgcaaaagatg

SEQ ID NO: 53534 - DNA, 103 bp, Artificial Sequence
  Synthetic Polynucleotide
taatacgactcactatagggatttattctatggcattcgatggcaatagtaacagaggagaactattatgatcgaatgcaacctggcggcagcgcaaaagatg

SEQ ID NO: 53535 - DNA, 103 bp, Artificial Sequence
  Synthetic Polynucleotide
taatacgactcactatagggaggatatttattctatggcattcgatggcaaacagaggagatgccatatgatgccatagaacctggcggcagcgcaaaagatg

SEQ ID NO: 53536 - DNA, 103 bp, Artificial Sequence
  Synthetic Polynucleotide
taatacgactcactatagggttccaaggatatttattctatggcattcgaaacagaggagatcgaatatgatagaataaaacctggcggcagcgcaaaagatg

SEQ ID NO: 53537 - DNA, 103 bp, Artificial Sequence
  Synthetic Polynucleotide
taatacgactcactataggggattatgtgtgtaaatatattatcggaaaaaacagaggagattttccatgaatatatttaacctggcggcagcgcaaaagatg

SEQ ID NO: 53538 - DNA, 103 bp, Artificial Sequence
  Synthetic Polynucleotide
taatacgactcactatagggatcaattccaaggatatttattctatggcaaacagaggagatgccatatgataaatatcaacctggcggcagcgcaaaagatg

SEQ ID NO: 53539 - DNA, 103 bp, Artificial Sequence
  Synthetic Polynucleotide
taatacgactcactatagggtttctatcaattccaaggatatttattctaaacagaggagatagaatatgtatccttggaacctggcggcagcgcaaaagatg

SEQ ID NO: 53540 - DNA, 103 bp, Artificial Sequence
  Synthetic Polynucleotide
taatacgactcactatagggtccgatttctatcaattccaaggatatttaaacagaggagataaataatgttggaattgaacctggcggcagcgcaaaagatg

SEQ ID NO: 53541 - DNA, 103 bp, Artificial Sequence
  Synthetic Polynucleotide
taatacgactcactataggggacagtccgatttctatcaattccaaggataacagaggagaatccttatgattgatagaaacctggcggcagcgcaaaagatg

SEQ ID NO: 53542 - DNA, 103 bp, Artificial Sequence
  Synthetic Polynucleotide
taatacgactcactatagggcatccgacagtccgatttctatcaattccaaacagaggagatggaatatgtagaaatcgaacctggcggcagcgcaaaagatg

SEQ ID NO: 53543 - DNA, 103 bp, Artificial Sequence
  Synthetic Polynucleotide
taatacgactcactatagggcacaacatccgacagtccgatttctatcaaaacagaggagattgataatgatcggactgaacctggcggcagcgcaaaagatg

SEQ ID NO: 53544 - DNA, 103 bp, Artificial Sequence
  Synthetic Polynucleotide
taatacgactcactatagggatgatcacaacatccgacagtccgatttctaacagaggagaagaaatatgactgtcggaaacctggcggcagcgcaaaagatg

SEQ ID NO: 53545 - DNA, 103 bp, Artificial Sequence
  Synthetic Polynucleotide
taatacgactcactatagggtgaagatgatcacaacatccgacagtccgaaacagaggagatcggacatgcggatgttgaacctggcggcagcgcaaaagatg

SEQ ID NO: 53546 - DNA, 103 bp, Artificial Sequence
  Synthetic Polynucleotide
taatacgactcactatagggtcctatgaagatgatcacaacatccgacagaacagaggagactgtcgatggttgtgatcaacctggcggcagcgcaaaagatg

SEQ ID NO: 53547 - DNA, 103 bp, Artificial Sequence
  Synthetic Polynucleotide
taatacgactcactataggggttaatcctatgaagatgatcacaacatccaacagaggagaggatgtatggatcatcttaacctggcggcagcgcaaaagatg

SEQ ID NO: 53548 - DNA, 103 bp, Artificial Sequence
  Synthetic Polynucleotide
taatacgactcactataggggaatggattatgtgtgtaaatatattatcgaacagaggagacgataaatgatttacacaaacctggcggcagcgcaaaagatg

SEQ ID NO: 53549 - DNA, 103 bp, Artificial Sequence
  Synthetic Polynucleotide
taatacgactcactatagggttgttgttaatcctatgaagatgatcacaaaacagaggagattgtgaatgtcttcatagaacctggcggcagcgcaaaagatg

SEQ ID NO: 53550 - DNA, 103 bp, Artificial Sequence
  Synthetic Polynucleotide
taatacgactcactatagggatacattgttgttaatcctatgaagatgataacagaggagaatcatcatgataggattaaacctggcggcagcgcaaaagatg

SEQ ID NO: 53551 - DNA, 103 bp, Artificial Sequence
  Synthetic Polynucleotide
taatacgactcactataggggcaccatacattgttgttaatcctatgaagaacagaggagacttcatatgattaacaacaacctggcggcagcgcaaaagatg

SEQ ID NO: 53552 - DNA, 103 bp, Artificial Sequence
  Synthetic Polynucleotide
taatacgactcactatagggaggcggcaccatacattgttgttaatcctaaacagaggagataggatatgcaacaatgtaacctggcggcagcgcaaaagatg

SEQ ID NO: 53553 - DNA, 103 bp, Artificial Sequence
  Synthetic Polynucleotide
taatacgactcactatagggacttcaggcggcaccatacattgttgttaaaacagaggagattaacaatgatgtatggtaacctggcggcagcgcaaaagatg

SEQ ID NO: 53554 - DNA, 103 bp, Artificial Sequence
  Synthetic Polynucleotide
taatacgactcactatagggatgaaacttcaggcggcaccatacattgttaacagaggagaaacaatatgtggtgccgcaacctggcggcagcgcaaaagatg

SEQ ID NO: 53555 - DNA, 103 bp, Artificial Sequence
  Synthetic Polynucleotide
taatacgactcactatagggacgatatgaaacttcaggcggcaccatacaaacagaggagatgtatgatgccgcctgaaaacctggcggcagcgcaaaagatg

SEQ ID NO: 53556 - DNA, 103 bp, Artificial Sequence
  Synthetic Polynucleotide
taatacgactcactatagggcagttacgatatgaaacttcaggcggcaccaacagaggagaggtgccatgtgaagtttcaacctggcggcagcgcaaaagatg

SEQ ID NO: 53557 - DNA, 103 bp, Artificial Sequence
  Synthetic Polynucleotide
taatacgactcactatagggggcatcagttacgatatgaaacttcaggcgaacagaggagacgcctgatgtttcatatcaacctggcggcagcgcaaaagatg

SEQ ID NO: 53558 - DNA, 103 bp, Artificial Sequence
  Synthetic Polynucleotide
taatacgactcactatagggtaaacggcatcagttacgatatgaaacttcaacagaggagagaagttatgtatcgtaacaacctggcggcagcgcaaaagatg

SEQ ID NO: 53559 - DNA, 103 bp, Artificial Sequence
  Synthetic Polynucleotide
taatacgactcactatagggtgagagaatggattatgtgtgtaaatatataacagaggagaatatatatgcacacataaaacctggcggcagcgcaaaagatg

SEQ ID NO: 53560 - DNA, 103 bp, Artificial Sequence
  Synthetic Polynucleotide
taatacgactcactatagggacctataaacggcatcagttacgatatgaaaacagaggagattcataatgtaactgatgaacctggcggcagcgcaaaagatg

SEQ ID NO: 53561 - DNA, 103 bp, Artificial Sequence
  Synthetic Polynucleotide
taatacgactcactataggggctagacctataaacggcatcagttacgataacagaggagaatcgtaatggatgccgttaacctggcggcagcgcaaaagatg

SEQ ID NO: 53562 - DNA, 103 bp, Artificial Sequence
  Synthetic Polynucleotide
taatacgactcactatagggctgtggctagacctataaacggcatcagttaacagaggagaaactgaatgcgtttatagaacctggcggcagcgcaaaagatg

SEQ ID NO: 53563 - DNA, 103 bp, Artificial Sequence
  Synthetic Polynucleotide
taatacgactcactatagggggtttctgtggctagacctataaacggcataacagaggagaatgccgatgataggtctaaacctggcggcagcgcaaaagatg

SEQ ID NO: 53564 - DNA, 103 bp, Artificial Sequence
  Synthetic Polynucleotide
taatacgactcactatagggacattggtttctgtggctagacctataaacaacagaggagagtttatatgtctagccacaacctggcggcagcgcaaaagatg

SEQ ID NO: 53565 - DNA, 103 bp, Artificial Sequence
  Synthetic Polynucleotide
taatacgactcactataggggacctacattggtttctgtggctagacctaaacagaggagataggtcatgccacagaaaaacctggcggcagcgcaaaagatg

SEQ ID NO: 53566 - DNA, 103 bp, Artificial Sequence
  Synthetic Polynucleotide
taatacgactcactatagggatttagacctacattggtttctgtggctagaacagaggagactagccatggaaaccaataacctggcggcagcgcaaaagatg

SEQ ID NO: 53567 - DNA, 103 bp, Artificial Sequence
  Synthetic Polynucleotide
taatacgactcactataggggttggatttagacctacattggtttctgtgaacagaggagacacagaatgcaatgtaggaacctggcggcagcgcaaaagatg

SEQ ID NO: 53568 - DNA, 103 bp, Artificial Sequence
  Synthetic Polynucleotide
taatacgactcactatagggctatagttggatttagacctacattggtttaacagaggagaaaaccaatgtaggtctaaaacctggcggcagcgcaaaagatg

SEQ ID NO: 53569 - DNA, 103 bp, Artificial Sequence
  Synthetic Polynucleotide
taatacgactcactatagggtttgtctatagttggatttagacctacattaacagaggagaaatgtaatgctaaatccaaacctggcggcagcgcaaaagatg

SEQ ID NO: 53570 - DNA, 103 bp, Artificial Sequence
  Synthetic Polynucleotide
taatacgactcactatagggattatatacagtacatttaacagtataataaacagaggagatattatatggttaaatgtaacctggcggcagcgcaaaagatg

SEQ ID NO: 53571 - DNA, 103 bp, Artificial Sequence
  Synthetic Polynucleotide
taatacgactcactataggggtgattgagagaatggattatgtgtgtaaaaacagaggagatttacaatgataatccataacctggcggcagcgcaaaagatg

SEQ ID NO: 53572 - DNA, 103 bp, Artificial Sequence
  Synthetic Polynucleotide
taatacgactcactatagggtctattttgtctatagttggatttagacctaacagaggagaaggtctatgtccaactataacctggcggcagcgcaaaagatg

SEQ ID NO: 53573 - DNA, 103 bp, Artificial Sequence
  Synthetic Polynucleotide
taatacgactcactatagggtggcttctattttgtctatagttggatttaaacagaggagataaatcatgctatagacaaacctggcggcagcgcaaaagatg

SEQ ID NO: 53574 - DNA, 103 bp, Artificial Sequence
  Synthetic Polynucleotide
taatacgactcactataggggatattggcttctattttgtctatagttggaacagaggagaccaactatggacaaaataaacctggcggcagcgcaaaagatg

SEQ ID NO: 53575 - DNA, 103 bp, Artificial Sequence
  Synthetic Polynucleotide
taatacgactcactataggggaacagatattggcttctattttgtctataaacagaggagatatagaatgaatagaagcaacctggcggcagcgcaaaagatg

SEQ ID NO: 53576 - DNA, 103 bp, Artificial Sequence
  Synthetic Polynucleotide
taatacgactcactatagggatgaggaacagatattggcttctattttgtaacagaggagaacaaaaatgaagccaataaacctggcggcagcgcaaaagatg

SEQ ID NO: 53577 - DNA, 103 bp, Artificial Sequence
  Synthetic Polynucleotide
taatacgactcactataggggacagatgaggaacagatattggcttctataacagaggagaatagaaatgaatatctgtaacctggcggcagcgcaaaagatg

SEQ ID NO: 53578 - DNA, 103 bp, Artificial Sequence
  Synthetic Polynucleotide
taatacgactcactataggggttatgacagatgaggaacagatattggctaacagaggagaagccaaatgctgttcctcaacctggcggcagcgcaaaagatg

SEQ ID NO: 53579 - DNA, 103 bp, Artificial Sequence
  Synthetic Polynucleotide
taatacgactcactatagggctcaagttatgacagatgaggaacagatataacagaggagaatatctatgcctcatctgaacctggcggcagcgcaaaagatg

SEQ ID NO: 53580 - DNA, 103 bp, Artificial Sequence
  Synthetic Polynucleotide
taatacgactcactatagggatgctctcaagttatgacagatgaggaacaaacagaggagatgttccatgtctgtcataaacctggcggcagcgcaaaagatg

SEQ ID NO: 53581 - DNA, 103 bp, Artificial Sequence
  Synthetic Polynucleotide
taatacgactcactatagggactggatgctctcaagttatgacagatgagaacagaggagactcatcatgcataacttgaacctggcggcagcgcaaaagatg

SEQ ID NO: 53582 - DNA, 103 bp, Artificial Sequence
  Synthetic Polynucleotide
taatacgactcactatagggatgtagtgattgagagaatggattatgtgtaacagaggagaacacatatgccattctctaacctggcggcagcgcaaaagatg

SEQ ID NO: 53583 - DNA, 103 bp, Artificial Sequence
  Synthetic Polynucleotide
taatacgactcactatagggttcatactggatgctctcaagttatgacagaacagaggagactgtcaatgcttgagagcaacctggcggcagcgcaaaagatg

SEQ ID NO: 53584 - DNA, 103 bp, Artificial Sequence
  Synthetic Polynucleotide
taatacgactcactataggggattattcatactggatgctctcaagttataacagaggagaataactatggagcatccaaacctggcggcagcgcaaaagatg

SEQ ID NO: 53585 - DNA, 103 bp, Artificial Sequence
  Synthetic Polynucleotide
taatacgactcactatagggatgaagattattcatactggatgctctcaaaacagaggagattgagaatgtccagtatgaacctggcggcagcgcaaaagatg

SEQ ID NO: 53586 - DNA, 103 bp, Artificial Sequence
  Synthetic Polynucleotide
taatacgactcactatagggatctaatgaagattattcatactggatgctaacagaggagaagcatcatgtatgaataaaacctggcggcagcgcaaaagatg

SEQ ID NO: 53587 - DNA, 103 bp, Artificial Sequence
  Synthetic Polynucleotide
taatacgactcactatagggtccccatctaatgaagattattcatactggaacagaggagaccagtaatgataatcttcaacctggcggcagcgcaaaagatg

SEQ ID NO: 53588 - DNA, 103 bp, Artificial Sequence
  Synthetic Polynucleotide
taatacgactcactataggggtagatccccatctaatgaagattattcataacagaggagaatgaatatgcttcattagaacctggcggcagcgcaaaagatg

SEQ ID NO: 53589 - DNA, 103 bp, Artificial Sequence
  Synthetic Polynucleotide
taatacgactcactatagggatgcggtagatccccatctaatgaagattaaacagaggagataatctatgttagatgggaacctggcggcagcgcaaaagatg

SEQ ID NO: 53590 - DNA, 103 bp, Artificial Sequence
  Synthetic Polynucleotide
taatacgactcactatagggtgatgatgcggtagatccccatctaatgaaaacagaggagattcattatgtggggatctaacctggcggcagcgcaaaagatg

SEQ ID NO: 53591 - DNA, 103 bp, Artificial Sequence
  Synthetic Polynucleotide
taatacgactcactatagggaacgatgatgatgcggtagatccccatctaaacagaggagatagatgatgatctaccgcaacctggcggcagcgcaaaagatg

SEQ ID NO: 53592 - DNA, 103 bp, Artificial Sequence
  Synthetic Polynucleotide
taatacgactcactatagggattgtaacgatgatgatgcggtagatccccaacagaggagaggggatatgccgcatcataacctggcggcagcgcaaaagatg

SEQ ID NO: 53593 - DNA, 103 bp, Artificial Sequence
  Synthetic Polynucleotide
taatacgactcactatagggtaaagatgtagtgattgagagaatggattaaacagaggagataatccatgctctcaatcaacctggcggcagcgcaaaagatg

SEQ ID NO: 53594 - DNA, 103 bp, Artificial Sequence
  Synthetic Polynucleotide
taatacgactcactatagggtttttattgtaacgatgatgatgcggtagaaacagaggagatctaccatgtcatcatcgaacctggcggcagcgcaaaagatg

SEQ ID NO: 53595 - DNA, 103 bp, Artificial Sequence
  Synthetic Polynucleotide
taatacgactcactatagggggaattttttattgtaacgatgatgatgcgaacagaggagacgcatcatgatcgttacaaacctggcggcagcgcaaaagatg

SEQ ID NO: 53596 - DNA, 103 bp, Artificial Sequence
  Synthetic Polynucleotide
taatacgactcactataggggaatgggaattttttattgtaacgatgatgaacagaggagacatcatatgtacaataaaaacctggcggcagcgcaaaagatg

SEQ ID NO: 53597 - DNA, 103 bp, Artificial Sequence
  Synthetic Polynucleotide
taatacgactcactatagggcattagaatgggaattttttattgtaacgaaacagaggagatcgttaatgtaaaaaattaacctggcggcagcgcaaaagatg

SEQ ID NO: 53598 - DNA, 103 bp, Artificial Sequence
  Synthetic Polynucleotide
taatacgactcactatagggatgaacattagaatgggaattttttattgtaacagaggagaacaataatgaattcccataacctggcggcagcgcaaaagatg

SEQ ID NO: 53599 - DNA, 103 bp, Artificial Sequence
  Synthetic Polynucleotide
taatacgactcactatagggcaattatgaacattagaatgggaattttttaacagaggagaaaaaaaatgccattctaaaacctggcggcagcgcaaaagatg

SEQ ID NO: 53600 - DNA, 103 bp, Artificial Sequence
  Synthetic Polynucleotide
taatacgactcactatagggaaaagcaattatgaacattagaatgggaataacagaggagaattcccatgctaatgttcaacctggcggcagcgcaaaagatg

SEQ ID NO: 53601 - DNA, 103 bp, Artificial Sequence
  Synthetic Polynucleotide
taatacgactcactatagggattagaaaagcaattatgaacattagaatgaacagaggagacattctatggttcataataacctggcggcagcgcaaaagatg

SEQ ID NO: 53602 - DNA, 103 bp, Artificial Sequence
  Synthetic Polynucleotide
taatacgactcactatagggccatgattagaaaagcaattatgaacattaaacagaggagataatgtatgtaattgcttaacctggcggcagcgcaaaagatg

SEQ ID NO: 53603 - DNA, 103 bp, Artificial Sequence
  Synthetic Polynucleotide
taatacgactcactataggggcataccatgattagaaaagcaattatgaaaacagaggagattcataatggcttttctaaacctggcggcagcgcaaaagatg

SEQ ID NO: 53604 - DNA, 103 bp, Artificial Sequence
  Synthetic Polynucleotide
taatacgactcactatagggaaacttaaagatgtagtgattgagagaatgaacagaggagacattctatgaatcactacaacctggcggcagcgcaaaagatg

SEQ ID NO: 53605 - DNA, 103 bp, Artificial Sequence
  Synthetic Polynucleotide
taatacgactcactatagggaacatgcataccatgattagaaaagcaattaacagaggagaaattgcatgtctaatcataacctggcggcagcgcaaaagatg

SEQ ID NO: 53606 - DNA, 103 bp, Artificial Sequence
  Synthetic Polynucleotide
taatacgactcactataggggggcaaacatgcataccatgattagaaaagaacagaggagacttttcatgtcatggtataacctggcggcagcgcaaaagatg

SEQ ID NO: 53607 - DNA, 103 bp, Artificial Sequence
  Synthetic Polynucleotide
taatacgactcactatagggtcaaagggcaaacatgcataccatgattagaacagaggagactaatcatggtatgcatgaacctggcggcagcgcaaaagatg

SEQ ID NO: 53608 - DNA, 103 bp, Artificial Sequence
  Synthetic Polynucleotide
taatacgactcactataggggagattcaaagggcaaacatgcataccatgaacagaggagacatggtatgcatgtttgcaacctggcggcagcgcaaaagatg

SEQ ID NO: 53609 - DNA, 103 bp, Artificial Sequence
  Synthetic Polynucleotide
taatacgactcactatagggccacagagattcaaagggcaaacatgcataaacagaggagatatgcaatgttgccctttaacctggcggcagcgcaaaagatg

SEQ ID NO: 53610 - DNA, 103 bp, Artificial Sequence
  Synthetic Polynucleotide
taatacgactcactatagggaatttccacagagattcaaagggcaaacataacagaggagaatgtttatgctttgaatcaacctggcggcagcgcaaaagatg

SEQ ID NO: 53611 - DNA, 103 bp, Artificial Sequence
  Synthetic Polynucleotide
taatacgactcactataggggatctaatttccacagagattcaaagggcaaacagaggagatgccctatgaatctctgtaacctggcggcagcgcaaaagatg

SEQ ID NO: 53612 - DNA, 103 bp, Artificial Sequence
  Synthetic Polynucleotide
taatacgactcactatagggtatcagatctaatttccacagagattcaaaaacagaggagatttgaaatgctgtggaaaaacctggcggcagcgcaaaagatg

SEQ ID NO: 53613 - DNA, 103 bp, Artificial Sequence
  Synthetic Polynucleotide
taatacgactcactatagggaggtgtatcagatctaatttccacagagataacagaggagaatctctatggaaattagaaacctggcggcagcgcaaaagatg

SEQ ID NO: 53614 - DNA, 103 bp, Artificial Sequence
  Synthetic Polynucleotide
taatacgactcactatagggattacaggtgtatcagatctaatttccacaaacagaggagatgtggaatgtagatctgaaacctggcggcagcgcaaaagatg

SEQ ID NO: 53615 - DNA, 103 bp, Artificial Sequence
  Synthetic Polynucleotide
taatacgactcactatagggacgaaaaacttaaagatgtagtgattgagaaacagaggagatctcaaatgctacatcttaacctggcggcagcgcaaaagatg

SEQ ID NO: 53616 - DNA, 103 bp, Artificial Sequence
  Synthetic Polynucleotide
taatacgactcactatagggtagtgattacaggtgtatcagatctaatttaacagaggagaaaattaatgctgatacacaacctggcggcagcgcaaaagatg

SEQ ID NO: 53617 - DNA, 103 bp, Artificial Sequence
  Synthetic Polynucleotide
taatacgactcactatagggtccgatagtgattacaggtgtatcagatctaacagaggagaagatctatgacacctgtaaacctggcggcagcgcaaaagatg

SEQ ID NO: 53618 - DNA, 103 bp, Artificial Sequence
  Synthetic Polynucleotide
taatacgactcactataggggataatccgatagtgattacaggtgtatcaaacagaggagatgatacatgtgtaatcacaacctggcggcagcgcaaaagatg

SEQ ID NO: 53619 - DNA, 103 bp, Artificial Sequence
  Synthetic Polynucleotide
taatacgactcactatagggcggaggataatccgatagtgattacaggtgaacagaggagacacctgatgtcactatcgaacctggcggcagcgcaaaagatg

SEQ ID NO: 53620 - DNA, 103 bp, Artificial Sequence
  Synthetic Polynucleotide
taatacgactcactatagggtcttacggaggataatccgatagtgattacaacagaggagagtaatcatgatcggattaaacctggcggcagcgcaaaagatg

SEQ ID NO: 53621 - DNA, 103 bp, Artificial Sequence
  Synthetic Polynucleotide
taatacgactcactatagggaatcgtcttacggaggataatccgatagtgaacagaggagacactatatgattatcctcaacctggcggcagcgcaaaagatg

SEQ ID NO: 53622 - DNA, 103 bp, Artificial Sequence
  Synthetic Polynucleotide
taatacgactcactatagggtggttaatcgtcttacggaggataatccgaaacagaggagatcggatatgcctccgtaaaacctggcggcagcgcaaaagatg

SEQ ID NO: 53623 - DNA, 103 bp, Artificial Sequence
  Synthetic Polynucleotide
taatacgactcactataggggttgttggttaatcgtcttacggaggataaaacagaggagattatccatggtaagacgaaacctggcggcagcgcaaaagatg

SEQ ID NO: 53624 - DNA, 103 bp, Artificial Sequence
  Synthetic Polynucleotide
taatacgactcactatagggtatatgttgttggttaatcgtcttacggagaacagaggagactccgtatgacgattaacaacctggcggcagcgcaaaagatg

SEQ ID NO: 53625 - DNA, 103 bp, Artificial Sequence
  Synthetic Polynucleotide
taatacgactcactatagggataattatatgttgttggttaatcgtcttaaacagaggagataagacatgtaaccaacaaacctggcggcagcgcaaaagatg

SEQ ID NO: 53626 - DNA, 103 bp, Artificial Sequence
  Synthetic Polynucleotide
taatacgactcactatagggtaacaacgaaaaacttaaagatgtagtgataacagaggagaatcactatgtctttaagtaacctggcggcagcgcaaaagatg

SEQ ID NO: 53627 - DNA, 103 bp, Artificial Sequence
  Synthetic Polynucleotide
taatacgactcactataggggtcttataattatatgttgttggttaatcgaacagaggagacgattaatgaacaacataaacctggcggcagcgcaaaagatg

SEQ ID NO: 53628 - DNA, 103 bp, Artificial Sequence
  Synthetic Polynucleotide
taatacgactcactataggggtaaagtcttataattatatgttgttggttaacagaggagaaaccaaatgcatataattaacctggcggcagcgcaaaagatg

SEQ ID NO: 53629 - DNA, 103 bp, Artificial Sequence
  Synthetic Polynucleotide
taatacgactcactataggggaagagtaaagtcttataattatatgttgtaacagaggagaacaacaatgaattataagaacctggcggcagcgcaaaagatg

SEQ ID NO: 53630 - DNA, 103 bp, Artificial Sequence
  Synthetic Polynucleotide
taatacgactcactatagggatttagaagagtaaagtcttataattatataacagaggagaatataaatgtaagactttaacctggcggcagcgcaaaagatg

SEQ ID NO: 53631 - DNA, 103 bp, Artificial Sequence
  Synthetic Polynucleotide
taatacgactcactatagggtatgaatttagaagagtaaagtcttataataacagaggagaattataatgctttactctaacctggcggcagcgcaaaagatg

SEQ ID NO: 53632 - DNA, 103 bp, Artificial Sequence
  Synthetic Polynucleotide
taatacgactcactatagggaactttatgaatttagaagagtaaagtcttaacagaggagaaagactatgctcttctaaaacctggcggcagcgcaaaagatg

SEQ ID NO: 53633 - DNA, 103 bp, Artificial Sequence
  Synthetic Polynucleotide
taatacgactcactatagggccagcaactttatgaatttagaagagtaaaaacagaggagatttactatgctaaattcaaacctggcggcagcgcaaaagatg

SEQ ID NO: 53634 - DNA, 103 bp, Artificial Sequence
  Synthetic Polynucleotide
taatacgactcactatagggctaatccagcaactttatgaatttagaagaaacagaggagatcttctatgttcataaagaacctggcggcagcgcaaaagatg

SEQ ID NO: 53635 - DNA, 103 bp, Artificial Sequence
  Synthetic Polynucleotide
taatacgactcactatagggatagtctaatccagcaactttatgaatttaaacagaggagataaattatgaaagttgctaacctggcggcagcgcaaaagatg

SEQ ID NO: 53636 - DNA, 103 bp, Artificial Sequence
  Synthetic Polynucleotide
taatacgactcactatagggcacatatagtctaatccagcaactttatgaaacagaggagatcataaatgtgctggattaacctggcggcagcgcaaaagatg

SEQ ID NO: 53637 - DNA, 103 bp, Artificial Sequence
  Synthetic Polynucleotide
taatacgactcactatagggtatcttaacaacgaaaaacttaaagatgtaaacagaggagatacatcatgaagtttttcaacctggcggcagcgcaaaagatg

SEQ ID NO: 53638 - DNA, 103 bp, Artificial Sequence
  Synthetic Polynucleotide
taatacgactcactatagggggagacacatatagtctaatccagcaacttaacagaggagaaagttgatggattagactaacctggcggcagcgcaaaagatg

SEQ ID NO: 53639 - DNA, 103 bp, Artificial Sequence
  Synthetic Polynucleotide
taatacgactcactatagggtacatggagacacatatagtctaatccagcaacagaggagagctggaatggactatatgaacctggcggcagcgcaaaagatg

SEQ ID NO: 53640 - DNA, 103 bp, Artificial Sequence
  Synthetic Polynucleotide
taatacgactcactataggggtatgtacatggagacacatatagtctaataacagaggagaattagaatgtatgtgtctaacctggcggcagcgcaaaagatg

SEQ ID NO: 53641 - DNA, 103 bp, Artificial Sequence
  Synthetic Polynucleotide
taatacgactcactatagggaacgcgtatgtacatggagacacatatagtaacagaggagaactataatggtctccatgaacctggcggcagcgcaaaagatg

SEQ ID NO: 53642 - DNA, 103 bp, Artificial Sequence
  Synthetic Polynucleotide
taatacgactcactatagggttgagaacgcgtatgtacatggagacacataacagaggagaatgtgtatgcatgtacataacctggcggcagcgcaaaagatg

SEQ ID NO: 53643 - DNA, 103 bp, Artificial Sequence
  Synthetic Polynucleotide
taatacgactcactatagggcgcgcttgagaacgcgtatgtacatggagaaacagaggagatctccaatgacatacgcgaacctggcggcagcgcaaaagatg

SEQ ID NO: 53644 - DNA, 103 bp, Artificial Sequence
  Synthetic Polynucleotide
taatacgactcactatagggcttcccgcgcttgagaacgcgtatgtacataacagaggagaatgtacatgcgcgttctcaacctggcggcagcgcaaaagatg

SEQ ID NO: 53645 - DNA, 103 bp, Artificial Sequence
  Synthetic Polynucleotide
taatacgactcactatagggttaaacttcccgcgcttgagaacgcgtatgaacagaggagacatacgatgtctcaagcgaacctggcggcagcgcaaaagatg

SEQ ID NO: 53646 - DNA, 103 bp, Artificial Sequence
  Synthetic Polynucleotide
taatacgactcactatagggtggcattaaacttcccgcgcttgagaacgcaacagaggagagcgttcatgagcgcgggaaacctggcggcagcgcaaaagatg

SEQ ID NO: 53647 - DNA, 103 bp, Artificial Sequence
  Synthetic Polynucleotide
taatacgactcactatagggctatttggcattaaacttcccgcgcttgagaacagaggagactcaagatggggaagtttaacctggcggcagcgcaaaagatg

SEQ ID NO: 53648 - DNA, 103 bp, Artificial Sequence
  Synthetic Polynucleotide
taatacgactcactatagggccaaatatcttaacaacgaaaaacttaaagaacagaggagactttaaatgtttcgttgtaacctggcggcagcgcaaaagatg

SEQ ID NO: 53649 - DNA, 103 bp, Artificial Sequence
  Synthetic Polynucleotide
taatacgactcactatagggtggcactatttggcattaaacttcccgcgcaacagaggagagcgcggatggtttaatgcaacctggcggcagcgcaaaagatg

SEQ ID NO: 53650 - DNA, 103 bp, Artificial Sequence
  Synthetic Polynucleotide
taatacgactcactatagggtctgatggcactatttggcattaaacttccaacagaggagaggaagtatgatgccaaataacctggcggcagcgcaaaagatg

SEQ ID NO: 53651 - DNA, 103 bp, Artificial Sequence
  Synthetic Polynucleotide
taatacgactcactatagggcctattctgatggcactatttggcattaaaaacagaggagatttaatatgaaatagtgcaacctggcggcagcgcaaaagatg

SEQ ID NO: 53652 - DNA, 103 bp, Artificial Sequence
  Synthetic Polynucleotide
taatacgactcactatagggttcatcctattctgatggcactatttggcaaacagaggagatgccaaatggtgccatcaaacctggcggcagcgcaaaagatg

SEQ ID NO: 53653 - DNA, 103 bp, Artificial Sequence
  Synthetic Polynucleotide
taatacgactcactatagggctacattcatcctattctgatggcactattaacagaggagaaatagtatgatcagaataaacctggcggcagcgcaaaagatg

SEQ ID NO: 53654 - DNA, 103 bp, Artificial Sequence
  Synthetic Polynucleotide
taatacgactcactatagggaattactacattcatcctattctgatggcaaacagaggagatgccatatgaataggatgaacctggcggcagcgcaaaagatg

SEQ ID NO: 53655 - DNA, 103 bp, Artificial Sequence
  Synthetic Polynucleotide
taatacgactcactatagggaaactaattactacattcatcctattctgaaacagaggagatcagaaatggatgaatgtaacctggcggcagcgcaaaagatg

SEQ ID NO: 53656 - DNA, 103 bp, Artificial Sequence
  Synthetic Polynucleotide
taatacgactcactatagggaccagaaactaattactacattcatcctataacagaggagaataggaatgatgtagtaaaacctggcggcagcgcaaaagatg

SEQ ID NO: 53657 - DNA, 103 bp, Artificial Sequence
  Synthetic Polynucleotide
taatacgactcactatagggagaaaaccagaaactaattactacattcataacagaggagaatgaatatggtaattagtaacctggcggcagcgcaaaagatg

SEQ ID NO: 53658 - DNA, 103 bp, Artificial Sequence
  Synthetic Polynucleotide
taatacgactcactatagggtttatagaaaaccagaaactaattactacaaacagaggagatgtagtatgtagtttctgaacctggcggcagcgcaaaagatg

SEQ ID NO: 53659 - DNA, 103 bp, Artificial Sequence
  Synthetic Polynucleotide
taatacgactcactatagggtttagccaaatatcttaacaacgaaaaactaacagaggagaagttttatgttgttaagaaacctggcggcagcgcaaaagatg

SEQ ID NO: 53660 - DNA, 103 bp, Artificial Sequence
  Synthetic Polynucleotide
taatacgactcactatagggttttatttatagaaaaccagaaactaattaaacagaggagataattaatgtctggttttaacctggcggcagcgcaaaagatg

SEQ ID NO: 53661 - DNA, 103 bp, Artificial Sequence
  Synthetic Polynucleotide
taatacgactcactatagggttgtcttttatttatagaaaaccagaaactaacagaggagaagtttcatgttttctataaacctggcggcagcgcaaaagatg

SEQ ID NO: 53662 - DNA, 103 bp, Artificial Sequence
  Synthetic Polynucleotide
taatacgactcactatagggaagatttgtcttttatttatagaaaaccagaacagaggagactggttatgtataaataaaacctggcggcagcgcaaaagatg

SEQ ID NO: 53663 - DNA, 103 bp, Artificial Sequence
  Synthetic Polynucleotide
taatacgactcactatagggctcgcaagatttgtcttttatttatagaaaaacagaggagatttctaatgataaaagacaacctggcggcagcgcaaaagatg

SEQ ID NO: 53664 - DNA, 103 bp, Artificial Sequence
  Synthetic Polynucleotide
taatacgactcactatagggtctagctcgcaagatttgtcttttatttataacagaggagaataaatatgagacaaatcaacctggcggcagcgcaaaagatg

SEQ ID NO: 53665 - DNA, 103 bp, Artificial Sequence
  Synthetic Polynucleotide
taatacgactcactatagggatatgtctagctcgcaagatttgtcttttaaacagaggagataaaagatgaatcttgcgaacctggcggcagcgcaaaagatg

SEQ ID NO: 53666 - DNA, 103 bp, Artificial Sequence
  Synthetic Polynucleotide
taatacgactcactatagggtaccgatatgtctagctcgcaagatttgtcaacagaggagagacaaaatgtgcgagctaaacctggcggcagcgcaaaagatg

SEQ ID NO: 53667 - DNA, 103 bp, Artificial Sequence
  Synthetic Polynucleotide
taatacgactcactatagggcattttaccgatatgtctagctcgcaagataacagaggagaatcttgatggctagacataacctggcggcagcgcaaaagatg

SEQ ID NO: 53668 - DNA, 103 bp, Artificial Sequence
  Synthetic Polynucleotide
taatacgactcactatagggccatgcattttaccgatatgtctagctcgcaacagaggagagcgagcatgacatatcggaacctggcggcagcgcaaaagatg

SEQ ID NO: 53669 - DNA, 103 bp, Artificial Sequence
  Synthetic Polynucleotide
taatacgactcactatagggccaatccatgcattttaccgatatgtctagaacagaggagactagacatgtcggtaaaaaacctggcggcagcgcaaaagatg

SEQ ID NO: 53670 - DNA, 103 bp, Artificial Sequence
  Synthetic Polynucleotide
taatacgactcactatagggtataatttagccaaatatcttaacaacgaaaacagaggagattcgttatgaagatatttaacctggcggcagcgcaaaagatg

SEQ ID NO: 53671 - DNA, 103 bp, Artificial Sequence
  Synthetic Polynucleotide
taatacgactcactatagggcgattccaatccatgcattttaccgatatgaacagaggagacatatcatgaaaatgcataacctggcggcagcgcaaaagatg

SEQ ID NO: 53672 - DNA, 103 bp, Artificial Sequence
  Synthetic Polynucleotide
taatacgactcactatagggctacacgattccaatccatgcattttaccgaacagaggagacggtaaatggcatggattaacctggcggcagcgcaaaagatg

SEQ ID NO: 53673 - DNA, 103 bp, Artificial Sequence
  Synthetic Polynucleotide
taatacgactcactataggggtcgactacacgattccaatccatgcatttaacagaggagaaaatgcatggattggaataacctggcggcagcgcaaaagatg

SEQ ID NO: 53674 - DNA, 103 bp, Artificial Sequence
  Synthetic Polynucleotide
taatacgactcactatagggcttctgtcgactacacgattccaatccatgaacagaggagacatggaatggaatcgtgtaacctggcggcagcgcaaaagatg

SEQ ID NO: 53675 - DNA, 103 bp, Artificial Sequence
  Synthetic Polynucleotide
taatacgactcactatagggatattcttctgtcgactacacgattccaataacagaggagaattggaatggtgtagtcgaacctggcggcagcgcaaaagatg

SEQ ID NO: 53676 - DNA, 103 bp, Artificial Sequence
  Synthetic Polynucleotide
taatacgactcactatagggtcatcatattcttctgtcgactacacgattaacagaggagaaatcgtatggtcgacagaaacctggcggcagcgcaaaagatg

SEQ ID NO: 53677 - DNA, 103 bp, Artificial Sequence
  Synthetic Polynucleotide
taatacgactcactatagggtctaatcatcatattcttctgtcgactacaaacagaggagatgtagtatgcagaagaataacctggcggcagcgcaaaagatg

SEQ ID NO: 53678 - DNA, 103 bp, Artificial Sequence
  Synthetic Polynucleotide
taatacgactcactatagggctccgtctaatcatcatattcttctgtcgaaacagaggagatcgacaatggaatatgataacctggcggcagcgcaaaagatg

SEQ ID NO: 53679 - DNA, 103 bp, Artificial Sequence
  Synthetic Polynucleotide
taatacgactcactatagggatactctccgtctaatcatcatattcttctaacagaggagaagaagaatgtgatgattaaacctggcggcagcgcaaaagatg

SEQ ID NO: 53680 - DNA, 103 bp, Artificial Sequence
  Synthetic Polynucleotide
taatacgactcactatagggaaaatatactctccgtctaatcatcatattaacagaggagaaatatgatgattagacggaacctggcggcagcgcaaaagatg

SEQ ID NO: 53681 - DNA, 103 bp, Artificial Sequence
  Synthetic Polynucleotide
taatacgactcactatagggaaactattatatacagtacatttaacagtaaacagaggagatactgtatgatgtactgtaacctggcggcagcgcaaaagatg

SEQ ID NO: 53682 - DNA, 103 bp, Artificial Sequence
  Synthetic Polynucleotide
taatacgactcactatagggaattatataatttagccaaatatcttaacaaacagaggagatgttaaatgatttggctaaacctggcggcagcgcaaaagatg

SEQ ID NO: 53683 - DNA, 103 bp, Artificial Sequence
  Synthetic Polynucleotide
taatacgactcactatagggtagataaaatatactctccgtctaatcatcaacagaggagagatgatatgacggagagtaacctggcggcagcgcaaaagatg

SEQ ID NO: 53684 - DNA, 103 bp, Artificial Sequence
  Synthetic Polynucleotide
taatacgactcactatagggagagttagataaaatatactctccgtctaaaacagaggagattagacatggagtatattaacctggcggcagcgcaaaagatg

SEQ ID NO: 53685 - DNA, 103 bp, Artificial Sequence
  Synthetic Polynucleotide
taatacgactcactatagggctcaaagagttagataaaatatactctccgaacagaggagacggagaatgtattttatcaacctggcggcagcgcaaaagatg

SEQ ID NO: 53686 - DNA, 103 bp, Artificial Sequence
  Synthetic Polynucleotide
taatacgactcactatagggaccaactcaaagagttagataaaatatactaacagaggagaagtataatgtatctaactaacctggcggcagcgcaaaagatg

SEQ ID NO: 53687 - DNA, 103 bp, Artificial Sequence
  Synthetic Polynucleotide
taatacgactcactatagggtggtgaccaactcaaagagttagataaaataacagaggagaattttaatgaactctttgaacctggcggcagcgcaaaagatg

SEQ ID NO: 53688 - DNA, 103 bp, Artificial Sequence
  Synthetic Polynucleotide
taatacgactcactatagggagaattggtgaccaactcaaagagttagataacagaggagaatctaaatgtttgagttgaacctggcggcagcgcaaaagatg

SEQ ID NO: 53689 - DNA, 103 bp, Artificial Sequence
  Synthetic Polynucleotide
taatacgactcactataggggtcctagaattggtgaccaactcaaagagtaacagaggagaactcttatggttggtcacaacctggcggcagcgcaaaagatg

SEQ ID NO: 53690 - DNA, 103 bp, Artificial Sequence
  Synthetic Polynucleotide
taatacgactcactatagggagctagtcctagaattggtgaccaactcaaaacagaggagattgagtatgtcaccaattaacctggcggcagcgcaaaagatg

SEQ ID NO: 53691 - DNA, 103 bp, Artificial Sequence
  Synthetic Polynucleotide
taatacgactcactatagggtctcgagctagtcctagaattggtgaccaaaacagaggagattggtcatgaattctaggaacctggcggcagcgcaaaagatg

SEQ ID NO: 53692 - DNA, 103 bp, Artificial Sequence
  Synthetic Polynucleotide
taatacgactcactatagggttcattctcgagctagtcctagaattggtgaacagaggagacaccaaatgtaggactagaacctggcggcagcgcaaaagatg

SEQ ID NO: 53693 - DNA, 103 bp, Artificial Sequence
  Synthetic Polynucleotide
taatacgactcactatagggaatagaattatataatttagccaaatatctaacagaggagaagatatatggctaaattaaacctggcggcagcgcaaaagatg

SEQ ID NO: 53694 - DNA, 103 bp, Artificial Sequence
  Synthetic Polynucleotide
taatacgactcactatagggacttattcattctcgagctagtcctagaataacagaggagaattctaatgctagctcgaaacctggcggcagcgcaaaagatg

SEQ ID NO: 53695 - DNA, 103 bp, Artificial Sequence
  Synthetic Polynucleotide
taatacgactcactatagggttagtacttattcattctcgagctagtcctaacagaggagaaggactatgtcgagaatgaacctggcggcagcgcaaaagatg

SEQ ID NO: 53696 - DNA, 103 bp, Artificial Sequence
  Synthetic Polynucleotide
taatacgactcactatagggatcctttagtacttattcattctcgagctaaacagaggagatagctcatgaatgaataaaacctggcggcagcgcaaaagatg

SEQ ID NO: 53697 - DNA, 103 bp, Artificial Sequence
  Synthetic Polynucleotide
taatacgactcactatagggtactcatcctttagtacttattcattctcgaacagaggagacgagaaatgataagtactaacctggcggcagcgcaaaagatg

SEQ ID NO: 53698 - DNA, 103 bp, Artificial Sequence
  Synthetic Polynucleotide
taatacgactcactatagggaaatgtactcatcctttagtacttattcataacagaggagaatgaatatgtactaaaggaacctggcggcagcgcaaaagatg

SEQ ID NO: 53699 - DNA, 103 bp, Artificial Sequence
  Synthetic Polynucleotide
taatacgactcactatagggctgtgaaatgtactcatcctttagtacttaaacagaggagataagtaatgaaggatgagaacctggcggcagcgcaaaagatg

SEQ ID NO: 53700 - DNA, 103 bp, Artificial Sequence
  Synthetic Polynucleotide
taatacgactcactatagggtgtttctgtgaaatgtactcatcctttagtaacagaggagaactaaaatgtgagtacataacctggcggcagcgcaaaagatg

SEQ ID NO: 53701 - DNA, 103 bp, Artificial Sequence
  Synthetic Polynucleotide
taatacgactcactataggggccagtgtttctgtgaaatgtactcatcctaacagaggagaaggatgatgacatttcacaacctggcggcagcgcaaaagatg

SEQ ID NO: 53702 - DNA, 103 bp, Artificial Sequence
  Synthetic Polynucleotide
taatacgactcactatagggacaacgccagtgtttctgtgaaatgtactcaacagaggagagagtacatgtcacagaaaaacctggcggcagcgcaaaagatg

SEQ ID NO: 53703 - DNA, 103 bp, Artificial Sequence
  Synthetic Polynucleotide
taatacgactcactatagggattgaacaacgccagtgtttctgtgaaatgaacagaggagacatttcatggaaacactgaacctggcggcagcgcaaaagatg

SEQ ID NO: 53704 - DNA, 103 bp, Artificial Sequence
  Synthetic Polynucleotide
taatacgactcactataggggatctaatagaattatataatttagccaaaaacagaggagatttggcatgattatataaaacctggcggcagcgcaaaagatg

SEQ ID NO: 53705 - DNA, 103 bp, Artificial Sequence
  Synthetic Polynucleotide
taatacgactcactatagggagcacattgaacaacgccagtgtttctgtgaacagaggagacacagaatgactggcgttaacctggcggcagcgcaaaagatg

SEQ ID NO: 53706 - DNA, 103 bp, Artificial Sequence
  Synthetic Polynucleotide
taatacgactcactatagggtaaagagcacattgaacaacgccagtgtttaacagaggagaaaacacatgcgttgttcaaacctggcggcagcgcaaaagatg

SEQ ID NO: 53707 - DNA, 103 bp, Artificial Sequence
  Synthetic Polynucleotide
taatacgactcactatagggccatgtaaagagcacattgaacaacgccagaacagaggagactggcgatgttcaatgtgaacctggcggcagcgcaaaagatg

SEQ ID NO: 53708 - DNA, 103 bp, Artificial Sequence
  Synthetic Polynucleotide
taatacgactcactatagggcttacccatgtaaagagcacattgaacaacaacagaggagagttgttatgtgtgctcttaacctggcggcagcgcaaaagatg

SEQ ID NO: 53709 - DNA, 103 bp, Artificial Sequence
  Synthetic Polynucleotide
taatacgactcactatagggaactccttacccatgtaaagagcacattgaaacagaggagatcaatgatgtctttacataacctggcggcagcgcaaaagatg

SEQ ID NO: 53710 - DNA, 103 bp, Artificial Sequence
  Synthetic Polynucleotide
taatacgactcactatagggatttcaactccttacccatgtaaagagcacaacagaggagagtgctcatgacatgggtaaacctggcggcagcgcaaaagatg

SEQ ID NO: 53711 - DNA, 103 bp, Artificial Sequence
  Synthetic Polynucleotide
taatacgactcactataggggagctatttcaactccttacccatgtaaagaacagaggagactttacatgggtaaggagaacctggcggcagcgcaaaagatg

SEQ ID NO: 53712 - DNA, 103 bp, Artificial Sequence
  Synthetic Polynucleotide
taatacgactcactataggggaaacgagctatttcaactccttacccatgaacagaggagacatgggatgggagttgaaaacctggcggcagcgcaaaagatg

SEQ ID NO: 53713 - DNA, 103 bp, Artificial Sequence
  Synthetic Polynucleotide
taatacgactcactatagggaaatagaaacgagctatttcaactccttacaacagaggagagtaaggatgtgaaatagcaacctggcggcagcgcaaaagatg

SEQ ID NO: 53714 - DNA, 103 bp, Artificial Sequence
  Synthetic Polynucleotide
taatacgactcactatagggagaacaaatagaaacgagctatttcaactcaacagaggagagagttgatgtagctcgttaacctggcggcagcgcaaaagatg

SEQ ID NO: 53715 - DNA, 103 bp, Artificial Sequence
  Synthetic Polynucleotide
taatacgactcactatagggttaatgatctaatagaattatataatttagaacagaggagactaaatatgataattctaaacctggcggcagcgcaaaagatg

SEQ ID NO: 53716 - DNA, 103 bp, Artificial Sequence
  Synthetic Polynucleotide
taatacgactcactatagggttgtcagaacaaatagaaacgagctatttcaacagaggagagaaataatgcgtttctataacctggcggcagcgcaaaagatg

SEQ ID NO: 53717 - DNA, 103 bp, Artificial Sequence
  Synthetic Polynucleotide
taatacgactcactatagggaaatattgtcagaacaaatagaaacgagctaacagaggagaagctcgatgctatttgttaacctggcggcagcgcaaaagatg

SEQ ID NO: 53718 - DNA, 103 bp, Artificial Sequence
  Synthetic Polynucleotide
taatacgactcactatagggaaactaaatattgtcagaacaaatagaaacaacagaggagagtttctatgtgttctgacaacctggcggcagcgcaaaagatg

SEQ ID NO: 53719 - DNA, 103 bp, Artificial Sequence
  Synthetic Polynucleotide
taatacgactcactatagggtgaataaactaaatattgtcagaacaaataaacagaggagatatttgatgtgacaatataacctggcggcagcgcaaaagatg

SEQ ID NO: 53720 - DNA, 103 bp, Artificial Sequence
  Synthetic Polynucleotide
taatacgactcactatagggcattatgaataaactaaatattgtcagaacaacagaggagagttctgatgatatttagtaacctggcggcagcgcaaaagatg

SEQ ID NO: 53721 - DNA, 103 bp, Artificial Sequence
  Synthetic Polynucleotide
taatacgactcactatagggcttaacattatgaataaactaaatattgtcaacagaggagagacaatatgtagtttattaacctggcggcagcgcaaaagatg

SEQ ID NO: 53722 - DNA, 103 bp, Artificial Sequence
  Synthetic Polynucleotide
taatacgactcactatagggatatgcttaacattatgaataaactaaataaacagaggagatatttaatgtattcataaaacctggcggcagcgcaaaagatg

SEQ ID NO: 53723 - DNA, 103 bp, Artificial Sequence
  Synthetic Polynucleotide
taatacgactcactatagggtcaggatatgcttaacattatgaataaactaacagaggagaagtttaatgataatgttaaacctggcggcagcgcaaaagatg

SEQ ID NO: 53724 - DNA, 103 bp, Artificial Sequence
  Synthetic Polynucleotide
taatacgactcactatagggactattcaggatatgcttaacattatgaataacagaggagaattcatatggttaagcataacctggcggcagcgcaaaagatg

SEQ ID NO: 53725 - DNA, 103 bp, Artificial Sequence
  Synthetic Polynucleotide
taatacgactcactatagggattttactattcaggatatgcttaacattaaacagaggagataatgtatggcatatcctaacctggcggcagcgcaaaagatg

SEQ ID NO: 53726 - DNA, 103 bp, Artificial Sequence
  Synthetic Polynucleotide
taatacgactcactatagggttctgttaatgatctaatagaattatataaaacagaggagattatatatgtctattagaaacctggcggcagcgcaaaagatg

SEQ ID NO: 53727 - DNA, 103 bp, Artificial Sequence
  Synthetic Polynucleotide
taatacgactcactatagggatctaattttactattcaggatatgcttaaaacagaggagattaagcatgtcctgaataaacctggcggcagcgcaaaagatg

SEQ ID NO: 53728 - DNA, 103 bp, Artificial Sequence
  Synthetic Polynucleotide
taatacgactcactataggggacacatctaattttactattcaggatatgaacagaggagacatatcatgaatagtaaaaacctggcggcagcgcaaaagatg

SEQ ID NO: 53729 - DNA, 103 bp, Artificial Sequence
  Synthetic Polynucleotide
taatacgactcactatagggagtatgacacatctaattttactattcaggaacagaggagacctgaaatgtaaaattagaacctggcggcagcgcaaaagatg

SEQ ID NO: 53730 - DNA, 103 bp, Artificial Sequence
  Synthetic Polynucleotide
taatacgactcactatagggtaacaagtatgacacatctaattttactataacagaggagaatagtaatgttagatgtgaacctggcggcagcgcaaaagatg

SEQ ID NO: 53731 - DNA, 103 bp, Artificial Sequence
  Synthetic Polynucleotide
taatacgactcactatagggactactaacaagtatgacacatctaattttaacagaggagaaaaattatgtgtgtcataaacctggcggcagcgcaaaagatg

SEQ ID NO: 53732 - DNA, 103 bp, Artificial Sequence
  Synthetic Polynucleotide
taatacgactcactatagggatctaactactaacaagtatgacacatctaaacagaggagatagatgatgcatacttgtaacctggcggcagcgcaaaagatg

SEQ ID NO: 53733 - DNA, 103 bp, Artificial Sequence
  Synthetic Polynucleotide
taatacgactcactatagggtaaatatctaactactaacaagtatgacacaacagaggagagtgtcaatgttgttagtaaacctggcggcagcgcaaaagatg

SEQ ID NO: 53734 - DNA, 103 bp, Artificial Sequence
  Synthetic Polynucleotide
taatacgactcactatagggattgctaaatatctaactactaacaagtataacagaggagaatacttatgagtagttagaacctggcggcagcgcaaaagatg

SEQ ID NO: 53735 - DNA, 103 bp, Artificial Sequence
  Synthetic Polynucleotide
taatacgactcactatagggatgcaattgctaaatatctaactactaacaaacagaggagatgttagatgttagatattaacctggcggcagcgcaaaagatg

SEQ ID NO: 53736 - DNA, 103 bp, Artificial Sequence
  Synthetic Polynucleotide
taatacgactcactatagggtgggaatgcaattgctaaatatctaactacaacagaggagagtagttatgtatttagcaaacctggcggcagcgcaaaagatg

SEQ ID NO: 53737 - DNA, 103 bp, Artificial Sequence
  Synthetic Polynucleotide
taatacgactcactatagggactgattctgttaatgatctaatagaattaaacagaggagataattcatgtagatcattaacctggcggcagcgcaaaagatg

SEQ ID NO: 53738 - DNA, 103 bp, Artificial Sequence
  Synthetic Polynucleotide
taatacgactcactatagggaatgatgggaatgcaattgctaaatatctaaacagaggagatagataatgagcaattgcaacctggcggcagcgcaaaagatg

SEQ ID NO: 53739 - DNA, 103 bp, Artificial Sequence
  Synthetic Polynucleotide
taatacgactcactatagggtgagaaatgatgggaatgcaattgctaaataacagaggagaatttagatgttgcattccaacctggcggcagcgcaaaagatg

SEQ ID NO: 53740 - DNA, 103 bp, Artificial Sequence
  Synthetic Polynucleotide
taatacgactcactataggggagattgagaaatgatgggaatgcaattgcaacagaggagagcaattatgttcccatcaaacctggcggcagcgcaaaagatg

SEQ ID NO: 53741 - DNA, 103 bp, Artificial Sequence
  Synthetic Polynucleotide
taatacgactcactatagggagtacgagattgagaaatgatgggaatgcaaacagaggagatgcattatgatcatttctaacctggcggcagcgcaaaagatg

SEQ ID NO: 53742 - DNA, 103 bp, Artificial Sequence
  Synthetic Polynucleotide
taatacgactcactatagggattggagtacgagattgagaaatgatgggaaacagaggagatcccatatgttctcaatcaacctggcggcagcgcaaaagatg

SEQ ID NO: 53743 - DNA, 103 bp, Artificial Sequence
  Synthetic Polynucleotide
taatacgactcactatagggacatgattggagtacgagattgagaaatgaaacagaggagatcatttatgaatctcgtaaacctggcggcagcgcaaaagatg

SEQ ID NO: 53744 - DNA, 103 bp, Artificial Sequence
  Synthetic Polynucleotide
taatacgactcactatagggtccacacatgattggagtacgagattgagaaacagaggagatctcaaatgcgtactccaaacctggcggcagcgcaaaagatg

SEQ ID NO: 53745 - DNA, 103 bp, Artificial Sequence
  Synthetic Polynucleotide
taatacgactcactatagggtagcatccacacatgattggagtacgagataacagaggagaatctcgatgtccaatcataacctggcggcagcgcaaaagatg

SEQ ID NO: 53746 - DNA, 103 bp, Artificial Sequence
  Synthetic Polynucleotide
taatacgactcactatagggtgaagtagcatccacacatgattggagtacaacagaggagagtactcatgtcatgtgtgaacctggcggcagcgcaaaagatg

SEQ ID NO: 53747 - DNA, 103 bp, Artificial Sequence
  Synthetic Polynucleotide
taatacgactcactatagggatagatgaagtagcatccacacatgattggaacagaggagaccaatcatgtgtggatgcaacctggcggcagcgcaaaagatg

SEQ ID NO: 53748 - DNA, 103 bp, Artificial Sequence
  Synthetic Polynucleotide
taatacgactcactatagggtatatactgattctgttaatgatctaatagaacagaggagactattaatgcattaacagaacctggcggcagcgcaaaagatg

SEQ ID NO: 53749 - DNA, 103 bp, Artificial Sequence
  Synthetic Polynucleotide
taatacgactcactatagggtttctatagatgaagtagcatccacacatgaacagaggagacatgtgatgatgctacttaacctggcggcagcgcaaaagatg

SEQ ID NO: 53750 - DNA, 103 bp, Artificial Sequence
  Synthetic Polynucleotide
taatacgactcactatagggtatggtttctatagatgaagtagcatccacaacagaggagagtggatatgacttcatctaacctggcggcagcgcaaaagatg

SEQ ID NO: 53751 - DNA, 103 bp, Artificial Sequence
  Synthetic Polynucleotide
taatacgactcactataggggattgtatggtttctatagatgaagtagcaaacagaggagatgctacatgatctatagaaacctggcggcagcgcaaaagatg

SEQ ID NO: 53752 - DNA, 103 bp, Artificial Sequence
  Synthetic Polynucleotide
taatacgactcactatagggaaaaggattgtatggtttctatagatgaagaacagaggagacttcatatgtagaaaccaaacctggcggcagcgcaaaagatg

SEQ ID NO: 53753 - DNA, 103 bp, Artificial Sequence
  Synthetic Polynucleotide
taatacgactcactatagggtaccaaaaaggattgtatggtttctatagaaacagaggagatctataatgaccatacaaaacctggcggcagcgcaaaagatg

SEQ ID NO: 53754 - DNA, 103 bp, Artificial Sequence
  Synthetic Polynucleotide
taatacgactcactatagggcagactaccaaaaaggattgtatggtttctaacagaggagaagaaacatgacaatccttaacctggcggcagcgcaaaagatg

SEQ ID NO: 53755 - DNA, 103 bp, Artificial Sequence
  Synthetic Polynucleotide
taatacgactcactatagggctcaacagactaccaaaaaggattgtatggaacagaggagaccatacatgcctttttggaacctggcggcagcgcaaaagatg

SEQ ID NO: 53756 - DNA, 103 bp, Artificial Sequence
  Synthetic Polynucleotide
taatacgactcactatagggtcaagctcaacagactaccaaaaaggattgaacagaggagacaatccatgttggtagtcaacctggcggcagcgcaaaagatg

SEQ ID NO: 53757 - DNA, 103 bp, Artificial Sequence
  Synthetic Polynucleotide
taatacgactcactatagggaatgatcaagctcaacagactaccaaaaagaacagaggagactttttatgagtctgttgaacctggcggcagcgcaaaagatg

SEQ ID NO: 53758 - DNA, 103 bp, Artificial Sequence
  Synthetic Polynucleotide
taatacgactcactatagggcaggaaatgatcaagctcaacagactaccaaacagaggagatggtagatggttgagcttaacctggcggcagcgcaaaagatg

SEQ ID NO: 53759 - DNA, 103 bp, Artificial Sequence
  Synthetic Polynucleotide
taatacgactcactatagggaaaaatatatactgattctgttaatgatctaacagaggagaagatcaatgacagaatcaaacctggcggcagcgcaaaagatg

SEQ ID NO: 53760 - DNA, 103 bp, Artificial Sequence
  Synthetic Polynucleotide
taatacgactcactatagggacgtgcaggaaatgatcaagctcaacagacaacagaggagagtctgtatggcttgatcaaacctggcggcagcgcaaaagatg

SEQ ID NO: 53761 - DNA, 103 bp, Artificial Sequence
  Synthetic Polynucleotide
taatacgactcactatagggcctaaacgtgcaggaaatgatcaagctcaaaacagaggagattgagcatgatcatttccaacctggcggcagcgcaaaagatg

SEQ ID NO: 53762 - DNA, 103 bp, Artificial Sequence
  Synthetic Polynucleotide
taatacgactcactatagggccaaacctaaacgtgcaggaaatgatcaagaacagaggagacttgatatgttcctgcacaacctggcggcagcgcaaaagatg

SEQ ID NO: 53763 - DNA, 103 bp, Artificial Sequence
  Synthetic Polynucleotide
taatacgactcactatagggacgtaccaaacctaaacgtgcaggaaatgaaacagaggagatcatttatggcacgtttaaacctggcggcagcgcaaaagatg

SEQ ID NO: 53764 - DNA, 103 bp, Artificial Sequence
  Synthetic Polynucleotide
taatacgactcactatagggaatcaacgtaccaaacctaaacgtgcaggaaacagaggagatcctgcatgtttaggtttaacctggcggcagcgcaaaagatg

SEQ ID NO: 53765 - DNA, 103 bp, Artificial Sequence
  Synthetic Polynucleotide
taatacgactcactatagggctagaaatcaacgtaccaaacctaaacgtgaacagaggagacacgttatggtttggtacaacctggcggcagcgcaaaagatg

SEQ ID NO: 53766 - DNA, 103 bp, Artificial Sequence
  Synthetic Polynucleotide
taatacgactcactatagggaggggctagaaatcaacgtaccaaacctaaaacagaggagattaggtatggtacgttgaaacctggcggcagcgcaaaagatg

SEQ ID NO: 53767 - DNA, 103 bp, Artificial Sequence
  Synthetic Polynucleotide
taatacgactcactatagggtccgcaggggctagaaatcaacgtaccaaaaacagaggagatttggtatgttgatttctaacctggcggcagcgcaaaagatg

SEQ ID NO: 53768 - DNA, 103 bp, Artificial Sequence
  Synthetic Polynucleotide
taatacgactcactatagggttatatccgcaggggctagaaatcaacgtaaacagaggagatacgttatgttctagcccaacctggcggcagcgcaaaagatg

SEQ ID NO: 53769 - DNA, 103 bp, Artificial Sequence
  Synthetic Polynucleotide
taatacgactcactatagggtgactttatatccgcaggggctagaaatcaaacagaggagatgatttatggcccctgcgaacctggcggcagcgcaaaagatg

SEQ ID NO: 53770 - DNA, 103 bp, Artificial Sequence
  Synthetic Polynucleotide
taatacgactcactatagggtctagaaaaatatatactgattctgttaataacagaggagaattaacatgatcagtataaacctggcggcagcgcaaaagatg

SEQ ID NO: 53771 - DNA, 103 bp, Artificial Sequence
  Synthetic Polynucleotide
taatacgactcactataggggacgatgactttatatccgcaggggctagaaacagaggagatctagcatgtgcggatataacctggcggcagcgcaaaagatg

SEQ ID NO: 53772 - DNA, 103 bp, Artificial Sequence
  Synthetic Polynucleotide
taatacgactcactatagggttgtagacgatgactttatatccgcaggggaacagaggagacccctgatgatataaagtaacctggcggcagcgcaaaagatg

SEQ ID NO: 53773 - DNA, 103 bp, Artificial Sequence
  Synthetic Polynucleotide
taatacgactcactatagggccaaattgtagacgatgactttatatccgcaacagaggagagcggatatgaagtcatcgaacctggcggcagcgcaaaagatg

SEQ ID NO: 53774 - DNA, 103 bp, Artificial Sequence
  Synthetic Polynucleotide
taatacgactcactatagggttgtcccaaattgtagacgatgactttataaacagaggagatataaaatgatcgtctacaacctggcggcagcgcaaaagatg

SEQ ID NO: 53775 - DNA, 103 bp, Artificial Sequence
  Synthetic Polynucleotide
taatacgactcactatagggattcattgtcccaaattgtagacgatgactaacagaggagaagtcatatgctacaatttaacctggcggcagcgcaaaagatg

SEQ ID NO: 53776 - DNA, 103 bp, Artificial Sequence
  Synthetic Polynucleotide
taatacgactcactatagggatgcaattcattgtcccaaattgtagacgaaacagaggagatcgtctatgatttgggacaacctggcggcagcgcaaaagatg

SEQ ID NO: 53777 - DNA, 103 bp, Artificial Sequence
  Synthetic Polynucleotide
taatacgactcactatagggagtgtatgcaattcattgtcccaaattgtaaacagaggagatacaatatgggacaatgaaacctggcggcagcgcaaaagatg

SEQ ID NO: 53778 - DNA, 103 bp, Artificial Sequence
  Synthetic Polynucleotide
taatacgactcactatagggcatgtagtgtatgcaattcattgtcccaaaaacagaggagatttgggatgatgaattgcaacctggcggcagcgcaaaagatg

SEQ ID NO: 53779 - DNA, 103 bp, Artificial Sequence
  Synthetic Polynucleotide
taatacgactcactatagggtttgtcatgtagtgtatgcaattcattgtcaacagaggagagacaatatgttgcatacaaacctggcggcagcgcaaaagatg

SEQ ID NO: 53780 - DNA, 103 bp, Artificial Sequence
  Synthetic Polynucleotide
taatacgactcactatagggaaatctttgtcatgtagtgtatgcaattcaaacagaggagatgaattatgtacactacaaacctggcggcagcgcaaaagatg

SEQ ID NO: 53781 - DNA, 103 bp, Artificial Sequence
  Synthetic Polynucleotide
taatacgactcactatagggttggatctagaaaaatatatactgattctgaacagaggagacagaatatgtatatatttaacctggcggcagcgcaaaagatg

SEQ ID NO: 53782 - DNA, 103 bp, Artificial Sequence
  Synthetic Polynucleotide
taatacgactcactatagggctgataaatctttgtcatgtagtgtatgcaaacagaggagatgcataatgtacatgacaaacctggcggcagcgcaaaagatg

SEQ ID NO: 53783 - DNA, 103 bp, Artificial Sequence
  Synthetic Polynucleotide
taatacgactcactatagggcacttctgataaatctttgtcatgtagtgtaacagaggagaacactaatggacaaagataacctggcggcagcgcaaaagatg

SEQ ID NO: 53784 - DNA, 103 bp, Artificial Sequence
  Synthetic Polynucleotide
taatacgactcactatagggattcacacttctgataaatctttgtcatgtaacagaggagaacatgaatgagatttatcaacctggcggcagcgcaaaagatg

SEQ ID NO: 53785 - DNA, 103 bp, Artificial Sequence
  Synthetic Polynucleotide
taatacgactcactatagggatcatattcacacttctgataaatctttgtaacagaggagaacaaagatgtatcagaagaacctggcggcagcgcaaaagatg

SEQ ID NO: 53786 - DNA, 103 bp, Artificial Sequence
  Synthetic Polynucleotide
taatacgactcactatagggtgaagatcatattcacacttctgataaatcaacagaggagagatttaatggaagtgtgaaacctggcggcagcgcaaaagatg

SEQ ID NO: 53787 - DNA, 103 bp, Artificial Sequence
  Synthetic Polynucleotide
taatacgactcactataggggtagatgaagatcatattcacacttctgataacagaggagaatcagaatggtgaatatgaacctggcggcagcgcaaaagatg

SEQ ID NO: 53788 - DNA, 103 bp, Artificial Sequence
  Synthetic Polynucleotide
taatacgactcactatagggctttggtagatgaagatcatattcacacttaacagaggagaaagtgtatgtatgatcttaacctggcggcagcgcaaaagatg

SEQ ID NO: 53789 - DNA, 103 bp, Artificial Sequence
  Synthetic Polynucleotide
taatacgactcactatagggtctttctttggtagatgaagatcatattcaaacagaggagatgaataatgtcttcatctaacctggcggcagcgcaaaagatg

SEQ ID NO: 53790 - DNA, 103 bp, Artificial Sequence
  Synthetic Polynucleotide
taatacgactcactatagggcaaactctttctttggtagatgaagatcataacagaggagaatgatcatgatctaccaaaacctggcggcagcgcaaaagatg

SEQ ID NO: 53791 - DNA, 103 bp, Artificial Sequence
  Synthetic Polynucleotide
taatacgactcactatagggctaatcaaactctttctttggtagatgaagaacagaggagacttcatatgccaaagaaaaacctggcggcagcgcaaaagatg

SEQ ID NO: 53792 - DNA, 103 bp, Artificial Sequence
  Synthetic Polynucleotide
taatacgactcactataggggttagaaactattatatacagtacatttaaaacagaggagattaaatatgctgtatataaacctggcggcagcgcaaaagatg

SEQ ID NO: 53793 - DNA, 103 bp, Artificial Sequence
  Synthetic Polynucleotide
taatacgactcactatagggcgtctttggatctagaaaaatatatactgaaacagaggagatcagtaatgatttttctaaacctggcggcagcgcaaaagatg

SEQ ID NO: 53794 - DNA, 103 bp, Artificial Sequence
  Synthetic Polynucleotide
taatacgactcactatagggttatactaatcaaactctttctttggtagaaacagaggagatctaccatggaaagagttaacctggcggcagcgcaaaagatg

SEQ ID NO: 53795 - DNA, 103 bp, Artificial Sequence
  Synthetic Polynucleotide
taatacgactcactatagggtctagttatactaatcaaactctttctttgaacagaggagacaaagaatgagtttgattaacctggcggcagcgcaaaagatg

SEQ ID NO: 53796 - DNA, 103 bp, Artificial Sequence
  Synthetic Polynucleotide
taatacgactcactatagggtaaaatctagttatactaatcaaactctttaacagaggagaaaagagatggattagtataacctggcggcagcgcaaaagatg

SEQ ID NO: 53797 - DNA, 103 bp, Artificial Sequence
  Synthetic Polynucleotide
taatacgactcactatagggaggactaaaatctagttatactaatcaaacaacagaggagagtttgaatggtataactaaacctggcggcagcgcaaaagatg

SEQ ID NO: 53798 - DNA, 103 bp, Artificial Sequence
  Synthetic Polynucleotide
taatacgactcactatagggaacacaggactaaaatctagttatactaataacagaggagaattagtatgactagatttaacctggcggcagcgcaaaagatg

SEQ ID NO: 53799 - DNA, 103 bp, Artificial Sequence
  Synthetic Polynucleotide
taatacgactcactatagggcatctaacacaggactaaaatctagttataaacagaggagatataacatgattttagtcaacctggcggcagcgcaaaagatg

SEQ ID NO: 53800 - DNA, 103 bp, Artificial Sequence
  Synthetic Polynucleotide
taatacgactcactatagggtttaacatctaacacaggactaaaatctagaacagaggagactagatatgagtcctgtgaacctggcggcagcgcaaaagatg

SEQ ID NO: 53801 - DNA, 103 bp, Artificial Sequence
  Synthetic Polynucleotide
taatacgactcactataggggtttttttaacatctaacacaggactaaaaaacagaggagattttagatgtgtgttagaaacctggcggcagcgcaaaagatg

SEQ ID NO: 53802 - DNA, 103 bp, Artificial Sequence
  Synthetic Polynucleotide
taatacgactcactataggggcgatgtttttttaacatctaacacaggacaacagaggagagtcctgatgtagatgttaaacctggcggcagcgcaaaagatg

SEQ ID NO: 53803 - DNA, 103 bp, Artificial Sequence
  Synthetic Polynucleotide
taatacgactcactatagggcaatagcgatgtttttttaacatctaacacaacagaggagagtgttaatggttaaaaaaaacctggcggcagcgcaaaagatg

SEQ ID NO: 53804 - DNA, 103 bp, Artificial Sequence
  Synthetic Polynucleotide
taatacgactcactataggggagttcgtctttggatctagaaaaatatataacagaggagaatatatatgtctagatccaacctggcggcagcgcaaaagatg

SEQ ID NO: 53805 - DNA, 103 bp, Artificial Sequence
  Synthetic Polynucleotide
taatacgactcactataggggtggtcaatagcgatgtttttttaacatctaacagaggagaagatgtatgaaaaacatcaacctggcggcagcgcaaaagatg

SEQ ID NO: 53806 - DNA, 103 bp, Artificial Sequence
  Synthetic Polynucleotide
taatacgactcactatagggaagccgtggtcaatagcgatgtttttttaaaacagaggagattaaaaatgcatcgctataacctggcggcagcgcaaaagatg

SEQ ID NO: 53807 - DNA, 103 bp, Artificial Sequence
  Synthetic Polynucleotide
taatacgactcactatagggaatggaagccgtggtcaatagcgatgttttaacagaggagaaaaacaatgctattgaccaacctggcggcagcgcaaaagatg

SEQ ID NO: 53808 - DNA, 103 bp, Artificial Sequence
  Synthetic Polynucleotide
taatacgactcactatagggtaaataatggaagccgtggtcaatagcgataacagaggagaatcgctatggaccacggcaacctggcggcagcgcaaaagatg

SEQ ID NO: 53809 - DNA, 103 bp, Artificial Sequence
  Synthetic Polynucleotide
taatacgactcactataggggaatataaataatggaagccgtggtcaataaacagaggagatattgaatgcggcttccaaacctggcggcagcgcaaaagatg

SEQ ID NO: 53810 - DNA, 103 bp, Artificial Sequence
  Synthetic Polynucleotide
taatacgactcactatagggactacgaatataaataatggaagccgtggtaacagaggagaaccacgatgtccattattaacctggcggcagcgcaaaagatg

SEQ ID NO: 53811 - DNA, 103 bp, Artificial Sequence
  Synthetic Polynucleotide
taatacgactcactatagggtaaaaactacgaatataaataatggaagccaacagaggagaggcttcatgtatttatataacctggcggcagcgcaaaagatg

SEQ ID NO: 53812 - DNA, 103 bp, Artificial Sequence
  Synthetic Polynucleotide
taatacgactcactatagggtcgagtaaaaactacgaatataaataatggaacagaggagaccattaatgatattcgtaaacctggcggcagcgcaaaagatg

SEQ ID NO: 53813 - DNA, 103 bp, Artificial Sequence
  Synthetic Polynucleotide
taatacgactcactatagggcgctttcgagtaaaaactacgaatataaataacagaggagaatttatatgcgtagttttaacctggcggcagcgcaaaagatg

SEQ ID NO: 53814 - DNA, 103 bp, Artificial Sequence
  Synthetic Polynucleotide
taatacgactcactatagggaatcacgctttcgagtaaaaactacgaataaacagaggagatattcgatgtttttactcaacctggcggcagcgcaaaagatg

SEQ ID NO: 53815 - DNA, 103 bp, Artificial Sequence
  Synthetic Polynucleotide
taatacgactcactatagggccaaagagttcgtctttggatctagaaaaaaacagaggagatttttcatgatccaaagaaacctggcggcagcgcaaaagatg

SEQ ID NO: 53816 - DNA, 103 bp, Artificial Sequence
  Synthetic Polynucleotide
taatacgactcactatagggattaaaatcacgctttcgagtaaaaactacaacagaggagagtagttatgactcgaaagaacctggcggcagcgcaaaagatg

SEQ ID NO: 53817 - DNA, 103 bp, Artificial Sequence
  Synthetic Polynucleotide
taatacgactcactatagggtggatattaaaatcacgctttcgagtaaaaaacagaggagattttacatgaaagcgtgaaacctggcggcagcgcaaaagatg

SEQ ID NO: 53818 - DNA, 103 bp, Artificial Sequence
  Synthetic Polynucleotide
taatacgactcactatagggaagattggatattaaaatcacgctttcgagaacagaggagactcgaaatggtgattttaaacctggcggcagcgcaaaagatg

SEQ ID NO: 53819 - DNA, 103 bp, Artificial Sequence
  Synthetic Polynucleotide
taatacgactcactataggggtaataagattggatattaaaatcacgcttaacagaggagaaagcgtatgtttaatatcaacctggcggcagcgcaaaagatg

SEQ ID NO: 53820 - DNA, 103 bp, Artificial Sequence
  Synthetic Polynucleotide
taatacgactcactatagggcaaaagtaataagattggatattaaaatcaaacagaggagatgatttatgtatccaatcaacctggcggcagcgcaaaagatg

SEQ ID NO: 53821 - DNA, 103 bp, Artificial Sequence
  Synthetic Polynucleotide
taatacgactcactataggggattccaaaagtaataagattggatattaaaacagaggagattaataatgaatcttattaacctggcggcagcgcaaaagatg

SEQ ID NO: 53822 - DNA, 103 bp, Artificial Sequence
  Synthetic Polynucleotide
taatacgactcactatagggtgaacgattccaaaagtaataagattggataacagaggagaatccaaatgtattactttaacctggcggcagcgcaaaagatg

SEQ ID NO: 53823 - DNA, 103 bp, Artificial Sequence
  Synthetic Polynucleotide
taatacgactcactatagggggttttgaacgattccaaaagtaataagataacagaggagaatcttaatgcttttggaaaacctggcggcagcgcaaaagatg

SEQ ID NO: 53824 - DNA, 103 bp, Artificial Sequence
  Synthetic Polynucleotide
taatacgactcactatagggtcaaaggttttgaacgattccaaaagtaataacagaggagaattactatgggaatcgttaacctggcggcagcgcaaaagatg

SEQ ID NO: 53825 - DNA, 103 bp, Artificial Sequence
  Synthetic Polynucleotide
taatacgactcactatagggactagtcaaaggttttgaacgattccaaaaaacagaggagattttggatgcgttcaaaaaacctggcggcagcgcaaaagatg

SEQ ID NO: 53826 - DNA, 103 bp, Artificial Sequence
  Synthetic Polynucleotide
taatacgactcactatagggggacgccaaagagttcgtctttggatctagaacagaggagactagatatgaagacgaacaacctggcggcagcgcaaaagatg

SEQ ID NO: 53827 - DNA, 103 bp, Artificial Sequence
  Synthetic Polynucleotide
taatacgactcactatagggctacaactagtcaaaggttttgaacgattcaacagaggagagaatcgatgaaaacctttaacctggcggcagcgcaaaagatg

SEQ ID NO: 53828 - DNA, 103 bp, Artificial Sequence
  Synthetic Polynucleotide
taatacgactcactatagggaaattctacaactagtcaaaggttttgaacaacagaggagagttcaaatgctttgactaaacctggcggcagcgcaaaagatg

SEQ ID NO: 53829 - DNA, 103 bp, Artificial Sequence
  Synthetic Polynucleotide
taatacgactcactatagggagatcaaattctacaactagtcaaaggtttaacagaggagaaaacctatgactagttgtaacctggcggcagcgcaaaagatg

SEQ ID NO: 53830 - DNA, 103 bp, Artificial Sequence
  Synthetic Polynucleotide
taatacgactcactataggggcaatagatcaaattctacaactagtcaaaaacagaggagatttgacatgttgtagaataacctggcggcagcgcaaaagatg

SEQ ID NO: 53831 - DNA, 103 bp, Artificial Sequence
  Synthetic Polynucleotide
taatacgactcactataggggtagggcaatagatcaaattctacaactagaacagaggagactagttatggaatttgataacctggcggcagcgcaaaagatg

SEQ ID NO: 53832 - DNA, 103 bp, Artificial Sequence
  Synthetic Polynucleotide
taatacgactcactatagggtacgcgtagggcaatagatcaaattctacaaacagaggagatgtagaatgtgatctattaacctggcggcagcgcaaaagatg

SEQ ID NO: 53833 - DNA, 103 bp, Artificial Sequence
  Synthetic Polynucleotide
taatacgactcactataggggagtatacgcgtagggcaatagatcaaattaacagaggagaaatttgatgtattgccctaacctggcggcagcgcaaaagatg

SEQ ID NO: 53834 - DNA, 103 bp, Artificial Sequence
  Synthetic Polynucleotide
taatacgactcactatagggcaagggagtatacgcgtagggcaatagatcaacagaggagagatctaatgccctacgcgaacctggcggcagcgcaaaagatg

SEQ ID NO: 53835 - DNA, 103 bp, Artificial Sequence
  Synthetic Polynucleotide
taatacgactcactatagggtgatgcaagggagtatacgcgtagggcaataacagaggagaattgccatgcgcgtatacaacctggcggcagcgcaaaagatg

SEQ ID NO: 53836 - DNA, 103 bp, Artificial Sequence
  Synthetic Polynucleotide
taatacgactcactataggggtatatgatgcaagggagtatacgcgtaggaacagaggagacctacgatgatactccctaacctggcggcagcgcaaaagatg

SEQ ID NO: 53837 - DNA, 103 bp, Artificial Sequence
  Synthetic Polynucleotide
taatacgactcactatagggatagaggacgccaaagagttcgtctttggaaacagaggagatccaaaatggaactctttaacctggcggcagcgcaaaagatg

SEQ ID NO: 53838 - DNA, 103 bp, Artificial Sequence
  Synthetic Polynucleotide
taatacgactcactatagggcgaacgtatatgatgcaagggagtatacgcaacagaggagagcgtatatgcccttgcataacctggcggcagcgcaaaagatg

SEQ ID NO: 53839 - DNA, 103 bp, Artificial Sequence
  Synthetic Polynucleotide
taatacgactcactatagggggtgacgaacgtatatgatgcaagggagtaaacagaggagatactccatggcatcatataacctggcggcagcgcaaaagatg

SEQ ID NO: 53840 - DNA, 103 bp, Artificial Sequence
  Synthetic Polynucleotide
taatacgactcactataggggatctggtgacgaacgtatatgatgcaaggaacagaggagaccttgcatgatatacgttaacctggcggcagcgcaaaagatg

SEQ ID NO: 53841 - DNA, 103 bp, Artificial Sequence
  Synthetic Polynucleotide
taatacgactcactatagggcaaacgatctggtgacgaacgtatatgatgaacagaggagacatcatatgcgttcgtcaaacctggcggcagcgcaaaagatg

SEQ ID NO: 53842 - DNA, 103 bp, Artificial Sequence
  Synthetic Polynucleotide
taatacgactcactatagggcgaaacaaacgatctggtgacgaacgtataaacagaggagatatacgatggtcaccagaaacctggcggcagcgcaaaagatg

SEQ ID NO: 53843 - DNA, 103 bp, Artificial Sequence
  Synthetic Polynucleotide
taatacgactcactatagggcaggccgaaacaaacgatctggtgacgaacaacagaggagagttcgtatgcagatcgttaacctggcggcagcgcaaaagatg

SEQ ID NO: 53844 - DNA, 103 bp, Artificial Sequence
  Synthetic Polynucleotide
taatacgactcactatagggaacttcaggccgaaacaaacgatctggtgaaacagaggagatcaccaatgcgtttgtttaacctggcggcagcgcaaaagatg

SEQ ID NO: 53845 - DNA, 103 bp, Artificial Sequence
  Synthetic Polynucleotide
taatacgactcactataggggcgccaacttcaggccgaaacaaacgatctaacagaggagaagatcgatggtttcggccaacctggcggcagcgcaaaagatg

SEQ ID NO: 53846 - DNA, 103 bp, Artificial Sequence
  Synthetic Polynucleotide
taatacgactcactataggggatatgcgccaacttcaggccgaaacaaacaacagaggagagtttgtatgggcctgaagaacctggcggcagcgcaaaagatg

SEQ ID NO: 53847 - DNA, 103 bp, Artificial Sequence
  Synthetic Polynucleotide
taatacgactcactatagggaaaaagatatgcgccaacttcaggccgaaaaacagaggagatttcggatggaagttggcaacctggcggcagcgcaaaagatg

SEQ ID NO: 53848 - DNA, 103 bp, Artificial Sequence
  Synthetic Polynucleotide
taatacgactcactatagggatattatagaggacgccaaagagttcgtctaacagaggagaagacgaatgctttggcgtaacctggcggcagcgcaaaagatg

SEQ ID NO: 53849 - DNA, 103 bp, Artificial Sequence
  Synthetic Polynucleotide
taatacgactcactatagggtgttgaaaaagatatgcgccaacttcaggcaacagaggagagcctgaatgtggcgcataaacctggcggcagcgcaaaagatg

SEQ ID NO: 53850 - DNA, 103 bp, Artificial Sequence
  Synthetic Polynucleotide
taatacgactcactatagggtcgagtgttgaaaaagatatgcgccaacttaacagaggagaaagttgatgcatatctttaacctggcggcagcgcaaaagatg

SEQ ID NO: 53851 - DNA, 103 bp, Artificial Sequence
  Synthetic Polynucleotide
taatacgactcactatagggtcatgtcgagtgttgaaaaagatatgcgccaacagaggagaggcgcaatgctttttcaaaacctggcggcagcgcaaaagatg

SEQ ID NO: 53852 - DNA, 103 bp, Artificial Sequence
  Synthetic Polynucleotide
taatacgactcactatagggggatctcatgtcgagtgttgaaaaagatataacagaggagaatatctatgtcaacactcaacctggcggcagcgcaaaagatg

SEQ ID NO: 53853 - DNA, 103 bp, Artificial Sequence
  Synthetic Polynucleotide
taatacgactcactatagggcttaaggatctcatgtcgagtgttgaaaaaaacagaggagatttttcatgactcgacataacctggcggcagcgcaaaagatg

SEQ ID NO: 53854 - DNA, 103 bp, Artificial Sequence
  Synthetic Polynucleotide
taatacgactcactatagggtggcccttaaggatctcatgtcgagtgttgaacagaggagacaacacatgacatgagataacctggcggcagcgcaaaagatg

SEQ ID NO: 53855 - DNA, 103 bp, Artificial Sequence
  Synthetic Polynucleotide
taatacgactcactatagggcaatatggcccttaaggatctcatgtcgagaacagaggagactcgacatgagatccttaaacctggcggcagcgcaaaagatg

SEQ ID NO: 53856 - DNA, 103 bp, Artificial Sequence
  Synthetic Polynucleotide
taatacgactcactatagggctagacaatatggcccttaaggatctcatgaacagaggagacatgagatgcttaagggcaacctggcggcagcgcaaaagatg

SEQ ID NO: 53857 - DNA, 103 bp, Artificial Sequence
  Synthetic Polynucleotide
taatacgactcactatagggaaaatctagacaatatggcccttaaggatcaacagaggagagatcctatggggccatataacctggcggcagcgcaaaagatg

SEQ ID NO: 53858 - DNA, 103 bp, Artificial Sequence
  Synthetic Polynucleotide
taatacgactcactatagggtcaacaaaatctagacaatatggcccttaaaacagaggagattaaggatgatattgtctaacctggcggcagcgcaaaagatg

SEQ ID NO: 53859 - DNA, 103 bp, Artificial Sequence
  Synthetic Polynucleotide
taatacgactcactatagggtgggaatattatagaggacgccaaagagttaacagaggagaaactctatggcgtcctctaacctggcggcagcgcaaaagatg

SEQ ID NO: 53860 - DNA, 103 bp, Artificial Sequence
  Synthetic Polynucleotide
taatacgactcactatagggacatctcaacaaaatctagacaatatggccaacagaggagaggccatatggtctagattaacctggcggcagcgcaaaagatg

SEQ ID NO: 53861 - DNA, 103 bp, Artificial Sequence
  Synthetic Polynucleotide
taatacgactcactataggggagcaacatctcaacaaaatctagacaataaacagaggagatattgtatggattttgttaacctggcggcagcgcaaaagatg

SEQ ID NO: 53862 - DNA, 103 bp, Artificial Sequence
  Synthetic Polynucleotide
taatacgactcactatagggtccaggagcaacatctcaacaaaatctagaaacagaggagatctagaatgtgttgagataacctggcggcagcgcaaaagatg

SEQ ID NO: 53863 - DNA, 103 bp, Artificial Sequence
  Synthetic Polynucleotide
taatacgactcactatagggccaaatccaggagcaacatctcaacaaaataacagaggagaattttgatgagatgttgcaacctggcggcagcgcaaaagatg

SEQ ID NO: 53864 - DNA, 103 bp, Artificial Sequence
  Synthetic Polynucleotide
taatacgactcactatagggaaaatccaaatccaggagcaacatctcaacaacagaggagagttgagatgttgctcctgaacctggcggcagcgcaaaagatg

SEQ ID NO: 53865 - DNA, 103 bp, Artificial Sequence
  Synthetic Polynucleotide
taatacgactcactatagggacaacaaaatccaaatccaggagcaacatcaacagaggagagatgttatgcctggatttaacctggcggcagcgcaaaagatg

SEQ ID NO: 53866 - DNA, 103 bp, Artificial Sequence
  Synthetic Polynucleotide
taatacgactcactatagggacagcacaacaaaatccaaatccaggagcaaacagaggagatgctccatgatttggattaacctggcggcagcgcaaaagatg

SEQ ID NO: 53867 - DNA, 103 bp, Artificial Sequence
  Synthetic Polynucleotide
taatacgactcactataggggtacaacagcacaacaaaatccaaatccagaacagaggagactggatatggattttgttaacctggcggcagcgcaaaagatg

SEQ ID NO: 53868 - DNA, 103 bp, Artificial Sequence
  Synthetic Polynucleotide
taatacgactcactatagggagtatgtacaacagcacaacaaaatccaaaaacagaggagatttggaatgtgttgtgctaacctggcggcagcgcaaaagatg

SEQ ID NO: 53869 - DNA, 103 bp, Artificial Sequence
  Synthetic Polynucleotide
taatacgactcactatagggggtacagtatgtacaacagcacaacaaaataacagaggagaattttgatgtgctgttgtaacctggcggcagcgcaaaagatg

SEQ ID NO: 53870 - DNA, 103 bp, Artificial Sequence
  Synthetic Polynucleotide
taatacgactcactatagggttttctgggaatattatagaggacgccaaaaacagaggagatttggcatgctctataataacctggcggcagcgcaaaagatg

SEQ ID NO: 53871 - DNA, 103 bp, Artificial Sequence
  Synthetic Polynucleotide
taatacgactcactatagggctggtggtacagtatgtacaacagcacaacaacagaggagagttgtgatgttgtacataaacctggcggcagcgcaaaagatg

SEQ ID NO: 53872 - DNA, 103 bp, Artificial Sequence
  Synthetic Polynucleotide
taatacgactcactatagggacctactggtggtacagtatgtacaacagcaacagaggagagctgttatgcatactgtaaacctggcggcagcgcaaaagatg

SEQ ID NO: 53873 - DNA, 103 bp, Artificial Sequence
  Synthetic Polynucleotide
taatacgactcactatagggcctacacctactggtggtacagtatgtacaaacagaggagatgtacaatgtgtaccaccaacctggcggcagcgcaaaagatg

SEQ ID NO: 53874 - DNA, 103 bp, Artificial Sequence
  Synthetic Polynucleotide
taatacgactcactataggggtactcctacacctactggtggtacagtataacagaggagaatactgatgcaccagtagaacctggcggcagcgcaaaagatg

SEQ ID NO: 53875 - DNA, 103 bp, Artificial Sequence
  Synthetic Polynucleotide
taatacgactcactatagggtgtatgtactcctacacctactggtggtacaacagaggagagtaccaatggtaggtgtaaacctggcggcagcgcaaaagatg

SEQ ID NO: 53876 - DNA, 103 bp, Artificial Sequence
  Synthetic Polynucleotide
taatacgactcactataggggccactgtatgtactcctacacctactggtaacagaggagaaccagtatgtgtaggagtaacctggcggcagcgcaaaagatg

SEQ ID NO: 53877 - DNA, 103 bp, Artificial Sequence
  Synthetic Polynucleotide
taatacgactcactatagggttgtggccactgtatgtactcctacacctaaacagaggagataggtgatggagtacataaacctggcggcagcgcaaaagatg

SEQ ID NO: 53878 - DNA, 103 bp, Artificial Sequence
  Synthetic Polynucleotide
taatacgactcactatagggtcctattgtggccactgtatgtactcctacaacagaggagagtaggaatgcatacagtgaacctggcggcagcgcaaaagatg

SEQ ID NO: 53879 - DNA, 103 bp, Artificial Sequence
  Synthetic Polynucleotide
taatacgactcactatagggcaacctcctattgtggccactgtatgtactaacagaggagaagtacaatgagtggccacaacctggcggcagcgcaaaagatg

SEQ ID NO: 53880 - DNA, 103 bp, Artificial Sequence
  Synthetic Polynucleotide
taatacgactcactatagggctcctcaacctcctattgtggccactgtataacagaggagaatacagatgccacaatagaacctggcggcagcgcaaaagatg

SEQ ID NO: 53881 - DNA, 103 bp, Artificial Sequence
  Synthetic Polynucleotide
taatacgactcactatagggatatcttttctgggaatattatagaggacgaacagaggagacgtcctatgtaatattccaacctggcggcagcgcaaaagatg

SEQ ID NO: 53882 - DNA, 103 bp, Artificial Sequence
  Synthetic Polynucleotide
taatacgactcactatagggtacacctcctcaacctcctattgtggccacaacagaggagagtggccatgataggaggtaacctggcggcagcgcaaaagatg

SEQ ID NO: 53883 - DNA, 103 bp, Artificial Sequence
  Synthetic Polynucleotide
taatacgactcactatagggacagttacacctcctcaacctcctattgtgaacagaggagacacaatatgaggttgaggaacctggcggcagcgcaaaagatg

SEQ ID NO: 53884 - DNA, 103 bp, Artificial Sequence
  Synthetic Polynucleotide
taatacgactcactatagggctccgacagttacacctcctcaacctcctaaacagaggagataggagatggaggaggtgaacctggcggcagcgcaaaagatg

SEQ ID NO: 53885 - DNA, 103 bp, Artificial Sequence
  Synthetic Polynucleotide
taatacgactcactatagggtactactccgacagttacacctcctcaaccaacagaggagaggttgaatgggtgtaactaacctggcggcagcgcaaaagatg

SEQ ID NO: 53886 - DNA, 103 bp, Artificial Sequence
  Synthetic Polynucleotide
taatacgactcactatagggtcttgtactactccgacagttacacctcctaacagaggagaaggaggatgaactgtcggaacctggcggcagcgcaaaagatg

SEQ ID NO: 53887 - DNA, 103 bp, Artificial Sequence
  Synthetic Polynucleotide
taatacgactcactataggggtatttcttgtactactccgacagttacacaacagaggagagtgtaaatgtcggagtagaacctggcggcagcgcaaaagatg

SEQ ID NO: 53888 - DNA, 103 bp, Artificial Sequence
  Synthetic Polynucleotide
taatacgactcactatagggtggaagtatttcttgtactactccgacagtaacagaggagaactgtcatggtagtacaaaacctggcggcagcgcaaaagatg

SEQ ID NO: 53889 - DNA, 103 bp, Artificial Sequence
  Synthetic Polynucleotide
taatacgactcactatagggtcggatggaagtatttcttgtactactccgaacagaggagacggagtatgacaagaaataacctggcggcagcgcaaaagatg

SEQ ID NO: 53890 - DNA, 103 bp, Artificial Sequence
  Synthetic Polynucleotide
taatacgactcactatagggaacaatcggatggaagtatttcttgtactaaacagaggagatagtacatgaaatacttcaacctggcggcagcgcaaaagatg

SEQ ID NO: 53891 - DNA, 103 bp, Artificial Sequence
  Synthetic Polynucleotide
taatacgactcactatagggtacacaacaatcggatggaagtatttcttgaacagaggagacaagaaatgcttccatccaacctggcggcagcgcaaaagatg

SEQ ID NO: 53892 - DNA, 103 bp, Artificial Sequence
  Synthetic Polynucleotide
taatacgactcactatagggcgaaaatatcttttctgggaatattatagaaacagaggagatctataatgttcccagaaaacctggcggcagcgcaaaagatg

SEQ ID NO: 53893 - DNA, 103 bp, Artificial Sequence
  Synthetic Polynucleotide
taatacgactcactatagggacatgtacacaacaatcggatggaagtattaacagaggagaaatactatgatccgattgaacctggcggcagcgcaaaagatg

SEQ ID NO: 53894 - DNA, 103 bp, Artificial Sequence
  Synthetic Polynucleotide
taatacgactcactatagggcaactacatgtacacaacaatcggatggaaaacagaggagattccatatgattgttgtgaacctggcggcagcgcaaaagatg

SEQ ID NO: 53895 - DNA, 103 bp, Artificial Sequence
  Synthetic Polynucleotide
taatacgactcactatagggaccaacaactacatgtacacaacaatcggaaacagaggagatccgatatgtgtgtacataacctggcggcagcgcaaaagatg

SEQ ID NO: 53896 - DNA, 103 bp, Artificial Sequence
  Synthetic Polynucleotide
taatacgactcactatagggacgttaccaacaactacatgtacacaacaaaacagaggagattgttgatgacatgtagtaacctggcggcagcgcaaaagatg

SEQ ID NO: 53897 - DNA, 103 bp, Artificial Sequence
  Synthetic Polynucleotide
taatacgactcactatagggctcagacgttaccaacaactacatgtacacaacagaggagagtgtacatgtagttgttgaacctggcggcagcgcaaaagatg

SEQ ID NO: 53898 - DNA, 103 bp, Artificial Sequence
  Synthetic Polynucleotide
taatacgactcactatagggaccttctcagacgttaccaacaactacatgaacagaggagacatgtaatggttggtaacaacctggcggcagcgcaaaagatg

SEQ ID NO: 53899 - DNA, 103 bp, Artificial Sequence
  Synthetic Polynucleotide
taatacgactcactatagggacccaaccttctcagacgttaccaacaactaacagaggagaagttgtatgtaacgtctgaacctggcggcagcgcaaaagatg

SEQ ID NO: 53900 - DNA, 103 bp, Artificial Sequence
  Synthetic Polynucleotide
taatacgactcactatagggcatctacccaaccttctcagacgttaccaaaacagaggagattggtaatgtctgagaagaacctggcggcagcgcaaaagatg

SEQ ID NO: 53901 - DNA, 103 bp, Artificial Sequence
  Synthetic Polynucleotide
taatacgactcactataggggacgccatctacccaaccttctcagacgttaacagaggagaaacgtcatggaaggttggaacctggcggcagcgcaaaagatg

SEQ ID NO: 53902 - DNA, 103 bp, Artificial Sequence
  Synthetic Polynucleotide
taatacgactcactatagggacgacgacgccatctacccaaccttctcagaacagaggagactgagaatgttgggtagaaacctggcggcagcgcaaaagatg

SEQ ID NO: 53903 - DNA, 103 bp, Artificial Sequence
  Synthetic Polynucleotide
taatacgactcactatagggtccacgttagaaactattatatacagtacaaacagaggagatgtactatgtataatagtaacctggcggcagcgcaaaagatg

SEQ ID NO: 53904 - DNA, 103 bp, Artificial Sequence
  Synthetic Polynucleotide
taatacgactcactatagggaaacacgaaaatatcttttctgggaatattaacagaggagaaatattatgagaaaagataacctggcggcagcgcaaaagatg

SEQ ID NO: 53905 - DNA, 103 bp, Artificial Sequence
  Synthetic Polynucleotide
taatacgactcactatagggagacgacgacgacgccatctacccaaccttaacagaggagaaaggttatgtagatggcgaacctggcggcagcgcaaaagatg

SEQ ID NO: 53906 - DNA, 103 bp, Artificial Sequence
  Synthetic Polynucleotide
taatacgactcactatagggtcaaaagacgacgacgacgccatctacccaaacagaggagatgggtaatgggcgtcgtcaacctggcggcagcgcaaaagatg

SEQ ID NO: 53907 - DNA, 103 bp, Artificial Sequence
  Synthetic Polynucleotide
taatacgactcactatagggaaagatcaaaagacgacgacgacgccatctaacagaggagaagatggatgcgtcgtcgtaacctggcggcagcgcaaaagatg

SEQ ID NO: 53908 - DNA, 103 bp, Artificial Sequence
  Synthetic Polynucleotide
taatacgactcactatagggttaataaagatcaaaagacgacgacgacgcaacagaggagagcgtcgatgtcgtcttttaacctggcggcagcgcaaaagatg

SEQ ID NO: 53909 - DNA, 103 bp, Artificial Sequence
  Synthetic Polynucleotide
taatacgactcactatagggtaaatttaataaagatcaaaagacgacgacaacagaggagagtcgtcatgttttgatctaacctggcggcagcgcaaaagatg

SEQ ID NO: 53910 - DNA, 103 bp, Artificial Sequence
  Synthetic Polynucleotide
taatacgactcactatagggatctctaaatttaataaagatcaaaagacgaacagaggagacgtcttatgatctttattaacctggcggcagcgcaaaagatg

SEQ ID NO: 53911 - DNA, 103 bp, Artificial Sequence
  Synthetic Polynucleotide
taatacgactcactatagggatattatctctaaatttaataaagatcaaaaacagaggagatttgatatgtattaaattaacctggcggcagcgcaaaagatg

SEQ ID NO: 53912 - DNA, 103 bp, Artificial Sequence
  Synthetic Polynucleotide
taatacgactcactatagggtcaggatattatctctaaatttaataaagaaacagaggagatctttaatgaatttagagaacctggcggcagcgcaaaagatg

SEQ ID NO: 53913 - DNA, 103 bp, Artificial Sequence
  Synthetic Polynucleotide
taatacgactcactataggggctgttcaggatattatctctaaatttaataacagaggagaattaaaatgagagataataacctggcggcagcgcaaaagatg

SEQ ID NO: 53914 - DNA, 103 bp, Artificial Sequence
  Synthetic Polynucleotide
taatacgactcactatagggtcaatgctgttcaggatattatctctaaataacagaggagaatttagatgtaatatcctaacctggcggcagcgcaaaagatg

SEQ ID NO: 53915 - DNA, 103 bp, Artificial Sequence
  Synthetic Polynucleotide
taatacgactcactatagggaactaaaacacgaaaatatcttttctgggaaacagaggagatcccagatgagatattttaacctggcggcagcgcaaaagatg

SEQ ID NO: 53916 - DNA, 103 bp, Artificial Sequence
  Synthetic Polynucleotide
taatacgactcactataggggccgatcaatgctgttcaggatattatctcaacagaggagagagataatgtcctgaacaaacctggcggcagcgcaaaagatg

SEQ ID NO: 53917 - DNA, 103 bp, Artificial Sequence
  Synthetic Polynucleotide
taatacgactcactatagggttgacgccgatcaatgctgttcaggatattaacagaggagaaatatcatgaacagcattaacctggcggcagcgcaaaagatg

SEQ ID NO: 53918 - DNA, 103 bp, Artificial Sequence
  Synthetic Polynucleotide
taatacgactcactatagggcagcgttgacgccgatcaatgctgttcaggaacagaggagacctgaaatgcattgatcgaacctggcggcagcgcaaaagatg

SEQ ID NO: 53919 - DNA, 103 bp, Artificial Sequence
  Synthetic Polynucleotide
taatacgactcactatagggccttccagcgttgacgccgatcaatgctgtaacagaggagaacagcaatgatcggcgtcaacctggcggcagcgcaaaagatg

SEQ ID NO: 53920 - DNA, 103 bp, Artificial Sequence
  Synthetic Polynucleotide
taatacgactcactatagggtcactccttccagcgttgacgccgatcaataacagaggagaattgatatgcgtcaacgcaacctggcggcagcgcaaaagatg

SEQ ID NO: 53921 - DNA, 103 bp, Artificial Sequence
  Synthetic Polynucleotide
taatacgactcactatagggcgagttcactccttccagcgttgacgccgaaacagaggagatcggcgatgacgctggaaaacctggcggcagcgcaaaagatg

SEQ ID NO: 53922 - DNA, 103 bp, Artificial Sequence
  Synthetic Polynucleotide
taatacgactcactatagggacaaccgagttcactccttccagcgttgacaacagaggagagtcaacatgggaaggagtaacctggcggcagcgcaaaagatg

SEQ ID NO: 53923 - DNA, 103 bp, Artificial Sequence
  Synthetic Polynucleotide
taatacgactcactatagggaatacacaaccgagttcactccttccagcgaacagaggagacgctggatggagtgaactaacctggcggcagcgcaaaagatg

SEQ ID NO: 53924 - DNA, 103 bp, Artificial Sequence
  Synthetic Polynucleotide
taatacgactcactatagggatgataatacacaaccgagttcactccttcaacagaggagagaaggaatgaactcggttaacctggcggcagcgcaaaagatg

SEQ ID NO: 53925 - DNA, 103 bp, Artificial Sequence
  Synthetic Polynucleotide
taatacgactcactatagggggcagatgataatacacaaccgagttcactaacagaggagaagtgaaatgggttgtgtaaacctggcggcagcgcaaaagatg

SEQ ID NO: 53926 - DNA, 103 bp, Artificial Sequence
  Synthetic Polynucleotide
taatacgactcactatagggcgataaactaaaacacgaaaatatcttttcaacagaggagagaaaagatgttttcgtgtaacctggcggcagcgcaaaagatg

SEQ ID NO: 53927 - DNA, 103 bp, Artificial Sequence
  Synthetic Polynucleotide
taatacgactcactatagggttgtcggcagatgataatacacaaccgagtaacagaggagaactcggatgtgtattatcaacctggcggcagcgcaaaagatg

SEQ ID NO: 53928 - DNA, 103 bp, Artificial Sequence
  Synthetic Polynucleotide
taatacgactcactatagggattggttgtcggcagatgataatacacaacaacagaggagagttgtgatgtatcatctgaacctggcggcagcgcaaaagatg

SEQ ID NO: 53929 - DNA, 103 bp, Artificial Sequence
  Synthetic Polynucleotide
taatacgactcactatagggttttgattggttgtcggcagatgataatacaacagaggagagtattaatgtctgccgacaacctggcggcagcgcaaaagatg

SEQ ID NO: 53930 - DNA, 103 bp, Artificial Sequence
  Synthetic Polynucleotide
taatacgactcactatagggaatctttttgattggttgtcggcagatgataacagaggagaatcatcatgcgacaaccaaacctggcggcagcgcaaaagatg

SEQ ID NO: 53931 - DNA, 103 bp, Artificial Sequence
  Synthetic Polynucleotide
taatacgactcactatagggtgtctaatctttttgattggttgtcggcagaacagaggagactgccgatgaccaatcaaaacctggcggcagcgcaaaagatg

SEQ ID NO: 53932 - DNA, 103 bp, Artificial Sequence
  Synthetic Polynucleotide
taatacgactcactatagggggatatgtctaatctttttgattggttgtcaacagaggagagacaacatgtcaaaaagaaacctggcggcagcgcaaaagatg

SEQ ID NO: 53933 - DNA, 103 bp, Artificial Sequence
  Synthetic Polynucleotide
taatacgactcactatagggtcatcggatatgtctaatctttttgattggaacagaggagaccaatcatgaagattagaaacctggcggcagcgcaaaagatg

SEQ ID NO: 53934 - DNA, 103 bp, Artificial Sequence
  Synthetic Polynucleotide
taatacgactcactatagggatacatcatcggatatgtctaatctttttgaacagaggagacaaaaaatgtagacatataacctggcggcagcgcaaaagatg

SEQ ID NO: 53935 - DNA, 103 bp, Artificial Sequence
  Synthetic Polynucleotide
taatacgactcactatagggaactaatacatcatcggatatgtctaatctaacagaggagaagattaatgatatccgataacctggcggcagcgcaaaagatg

SEQ ID NO: 53936 - DNA, 103 bp, Artificial Sequence
  Synthetic Polynucleotide
taatacgactcactatagggcaacaaactaatacatcatcggatatgtctaacagaggagaagacatatgcgatgatgtaacctggcggcagcgcaaaagatg

SEQ ID NO: 53937 - DNA, 103 bp, Artificial Sequence
  Synthetic Polynucleotide
taatacgactcactataggggatctcgataaactaaaacacgaaaatatcaacagaggagagatattatggtgttttagaacctggcggcagcgcaaaagatg

SEQ ID NO: 53938 - DNA, 103 bp, Artificial Sequence
  Synthetic Polynucleotide
taatacgactcactataggggacaacaacaaactaatacatcatcggataaacagaggagatatccgatgatgtattagaacctggcggcagcgcaaaagatg

SEQ ID NO: 53939 - DNA, 103 bp, Artificial Sequence
  Synthetic Polynucleotide
taatacgactcactatagggaccacgacaacaacaaactaatacatcatcaacagaggagagatgatatgttagtttgtaacctggcggcagcgcaaaagatg

SEQ ID NO: 53940 - DNA, 103 bp, Artificial Sequence
  Synthetic Polynucleotide
taatacgactcactatagggccaaaaccacgacaacaacaaactaatacaaacagaggagatgtattatgttgttgttgaacctggcggcagcgcaaaagatg

SEQ ID NO: 53941 - DNA, 103 bp, Artificial Sequence
  Synthetic Polynucleotide
taatacgactcactatagggctacaccaaaaccacgacaacaacaaactaaacagaggagatagtttatggttgtcgtgaacctggcggcagcgcaaaagatg

SEQ ID NO: 53942 - DNA, 103 bp, Artificial Sequence
  Synthetic Polynucleotide
taatacgactcactatagggggctcctacaccaaaaccacgacaacaacaaacagaggagatgttgtatgcgtggttttaacctggcggcagcgcaaaagatg

SEQ ID NO: 53943 - DNA, 103 bp, Artificial Sequence
  Synthetic Polynucleotide
taatacgactcactatagggacaccggctcctacaccaaaaccacgacaaaacagaggagattgtcgatgttttggtgtaacctggcggcagcgcaaaagatg

SEQ ID NO: 53944 - DNA, 103 bp, Artificial Sequence
  Synthetic Polynucleotide
taatacgactcactatagggtacctacaccggctcctacaccaaaaccacaacagaggagagtggttatggtgtaggagaacctggcggcagcgcaaaagatg

SEQ ID NO: 53945 - DNA, 103 bp, Artificial Sequence
  Synthetic Polynucleotide
taatacgactcactataggggcaggtacctacaccggctcctacaccaaaaacagaggagatttggtatgggagccggtaacctggcggcagcgcaaaagatg

SEQ ID NO: 53946 - DNA, 103 bp, Artificial Sequence
  Synthetic Polynucleotide
taatacgactcactatagggccactgcaggtacctacaccggctcctacaaacagaggagatgtaggatgcggtgtaggaacctggcggcagcgcaaaagatg

SEQ ID NO: 53947 - DNA, 103 bp, Artificial Sequence
  Synthetic Polynucleotide
taatacgactcactatagggtaactccactgcaggtacctacaccggctcaacagaggagagagccgatgtaggtacctaacctggcggcagcgcaaaagatg

SEQ ID NO: 53948 - DNA, 103 bp, Artificial Sequence
  Synthetic Polynucleotide
taatacgactcactataggggattagatctcgataaactaaaacacgaaaaacagaggagatttcgtatgttagtttataacctggcggcagcgcaaaagatg

SEQ ID NO: 53949 - DNA, 103 bp, Artificial Sequence
  Synthetic Polynucleotide
taatacgactcactatagggtcatataactccactgcaggtacctacaccaacagaggagaggtgtaatgacctgcagtaacctggcggcagcgcaaaagatg

SEQ ID NO: 53950 - DNA, 103 bp, Artificial Sequence
  Synthetic Polynucleotide
taatacgactcactatagggactattcatataactccactgcaggtacctaacagaggagaaggtacatgcagtggagtaacctggcggcagcgcaaaagatg

SEQ ID NO: 53951 - DNA, 103 bp, Artificial Sequence
  Synthetic Polynucleotide
taatacgactcactatagggaaccaactattcatataactccactgcaggaacagaggagacctgcaatggagttatataacctggcggcagcgcaaaagatg

SEQ ID NO: 53952 - DNA, 103 bp, Artificial Sequence
  Synthetic Polynucleotide
taatacgactcactataggggctacaaccaactattcatataactccactaacagaggagaagtggaatgatatgaataaacctggcggcagcgcaaaagatg

SEQ ID NO: 53953 - DNA, 103 bp, Artificial Sequence
  Synthetic Polynucleotide
taatacgactcactatagggcaaccgctacaaccaactattcatataactaacagaggagaagttatatgaatagttggaacctggcggcagcgcaaaagatg

SEQ ID NO: 53954 - DNA, 103 bp, Artificial Sequence
  Synthetic Polynucleotide
taatacgactcactatagggctatccaaccgctacaaccaactattcataaacagaggagatatgaaatgttggttgtaaacctggcggcagcgcaaaagatg

SEQ ID NO: 53955 - DNA, 103 bp, Artificial Sequence
  Synthetic Polynucleotide
taatacgactcactatagggacagcctatccaaccgctacaaccaactataacagaggagaatagttatgtgtagcggtaacctggcggcagcgcaaaagatg

SEQ ID NO: 53956 - DNA, 103 bp, Artificial Sequence
  Synthetic Polynucleotide
taatacgactcactatagggagcagacagcctatccaaccgctacaaccaaacagaggagatggttgatgcggttggataacctggcggcagcgcaaaagatg

SEQ ID NO: 53957 - DNA, 103 bp, Artificial Sequence
  Synthetic Polynucleotide
taatacgactcactatagggccgccagcagacagcctatccaaccgctacaacagaggagagtagcgatgggataggctaacctggcggcagcgcaaaagatg

SEQ ID NO: 53958 - DNA, 103 bp, Artificial Sequence
  Synthetic Polynucleotide
taatacgactcactataggggatggccgccagcagacagcctatccaaccaacagaggagaggttggatgggctgtctgaacctggcggcagcgcaaaagatg

SEQ ID NO: 53959 - DNA, 103 bp, Artificial Sequence
  Synthetic Polynucleotide
taatacgactcactataggggaacagattagatctcgataaactaaaacaaacagaggagatgttttatgttatcgagaaacctggcggcagcgcaaaagatg

SEQ ID NO: 53960 - DNA, 103 bp, Artificial Sequence
  Synthetic Polynucleotide
taatacgactcactatagggaatatgatggccgccagcagacagcctatcaacagaggagagataggatgtctgctggcaacctggcggcagcgcaaaagatg

SEQ ID NO: 53961 - DNA, 103 bp, Artificial Sequence
  Synthetic Polynucleotide
taatacgactcactataggggagataatatgatggccgccagcagacagcaacagaggagagctgtcatgtggcggccaaacctggcggcagcgcaaaagatg

SEQ ID NO: 53962 - DNA, 103 bp, Artificial Sequence
  Synthetic Polynucleotide
taatacgactcactatagggagctagagataatatgatggccgccagcagaacagaggagactgctgatggccatcataaacctggcggcagcgcaaaagatg

SEQ ID NO: 53963 - DNA, 103 bp, Artificial Sequence
  Synthetic Polynucleotide
taatacgactcactatagggcaactagctagagataatatgatggccgccaacagaggagaggcggcatgcatattatcaacctggcggcagcgcaaaagatg

SEQ ID NO: 53964 - DNA, 103 bp, Artificial Sequence
  Synthetic Polynucleotide
taatacgactcactataggggagaacaactagctagagataatatgatggaacagaggagaccatcaatgtatctctagaacctggcggcagcgcaaaagatg

SEQ ID NO: 53965 - DNA, 103 bp, Artificial Sequence
  Synthetic Polynucleotide
taatacgactcactataggggttgcgagaacaactagctagagataatataacagaggagaatattaatgctagctagtaacctggcggcagcgcaaaagatg

SEQ ID NO: 53966 - DNA, 103 bp, Artificial Sequence
  Synthetic Polynucleotide
taatacgactcactatagggagacagttgcgagaacaactagctagagataacagaggagaatctctatgtagttgttcaacctggcggcagcgcaaaagatg

SEQ ID NO: 53967 - DNA, 103 bp, Artificial Sequence
  Synthetic Polynucleotide
taatacgactcactatagggatcaaagacagttgcgagaacaactagctaaacagaggagatagctaatggttctcgcaaacctggcggcagcgcaaaagatg

SEQ ID NO: 53968 - DNA, 103 bp, Artificial Sequence
  Synthetic Polynucleotide
taatacgactcactataggggtattatcaaagacagttgcgagaacaactaacagaggagaagttgtatgcgcaactgtaacctggcggcagcgcaaaagatg

SEQ ID NO: 53969 - DNA, 103 bp, Artificial Sequence
  Synthetic Polynucleotide
taatacgactcactataggggagtcgtattatcaaagacagttgcgagaaaacagaggagattctcgatgctgtctttgaacctggcggcagcgcaaaagatg

SEQ ID NO: 53970 - DNA, 103 bp, Artificial Sequence
  Synthetic Polynucleotide
taatacgactcactatagggtatatgaacagattagatctcgataaactaaacagaggagatagtttatggagatctaaaacctggcggcagcgcaaaagatg

SEQ ID NO: 53971 - DNA, 103 bp, Artificial Sequence
  Synthetic Polynucleotide
taatacgactcactatagggctcaagagtcgtattatcaaagacagttgcaacagaggagagcaactatgtttgataataacctggcggcagcgcaaaagatg

SEQ ID NO: 53972 - DNA, 103 bp, Artificial Sequence
  Synthetic Polynucleotide
taatacgactcactatagggaaagtctcaagagtcgtattatcaaagacaaacagaggagatgtcttatgtaatacgacaacctggcggcagcgcaaaagatg

SEQ ID NO: 53973 - DNA, 103 bp, Artificial Sequence
  Synthetic Polynucleotide
taatacgactcactatagggggactaaagtctcaagagtcgtattatcaaaacagaggagattgataatgcgactcttgaacctggcggcagcgcaaaagatg

SEQ ID NO: 53974 - DNA, 103 bp, Artificial Sequence
  Synthetic Polynucleotide
taatacgactcactatagggaaataggactaaagtctcaagagtcgtattaacagaggagaaatacgatgcttgagactaacctggcggcagcgcaaaagatg

SEQ ID NO: 53975 - DNA, 103 bp, Artificial Sequence
  Synthetic Polynucleotide
taatacgactcactataggggattgaaataggactaaagtctcaagagtcaacagaggagagactctatggactttagtaacctggcggcagcgcaaaagatg

SEQ ID NO: 53976 - DNA, 103 bp, Artificial Sequence
  Synthetic Polynucleotide
taatacgactcactataggggaagcgattgaaataggactaaagtctcaaaacagaggagattgagaatgtagtcctataacctggcggcagcgcaaaagatg

SEQ ID NO: 53977 - DNA, 103 bp, Artificial Sequence
  Synthetic Polynucleotide
taatacgactcactatagggaggatgaagcgattgaaataggactaaagtaacagaggagaactttaatgctatttcaaaacctggcggcagcgcaaaagatg

SEQ ID NO: 53978 - DNA, 103 bp, Artificial Sequence
  Synthetic Polynucleotide
taatacgactcactatagggaaaaaaggatgaagcgattgaaataggactaacagaggagaagtcctatgtcaatcgctaacctggcggcagcgcaaaagatg

SEQ ID NO: 53979 - DNA, 103 bp, Artificial Sequence
  Synthetic Polynucleotide
taatacgactcactataggggatataaaaaaggatgaagcgattgaaataaacagaggagatatttcatgcgcttcatcaacctggcggcagcgcaaaagatg

SEQ ID NO: 53980 - DNA, 103 bp, Artificial Sequence
  Synthetic Polynucleotide
taatacgactcactatagggatctggatataaaaaaggatgaagcgattgaacagaggagacaatcgatgcatccttttaacctggcggcagcgcaaaagatg

SEQ ID NO: 53981 - DNA, 103 bp, Artificial Sequence
  Synthetic Polynucleotide
taatacgactcactatagggatacgtatatgaacagattagatctcgataaacagaggagatatcgaatgctaatctgtaacctggcggcagcgcaaaagatg

SEQ ID NO: 53982 - DNA, 103 bp, Artificial Sequence
  Synthetic Polynucleotide
taatacgactcactatagggaaaggatctggatataaaaaaggatgaagcaacagaggagagcttcaatgttttttataaacctggcggcagcgcaaaagatg

SEQ ID NO: 53983 - DNA, 103 bp, Artificial Sequence
  Synthetic Polynucleotide
taatacgactcactataggggaagaaaaggatctggatataaaaaaggataacagaggagaatccttatgtatatccagaacctggcggcagcgcaaaagatg

SEQ ID NO: 53984 - DNA, 103 bp, Artificial Sequence
  Synthetic Polynucleotide
taatacgactcactatagggattctgaagaaaaggatctggatataaaaaaacagaggagatttttaatgccagatcctaacctggcggcagcgcaaaagatg

SEQ ID NO: 53985 - DNA, 103 bp, Artificial Sequence
  Synthetic Polynucleotide
taatacgactcactatagggctattattctgaagaaaaggatctggatataacagaggagaatatccatgtccttttctaacctggcggcagcgcaaaagatg

SEQ ID NO: 53986 - DNA, 103 bp, Artificial Sequence
  Synthetic Polynucleotide
taatacgactcactatagggtcaatctattattctgaagaaaaggatctgaacagaggagacagatcatgttcttcagaaacctggcggcagcgcaaaagatg

SEQ ID NO: 53987 - DNA, 103 bp, Artificial Sequence
  Synthetic Polynucleotide
taatacgactcactatagggagtcgtcaatctattattctgaagaaaaggaacagaggagaccttttatgcagaataataacctggcggcagcgcaaaagatg

SEQ ID NO: 53988 - DNA, 103 bp, Artificial Sequence
  Synthetic Polynucleotide
taatacgactcactatagggaccaaagtcgtcaatctattattctgaagaaacagaggagatcttcaatgtaatagattaacctggcggcagcgcaaaagatg

SEQ ID NO: 53989 - DNA, 103 bp, Artificial Sequence
  Synthetic Polynucleotide
taatacgactcactatagggtctacaccaaagtcgtcaatctattattctaacagaggagaagaataatggattgacgaaacctggcggcagcgcaaaagatg

SEQ ID NO: 53990 - DNA, 103 bp, Artificial Sequence
  Synthetic Polynucleotide
taatacgactcactatagggaatcctctacaccaaagtcgtcaatctattaacagaggagaaatagaatgacgactttgaacctggcggcagcgcaaaagatg

SEQ ID NO: 53991 - DNA, 103 bp, Artificial Sequence
  Synthetic Polynucleotide
taatacgactcactatagggggcagaatcctctacaccaaagtcgtcaataacagaggagaattgacatgtttggtgtaaacctggcggcagcgcaaaagatg

SEQ ID NO: 53992 - DNA, 103 bp, Artificial Sequence
  Synthetic Polynucleotide
taatacgactcactatagggcatggatacgtatatgaacagattagatctaacagaggagaagatctatgctgttcataaacctggcggcagcgcaaaagatg

SEQ ID NO: 53993 - DNA, 103 bp, Artificial Sequence
  Synthetic Polynucleotide
taatacgactcactataggggggttggcagaatcctctacaccaaagtcgaacagaggagacgacttatgtgtagaggaaacctggcggcagcgcaaaagatg

SEQ ID NO: 53994 - DNA, 103 bp, Artificial Sequence
  Synthetic Polynucleotide
taatacgactcactatagggcacaggggttggcagaatcctctacaccaaaacagaggagattggtgatgaggattctgaacctggcggcagcgcaaaagatg

SEQ ID NO: 53995 - DNA, 103 bp, Artificial Sequence
  Synthetic Polynucleotide
taatacgactcactataggggttctcacaggggttggcagaatcctctacaacagaggagagtagagatgtctgccaacaacctggcggcagcgcaaaagatg

SEQ ID NO: 53996 - DNA, 103 bp, Artificial Sequence
  Synthetic Polynucleotide
taatacgactcactatagggaacaagttctcacaggggttggcagaatccaacagaggagaggattcatgcaacccctgaacctggcggcagcgcaaaagatg

SEQ ID NO: 53997 - DNA, 103 bp, Artificial Sequence
  Synthetic Polynucleotide
taatacgactcactatagggtctttaacaagttctcacaggggttggcagaacagaggagactgccaatgcctgtgagaaacctggcggcagcgcaaaagatg

SEQ ID NO: 53998 - DNA, 103 bp, Artificial Sequence
  Synthetic Polynucleotide
taatacgactcactatagggggacttctttaacaagttctcacaggggttaacagaggagaaaccccatggagaacttgaacctggcggcagcgcaaaagatg

SEQ ID NO: 53999 - DNA, 103 bp, Artificial Sequence
  Synthetic Polynucleotide
taatacgactcactatagggtaaatggacttctttaacaagttctcacagaacagaggagactgtgaatgcttgttaaaaacctggcggcagcgcaaaagatg

SEQ ID NO: 54000 - DNA, 103 bp, Artificial Sequence
  Synthetic Polynucleotide
taatacgactcactatagggagccttaaatggacttctttaacaagttctaacagaggagaagaactatgtaaagaagtaacctggcggcagcgcaaaagatg

SEQ ID NO: 54001 - DNA, 103 bp, Artificial Sequence
  Synthetic Polynucleotide
taatacgactcactatagggtttaaagccttaaatggacttctttaacaaaacagaggagattgttaatgaagtccattaacctggcggcagcgcaaaagatg

SEQ ID NO: 54002 - DNA, 103 bp, Artificial Sequence
  Synthetic Polynucleotide
taatacgactcactatagggtcaattttaaagccttaaatggacttctttaacagaggagaaaagaaatgcatttaaggaacctggcggcagcgcaaaagatg

SEQ ID NO: 54003 - DNA, 103 bp, Artificial Sequence
  Synthetic Polynucleotide
taatacgactcactataggggcaatcatggatacgtatatgaacagattaaacagaggagataatctatgcatatacgtaacctggcggcagcgcaaaagatg

SEQ ID NO: 54004 - DNA, 103 bp, Artificial Sequence
  Synthetic Polynucleotide
taatacgactcactataggggcaattcaattttaaagccttaaatggactaacagaggagaagtccaatgaaggctttaaacctggcggcagcgcaaaagatg

SEQ ID NO: 54005 - DNA, 103 bp, Artificial Sequence
  Synthetic Polynucleotide
taatacgactcactatagggtaatcgcaattcaattttaaagccttaaataacagaggagaatttaaatgtttaaaattaacctggcggcagcgcaaaagatg

SEQ ID NO: 54006 - DNA, 103 bp, Artificial Sequence
  Synthetic Polynucleotide
taatacgactcactatagggtcttataatcgcaattcaattttaaagcctaacagaggagaaggcttatgaattgaattaacctggcggcagcgcaaaagatg

SEQ ID NO: 54007 - DNA, 103 bp, Artificial Sequence
  Synthetic Polynucleotide
taatacgactcactatagggtttaatcttataatcgcaattcaattttaaaacagaggagattaaaaatgaattgcgataacctggcggcagcgcaaaagatg

SEQ ID NO: 54008 - DNA, 103 bp, Artificial Sequence
  Synthetic Polynucleotide
taatacgactcactatagggtgccatttaatcttataatcgcaattcaataacagaggagaattgaaatgcgattataaaacctggcggcagcgcaaaagatg

SEQ ID NO: 54009 - DNA, 103 bp, Artificial Sequence
  Synthetic Polynucleotide
taatacgactcactataggggtgtctgccatttaatcttataatcgcaataacagaggagaattgcgatgataagattaaacctggcggcagcgcaaaagatg

SEQ ID NO: 54010 - DNA, 103 bp, Artificial Sequence
  Synthetic Polynucleotide
taatacgactcactatagggcgtctgtgtctgccatttaatcttataatcaacagaggagagattatatgattaaatggaacctggcggcagcgcaaaagatg

SEQ ID NO: 54011 - DNA, 103 bp, Artificial Sequence
  Synthetic Polynucleotide
taatacgactcactatagggaatatcgtctgtgtctgccatttaatcttaaacagaggagataagatatgatggcagacaacctggcggcagcgcaaaagatg

SEQ ID NO: 54012 - DNA, 103 bp, Artificial Sequence
  Synthetic Polynucleotide
taatacgactcactatagggtcgataatatcgtctgtgtctgccatttaaaacagaggagattaaatatgagacacagaaacctggcggcagcgcaaaagatg

SEQ ID NO: 54013 - DNA, 103 bp, Artificial Sequence
  Synthetic Polynucleotide
taatacgactcactatagggcatagtcgataatatcgtctgtgtctgccaaacagaggagatggcagatgcagacgataaacctggcggcagcgcaaaagatg

SEQ ID NO: 54014 - DNA, 103 bp, Artificial Sequence
  Synthetic Polynucleotide
taatacgactcactatagggataacttatcaaaacatatagatagacgagaacagaggagactcgtcatgctatatgttaacctggcggcagcgcaaaagatg

SEQ ID NO: 54015 - DNA, 103 bp, Artificial Sequence
  Synthetic Polynucleotide
taatacgactcactatagggtgtactccacgttagaaactattatatacaaacagaggagatgtataatgtagtttctaaacctggcggcagcgcaaaagatg

SEQ ID NO: 54016 - DNA, 103 bp, Artificial Sequence
  Synthetic Polynucleotide
taatacgactcactatagggaccgcgcaatcatggatacgtatatgaacaaacagaggagatgttcaatgacgtatccaaacctggcggcagcgcaaaagatg

SEQ ID NO: 54017 - DNA, 103 bp, Artificial Sequence
  Synthetic Polynucleotide
taatacgactcactatagggggattcatagtcgataatatcgtctgtgtcaacagaggagagacacaatggatattatcaacctggcggcagcgcaaaagatg

SEQ ID NO: 54018 - DNA, 103 bp, Artificial Sequence
  Synthetic Polynucleotide
taatacgactcactatagggtcatcggattcatagtcgataatatcgtctaacagaggagaagacgaatgtatcgactaaacctggcggcagcgcaaaagatg

SEQ ID NO: 54019 - DNA, 103 bp, Artificial Sequence
  Synthetic Polynucleotide
taatacgactcactatagggtgagatcatcggattcatagtcgataatataacagaggagaatattaatgactatgaataacctggcggcagcgcaaaagatg

SEQ ID NO: 54020 - DNA, 103 bp, Artificial Sequence
  Synthetic Polynucleotide
taatacgactcactatagggttcagtgagatcatcggattcatagtcgataacagaggagaatcgacatggaatccgataacctggcggcagcgcaaaagatg

SEQ ID NO: 54021 - DNA, 103 bp, Artificial Sequence
  Synthetic Polynucleotide
taatacgactcactatagggtcgtattcagtgagatcatcggattcatagaacagaggagactatgaatgcgatgatctaacctggcggcagcgcaaaagatg

SEQ ID NO: 54022 - DNA, 103 bp, Artificial Sequence
  Synthetic Polynucleotide
taatacgactcactatagggcatcctcgtattcagtgagatcatcggattaacagaggagaaatccgatgatctcactgaacctggcggcagcgcaaaagatg

SEQ ID NO: 54023 - DNA, 103 bp, Artificial Sequence
  Synthetic Polynucleotide
taatacgactcactatagggatcatcatcctcgtattcagtgagatcatcaacagaggagagatgatatgactgaatacaacctggcggcagcgcaaaagatg

SEQ ID NO: 54024 - DNA, 103 bp, Artificial Sequence
  Synthetic Polynucleotide
taatacgactcactatagggtcttcatcatcatcctcgtattcagtgagaaacagaggagatctcacatgatacgaggaaacctggcggcagcgcaaaagatg

SEQ ID NO: 54025 - DNA, 103 bp, Artificial Sequence
  Synthetic Polynucleotide
taatacgactcactatagggcttcctcttcatcatcatcctcgtattcagaacagaggagactgaatatgaggatgatgaacctggcggcagcgcaaaagatg

SEQ ID NO: 54026 - DNA, 103 bp, Artificial Sequence
  Synthetic Polynucleotide
taatacgactcactatagggatcttcttcctcttcatcatcatcctcgtaaacagaggagatacgagatggatgatgaaaacctggcggcagcgcaaaagatg

SEQ ID NO: 54027 - DNA, 103 bp, Artificial Sequence
  Synthetic Polynucleotide
taatacgactcactatagggaacgtaccgcgcaatcatggatacgtatataacagaggagaatatacatgtccatgattaacctggcggcagcgcaaaagatg

SEQ ID NO: 54028 - DNA, 103 bp, Artificial Sequence
  Synthetic Polynucleotide
taatacgactcactatagggtctccatcttcttcctcttcatcatcatccaacagaggagaggatgaatgtgaagaggaaacctggcggcagcgcaaaagatg

SEQ ID NO: 54029 - DNA, 103 bp, Artificial Sequence
  Synthetic Polynucleotide
taatacgactcactataggggtgactctccatcttcttcctcttcatcataacagaggagaatgatgatgaggaagaagaacctggcggcagcgcaaaagatg

SEQ ID NO: 54030 - DNA, 103 bp, Artificial Sequence
  Synthetic Polynucleotide
taatacgactcactatagggttctagtgactctccatcttcttcctcttcaacagaggagagaagagatggaagatggaaacctggcggcagcgcaaaagatg

SEQ ID NO: 54031 - DNA, 103 bp, Artificial Sequence
  Synthetic Polynucleotide
taatacgactcactatagggctagtttctagtgactctccatcttcttccaacagaggagaggaagaatgtggagagtcaacctggcggcagcgcaaaagatg

SEQ ID NO: 54032 - DNA, 103 bp, Artificial Sequence
  Synthetic Polynucleotide
taatacgactcactatagggtatcactagtttctagtgactctccatcttaacagaggagaaagatgatgagtcactagaacctggcggcagcgcaaaagatg

SEQ ID NO: 54033 - DNA, 103 bp, Artificial Sequence
  Synthetic Polynucleotide
taatacgactcactatagggatctatatcactagtttctagtgactctccaacagaggagaggagagatgctagaaactaacctggcggcagcgcaaaagatg

SEQ ID NO: 54034 - DNA, 103 bp, Artificial Sequence
  Synthetic Polynucleotide
taatacgactcactatagggttgggatctatatcactagtttctagtgacaacagaggagagtcactatgaactagtgaaacctggcggcagcgcaaaagatg

SEQ ID NO: 54035 - DNA, 103 bp, Artificial Sequence
  Synthetic Polynucleotide
taatacgactcactatagggaagatttgggatctatatcactagtttctaaacagaggagatagaaaatggtgatatagaacctggcggcagcgcaaaagatg

SEQ ID NO: 54036 - DNA, 103 bp, Artificial Sequence
  Synthetic Polynucleotide
taatacgactcactatagggataagaagatttgggatctatatcactagtaacagaggagaactagtatgatagatcccaacctggcggcagcgcaaaagatg

SEQ ID NO: 54037 - DNA, 103 bp, Artificial Sequence
  Synthetic Polynucleotide
taatacgactcactatagggatcttataagaagatttgggatctatatcaaacagaggagatgatatatgtcccaaatcaacctggcggcagcgcaaaagatg

SEQ ID NO: 54038 - DNA, 103 bp, Artificial Sequence
  Synthetic Polynucleotide
taatacgactcactatagggatcataacgtaccgcgcaatcatggatacgaacagaggagacgtatcatggattgcgcgaacctggcggcagcgcaaaagatg

SEQ ID NO: 54039 - DNA, 103 bp, Artificial Sequence
  Synthetic Polynucleotide
taatacgactcactatagggctacaatcttataagaagatttgggatctaaacagaggagatagatcatgaatcttcttaacctggcggcagcgcaaaagatg

SEQ ID NO: 54040 - DNA, 103 bp, Artificial Sequence
  Synthetic Polynucleotide
taatacgactcactatagggtgattctacaatcttataagaagatttgggaacagaggagacccaaaatgtcttataagaacctggcggcagcgcaaaagatg

SEQ ID NO: 54041 - DNA, 103 bp, Artificial Sequence
  Synthetic Polynucleotide
taatacgactcactataggggatgctgattctacaatcttataagaagataacagaggagaatcttcatgtaagattgtaacctggcggcagcgcaaaagatg

SEQ ID NO: 54042 - DNA, 103 bp, Artificial Sequence
  Synthetic Polynucleotide
taatacgactcactataggggagtggatgctgattctacaatcttataagaacagaggagacttataatgttgtagaataacctggcggcagcgcaaaagatg

SEQ ID NO: 54043 - DNA, 103 bp, Artificial Sequence
  Synthetic Polynucleotide
taatacgactcactatagggtatatgagtggatgctgattctacaatcttaacagaggagaaagattatggaatcagcaaacctggcggcagcgcaaaagatg

SEQ ID NO: 54044 - DNA, 103 bp, Artificial Sequence
  Synthetic Polynucleotide
taatacgactcactatagggtcttctatatgagtggatgctgattctacaaacagaggagatgtagaatgagcatccacaacctggcggcagcgcaaaagatg

SEQ ID NO: 54045 - DNA, 103 bp, Artificial Sequence
  Synthetic Polynucleotide
taatacgactcactataggggtgcatcttctatatgagtggatgctgattaacagaggagaaatcagatgccactcataaacctggcggcagcgcaaaagatg

SEQ ID NO: 54046 - DNA, 103 bp, Artificial Sequence
  Synthetic Polynucleotide
taatacgactcactatagggggaatgtgcatcttctatatgagtggatgcaacagaggagagcatccatgcatatagaaaacctggcggcagcgcaaaagatg

SEQ ID NO: 54047 - DNA, 103 bp, Artificial Sequence
  Synthetic Polynucleotide
taatacgactcactatagggagattggaatgtgcatcttctatatgagtgaacagaggagacactcaatgagaagatgcaacctggcggcagcgcaaaagatg

SEQ ID NO: 54048 - DNA, 103 bp, Artificial Sequence
  Synthetic Polynucleotide
taatacgactcactataggggtttaagattggaatgtgcatcttctatataacagaggagaatatagatgatgcacattaacctggcggcagcgcaaaagatg

SEQ ID NO: 54049 - DNA, 103 bp, Artificial Sequence
  Synthetic Polynucleotide
taatacgactcactatagggcggctatcataacgtaccgcgcaatcatggaacagaggagaccatgaatgcgcggtacgaacctggcggcagcgcaaaagatg

SEQ ID NO: 54050 - DNA, 103 bp, Artificial Sequence
  Synthetic Polynucleotide
taatacgactcactatagggtatatgtttaagattggaatgtgcatcttcaacagaggagagaagatatgcattccaataacctggcggcagcgcaaaagatg

SEQ ID NO: 54051 - DNA, 103 bp, Artificial Sequence
  Synthetic Polynucleotide
taatacgactcactatagggttccctatatgtttaagattggaatgtgcaaacagaggagatgcacaatgcaatcttaaaacctggcggcagcgcaaaagatg

SEQ ID NO: 54052 - DNA, 103 bp, Artificial Sequence
  Synthetic Polynucleotide
taatacgactcactatagggtatgattccctatatgtttaagattggaataacagaggagaattccaatgttaaacataaacctggcggcagcgcaaaagatg

SEQ ID NO: 54053 - DNA, 103 bp, Artificial Sequence
  Synthetic Polynucleotide
taatacgactcactatagggagatatatgattccctatatgtttaagattaacagaggagaaatcttatgcatatagggaacctggcggcagcgcaaaagatg

SEQ ID NO: 54054 - DNA, 103 bp, Artificial Sequence
  Synthetic Polynucleotide
taatacgactcactatagggagagcagatatatgattccctatatgtttaaacagaggagataaacaatgagggaatcaaacctggcggcagcgcaaaagatg

SEQ ID NO: 54055 - DNA, 103 bp, Artificial Sequence
  Synthetic Polynucleotide
taatacgactcactataggggtttaagagcagatatatgattccctatataacagaggagaatatagatgatcatatataacctggcggcagcgcaaaagatg

SEQ ID NO: 54056 - DNA, 103 bp, Artificial Sequence
  Synthetic Polynucleotide
taatacgactcactataggggcgtcgtttaagagcagatatatgattcccaacagaggagagggaatatgatatctgctaacctggcggcagcgcaaaagatg

SEQ ID NO: 54057 - DNA, 103 bp, Artificial Sequence
  Synthetic Polynucleotide
taatacgactcactataggggtatagcgtcgtttaagagcagatatatgaaacagaggagatcatatatgtgctcttaaaacctggcggcagcgcaaaagatg

SEQ ID NO: 54058 - DNA, 103 bp, Artificial Sequence
  Synthetic Polynucleotide
taatacgactcactataggggtctagtatagcgtcgtttaagagcagataaacagaggagatatctgatgttaaacgacaacctggcggcagcgcaaaagatg

SEQ ID NO: 54059 - DNA, 103 bp, Artificial Sequence
  Synthetic Polynucleotide
taatacgactcactatagggtatacgtctagtatagcgtcgtttaagagcaacagaggagagctcttatgcgacgctataacctggcggcagcgcaaaagatg

SEQ ID NO: 54060 - DNA, 103 bp, Artificial Sequence
  Synthetic Polynucleotide
taatacgactcactatagggttatgcggctatcataacgtaccgcgcaataacagaggagaattgcgatgtacgttatgaacctggcggcagcgcaaaagatg

SEQ ID NO: 54061 - DNA, 103 bp, Artificial Sequence
  Synthetic Polynucleotide
taatacgactcactatagggagacttatacgtctagtatagcgtcgtttaaacagaggagataaacgatgctatactagaacctggcggcagcgcaaaagatg

SEQ ID NO: 54062 - DNA, 103 bp, Artificial Sequence
  Synthetic Polynucleotide
taatacgactcactatagggcaaatagacttatacgtctagtatagcgtcaacagaggagagacgctatgctagacgtaaacctggcggcagcgcaaaagatg

SEQ ID NO: 54063 - DNA, 103 bp, Artificial Sequence
  Synthetic Polynucleotide
taatacgactcactatagggtatttcaaatagacttatacgtctagtataaacagaggagatatactatgcgtataagtaacctggcggcagcgcaaaagatg

SEQ ID NO: 54064 - DNA, 103 bp, Artificial Sequence
  Synthetic Polynucleotide
taatacgactcactatagggcccgctatttcaaatagacttatacgtctaaacagaggagatagacgatgaagtctattaacctggcggcagcgcaaaagatg

SEQ ID NO: 54065 - DNA, 103 bp, Artificial Sequence
  Synthetic Polynucleotide
taatacgactcactatagggttatacccgctatttcaaatagacttatacaacagaggagagtataaatgtatttgaaaaacctggcggcagcgcaaaagatg

SEQ ID NO: 54066 - DNA, 103 bp, Artificial Sequence
  Synthetic Polynucleotide
taatacgactcactatagggtgctattatacccgctatttcaaatagactaacagaggagaagtctaatggaaatagcgaacctggcggcagcgcaaaagatg

SEQ ID NO: 54067 - DNA, 103 bp, Artificial Sequence
  Synthetic Polynucleotide
taatacgactcactatagggctttctgctattatacccgctatttcaaataacagaggagaatttgaatgagcgggtataacctggcggcagcgcaaaagatg

SEQ ID NO: 54068 - DNA, 103 bp, Artificial Sequence
  Synthetic Polynucleotide
taatacgactcactatagggtatagctttctgctattatacccgctatttaacagaggagaaaatagatggtataatagaacctggcggcagcgcaaaagatg

SEQ ID NO: 54069 - DNA, 103 bp, Artificial Sequence
  Synthetic Polynucleotide
taatacgactcactatagggcaagttatagctttctgctattatacccgcaacagaggagagcgggtatgatagcagaaaacctggcggcagcgcaaaagatg

SEQ ID NO: 54070 - DNA, 103 bp, Artificial Sequence
  Synthetic Polynucleotide
taatacgactcactatagggtgaagcaagttatagctttctgctattataaacagaggagatataatatgagaaagctaaacctggcggcagcgcaaaagatg

SEQ ID NO: 54071 - DNA, 103 bp, Artificial Sequence
  Synthetic Polynucleotide
taatacgactcactatagggttattttatgcggctatcataacgtaccgcaacagaggagagcggtaatgtatgatagcaacctggcggcagcgcaaaagatg

SEQ ID NO: 54072 - DNA, 103 bp, Artificial Sequence
  Synthetic Polynucleotide
taatacgactcactatagggctcgttgaagcaagttatagctttctgctaaacagaggagatagcagatggctataactaacctggcggcagcgcaaaagatg

SEQ ID NO: 54073 - DNA, 103 bp, Artificial Sequence
  Synthetic Polynucleotide
taatacgactcactatagggtcttcctcgttgaagcaagttatagctttcaacagaggagagaaagcatgaacttgcttaacctggcggcagcgcaaaagatg

SEQ ID NO: 54074 - DNA, 103 bp, Artificial Sequence
  Synthetic Polynucleotide
taatacgactcactatagggggtaatcttcctcgttgaagcaagttatagaacagaggagactataaatggcttcaacgaacctggcggcagcgcaaaagatg

SEQ ID NO: 54075 - DNA, 103 bp, Artificial Sequence
  Synthetic Polynucleotide
taatacgactcactatagggctagaggtaatcttcctcgttgaagcaagtaacagaggagaacttgcatgaacgaggaaaacctggcggcagcgcaaaagatg

SEQ ID NO: 54076 - DNA, 103 bp, Artificial Sequence
  Synthetic Polynucleotide
taatacgactcactatagggtgaaactagaggtaatcttcctcgttgaagaacagaggagacttcaaatgggaagattaaacctggcggcagcgcaaaagatg

SEQ ID NO: 54077 - DNA, 103 bp, Artificial Sequence
  Synthetic Polynucleotide
taatacgactcactatagggaattctgaaactagaggtaatcttcctcgtaacagaggagaacgaggatgattacctctaacctggcggcagcgcaaaagatg

SEQ ID NO: 54078 - DNA, 103 bp, Artificial Sequence
  Synthetic Polynucleotide
taatacgactcactatagggtagaaaattctgaaactagaggtaatcttcaacagaggagagaagatatgctctagtttaacctggcggcagcgcaaaagatg

SEQ ID NO: 54079 - DNA, 103 bp, Artificial Sequence
  Synthetic Polynucleotide
taatacgactcactatagggttcgttagaaaattctgaaactagaggtaaaacagaggagattacctatggtttcagaaaacctggcggcagcgcaaaagatg

SEQ ID NO: 54080 - DNA, 103 bp, Artificial Sequence
  Synthetic Polynucleotide
taatacgactcactatagggatcgtttcgttagaaaattctgaaactagaaacagaggagatctagtatgagaattttcaacctggcggcagcgcaaaagatg

SEQ ID NO: 54081 - DNA, 103 bp, Artificial Sequence
  Synthetic Polynucleotide
taatacgactcactataggggcttcatcgtttcgttagaaaattctgaaaaacagaggagatttcagatgtttctaacgaacctggcggcagcgcaaaagatg

SEQ ID NO: 54082 - DNA, 103 bp, Artificial Sequence
  Synthetic Polynucleotide
taatacgactcactatagggggattttattttatgcggctatcataacgtaacagaggagaacgttaatgtagccgcataacctggcggcagcgcaaaagatg

SEQ ID NO: 54083 - DNA, 103 bp, Artificial Sequence
  Synthetic Polynucleotide
taatacgactcactatagggattttgcttcatcgtttcgttagaaaattcaacagaggagagaatttatgaacgaaacgaacctggcggcagcgcaaaagatg

SEQ ID NO: 54084 - DNA, 103 bp, Artificial Sequence
  Synthetic Polynucleotide
taatacgactcactatagggagcatattttgcttcatcgtttcgttagaaaacagaggagattctaaatgaacgatgaaaacctggcggcagcgcaaaagatg

SEQ ID NO: 54085 - DNA, 103 bp, Artificial Sequence
  Synthetic Polynucleotide
taatacgactcactatagggcatgtagcatattttgcttcatcgtttcgtaacagaggagaacgaaaatgtgaagcaaaaacctggcggcagcgcaaaagatg

SEQ ID NO: 54086 - DNA, 103 bp, Artificial Sequence
  Synthetic Polynucleotide
taatacgactcactatagggaattacatgtagcatattttgcttcatcgtaacagaggagaacgatgatgcaaaatatgaacctggcggcagcgcaaaagatg

SEQ ID NO: 54087 - DNA, 103 bp, Artificial Sequence
  Synthetic Polynucleotide
taatacgactcactatagggtgtataattacatgtagcatattttgcttcaacagaggagagaagcaatgtatgctacaaacctggcggcagcgcaaaagatg

SEQ ID NO: 54088 - DNA, 103 bp, Artificial Sequence
  Synthetic Polynucleotide
taatacgactcactatagggtctcttgtataattacatgtagcatattttaacagaggagaaaaataatgtacatgtaaaacctggcggcagcgcaaaagatg

SEQ ID NO: 54089 - DNA, 103 bp, Artificial Sequence
  Synthetic Polynucleotide
taatacgactcactatagggctctatctcttgtataattacatgtagcataacagaggagaatgctaatggtaattataaacctggcggcagcgcaaaagatg

SEQ ID NO: 54090 - DNA, 103 bp, Artificial Sequence
  Synthetic Polynucleotide
taatacgactcactatagggccctcctctatctcttgtataattacatgtaacagaggagaacatgtatgtatacaagaaacctggcggcagcgcaaaagatg

SEQ ID NO: 54091 - DNA, 103 bp, Artificial Sequence
  Synthetic Polynucleotide
taatacgactcactatagggaagaaccctcctctatctcttgtataattaaacagaggagataattaatgaagagatagaacctggcggcagcgcaaaagatg

SEQ ID NO: 54092 - DNA, 103 bp, Artificial Sequence
  Synthetic Polynucleotide
taatacgactcactatagggaggacaagaaccctcctctatctcttgtataacagaggagaatacaaatgatagaggagaacctggcggcagcgcaaaagatg

SEQ ID NO: 54093 - DNA, 103 bp, Artificial Sequence
  Synthetic Polynucleotide
taatacgactcactatagggaaaatggattttattttatgcggctatcataacagaggagaatgataatggcataaaataacctggcggcagcgcaaaagatg

SEQ ID NO: 54094 - DNA, 103 bp, Artificial Sequence
  Synthetic Polynucleotide
taatacgactcactatagggactataggacaagaaccctcctctatctctaacagaggagaagagatatgggagggttcaacctggcggcagcgcaaaagatg

SEQ ID NO: 54095 - DNA, 103 bp, Artificial Sequence
  Synthetic Polynucleotide
taatacgactcactatagggcgatgactataggacaagaaccctcctctaaacagaggagatagaggatggttcttgtcaacctggcggcagcgcaaaagatg

SEQ ID NO: 54096 - DNA, 103 bp, Artificial Sequence
  Synthetic Polynucleotide
taatacgactcactatagggcttttcgatgactataggacaagaaccctcaacagaggagagagggtatgtgtcctataaacctggcggcagcgcaaaagatg

SEQ ID NO: 54097 - DNA, 103 bp, Artificial Sequence
  Synthetic Polynucleotide
taatacgactcactatagggccgttcttttcgatgactataggacaagaaaacagaggagattcttgatgtatagtcataacctggcggcagcgcaaaagatg

SEQ ID NO: 54098 - DNA, 103 bp, Artificial Sequence
  Synthetic Polynucleotide
taatacgactcactatagggattctccgttcttttcgatgactataggacaacagaggagagtcctaatgtcatcgaaaaacctggcggcagcgcaaaagatg

SEQ ID NO: 54099 - DNA, 103 bp, Artificial Sequence
  Synthetic Polynucleotide
taatacgactcactatagggcaacaattctccgttcttttcgatgactataacagaggagaatagtcatggaaaagaacaacctggcggcagcgcaaaagatg

SEQ ID NO: 54100 - DNA, 103 bp, Artificial Sequence
  Synthetic Polynucleotide
taatacgactcactatagggaccgacaacaattctccgttcttttcgatgaacagaggagacatcgaatggaacggagaaacctggcggcagcgcaaaagatg

SEQ ID NO: 54101 - DNA, 103 bp, Artificial Sequence
  Synthetic Polynucleotide
taatacgactcactatagggcgtttaccgacaacaattctccgttcttttaacagaggagaaaaagaatggagaattgtaacctggcggcagcgcaaaagatg

SEQ ID NO: 54102 - DNA, 103 bp, Artificial Sequence
  Synthetic Polynucleotide
taatacgactcactatagggaaaatcgtttaccgacaacaattctccgttaacagaggagaaacggaatgttgttgtcgaacctggcggcagcgcaaaagatg

SEQ ID NO: 54103 - DNA, 103 bp, Artificial Sequence
  Synthetic Polynucleotide
taatacgactcactatagggttgtcaaaatcgtttaccgacaacaattctaacagaggagaagaattatggtcggtaaaaacctggcggcagcgcaaaagatg

SEQ ID NO: 54104 - DNA, 103 bp, Artificial Sequence
  Synthetic Polynucleotide
taatacgactcactatagggaaatgaaaatggattttattttatgcggctaacagaggagaagccgcatgaaataaaataacctggcggcagcgcaaaagatg

SEQ ID NO: 54105 - DNA, 103 bp, Artificial Sequence
  Synthetic Polynucleotide
taatacgactcactatagggcatctttgtcaaaatcgtttaccgacaacaaacagaggagatgttgtatgtaaacgattaacctggcggcagcgcaaaagatg

SEQ ID NO: 54106 - DNA, 103 bp, Artificial Sequence
  Synthetic Polynucleotide
taatacgactcactatagggcagaccatctttgtcaaaatcgtttaccgaaacagaggagatcggtaatggattttgacaacctggcggcagcgcaaaagatg

SEQ ID NO: 54107 - DNA, 103 bp, Artificial Sequence
  Synthetic Polynucleotide
taatacgactcactatagggaatttcagaccatctttgtcaaaatcgtttaacagaggagaaaacgaatgtgacaaagaaacctggcggcagcgcaaaagatg

SEQ ID NO: 54108 - DNA, 103 bp, Artificial Sequence
  Synthetic Polynucleotide
taatacgactcactataggggatggaatttcagaccatctttgtcaaaataacagaggagaattttgatgaagatggtcaacctggcggcagcgcaaaagatg

SEQ ID NO: 54109 - DNA, 103 bp, Artificial Sequence
  Synthetic Polynucleotide
taatacgactcactataggggtctagatggaatttcagaccatctttgtcaacagaggagagacaaaatgggtctgaaaaacctggcggcagcgcaaaagatg

SEQ ID NO: 54110 - DNA, 103 bp, Artificial Sequence
  Synthetic Polynucleotide
taatacgactcactatagggatatagtctagatggaatttcagaccatctaacagaggagaagatggatggaaattccaaacctggcggcagcgcaaaagatg

SEQ ID NO: 54111 - DNA, 103 bp, Artificial Sequence
  Synthetic Polynucleotide
taatacgactcactatagggtgataatatagtctagatggaatttcagacaacagaggagagtctgaatgtccatctagaacctggcggcagcgcaaaagatg

SEQ ID NO: 54112 - DNA, 103 bp, Artificial Sequence
  Synthetic Polynucleotide
taatacgactcactatagggaattttgataatatagtctagatggaatttaacagaggagaaaattcatgctagactataacctggcggcagcgcaaaagatg

SEQ ID NO: 54113 - DNA, 103 bp, Artificial Sequence
  Synthetic Polynucleotide
taatacgactcactatagggttccaaattttgataatatagtctagatggaacagaggagaccatctatgctatattataacctggcggcagcgcaaaagatg

SEQ ID NO: 54114 - DNA, 103 bp, Artificial Sequence
  Synthetic Polynucleotide
taatacgactcactataggggaagtttccaaattttgataatatagtctaaacagaggagatagactatgttatcaaaaaacctggcggcagcgcaaaagatg

SEQ ID NO: 54115 - DNA, 103 bp, Artificial Sequence
  Synthetic Polynucleotide
taatacgactcactataggggttaaaaatgaaaatggattttattttatgaacagaggagacataaaatgaaatccattaacctggcggcagcgcaaaagatg

SEQ ID NO: 54116 - DNA, 103 bp, Artificial Sequence
  Synthetic Polynucleotide
taatacgactcactatagggtttttgaagtttccaaattttgataatataaacagaggagatatattatgaaaatttggaacctggcggcagcgcaaaagatg

SEQ ID NO: 54117 - DNA, 103 bp, Artificial Sequence
  Synthetic Polynucleotide
taatacgactcactatagggtatcgtttttgaagtttccaaattttgataaacagaggagatatcaaatgttggaaactaacctggcggcagcgcaaaagatg

SEQ ID NO: 54118 - DNA, 103 bp, Artificial Sequence
  Synthetic Polynucleotide
taatacgactcactatagggtctaatatcgtttttgaagtttccaaatttaacagaggagaaaatttatgaacttcaaaaacctggcggcagcgcaaaagatg

SEQ ID NO: 54119 - DNA, 103 bp, Artificial Sequence
  Synthetic Polynucleotide
taatacgactcactatagggtaaattctaatatcgtttttgaagtttccaaacagaggagatggaaaatgcaaaaacgaaacctggcggcagcgcaaaagatg

SEQ ID NO: 54120 - DNA, 103 bp, Artificial Sequence
  Synthetic Polynucleotide
taatacgactcactatagggtcgtataaattctaatatcgtttttgaagtaacagaggagaacttcaatgacgatattaaacctggcggcagcgcaaaagatg

SEQ ID NO: 54121 - DNA, 103 bp, Artificial Sequence
  Synthetic Polynucleotide
taatacgactcactataggggatattcgtataaattctaatatcgtttttaacagaggagaaaaaacatgattagaattaacctggcggcagcgcaaaagatg

SEQ ID NO: 54122 - DNA, 103 bp, Artificial Sequence
  Synthetic Polynucleotide
taatacgactcactatagggagaacgatattcgtataaattctaatatcgaacagaggagacgatatatgaatttatacaacctggcggcagcgcaaaagatg

SEQ ID NO: 54123 - DNA, 103 bp, Artificial Sequence
  Synthetic Polynucleotide
taatacgactcactatagggtttagagaacgatattcgtataaattctaaaacagaggagattagaaatgatacgaataaacctggcggcagcgcaaaagatg

SEQ ID NO: 54124 - DNA, 103 bp, Artificial Sequence
  Synthetic Polynucleotide
taatacgactcactatagggtgacatttagagaacgatattcgtataaataacagaggagaatttatatgaatatcgttaacctggcggcagcgcaaaagatg

SEQ ID NO: 54125 - DNA, 103 bp, Artificial Sequence
  Synthetic Polynucleotide
taatacgactcactataggggattgtgacatttagagaacgatattcgtaaacagaggagatacgaaatgcgttctctaaacctggcggcagcgcaaaagatg

SEQ ID NO: 54126 - DNA, 103 bp, Artificial Sequence
  Synthetic Polynucleotide
taatacgactcactatagggaattctgtactccacgttagaaactattataacagaggagaataataatgtctaacgtgaacctggcggcagcgcaaaagatg

SEQ ID NO: 54127 - DNA, 103 bp, Artificial Sequence
  Synthetic Polynucleotide
taatacgactcactatagggtattggttaaaaatgaaaatggattttattaacagaggagaaataaaatgcattttcataacctggcggcagcgcaaaagatg

SEQ ID NO: 54128 - DNA, 103 bp, Artificial Sequence
  Synthetic Polynucleotide
taatacgactcactataggggacttgattgtgacatttagagaacgatataacagaggagaatatcgatgtctaaatgtaacctggcggcagcgcaaaagatg

SEQ ID NO: 54129 - DNA, 103 bp, Artificial Sequence
  Synthetic Polynucleotide
taatacgactcactatagggtgagagacttgattgtgacatttagagaacaacagaggagagttctcatgatgtcacaaaacctggcggcagcgcaaaagatg

SEQ ID NO: 54130 - DNA, 103 bp, Artificial Sequence
  Synthetic Polynucleotide
taatacgactcactatagggaaatatgagagacttgattgtgacatttagaacagaggagactaaatatgacaatcaagaacctggcggcagcgcaaaagatg

SEQ ID NO: 54131 - DNA, 103 bp, Artificial Sequence
  Synthetic Polynucleotide
taatacgactcactatagggctgctaaatatgagagacttgattgtgacaaacagaggagatgtcacatgcaagtctctaacctggcggcagcgcaaaagatg

SEQ ID NO: 54132 - DNA, 103 bp, Artificial Sequence
  Synthetic Polynucleotide
taatacgactcactatagggataacctgctaaatatgagagacttgattgaacagaggagacaatcaatgctctcatataacctggcggcagcgcaaaagatg

SEQ ID NO: 54133 - DNA, 103 bp, Artificial Sequence
  Synthetic Polynucleotide
taatacgactcactatagggcgacaataacctgctaaatatgagagacttaacagaggagaaagtctatgatatttagcaacctggcggcagcgcaaaagatg

SEQ ID NO: 54134 - DNA, 103 bp, Artificial Sequence
  Synthetic Polynucleotide
taatacgactcactatagggaagtacgacaataacctgctaaatatgagaaacagaggagatctcatatgtagcaggttaacctggcggcagcgcaaaagatg

SEQ ID NO: 54135 - DNA, 103 bp, Artificial Sequence
  Synthetic Polynucleotide
taatacgactcactatagggatataaagtacgacaataacctgctaaataaacagaggagatatttaatgggttattgtaacctggcggcagcgcaaaagatg

SEQ ID NO: 54136 - DNA, 103 bp, Artificial Sequence
  Synthetic Polynucleotide
taatacgactcactatagggacacgatataaagtacgacaataacctgctaacagaggagaagcaggatgttgtcgtacaacctggcggcagcgcaaaagatg

SEQ ID NO: 54137 - DNA, 103 bp, Artificial Sequence
  Synthetic Polynucleotide
taatacgactcactatagggaatgaacacgatataaagtacgacaataacaacagaggagagttattatggtactttataacctggcggcagcgcaaaagatg

SEQ ID NO: 54138 - DNA, 103 bp, Artificial Sequence
  Synthetic Polynucleotide
taatacgactcactataggggatagtattggttaaaaatgaaaatggattaacagaggagaaatccaatgtcatttttaaacctggcggcagcgcaaaagatg

SEQ ID NO: 54139 - DNA, 103 bp, Artificial Sequence
  Synthetic Polynucleotide
taatacgactcactatagggtcgttaatgaacacgatataaagtacgacaaacagaggagatgtcgtatgttatatcgtaacctggcggcagcgcaaaagatg

SEQ ID NO: 54140 - DNA, 103 bp, Artificial Sequence
  Synthetic Polynucleotide
taatacgactcactatagggaaatatcgttaatgaacacgatataaagtaaacagaggagatactttatgtcgtgttcaaacctggcggcagcgcaaaagatg

SEQ ID NO: 54141 - DNA, 103 bp, Artificial Sequence
  Synthetic Polynucleotide
taatacgactcactatagggttgcaaaatatcgttaatgaacacgatataaacagaggagatatatcatgttcattaacaacctggcggcagcgcaaaagatg

SEQ ID NO: 54142 - DNA, 103 bp, Artificial Sequence
  Synthetic Polynucleotide
taatacgactcactatagggctattttgcaaaatatcgttaatgaacacgaacagaggagacgtgttatgtaacgatataacctggcggcagcgcaaaagatg

SEQ ID NO: 54143 - DNA, 103 bp, Artificial Sequence
  Synthetic Polynucleotide
taatacgactcactatagggcattactattttgcaaaatatcgttaatgaaacagaggagatcattaatgatattttgcaacctggcggcagcgcaaaagatg

SEQ ID NO: 54144 - DNA, 103 bp, Artificial Sequence
  Synthetic Polynucleotide
taatacgactcactatagggagaatcattactattttgcaaaatatcgttaacagaggagaaacgatatgttgcaaaataacctggcggcagcgcaaaagatg

SEQ ID NO: 54145 - DNA, 103 bp, Artificial Sequence
  Synthetic Polynucleotide
taatacgactcactatagggaagatagaatcattactattttgcaaaataaacagaggagatattttatgaaatagtaaaacctggcggcagcgcaaaagatg

SEQ ID NO: 54146 - DNA, 103 bp, Artificial Sequence
  Synthetic Polynucleotide
taatacgactcactataggggaaggaagatagaatcattactattttgcaaacagaggagatgcaaaatggtaatgattaacctggcggcagcgcaaaagatg

SEQ ID NO: 54147 - DNA, 103 bp, Artificial Sequence
  Synthetic Polynucleotide
taatacgactcactatagggctatcgaaggaagatagaatcattactattaacagaggagaaatagtatggattctatcaacctggcggcagcgcaaaagatg

SEQ ID NO: 54148 - DNA, 103 bp, Artificial Sequence
  Synthetic Polynucleotide
taatacgactcactatagggaatatctatcgaaggaagatagaatcattaaacagaggagataatgaatgtatcttcctaacctggcggcagcgcaaaagatg

SEQ ID NO: 54149 - DNA, 103 bp, Artificial Sequence
  Synthetic Polynucleotide
taatacgactcactataggggaggagatagtattggttaaaaatgaaaataacagaggagaattttcatgtttaaccaaaacctggcggcagcgcaaaagatg

SEQ ID NO: 54150 - DNA, 103 bp, Artificial Sequence
  Synthetic Polynucleotide
taatacgactcactatagggtgaagaatatctatcgaaggaagatagaataacagaggagaattctaatgtccttcgataacctggcggcagcgcaaaagatg

SEQ ID NO: 54151 - DNA, 103 bp, Artificial Sequence
  Synthetic Polynucleotide
taatacgactcactatagggatctctgaagaatatctatcgaaggaagataacagaggagaatcttcatgcgatagataaacctggcggcagcgcaaaagatg

SEQ ID NO: 54152 - DNA, 103 bp, Artificial Sequence
  Synthetic Polynucleotide
taatacgactcactatagggcaataatctctgaagaatatctatcgaaggaacagaggagaccttcgatggatattcttaacctggcggcagcgcaaaagatg

SEQ ID NO: 54153 - DNA, 103 bp, Artificial Sequence
  Synthetic Polynucleotide
taatacgactcactatagggtaagacaataatctctgaagaatatctatcaacagaggagagatagaatgtcttcagagaacctggcggcagcgcaaaagatg

SEQ ID NO: 54154 - DNA, 103 bp, Artificial Sequence
  Synthetic Polynucleotide
taatacgactcactataggggaatataagacaataatctctgaagaatataacagaggagaatattcatgagagattataacctggcggcagcgcaaaagatg

SEQ ID NO: 54155 - DNA, 103 bp, Artificial Sequence
  Synthetic Polynucleotide
taatacgactcactatagggagaaagaatataagacaataatctctgaagaacagaggagacttcagatgttattgtctaacctggcggcagcgcaaaagatg

SEQ ID NO: 54156 - DNA, 103 bp, Artificial Sequence
  Synthetic Polynucleotide
taatacgactcactatagggtaacaagaaagaatataagacaataatctcaacagaggagagagattatggtcttatataacctggcggcagcgcaaaagatg

SEQ ID NO: 54157 - DNA, 103 bp, Artificial Sequence
  Synthetic Polynucleotide
taatacgactcactatagggtcggataacaagaaagaatataagacaataaacagaggagatattgtatgatattctttaacctggcggcagcgcaaaagatg

SEQ ID NO: 54158 - DNA, 103 bp, Artificial Sequence
  Synthetic Polynucleotide
taatacgactcactatagggttatatcggataacaagaaagaatataagaaacagaggagatcttatatgctttcttgtaacctggcggcagcgcaaaagatg

SEQ ID NO: 54159 - DNA, 103 bp, Artificial Sequence
  Synthetic Polynucleotide
taatacgactcactatagggtaaatttatatcggataacaagaaagaataaacagaggagatattctatgttgttatccaacctggcggcagcgcaaaagatg

SEQ ID NO: 54160 - DNA, 103 bp, Artificial Sequence
  Synthetic Polynucleotide
taatacgactcactataggggaatagaggagatagtattggttaaaaatgaacagaggagacattttatgccaatactaaacctggcggcagcgcaaaagatg

SEQ ID NO: 54161 - DNA, 103 bp, Artificial Sequence
  Synthetic Polynucleotide
taatacgactcactatagggcttattaaatttatatcggataacaagaaaaacagaggagatttcttatgatccgatataacctggcggcagcgcaaaagatg

SEQ ID NO: 54162 - DNA, 103 bp, Artificial Sequence
  Synthetic Polynucleotide
taatacgactcactatagggaaagtcttattaaatttatatcggataacaaacagaggagatgttatatgatataaattaacctggcggcagcgcaaaagatg

SEQ ID NO: 54163 - DNA, 103 bp, Artificial Sequence
  Synthetic Polynucleotide
taatacgactcactatagggtgttcaaagtcttattaaatttatatcggaaacagaggagatccgatatgaatttaataaacctggcggcagcgcaaaagatg

SEQ ID NO: 54164 - DNA, 103 bp, Artificial Sequence
  Synthetic Polynucleotide
taatacgactcactatagggaataatgttcaaagtcttattaaatttataaacagaggagatataaaatgaataagactaacctggcggcagcgcaaaagatg

SEQ ID NO: 54165 - DNA, 103 bp, Artificial Sequence
  Synthetic Polynucleotide
taatacgactcactataggggtattaataatgttcaaagtcttattaaataacagaggagaatttaaatggactttgaaaacctggcggcagcgcaaaagatg

SEQ ID NO: 54166 - DNA, 103 bp, Artificial Sequence
  Synthetic Polynucleotide
taatacgactcactatagggaacgggtattaataatgttcaaagtcttataacagaggagaataagaatgtgaacattaaacctggcggcagcgcaaaagatg

SEQ ID NO: 54167 - DNA, 103 bp, Artificial Sequence
  Synthetic Polynucleotide
taatacgactcactatagggaaacaaacgggtattaataatgttcaaagtaacagaggagaactttgatgattattaataacctggcggcagcgcaaaagatg

SEQ ID NO: 54168 - DNA, 103 bp, Artificial Sequence
  Synthetic Polynucleotide
taatacgactcactatagggaatttaaacaaacgggtattaataatgttcaacagaggagagaacatatgtaatacccgaacctggcggcagcgcaaaagatg

SEQ ID NO: 54169 - DNA, 103 bp, Artificial Sequence
  Synthetic Polynucleotide
taatacgactcactatagggagaaaaatttaaacaaacgggtattaataaaacagaggagattattaatgcccgtttgtaacctggcggcagcgcaaaagatg

SEQ ID NO: 54170 - DNA, 103 bp, Artificial Sequence
  Synthetic Polynucleotide
taatacgactcactatagggtctgtagaaaaatttaaacaaacgggtattaacagaggagaaataccatgttgtttaaaaacctggcggcagcgcaaaagatg

SEQ ID NO: 54171 - DNA, 103 bp, Artificial Sequence
  Synthetic Polynucleotide
taatacgactcactatagggattatgaatagaggagatagtattggttaaaacagaggagattaaccatgactatctccaacctggcggcagcgcaaaagatg

SEQ ID NO: 54172 - DNA, 103 bp, Artificial Sequence
  Synthetic Polynucleotide
taatacgactcactatagggaaatatctgtagaaaaatttaaacaaacggaacagaggagaccgtttatgtaaatttttaacctggcggcagcgcaaaagatg

SEQ ID NO: 54173 - DNA, 103 bp, Artificial Sequence
  Synthetic Polynucleotide
taatacgactcactatagggaactaaaatatctgtagaaaaatttaaacaaacagaggagatgtttaatgttttctacaaacctggcggcagcgcaaaagatg

SEQ ID NO: 54174 - DNA, 103 bp, Artificial Sequence
  Synthetic Polynucleotide
taatacgactcactatagggaccaaaactaaaatatctgtagaaaaatttaacagaggagaaaatttatgtacagatataacctggcggcagcgcaaaagatg

SEQ ID NO: 54175 - DNA, 103 bp, Artificial Sequence
  Synthetic Polynucleotide
taatacgactcactatagggaatctaccaaaactaaaatatctgtagaaaaacagaggagatttctaatgatattttagaacctggcggcagcgcaaaagatg

SEQ ID NO: 54176 - DNA, 103 bp, Artificial Sequence
  Synthetic Polynucleotide
taatacgactcactatagggaatagaatctaccaaaactaaaatatctgtaacagaggagaacagatatgttagttttgaacctggcggcagcgcaaaagatg

SEQ ID NO: 54177 - DNA, 103 bp, Artificial Sequence
  Synthetic Polynucleotide
taatacgactcactataggggacacaatagaatctaccaaaactaaaataaacagaggagatattttatgtttggtagaaacctggcggcagcgcaaaagatg

SEQ ID NO: 54178 - DNA, 103 bp, Artificial Sequence
  Synthetic Polynucleotide
taatacgactcactatagggtaacagacacaatagaatctaccaaaactaaacagaggagatagtttatgtagattctaaacctggcggcagcgcaaaagatg

SEQ ID NO: 54179 - DNA, 103 bp, Artificial Sequence
  Synthetic Polynucleotide
taatacgactcactatagggtctattaacagacacaatagaatctaccaaaacagaggagattggtaatgtctattgtgaacctggcggcagcgcaaaagatg

SEQ ID NO: 54180 - DNA, 103 bp, Artificial Sequence
  Synthetic Polynucleotide
taatacgactcactataggggggtgtctattaacagacacaatagaatctaacagaggagaagattcatgtgtgtctgtaacctggcggcagcgcaaaagatg

SEQ ID NO: 54181 - DNA, 103 bp, Artificial Sequence
  Synthetic Polynucleotide
taatacgactcactatagggatgttgggtgtctattaacagacacaatagaacagaggagactattgatgctgttaataaacctggcggcagcgcaaaagatg

SEQ ID NO: 54182 - DNA, 103 bp, Artificial Sequence
  Synthetic Polynucleotide
taatacgactcactatagggtctcaattatgaatagaggagatagtattgaacagaggagacaatacatgctcctctataacctggcggcagcgcaaaagatg

SEQ ID NO: 54183 - DNA, 103 bp, Artificial Sequence
  Synthetic Polynucleotide
taatacgactcactatagggtgtcgatgttgggtgtctattaacagacacaacagaggagagtgtctatgaatagacacaacctggcggcagcgcaaaagatg

SEQ ID NO: 54184 - DNA, 103 bp, Artificial Sequence
  Synthetic Polynucleotide
taatacgactcactatagggtcgaatgtcgatgttgggtgtctattaacaaacagaggagatgttaaatgacacccaacaacctggcggcagcgcaaaagatg

SEQ ID NO: 54185 - DNA, 103 bp, Artificial Sequence
  Synthetic Polynucleotide
taatacgactcactatagggtaacgtcgaatgtcgatgttgggtgtctataacagaggagaatagacatgcaacatcgaaacctggcggcagcgcaaaagatg

SEQ ID NO: 54186 - DNA, 103 bp, Artificial Sequence
  Synthetic Polynucleotide
taatacgactcactatagggacaattaacgtcgaatgtcgatgttgggtgaacagaggagacacccaatgtcgacattcaacctggcggcagcgcaaaagatg

SEQ ID NO: 54187 - DNA, 103 bp, Artificial Sequence
  Synthetic Polynucleotide
taatacgactcactatagggtatagacaattaacgtcgaatgtcgatgttaacagaggagaaacatcatgattcgacgtaacctggcggcagcgcaaaagatg

SEQ ID NO: 54188 - DNA, 103 bp, Artificial Sequence
  Synthetic Polynucleotide
taatacgactcactatagggtaatttatagacaattaacgtcgaatgtcgaacagaggagacgacatatgacgttaattaacctggcggcagcgcaaaagatg

SEQ ID NO: 54189 - DNA, 103 bp, Artificial Sequence
  Synthetic Polynucleotide
taatacgactcactatagggtactctaatttatagacaattaacgtcgaaaacagaggagattcgacatgaattgtctaaacctggcggcagcgcaaaagatg

SEQ ID NO: 54190 - DNA, 103 bp, Artificial Sequence
  Synthetic Polynucleotide
taatacgactcactatagggatttatactctaatttatagacaattaacgaacagaggagacgttaaatgtctataaataacctggcggcagcgcaaaagatg

SEQ ID NO: 54191 - DNA, 103 bp, Artificial Sequence
  Synthetic Polynucleotide
taatacgactcactatagggctaaaatttatactctaatttatagacaataacagaggagaattgtcatgaaattagagaacctggcggcagcgcaaaagatg

SEQ ID NO: 54192 - DNA, 103 bp, Artificial Sequence
  Synthetic Polynucleotide
taatacgactcactatagggtatttctaaaatttatactctaatttatagaacagaggagactataaatgagagtataaaacctggcggcagcgcaaaagatg

SEQ ID NO: 54193 - DNA, 103 bp, Artificial Sequence
  Synthetic Polynucleotide
taatacgactcactatagggatcaatctcaattatgaatagaggagatagaacagaggagactatctatgctattcataaacctggcggcagcgcaaaagatg

SEQ ID NO: 54194 - DNA, 103 bp, Artificial Sequence
  Synthetic Polynucleotide
taatacgactcactatagggaatgttatttctaaaatttatactctaattaacagaggagaaattagatgataaattttaacctggcggcagcgcaaaagatg

SEQ ID NO: 54195 - DNA, 103 bp, Artificial Sequence
  Synthetic Polynucleotide
taatacgactcactatagggttgctaatgttatttctaaaatttatactcaacagaggagagagtatatgttttagaaaaacctggcggcagcgcaaaagatg

SEQ ID NO: 54196 - DNA, 103 bp, Artificial Sequence
  Synthetic Polynucleotide
taatacgactcactatagggacaatttgctaatgttatttctaaaatttaaacagaggagataaattatggaaataacaaacctggcggcagcgcaaaagatg

SEQ ID NO: 54197 - DNA, 103 bp, Artificial Sequence
  Synthetic Polynucleotide
taatacgactcactataggggcacaacaatttgctaatgttatttctaaaaacagaggagatttagaatgaacattagcaacctggcggcagcgcaaaagatg

SEQ ID NO: 54198 - DNA, 103 bp, Artificial Sequence
  Synthetic Polynucleotide
taatacgactcactatagggtcaacgcacaacaatttgctaatgttatttaacagaggagaaaataaatgtagcaaattaacctggcggcagcgcaaaagatg

SEQ ID NO: 54199 - DNA, 103 bp, Artificial Sequence
  Synthetic Polynucleotide
taatacgactcactatagggcgacatcaacgcacaacaatttgctaatgtaacagaggagaacattaatgaattgttgtaacctggcggcagcgcaaaagatg

SEQ ID NO: 54200 - DNA, 103 bp, Artificial Sequence
  Synthetic Polynucleotide
taatacgactcactatagggaataacgacatcaacgcacaacaatttgctaacagaggagaagcaaaatgttgtgcgttaacctggcggcagcgcaaaagatg

SEQ ID NO: 54201 - DNA, 103 bp, Artificial Sequence
  Synthetic Polynucleotide
taatacgactcactatagggttcagaataacgacatcaacgcacaacaataacagaggagaattgttatgcgttgatgtaacctggcggcagcgcaaaagatg

SEQ ID NO: 54202 - DNA, 103 bp, Artificial Sequence
  Synthetic Polynucleotide
taatacgactcactatagggactgtttcagaataacgacatcaacgcacaaacagaggagatgtgcgatgatgtcgttaaacctggcggcagcgcaaaagatg

SEQ ID NO: 54203 - DNA, 103 bp, Artificial Sequence
  Synthetic Polynucleotide
taatacgactcactatagggatcatactgtttcagaataacgacatcaacaacagaggagagttgatatggttattctgaacctggcggcagcgcaaaagatg

SEQ ID NO: 54204 - DNA, 103 bp, Artificial Sequence
  Synthetic Polynucleotide
taatacgactcactatagggattacatcaatctcaattatgaatagaggaaacagaggagatcctctatgcataattgaaacctggcggcagcgcaaaagatg

SEQ ID NO: 54205 - DNA, 103 bp, Artificial Sequence
  Synthetic Polynucleotide
taatacgactcactatagggctaaaatcatactgtttcagaataacgacaaacagaggagatgtcgtatgtctgaaacaaacctggcggcagcgcaaaagatg

SEQ ID NO: 54206 - DNA, 103 bp, Artificial Sequence
  Synthetic Polynucleotide
taatacgactcactataggggctacctaaaatcatactgtttcagaataaaacagaggagattattcatgaacagtatgaacctggcggcagcgcaaaagatg

SEQ ID NO: 54207 - DNA, 103 bp, Artificial Sequence
  Synthetic Polynucleotide
taatacgactcactatagggaaaatgctacctaaaatcatactgtttcagaacagaggagactgaaaatgtatgattttaacctggcggcagcgcaaaagatg

SEQ ID NO: 54208 - DNA, 103 bp, Artificial Sequence
  Synthetic Polynucleotide
taatacgactcactatagggttaagaaaatgctacctaaaatcatactgtaacagaggagaacagtaatgttttaggtaaacctggcggcagcgcaaaagatg

SEQ ID NO: 54209 - DNA, 103 bp, Artificial Sequence
  Synthetic Polynucleotide
taatacgactcactatagggctttgttaagaaaatgctacctaaaatcataacagaggagaatgattatgggtagcattaacctggcggcagcgcaaaagatg

SEQ ID NO: 54210 - DNA, 103 bp, Artificial Sequence
  Synthetic Polynucleotide
taatacgactcactataggggttctctttgttaagaaaatgctacctaaaaacagaggagatttaggatgcattttcttaacctggcggcagcgcaaaagatg

SEQ ID NO: 54211 - DNA, 103 bp, Artificial Sequence
  Synthetic Polynucleotide
taatacgactcactatagggaatacgttctctttgttaagaaaatgctacaacagaggagagtagcaatgtcttaacaaaacctggcggcagcgcaaaagatg

SEQ ID NO: 54212 - DNA, 103 bp, Artificial Sequence
  Synthetic Polynucleotide
taatacgactcactatagggcaataaatacgttctctttgttaagaaaataacagaggagaattttcatgacaaagagaaacctggcggcagcgcaaaagatg

SEQ ID NO: 54213 - DNA, 103 bp, Artificial Sequence
  Synthetic Polynucleotide
taatacgactcactatagggagtaacaataaatacgttctctttgttaagaacagaggagacttaacatggagaacgtaaacctggcggcagcgcaaaagatg

SEQ ID NO: 54214 - DNA, 103 bp, Artificial Sequence
  Synthetic Polynucleotide
taatacgactcactatagggaactgagtaacaataaatacgttctctttgaacagaggagacaaagaatgcgtatttataacctggcggcagcgcaaaagatg

SEQ ID NO: 54215 - DNA, 103 bp, Artificial Sequence
  Synthetic Polynucleotide
taatacgactcactatagggaaagtattacatcaatctcaattatgaataaacagaggagatattcaatgttgagattgaacctggcggcagcgcaaaagatg

SEQ ID NO: 54216 - DNA, 103 bp, Artificial Sequence
  Synthetic Polynucleotide
taatacgactcactatagggtgttcaactgagtaacaataaatacgttctaacagaggagaagaacgatgttattgttaaacctggcggcagcgcaaaagatg

SEQ ID NO: 54217 - DNA, 103 bp, Artificial Sequence
  Synthetic Polynucleotide
taatacgactcactatagggtcatctgttcaactgagtaacaataaatacaacagaggagagtatttatggttactcagaacctggcggcagcgcaaaagatg

SEQ ID NO: 54218 - DNA, 103 bp, Artificial Sequence
  Synthetic Polynucleotide
taatacgactcactatagggatatatcatctgttcaactgagtaacaataaacagaggagatattgtatgtcagttgaaaacctggcggcagcgcaaaagatg

SEQ ID NO: 54219 - DNA, 103 bp, Artificial Sequence
  Synthetic Polynucleotide
taatacgactcactatagggtctggatatatcatctgttcaactgagtaaaacagaggagattactcatgtgaacagataacctggcggcagcgcaaaagatg

SEQ ID NO: 54220 - DNA, 103 bp, Artificial Sequence
  Synthetic Polynucleotide
taatacgactcactatagggagtaatctggatatatcatctgttcaactgaacagaggagacagttgatgagatgatataacctggcggcagcgcaaaagatg

SEQ ID NO: 54221 - DNA, 103 bp, Artificial Sequence
  Synthetic Polynucleotide
taatacgactcactataggggcgttagtaatctggatatatcatctgttcaacagaggagagaacagatgatatatccaaacctggcggcagcgcaaaagatg

SEQ ID NO: 54222 - DNA, 103 bp, Artificial Sequence
  Synthetic Polynucleotide
taatacgactcactatagggcagatgcgttagtaatctggatatatcatcaacagaggagagatgatatgtccagattaaacctggcggcagcgcaaaagatg

SEQ ID NO: 54223 - DNA, 103 bp, Artificial Sequence
  Synthetic Polynucleotide
taatacgactcactatagggggaatcagatgcgttagtaatctggatataaacagaggagatatatcatgattactaacaacctggcggcagcgcaaaagatg

SEQ ID NO: 54224 - DNA, 103 bp, Artificial Sequence
  Synthetic Polynucleotide
taatacgactcactatagggtatatggaatcagatgcgttagtaatctggaacagaggagaccagatatgtaacgcatcaacctggcggcagcgcaaaagatg

SEQ ID NO: 54225 - DNA, 103 bp, Artificial Sequence
  Synthetic Polynucleotide
taatacgactcactatagggtttggtatatggaatcagatgcgttagtaaaacagaggagattactaatgcatctgattaacctggcggcagcgcaaaagatg

SEQ ID NO: 54226 - DNA, 103 bp, Artificial Sequence
  Synthetic Polynucleotide
taatacgactcactataggggtaacaaagtattacatcaatctcaattataacagaggagaataattatgattgatgtaaacctggcggcagcgcaaaagatg

SEQ ID NO: 54227 - DNA, 103 bp, Artificial Sequence
  Synthetic Polynucleotide
taatacgactcactataggggaaagtttggtatatggaatcagatgcgttaacagaggagaaacgcaatggattccataaacctggcggcagcgcaaaagatg

SEQ ID NO: 54228 - DNA, 103 bp, Artificial Sequence
  Synthetic Polynucleotide
taatacgactcactatagggcttctgaaagtttggtatatggaatcagataacagaggagaatctgaatgcatataccaaacctggcggcagcgcaaaagatg

SEQ ID NO: 54229 - DNA, 103 bp, Artificial Sequence
  Synthetic Polynucleotide
taatacgactcactatagggcatttcttctgaaagtttggtatatggaataacagaggagaattccaatgaccaaacttaacctggcggcagcgcaaaagatg

SEQ ID NO: 54230 - DNA, 103 bp, Artificial Sequence
  Synthetic Polynucleotide
taatacgactcactatagggtacaccatttcttctgaaagtttggtatataacagaggagaatatacatgactttcagaaacctggcggcagcgcaaaagatg

SEQ ID NO: 54231 - DNA, 103 bp, Artificial Sequence
  Synthetic Polynucleotide
taatacgactcactatagggaattgtacaccatttcttctgaaagtttggaacagaggagaccaaacatgcagaagaaaaacctggcggcagcgcaaaagatg

SEQ ID NO: 54232 - DNA, 103 bp, Artificial Sequence
  Synthetic Polynucleotide
taatacgactcactatagggcaaacaattgtacaccatttcttctgaaagaacagaggagactttcaatggaaatggtgaacctggcggcagcgcaaaagatg

SEQ ID NO: 54233 - DNA, 103 bp, Artificial Sequence
  Synthetic Polynucleotide
taatacgactcactataggggaatacaaacaattgtacaccatttcttctaacagaggagaagaagaatgggtgtacaaaacctggcggcagcgcaaaagatg

SEQ ID NO: 54234 - DNA, 103 bp, Artificial Sequence
  Synthetic Polynucleotide
taatacgactcactatagggtgaatgaatacaaacaattgtacaccatttaacagaggagaaaatggatgacaattgttaacctggcggcagcgcaaaagatg

SEQ ID NO: 54235 - DNA, 103 bp, Artificial Sequence
  Synthetic Polynucleotide
taatacgactcactataggggacattgaatgaatacaaacaattgtacacaacagaggagagtgtacatgtgtttgtataacctggcggcagcgcaaaagatg

SEQ ID NO: 54236 - DNA, 103 bp, Artificial Sequence
  Synthetic Polynucleotide
taatacgactcactatagggaaggagacattgaatgaatacaaacaattgaacagaggagacaattgatggtattcattaacctggcggcagcgcaaaagatg

SEQ ID NO: 54237 - DNA, 103 bp, Artificial Sequence
  Synthetic Polynucleotide
taatacgactcactatagggccgaaaattctgtactccacgttagaaactaacagaggagaagtttcatgcgtggagtaaacctggcggcagcgcaaaagatg

SEQ ID NO: 54238 - DNA, 103 bp, Artificial Sequence
  Synthetic Polynucleotide
taatacgactcactatagggtcaaagtaacaaagtattacatcaatctcaaacagaggagatgagatatgtgtaatactaacctggcggcagcgcaaaagatg

SEQ ID NO: 54239 - DNA, 103 bp, Artificial Sequence
  Synthetic Polynucleotide
taatacgactcactatagggctgaaaaggagacattgaatgaatacaaacaacagaggagagtttgtatgcattcaatgaacctggcggcagcgcaaaagatg

SEQ ID NO: 54240 - DNA, 103 bp, Artificial Sequence
  Synthetic Polynucleotide
taatacgactcactatagggaatttctgaaaaggagacattgaatgaataaacagaggagatattcaatgaatgtctccaacctggcggcagcgcaaaagatg

SEQ ID NO: 54241 - DNA, 103 bp, Artificial Sequence
  Synthetic Polynucleotide
taatacgactcactatagggaaactaatttctgaaaaggagacattgaataacagaggagaattcaaatgctccttttcaacctggcggcagcgcaaaagatg

SEQ ID NO: 54242 - DNA, 103 bp, Artificial Sequence
  Synthetic Polynucleotide
taatacgactcactatagggactctaaactaatttctgaaaaggagacataacagaggagaatgtctatgtttcagaaaaacctggcggcagcgcaaaagatg

SEQ ID NO: 54243 - DNA, 103 bp, Artificial Sequence
  Synthetic Polynucleotide
taatacgactcactatagggatttgactctaaactaatttctgaaaaggaaacagaggagatcctttatggaaattagtaacctggcggcagcgcaaaagatg

SEQ ID NO: 54244 - DNA, 103 bp, Artificial Sequence
  Synthetic Polynucleotide
taatacgactcactataggggcagtatttgactctaaactaatttctgaaaacagaggagattcagaatgtagtttagaaacctggcggcagcgcaaaagatg

SEQ ID NO: 54245 - DNA, 103 bp, Artificial Sequence
  Synthetic Polynucleotide
taatacgactcactatagggttattgcagtatttgactctaaactaatttaacagaggagaaaattaatgtagagtcaaaacctggcggcagcgcaaaagatg

SEQ ID NO: 54246 - DNA, 103 bp, Artificial Sequence
  Synthetic Polynucleotide
taatacgactcactataggggaaaattattgcagtatttgactctaaactaacagaggagaagtttaatgtcaaatactaacctggcggcagcgcaaaagatg

SEQ ID NO: 54247 - DNA, 103 bp, Artificial Sequence
  Synthetic Polynucleotide
taatacgactcactatagggcttttgaaaattattgcagtatttgactctaacagaggagaagagtcatgtactgcaataacctggcggcagcgcaaaagatg

SEQ ID NO: 54248 - DNA, 103 bp, Artificial Sequence
  Synthetic Polynucleotide
taatacgactcactatagggactatcttttgaaaattattgcagtatttgaacagaggagacaaataatgcaataatttaacctggcggcagcgcaaaagatg

SEQ ID NO: 54249 - DNA, 103 bp, Artificial Sequence
  Synthetic Polynucleotide
taatacgactcactatagggtacgttcaaagtaacaaagtattacatcaaaacagaggagattgatgatgtactttgttaacctggcggcagcgcaaaagatg

SEQ ID NO: 54250 - DNA, 103 bp, Artificial Sequence
  Synthetic Polynucleotide
taatacgactcactatagggtgaaaactatcttttgaaaattattgcagtaacagaggagaactgcaatgattttcaaaaacctggcggcagcgcaaaagatg

SEQ ID NO: 54251 - DNA, 103 bp, Artificial Sequence
  Synthetic Polynucleotide
taatacgactcactatagggtctgatgaaaactatcttttgaaaattattaacagaggagaaataatatgcaaaagataaacctggcggcagcgcaaaagatg

SEQ ID NO: 54252 - DNA, 103 bp, Artificial Sequence
  Synthetic Polynucleotide
taatacgactcactatagggtcttatctgatgaaaactatcttttgaaaaaacagaggagattttcaatggatagttttaacctggcggcagcgcaaaagatg

SEQ ID NO: 54253 - DNA, 103 bp, Artificial Sequence
  Synthetic Polynucleotide
taatacgactcactatagggtaaaatcttatctgatgaaaactatcttttaacagaggagaaaaagaatgttttcatcaaacctggcggcagcgcaaaagatg

SEQ ID NO: 54254 - DNA, 103 bp, Artificial Sequence
  Synthetic Polynucleotide
taatacgactcactatagggctaaataaaatcttatctgatgaaaactataacagaggagaatagttatgatcagataaaacctggcggcagcgcaaaagatg

SEQ ID NO: 54255 - DNA, 103 bp, Artificial Sequence
  Synthetic Polynucleotide
taatacgactcactatagggctacactaaataaaatcttatctgatgaaaaacagaggagatttcatatgataagatttaacctggcggcagcgcaaaagatg

SEQ ID NO: 54256 - DNA, 103 bp, Artificial Sequence
  Synthetic Polynucleotide
taatacgactcactatagggcatatctacactaaataaaatcttatctgaaacagaggagatcagatatgattttatttaacctggcggcagcgcaaaagatg

SEQ ID NO: 54257 - DNA, 103 bp, Artificial Sequence
  Synthetic Polynucleotide
taatacgactcactatagggtttatcatatctacactaaataaaatcttaaacagaggagataagatatgatttagtgtaacctggcggcagcgcaaaagatg

SEQ ID NO: 54258 - DNA, 103 bp, Artificial Sequence
  Synthetic Polynucleotide
taatacgactcactatagggatagttttatcatatctacactaaataaaaaacagaggagattttatatggtgtagataaacctggcggcagcgcaaaagatg

SEQ ID NO: 54259 - DNA, 103 bp, Artificial Sequence
  Synthetic Polynucleotide
taatacgactcactatagggaaacaatagttttatcatatctacactaaaaacagaggagatttagtatggatatgataaacctggcggcagcgcaaaagatg

SEQ ID NO: 54260 - DNA, 103 bp, Artificial Sequence
  Synthetic Polynucleotide
taatacgactcactataggggtttttacgttcaaagtaacaaagtattacaacagaggagagtaataatgtgttactttaacctggcggcagcgcaaaagatg

SEQ ID NO: 54261 - DNA, 103 bp, Artificial Sequence
  Synthetic Polynucleotide
taatacgactcactatagggcaacaaaacaatagttttatcatatctacaaacagaggagatgtagaatggataaaactaacctggcggcagcgcaaaagatg

SEQ ID NO: 54262 - DNA, 103 bp, Artificial Sequence
  Synthetic Polynucleotide
taatacgactcactatagggttctccaacaaaacaatagttttatcatataacagaggagaatatgaatgaactattgtaacctggcggcagcgcaaaagatg

SEQ ID NO: 54263 - DNA, 103 bp, Artificial Sequence
  Synthetic Polynucleotide
taatacgactcactatagggtcaagttctccaacaaaacaatagttttataacagaggagaataaaaatgttgttttgtaacctggcggcagcgcaaaagatg

SEQ ID NO: 54264 - DNA, 103 bp, Artificial Sequence
  Synthetic Polynucleotide
taatacgactcactataggggcgtatcaagttctccaacaaaacaatagtaacagaggagaactattatgttgttggagaacctggcggcagcgcaaaagatg

SEQ ID NO: 54265 - DNA, 103 bp, Artificial Sequence
  Synthetic Polynucleotide
taatacgactcactatagggatgcggcgtatcaagttctccaacaaaacaaacagaggagatgttttatgggagaacttaacctggcggcagcgcaaaagatg

SEQ ID NO: 54266 - DNA, 103 bp, Artificial Sequence
  Synthetic Polynucleotide
taatacgactcactatagggagagaatgcggcgtatcaagttctccaacaaacagaggagatgttggatgacttgatacaacctggcggcagcgcaaaagatg

SEQ ID NO: 54267 - DNA, 103 bp, Artificial Sequence
  Synthetic Polynucleotide
taatacgactcactatagggactacagagaatgcggcgtatcaagttctcaacagaggagagagaacatgatacgccgcaacctggcggcagcgcaaaagatg

SEQ ID NO: 54268 - DNA, 103 bp, Artificial Sequence
  Synthetic Polynucleotide
taatacgactcactatagggcgtcgactacagagaatgcggcgtatcaagaacagaggagacttgatatgccgcattctaacctggcggcagcgcaaaagatg

SEQ ID NO: 54269 - DNA, 103 bp, Artificial Sequence
  Synthetic Polynucleotide
taatacgactcactataggggagagcgtcgactacagagaatgcggcgtaaacagaggagatacgccatgttctctgtaaacctggcggcagcgcaaaagatg

SEQ ID NO: 54270 - DNA, 103 bp, Artificial Sequence
  Synthetic Polynucleotide
taatacgactcactatagggcatttgagagcgtcgactacagagaatgcgaacagaggagacgcattatgtgtagtcgaaacctggcggcagcgcaaaagatg

SEQ ID NO: 54271 - DNA, 103 bp, Artificial Sequence
  Synthetic Polynucleotide
taatacgactcactataggggtactgtttttacgttcaaagtaacaaagtaacagaggagaactttgatgctttgaacgaacctggcggcagcgcaaaagatg

SEQ ID NO: 54272 - DNA, 103 bp, Artificial Sequence
  Synthetic Polynucleotide
taatacgactcactatagggtttcccatttgagagcgtcgactacagagaaacagaggagatctctgatgtcgacgctcaacctggcggcagcgcaaaagatg

SEQ ID NO: 54273 - DNA, 103 bp, Artificial Sequence
  Synthetic Polynucleotide
taatacgactcactataggggattgtttcccatttgagagcgtcgactacaacagaggagagtagtcatggctctcaaaaacctggcggcagcgcaaaagatg

SEQ ID NO: 54274 - DNA, 103 bp, Artificial Sequence
  Synthetic Polynucleotide
taatacgactcactatagggatggagattgtttcccatttgagagcgtcgaacagaggagacgacgcatgcaaatgggaaacctggcggcagcgcaaaagatg

SEQ ID NO: 54275 - DNA, 103 bp, Artificial Sequence
  Synthetic Polynucleotide
taatacgactcactatagggaaataatggagattgtttcccatttgagagaacagaggagactctcaatggggaaacaaaacctggcggcagcgcaaaagatg

SEQ ID NO: 54276 - DNA, 103 bp, Artificial Sequence
  Synthetic Polynucleotide
taatacgactcactatagggcaaaaaaataatggagattgtttcccatttaacagaggagaaaatggatgacaatctccaacctggcggcagcgcaaaagatg

SEQ ID NO: 54277 - DNA, 103 bp, Artificial Sequence
  Synthetic Polynucleotide
taatacgactcactataggggattccaaaaaaataatggagattgtttccaacagaggagaggaaacatgctccattataacctggcggcagcgcaaaagatg

SEQ ID NO: 54278 - DNA, 103 bp, Artificial Sequence
  Synthetic Polynucleotide
taatacgactcactatagggtatccgattccaaaaaaataatggagattgaacagaggagacaatctatgttattttttaacctggcggcagcgcaaaagatg

SEQ ID NO: 54279 - DNA, 103 bp, Artificial Sequence
  Synthetic Polynucleotide
taatacgactcactatagggtatagtatccgattccaaaaaaataatggaaacagaggagatccattatgtttttggaaaacctggcggcagcgcaaaagatg

SEQ ID NO: 54280 - DNA, 103 bp, Artificial Sequence
  Synthetic Polynucleotide
taatacgactcactataggggaagatatagtatccgattccaaaaaaataaacagaggagatattttatgggaatcggaaacctggcggcagcgcaaaagatg

SEQ ID NO: 54281 - DNA, 103 bp, Artificial Sequence
  Synthetic Polynucleotide
taatacgactcactatagggataccgaagatatagtatccgattccaaaaaacagaggagattttggatgcggatactaaacctggcggcagcgcaaaagatg

SEQ ID NO: 54282 - DNA, 103 bp, Artificial Sequence
  Synthetic Polynucleotide
taatacgactcactatagggtccgtgtactgtttttacgttcaaagtaacaacagaggagagttactatgaacgtaaaaaacctggcggcagcgcaaaagatg

SEQ ID NO: 54283 - DNA, 103 bp, Artificial Sequence
  Synthetic Polynucleotide
taatacgactcactatagggtcaagataccgaagatatagtatccgattcaacagaggagagaatcgatgactatatctaacctggcggcagcgcaaaagatg

SEQ ID NO: 54284 - DNA, 103 bp, Artificial Sequence
  Synthetic Polynucleotide
taatacgactcactatagggctgcgtcaagataccgaagatatagtatccaacagaggagaggatacatgatcttcggtaacctggcggcagcgcaaaagatg

SEQ ID NO: 54285 - DNA, 103 bp, Artificial Sequence
  Synthetic Polynucleotide
taatacgactcactatagggctagactgcgtcaagataccgaagatatagaacagaggagactatatatgcggtatcttaacctggcggcagcgcaaaagatg

SEQ ID NO: 54286 - DNA, 103 bp, Artificial Sequence
  Synthetic Polynucleotide
taatacgactcactataggggtatactagactgcgtcaagataccgaagaaacagaggagatcttcgatgtcttgacgcaacctggcggcagcgcaaaagatg

SEQ ID NO: 54287 - DNA, 103 bp, Artificial Sequence
  Synthetic Polynucleotide
taatacgactcactatagggtctatgtatactagactgcgtcaagataccaacagaggagaggtatcatgacgcagtctaacctggcggcagcgcaaaagatg

SEQ ID NO: 54288 - DNA, 103 bp, Artificial Sequence
  Synthetic Polynucleotide
taatacgactcactatagggttaactctatgtatactagactgcgtcaagaacagaggagacttgacatggtctagtataacctggcggcagcgcaaaagatg

SEQ ID NO: 54289 - DNA, 103 bp, Artificial Sequence
  Synthetic Polynucleotide
taatacgactcactatagggttctcttaactctatgtatactagactgcgaacagaggagacgcagtatggtatacataaacctggcggcagcgcaaaagatg

SEQ ID NO: 54290 - DNA, 103 bp, Artificial Sequence
  Synthetic Polynucleotide
taatacgactcactatagggctaatttctcttaactctatgtatactagaaacagaggagatctagtatgcatagagttaacctggcggcagcgcaaaagatg

SEQ ID NO: 54291 - DNA, 103 bp, Artificial Sequence
  Synthetic Polynucleotide
taatacgactcactatagggaaactctaatttctcttaactctatgtataaacagaggagatatacaatgagttaagagaacctggcggcagcgcaaaagatg

SEQ ID NO: 54292 - DNA, 103 bp, Artificial Sequence
  Synthetic Polynucleotide
taatacgactcactatagggtgtacaaactctaatttctcttaactctataacagaggagaatagagatgagagaaattaacctggcggcagcgcaaaagatg

SEQ ID NO: 54293 - DNA, 103 bp, Artificial Sequence
  Synthetic Polynucleotide
taatacgactcactatagggacggatccgtgtactgtttttacgttcaaaaacagaggagatttgaaatgaaaaacagtaacctggcggcagcgcaaaagatg

SEQ ID NO: 54294 - DNA, 103 bp, Artificial Sequence
  Synthetic Polynucleotide
taatacgactcactatagggcttaatgtacaaactctaatttctcttaacaacagaggagagttaagatgaattagagtaacctggcggcagcgcaaaagatg

SEQ ID NO: 54295 - DNA, 103 bp, Artificial Sequence
  Synthetic Polynucleotide
taatacgactcactatagggtgttgcttaatgtacaaactctaatttctcaacagaggagagagaaaatggagtttgtaaacctggcggcagcgcaaaagatg

SEQ ID NO: 54296 - DNA, 103 bp, Artificial Sequence
  Synthetic Polynucleotide
taatacgactcactatagggagacatgttgcttaatgtacaaactctaataacagaggagaattagaatgtgtacattaaacctggcggcagcgcaaaagatg

SEQ ID NO: 54297 - DNA, 103 bp, Artificial Sequence
  Synthetic Polynucleotide
taatacgactcactatagggtttaaagacatgttgcttaatgtacaaactaacagaggagaagtttgatgattaagcaaaacctggcggcagcgcaaaagatg

SEQ ID NO: 54298 - DNA, 103 bp, Artificial Sequence
  Synthetic Polynucleotide
taatacgactcactatagggccacatttaaagacatgttgcttaatgtacaacagaggagagtacatatggcaacatgtaacctggcggcagcgcaaaagatg

SEQ ID NO: 54299 - DNA, 103 bp, Artificial Sequence
  Synthetic Polynucleotide
taatacgactcactatagggtgtagccacatttaaagacatgttgcttaaaacagaggagattaagcatgatgtctttaaacctggcggcagcgcaaaagatg

SEQ ID NO: 54300 - DNA, 103 bp, Artificial Sequence
  Synthetic Polynucleotide
taatacgactcactatagggaagtttgtagccacatttaaagacatgttgaacagaggagacaacatatgtttaaatgtaacctggcggcagcgcaaaagatg

SEQ ID NO: 54301 - DNA, 103 bp, Artificial Sequence
  Synthetic Polynucleotide
taatacgactcactatagggaggaaaagtttgtagccacatttaaagacaaacagaggagatgtcttatgatgtggctaaacctggcggcagcgcaaaagatg

SEQ ID NO: 54302 - DNA, 103 bp, Artificial Sequence
  Synthetic Polynucleotide
taatacgactcactatagggggaaaaggaaaagtttgtagccacatttaaaacagaggagattaaatatggctacaaacaacctggcggcagcgcaaaagatg

SEQ ID NO: 54303 - DNA, 103 bp, Artificial Sequence
  Synthetic Polynucleotide
taatacgactcactataggggatgcggaaaaggaaaagtttgtagccacaaacagaggagatgtggcatgaaacttttcaacctggcggcagcgcaaaagatg

SEQ ID NO: 54304 - DNA, 103 bp, Artificial Sequence
  Synthetic Polynucleotide
taatacgactcactataggggagatacggatccgtgtactgtttttacgtaacagaggagaacgtaaatgcagtacacgaacctggcggcagcgcaaaagatg

SEQ ID NO: 54305 - DNA, 103 bp, Artificial Sequence
  Synthetic Polynucleotide
taatacgactcactatagggtagatgatgcggaaaaggaaaagtttgtagaacagaggagactacaaatgtttccttttaacctggcggcagcgcaaaagatg

SEQ ID NO: 54306 - DNA, 103 bp, Artificial Sequence
  Synthetic Polynucleotide
taatacgactcactatagggtaaactagatgatgcggaaaaggaaaagttaacagaggagaaactttatgttttccgcaaacctggcggcagcgcaaaagatg

SEQ ID NO: 54307 - DNA, 103 bp, Artificial Sequence
  Synthetic Polynucleotide
taatacgactcactatagggtataataaactagatgatgcggaaaaggaaaacagaggagattccttatgcgcatcatcaacctggcggcagcgcaaaagatg

SEQ ID NO: 54308 - DNA, 103 bp, Artificial Sequence
  Synthetic Polynucleotide
taatacgactcactatagggcggtatataataaactagatgatgcggaaaaacagaggagatttccgatgcatctagttaacctggcggcagcgcaaaagatg

SEQ ID NO: 54309 - DNA, 103 bp, Artificial Sequence
  Synthetic Polynucleotide
taatacgactcactatagggaaaatcggtatataataaactagatgatgcaacagaggagagcatcaatgagtttattaaacctggcggcagcgcaaaagatg

SEQ ID NO: 54310 - DNA, 103 bp, Artificial Sequence
  Synthetic Polynucleotide
taatacgactcactataggggttgtaaaatcggtatataataaactagataacagaggagaatctagatgattatatacaacctggcggcagcgcaaaagatg

SEQ ID NO: 54311 - DNA, 103 bp, Artificial Sequence
  Synthetic Polynucleotide
taatacgactcactataggggcgccgttgtaaaatcggtatataataaacaacagaggagagtttatatgataccgattaacctggcggcagcgcaaaagatg

SEQ ID NO: 54312 - DNA, 103 bp, Artificial Sequence
  Synthetic Polynucleotide
taatacgactcactatagggatctggcgccgttgtaaaatcggtatataaaacagaggagattatatatggattttacaaacctggcggcagcgcaaaagatg

SEQ ID NO: 54313 - DNA, 103 bp, Artificial Sequence
  Synthetic Polynucleotide
taatacgactcactatagggcttaaatctggcgccgttgtaaaatcggtaaacagaggagataccgaatgtacaacggcaacctggcggcagcgcaaaagatg

SEQ ID NO: 54314 - DNA, 103 bp, Artificial Sequence
  Synthetic Polynucleotide
taatacgactcactatagggggtttcttaaatctggcgccgttgtaaaataacagaggagaattttaatgcggcgccagaacctggcggcagcgcaaaagatg

SEQ ID NO: 54315 - DNA, 103 bp, Artificial Sequence
  Synthetic Polynucleotide
taatacgactcactatagggtgttggagatacggatccgtgtactgttttaacagaggagaaaaacaatgcacggatccaacctggcggcagcgcaaaagatg

SEQ ID NO: 54316 - DNA, 103 bp, Artificial Sequence
  Synthetic Polynucleotide
taatacgactcactatagggattctggtttcttaaatctggcgccgttgtaacagaggagaacaacgatgccagatttaaacctggcggcagcgcaaaagatg

SEQ ID NO: 54317 - DNA, 103 bp, Artificial Sequence
  Synthetic Polynucleotide
taatacgactcactatagggttttcattctggtttcttaaatctggcgccaacagaggagaggcgccatgtttaagaaaaacctggcggcagcgcaaaagatg

SEQ ID NO: 54318 - DNA, 103 bp, Artificial Sequence
  Synthetic Polynucleotide
taatacgactcactatagggagagtttttcattctggtttcttaaatctgaacagaggagacagattatggaaaccagaaacctggcggcagcgcaaaagatg

SEQ ID NO: 54319 - DNA, 103 bp, Artificial Sequence
  Synthetic Polynucleotide
taatacgactcactatagggttatcagagtttttcattctggtttcttaaaacagaggagattaagaatgcagaatgaaaacctggcggcagcgcaaaagatg

SEQ ID NO: 54320 - DNA, 103 bp, Artificial Sequence
  Synthetic Polynucleotide
taatacgactcactatagggtgtagttatcagagtttttcattctggtttaacagaggagaaaaccaatgtgaaaaactaacctggcggcagcgcaaaagatg

SEQ ID NO: 54321 - DNA, 103 bp, Artificial Sequence
  Synthetic Polynucleotide
taatacgactcactatagggaatattgtagttatcagagtttttcattctaacagaggagaagaatgatgaactctgataacctggcggcagcgcaaaagatg

SEQ ID NO: 54322 - DNA, 103 bp, Artificial Sequence
  Synthetic Polynucleotide
taatacgactcactataggggatgaaatattgtagttatcagagtttttcaacagaggagagaaaaaatgtgataactaaacctggcggcagcgcaaaagatg

SEQ ID NO: 54323 - DNA, 103 bp, Artificial Sequence
  Synthetic Polynucleotide
taatacgactcactatagggactatgatgaaatattgtagttatcagagtaacagaggagaactctgatgactacaataaacctggcggcagcgcaaaagatg

SEQ ID NO: 54324 - DNA, 103 bp, Artificial Sequence
  Synthetic Polynucleotide
taatacgactcactatagggttgtaactatgatgaaatattgtagttatcaacagaggagagataacatgaatatttcaaacctggcggcagcgcaaaagatg

SEQ ID NO: 54325 - DNA, 103 bp, Artificial Sequence
  Synthetic Polynucleotide
taatacgactcactatagggtaaaattgtaactatgatgaaatattgtagaacagaggagactacaaatgttcatcataaacctggcggcagcgcaaaagatg

SEQ ID NO: 54326 - DNA, 103 bp, Artificial Sequence
  Synthetic Polynucleotide
taatacgactcactatagggatgcttgttggagatacggatccgtgtactaacagaggagaagtacaatgatccgtatcaacctggcggcagcgcaaaagatg

SEQ ID NO: 54327 - DNA, 103 bp, Artificial Sequence
  Synthetic Polynucleotide
taatacgactcactataggggatgataaaattgtaactatgatgaaatataacagaggagaatatttatgcatagttacaacctggcggcagcgcaaaagatg

SEQ ID NO: 54328 - DNA, 103 bp, Artificial Sequence
  Synthetic Polynucleotide
taatacgactcactatagggtagaagatgataaaattgtaactatgatgaaacagaggagatcatcaatgttacaatttaacctggcggcagcgcaaaagatg

SEQ ID NO: 54329 - DNA, 103 bp, Artificial Sequence
  Synthetic Polynucleotide
taatacgactcactatagggaactatagaagatgataaaattgtaactataacagaggagaatagttatgattttatcaaacctggcggcagcgcaaaagatg

SEQ ID NO: 54330 - DNA, 103 bp, Artificial Sequence
  Synthetic Polynucleotide
taatacgactcactatagggacaccaactatagaagatgataaaattgtaaacagaggagatacaatatgatcatcttcaacctggcggcagcgcaaaagatg

SEQ ID NO: 54331 - DNA, 103 bp, Artificial Sequence
  Synthetic Polynucleotide
taatacgactcactatagggttatcacaccaactatagaagatgataaaaaacagaggagattttatatgcttctatagaacctggcggcagcgcaaaagatg

SEQ ID NO: 54332 - DNA, 103 bp, Artificial Sequence
  Synthetic Polynucleotide
taatacgactcactatagggatgtgttatcacaccaactatagaagatgaaacagaggagatcatctatgatagttggtaacctggcggcagcgcaaaagatg

SEQ ID NO: 54333 - DNA, 103 bp, Artificial Sequence
  Synthetic Polynucleotide
taatacgactcactatagggaaggtatgtgttatcacaccaactatagaaaacagaggagattctatatgtggtgtgataacctggcggcagcgcaaaagatg

SEQ ID NO: 54334 - DNA, 103 bp, Artificial Sequence
  Synthetic Polynucleotide
taatacgactcactatagggagaaaaaggtatgtgttatcacaccaactaaacagaggagatagttgatgtgataacacaacctggcggcagcgcaaaagatg

SEQ ID NO: 54335 - DNA, 103 bp, Artificial Sequence
  Synthetic Polynucleotide
taatacgactcactatagggcttggagaaaaaggtatgtgttatcacaccaacagaggagaggtgtgatgacacataccaacctggcggcagcgcaaaagatg

SEQ ID NO: 54336 - DNA, 103 bp, Artificial Sequence
  Synthetic Polynucleotide
taatacgactcactatagggccagtcttggagaaaaaggtatgtgttatcaacagaggagagataacatgtacctttttaacctggcggcagcgcaaaagatg

SEQ ID NO: 54337 - DNA, 103 bp, Artificial Sequence
  Synthetic Polynucleotide
taatacgactcactatagggactacatgcttgttggagatacggatccgtaacagaggagaacggatatgtatctccaaaacctggcggcagcgcaaaagatg

SEQ ID NO: 54338 - DNA, 103 bp, Artificial Sequence
  Synthetic Polynucleotide
taatacgactcactatagggtggttccagtcttggagaaaaaggtatgtgaacagaggagacacataatgttttctccaaacctggcggcagcgcaaaagatg

SEQ ID NO: 54339 - DNA, 103 bp, Artificial Sequence
  Synthetic Polynucleotide
taatacgactcactataggggacgttggttccagtcttggagaaaaaggtaacagaggagaacctttatgtccaagactaacctggcggcagcgcaaaagatg

SEQ ID NO: 54340 - DNA, 103 bp, Artificial Sequence
  Synthetic Polynucleotide
taatacgactcactatagggtttatgacgttggttccagtcttggagaaaaacagaggagatttctcatggactggaacaacctggcggcagcgcaaaagatg

SEQ ID NO: 54341 - DNA, 103 bp, Artificial Sequence
  Synthetic Polynucleotide
taatacgactcactatagggacatttttatgacgttggttccagtcttggaacagaggagaccaagaatggaaccaacgaacctggcggcagcgcaaaagatg

SEQ ID NO: 54342 - DNA, 103 bp, Artificial Sequence
  Synthetic Polynucleotide
taatacgactcactatagggtttaaacatttttatgacgttggttccagtaacagaggagaactggaatgaacgtcataaacctggcggcagcgcaaaagatg

SEQ ID NO: 54343 - DNA, 103 bp, Artificial Sequence
  Synthetic Polynucleotide
taatacgactcactatagggtttgatttaaacatttttatgacgttggttaacagaggagaaaccaaatgcataaaaataacctggcggcagcgcaaaagatg

SEQ ID NO: 54344 - DNA, 103 bp, Artificial Sequence
  Synthetic Polynucleotide
taatacgactcactatagggtggattttgatttaaacatttttatgacgtaacagaggagaacgtcaatgaaatgtttaaacctggcggcagcgcaaaagatg

SEQ ID NO: 54345 - DNA, 103 bp, Artificial Sequence
  Synthetic Polynucleotide
taatacgactcactatagggtgatatggattttgatttaaacatttttataacagaggagaataaaaatgtttaaatcaaacctggcggcagcgcaaaagatg

SEQ ID NO: 54346 - DNA, 103 bp, Artificial Sequence
  Synthetic Polynucleotide
taatacgactcactataggggatgttgatatggattttgatttaaacattaacagaggagaaatgttatgatcaaaatcaacctggcggcagcgcaaaagatg

SEQ ID NO: 54347 - DNA, 103 bp, Artificial Sequence
  Synthetic Polynucleotide
taatacgactcactatagggcatcagatgttgatatggattttgatttaaaacagaggagattaaatatgaatccatataacctggcggcagcgcaaaagatg

SEQ ID NO: 54348 - DNA, 103 bp, Artificial Sequence
  Synthetic Polynucleotide
taatacgactcactatagggattaaccgaaaattctgtactccacgttagaacagaggagactaacgatgagtacagaaaacctggcggcagcgcaaaagatg

SEQ ID NO: 54349 - DNA, 103 bp, Artificial Sequence
  Synthetic Polynucleotide
taatacgactcactatagggtgattactacatgcttgttggagatacggaaacagaggagatccgtaatgccaacaagcaacctggcggcagcgcaaaagatg

SEQ ID NO: 54350 - DNA, 103 bp, Artificial Sequence
  Synthetic Polynucleotide
taatacgactcactatagggtagcgcatcagatgttgatatggattttgaaacagaggagatcaaaaatgatatcaacaaacctggcggcagcgcaaaagatg

SEQ ID NO: 54351 - DNA, 103 bp, Artificial Sequence
  Synthetic Polynucleotide
taatacgactcactatagggggtcttagcgcatcagatgttgatatggataacagaggagaatccatatgaacatctgaaacctggcggcagcgcaaaagatg

SEQ ID NO: 54352 - DNA, 103 bp, Artificial Sequence
  Synthetic Polynucleotide
taatacgactcactatagggagactggtcttagcgcatcagatgttgataaacagaggagatatcaaatgctgatgcgcaacctggcggcagcgcaaaagatg

SEQ ID NO: 54353 - DNA, 103 bp, Artificial Sequence
  Synthetic Polynucleotide
taatacgactcactatagggacgcgagactggtcttagcgcatcagatgtaacagaggagaacatctatggcgctaagaaacctggcggcagcgcaaaagatg

SEQ ID NO: 54354 - DNA, 103 bp, Artificial Sequence
  Synthetic Polynucleotide
taatacgactcactatagggcttgaacgcgagactggtcttagcgcatcaaacagaggagatgatgcatgaagaccagtaacctggcggcagcgcaaaagatg

SEQ ID NO: 54355 - DNA, 103 bp, Artificial Sequence
  Synthetic Polynucleotide
taatacgactcactatagggataatcttgaacgcgagactggtcttagcgaacagaggagacgctaaatgcagtctcgcaacctggcggcagcgcaaaagatg

SEQ ID NO: 54356 - DNA, 103 bp, Artificial Sequence
  Synthetic Polynucleotide
taatacgactcactatagggtaaagataatcttgaacgcgagactggtctaacagaggagaagaccaatgtcgcgttcaaacctggcggcagcgcaaaagatg

SEQ ID NO: 54357 - DNA, 103 bp, Artificial Sequence
  Synthetic Polynucleotide
taatacgactcactatagggattagtaaagataatcttgaacgcgagactaacagaggagaagtctcatgttcaagattaacctggcggcagcgcaaaagatg

SEQ ID NO: 54358 - DNA, 103 bp, Artificial Sequence
  Synthetic Polynucleotide
taatacgactcactatagggtcaccattagtaaagataatcttgaacgcgaacagaggagacgcgttatggattatcttaacctggcggcagcgcaaaagatg

SEQ ID NO: 54359 - DNA, 103 bp, Artificial Sequence
  Synthetic Polynucleotide
taatacgactcactataggggttcgtcaccattagtaaagataatcttgaaacagaggagatcaagaatgtctttactaaacctggcggcagcgcaaaagatg

SEQ ID NO: 54360 - DNA, 103 bp, Artificial Sequence
  Synthetic Polynucleotide
taatacgactcactatagggaaatttgattactacatgcttgttggagataacagaggagaatctccatgaagcatgtaaacctggcggcagcgcaaaagatg

SEQ ID NO: 54361 - DNA, 103 bp, Artificial Sequence
  Synthetic Polynucleotide
taatacgactcactataggggatgagttcgtcaccattagtaaagataataacagaggagaattatcatgactaatggtaacctggcggcagcgcaaaagatg

SEQ ID NO: 54362 - DNA, 103 bp, Artificial Sequence
  Synthetic Polynucleotide
taatacgactcactatagggtatacgatgagttcgtcaccattagtaaagaacagaggagactttacatgtggtgacgaaacctggcggcagcgcaaaagatg

SEQ ID NO: 54363 - DNA, 103 bp, Artificial Sequence
  Synthetic Polynucleotide
taatacgactcactatagggagttctatacgatgagttcgtcaccattagaacagaggagactaatgatgacgaactcaaacctggcggcagcgcaaaagatg

SEQ ID NO: 54364 - DNA, 103 bp, Artificial Sequence
  Synthetic Polynucleotide
taatacgactcactatagggcttagagttctatacgatgagttcgtcaccaacagaggagaggtgacatgctcatcgtaaacctggcggcagcgcaaaagatg

SEQ ID NO: 54365 - DNA, 103 bp, Artificial Sequence
  Synthetic Polynucleotide
taatacgactcactatagggacaaacttagagttctatacgatgagttcgaacagaggagacgaactatgcgtatagaaaacctggcggcagcgcaaaagatg

SEQ ID NO: 54366 - DNA, 103 bp, Artificial Sequence
  Synthetic Polynucleotide
taatacgactcactatagggaatggacaaacttagagttctatacgatgaaacagaggagatcatcgatgagaactctaaacctggcggcagcgcaaaagatg

SEQ ID NO: 54367 - DNA, 103 bp, Artificial Sequence
  Synthetic Polynucleotide
taatacgactcactatagggtaaataatggacaaacttagagttctatacaacagaggagagtatagatgtctaagtttaacctggcggcagcgcaaaagatg

SEQ ID NO: 54368 - DNA, 103 bp, Artificial Sequence
  Synthetic Polynucleotide
taatacgactcactataggggtaaataaataatggacaaacttagagttcaacagaggagagaactcatggtttgtccaaacctggcggcagcgcaaaagatg

SEQ ID NO: 54369 - DNA, 103 bp, Artificial Sequence
  Synthetic Polynucleotide
taatacgactcactatagggaatctgtaaataaataatggacaaacttagaacagaggagactaagtatgtccattattaacctggcggcagcgcaaaagatg

SEQ ID NO: 54370 - DNA, 103 bp, Artificial Sequence
  Synthetic Polynucleotide
taatacgactcactatagggaactaaatctgtaaataaataatggacaaaaacagaggagatttgtcatgtatttatttaacctggcggcagcgcaaaagatg

SEQ ID NO: 54371 - DNA, 103 bp, Artificial Sequence
  Synthetic Polynucleotide
taatacgactcactatagggacaccaaatttgattactacatgcttgttgaacagaggagacaacaaatgtgtagtaataacctggcggcagcgcaaaagatg

SEQ ID NO: 54372 - DNA, 103 bp, Artificial Sequence
  Synthetic Polynucleotide
taatacgactcactatagggtaaacaactaaatctgtaaataaataatggaacagaggagaccattaatgatttacagaaacctggcggcagcgcaaaagatg

SEQ ID NO: 54373 - DNA, 103 bp, Artificial Sequence
  Synthetic Polynucleotide
taatacgactcactatagggtaaattaaacaactaaatctgtaaataaataacagaggagaatttatatgcagatttagaacctggcggcagcgcaaaagatg

SEQ ID NO: 54374 - DNA, 103 bp, Artificial Sequence
  Synthetic Polynucleotide
taatacgactcactatagggacaaataaattaaacaactaaatctgtaaaaacagaggagatttacaatgttagttgttaacctggcggcagcgcaaaagatg

SEQ ID NO: 54375 - DNA, 103 bp, Artificial Sequence
  Synthetic Polynucleotide
taatacgactcactatagggagagtacaaataaattaaacaactaaatctaacagaggagaagatttatgtgtttaattaacctggcggcagcgcaaaagatg

SEQ ID NO: 54376 - DNA, 103 bp, Artificial Sequence
  Synthetic Polynucleotide
taatacgactcactatagggttggaagagtacaaataaattaaacaactaaacagaggagatagttgatgaatttatttaacctggcggcagcgcaaaagatg

SEQ ID NO: 54377 - DNA, 103 bp, Artificial Sequence
  Synthetic Polynucleotide
taatacgactcactatagggcaactttggaagagtacaaataaattaaacaacagaggagagtttaaatgatttgtactaacctggcggcagcgcaaaagatg

SEQ ID NO: 54378 - DNA, 103 bp, Artificial Sequence
  Synthetic Polynucleotide
taatacgactcactatagggtatcccaactttggaagagtacaaataaataacagaggagaatttatatgtactcttccaacctggcggcagcgcaaaagatg

SEQ ID NO: 54379 - DNA, 103 bp, Artificial Sequence
  Synthetic Polynucleotide
taatacgactcactatagggaatactatcccaactttggaagagtacaaaaacagaggagatttgtaatgttccaaagtaacctggcggcagcgcaaaagatg

SEQ ID NO: 54380 - DNA, 103 bp, Artificial Sequence
  Synthetic Polynucleotide
taatacgactcactatagggagaaaaatactatcccaactttggaagagtaacagaggagaactcttatgaagttgggaaacctggcggcagcgcaaaagatg

SEQ ID NO: 54381 - DNA, 103 bp, Artificial Sequence
  Synthetic Polynucleotide
taatacgactcactatagggacgttagaaaaatactatcccaactttggaaacagaggagatccaaaatggggatagtaaacctggcggcagcgcaaaagatg

SEQ ID NO: 54382 - DNA, 103 bp, Artificial Sequence
  Synthetic Polynucleotide
taatacgactcactatagggtaacaacaccaaatttgattactacatgctaacagaggagaagcatgatgtaatcaaataacctggcggcagcgcaaaagatg

SEQ ID NO: 54383 - DNA, 103 bp, Artificial Sequence
  Synthetic Polynucleotide
taatacgactcactatagggtaccaacgttagaaaaatactatcccaactaacagaggagaagttggatgagtatttttaacctggcggcagcgcaaaagatg

SEQ ID NO: 54384 - DNA, 103 bp, Artificial Sequence
  Synthetic Polynucleotide
taatacgactcactatagggtataataccaacgttagaaaaatactatccaacagaggagaggatagatgttttctaacaacctggcggcagcgcaaaagatg

SEQ ID NO: 54385 - DNA, 103 bp, Artificial Sequence
  Synthetic Polynucleotide
taatacgactcactatagggaataatataataccaacgttagaaaaatacaacagaggagagtatttatgtaacgttggaacctggcggcagcgcaaaagatg

SEQ ID NO: 54386 - DNA, 103 bp, Artificial Sequence
  Synthetic Polynucleotide
taatacgactcactatagggatcctaataatataataccaacgttagaaaaacagaggagatttctaatgttggtattaaacctggcggcagcgcaaaagatg

SEQ ID NO: 54387 - DNA, 103 bp, Artificial Sequence
  Synthetic Polynucleotide
taatacgactcactatagggcgtagatcctaataatataataccaacgttaacagaggagaaacgttatgattatattaaacctggcggcagcgcaaaagatg

SEQ ID NO: 54388 - DNA, 103 bp, Artificial Sequence
  Synthetic Polynucleotide
taatacgactcactatagggatgaacgtagatcctaataatataataccaaacagaggagatggtatatgattattaggaacctggcggcagcgcaaaagatg

SEQ ID NO: 54389 - DNA, 103 bp, Artificial Sequence
  Synthetic Polynucleotide
taatacgactcactatagggtacatatgaacgtagatcctaataatataaaacagaggagattatatatgtaggatctaaacctggcggcagcgcaaaagatg

SEQ ID NO: 54390 - DNA, 103 bp, Artificial Sequence
  Synthetic Polynucleotide
taatacgactcactatagggtatgatacatatgaacgtagatcctaataaaacagaggagattattaatgtctacgttcaacctggcggcagcgcaaaagatg

SEQ ID NO: 54391 - DNA, 103 bp, Artificial Sequence
  Synthetic Polynucleotide
taatacgactcactatagggaatattatgatacatatgaacgtagatcctaacagaggagaaggatcatggttcatatgaacctggcggcagcgcaaaagatg

SEQ ID NO: 54392 - DNA, 103 bp, Artificial Sequence
  Synthetic Polynucleotide
taatacgactcactatagggtgattaatattatgatacatatgaacgtagaacagaggagactacgtatgtatgtatcaaacctggcggcagcgcaaaagatg

SEQ ID NO: 54393 - DNA, 103 bp, Artificial Sequence
  Synthetic Polynucleotide
taatacgactcactatagggaagtttaacaacaccaaatttgattactacaacagaggagagtagtaatgaaatttggtaacctggcggcagcgcaaaagatg

SEQ ID NO: 54394 - DNA, 103 bp, Artificial Sequence
  Synthetic Polynucleotide
taatacgactcactataggggtggatgattaatattatgatacatatgaaaacagaggagattcataatgatcataataaacctggcggcagcgcaaaagatg

SEQ ID NO: 54395 - DNA, 103 bp, Artificial Sequence
  Synthetic Polynucleotide
taatacgactcactatagggaaaacgtggatgattaatattatgatacataacagaggagaatgtatatgaatattaataacctggcggcagcgcaaaagatg

SEQ ID NO: 54396 - DNA, 103 bp, Artificial Sequence
  Synthetic Polynucleotide
taatacgactcactatagggttatcaaaacgtggatgattaatattatgaaacagaggagatcataaatgtaatcatccaacctggcggcagcgcaaaagatg

SEQ ID NO: 54397 - DNA, 103 bp, Artificial Sequence
  Synthetic Polynucleotide
taatacgactcactatagggtagatttatcaaaacgtggatgattaatataacagaggagaatattaatgatccacgttaacctggcggcagcgcaaaagatg

SEQ ID NO: 54398 - DNA, 103 bp, Artificial Sequence
  Synthetic Polynucleotide
taatacgactcactatagggaaagatagatttatcaaaacgtggatgattaacagaggagaaatcatatgcgttttgataacctggcggcagcgcaaaagatg

SEQ ID NO: 54399 - DNA, 103 bp, Artificial Sequence
  Synthetic Polynucleotide
taatacgactcactatagggaagctaaagatagatttatcaaaacgtggaaacagaggagatccacgatgtgataaatcaacctggcggcagcgcaaaagatg

SEQ ID NO: 54400 - DNA, 103 bp, Artificial Sequence
  Synthetic Polynucleotide
taatacgactcactatagggttcagaagctaaagatagatttatcaaaacaacagaggagagttttgatgaatctatctaacctggcggcagcgcaaaagatg

SEQ ID NO: 54401 - DNA, 103 bp, Artificial Sequence
  Synthetic Polynucleotide
taatacgactcactataggggttatttcagaagctaaagatagatttatcaacagaggagagataaaatgatctttagcaacctggcggcagcgcaaaagatg

SEQ ID NO: 54402 - DNA, 103 bp, Artificial Sequence
  Synthetic Polynucleotide
taatacgactcactatagggaatacgttatttcagaagctaaagatagataacagaggagaatctatatgtagcttctgaacctggcggcagcgcaaaagatg

SEQ ID NO: 54403 - DNA, 103 bp, Artificial Sequence
  Synthetic Polynucleotide
taatacgactcactataggggtttaaatacgttatttcagaagctaaagaaacagaggagatctttaatgtctgaaataaacctggcggcagcgcaaaagatg

SEQ ID NO: 54404 - DNA, 103 bp, Artificial Sequence
  Synthetic Polynucleotide
taatacgactcactatagggttgcgaagtttaacaacaccaaatttgattaacagaggagaaatcaaatgtggtgttgtaacctggcggcagcgcaaaagatg

SEQ ID NO: 54405 - DNA, 103 bp, Artificial Sequence
  Synthetic Polynucleotide
taatacgactcactatagggcctttgtttaaatacgttatttcagaagctaacagaggagaagcttcatgaataacgtaaacctggcggcagcgcaaaagatg

SEQ ID NO: 54406 - DNA, 103 bp, Artificial Sequence
  Synthetic Polynucleotide
taatacgactcactatagggtttctcctttgtttaaatacgttatttcagaacagaggagactgaaaatgcgtatttaaaacctggcggcagcgcaaaagatg

SEQ ID NO: 54407 - DNA, 103 bp, Artificial Sequence
  Synthetic Polynucleotide
taatacgactcactatagggatatttttctcctttgtttaaatacgttataacagaggagaataacgatgttaaacaaaaacctggcggcagcgcaaaagatg

SEQ ID NO: 54408 - DNA, 103 bp, Artificial Sequence
  Synthetic Polynucleotide
taatacgactcactataggggctaaatatttttctcctttgtttaaatacaacagaggagagtatttatgcaaaggagaaacctggcggcagcgcaaaagatg

SEQ ID NO: 54409 - DNA, 103 bp, Artificial Sequence
  Synthetic Polynucleotide
taatacgactcactatagggccgtagctaaatatttttctcctttgtttaaacagaggagataaacaatggagaaaaataacctggcggcagcgcaaaagatg

SEQ ID NO: 54410 - DNA, 103 bp, Artificial Sequence
  Synthetic Polynucleotide
taatacgactcactatagggtgatgccgtagctaaatatttttctcctttaacagaggagaaaaggaatgaaatatttaaacctggcggcagcgcaaaagatg

SEQ ID NO: 54411 - DNA, 103 bp, Artificial Sequence
  Synthetic Polynucleotide
taatacgactcactatagggacgtctgatgccgtagctaaatatttttctaacagaggagaagaaaaatgtttagctacaacctggcggcagcgcaaaagatg

SEQ ID NO: 54412 - DNA, 103 bp, Artificial Sequence
  Synthetic Polynucleotide
taatacgactcactatagggttattacgtctgatgccgtagctaaatattaacagaggagaaatattatgctacggcataacctggcggcagcgcaaaagatg

SEQ ID NO: 54413 - DNA, 103 bp, Artificial Sequence
  Synthetic Polynucleotide
taatacgactcactatagggaaatgttattacgtctgatgccgtagctaaaacagaggagattagctatggcatcagacaacctggcggcagcgcaaaagatg

SEQ ID NO: 54414 - DNA, 103 bp, Artificial Sequence
  Synthetic Polynucleotide
taatacgactcactatagggacaaaaaatgttattacgtctgatgccgtaaacagaggagatacggcatgagacgtaataacctggcggcagcgcaaaagatg

SEQ ID NO: 54415 - DNA, 103 bp, Artificial Sequence
  Synthetic Polynucleotide
taatacgactcactataggggaatattgcgaagtttaacaacaccaaattaacagaggagaaatttgatgttgttaaacaacctggcggcagcgcaaaagatg

SEQ ID NO: 54416 - DNA, 103 bp, Artificial Sequence
  Synthetic Polynucleotide
taatacgactcactatagggcatttacaaaaaatgttattacgtctgatgaacagaggagacatcagatgtaataacataacctggcggcagcgcaaaagatg

SEQ ID NO: 54417 - DNA, 103 bp, Artificial Sequence
  Synthetic Polynucleotide
taatacgactcactatagggcgttacatttacaaaaaatgttattacgtcaacagaggagagacgtaatgacattttttaacctggcggcagcgcaaaagatg

SEQ ID NO: 54418 - DNA, 103 bp, Artificial Sequence
  Synthetic Polynucleotide
taatacgactcactatagggaaatacgttacatttacaaaaaatgttattaacagaggagaaataacatgttttgtaaaaacctggcggcagcgcaaaagatg

SEQ ID NO: 54419 - DNA, 103 bp, Artificial Sequence
  Synthetic Polynucleotide
taatacgactcactatagggcgtctaaatacgttacatttacaaaaaatgaacagaggagacattttatgtaaatgtaaaacctggcggcagcgcaaaagatg

SEQ ID NO: 54420 - DNA, 103 bp, Artificial Sequence
  Synthetic Polynucleotide
taatacgactcactatagggtctctcgtctaaatacgttacatttacaaaaacagaggagatttgtaatggtaacgtataacctggcggcagcgcaaaagatg

SEQ ID NO: 54421 - DNA, 103 bp, Artificial Sequence
  Synthetic Polynucleotide
taatacgactcactataggggaagatctctcgtctaaatacgttacatttaacagaggagaaaatgtatggtatttagaaacctggcggcagcgcaaaagatg

SEQ ID NO: 54422 - DNA, 103 bp, Artificial Sequence
  Synthetic Polynucleotide
taatacgactcactatagggttaacgaagatctctcgtctaaatacgttaaacagaggagataacgtatgtagacgagaaacctggcggcagcgcaaaagatg

SEQ ID NO: 54423 - DNA, 103 bp, Artificial Sequence
  Synthetic Polynucleotide
taatacgactcactatagggactttttaacgaagatctctcgtctaaataaacagaggagatatttaatggagagatctaacctggcggcagcgcaaaagatg

SEQ ID NO: 54424 - DNA, 103 bp, Artificial Sequence
  Synthetic Polynucleotide
taatacgactcactatagggggaaaactttttaacgaagatctctcgtctaacagaggagaagacgaatgatcttcgttaacctggcggcagcgcaaaagatg

SEQ ID NO: 54425 - DNA, 103 bp, Artificial Sequence
  Synthetic Polynucleotide
taatacgactcactatagggtagatggaaaactttttaacgaagatctctaacagaggagaagagatatgcgttaaaaaaacctggcggcagcgcaaaagatg

SEQ ID NO: 54426 - DNA, 103 bp, Artificial Sequence
  Synthetic Polynucleotide
taatacgactcactatagggttaatgaatattgcgaagtttaacaacaccaacagaggagaggtgttatgaaacttcgcaacctggcggcagcgcaaaagatg

SEQ ID NO: 54427 - DNA, 103 bp, Artificial Sequence
  Synthetic Polynucleotide
taatacgactcactatagggctacatagatggaaaactttttaacgaagaaacagaggagatcttcgatgaaaagttttaacctggcggcagcgcaaaagatg

SEQ ID NO: 54428 - DNA, 103 bp, Artificial Sequence
  Synthetic Polynucleotide
taatacgactcactatagggggattctacatagatggaaaactttttaacaacagaggagagttaaaatgttttccatcaacctggcggcagcgcaaaagatg

SEQ ID NO: 54429 - DNA, 103 bp, Artificial Sequence
  Synthetic Polynucleotide
taatacgactcactatagggccgatggattctacatagatggaaaactttaacagaggagaaaagttatgcatctatgtaacctggcggcagcgcaaaagatg

SEQ ID NO: 54430 - DNA, 103 bp, Artificial Sequence
  Synthetic Polynucleotide
taatacgactcactatagggaacaaccgatggattctacatagatggaaaaacagaggagatttccaatgatgtagaataacctggcggcagcgcaaaagatg

SEQ ID NO: 54431 - DNA, 103 bp, Artificial Sequence
  Synthetic Polynucleotide
taatacgactcactataggggtgttaacaaccgatggattctacatagataacagaggagaatctatatggaatccatcaacctggcggcagcgcaaaagatg

SEQ ID NO: 54432 - DNA, 103 bp, Artificial Sequence
  Synthetic Polynucleotide
taatacgactcactataggggaatggtgttaacaaccgatggattctacaaacagaggagatgtagaatgcatcggttgaacctggcggcagcgcaaaagatg

SEQ ID NO: 54433 - DNA, 103 bp, Artificial Sequence
  Synthetic Polynucleotide
taatacgactcactatagggcgcgggaatggtgttaacaaccgatggattaacagaggagaaatccaatggttgttaacaacctggcggcagcgcaaaagatg

SEQ ID NO: 54434 - DNA, 103 bp, Artificial Sequence
  Synthetic Polynucleotide
taatacgactcactatagggtctgacgcgggaatggtgttaacaaccgataacagaggagaatcggtatgtaacaccataacctggcggcagcgcaaaagatg

SEQ ID NO: 54435 - DNA, 103 bp, Artificial Sequence
  Synthetic Polynucleotide
taatacgactcactatagggttcaatctgacgcgggaatggtgttaacaaaacagaggagattgttaatgccattcccgaacctggcggcagcgcaaaagatg

SEQ ID NO: 54436 - DNA, 103 bp, Artificial Sequence
  Synthetic Polynucleotide
taatacgactcactatagggtcctattcaatctgacgcgggaatggtgttaacagaggagaaacaccatgcccgcgtcaaacctggcggcagcgcaaaagatg

SEQ ID NO: 54437 - DNA, 103 bp, Artificial Sequence
  Synthetic Polynucleotide
taatacgactcactatagggctaaattaatgaatattgcgaagtttaacaaacagaggagatgttaaatgtcgcaatataacctggcggcagcgcaaaagatg

SEQ ID NO: 54438 - DNA, 103 bp, Artificial Sequence
  Synthetic Polynucleotide
taatacgactcactatagggcaaactcctattcaatctgacgcgggaatgaacagaggagacattccatggtcagattgaacctggcggcagcgcaaaagatg

SEQ ID NO: 54439 - DNA, 103 bp, Artificial Sequence
  Synthetic Polynucleotide
taatacgactcactatagggctattcaaactcctattcaatctgacgcggaacagaggagaccgcgtatgattgaatagaacctggcggcagcgcaaaagatg

SEQ ID NO: 54440 - DNA, 103 bp, Artificial Sequence
  Synthetic Polynucleotide
taatacgactcactatagggacaaactattcaaactcctattcaatctgaaacagaggagatcagatatgataggagttaacctggcggcagcgcaaaagatg

SEQ ID NO: 54441 - DNA, 103 bp, Artificial Sequence
  Synthetic Polynucleotide
taatacgactcactatagggccaaaacaaactattcaaactcctattcaaaacagaggagattgaatatgagtttgaataacctggcggcagcgcaaaagatg

SEQ ID NO: 54442 - DNA, 103 bp, Artificial Sequence
  Synthetic Polynucleotide
taatacgactcactatagggtatttccaaaacaaactattcaaactcctaaacagaggagataggagatggaatagtttaacctggcggcagcgcaaaagatg

SEQ ID NO: 54443 - DNA, 103 bp, Artificial Sequence
  Synthetic Polynucleotide
taatacgactcactatagggggatctatttccaaaacaaactattcaaacaacagaggagagtttgaatggtttgttttaacctggcggcagcgcaaaagatg

SEQ ID NO: 54444 - DNA, 103 bp, Artificial Sequence
  Synthetic Polynucleotide
taatacgactcactatagggttgaaggatctatttccaaaacaaactattaacagaggagaaatagtatgttttggaaaaacctggcggcagcgcaaaagatg

SEQ ID NO: 54445 - DNA, 103 bp, Artificial Sequence
  Synthetic Polynucleotide
taatacgactcactatagggagttattgaaggatctatttccaaaacaaaaacagaggagatttgttatggaaatagataacctggcggcagcgcaaaagatg

SEQ ID NO: 54446 - DNA, 103 bp, Artificial Sequence
  Synthetic Polynucleotide
taatacgactcactatagggctataagttattgaaggatctatttccaaaaacagaggagatttggaatgagatccttcaacctggcggcagcgcaaaagatg

SEQ ID NO: 54447 - DNA, 103 bp, Artificial Sequence
  Synthetic Polynucleotide
taatacgactcactatagggcccaactataagttattgaaggatctatttaacagaggagaaaatagatgcttcaataaaacctggcggcagcgcaaaagatg

SEQ ID NO: 54448 - DNA, 103 bp, Artificial Sequence
  Synthetic Polynucleotide
taatacgactcactatagggtctatctaaattaatgaatattgcgaagttaacagaggagaaacttcatgatattcattaacctggcggcagcgcaaaagatg

SEQ ID NO: 54449 - DNA, 103 bp, Artificial Sequence
  Synthetic Polynucleotide
taatacgactcactatagggtcccacccaactataagttattgaaggatcaacagaggagagatcctatgataacttataacctggcggcagcgcaaaagatg

SEQ ID NO: 54450 - DNA, 103 bp, Artificial Sequence
  Synthetic Polynucleotide
taatacgactcactatagggttttttcccacccaactataagttattgaaaacagaggagattcaatatgttatagttgaacctggcggcagcgcaaaagatg

SEQ ID NO: 54451 - DNA, 103 bp, Artificial Sequence
  Synthetic Polynucleotide
taatacgactcactatagggatcgattttttcccacccaactataagttaaacagaggagataacttatggttgggtggaacctggcggcagcgcaaaagatg

SEQ ID NO: 54452 - DNA, 103 bp, Artificial Sequence
  Synthetic Polynucleotide
taatacgactcactatagggataaaatcgattttttcccacccaactataaacagaggagatatagtatggtgggaaaaaacctggcggcagcgcaaaagatg

SEQ ID NO: 54453 - DNA, 103 bp, Artificial Sequence
  Synthetic Polynucleotide
taatacgactcactatagggtagtgataaaatcgattttttcccacccaaaacagaggagattgggtatgaaaaaatcgaacctggcggcagcgcaaaagatg

SEQ ID NO: 54454 - DNA, 103 bp, Artificial Sequence
  Synthetic Polynucleotide
taatacgactcactataggggagtctagtgataaaatcgattttttcccaaacagaggagatgggaaatgatcgattttaacctggcggcagcgcaaaagatg

SEQ ID NO: 54455 - DNA, 103 bp, Artificial Sequence
  Synthetic Polynucleotide
taatacgactcactatagggagaaagagtctagtgataaaatcgatttttaacagaggagaaaaaatatgttttatcacaacctggcggcagcgcaaaagatg

SEQ ID NO: 54456 - DNA, 103 bp, Artificial Sequence
  Synthetic Polynucleotide
taatacgactcactatagggaaaaaagaaagagtctagtgataaaatcgaaacagaggagatcgattatgtcactagacaacctggcggcagcgcaaaagatg

SEQ ID NO: 54457 - DNA, 103 bp, Artificial Sequence
  Synthetic Polynucleotide
taatacgactcactatagggatagtaaaaaagaaagagtctagtgataaaaacagaggagatttatcatgagactctttaacctggcggcagcgcaaaagatg

SEQ ID NO: 54458 - DNA, 103 bp, Artificial Sequence
  Synthetic Polynucleotide
taatacgactcactatagggtaatgatagtaaaaaagaaagagtctagtgaacagaggagacactagatgctttcttttaacctggcggcagcgcaaaagatg

SEQ ID NO: 54459 - DNA, 103 bp, Artificial Sequence
  Synthetic Polynucleotide
taatacgactcactatagggaactcattaaccgaaaattctgtactccacaacagaggagagtggagatgagaattttcaacctggcggcagcgcaaaagatg

SEQ ID NO: 54460 - DNA, 103 bp, Artificial Sequence
  Synthetic Polynucleotide
taatacgactcactatagggaaatttctatctaaattaatgaatattgcgaacagaggagacgcaatatgcattaatttaacctggcggcagcgcaaaagatg

SEQ ID NO: 54461 - DNA, 103 bp, Artificial Sequence
  Synthetic Polynucleotide
taatacgactcactatagggtgaggtaatgatagtaaaaaagaaagagtcaacagaggagagactctatgttttttactaacctggcggcagcgcaaaagatg

SEQ ID NO: 54462 - DNA, 103 bp, Artificial Sequence
  Synthetic Polynucleotide
taatacgactcactataggggttcatgaggtaatgatagtaaaaaagaaaaacagaggagatttcttatgtactatcataacctggcggcagcgcaaaagatg

SEQ ID NO: 54463 - DNA, 103 bp, Artificial Sequence
  Synthetic Polynucleotide
taatacgactcactatagggaaatagttcatgaggtaatgatagtaaaaaaacagaggagatttttaatgtcattacctaacctggcggcagcgcaaaagatg

SEQ ID NO: 54464 - DNA, 103 bp, Artificial Sequence
  Synthetic Polynucleotide
taatacgactcactatagggtcaagaaatagttcatgaggtaatgatagtaacagaggagaactatcatgacctcatgaaacctggcggcagcgcaaaagatg

SEQ ID NO: 54465 - DNA, 103 bp, Artificial Sequence
  Synthetic Polynucleotide
taatacgactcactatagggctcattcaagaaatagttcatgaggtaatgaacagaggagacattacatgatgaactataacctggcggcagcgcaaaagatg

SEQ ID NO: 54466 - DNA, 103 bp, Artificial Sequence
  Synthetic Polynucleotide
taatacgactcactatagggatatactcattcaagaaatagttcatgaggaacagaggagacctcatatgctatttcttaacctggcggcagcgcaaaagatg

SEQ ID NO: 54467 - DNA, 103 bp, Artificial Sequence
  Synthetic Polynucleotide
taatacgactcactatagggaatacatatactcattcaagaaatagttcaaacagaggagatgaactatgtcttgaatgaacctggcggcagcgcaaaagatg

SEQ ID NO: 54468 - DNA, 103 bp, Artificial Sequence
  Synthetic Polynucleotide
taatacgactcactatagggaagaaaatacatatactcattcaagaaataaacagaggagatatttcatgaatgagtataacctggcggcagcgcaaaagatg

SEQ ID NO: 54469 - DNA, 103 bp, Artificial Sequence
  Synthetic Polynucleotide
taatacgactcactatagggtaggaaagaaaatacatatactcattcaagaacagaggagacttgaaatggtatatgtaaacctggcggcagcgcaaaagatg

SEQ ID NO: 54470 - DNA, 103 bp, Artificial Sequence
  Synthetic Polynucleotide
taatacgactcactatagggcgatataggaaagaaaatacatatactcataacagaggagaatgagtatgtgtattttcaacctggcggcagcgcaaaagatg

SEQ ID NO: 54471 - DNA, 103 bp, Artificial Sequence
  Synthetic Polynucleotide
taatacgactcactatagggagtataaatttctatctaaattaatgaataaacagaggagatattcaatgatttagataaacctggcggcagcgcaaaagatg

SEQ ID NO: 54472 - DNA, 103 bp, Artificial Sequence
  Synthetic Polynucleotide
taatacgactcactataggggcgtccgatataggaaagaaaatacatataaacagaggagatatatgatgtttctttccaacctggcggcagcgcaaaagatg

SEQ ID NO: 54473 - DNA, 103 bp, Artificial Sequence
  Synthetic Polynucleotide
taatacgactcactatagggtgaacgcgtccgatataggaaagaaaatacaacagaggagagtatttatgttcctatataacctggcggcagcgcaaaagatg

SEQ ID NO: 54474 - DNA, 103 bp, Artificial Sequence
  Synthetic Polynucleotide
taatacgactcactatagggtccaatgaacgcgtccgatataggaaagaaaacagaggagattctttatgatatcggacaacctggcggcagcgcaaaagatg

SEQ ID NO: 54475 - DNA, 103 bp, Artificial Sequence
  Synthetic Polynucleotide
taatacgactcactatagggtattttccaatgaacgcgtccgatataggaaacagaggagatcctatatgggacgcgttaacctggcggcagcgcaaaagatg

SEQ ID NO: 54476 - DNA, 103 bp, Artificial Sequence
  Synthetic Polynucleotide
taatacgactcactatagggtggtatattttccaatgaacgcgtccgataaacagaggagatatcggatgcgttcattgaacctggcggcagcgcaaaagatg

SEQ ID NO: 54477 - DNA, 103 bp, Artificial Sequence
  Synthetic Polynucleotide
taatacgactcactatagggcgacatggtatattttccaatgaacgcgtcaacagaggagagacgcgatgattggaaaaaacctggcggcagcgcaaaagatg

SEQ ID NO: 54478 - DNA, 103 bp, Artificial Sequence
  Synthetic Polynucleotide
taatacgactcactataggggttaacgacatggtatattttccaatgaacaacagaggagagttcatatgaaaatatacaacctggcggcagcgcaaaagatg

SEQ ID NO: 54479 - DNA, 103 bp, Artificial Sequence
  Synthetic Polynucleotide
taatacgactcactatagggttatagttaacgacatggtatattttccaaaacagaggagattggaaatgataccatgtaacctggcggcagcgcaaaagatg

SEQ ID NO: 54480 - DNA, 103 bp, Artificial Sequence
  Synthetic Polynucleotide
taatacgactcactatagggtattcttatagttaacgacatggtatatttaacagaggagaaaatatatgatgtcgttaaacctggcggcagcgcaaaagatg

SEQ ID NO: 54481 - DNA, 103 bp, Artificial Sequence
  Synthetic Polynucleotide
taatacgactcactatagggaaaaatattcttatagttaacgacatggtaaacagaggagataccatatggttaactataacctggcggcagcgcaaaagatg

SEQ ID NO: 54482 - DNA, 103 bp, Artificial Sequence
  Synthetic Polynucleotide
taatacgactcactatagggtgatgagtataaatttctatctaaattaataacagaggagaattaatatggatagaaataacctggcggcagcgcaaaagatg

SEQ ID NO: 54483 - DNA, 103 bp, Artificial Sequence
  Synthetic Polynucleotide
taatacgactcactatagggaggataaaaatattcttatagttaacgacaaacagaggagatgtcgtatgctataagaaaacctggcggcagcgcaaaagatg

SEQ ID NO: 54484 - DNA, 103 bp, Artificial Sequence
  Synthetic Polynucleotide
taatacgactcactatagggaaacgaggataaaaatattcttatagttaaaacagaggagattaactatgagaatatttaacctggcggcagcgcaaaagatg

SEQ ID NO: 54485 - DNA, 103 bp, Artificial Sequence
  Synthetic Polynucleotide
taatacgactcactatagggtttgtaaacgaggataaaaatattcttataaacagaggagatataagatgatttttatcaacctggcggcagcgcaaaagatg

SEQ ID NO: 54486 - DNA, 103 bp, Artificial Sequence
  Synthetic Polynucleotide
taatacgactcactatagggttcagtttgtaaacgaggataaaaatattcaacagaggagagaatatatgtatcctcgtaacctggcggcagcgcaaaagatg

SEQ ID NO: 54487 - DNA, 103 bp, Artificial Sequence
  Synthetic Polynucleotide
taatacgactcactatagggtattattcagtttgtaaacgaggataaaaaaacagaggagatttttaatgtcgtttacaaacctggcggcagcgcaaaagatg

SEQ ID NO: 54488 - DNA, 103 bp, Artificial Sequence
  Synthetic Polynucleotide
taatacgactcactatagggtctaatattattcagtttgtaaacgaggataacagaggagaatcctcatgtacaaactgaacctggcggcagcgcaaaagatg

SEQ ID NO: 54489 - DNA, 103 bp, Artificial Sequence
  Synthetic Polynucleotide
taatacgactcactatagggctacgtctaatattattcagtttgtaaacgaacagaggagacgtttaatgactgaataaaacctggcggcagcgcaaaagatg

SEQ ID NO: 54490 - DNA, 103 bp, Artificial Sequence
  Synthetic Polynucleotide
taatacgactcactatagggacgaactacgtctaatattattcagtttgtaacagaggagaacaaacatgataatattaaacctggcggcagcgcaaaagatg

SEQ ID NO: 54491 - DNA, 103 bp, Artificial Sequence
  Synthetic Polynucleotide
taatacgactcactatagggcgtttacgaactacgtctaatattattcagaacagaggagactgaatatgattagacgtaacctggcggcagcgcaaaagatg

SEQ ID NO: 54492 - DNA, 103 bp, Artificial Sequence
  Synthetic Polynucleotide
taatacgactcactatagggtagttcgtttacgaactacgtctaatattaaacagaggagataatatatgacgtagttcaacctggcggcagcgcaaaagatg

SEQ ID NO: 54493 - DNA, 103 bp, Artificial Sequence
  Synthetic Polynucleotide
taatacgactcactatagggacagatgatgagtataaatttctatctaaaaacagaggagatttagaatgaaatttataaacctggcggcagcgcaaaagatg

SEQ ID NO: 54494 - DNA, 103 bp, Artificial Sequence
  Synthetic Polynucleotide
taatacgactcactatagggtgatatagttcgtttacgaactacgtctaaaacagaggagattagacatggttcgtaaaaacctggcggcagcgcaaaagatg

SEQ ID NO: 54495 - DNA, 103 bp, Artificial Sequence
  Synthetic Polynucleotide
taatacgactcactatagggggtaatgatatagttcgtttacgaactacgaacagaggagacgtagtatgtaaacgaacaacctggcggcagcgcaaaagatg

SEQ ID NO: 54496 - DNA, 103 bp, Artificial Sequence
  Synthetic Polynucleotide
taatacgactcactataggggtactggtaatgatatagttcgtttacgaaaacagaggagattcgtaatggaactatataacctggcggcagcgcaaaagatg

SEQ ID NO: 54497 - DNA, 103 bp, Artificial Sequence
  Synthetic Polynucleotide
taatacgactcactatagggatgttgtactggtaatgatatagttcgtttaacagaggagaaaacgaatgatatcattaaacctggcggcagcgcaaaagatg

SEQ ID NO: 54498 - DNA, 103 bp, Artificial Sequence
  Synthetic Polynucleotide
taatacgactcactataggggttagatgttgtactggtaatgatatagttaacagaggagaaactatatgattaccagtaacctggcggcagcgcaaaagatg

SEQ ID NO: 54499 - DNA, 103 bp, Artificial Sequence
  Synthetic Polynucleotide
taatacgactcactatagggatatagttagatgttgtactggtaatgataaacagaggagatatcatatgcagtacaacaacctggcggcagcgcaaaagatg

SEQ ID NO: 54500 - DNA, 103 bp, Artificial Sequence
  Synthetic Polynucleotide
taatacgactcactatagggatatcatatagttagatgttgtactggtaaaacagaggagattaccaatgcaacatctaaacctggcggcagcgcaaaagatg

SEQ ID NO: 54501 - DNA, 103 bp, Artificial Sequence
  Synthetic Polynucleotide
taatacgactcactatagggagtggatatcatatagttagatgttgtactaacagaggagaagtacaatgtctaactataacctggcggcagcgcaaaagatg

SEQ ID NO: 54502 - DNA, 103 bp, Artificial Sequence
  Synthetic Polynucleotide
taatacgactcactatagggaaactagtggatatcatatagttagatgttaacagaggagaaacatcatgctatatgataacctggcggcagcgcaaaagatg

SEQ ID NO: 54503 - DNA, 103 bp, Artificial Sequence
  Synthetic Polynucleotide
taatacgactcactatagggaaaggaaactagtggatatcatatagttagaacagaggagactaactatgtgatatccaaacctggcggcagcgcaaaagatg

SEQ ID NO: 54504 - DNA, 103 bp, Artificial Sequence
  Synthetic Polynucleotide
taatacgactcactatagggctaaaacagatgatgagtataaatttctataacagaggagaatagaaatgtatactcataacctggcggcagcgcaaaagatg

SEQ ID NO: 54505 - DNA, 103 bp, Artificial Sequence
  Synthetic Polynucleotide
taatacgactcactatagggcggctaaaggaaactagtggatatcatataaacagaggagatatatgatgtccactagtaacctggcggcagcgcaaaagatg

SEQ ID NO: 54506 - DNA, 103 bp, Artificial Sequence
  Synthetic Polynucleotide
taatacgactcactatagggataaacggctaaaggaaactagtggatatcaacagaggagagatatcatgtagtttcctaacctggcggcagcgcaaaagatg

SEQ ID NO: 54507 - DNA, 103 bp, Artificial Sequence
  Synthetic Polynucleotide
taatacgactcactatagggagataataaacggctaaaggaaactagtggaacagaggagaccactaatgtcctttagcaacctggcggcagcgcaaaagatg

SEQ ID NO: 54508 - DNA, 103 bp, Artificial Sequence
  Synthetic Polynucleotide
taatacgactcactataggggaacaagataataaacggctaaaggaaactaacagaggagaagtttcatgtagccgtttaacctggcggcagcgcaaaagatg

SEQ ID NO: 54509 - DNA, 103 bp, Artificial Sequence
  Synthetic Polynucleotide
taatacgactcactatagggatatggaacaagataataaacggctaaaggaacagaggagacctttaatggtttattataacctggcggcagcgcaaaagatg

SEQ ID NO: 54510 - DNA, 103 bp, Artificial Sequence
  Synthetic Polynucleotide
taatacgactcactatagggtgctaatatggaacaagataataaacggctaacagaggagaagccgtatgttatcttgtaacctggcggcagcgcaaaagatg

SEQ ID NO: 54511 - DNA, 103 bp, Artificial Sequence
  Synthetic Polynucleotide
taatacgactcactatagggatgactgctaatatggaacaagataataaaaacagaggagatttattatgttgttccataacctggcggcagcgcaaaagatg

SEQ ID NO: 54512 - DNA, 103 bp, Artificial Sequence
  Synthetic Polynucleotide
taatacgactcactatagggatggaatgactgctaatatggaacaagataaacagaggagatatcttatgccatattagaacctggcggcagcgcaaaagatg

SEQ ID NO: 54513 - DNA, 103 bp, Artificial Sequence
  Synthetic Polynucleotide
taatacgactcactatagggaaatgatggaatgactgctaatatggaacaaacagaggagatgttccatgttagcagtcaacctggcggcagcgcaaaagatg

SEQ ID NO: 54514 - DNA, 103 bp, Artificial Sequence
  Synthetic Polynucleotide
taatacgactcactatagggttcttaaatgatggaatgactgctaatatgaacagaggagacatattatgagtcattccaacctggcggcagcgcaaaagatg

SEQ ID NO: 54515 - DNA, 103 bp, Artificial Sequence
  Synthetic Polynucleotide
taatacgactcactataggggattcctaaaacagatgatgagtataaattaacagaggagaaatttaatgtcatcatctaacctggcggcagcgcaaaagatg

SEQ ID NO: 54516 - DNA, 103 bp, Artificial Sequence
  Synthetic Polynucleotide
taatacgactcactatagggacgccttcttaaatgatggaatgactgctaaacagaggagatagcagatgttccatcataacctggcggcagcgcaaaagatg

SEQ ID NO: 54517 - DNA, 103 bp, Artificial Sequence
  Synthetic Polynucleotide
taatacgactcactatagggctttgacgccttcttaaatgatggaatgacaacagaggagagtcattatgtcatttaagaacctggcggcagcgcaaaagatg

SEQ ID NO: 54518 - DNA, 103 bp, Artificial Sequence
  Synthetic Polynucleotide
taatacgactcactatagggattatctttgacgccttcttaaatgatggaaacagaggagatccatcatgtaagaaggcaacctggcggcagcgcaaaagatg

SEQ ID NO: 54519 - DNA, 103 bp, Artificial Sequence
  Synthetic Polynucleotide
taatacgactcactatagggtccctattatctttgacgccttcttaaatgaacagaggagacatttaatgaggcgtcaaaacctggcggcagcgcaaaagatg

SEQ ID NO: 54520 - DNA, 103 bp, Artificial Sequence
  Synthetic Polynucleotide
taatacgactcactatagggatttctccctattatctttgacgccttcttaacagaggagaaagaagatgtcaaagataaacctggcggcagcgcaaaagatg

SEQ ID NO: 54521 - DNA, 103 bp, Artificial Sequence
  Synthetic Polynucleotide
taatacgactcactatagggatgtcatttctccctattatctttgacgccaacagaggagaggcgtcatggataataggaacctggcggcagcgcaaaagatg

SEQ ID NO: 54522 - DNA, 103 bp, Artificial Sequence
  Synthetic Polynucleotide
taatacgactcactatagggccaaaatgtcatttctccctattatctttgaacagaggagacaaagaatgtagggagaaaacctggcggcagcgcaaaagatg

SEQ ID NO: 54523 - DNA, 103 bp, Artificial Sequence
  Synthetic Polynucleotide
taatacgactcactatagggagaatccaaaatgtcatttctccctattataacagaggagaataataatgagaaatgacaacctggcggcagcgcaaaagatg

SEQ ID NO: 54524 - DNA, 103 bp, Artificial Sequence
  Synthetic Polynucleotide
taatacgactcactataggggtaacagaatccaaaatgtcatttctccctaacagaggagaagggagatgtgacattttaacctggcggcagcgcaaaagatg

SEQ ID NO: 54525 - DNA, 103 bp, Artificial Sequence
  Synthetic Polynucleotide
taatacgactcactatagggaagtagtaacagaatccaaaatgtcatttcaacagaggagagaaatgatgttttggattaacctggcggcagcgcaaaagatg

SEQ ID NO: 54526 - DNA, 103 bp, Artificial Sequence
  Synthetic Polynucleotide
taatacgactcactatagggacatggattcctaaaacagatgatgagtataacagaggagaatactcatgatctgttttaacctggcggcagcgcaaaagatg

SEQ ID NO: 54527 - DNA, 103 bp, Artificial Sequence
  Synthetic Polynucleotide
taatacgactcactatagggtggtaaagtagtaacagaatccaaaatgtcaacagaggagagacattatggattctgttaacctggcggcagcgcaaaagatg

SEQ ID NO: 54528 - DNA, 103 bp, Artificial Sequence
  Synthetic Polynucleotide
taatacgactcactatagggaattttggtaaagtagtaacagaatccaaaaacagaggagatttggaatgtgttactacaacctggcggcagcgcaaaagatg

SEQ ID NO: 54529 - DNA, 103 bp, Artificial Sequence
  Synthetic Polynucleotide
taatacgactcactatagggtccttaattttggtaaagtagtaacagaataacagaggagaattctgatgctactttacaacctggcggcagcgcaaaagatg

SEQ ID NO: 54530 - DNA, 103 bp, Artificial Sequence
  Synthetic Polynucleotide
taatacgactcactataggggtatatccttaattttggtaaagtagtaacaacagaggagagttactatgttaccaaaaaacctggcggcagcgcaaaagatg

SEQ ID NO: 54531 - DNA, 103 bp, Artificial Sequence
  Synthetic Polynucleotide
taatacgactcactatagggagtccgtatatccttaattttggtaaagtaaacagaggagatactttatgaaaattaagaacctggcggcagcgcaaaagatg

SEQ ID NO: 54532 - DNA, 103 bp, Artificial Sequence
  Synthetic Polynucleotide
taatacgactcactatagggtagtaagtccgtatatccttaattttggtaaacagaggagataccaaatgtaaggatataacctggcggcagcgcaaaagatg

SEQ ID NO: 54533 - DNA, 103 bp, Artificial Sequence
  Synthetic Polynucleotide
taatacgactcactatagggaaagatagtaagtccgtatatccttaatttaacagaggagaaaattaatgatatacggaaacctggcggcagcgcaaaagatg

SEQ ID NO: 54534 - DNA, 103 bp, Artificial Sequence
  Synthetic Polynucleotide
taatacgactcactataggggagaaaaagatagtaagtccgtatatccttaacagaggagaaaggatatgcggacttacaacctggcggcagcgcaaaagatg

SEQ ID NO: 54535 - DNA, 103 bp, Artificial Sequence
  Synthetic Polynucleotide
taatacgactcactatagggacgttgagaaaaagatagtaagtccgtataaacagaggagatatacgatgttactatctaacctggcggcagcgcaaaagatg

SEQ ID NO: 54536 - DNA, 103 bp, Artificial Sequence
  Synthetic Polynucleotide
taatacgactcactatagggaatcgacgttgagaaaaagatagtaagtccaacagaggagaggacttatgatctttttcaacctggcggcagcgcaaaagatg

SEQ ID NO: 54537 - DNA, 103 bp, Artificial Sequence
  Synthetic Polynucleotide
taatacgactcactatagggataatacatggattcctaaaacagatgatgaacagaggagacatcatatgttttaggaaaacctggcggcagcgcaaaagatg

SEQ ID NO: 54538 - DNA, 103 bp, Artificial Sequence
  Synthetic Polynucleotide
taatacgactcactatagggcatcaaatcgacgttgagaaaaagatagtaaacagaggagatactatatgtttctcaacaacctggcggcagcgcaaaagatg

SEQ ID NO: 54539 - DNA, 103 bp, Artificial Sequence
  Synthetic Polynucleotide
taatacgactcactataggggtgttcatcaaatcgacgttgagaaaaagaaacagaggagatcttttatgcaacgtcgaaacctggcggcagcgcaaaagatg

SEQ ID NO: 54540 - DNA, 103 bp, Artificial Sequence
  Synthetic Polynucleotide
taatacgactcactatagggatcgtgtgttcatcaaatcgacgttgagaaaacagaggagattctcaatgtcgatttgaaacctggcggcagcgcaaaagatg

SEQ ID NO: 54541 - DNA, 103 bp, Artificial Sequence
  Synthetic Polynucleotide
taatacgactcactatagggttttcatcgtgtgttcatcaaatcgacgttaacagaggagaaacgtcatgttgatgaacaacctggcggcagcgcaaaagatg

SEQ ID NO: 54542 - DNA, 103 bp, Artificial Sequence
  Synthetic Polynucleotide
taatacgactcactataggggcacattttcatcgtgtgttcatcaaatcgaacagaggagacgatttatggaacacacgaacctggcggcagcgcaaaagatg

SEQ ID NO: 54543 - DNA, 103 bp, Artificial Sequence
  Synthetic Polynucleotide
taatacgactcactatagggtagaagcacattttcatcgtgtgttcatcaaacagaggagatgatgaatgcacgatgaaaacctggcggcagcgcaaaagatg

SEQ ID NO: 54544 - DNA, 103 bp, Artificial Sequence
  Synthetic Polynucleotide
taatacgactcactatagggtctcatagaagcacattttcatcgtgtgttaacagaggagaaacacaatgtgaaaatgtaacctggcggcagcgcaaaagatg

SEQ ID NO: 54545 - DNA, 103 bp, Artificial Sequence
  Synthetic Polynucleotide
taatacgactcactatagggatcaatctcatagaagcacattttcatcgtaacagaggagaacgatgatgatgtgcttcaacctggcggcagcgcaaaagatg

SEQ ID NO: 54546 - DNA, 103 bp, Artificial Sequence
  Synthetic Polynucleotide
taatacgactcactatagggacatgatcaatctcatagaagcacattttcaacagaggagagaaaatatgcttctatgaaacctggcggcagcgcaaaagatg

SEQ ID NO: 54547 - DNA, 103 bp, Artificial Sequence
  Synthetic Polynucleotide
taatacgactcactatagggtttctacatgatcaatctcatagaagcacaaacagaggagatgtgctatgatgagattgaacctggcggcagcgcaaaagatg

SEQ ID NO: 54548 - DNA, 103 bp, Artificial Sequence
  Synthetic Polynucleotide
taatacgactcactatagggtggtaataatacatggattcctaaaacagaaacagaggagatctgttatgggaatccataacctggcggcagcgcaaaagatg

SEQ ID NO: 54549 - DNA, 103 bp, Artificial Sequence
  Synthetic Polynucleotide
taatacgactcactataggggttgttttctacatgatcaatctcatagaaaacagaggagattctatatgattgatcataacctggcggcagcgcaaaagatg

SEQ ID NO: 54550 - DNA, 103 bp, Artificial Sequence
  Synthetic Polynucleotide
taatacgactcactatagggcccttgttgttttctacatgatcaatctcaaacagaggagatgagatatgtcatgtagaaacctggcggcagcgcaaaagatg

SEQ ID NO: 54551 - DNA, 103 bp, Artificial Sequence
  Synthetic Polynucleotide
taatacgactcactatagggtgtatcccttgttgttttctacatgatcaaaacagaggagattgatcatgtagaaaacaaacctggcggcagcgcaaaagatg

SEQ ID NO: 54552 - DNA, 103 bp, Artificial Sequence
  Synthetic Polynucleotide
taatacgactcactatagggaatattgtatcccttgttgttttctacatgaacagaggagacatgtaatgaacaacaagaacctggcggcagcgcaaaagatg

SEQ ID NO: 54553 - DNA, 103 bp, Artificial Sequence
  Synthetic Polynucleotide
taatacgactcactataggggcggaaatattgtatcccttgttgttttctaacagaggagaagaaaaatgcaagggataaacctggcggcagcgcaaaagatg

SEQ ID NO: 54554 - DNA, 103 bp, Artificial Sequence
  Synthetic Polynucleotide
taatacgactcactataggggatatgcggaaatattgtatcccttgttgtaacagaggagaacaacaatggatacaataaacctggcggcagcgcaaaagatg

SEQ ID NO: 54555 - DNA, 103 bp, Artificial Sequence
  Synthetic Polynucleotide
taatacgactcactatagggttcatgatatgcggaaatattgtatcccttaacagaggagaaagggaatgaatatttccaacctggcggcagcgcaaaagatg

SEQ ID NO: 54556 - DNA, 103 bp, Artificial Sequence
  Synthetic Polynucleotide
taatacgactcactatagggtatatttcatgatatgcggaaatattgtataacagaggagaatacaaatgttccgcataaacctggcggcagcgcaaaagatg

SEQ ID NO: 54557 - DNA, 103 bp, Artificial Sequence
  Synthetic Polynucleotide
taatacgactcactatagggcttaatatatttcatgatatgcggaaatataacagaggagaatatttatgcatatcatgaacctggcggcagcgcaaaagatg

SEQ ID NO: 54558 - DNA, 103 bp, Artificial Sequence
  Synthetic Polynucleotide
taatacgactcactataggggatttcttaatatatttcatgatatgcggaaacagaggagatccgcaatgcatgaaataaacctggcggcagcgcaaaagatg

SEQ ID NO: 54559 - DNA, 103 bp, Artificial Sequence
  Synthetic Polynucleotide
taatacgactcactataggggaaagtggtaataatacatggattcctaaaaacagaggagatttaggatgccatgtattaacctggcggcagcgcaaaagatg

SEQ ID NO: 54560 - DNA, 103 bp, Artificial Sequence
  Synthetic Polynucleotide
taatacgactcactatagggggtgggatttcttaatatatttcatgatataacagaggagaatatcaatgaatatattaaacctggcggcagcgcaaaagatg

SEQ ID NO: 54561 - DNA, 103 bp, Artificial Sequence
  Synthetic Polynucleotide
taatacgactcactatagggaataaggtgggatttcttaatatatttcataacagaggagaatgaaaatgattaagaaaaacctggcggcagcgcaaaagatg

SEQ ID NO: 54562 - DNA, 103 bp, Artificial Sequence
  Synthetic Polynucleotide
taatacgactcactatagggaatataataaggtgggatttcttaatatataacagaggagaatatatatggaaatcccaaacctggcggcagcgcaaaagatg

SEQ ID NO: 54563 - DNA, 103 bp, Artificial Sequence
  Synthetic Polynucleotide
taatacgactcactatagggggggaaatataataaggtgggatttcttaaaacagaggagattaagaatgcccaccttaaacctggcggcagcgcaaaagatg

SEQ ID NO: 54564 - DNA, 103 bp, Artificial Sequence
  Synthetic Polynucleotide
taatacgactcactatagggcctttggggaaatataataaggtgggatttaacagaggagaaaatccatgcttattataaacctggcggcagcgcaaaagatg

SEQ ID NO: 54565 - DNA, 103 bp, Artificial Sequence
  Synthetic Polynucleotide
taatacgactcactatagggtggatcctttggggaaatataataaggtggaacagaggagaccacctatgtatatttccaacctggcggcagcgcaaaagatg

SEQ ID NO: 54566 - DNA, 103 bp, Artificial Sequence
  Synthetic Polynucleotide
taatacgactcactataggggtgcatggatcctttggggaaatataataaaacagaggagattattaatgttccccaaaaacctggcggcagcgcaaaagatg

SEQ ID NO: 54567 - DNA, 103 bp, Artificial Sequence
  Synthetic Polynucleotide
taatacgactcactatagggtttacgtgcatggatcctttggggaaatataacagaggagaatatttatgcaaaggatcaacctggcggcagcgcaaaagatg

SEQ ID NO: 54568 - DNA, 103 bp, Artificial Sequence
  Synthetic Polynucleotide
taatacgactcactatagggtaatgtttacgtgcatggatcctttggggaaacagaggagatccccaatggatccatgcaacctggcggcagcgcaaaagatg

SEQ ID NO: 54569 - DNA, 103 bp, Artificial Sequence
  Synthetic Polynucleotide
taatacgactcactatagggcgatataatgtttacgtgcatggatcctttaacagaggagaaaaggaatgatgcacgtaaacctggcggcagcgcaaaagatg

SEQ ID NO: 54570 - DNA, 103 bp, Artificial Sequence
  Synthetic Polynucleotide
taatacgactcactatagggccatgaactcattaaccgaaaattctgtacaacagaggagagtacagatgtttcggttaaacctggcggcagcgcaaaagatg

SEQ ID NO: 54571 - DNA, 103 bp, Artificial Sequence
  Synthetic Polynucleotide
taatacgactcactatagggagttggaaagtggtaataatacatggattcaacagaggagagaatccatgtattattacaacctggcggcagcgcaaaagatg

SEQ ID NO: 54572 - DNA, 103 bp, Artificial Sequence
  Synthetic Polynucleotide
taatacgactcactataggggataacgatataatgtttacgtgcatggataacagaggagaatccatatgcgtaaacataacctggcggcagcgcaaaagatg

SEQ ID NO: 54573 - DNA, 103 bp, Artificial Sequence
  Synthetic Polynucleotide
taatacgactcactatagggttaatgataacgatataatgtttacgtgcaaacagaggagatgcacgatgacattatataacctggcggcagcgcaaaagatg

SEQ ID NO: 54574 - DNA, 103 bp, Artificial Sequence
  Synthetic Polynucleotide
taatacgactcactatagggctttattaatgataacgatataatgtttacaacagaggagagtaaacatgatatcgttaaacctggcggcagcgcaaaagatg

SEQ ID NO: 54575 - DNA, 103 bp, Artificial Sequence
  Synthetic Polynucleotide
taatacgactcactataggggaagtctttattaatgataacgatataatgaacagaggagacattatatggttatcattaacctggcggcagcgcaaaagatg

SEQ ID NO: 54576 - DNA, 103 bp, Artificial Sequence
  Synthetic Polynucleotide
taatacgactcactatagggagaaagaagtctttattaatgataacgataaacagaggagatatcgtatgcattaataaaacctggcggcagcgcaaaagatg

SEQ ID NO: 54577 - DNA, 103 bp, Artificial Sequence
  Synthetic Polynucleotide
taatacgactcactatagggcgatgagaaagaagtctttattaatgataaaacagaggagattatcaatgataaagactaacctggcggcagcgcaaaagatg

SEQ ID NO: 54578 - DNA, 103 bp, Artificial Sequence
  Synthetic Polynucleotide
taatacgactcactatagggagatccgatgagaaagaagtctttattaataacagaggagaattaatatggacttctttaacctggcggcagcgcaaaagatg

SEQ ID NO: 54579 - DNA, 103 bp, Artificial Sequence
  Synthetic Polynucleotide
taatacgactcactatagggtttacagatccgatgagaaagaagtctttaaacagaggagataaagaatgctttctcataacctggcggcagcgcaaaagatg

SEQ ID NO: 54580 - DNA, 103 bp, Artificial Sequence
  Synthetic Polynucleotide
taatacgactcactatagggcaacttttacagatccgatgagaaagaagtaacagaggagaacttctatgtcatcggataacctggcggcagcgcaaaagatg

SEQ ID NO: 54581 - DNA, 103 bp, Artificial Sequence
  Synthetic Polynucleotide
taatacgactcactatagggagtaacaacttttacagatccgatgagaaaaacagaggagatttctcatgggatctgtaaacctggcggcagcgcaaaagatg

SEQ ID NO: 54582 - DNA, 103 bp, Artificial Sequence
  Synthetic Polynucleotide
taatacgactcactatagggtgataagttggaaagtggtaataatacatgaacagaggagacatgtaatgttaccacttaacctggcggcagcgcaaaagatg

SEQ ID NO: 54583 - DNA, 103 bp, Artificial Sequence
  Synthetic Polynucleotide
taatacgactcactatagggaaatcagtaacaacttttacagatccgatgaacagaggagacatcggatgtgtaaaagtaacctggcggcagcgcaaaagatg

SEQ ID NO: 54584 - DNA, 103 bp, Artificial Sequence
  Synthetic Polynucleotide
taatacgactcactataggggaaaaaaatcagtaacaacttttacagatcaacagaggagagatctgatgaagttgttaaacctggcggcagcgcaaaagatg

SEQ ID NO: 54585 - DNA, 103 bp, Artificial Sequence
  Synthetic Polynucleotide
taatacgactcactatagggggaatgaaaaaaatcagtaacaacttttacaacagaggagagtaaaaatggttactgataacctggcggcagcgcaaaagatg

SEQ ID NO: 54586 - DNA, 103 bp, Artificial Sequence
  Synthetic Polynucleotide
taatacgactcactatagggatcctggaatgaaaaaaatcagtaacaactaacagaggagaagttgtatgtgattttttaacctggcggcagcgcaaaagatg

SEQ ID NO: 54587 - DNA, 103 bp, Artificial Sequence
  Synthetic Polynucleotide
taatacgactcactatagggtctagatcctggaatgaaaaaaatcagtaaaacagaggagattactgatgtttttcattaacctggcggcagcgcaaaagatg

SEQ ID NO: 54588 - DNA, 103 bp, Artificial Sequence
  Synthetic Polynucleotide
taatacgactcactatagggaattatctagatcctggaatgaaaaaaatcaacagaggagagattttatgcattccaggaacctggcggcagcgcaaaagatg

SEQ ID NO: 54589 - DNA, 103 bp, Artificial Sequence
  Synthetic Polynucleotide
taatacgactcactatagggttattaattatctagatcctggaatgaaaaaacagaggagattttcaatgcaggatctaaacctggcggcagcgcaaaagatg

SEQ ID NO: 54590 - DNA, 103 bp, Artificial Sequence
  Synthetic Polynucleotide
taatacgactcactatagggcgtcattattaattatctagatcctggaataacagaggagaattccaatgtctagataaaacctggcggcagcgcaaaagatg

SEQ ID NO: 54591 - DNA, 103 bp, Artificial Sequence
  Synthetic Polynucleotide
taatacgactcactatagggaaacccgtcattattaattatctagatcctaacagaggagaaggatcatgataattaataacctggcggcagcgcaaaagatg

SEQ ID NO: 54592 - DNA, 103 bp, Artificial Sequence
  Synthetic Polynucleotide
taatacgactcactatagggatagaaaacccgtcattattaattatctagaacagaggagactagatatgtaataatgaaacctggcggcagcgcaaaagatg

SEQ ID NO: 54593 - DNA, 103 bp, Artificial Sequence
  Synthetic Polynucleotide
taatacgactcactataggggataatgataagttggaaagtggtaataataacagaggagaattattatgactttccaaaacctggcggcagcgcaaaagatg

SEQ ID NO: 54594 - DNA, 103 bp, Artificial Sequence
  Synthetic Polynucleotide
taatacgactcactatagggtaaaaatagaaaacccgtcattattaattaaacagaggagataattaatgatgacgggtaacctggcggcagcgcaaaagatg

SEQ ID NO: 54595 - DNA, 103 bp, Artificial Sequence
  Synthetic Polynucleotide
taatacgactcactatagggaagaataaaaatagaaaacccgtcattattaacagaggagaaataatatggggttttctaacctggcggcagcgcaaaagatg

SEQ ID NO: 54596 - DNA, 103 bp, Artificial Sequence
  Synthetic Polynucleotide
taatacgactcactatagggatacaaagaataaaaatagaaaacccgtcaaacagaggagatgacggatgttctattttaacctggcggcagcgcaaaagatg

SEQ ID NO: 54597 - DNA, 103 bp, Artificial Sequence
  Synthetic Polynucleotide
taatacgactcactatagggccaaaatacaaagaataaaaatagaaaaccaacagaggagaggttttatgtttttattcaacctggcggcagcgcaaaagatg

SEQ ID NO: 54598 - DNA, 103 bp, Artificial Sequence
  Synthetic Polynucleotide
taatacgactcactatagggatatgccaaaatacaaagaataaaaatagaaacagaggagatctattatgattctttgtaacctggcggcagcgcaaaagatg

SEQ ID NO: 54599 - DNA, 103 bp, Artificial Sequence
  Synthetic Polynucleotide
taatacgactcactatagggctaggatatgccaaaatacaaagaataaaaaacagaggagattttatatgttgtattttaacctggcggcagcgcaaaagatg

SEQ ID NO: 54600 - DNA, 103 bp, Artificial Sequence
  Synthetic Polynucleotide
taatacgactcactatagggctggtctaggatatgccaaaatacaaagaaaacagaggagattctttatgttttggcataacctggcggcagcgcaaaagatg

SEQ ID NO: 54601 - DNA, 103 bp, Artificial Sequence
  Synthetic Polynucleotide
taatacgactcactataggggtttactggtctaggatatgccaaaatacaaacagaggagatgtattatggcatatcctaacctggcggcagcgcaaaagatg

SEQ ID NO: 54602 - DNA, 103 bp, Artificial Sequence
  Synthetic Polynucleotide
taatacgactcactatagggaaactgtttactggtctaggatatgccaaaaacagaggagatttggcatgtcctagaccaacctggcggcagcgcaaaagatg

SEQ ID NO: 54603 - DNA, 103 bp, Artificial Sequence
  Synthetic Polynucleotide
taatacgactcactatagggagtggaaactgtttactggtctaggatatgaacagaggagacatatcatggaccagtaaaacctggcggcagcgcaaaagatg

SEQ ID NO: 54604 - DNA, 103 bp, Artificial Sequence
  Synthetic Polynucleotide
taatacgactcactatagggcctgggataatgataagttggaaagtggtaaacagaggagataccacatgccaacttataacctggcggcagcgcaaaagatg

SEQ ID NO: 54605 - DNA, 103 bp, Artificial Sequence
  Synthetic Polynucleotide
taatacgactcactatagggaccaaagtggaaactgtttactggtctaggaacagaggagacctagaatggtaaacagtaacctggcggcagcgcaaaagatg

SEQ ID NO: 54606 - DNA, 103 bp, Artificial Sequence
  Synthetic Polynucleotide
taatacgactcactatagggattttaccaaagtggaaactgtttactggtaacagaggagaaccagtatgcagtttccaaacctggcggcagcgcaaaagatg

SEQ ID NO: 54607 - DNA, 103 bp, Artificial Sequence
  Synthetic Polynucleotide
taatacgactcactatagggtgctgattttaccaaagtggaaactgtttaaacagaggagataaacaatgtccactttgaacctggcggcagcgcaaaagatg

SEQ ID NO: 54608 - DNA, 103 bp, Artificial Sequence
  Synthetic Polynucleotide
taatacgactcactatagggaagtctgctgattttaccaaagtggaaactaacagaggagaagtttcatgtttggtaaaaacctggcggcagcgcaaaagatg

SEQ ID NO: 54609 - DNA, 103 bp, Artificial Sequence
  Synthetic Polynucleotide
taatacgactcactatagggttcaaaagtctgctgattttaccaaagtggaacagaggagaccacttatgtaaaatcagaacctggcggcagcgcaaaagatg

SEQ ID NO: 54610 - DNA, 103 bp, Artificial Sequence
  Synthetic Polynucleotide
taatacgactcactatagggtagcgttcaaaagtctgctgattttaccaaaacagaggagattggtaatgtcagcagacaacctggcggcagcgcaaaagatg

SEQ ID NO: 54611 - DNA, 103 bp, Artificial Sequence
  Synthetic Polynucleotide
taatacgactcactatagggtttaatagcgttcaaaagtctgctgattttaacagaggagaaaaatcatgagacttttgaacctggcggcagcgcaaaagatg

SEQ ID NO: 54612 - DNA, 103 bp, Artificial Sequence
  Synthetic Polynucleotide
taatacgactcactatagggccatgtttaatagcgttcaaaagtctgctgaacagaggagacagcagatgtttgaacgcaacctggcggcagcgcaaaagatg

SEQ ID NO: 54613 - DNA, 103 bp, Artificial Sequence
  Synthetic Polynucleotide
taatacgactcactatagggtaatgccatgtttaatagcgttcaaaagtcaacagaggagagactttatgacgctattaaacctggcggcagcgcaaaagatg

SEQ ID NO: 54614 - DNA, 103 bp, Artificial Sequence
  Synthetic Polynucleotide
taatacgactcactataggggccattaatgccatgtttaatagcgttcaaaacagaggagattgaacatgattaaacataacctggcggcagcgcaaaagatg

SEQ ID NO: 54615 - DNA, 103 bp, Artificial Sequence
  Synthetic Polynucleotide
taatacgactcactatagggcatagcctgggataatgataagttggaaagaacagaggagactttccatgttatcattaaacctggcggcagcgcaaaagatg

SEQ ID NO: 54616 - DNA, 103 bp, Artificial Sequence
  Synthetic Polynucleotide
taatacgactcactatagggttattgccattaatgccatgtttaatagcgaacagaggagacgctatatgacatggcataacctggcggcagcgcaaaagatg

SEQ ID NO: 54617 - DNA, 103 bp, Artificial Sequence
  Synthetic Polynucleotide
taatacgactcactatagggtttagttattgccattaatgccatgtttaaaacagaggagattaaacatggcattaatgaacctggcggcagcgcaaaagatg

SEQ ID NO: 54618 - DNA, 103 bp, Artificial Sequence
  Synthetic Polynucleotide
taatacgactcactatagggacatttttagttattgccattaatgccatgaacagaggagacatggcatgaatggcaataacctggcggcagcgcaaaagatg

SEQ ID NO: 54619 - DNA, 103 bp, Artificial Sequence
  Synthetic Polynucleotide
taatacgactcactatagggattttacatttttagttattgccattaatgaacagaggagacattaaatgcaataactaaacctggcggcagcgcaaaagatg

SEQ ID NO: 54620 - DNA, 103 bp, Artificial Sequence
  Synthetic Polynucleotide
taatacgactcactatagggaaaatattttacatttttagttattgccataacagaggagaatggcaatgactaaaaataacctggcggcagcgcaaaagatg

SEQ ID NO: 54621 - DNA, 103 bp, Artificial Sequence
  Synthetic Polynucleotide
taatacgactcactatagggatagaaaaatattttacatttttagttattaacagaggagaaataacatgaaatgtaaaaacctggcggcagcgcaaaagatg

SEQ ID NO: 54622 - DNA, 103 bp, Artificial Sequence
  Synthetic Polynucleotide
taatacgactcactatagggctaacatagaaaaatattttacatttttagaacagaggagactaaaaatgtaaaatattaacctggcggcagcgcaaaagatg

SEQ ID NO: 54623 - DNA, 103 bp, Artificial Sequence
  Synthetic Polynucleotide
taatacgactcactatagggtattcctaacatagaaaaatattttacattaacagaggagaaatgtaatgtatttttctaacctggcggcagcgcaaaagatg

SEQ ID NO: 54624 - DNA, 103 bp, Artificial Sequence
  Synthetic Polynucleotide
taatacgactcactatagggaaccatattcctaacatagaaaaatattttaacagaggagaaaaataatgttctatgttaacctggcggcagcgcaaaagatg

SEQ ID NO: 54625 - DNA, 103 bp, Artificial Sequence
  Synthetic Polynucleotide
taatacgactcactatagggtgaaaaaccatattcctaacatagaaaaataacagaggagaatttttatgtgttaggaaaacctggcggcagcgcaaaagatg

SEQ ID NO: 54626 - DNA, 103 bp, Artificial Sequence
  Synthetic Polynucleotide
taatacgactcactatagggcgaaacatagcctgggataatgataagttgaacagaggagacaacttatgattatcccaaacctggcggcagcgcaaaagatg

SEQ ID NO: 54627 - DNA, 103 bp, Artificial Sequence
  Synthetic Polynucleotide
taatacgactcactatagggtaaagtgaaaaaccatattcctaacatagaaacagaggagatctatgatgggaatatggaacctggcggcagcgcaaaagatg

SEQ ID NO: 54628 - DNA, 103 bp, Artificial Sequence
  Synthetic Polynucleotide
taatacgactcactatagggtctattaaagtgaaaaaccatattcctaacaacagaggagagttaggatgatggtttttaacctggcggcagcgcaaaagatg

SEQ ID NO: 54629 - DNA, 103 bp, Artificial Sequence
  Synthetic Polynucleotide
taatacgactcactatagggatatatctattaaagtgaaaaaccatattcaacagaggagagaatatatgttttcacttaacctggcggcagcgcaaaagatg

SEQ ID NO: 54630 - DNA, 103 bp, Artificial Sequence
  Synthetic Polynucleotide
taatacgactcactatagggaaaccatatatctattaaagtgaaaaaccaaacagaggagatggtttatgactttaataaacctggcggcagcgcaaaagatg

SEQ ID NO: 54631 - DNA, 103 bp, Artificial Sequence
  Synthetic Polynucleotide
taatacgactcactataggggccaaaaaccatatatctattaaagtgaaaaacagaggagatttcacatgaatagatataacctggcggcagcgcaaaagatg

SEQ ID NO: 54632 - DNA, 103 bp, Artificial Sequence
  Synthetic Polynucleotide
taatacgactcactatagggttttggccaaaaaccatatatctattaaagaacagaggagactttaaatgatatatggtaacctggcggcagcgcaaaagatg

SEQ ID NO: 54633 - DNA, 103 bp, Artificial Sequence
  Synthetic Polynucleotide
taatacgactcactatagggtatcattttggccaaaaaccatatatctataacagaggagaatagatatgtggtttttgaacctggcggcagcgcaaaagatg

SEQ ID NO: 54634 - DNA, 103 bp, Artificial Sequence
  Synthetic Polynucleotide
taatacgactcactatagggatatctatcattttggccaaaaaccatataaacagaggagatatatgatgtttggccaaaacctggcggcagcgcaaaagatg

SEQ ID NO: 54635 - DNA, 103 bp, Artificial Sequence
  Synthetic Polynucleotide
taatacgactcactatagggaaaaaatatctatcattttggccaaaaaccaacagaggagaggttttatgccaaaatgaaacctggcggcagcgcaaaagatg

SEQ ID NO: 54636 - DNA, 103 bp, Artificial Sequence
  Synthetic Polynucleotide
taatacgactcactatagggggataaaaaaatatctatcattttggccaaaacagaggagattggccatgatgatagataacctggcggcagcgcaaaagatg

SEQ ID NO: 54637 - DNA, 103 bp, Artificial Sequence
  Synthetic Polynucleotide
taatacgactcactatagggatggacgaaacatagcctgggataatgataaacagaggagatatcatatgcccaggctaaacctggcggcagcgcaaaagatg

SEQ ID NO: 54638 - DNA, 103 bp, Artificial Sequence
  Synthetic Polynucleotide
taatacgactcactatagggtcctcggataaaaaaatatctatcattttgaacagaggagacaaaatatgagatattttaacctggcggcagcgcaaaagatg

SEQ ID NO: 54639 - DNA, 103 bp, Artificial Sequence
  Synthetic Polynucleotide
taatacgactcactatagggtactatcctcggataaaaaaatatctatcaaacagaggagatgatagatgtttttttataacctggcggcagcgcaaaagatg

SEQ ID NO: 54640 - DNA, 103 bp, Artificial Sequence
  Synthetic Polynucleotide
taatacgactcactatagggtattttactatcctcggataaaaaaatatcaacagaggagagatattatgttatccgagaacctggcggcagcgcaaaagatg

SEQ ID NO: 54641 - DNA, 103 bp, Artificial Sequence
  Synthetic Polynucleotide
taatacgactcactatagggaataatattttactatcctcggataaaaaaaacagaggagattttttatgcgaggatagaacctggcggcagcgcaaaagatg

SEQ ID NO: 54642 - DNA, 103 bp, Artificial Sequence
  Synthetic Polynucleotide
taatacgactcactatagggcgactaataatattttactatcctcggataaacagaggagatatccgatgatagtaaaaaacctggcggcagcgcaaaagatg

SEQ ID NO: 54643 - DNA, 103 bp, Artificial Sequence
  Synthetic Polynucleotide
taatacgactcactataggggacggcgactaataatattttactatcctcaacagaggagagaggatatgaaaatattaaacctggcggcagcgcaaaagatg

SEQ ID NO: 54644 - DNA, 103 bp, Artificial Sequence
  Synthetic Polynucleotide
taatacgactcactatagggatagagacggcgactaataatattttactaaacagaggagatagtaaatgattattagtaacctggcggcagcgcaaaagatg

SEQ ID NO: 54645 - DNA, 103 bp, Artificial Sequence
  Synthetic Polynucleotide
taatacgactcactatagggtttttatagagacggcgactaataatatttaacagaggagaaaatatatgtagtcgccgaacctggcggcagcgcaaaagatg

SEQ ID NO: 54646 - DNA, 103 bp, Artificial Sequence
  Synthetic Polynucleotide
taatacgactcactatagggcttcatttttatagagacggcgactaataaaacagaggagattattaatggccgtctctaacctggcggcagcgcaaaagatg

SEQ ID NO: 54647 - DNA, 103 bp, Artificial Sequence
  Synthetic Polynucleotide
taatacgactcactatagggactagcttcatttttatagagacggcgactaacagaggagaagtcgcatgctctataaaaacctggcggcagcgcaaaagatg

SEQ ID NO: 54648 - DNA, 103 bp, Artificial Sequence
  Synthetic Polynucleotide
taatacgactcactatagggtgatgatggacgaaacatagcctgggataaaacagaggagattatccatggctatgtttaacctggcggcagcgcaaaagatg

SEQ ID NO: 54649 - DNA, 103 bp, Artificial Sequence
  Synthetic Polynucleotide
taatacgactcactatagggtcgagactagcttcatttttatagagacggaacagaggagaccgtctatgtaaaaatgaaacctggcggcagcgcaaaagatg

SEQ ID NO: 54650 - DNA, 103 bp, Artificial Sequence
  Synthetic Polynucleotide
taatacgactcactatagggggatatcgagactagcttcatttttatagaaacagaggagatctataatgatgaagctaaacctggcggcagcgcaaaagatg

SEQ ID NO: 54651 - DNA, 103 bp, Artificial Sequence
  Synthetic Polynucleotide
taatacgactcactatagggaaattggatatcgagactagcttcatttttaacagaggagaaaaaatatggctagtctcaacctggcggcagcgcaaaagatg

SEQ ID NO: 54652 - DNA, 103 bp, Artificial Sequence
  Synthetic Polynucleotide
taatacgactcactataggggaataaaattggatatcgagactagcttcaaacagaggagatgaagcatgtctcgatataacctggcggcagcgcaaaagatg

SEQ ID NO: 54653 - DNA, 103 bp, Artificial Sequence
  Synthetic Polynucleotide
taatacgactcactatagggttctagaataaaattggatatcgagactagaacagaggagactagtcatgatatccaataacctggcggcagcgcaaaagatg

SEQ ID NO: 54654 - DNA, 103 bp, Artificial Sequence
  Synthetic Polynucleotide
taatacgactcactatagggatcaattctagaataaaattggatatcgagaacagaggagactcgatatgcaattttataacctggcggcagcgcaaaagatg

SEQ ID NO: 54655 - DNA, 103 bp, Artificial Sequence
  Synthetic Polynucleotide
taatacgactcactatagggctcctatcaattctagaataaaattggataaacagaggagatatccaatgttattctagaacctggcggcagcgcaaaagatg

SEQ ID NO: 54656 - DNA, 103 bp, Artificial Sequence
  Synthetic Polynucleotide
taatacgactcactatagggggcgactcctatcaattctagaataaaattaacagaggagaaattttatgctagaattgaacctggcggcagcgcaaaagatg

SEQ ID NO: 54657 - DNA, 103 bp, Artificial Sequence
  Synthetic Polynucleotide
taatacgactcactatagggcatttggcgactcctatcaattctagaataaacagaggagatattctatgattgataggaacctggcggcagcgcaaaagatg

SEQ ID NO: 54658 - DNA, 103 bp, Artificial Sequence
  Synthetic Polynucleotide
taatacgactcactatagggaggtacatttggcgactcctatcaattctaaacagaggagatagaatatgtaggagtcgaacctggcggcagcgcaaaagatg

SEQ ID NO: 54659 - DNA, 103 bp, Artificial Sequence
  Synthetic Polynucleotide
taatacgactcactatagggcgcaatgatgatggacgaaacatagcctggaacagaggagaccaggcatggtttcgtccaacctggcggcagcgcaaaagatg

SEQ ID NO: 54660 - DNA, 103 bp, Artificial Sequence
  Synthetic Polynucleotide
taatacgactcactataggggtataaggtacatttggcgactcctatcaaaacagaggagattgataatggtcgccaaaaacctggcggcagcgcaaaagatg

SEQ ID NO: 54661 - DNA, 103 bp, Artificial Sequence
  Synthetic Polynucleotide
taatacgactcactatagggataacgtataaggtacatttggcgactcctaacagaggagaaggagtatgcaaatgtacaacctggcggcagcgcaaaagatg

SEQ ID NO: 54662 - DNA, 103 bp, Artificial Sequence
  Synthetic Polynucleotide
taatacgactcactataggggagatataacgtataaggtacatttggcgaaacagaggagatcgccaatggtaccttataacctggcggcagcgcaaaagatg

SEQ ID NO: 54663 - DNA, 103 bp, Artificial Sequence
  Synthetic Polynucleotide
taatacgactcactatagggcaagggagatataacgtataaggtacatttaacagaggagaaaatgtatgttatacgttaacctggcggcagcgcaaaagatg

SEQ ID NO: 54664 - DNA, 103 bp, Artificial Sequence
  Synthetic Polynucleotide
taatacgactcactatagggcgcatcaagggagatataacgtataaggtaaacagaggagataccttatgcgttatatcaacctggcggcagcgcaaaagatg

SEQ ID NO: 54665 - DNA, 103 bp, Artificial Sequence
  Synthetic Polynucleotide
taatacgactcactatagggtggaacgcatcaagggagatataacgtataaacagaggagatatacgatgtatctccctaacctggcggcagcgcaaaagatg

SEQ ID NO: 54666 - DNA, 103 bp, Artificial Sequence
  Synthetic Polynucleotide
taatacgactcactatagggacaaatggaacgcatcaagggagatataacaacagaggagagttataatgcccttgatgaacctggcggcagcgcaaaagatg

SEQ ID NO: 54667 - DNA, 103 bp, Artificial Sequence
  Synthetic Polynucleotide
taatacgactcactataggggatacacaaatggaacgcatcaagggagataacagaggagaatctccatggatgcgttcaacctggcggcagcgcaaaagatg

SEQ ID NO: 54668 - DNA, 103 bp, Artificial Sequence
  Synthetic Polynucleotide
taatacgactcactatagggatatagatacacaaatggaacgcatcaaggaacagaggagaccttgaatggttccatttaacctggcggcagcgcaaaagatg

SEQ ID NO: 54669 - DNA, 103 bp, Artificial Sequence
  Synthetic Polynucleotide
taatacgactcactataggggtcagatatagatacacaaatggaacgcataacagaggagaatgcgtatgatttgtgtaaacctggcggcagcgcaaaagatg

SEQ ID NO: 54670 - DNA, 103 bp, Artificial Sequence
  Synthetic Polynucleotide
taatacgactcactatagggctctgcgcaatgatgatggacgaaacatagaacagaggagactatgtatggtccatcataacctggcggcagcgcaaaagatg

SEQ ID NO: 54671 - DNA, 103 bp, Artificial Sequence
  Synthetic Polynucleotide
taatacgactcactatagggcttgtgtcagatatagatacacaaatggaaaacagaggagattccatatgtgtatctataacctggcggcagcgcaaaagatg

SEQ ID NO: 54672 - DNA, 103 bp, Artificial Sequence
  Synthetic Polynucleotide
taatacgactcactatagggccgatcttgtgtcagatatagatacacaaaaacagaggagatttgtgatgctatatctgaacctggcggcagcgcaaaagatg

SEQ ID NO: 54673 - DNA, 103 bp, Artificial Sequence
  Synthetic Polynucleotide
taatacgactcactatagggatttaccgatcttgtgtcagatatagatacaacagaggagagtatctatgtctgacacaaacctggcggcagcgcaaaagatg

SEQ ID NO: 54674 - DNA, 103 bp, Artificial Sequence
  Synthetic Polynucleotide
taatacgactcactatagggaaactatttaccgatcttgtgtcagatataaacagaggagatatatcatgcacaagatcaacctggcggcagcgcaaaagatg

SEQ ID NO: 54675 - DNA, 103 bp, Artificial Sequence
  Synthetic Polynucleotide
taatacgactcactatagggacgtaaaactatttaccgatcttgtgtcagaacagaggagactgacaatggatcggtaaaacctggcggcagcgcaaaagatg

SEQ ID NO: 54676 - DNA, 103 bp, Artificial Sequence
  Synthetic Polynucleotide
taatacgactcactatagggtaataacgtaaaactatttaccgatcttgtaacagaggagaacaagaatggtaaatagtaacctggcggcagcgcaaaagatg

SEQ ID NO: 54677 - DNA, 103 bp, Artificial Sequence
  Synthetic Polynucleotide
taatacgactcactatagggatgattaataacgtaaaactatttaccgataacagaggagaatcggtatgtagttttacaacctggcggcagcgcaaaagatg

SEQ ID NO: 54678 - DNA, 103 bp, Artificial Sequence
  Synthetic Polynucleotide
taatacgactcactatagggccgtgatgattaataacgtaaaactatttaaacagaggagataaataatgttacgttataacctggcggcagcgcaaaagatg

SEQ ID NO: 54679 - DNA, 103 bp, Artificial Sequence
  Synthetic Polynucleotide
taatacgactcactatagggtgataccgtgatgattaataacgtaaaactaacagaggagaagttttatgttattaatcaacctggcggcagcgcaaaagatg

SEQ ID NO: 54680 - DNA, 103 bp, Artificial Sequence
  Synthetic Polynucleotide
taatacgactcactataggggacggtgataccgtgatgattaataacgtaaacagaggagatacgttatgaatcatcacaacctggcggcagcgcaaaagatg

SEQ ID NO: 54681 - DNA, 103 bp, Artificial Sequence
  Synthetic Polynucleotide
taatacgactcactatagggctttaccatgaactcattaaccgaaaattcaacagaggagagaatttatggttaatgagaacctggcggcagcgcaaaagatg

SEQ ID NO: 54682 - DNA, 103 bp, Artificial Sequence
  Synthetic Polynucleotide
taatacgactcactatagggattcactctgcgcaatgatgatggacgaaaaacagaggagatttcgtatgtcatcattgaacctggcggcagcgcaaaagatg

SEQ ID NO: 54683 - DNA, 103 bp, Artificial Sequence
  Synthetic Polynucleotide
taatacgactcactatagggctagcgacggtgataccgtgatgattaataaacagaggagatattaaatgtcacggtataacctggcggcagcgcaaaagatg

SEQ ID NO: 54684 - DNA, 103 bp, Artificial Sequence
  Synthetic Polynucleotide
taatacgactcactatagggattatctagcgacggtgataccgtgatgataacagaggagaatcatcatggtatcaccgaacctggcggcagcgcaaaagatg

SEQ ID NO: 54685 - DNA, 103 bp, Artificial Sequence
  Synthetic Polynucleotide
taatacgactcactatagggttagcattatctagcgacggtgataccgtgaacagaggagacacggtatgaccgtcgctaacctggcggcagcgcaaaagatg

SEQ ID NO: 54686 - DNA, 103 bp, Artificial Sequence
  Synthetic Polynucleotide
taatacgactcactataggggaacattagcattatctagcgacggtgataaacagaggagatatcacatgcgctagataaacctggcggcagcgcaaaagatg

SEQ ID NO: 54687 - DNA, 103 bp, Artificial Sequence
  Synthetic Polynucleotide
taatacgactcactatagggggatggaacattagcattatctagcgacggaacagaggagaccgtcgatggataatgctaacctggcggcagcgcaaaagatg

SEQ ID NO: 54688 - DNA, 103 bp, Artificial Sequence
  Synthetic Polynucleotide
taatacgactcactataggggacttggatggaacattagcattatctagcaacagaggagagctagaatgtgctaatgtaacctggcggcagcgcaaaagatg

SEQ ID NO: 54689 - DNA, 103 bp, Artificial Sequence
  Synthetic Polynucleotide
taatacgactcactatagggtttgggacttggatggaacattagcattataacagaggagaataatgatgatgttccataacctggcggcagcgcaaaagatg

SEQ ID NO: 54690 - DNA, 103 bp, Artificial Sequence
  Synthetic Polynucleotide
taatacgactcactatagggctccatttgggacttggatggaacattagcaacagaggagagctaatatgccatccaagaacctggcggcagcgcaaaagatg

SEQ ID NO: 54691 - DNA, 103 bp, Artificial Sequence
  Synthetic Polynucleotide
taatacgactcactatagggaatctctccatttgggacttggatggaacaaacagaggagatgttccatgcaagtcccaaacctggcggcagcgcaaaagatg

SEQ ID NO: 54692 - DNA, 103 bp, Artificial Sequence
  Synthetic Polynucleotide
taatacgactcactatagggagttaaatctctccatttgggacttggatgaacagaggagacatccaatgcccaaatggaacctggcggcagcgcaaaagatg

SEQ ID NO: 54693 - DNA, 103 bp, Artificial Sequence
  Synthetic Polynucleotide
taatacgactcactataggggaattattcactctgcgcaatgatgatggaaacagaggagatccatcatgattgcgcagaacctggcggcagcgcaaaagatg

SEQ ID NO: 54694 - DNA, 103 bp, Artificial Sequence
  Synthetic Polynucleotide
taatacgactcactatagggtgaacagttaaatctctccatttgggacttaacagaggagaaagtccatgatggagagaaacctggcggcagcgcaaaagatg

SEQ ID NO: 54695 - DNA, 103 bp, Artificial Sequence
  Synthetic Polynucleotide
taatacgactcactatagggaacgatgaacagttaaatctctccatttggaacagaggagaccaaatatggagatttaaaacctggcggcagcgcaaaagatg

SEQ ID NO: 54696 - DNA, 103 bp, Artificial Sequence
  Synthetic Polynucleotide
taatacgactcactatagggttctaaacgatgaacagttaaatctctccaaacagaggagatggagaatgttaactgttaacctggcggcagcgcaaaagatg

SEQ ID NO: 54697 - DNA, 103 bp, Artificial Sequence
  Synthetic Polynucleotide
taatacgactcactatagggttttattctaaacgatgaacagttaaatctaacagaggagaagatttatgtgttcatcgaacctggcggcagcgcaaaagatg

SEQ ID NO: 54698 - DNA, 103 bp, Artificial Sequence
  Synthetic Polynucleotide
taatacgactcactatagggaatcattttattctaaacgatgaacagttaaacagaggagataactgatgatcgtttagaacctggcggcagcgcaaaagatg

SEQ ID NO: 54699 - DNA, 103 bp, Artificial Sequence
  Synthetic Polynucleotide
taatacgactcactatagggccggtaatcattttattctaaacgatgaacaacagaggagagttcatatgttagaataaaacctggcggcagcgcaaaagatg

SEQ ID NO: 54700 - DNA, 103 bp, Artificial Sequence
  Synthetic Polynucleotide
taatacgactcactatagggtatgaccggtaatcattttattctaaacgaaacagaggagatcgtttatgataaaatgaaacctggcggcagcgcaaaagatg

SEQ ID NO: 54701 - DNA, 103 bp, Artificial Sequence
  Synthetic Polynucleotide
taatacgactcactatagggattaatatgaccggtaatcattttattctaaacagaggagatagaatatgatgattaccaacctggcggcagcgcaaaagatg

SEQ ID NO: 54702 - DNA, 103 bp, Artificial Sequence
  Synthetic Polynucleotide
taatacgactcactatagggactttattaatatgaccggtaatcattttaaacagaggagataaaatatgtaccggtcaaacctggcggcagcgcaaaagatg

SEQ ID NO: 54703 - DNA, 103 bp, Artificial Sequence
  Synthetic Polynucleotide
taatacgactcactatagggtgaacactttattaatatgaccggtaatcaaacagaggagatgattaatggtcatattaaacctggcggcagcgcaaaagatg

SEQ ID NO: 54704 - DNA, 103 bp, Artificial Sequence
  Synthetic Polynucleotide
taatacgactcactatagggcagaagaattattcactctgcgcaatgatgaacagaggagacatcatatggcagagtgaaacctggcggcagcgcaaaagatg

SEQ ID NO: 54705 - DNA, 103 bp, Artificial Sequence
  Synthetic Polynucleotide
taatacgactcactatagggtacgatgaacactttattaatatgaccggtaacagaggagaaccggtatgattaataaaaacctggcggcagcgcaaaagatg

SEQ ID NO: 54706 - DNA, 103 bp, Artificial Sequence
  Synthetic Polynucleotide
taatacgactcactatagggctagatacgatgaacactttattaatatgaaacagaggagatcatatatgtaaagtgttaacctggcggcagcgcaaaagatg

SEQ ID NO: 54707 - DNA, 103 bp, Artificial Sequence
  Synthetic Polynucleotide
taatacgactcactataggggttatctagatacgatgaacactttattaaaacagaggagattaataatgtgttcatcgaacctggcggcagcgcaaaagatg

SEQ ID NO: 54708 - DNA, 103 bp, Artificial Sequence
  Synthetic Polynucleotide
taatacgactcactatagggtcgttgttatctagatacgatgaacactttaacagaggagaaaagtgatgatcgtatctaacctggcggcagcgcaaaagatg

SEQ ID NO: 54709 - DNA, 103 bp, Artificial Sequence
  Synthetic Polynucleotide
taatacgactcactatagggataagtcgttgttatctagatacgatgaacaacagaggagagttcatatgatctagataaacctggcggcagcgcaaaagatg

SEQ ID NO: 54710 - DNA, 103 bp, Artificial Sequence
  Synthetic Polynucleotide
taatacgactcactatagggtaattataagtcgttgttatctagatacgaaacagaggagatcgtatatggataacaacaacctggcggcagcgcaaaagatg

SEQ ID NO: 54711 - DNA, 103 bp, Artificial Sequence
  Synthetic Polynucleotide
taatacgactcactataggggacattaattataagtcgttgttatctagaaacagaggagatctagaatgcaacgacttaacctggcggcagcgcaaaagatg

SEQ ID NO: 54712 - DNA, 103 bp, Artificial Sequence
  Synthetic Polynucleotide
taatacgactcactatagggacttggacattaattataagtcgttgttataacagaggagaataacaatgacttataataacctggcggcagcgcaaaagatg

SEQ ID NO: 54713 - DNA, 103 bp, Artificial Sequence
  Synthetic Polynucleotide
taatacgactcactatagggtcaagacttggacattaattataagtcgttaacagaggagaaacgacatgtaattaatgaacctggcggcagcgcaaaagatg

SEQ ID NO: 54714 - DNA, 103 bp, Artificial Sequence
  Synthetic Polynucleotide
taatacgactcactatagggcgagttcaagacttggacattaattataagaacagaggagacttataatgaatgtccaaaacctggcggcagcgcaaaagatg

SEQ ID NO: 54715 - DNA, 103 bp, Artificial Sequence
  Synthetic Polynucleotide
taatacgactcactatagggggatacagaagaattattcactctgcgcaaaacagaggagattgcgcatggtgaataataacctggcggcagcgcaaaagatg

SEQ ID NO: 54716 - DNA, 103 bp, Artificial Sequence
  Synthetic Polynucleotide
taatacgactcactatagggttcagcgagttcaagacttggacattaattaacagaggagaaattaaatgccaagtcttaacctggcggcagcgcaaaagatg

SEQ ID NO: 54717 - DNA, 103 bp, Artificial Sequence
  Synthetic Polynucleotide
taatacgactcactataggggatcattcagcgagttcaagacttggacataacagaggagaatgtccatgtcttgaactaacctggcggcagcgcaaaagatg

SEQ ID NO: 54718 - DNA, 103 bp, Artificial Sequence
  Synthetic Polynucleotide
taatacgactcactatagggaaaaagatcattcagcgagttcaagacttgaacagaggagacaagtcatgaactcgctgaacctggcggcagcgcaaaagatg

SEQ ID NO: 54719 - DNA, 103 bp, Artificial Sequence
  Synthetic Polynucleotide
taatacgactcactatagggggttaaaaaagatcattcagcgagttcaagaacagaggagacttgaaatggctgaatgaaacctggcggcagcgcaaaagatg

SEQ ID NO: 54720 - DNA, 103 bp, Artificial Sequence
  Synthetic Polynucleotide
taatacgactcactatagggaactgggttaaaaaagatcattcagcgagtaacagaggagaactcgcatgatgatctttaacctggcggcagcgcaaaagatg

SEQ ID NO: 54721 - DNA, 103 bp, Artificial Sequence
  Synthetic Polynucleotide
taatacgactcactatagggaaactaactgggttaaaaaagatcattcagaacagaggagactgaatatgcttttttaaaacctggcggcagcgcaaaagatg

SEQ ID NO: 54722 - DNA, 103 bp, Artificial Sequence
  Synthetic Polynucleotide
taatacgactcactatagggatctaaaactaactgggttaaaaaagatcaaacagaggagatgatctatgttaacccagaacctggcggcagcgcaaaagatg

SEQ ID NO: 54723 - DNA, 103 bp, Artificial Sequence
  Synthetic Polynucleotide
taatacgactcactatagggtaccaatctaaaactaactgggttaaaaaaaacagaggagattttttatgccagttagtaacctggcggcagcgcaaaagatg

SEQ ID NO: 54724 - DNA, 103 bp, Artificial Sequence
  Synthetic Polynucleotide
taatacgactcactatagggtttcgtaccaatctaaaactaactgggttaaacagaggagataacccatgtagttttagaacctggcggcagcgcaaaagatg

SEQ ID NO: 54725 - DNA, 103 bp, Artificial Sequence
  Synthetic Polynucleotide
taatacgactcactatagggatatatttcgtaccaatctaaaactaactgaacagaggagacagttaatgttagattggaacctggcggcagcgcaaaagatg

SEQ ID NO: 54726 - DNA, 103 bp, Artificial Sequence
  Synthetic Polynucleotide
taatacgactcactatagggctgccggatacagaagaattattcactctgaacagaggagacagagtatgtaattcttcaacctggcggcagcgcaaaagatg

SEQ ID NO: 54727 - DNA, 103 bp, Artificial Sequence
  Synthetic Polynucleotide
taatacgactcactatagggtaacaatatatttcgtaccaatctaaaactaacagaggagaagttttatgttggtacgaaacctggcggcagcgcaaaagatg

SEQ ID NO: 54728 - DNA, 103 bp, Artificial Sequence
  Synthetic Polynucleotide
taatacgactcactatagggaagtttaacaatatatttcgtaccaatctaaacagaggagatagattatgacgaaatataacctggcggcagcgcaaaagatg

SEQ ID NO: 54729 - DNA, 103 bp, Artificial Sequence
  Synthetic Polynucleotide
taatacgactcactatagggaatcaaagtttaacaatatatttcgtaccaaacagaggagatggtacatgatatattgtaacctggcggcagcgcaaaagatg

SEQ ID NO: 54730 - DNA, 103 bp, Artificial Sequence
  Synthetic Polynucleotide
taatacgactcactatagggtgtagaatcaaagtttaacaatatatttcgaacagaggagacgaaatatgttgttaaacaacctggcggcagcgcaaaagatg

SEQ ID NO: 54731 - DNA, 103 bp, Artificial Sequence
  Synthetic Polynucleotide
taatacgactcactatagggattactgtagaatcaaagtttaacaatataaacagaggagatatattatgaaactttgaaacctggcggcagcgcaaaagatg

SEQ ID NO: 54732 - DNA, 103 bp, Artificial Sequence
  Synthetic Polynucleotide
taatacgactcactatagggtggacattactgtagaatcaaagtttaacaaacagaggagatgttaaatgttgattctaaacctggcggcagcgcaaaagatg

SEQ ID NO: 54733 - DNA, 103 bp, Artificial Sequence
  Synthetic Polynucleotide
taatacgactcactatagggagatttggacattactgtagaatcaaagttaacagaggagaaactttatgtctacagtaaacctggcggcagcgcaaaagatg

SEQ ID NO: 54734 - DNA, 103 bp, Artificial Sequence
  Synthetic Polynucleotide
taatacgactcactatagggcaactagatttggacattactgtagaatcaaacagaggagatgattcatgagtaatgtcaacctggcggcagcgcaaaagatg

SEQ ID NO: 54735 - DNA, 103 bp, Artificial Sequence
  Synthetic Polynucleotide
taatacgactcactatagggttccacaactagatttggacattactgtagaacagaggagactacagatgtgtccaaataacctggcggcagcgcaaaagatg

SEQ ID NO: 54736 - DNA, 103 bp, Artificial Sequence
  Synthetic Polynucleotide
taatacgactcactatagggcgtatttccacaactagatttggacattacaacagaggagagtaatgatgaaatctagtaacctggcggcagcgcaaaagatg

SEQ ID NO: 54737 - DNA, 103 bp, Artificial Sequence
  Synthetic Polynucleotide
taatacgactcactatagggttgaactgccggatacagaagaattattcaaacagaggagatgaataatgcttctgtataacctggcggcagcgcaaaagatg

SEQ ID NO: 54738 - DNA, 103 bp, Artificial Sequence
  Synthetic Polynucleotide
taatacgactcactatagggatggacgtatttccacaactagatttggacaacagaggagagtccaaatgtagttgtggaacctggcggcagcgcaaaagatg

SEQ ID NO: 54739 - DNA, 103 bp, Artificial Sequence
  Synthetic Polynucleotide
taatacgactcactatagggtgctgatggacgtatttccacaactagattaacagaggagaaatctaatggtggaaataaacctggcggcagcgcaaaagatg

SEQ ID NO: 54740 - DNA, 103 bp, Artificial Sequence
  Synthetic Polynucleotide
taatacgactcactatagggaacaatgctgatggacgtatttccacaactaacagaggagaagttgtatgaatacgtccaacctggcggcagcgcaaaagatg

SEQ ID NO: 54741 - DNA, 103 bp, Artificial Sequence
  Synthetic Polynucleotide
taatacgactcactatagggtttgaaacaatgctgatggacgtatttccaaacagaggagatggaaaatggtccatcagaacctggcggcagcgcaaaagatg

SEQ ID NO: 54742 - DNA, 103 bp, Artificial Sequence
  Synthetic Polynucleotide
taatacgactcactatagggtcaagtttgaaacaatgctgatggacgtataacagaggagaatacgtatgtcagcattgaacctggcggcagcgcaaaagatg

SEQ ID NO: 54743 - DNA, 103 bp, Artificial Sequence
  Synthetic Polynucleotide
taatacgactcactatagggtattatcaagtttgaaacaatgctgatggaaacagaggagatccatcatgattgtttcaaacctggcggcagcgcaaaagatg

SEQ ID NO: 54744 - DNA, 103 bp, Artificial Sequence
  Synthetic Polynucleotide
taatacgactcactatagggaataatattatcaagtttgaaacaatgctgaacagaggagacagcatatgttcaaacttaacctggcggcagcgcaaaagatg

SEQ ID NO: 54745 - DNA, 103 bp, Artificial Sequence
  Synthetic Polynucleotide
taatacgactcactatagggtggataataatattatcaagtttgaaacaaaacagaggagattgtttatgacttgataaaacctggcggcagcgcaaaagatg

SEQ ID NO: 54746 - DNA, 103 bp, Artificial Sequence
  Synthetic Polynucleotide
taatacgactcactatagggagatgtggataataatattatcaagtttgaaacagaggagatcaaacatgataatattaaacctggcggcagcgcaaaagatg

SEQ ID NO: 54747 - DNA, 103 bp, Artificial Sequence
  Synthetic Polynucleotide
taatacgactcactatagggtatgaagatgtggataataatattatcaagaacagaggagacttgatatgattattatcaacctggcggcagcgcaaaagatg

SEQ ID NO: 54748 - DNA, 103 bp, Artificial Sequence
  Synthetic Polynucleotide
taatacgactcactatagggtatatttgaactgccggatacagaagaattaacagaggagaaattctatggtatccggcaacctggcggcagcgcaaaagatg

SEQ ID NO: 54749 - DNA, 103 bp, Artificial Sequence
  Synthetic Polynucleotide
taatacgactcactataggggatcatatgaagatgtggataataatattaaacagaggagataatatatgtatccacataacctggcggcagcgcaaaagatg

SEQ ID NO: 54750 - DNA, 103 bp, Artificial Sequence
  Synthetic Polynucleotide
taatacgactcactatagggatttggatcatatgaagatgtggataataaaacagaggagattattaatgacatcttcaaacctggcggcagcgcaaaagatg

SEQ ID NO: 54751 - DNA, 103 bp, Artificial Sequence
  Synthetic Polynucleotide
taatacgactcactatagggccagaatttggatcatatgaagatgtggataacagaggagaatccacatgttcatatgaaacctggcggcagcgcaaaagatg

SEQ ID NO: 54752 - DNA, 103 bp, Artificial Sequence
  Synthetic Polynucleotide
taatacgactcactatagggctattccagaatttggatcatatgaagatgaacagaggagacatcttatgatgatccaaaacctggcggcagcgcaaaagatg

SEQ ID NO: 54753 - DNA, 103 bp, Artificial Sequence
  Synthetic Polynucleotide
taatacgactcactatagggtacatctattccagaatttggatcatatgaaacagaggagatcatatatgccaaattctaacctggcggcagcgcaaaagatg

SEQ ID NO: 54754 - DNA, 103 bp, Artificial Sequence
  Synthetic Polynucleotide
taatacgactcactatagggtgtgatacatctattccagaatttggatcaaacagaggagatgatccatgttctggaataacctggcggcagcgcaaaagatg

SEQ ID NO: 54755 - DNA, 103 bp, Artificial Sequence
  Synthetic Polynucleotide
taatacgactcactataggggagcgtgtgatacatctattccagaatttgaacagaggagacaaattatggaatagatgaacctggcggcagcgcaaaagatg

SEQ ID NO: 54756 - DNA, 103 bp, Artificial Sequence
  Synthetic Polynucleotide
taatacgactcactatagggagccagagcgtgtgatacatctattccagaaacagaggagatctggaatggatgtatcaaacctggcggcagcgcaaaagatg

SEQ ID NO: 54757 - DNA, 103 bp, Artificial Sequence
  Synthetic Polynucleotide
taatacgactcactatagggtgggtagccagagcgtgtgatacatctattaacagaggagaaatagaatgatcacacgcaacctggcggcagcgcaaaagatg

SEQ ID NO: 54758 - DNA, 103 bp, Artificial Sequence
  Synthetic Polynucleotide
taatacgactcactatagggttatctgggtagccagagcgtgtgatacataacagaggagaatgtatatgacgctctggaacctggcggcagcgcaaaagatg

SEQ ID NO: 54759 - DNA, 103 bp, Artificial Sequence
  Synthetic Polynucleotide
taatacgactcactataggggatcatatatttgaactgccggatacagaaaacagaggagattctgtatgcggcagttcaacctggcggcagcgcaaaagatg

SEQ ID NO: 54760 - DNA, 103 bp, Artificial Sequence
  Synthetic Polynucleotide
taatacgactcactatagggtttggttatctgggtagccagagcgtgtgaaacagaggagatcacacatgctggctaccaacctggcggcagcgcaaaagatg

SEQ ID NO: 54761 - DNA, 103 bp, Artificial Sequence
  Synthetic Polynucleotide
taatacgactcactataggggactttttggttatctgggtagccagagcgaacagaggagacgctctatgtacccagataacctggcggcagcgcaaaagatg

SEQ ID NO: 54762 - DNA, 103 bp, Artificial Sequence
  Synthetic Polynucleotide
taatacgactcactatagggcgtgcgactttttggttatctgggtagccaaacagaggagatggctaatgagataaccaaacctggcggcagcgcaaaagatg

SEQ ID NO: 54763 - DNA, 103 bp, Artificial Sequence
  Synthetic Polynucleotide
taatacgactcactatagggtggagcgtgcgactttttggttatctgggtaacagaggagaacccagatgaccaaaaagaacctggcggcagcgcaaaagatg

SEQ ID NO: 54764 - DNA, 103 bp, Artificial Sequence
  Synthetic Polynucleotide
taatacgactcactatagggtatcctggagcgtgcgactttttggttatcaacagaggagagataacatgaaagtcgcaaacctggcggcagcgcaaaagatg

SEQ ID NO: 54765 - DNA, 103 bp, Artificial Sequence
  Synthetic Polynucleotide
taatacgactcactatagggatgtatatcctggagcgtgcgactttttggaacagaggagaccaaaaatgcgcacgctcaacctggcggcagcgcaaaagatg

SEQ ID NO: 54766 - DNA, 103 bp, Artificial Sequence
  Synthetic Polynucleotide
taatacgactcactatagggatacaatgtatatcctggagcgtgcgacttaacagaggagaaagtcgatggctccaggaaacctggcggcagcgcaaaagatg

SEQ ID NO: 54767 - DNA, 103 bp, Artificial Sequence
  Synthetic Polynucleotide
taatacgactcactatagggtttttatacaatgtatatcctggagcgtgcaacagaggagagcacgcatgaggatatacaacctggcggcagcgcaaaagatg

SEQ ID NO: 54768 - DNA, 103 bp, Artificial Sequence
  Synthetic Polynucleotide
taatacgactcactatagggatagctttttatacaatgtatatcctggagaacagaggagactccagatgatacattgtaacctggcggcagcgcaaaagatg

SEQ ID NO: 54769 - DNA, 103 bp, Artificial Sequence
  Synthetic Polynucleotide
taatacgactcactatagggaaacgatagctttttatacaatgtatatccaacagaggagaggatatatgttgtataaaaacctggcggcagcgcaaaagatg

SEQ ID NO: 54770 - DNA, 103 bp, Artificial Sequence
  Synthetic Polynucleotide
taatacgactcactataggggcatggatcatatatttgaactgccggataaacagaggagatatccgatggttcaaataaacctggcggcagcgcaaaagatg

SEQ ID NO: 54771 - DNA, 103 bp, Artificial Sequence
  Synthetic Polynucleotide
taatacgactcactatagggcttaaaaacgatagctttttatacaatgtaaacagaggagatacattatgtaaaaagctaacctggcggcagcgcaaaagatg

SEQ ID NO: 54772 - DNA, 103 bp, Artificial Sequence
  Synthetic Polynucleotide
taatacgactcactatagggcactacttaaaaacgatagctttttatacaaacagaggagatgtataatgagctatcgtaacctggcggcagcgcaaaagatg

SEQ ID NO: 54773 - DNA, 103 bp, Artificial Sequence
  Synthetic Polynucleotide
taatacgactcactatagggaaaaacactacttaaaaacgatagctttttaacagaggagaaaaaagatgtcgtttttaaacctggcggcagcgcaaaagatg

SEQ ID NO: 54774 - DNA, 103 bp, Artificial Sequence
  Synthetic Polynucleotide
taatacgactcactatagggcaaaaaaaaacactacttaaaaacgatagcaacagaggagagctatcatgtttaagtagaacctggcggcagcgcaaaagatg

SEQ ID NO: 54775 - DNA, 103 bp, Artificial Sequence
  Synthetic Polynucleotide
taatacgactcactatagggatacgcaaaaaaaaacactacttaaaaacgaacagaggagacgttttatggtagtgtttaacctggcggcagcgcaaaagatg

SEQ ID NO: 54776 - DNA, 103 bp, Artificial Sequence
  Synthetic Polynucleotide
taatacgactcactatagggcgtatatacgcaaaaaaaaacactacttaaaacagaggagattaagtatggttttttttaacctggcggcagcgcaaaagatg

SEQ ID NO: 54777 - DNA, 103 bp, Artificial Sequence
  Synthetic Polynucleotide
taatacgactcactatagggcccttcgtatatacgcaaaaaaaaacactaaacagaggagatagtgtatgtttttgcgtaacctggcggcagcgcaaaagatg

SEQ ID NO: 54778 - DNA, 103 bp, Artificial Sequence
  Synthetic Polynucleotide
taatacgactcactatagggtcaatcccttcgtatatacgcaaaaaaaaaaacagaggagattttttatggcgtatataaacctggcggcagcgcaaaagatg

SEQ ID NO: 54779 - DNA, 103 bp, Artificial Sequence
  Synthetic Polynucleotide
taatacgactcactatagggtattttcaatcccttcgtatatacgcaaaaaacagaggagattttgcatgtatacgaagaacctggcggcagcgcaaaagatg

SEQ ID NO: 54780 - DNA, 103 bp, Artificial Sequence
  Synthetic Polynucleotide
taatacgactcactatagggaatactattttcaatcccttcgtatatacgaacagaggagacgtataatggaagggattaacctggcggcagcgcaaaagatg

SEQ ID NO: 54781 - DNA, 103 bp, Artificial Sequence
  Synthetic Polynucleotide
taatacgactcactatagggtctatgcatggatcatatatttgaactgccaacagaggagaggcagtatgaatatatgaaacctggcggcagcgcaaaagatg

SEQ ID NO: 54782 - DNA, 103 bp, Artificial Sequence
  Synthetic Polynucleotide
taatacgactcactatagggtcgataatactattttcaatcccttcgtataacagaggagaatacgaatggattgaaaaaacctggcggcagcgcaaaagatg

SEQ ID NO: 54783 - DNA, 103 bp, Artificial Sequence
  Synthetic Polynucleotide
taatacgactcactatagggttacgtcgataatactattttcaatcccttaacagaggagaaagggaatgaaaatagtaaacctggcggcagcgcaaaagatg

SEQ ID NO: 54784 - DNA, 103 bp, Artificial Sequence
  Synthetic Polynucleotide
taatacgactcactatagggtatagttacgtcgataatactattttcaataacagaggagaattgaaatgagtattatcaacctggcggcagcgcaaaagatg

SEQ ID NO: 54785 - DNA, 103 bp, Artificial Sequence
  Synthetic Polynucleotide
taatacgactcactatagggtggaatatagttacgtcgataatactatttaacagaggagaaaatagatgtatcgacgtaacctggcggcagcgcaaaagatg

SEQ ID NO: 54786 - DNA, 103 bp, Artificial Sequence
  Synthetic Polynucleotide
taatacgactcactatagggtaatttggaatatagttacgtcgataatacaacagaggagagtattaatgacgtaactaaacctggcggcagcgcaaaagatg

SEQ ID NO: 54787 - DNA, 103 bp, Artificial Sequence
  Synthetic Polynucleotide
taatacgactcactatagggaagaataatttggaatatagttacgtcgataacagaggagaatcgacatgactatattcaacctggcggcagcgcaaaagatg

SEQ ID NO: 54788 - DNA, 103 bp, Artificial Sequence
  Synthetic Polynucleotide
taatacgactcactatagggcgcataagaataatttggaatatagttacgaacagaggagacgtaacatgattccaaataacctggcggcagcgcaaaagatg

SEQ ID NO: 54789 - DNA, 103 bp, Artificial Sequence
  Synthetic Polynucleotide
taatacgactcactatagggctattcgcataagaataatttggaatatagaacagaggagactatatatgaaattattcaacctggcggcagcgcaaaagatg

SEQ ID NO: 54790 - DNA, 103 bp, Artificial Sequence
  Synthetic Polynucleotide
taatacgactcactatagggattatctattcgcataagaataatttggaaaacagaggagattccaaatgattcttatgaacctggcggcagcgcaaaagatg

SEQ ID NO: 54791 - DNA, 103 bp, Artificial Sequence
  Synthetic Polynucleotide
taatacgactcactatagggatattattatctattcgcataagaataattaacagaggagaaattatatgtatgcgaataacctggcggcagcgcaaaagatg

SEQ ID NO: 54792 - DNA, 103 bp, Artificial Sequence
  Synthetic Polynucleotide
taatacgactcactatagggtcgccctttaccatgaactcattaaccgaaaacagaggagattcggtatgtgagttcataacctggcggcagcgcaaaagatg

SEQ ID NO: 54793 - DNA, 103 bp, Artificial Sequence
  Synthetic Polynucleotide
taatacgactcactataggggccgatctatgcatggatcatatatttgaaaacagaggagattcaaaatgatgatccataacctggcggcagcgcaaaagatg

SEQ ID NO: 54794 - DNA, 103 bp, Artificial Sequence
  Synthetic Polynucleotide
taatacgactcactatagggggacgatattattatctattcgcataagaaaacagaggagattcttaatggaatagataaacctggcggcagcgcaaaagatg

SEQ ID NO: 54795 - DNA, 103 bp, Artificial Sequence
  Synthetic Polynucleotide
taatacgactcactatagggattaaggacgatattattatctattcgcataacagaggagaatgcgaatggataataataacctggcggcagcgcaaaagatg

SEQ ID NO: 54796 - DNA, 103 bp, Artificial Sequence
  Synthetic Polynucleotide
taatacgactcactatagggtagatattaaggacgatattattatctattaacagaggagaaatagaatgtaatatcgtaacctggcggcagcgcaaaagatg

SEQ ID NO: 54797 - DNA, 103 bp, Artificial Sequence
  Synthetic Polynucleotide
taatacgactcactatagggtttgttagatattaaggacgatattattataacagaggagaataataatgtcgtccttaaacctggcggcagcgcaaaagatg

SEQ ID NO: 54798 - DNA, 103 bp, Artificial Sequence
  Synthetic Polynucleotide
taatacgactcactatagggggaaatttgttagatattaaggacgatattaacagaggagaaatatcatgcttaatatcaacctggcggcagcgcaaaagatg

SEQ ID NO: 54799 - DNA, 103 bp, Artificial Sequence
  Synthetic Polynucleotide
taatacgactcactatagggatttaggaaatttgttagatattaaggacgaacagaggagacgtcctatgtatctaacaaacctggcggcagcgcaaaagatg

SEQ ID NO: 54800 - DNA, 103 bp, Artificial Sequence
  Synthetic Polynucleotide
taatacgactcactataggggggatatttaggaaatttgttagatattaaaacagaggagattaataatgaacaaatttaacctggcggcagcgcaaaagatg

SEQ ID NO: 54801 - DNA, 103 bp, Artificial Sequence
  Synthetic Polynucleotide
taatacgactcactatagggttaaagggatatttaggaaatttgttagataacagaggagaatctaaatgatttcctaaaacctggcggcagcgcaaaagatg

SEQ ID NO: 54802 - DNA, 103 bp, Artificial Sequence
  Synthetic Polynucleotide
taatacgactcactatagggctcaattaaagggatatttaggaaatttgtaacagaggagaacaaatatgctaaatatcaacctggcggcagcgcaaaagatg

SEQ ID NO: 54803 - DNA, 103 bp, Artificial Sequence
  Synthetic Polynucleotide
taatacgactcactatagggaatgactcaattaaagggatatttaggaaaaacagaggagatttcctatgtatccctttaacctggcggcagcgcaaaagatg

SEQ ID NO: 54804 - DNA, 103 bp, Artificial Sequence
  Synthetic Polynucleotide
taatacgactcactataggggctttgccgatctatgcatggatcatatataacagaggagaatatatatgccatgcataaacctggcggcagcgcaaaagatg

SEQ ID NO: 54805 - DNA, 103 bp, Artificial Sequence
  Synthetic Polynucleotide
taatacgactcactatagggcttcgaatgactcaattaaagggatatttaaacagaggagataaataatgctttaattgaacctggcggcagcgcaaaagatg

SEQ ID NO: 54806 - DNA, 103 bp, Artificial Sequence
  Synthetic Polynucleotide
taatacgactcactatagggtgacgcttcgaatgactcaattaaagggataacagaggagaatccctatgattgagtcaaacctggcggcagcgcaaaagatg

SEQ ID NO: 54807 - DNA, 103 bp, Artificial Sequence
  Synthetic Polynucleotide
taatacgactcactatagggtctattgacgcttcgaatgactcaattaaaaacagaggagatttaatatggtcattcgaaacctggcggcagcgcaaaagatg

SEQ ID NO: 54808 - DNA, 103 bp, Artificial Sequence
  Synthetic Polynucleotide
taatacgactcactatagggcatattctattgacgcttcgaatgactcaaaacagaggagattgagtatgtcgaagcgtaacctggcggcagcgcaaaagatg

SEQ ID NO: 54809 - DNA, 103 bp, Artificial Sequence
  Synthetic Polynucleotide
taatacgactcactatagggagagacatattctattgacgcttcgaatgaaacagaggagatcattcatggcgtcaataaacctggcggcagcgcaaaagatg

SEQ ID NO: 54810 - DNA, 103 bp, Artificial Sequence
  Synthetic Polynucleotide
taatacgactcactatagggagttaagagacatattctattgacgcttcgaacagaggagacgaagcatgaatagaataaacctggcggcagcgcaaaagatg

SEQ ID NO: 54811 - DNA, 103 bp, Artificial Sequence
  Synthetic Polynucleotide
taatacgactcactataggggaaatagttaagagacatattctattgacgaacagaggagacgtcaaatgaatatgtctaacctggcggcagcgcaaaagatg

SEQ ID NO: 54812 - DNA, 103 bp, Artificial Sequence
  Synthetic Polynucleotide
taatacgactcactatagggagccggaaatagttaagagacatattctataacagaggagaatagaaatggtctcttaaaacctggcggcagcgcaaaagatg

SEQ ID NO: 54813 - DNA, 103 bp, Artificial Sequence
  Synthetic Polynucleotide
taatacgactcactatagggacaacagccggaaatagttaagagacatataacagaggagaatatgtatgttaactattaacctggcggcagcgcaaaagatg

SEQ ID NO: 54814 - DNA, 103 bp, Artificial Sequence
  Synthetic Polynucleotide
taatacgactcactatagggaatatacaacagccggaaatagttaagagaaacagaggagatctcttatgtatttccggaacctggcggcagcgcaaaagatg

SEQ ID NO: 54815 - DNA, 103 bp, Artificial Sequence
  Synthetic Polynucleotide
taatacgactcactatagggcgatagctttgccgatctatgcatggatcaaacagaggagatgatccatgcatagatcgaacctggcggcagcgcaaaagatg

SEQ ID NO: 54816 - DNA, 103 bp, Artificial Sequence
  Synthetic Polynucleotide
taatacgactcactatagggatttaaatatacaacagccggaaatagttaaacagaggagataactaatgccggctgttaacctggcggcagcgcaaaagatg

SEQ ID NO: 54817 - DNA, 103 bp, Artificial Sequence
  Synthetic Polynucleotide
taatacgactcactatagggaagtcatttaaatatacaacagccggaaataacagaggagaatttccatgtgttgtataaacctggcggcagcgcaaaagatg

SEQ ID NO: 54818 - DNA, 103 bp, Artificial Sequence
  Synthetic Polynucleotide
taatacgactcactatagggttacgaagtcatttaaatatacaacagccgaacagaggagacggctgatgtatatttaaaacctggcggcagcgcaaaagatg

SEQ ID NO: 54819 - DNA, 103 bp, Artificial Sequence
  Synthetic Polynucleotide
taatacgactcactatagggatttcttacgaagtcatttaaatatacaacaacagaggagagttgtaatgttaaatgacaacctggcggcagcgcaaaagatg

SEQ ID NO: 54820 - DNA, 103 bp, Artificial Sequence
  Synthetic Polynucleotide
taatacgactcactatagggatattatttcttacgaagtcatttaaatataacagaggagaatatttatgtgacttcgtaacctggcggcagcgcaaaagatg

SEQ ID NO: 54821 - DNA, 103 bp, Artificial Sequence
  Synthetic Polynucleotide
taatacgactcactatagggcccatatattatttcttacgaagtcatttaaacagaggagataaatgatgtcgtaagaaaacctggcggcagcgcaaaagatg

SEQ ID NO: 54822 - DNA, 103 bp, Artificial Sequence
  Synthetic Polynucleotide
taatacgactcactatagggagtcgcccatatattatttcttacgaagtcaacagaggagagacttcatgagaaataataacctggcggcagcgcaaaagatg

SEQ ID NO: 54823 - DNA, 103 bp, Artificial Sequence
  Synthetic Polynucleotide
taatacgactcactatagggtgaaaagtcgcccatatattatttcttacgaacagaggagacgtaagatgtaatatatgaacctggcggcagcgcaaaagatg

SEQ ID NO: 54824 - DNA, 103 bp, Artificial Sequence
  Synthetic Polynucleotide
taatacgactcactatagggatagatgaaaagtcgcccatatattatttcaacagaggagagaaataatgtatgggcgaaacctggcggcagcgcaaaagatg

SEQ ID NO: 54825 - DNA, 103 bp, Artificial Sequence
  Synthetic Polynucleotide
taatacgactcactatagggattacatagatgaaaagtcgcccatatattaacagaggagaaatataatggcgacttttaacctggcggcagcgcaaaagatg

SEQ ID NO: 54826 - DNA, 103 bp, Artificial Sequence
  Synthetic Polynucleotide
taatacgactcactatagggatctacgatagctttgccgatctatgcatgaacagaggagacatgcaatgatcggcaaaaacctggcggcagcgcaaaagatg

SEQ ID NO: 54827 - DNA, 103 bp, Artificial Sequence
  Synthetic Polynucleotide
taatacgactcactatagggatatgattacatagatgaaaagtcgcccataacagaggagaatgggcatgttttcatctaacctggcggcagcgcaaaagatg

SEQ ID NO: 54828 - DNA, 103 bp, Artificial Sequence
  Synthetic Polynucleotide
taatacgactcactatagggactccatatgattacatagatgaaaagtcgaacagaggagacgacttatgatctatgtaaacctggcggcagcgcaaaagatg

SEQ ID NO: 54829 - DNA, 103 bp, Artificial Sequence
  Synthetic Polynucleotide
taatacgactcactatagggatctcactccatatgattacatagatgaaaaacagaggagatttcatatgtgtaatcataacctggcggcagcgcaaaagatg

SEQ ID NO: 54830 - DNA, 103 bp, Artificial Sequence
  Synthetic Polynucleotide
taatacgactcactatagggcctatatctcactccatatgattacatagaaacagaggagatctatgatgtcatatggaaacctggcggcagcgcaaaagatg

SEQ ID NO: 54831 - DNA, 103 bp, Artificial Sequence
  Synthetic Polynucleotide
taatacgactcactatagggcgagccctatatctcactccatatgattacaacagaggagagtaatcatgtggagtgagaacctggcggcagcgcaaaagatg

SEQ ID NO: 54832 - DNA, 103 bp, Artificial Sequence
  Synthetic Polynucleotide
taatacgactcactatagggtagaacgagccctatatctcactccatatgaacagaggagacatatgatgtgagatataaacctggcggcagcgcaaaagatg

SEQ ID NO: 54833 - DNA, 103 bp, Artificial Sequence
  Synthetic Polynucleotide
taatacgactcactatagggggaggtagaacgagccctatatctcactccaacagaggagaggagtgatgtatagggctaacctggcggcagcgcaaaagatg

SEQ ID NO: 54834 - DNA, 103 bp, Artificial Sequence
  Synthetic Polynucleotide
taatacgactcactataggggggcaggaggtagaacgagccctatatctcaacagaggagagagataatgggctcgttcaacctggcggcagcgcaaaagatg

SEQ ID NO: 54835 - DNA, 103 bp, Artificial Sequence
  Synthetic Polynucleotide
taatacgactcactataggggtaaagggcaggaggtagaacgagccctataacagaggagaatagggatggttctacctaacctggcggcagcgcaaaagatg

SEQ ID NO: 54836 - DNA, 103 bp, Artificial Sequence
  Synthetic Polynucleotide
taatacgactcactatagggggtgggtaaagggcaggaggtagaacgagcaacagaggagagctcgtatgacctcctgcaacctggcggcagcgcaaaagatg

SEQ ID NO: 54837 - DNA, 103 bp, Artificial Sequence
  Synthetic Polynucleotide
taatacgactcactatagggatcacatctacgatagctttgccgatctataacagaggagaatagatatgcaaagctataacctggcggcagcgcaaaagatg

SEQ ID NO: 54838 - DNA, 103 bp, Artificial Sequence
  Synthetic Polynucleotide
taatacgactcactatagggttacaggtgggtaaagggcaggaggtagaaaacagaggagattctacatgctgccctttaacctggcggcagcgcaaaagatg

SEQ ID NO: 54839 - DNA, 103 bp, Artificial Sequence
  Synthetic Polynucleotide
taatacgactcactatagggtggtattacaggtgggtaaagggcaggaggaacagaggagacctcctatgctttacccaaacctggcggcagcgcaaaagatg

SEQ ID NO: 54840 - DNA, 103 bp, Artificial Sequence
  Synthetic Polynucleotide
taatacgactcactatagggacaattggtattacaggtgggtaaagggcaaacagaggagatgccctatgcccacctgtaacctggcggcagcgcaaaagatg

SEQ ID NO: 54841 - DNA, 103 bp, Artificial Sequence
  Synthetic Polynucleotide
taatacgactcactatagggagtccacaattggtattacaggtgggtaaaaacagaggagatttaccatgctgtaatacaacctggcggcagcgcaaaagatg

SEQ ID NO: 54842 - DNA, 103 bp, Artificial Sequence
  Synthetic Polynucleotide
taatacgactcactatagggtagtgagtccacaattggtattacaggtggaacagaggagaccacctatgataccaattaacctggcggcagcgcaaaagatg

SEQ ID NO: 54843 - DNA, 103 bp, Artificial Sequence
  Synthetic Polynucleotide
taatacgactcactatagggatatatagtgagtccacaattggtattacaaacagaggagatgtaatatgaattgtggaaacctggcggcagcgcaaaagatg

SEQ ID NO: 54844 - DNA, 103 bp, Artificial Sequence
  Synthetic Polynucleotide
taatacgactcactatagggatgcgatatatagtgagtccacaattggtaaacagaggagataccaaatgtggactcacaacctggcggcagcgcaaaagatg

SEQ ID NO: 54845 - DNA, 103 bp, Artificial Sequence
  Synthetic Polynucleotide
taatacgactcactatagggtaaatatgcgatatatagtgagtccacaataacagaggagaattgtgatgtcactatataacctggcggcagcgcaaaagatg

SEQ ID NO: 54846 - DNA, 103 bp, Artificial Sequence
  Synthetic Polynucleotide
taatacgactcactatagggcgatataaatatgcgatatatagtgagtccaacagaggagaggactcatgatatatcgcaacctggcggcagcgcaaaagatg

SEQ ID NO: 54847 - DNA, 103 bp, Artificial Sequence
  Synthetic Polynucleotide
taatacgactcactatagggccccacgatataaatatgcgatatatagtgaacagaggagacactatatgtcgcatattaacctggcggcagcgcaaaagatg

SEQ ID NO: 54848 - DNA, 103 bp, Artificial Sequence
  Synthetic Polynucleotide
taatacgactcactataggggaaaaatcacatctacgatagctttgccgaaacagaggagatcggcaatgctatcgtagaacctggcggcagcgcaaaagatg

SEQ ID NO: 54849 - DNA, 103 bp, Artificial Sequence
  Synthetic Polynucleotide
taatacgactcactatagggctttaccccacgatataaatatgcgatataaacagaggagatatatcatgtatttatataacctggcggcagcgcaaaagatg

SEQ ID NO: 54850 - DNA, 103 bp, Artificial Sequence
  Synthetic Polynucleotide
taatacgactcactatagggtttcactttaccccacgatataaatatgcgaacagaggagacgcataatgatatcgtggaacctggcggcagcgcaaaagatg

SEQ ID NO: 54851 - DNA, 103 bp, Artificial Sequence
  Synthetic Polynucleotide
taatacgactcactatagggtagattttcactttaccccacgatataaataacagaggagaatttatatggtggggtaaaacctggcggcagcgcaaaagatg

SEQ ID NO: 54852 - DNA, 103 bp, Artificial Sequence
  Synthetic Polynucleotide
taatacgactcactatagggggtagtagattttcactttaccccacgataaacagaggagatatcgtatggtaaagtgaaacctggcggcagcgcaaaagatg

SEQ ID NO: 54853 - DNA, 103 bp, Artificial Sequence
  Synthetic Polynucleotide
taatacgactcactatagggtcatcggtagtagattttcactttaccccaaacagaggagatggggtatggtgaaaatcaacctggcggcagcgcaaaagatg

SEQ ID NO: 54854 - DNA, 103 bp, Artificial Sequence
  Synthetic Polynucleotide
taatacgactcactatagggttacatcatcggtagtagattttcactttaaacagaggagataaagtatgaatctactaaacctggcggcagcgcaaaagatg

SEQ ID NO: 54855 - DNA, 103 bp, Artificial Sequence
  Synthetic Polynucleotide
taatacgactcactatagggaagacttacatcatcggtagtagattttcaaacagaggagatgaaaaatgactaccgataacctggcggcagcgcaaaagatg

SEQ ID NO: 54856 - DNA, 103 bp, Artificial Sequence
  Synthetic Polynucleotide
taatacgactcactatagggattgtaagacttacatcatcggtagtagataacagaggagaatctacatgcgatgatgtaacctggcggcagcgcaaaagatg

SEQ ID NO: 54857 - DNA, 103 bp, Artificial Sequence
  Synthetic Polynucleotide
taatacgactcactatagggcaaacattgtaagacttacatcatcggtagaacagaggagactaccgatgatgtaagtcaacctggcggcagcgcaaaagatg

SEQ ID NO: 54858 - DNA, 103 bp, Artificial Sequence
  Synthetic Polynucleotide
taatacgactcactatagggtggttcaaacattgtaagacttacatcatcaacagaggagagatgatatgagtcttacaaacctggcggcagcgcaaaagatg

SEQ ID NO: 54859 - DNA, 103 bp, Artificial Sequence
  Synthetic Polynucleotide
taatacgactcactatagggtttaggaaaaatcacatctacgatagctttaacagaggagaaaagctatggtagatgtgaacctggcggcagcgcaaaagatg

SEQ ID NO: 54860 - DNA, 103 bp, Artificial Sequence
  Synthetic Polynucleotide
taatacgactcactatagggggtactggttcaaacattgtaagacttacaaacagaggagatgtaagatgtacaatgttaacctggcggcagcgcaaaagatg

SEQ ID NO: 54861 - DNA, 103 bp, Artificial Sequence
  Synthetic Polynucleotide
taatacgactcactataggggatctggtactggttcaaacattgtaagacaacagaggagagtcttaatgtgtttgaacaacctggcggcagcgcaaaagatg

SEQ ID NO: 54862 - DNA, 103 bp, Artificial Sequence
  Synthetic Polynucleotide
taatacgactcactatagggattaagatctggtactggttcaaacattgtaacagaggagaacaatgatggaaccagtaaacctggcggcagcgcaaaagatg

SEQ ID NO: 54863 - DNA, 103 bp, Artificial Sequence
  Synthetic Polynucleotide
taatacgactcactatagggtccaaattaagatctggtactggttcaaacaacagaggagagtttgaatgagtaccagaaacctggcggcagcgcaaaagatg

SEQ ID NO: 54864 - DNA, 103 bp, Artificial Sequence
  Synthetic Polynucleotide
taatacgactcactatagggaggcctccaaattaagatctggtactggttaacagaggagaaaccagatgcagatcttaaacctggcggcagcgcaaaagatg

SEQ ID NO: 54865 - DNA, 103 bp, Artificial Sequence
  Synthetic Polynucleotide
taatacgactcactatagggtacggaggcctccaaattaagatctggtacaacagaggagagtaccaatgcttaatttgaacctggcggcagcgcaaaagatg

SEQ ID NO: 54866 - DNA, 103 bp, Artificial Sequence
  Synthetic Polynucleotide
taatacgactcactatagggagttctacggaggcctccaaattaagatctaacagaggagaagatctatgtttggaggcaacctggcggcagcgcaaaagatg

SEQ ID NO: 54867 - DNA, 103 bp, Artificial Sequence
  Synthetic Polynucleotide
taatacgactcactatagggcccctagttctacggaggcctccaaattaaaacagaggagattaattatgaggcctccgaacctggcggcagcgcaaaagatg

SEQ ID NO: 54868 - DNA, 103 bp, Artificial Sequence
  Synthetic Polynucleotide
taatacgactcactatagggtacctcccctagttctacggaggcctccaaaacagaggagattggagatgtccgtagaaaacctggcggcagcgcaaaagatg

SEQ ID NO: 54869 - DNA, 103 bp, Artificial Sequence
  Synthetic Polynucleotide
taatacgactcactatagggatatttacctcccctagttctacggaggccaacagaggagaggcctcatgagaactaggaacctggcggcagcgcaaaagatg

SEQ ID NO: 54870 - DNA, 103 bp, Artificial Sequence
  Synthetic Polynucleotide
taatacgactcactatagggctcgatttaggaaaaatcacatctacgataaacagaggagatatcgtatgtgtgattttaacctggcggcagcgcaaaagatg

SEQ ID NO: 54871 - DNA, 103 bp, Artificial Sequence
  Synthetic Polynucleotide
taatacgactcactataggggatctatatttacctcccctagttctacggaacagaggagaccgtagatgtaggggaggaacctggcggcagcgcaaaagatg

SEQ ID NO: 54872 - DNA, 103 bp, Artificial Sequence
  Synthetic Polynucleotide
taatacgactcactatagggtgtttgatctatatttacctcccctagttcaacagaggagagaactaatggaggtaaataacctggcggcagcgcaaaagatg

SEQ ID NO: 54873 - DNA, 103 bp, Artificial Sequence
  Synthetic Polynucleotide
taatacgactcactatagggggtgttgtttgatctatatttacctcccctaacagaggagaaggggaatgaaatatagaaacctggcggcagcgcaaaagatg

SEQ ID NO: 54874 - DNA, 103 bp, Artificial Sequence
  Synthetic Polynucleotide
taatacgactcactatagggtcataggtgttgtttgatctatatttacctaacagaggagaaggtaaatgtagatcaaaaacctggcggcagcgcaaaagatg

SEQ ID NO: 54875 - DNA, 103 bp, Artificial Sequence
  Synthetic Polynucleotide
taatacgactcactatagggctttatcataggtgttgtttgatctatattaacagaggagaaatataatgcaaacaacaaacctggcggcagcgcaaaagatg

SEQ ID NO: 54876 - DNA, 103 bp, Artificial Sequence
  Synthetic Polynucleotide
taatacgactcactatagggttctcctttatcataggtgttgtttgatctaacagaggagaagatcaatgaacacctataacctggcggcagcgcaaaagatg

SEQ ID NO: 54877 - DNA, 103 bp, Artificial Sequence
  Synthetic Polynucleotide
taatacgactcactatagggcgatattctcctttatcataggtgttgtttaacagaggagaaaacaaatgctatgataaaacctggcggcagcgcaaaagatg

SEQ ID NO: 54878 - DNA, 103 bp, Artificial Sequence
  Synthetic Polynucleotide
taatacgactcactatagggaaaaccgatattctcctttatcataggtgtaacagaggagaacacctatgataaaggagaacctggcggcagcgcaaaagatg

SEQ ID NO: 54879 - DNA, 103 bp, Artificial Sequence
  Synthetic Polynucleotide
taatacgactcactataggggatataaaaccgatattctcctttatcataaacagaggagatatgatatgggagaatataacctggcggcagcgcaaaagatg

SEQ ID NO: 54880 - DNA, 103 bp, Artificial Sequence
  Synthetic Polynucleotide
taatacgactcactatagggtgcgggatataaaaccgatattctcctttaaacagaggagataaaggatgatatcggttaacctggcggcagcgcaaaagatg

SEQ ID NO: 54881 - DNA, 103 bp, Artificial Sequence
  Synthetic Polynucleotide
taatacgactcactatagggttatactcgatttaggaaaaatcacatctaaacagaggagatagatgatgtttttcctaaacctggcggcagcgcaaaagatg

SEQ ID NO: 54882 - DNA, 103 bp, Artificial Sequence
  Synthetic Polynucleotide
taatacgactcactatagggtctactgcgggatataaaaccgatattctcaacagaggagagagaatatgggttttataaacctggcggcagcgcaaaagatg

SEQ ID NO: 54883 - DNA, 103 bp, Artificial Sequence
  Synthetic Polynucleotide
taatacgactcactatagggagacgtctactgcgggatataaaaccgataaacagaggagatatcggatgtatatcccgaacctggcggcagcgcaaaagatg

SEQ ID NO: 54884 - DNA, 103 bp, Artificial Sequence
  Synthetic Polynucleotide
taatacgactcactatagggcgaatagacgtctactgcgggatataaaacaacagaggagagttttaatgcccgcagtaaacctggcggcagcgcaaaagatg

SEQ ID NO: 54885 - DNA, 103 bp, Artificial Sequence
  Synthetic Polynucleotide
taatacgactcactatagggatgggcgaatagacgtctactgcgggatataacagaggagaatatccatgagtagacgtaacctggcggcagcgcaaaagatg

SEQ ID NO: 54886 - DNA, 103 bp, Artificial Sequence
  Synthetic Polynucleotide
taatacgactcactataggggatctatgggcgaatagacgtctactgcggaacagaggagaccgcagatgacgtctattaacctggcggcagcgcaaaagatg

SEQ ID NO: 54887 - DNA, 103 bp, Artificial Sequence
  Synthetic Polynucleotide
taatacgactcactatagggccttagatctatgggcgaatagacgtctacaacagaggagagtagacatgtattcgcccaacctggcggcagcgcaaaagatg

SEQ ID NO: 54888 - DNA, 103 bp, Artificial Sequence
  Synthetic Polynucleotide
taatacgactcactatagggatcatccttagatctatgggcgaatagacgaacagaggagacgtctaatggcccatagaaacctggcggcagcgcaaaagatg

SEQ ID NO: 54889 - DNA, 103 bp, Artificial Sequence
  Synthetic Polynucleotide
taatacgactcactatagggctctcatcatccttagatctatgggcgaataacagaggagaattcgcatgtagatctaaaacctggcggcagcgcaaaagatg

SEQ ID NO: 54890 - DNA, 103 bp, Artificial Sequence
  Synthetic Polynucleotide
taatacgactcactataggggttttctctcatcatccttagatctatgggaacagaggagacccataatgctaaggatgaacctggcggcagcgcaaaagatg

SEQ ID NO: 54891 - DNA, 103 bp, Artificial Sequence
  Synthetic Polynucleotide
taatacgactcactatagggtgctagttttctctcatcatccttagatctaacagaggagaagatctatggatgatgagaacctggcggcagcgcaaaagatg

SEQ ID NO: 54892 - DNA, 103 bp, Artificial Sequence
  Synthetic Polynucleotide
taatacgactcactataggggagttttatactcgatttaggaaaaatcacaacagaggagagtgattatgcctaaatcgaacctggcggcagcgcaaaagatg

SEQ ID NO: 54893 - DNA, 103 bp, Artificial Sequence
  Synthetic Polynucleotide
taatacgactcactatagggcgtagtgctagttttctctcatcatccttaaacagaggagataaggaatgtgagagaaaaacctggcggcagcgcaaaagatg

SEQ ID NO: 54894 - DNA, 103 bp, Artificial Sequence
  Synthetic Polynucleotide
taatacgactcactatagggagaatcgtagtgctagttttctctcatcataacagaggagaatgatgatggaaaactagaacctggcggcagcgcaaaagatg

SEQ ID NO: 54895 - DNA, 103 bp, Artificial Sequence
  Synthetic Polynucleotide
taatacgactcactatagggtaaaaagaatcgtagtgctagttttctctcaacagaggagagagagaatgctagcactaaacctggcggcagcgcaaaagatg

SEQ ID NO: 54896 - DNA, 103 bp, Artificial Sequence
  Synthetic Polynucleotide
taatacgactcactatagggctttgtaaaaagaatcgtagtgctagttttaacagaggagaaaaactatgactacgattaacctggcggcagcgcaaaagatg

SEQ ID NO: 54897 - DNA, 103 bp, Artificial Sequence
  Synthetic Polynucleotide
taatacgactcactatagggaaagtctttgtaaaaagaatcgtagtgctaaacagaggagatagcacatggattcttttaacctggcggcagcgcaaaagatg

SEQ ID NO: 54898 - DNA, 103 bp, Artificial Sequence
  Synthetic Polynucleotide
taatacgactcactatagggaaaataaagtctttgtaaaaagaatcgtagaacagaggagactacgaatgtttttacaaaacctggcggcagcgcaaaagatg

SEQ ID NO: 54899 - DNA, 103 bp, Artificial Sequence
  Synthetic Polynucleotide
taatacgactcactatagggtctaaaaaataaagtctttgtaaaaagaataacagaggagaattcttatgacaaagactaacctggcggcagcgcaaaagatg

SEQ ID NO: 54900 - DNA, 103 bp, Artificial Sequence
  Synthetic Polynucleotide
taatacgactcactatagggtatgatctaaaaaataaagtctttgtaaaaaacagaggagattttacatggactttattaacctggcggcagcgcaaaagatg

SEQ ID NO: 54901 - DNA, 103 bp, Artificial Sequence
  Synthetic Polynucleotide
taatacgactcactatagggctctctatgatctaaaaaataaagtctttgaacagaggagacaaagaatgtattttttaaacctggcggcagcgcaaaagatg

SEQ ID NO: 54902 - DNA, 103 bp, Artificial Sequence
  Synthetic Polynucleotide
taatacgactcactatagggtgaatctctctatgatctaaaaaataaagtaacagaggagaactttaatgtttagatcaaacctggcggcagcgcaaaagatg

SEQ ID NO: 54903 - DNA, 103 bp, Artificial Sequence
  Synthetic Polynucleotide
taatacgactcactatagggttcattcgccctttaccatgaactcattaaaacagaggagattaatgatgtcatggtaaaacctggcggcagcgcaaaagatg

SEQ ID NO: 54904 - DNA, 103 bp, Artificial Sequence
  Synthetic Polynucleotide
taatacgactcactatagggtaaacgagttttatactcgatttaggaaaaaacagaggagattttccatgatcgagtataacctggcggcagcgcaaaagatg

SEQ ID NO: 54905 - DNA, 103 bp, Artificial Sequence
  Synthetic Polynucleotide
taatacgactcactatagggaataatgaatctctctatgatctaaaaaataacagaggagaatttttatgatcatagagaacctggcggcagcgcaaaagatg

SEQ ID NO: 54906 - DNA, 103 bp, Artificial Sequence
  Synthetic Polynucleotide
taatacgactcactataggggaacaaataatgaatctctctatgatctaaaacagaggagattagatatgagagagattaacctggcggcagcgcaaaagatg

SEQ ID NO: 54907 - DNA, 103 bp, Artificial Sequence
  Synthetic Polynucleotide
taatacgactcactatagggcatctgaacaaataatgaatctctctatgaaacagaggagatcatagatggattcattaaacctggcggcagcgcaaaagatg

SEQ ID NO: 54908 - DNA, 103 bp, Artificial Sequence
  Synthetic Polynucleotide
taatacgactcactatagggcaacgcatctgaacaaataatgaatctctcaacagaggagagagagaatgattatttgtaacctggcggcagcgcaaaagatg

SEQ ID NO: 54909 - DNA, 103 bp, Artificial Sequence
  Synthetic Polynucleotide
taatacgactcactatagggagcgtcaacgcatctgaacaaataatgaataacagaggagaattcatatgttgttcagaaacctggcggcagcgcaaaagatg

SEQ ID NO: 54910 - DNA, 103 bp, Artificial Sequence
  Synthetic Polynucleotide
taatacgactcactatagggtttacagcgtcaacgcatctgaacaaataaaacagaggagattatttatgcagatgcgtaacctggcggcagcgcaaaagatg

SEQ ID NO: 54911 - DNA, 103 bp, Artificial Sequence
  Synthetic Polynucleotide
taatacgactcactatagggcgtcttttacagcgtcaacgcatctgaacaaacagaggagatgttcaatggcgttgacgaacctggcggcagcgcaaaagatg

SEQ ID NO: 54912 - DNA, 103 bp, Artificial Sequence
  Synthetic Polynucleotide
taatacgactcactatagggagtgacgtcttttacagcgtcaacgcatctaacagaggagaagatgcatggacgctgtaaacctggcggcagcgcaaaagatg

SEQ ID NO: 54913 - DNA, 103 bp, Artificial Sequence
  Synthetic Polynucleotide
taatacgactcactataggggtaatagtgacgtcttttacagcgtcaacgaacagaggagacgttgaatgtgtaaaagaaacctggcggcagcgcaaaagatg

SEQ ID NO: 54914 - DNA, 103 bp, Artificial Sequence
  Synthetic Polynucleotide
taatacgactcactatagggttttggtaatagtgacgtcttttacagcgtaacagaggagaacgctgatgaagacgtcaaacctggcggcagcgcaaaagatg

SEQ ID NO: 54915 - DNA, 103 bp, Artificial Sequence
  Synthetic Polynucleotide
taatacgactcactataggggctagtaaacgagttttatactcgatttagaacagaggagactaaatatggtataaaacaacctggcggcagcgcaaaagatg

SEQ ID NO: 54916 - DNA, 103 bp, Artificial Sequence
  Synthetic Polynucleotide
taatacgactcactatagggattttttttggtaatagtgacgtcttttacaacagaggagagtaaaaatggtcactattaacctggcggcagcgcaaaagatg

SEQ ID NO: 54917 - DNA, 103 bp, Artificial Sequence
  Synthetic Polynucleotide
taatacgactcactatagggatgttattttttttggtaatagtgacgtctaacagaggagaagacgtatgtattaccaaaacctggcggcagcgcaaaagatg

SEQ ID NO: 54918 - DNA, 103 bp, Artificial Sequence
  Synthetic Polynucleotide
taatacgactcactatagggcaataatgttattttttttggtaatagtgaaacagaggagatcactaatgccaaaaaaaaacctggcggcagcgcaaaagatg

SEQ ID NO: 54919 - DNA, 103 bp, Artificial Sequence
  Synthetic Polynucleotide
taatacgactcactatagggcgccacaataatgttattttttttggtaataacagaggagaattaccatgaaaaataacaacctggcggcagcgcaaaagatg

SEQ ID NO: 54920 - DNA, 103 bp, Artificial Sequence
  Synthetic Polynucleotide
taatacgactcactatagggtaaggcgccacaataatgttattttttttgaacagaggagacaaaaaatgtaacattataacctggcggcagcgcaaaagatg

SEQ ID NO: 54921 - DNA, 103 bp, Artificial Sequence
  Synthetic Polynucleotide
taatacgactcactatagggctatataaggcgccacaataatgttattttaacagaggagaaaaataatgttattgtggaacctggcggcagcgcaaaagatg

SEQ ID NO: 54922 - DNA, 103 bp, Artificial Sequence
  Synthetic Polynucleotide
taatacgactcactatagggaagtgctatataaggcgccacaataatgttaacagaggagaaacattatggtggcgcctaacctggcggcagcgcaaaagatg

SEQ ID NO: 54923 - DNA, 103 bp, Artificial Sequence
  Synthetic Polynucleotide
taatacgactcactataggggttaaaagtgctatataaggcgccacaataaacagaggagatattgtatggccttatataacctggcggcagcgcaaaagatg

SEQ ID NO: 54924 - DNA, 103 bp, Artificial Sequence
  Synthetic Polynucleotide
taatacgactcactatagggcaatagttaaaagtgctatataaggcgccaaacagaggagatggcgcatgatatagcacaacctggcggcagcgcaaaagatg

SEQ ID NO: 54925 - DNA, 103 bp, Artificial Sequence
  Synthetic Polynucleotide
taatacgactcactatagggtgatgcaatagttaaaagtgctatataaggaacagaggagaccttatatggcacttttaaacctggcggcagcgcaaaagatg

SEQ ID NO: 54926 - DNA, 103 bp, Artificial Sequence
  Synthetic Polynucleotide
taatacgactcactatagggtgtttgctagtaaacgagttttatactcgaaacagaggagatcgagtatgaaactcgttaacctggcggcagcgcaaaagatg

SEQ ID NO: 54927 - DNA, 103 bp, Artificial Sequence
  Synthetic Polynucleotide
taatacgactcactatagggccttttgatgcaatagttaaaagtgctataaacagaggagatatagcatgtttaactataacctggcggcagcgcaaaagatg

SEQ ID NO: 54928 - DNA, 103 bp, Artificial Sequence
  Synthetic Polynucleotide
taatacgactcactatagggtgcatccttttgatgcaatagttaaaagtgaacagaggagacactttatgctattgcataacctggcggcagcgcaaaagatg

SEQ ID NO: 54929 - DNA, 103 bp, Artificial Sequence
  Synthetic Polynucleotide
taatacgactcactatagggaagtttgcatccttttgatgcaatagttaaaacagaggagattaactatggcatcaaaaaacctggcggcagcgcaaaagatg

SEQ ID NO: 54930 - DNA, 103 bp, Artificial Sequence
  Synthetic Polynucleotide
taatacgactcactatagggtctgtaagtttgcatccttttgatgcaataaacagaggagatattgcatgaaaaggatgaacctggcggcagcgcaaaagatg

SEQ ID NO: 54931 - DNA, 103 bp, Artificial Sequence
  Synthetic Polynucleotide
taatacgactcactatagggttgtttctgtaagtttgcatccttttgatgaacagaggagacatcaaatggatgcaaacaacctggcggcagcgcaaaagatg

SEQ ID NO: 54932 - DNA, 103 bp, Artificial Sequence
  Synthetic Polynucleotide
taatacgactcactatagggaatcattgtttctgtaagtttgcatcctttaacagaggagaaaaggaatgaaacttacaaacctggcggcagcgcaaaagatg

SEQ ID NO: 54933 - DNA, 103 bp, Artificial Sequence
  Synthetic Polynucleotide
taatacgactcactataggggcttcaatcattgtttctgtaagtttgcataacagaggagaatgcaaatgtacagaaacaacctggcggcagcgcaaaagatg

SEQ ID NO: 54934 - DNA, 103 bp, Artificial Sequence
  Synthetic Polynucleotide
taatacgactcactatagggagaatgcttcaatcattgtttctgtaagttaacagaggagaaacttaatgaaacaatgaaacctggcggcagcgcaaaagatg

SEQ ID NO: 54935 - DNA, 103 bp, Artificial Sequence
  Synthetic Polynucleotide
taatacgactcactatagggtggaaagaatgcttcaatcattgtttctgtaacagaggagaacagaaatgatgattgaaaacctggcggcagcgcaaaagatg

SEQ ID NO: 54936 - DNA, 103 bp, Artificial Sequence
  Synthetic Polynucleotide
taatacgactcactatagggagttctggaaagaatgcttcaatcattgttaacagaggagaaacaatatgtgaagcattaacctggcggcagcgcaaaagatg

SEQ ID NO: 54937 - DNA, 103 bp, Artificial Sequence
  Synthetic Polynucleotide
taatacgactcactataggggaaagtgtttgctagtaaacgagttttataaacagaggagatataaaatgcgtttactaaacctggcggcagcgcaaaagatg

SEQ ID NO: 54938 - DNA, 103 bp, Artificial Sequence
  Synthetic Polynucleotide
taatacgactcactatagggtatatagttctggaaagaatgcttcaatcaaacagaggagatgattgatgcattctttcaacctggcggcagcgcaaaagatg

SEQ ID NO: 54939 - DNA, 103 bp, Artificial Sequence
  Synthetic Polynucleotide
taatacgactcactatagggttcattatatagttctggaaagaatgcttcaacagaggagagaagcaatgtttccagaaaacctggcggcagcgcaaaagatg

SEQ ID NO: 54940 - DNA, 103 bp, Artificial Sequence
  Synthetic Polynucleotide
taatacgactcactatagggctatgttcattatatagttctggaaagaataacagaggagaattcttatgagaactataaacctggcggcagcgcaaaagatg

SEQ ID NO: 54941 - DNA, 103 bp, Artificial Sequence
  Synthetic Polynucleotide
taatacgactcactatagggtcttactatgttcattatatagttctggaaaacagaggagattccagatgtatataatgaacctggcggcagcgcaaaagatg

SEQ ID NO: 54942 - DNA, 103 bp, Artificial Sequence
  Synthetic Polynucleotide
taatacgactcactataggggaatttcttactatgttcattatatagttcaacagaggagagaactaatgaatgaacataacctggcggcagcgcaaaagatg

SEQ ID NO: 54943 - DNA, 103 bp, Artificial Sequence
  Synthetic Polynucleotide
taatacgactcactatagggaatttgaatttcttactatgttcattatataacagaggagaatataaatgacatagtaaaacctggcggcagcgcaaaagatg

SEQ ID NO: 54944 - DNA, 103 bp, Artificial Sequence
  Synthetic Polynucleotide
taatacgactcactatagggagttgaatttgaatttcttactatgttcataacagaggagaatgaacatggtaagaaataacctggcggcagcgcaaaagatg

SEQ ID NO: 54945 - DNA, 103 bp, Artificial Sequence
  Synthetic Polynucleotide
taatacgactcactatagggttgagagttgaatttgaatttcttactatgaacagaggagacatagtatgaaattcaaaaacctggcggcagcgcaaaagatg

SEQ ID NO: 54946 - DNA, 103 bp, Artificial Sequence
  Synthetic Polynucleotide
taatacgactcactataggggatacttgagagttgaatttgaatttcttaaacagaggagataagaaatgcaaattcaaaacctggcggcagcgcaaaagatg

SEQ ID NO: 54947 - DNA, 103 bp, Artificial Sequence
  Synthetic Polynucleotide
taatacgactcactatagggtgatggatacttgagagttgaatttgaattaacagaggagaaattcaatgtcaactctcaacctggcggcagcgcaaaagatg

SEQ ID NO: 54948 - DNA, 103 bp, Artificial Sequence
  Synthetic Polynucleotide
taatacgactcactatagggatcaggaaagtgtttgctagtaaacgagttaacagaggagaaactcgatgactagcaaaaacctggcggcagcgcaaaagatg

SEQ ID NO: 54949 - DNA, 103 bp, Artificial Sequence
  Synthetic Polynucleotide
taatacgactcactatagggttggatgatggatacttgagagttgaatttaacagaggagaaaattcatgtctcaagtaaacctggcggcagcgcaaaagatg

SEQ ID NO: 54950 - DNA, 103 bp, Artificial Sequence
  Synthetic Polynucleotide
taatacgactcactatagggttttcttggatgatggatacttgagagttgaacagaggagacaactcatgagtatccataacctggcggcagcgcaaaagatg

SEQ ID NO: 54951 - DNA, 103 bp, Artificial Sequence
  Synthetic Polynucleotide
taatacgactcactatagggcaagtttttcttggatgatggatacttgagaacagaggagactcaagatgccatcatccaacctggcggcagcgcaaaagatg

SEQ ID NO: 54952 - DNA, 103 bp, Artificial Sequence
  Synthetic Polynucleotide
taatacgactcactatagggatatccaagtttttcttggatgatggatacaacagaggagagtatccatgatccaagaaaacctggcggcagcgcaaaagatg

SEQ ID NO: 54953 - DNA, 103 bp, Artificial Sequence
  Synthetic Polynucleotide
taatacgactcactataggggactgatatccaagtttttcttggatgatgaacagaggagacatcatatgagaaaaactaacctggcggcagcgcaaaagatg

SEQ ID NO: 54954 - DNA, 103 bp, Artificial Sequence
  Synthetic Polynucleotide
taatacgactcactatagggttccagactgatatccaagtttttcttggaaacagaggagatccaagatgaacttggataacctggcggcagcgcaaaagatg

SEQ ID NO: 54955 - DNA, 103 bp, Artificial Sequence
  Synthetic Polynucleotide
taatacgactcactatagggatagtttccagactgatatccaagtttttcaacagaggagagaaaaaatgggatatcagaacctggcggcagcgcaaaagatg

SEQ ID NO: 54956 - DNA, 103 bp, Artificial Sequence
  Synthetic Polynucleotide
taatacgactcactatagggacgtgatagtttccagactgatatccaagtaacagaggagaacttggatgtcagtctggaacctggcggcagcgcaaaagatg

SEQ ID NO: 54957 - DNA, 103 bp, Artificial Sequence
  Synthetic Polynucleotide
taatacgactcactatagggcataaacgtgatagtttccagactgatatcaacagaggagagatatcatgctggaaactaacctggcggcagcgcaaaagatg

SEQ ID NO: 54958 - DNA, 103 bp, Artificial Sequence
  Synthetic Polynucleotide
taatacgactcactatagggaaaatcataaacgtgatagtttccagactgaacagaggagacagtctatgaactatcacaacctggcggcagcgcaaaagatg

SEQ ID NO: 54959 - DNA, 103 bp, Artificial Sequence
  Synthetic Polynucleotide
taatacgactcactatagggaataaatcaggaaagtgtttgctagtaaacaacagaggagagtttacatgcaaacacttaacctggcggcagcgcaaaagatg

SEQ ID NO: 54960 - DNA, 103 bp, Artificial Sequence
  Synthetic Polynucleotide
taatacgactcactatagggggttcaaaatcataaacgtgatagtttccaaacagaggagatggaaaatgtcacgtttaaacctggcggcagcgcaaaagatg

SEQ ID NO: 54961 - DNA, 103 bp, Artificial Sequence
  Synthetic Polynucleotide
taatacgactcactatagggaatacggttcaaaatcataaacgtgatagtaacagaggagaactatcatgtttatgattaacctggcggcagcgcaaaagatg

SEQ ID NO: 54962 - DNA, 103 bp, Artificial Sequence
  Synthetic Polynucleotide
taatacgactcactatagggagagtaatacggttcaaaatcataaacgtgaacagaggagacacgttatggattttgaaaacctggcggcagcgcaaaagatg

SEQ ID NO: 54963 - DNA, 103 bp, Artificial Sequence
  Synthetic Polynucleotide
taatacgactcactatagggactgtagagtaatacggttcaaaatcataaaacagaggagattatgaatgtgaaccgtaaacctggcggcagcgcaaaagatg

SEQ ID NO: 54964 - DNA, 103 bp, Artificial Sequence
  Synthetic Polynucleotide
taatacgactcactatagggaagctactgtagagtaatacggttcaaaataacagaggagaattttgatgcgtattactaacctggcggcagcgcaaaagatg

SEQ ID NO: 54965 - DNA, 103 bp, Artificial Sequence
  Synthetic Polynucleotide
taatacgactcactatagggagccaaagctactgtagagtaatacggttcaacagaggagagaaccgatgtactctacaaacctggcggcagcgcaaaagatg

SEQ ID NO: 54966 - DNA, 103 bp, Artificial Sequence
  Synthetic Polynucleotide
taatacgactcactatagggcgaatagccaaagctactgtagagtaatacaacagaggagagtattaatgtacagtagcaacctggcggcagcgcaaaagatg

SEQ ID NO: 54967 - DNA, 103 bp, Artificial Sequence
  Synthetic Polynucleotide
taatacgactcactatagggcatctcgaatagccaaagctactgtagagtaacagaggagaactctaatgtagctttggaacctggcggcagcgcaaaagatg

SEQ ID NO: 54968 - DNA, 103 bp, Artificial Sequence
  Synthetic Polynucleotide
taatacgactcactatagggatgttcatctcgaatagccaaagctactgtaacagaggagaacagtaatgttggctattaacctggcggcagcgcaaaagatg

SEQ ID NO: 54969 - DNA, 103 bp, Artificial Sequence
  Synthetic Polynucleotide
taatacgactcactataggggatgaatgttcatctcgaatagccaaagctaacagaggagaagctttatgtattcgagaaacctggcggcagcgcaaaagatg

SEQ ID NO: 54970 - DNA, 103 bp, Artificial Sequence
  Synthetic Polynucleotide
taatacgactcactatagggtggtcaataaatcaggaaagtgtttgctagaacagaggagactagcaatgactttcctgaacctggcggcagcgcaaaagatg

SEQ ID NO: 54971 - DNA, 103 bp, Artificial Sequence
  Synthetic Polynucleotide
taatacgactcactatagggtgccagatgaatgttcatctcgaatagccaaacagaggagatggctaatggagatgaacaacctggcggcagcgcaaaagatg

SEQ ID NO: 54972 - DNA, 103 bp, Artificial Sequence
  Synthetic Polynucleotide
taatacgactcactatagggaaaaatgccagatgaatgttcatctcgaataacagaggagaattcgaatggaacattcaaacctggcggcagcgcaaaagatg

SEQ ID NO: 54973 - DNA, 103 bp, Artificial Sequence
  Synthetic Polynucleotide
taatacgactcactatagggatattaaaaatgccagatgaatgttcatctaacagaggagaagatgaatgttcatctggaacctggcggcagcgcaaaagatg

SEQ ID NO: 54974 - DNA, 103 bp, Artificial Sequence
  Synthetic Polynucleotide
taatacgactcactataggggacggatattaaaaatgccagatgaatgttaacagaggagaaacattatgctggcatttaacctggcggcagcgcaaaagatg

SEQ ID NO: 54975 - DNA, 103 bp, Artificial Sequence
  Synthetic Polynucleotide
taatacgactcactatagggctcttgacggatattaaaaatgccagatgaaacagaggagatcatctatgatttttaataacctggcggcagcgcaaaagatg

SEQ ID NO: 54976 - DNA, 103 bp, Artificial Sequence
  Synthetic Polynucleotide
taatacgactcactatagggtaactctcttgacggatattaaaaatgccaaacagaggagatggcatatgtaatatccgaacctggcggcagcgcaaaagatg

SEQ ID NO: 54977 - DNA, 103 bp, Artificial Sequence
  Synthetic Polynucleotide
taatacgactcactatagggccagataactctcttgacggatattaaaaaaacagaggagatttttaatgtccgtcaagaacctggcggcagcgcaaaagatg

SEQ ID NO: 54978 - DNA, 103 bp, Artificial Sequence
  Synthetic Polynucleotide
taatacgactcactatagggacttaccagataactctcttgacggatattaacagaggagaaatatcatgcaagagagtaacctggcggcagcgcaaaagatg

SEQ ID NO: 54979 - DNA, 103 bp, Artificial Sequence
  Synthetic Polynucleotide
taatacgactcactatagggaatgaacttaccagataactctcttgacggaacagaggagaccgtcaatggagttatctaacctggcggcagcgcaaaagatg

SEQ ID NO: 54980 - DNA, 103 bp, Artificial Sequence
  Synthetic Polynucleotide
taatacgactcactatagggcagataatgaacttaccagataactctcttaacagaggagaaagagaatgatctggtaaaacctggcggcagcgcaaaagatg

SEQ ID NO: 54981 - DNA, 103 bp, Artificial Sequence
  Synthetic Polynucleotide
taatacgactcactatagggtgtcttggtcaataaatcaggaaagtgtttaacagaggagaaaacacatgcctgatttaaacctggcggcagcgcaaaagatg

SEQ ID NO: 54982 - DNA, 103 bp, Artificial Sequence
  Synthetic Polynucleotide
taatacgactcactatagggtatttcagataatgaacttaccagataactaacagaggagaagttatatggtaagttcaaacctggcggcagcgcaaaagatg

SEQ ID NO: 54983 - DNA, 103 bp, Artificial Sequence
  Synthetic Polynucleotide
taatacgactcactatagggtatgttatttcagataatgaacttaccagaaacagaggagatctggtatgttcattatcaacctggcggcagcgcaaaagatg

SEQ ID NO: 54984 - DNA, 103 bp, Artificial Sequence
  Synthetic Polynucleotide
taatacgactcactatagggatctatatgttatttcagataatgaacttaaacagaggagataagttatgtatctgaaaaacctggcggcagcgcaaaagatg

SEQ ID NO: 54985 - DNA, 103 bp, Artificial Sequence
  Synthetic Polynucleotide
taatacgactcactatagggataaaatctatatgttatttcagataatgaaacagaggagatcattaatggaaataacaaacctggcggcagcgcaaaagatg

SEQ ID NO: 54986 - DNA, 103 bp, Artificial Sequence
  Synthetic Polynucleotide
taatacgactcactatagggattagataaaatctatatgttatttcagataacagaggagaatctgaatgaacatatagaacctggcggcagcgcaaaagatg

SEQ ID NO: 54987 - DNA, 103 bp, Artificial Sequence
  Synthetic Polynucleotide
taatacgactcactataggggattaattagataaaatctatatgttatttaacagaggagaaaataaatgatagattttaacctggcggcagcgcaaaagatg

SEQ ID NO: 54988 - DNA, 103 bp, Artificial Sequence
  Synthetic Polynucleotide
taatacgactcactatagggttttagattaattagataaaatctatatgtaacagaggagaacatatatgttttatctaaacctggcggcagcgcaaaagatg

SEQ ID NO: 54989 - DNA, 103 bp, Artificial Sequence
  Synthetic Polynucleotide
taatacgactcactatagggtcagattttagattaattagataaaatctaaacagaggagatagattatgtctaattaaaacctggcggcagcgcaaaagatg

SEQ ID NO: 54990 - DNA, 103 bp, Artificial Sequence
  Synthetic Polynucleotide
taatacgactcactatagggcaagatcagattttagattaattagataaaaacagaggagatttatcatgttaatctaaaacctggcggcagcgcaaaagatg

SEQ ID NO: 54991 - DNA, 103 bp, Artificial Sequence
  Synthetic Polynucleotide
taatacgactcactatagggttgaacaagatcagattttagattaattagaacagaggagactaattatgctaaaatctaacctggcggcagcgcaaaagatg

SEQ ID NO: 54992 - DNA, 103 bp, Artificial Sequence
  Synthetic Polynucleotide
taatacgactcactatagggatatgtgtcttggtcaataaatcaggaaagaacagaggagactttccatgtttattgacaacctggcggcagcgcaaaagatg

SEQ ID NO: 54993 - DNA, 103 bp, Artificial Sequence
  Synthetic Polynucleotide
taatacgactcactatagggctccattgaacaagatcagattttagattaaacagaggagataatctatgatctgatctaacctggcggcagcgcaaaagatg

SEQ ID NO: 54994 - DNA, 103 bp, Artificial Sequence
  Synthetic Polynucleotide
taatacgactcactatagggtagcactccattgaacaagatcagattttaaacagaggagataaaatatgatcttgttcaacctggcggcagcgcaaaagatg

SEQ ID NO: 54995 - DNA, 103 bp, Artificial Sequence
  Synthetic Polynucleotide
taatacgactcactatagggcgtactagcactccattgaacaagatcagaaacagaggagatctgatatggttcaatggaacctggcggcagcgcaaaagatg

SEQ ID NO: 54996 - DNA, 103 bp, Artificial Sequence
  Synthetic Polynucleotide
taatacgactcactataggggcgcccgtactagcactccattgaacaagaaacagaggagatcttgtatgatggagtgcaacctggcggcagcgcaaaagatg

SEQ ID NO: 54997 - DNA, 103 bp, Artificial Sequence
  Synthetic Polynucleotide
taatacgactcactatagggttacagcgcccgtactagcactccattgaaaacagaggagattcaatatggtgctagtaaacctggcggcagcgcaaaagatg

SEQ ID NO: 54998 - DNA, 103 bp, Artificial Sequence
  Synthetic Polynucleotide
taatacgactcactatagggattaattacagcgcccgtactagcactccaaacagaggagatggagtatgagtacgggcaacctggcggcagcgcaaaagatg

SEQ ID NO: 54999 - DNA, 103 bp, Artificial Sequence
  Synthetic Polynucleotide
taatacgactcactatagggatttgattaattacagcgcccgtactagcaaacagaggagatgctagatggggcgctgtaacctggcggcagcgcaaaagatg

SEQ ID NO: 55000 - DNA, 103 bp, Artificial Sequence
  Synthetic Polynucleotide
taatacgactcactatagggttaccatttgattaattacagcgcccgtacaacagaggagagtacggatgctgtaattaaacctggcggcagcgcaaaagatg

SEQ ID NO: 55001 - DNA, 103 bp, Artificial Sequence
  Synthetic Polynucleotide
taatacgactcactatagggagtatttaccatttgattaattacagcgccaacagaggagaggcgctatgattaatcaaaacctggcggcagcgcaaaagatg

SEQ ID NO: 55002 - DNA, 103 bp, Artificial Sequence
  Synthetic Polynucleotide
taatacgactcactatagggaatacagtatttaccatttgattaattacaaacagaggagatgtaatatgtcaaatggtaacctggcggcagcgcaaaagatg

SEQ ID NO: 55003 - DNA, 103 bp, Artificial Sequence
  Synthetic Polynucleotide
taatacgactcactatagggaaaccatatgtgtcttggtcaataaatcagaacagaggagactgattatgtgaccaagaaacctggcggcagcgcaaaagatg

SEQ ID NO: 55004 - DNA, 103 bp, Artificial Sequence
  Synthetic Polynucleotide
taatacgactcactatagggtaatcaatacagtatttaccatttgattaaaacagaggagattaatcatgtggtaaataaacctggcggcagcgcaaaagatg

SEQ ID NO: 55005 - DNA, 103 bp, Artificial Sequence
  Synthetic Polynucleotide
taatacgactcactatagggcactgtaatcaatacagtatttaccatttgaacagaggagacaaatgatgaatactgtaaacctggcggcagcgcaaaagatg

SEQ ID NO: 55006 - DNA, 103 bp, Artificial Sequence
  Synthetic Polynucleotide
taatacgactcactatagggtcatacactgtaatcaatacagtatttaccaacagaggagaggtaaaatgtgtattgataacctggcggcagcgcaaaagatg

SEQ ID NO: 55007 - DNA, 103 bp, Artificial Sequence
  Synthetic Polynucleotide
taatacgactcactatagggacttttcatacactgtaatcaatacagtataacagaggagaatactgatgtgattacagaacctggcggcagcgcaaaagatg

SEQ ID NO: 55008 - DNA, 103 bp, Artificial Sequence
  Synthetic Polynucleotide
taatacgactcactatagggttgtaacttttcatacactgtaatcaatacaacagaggagagtattgatgacagtgtataacctggcggcagcgcaaaagatg

SEQ ID NO: 55009 - DNA, 103 bp, Artificial Sequence
  Synthetic Polynucleotide
taatacgactcactatagggaccagttgtaacttttcatacactgtaatcaacagaggagagattacatggtatgaaaaaacctggcggcagcgcaaaagatg

SEQ ID NO: 55010 - DNA, 103 bp, Artificial Sequence
  Synthetic Polynucleotide
taatacgactcactatagggctatgaccagttgtaacttttcatacactgaacagaggagacagtgtatgaaaagttacaacctggcggcagcgcaaaagatg

SEQ ID NO: 55011 - DNA, 103 bp, Artificial Sequence
  Synthetic Polynucleotide
taatacgactcactatagggattttctatgaccagttgtaacttttcataaacagaggagatatgaaatgttacaactgaacctggcggcagcgcaaaagatg

SEQ ID NO: 55012 - DNA, 103 bp, Artificial Sequence
  Synthetic Polynucleotide
taatacgactcactataggggaatcattttctatgaccagttgtaactttaacagaggagaaaagttatgactggtcataacctggcggcagcgcaaaagatg

SEQ ID NO: 55013 - DNA, 103 bp, Artificial Sequence
  Synthetic Polynucleotide
taatacgactcactatagggattgtgaatcattttctatgaccagttgtaaacagaggagatacaacatgtcatagaaaaacctggcggcagcgcaaaagatg

SEQ ID NO: 55014 - DNA, 103 bp, Artificial Sequence
  Synthetic Polynucleotide
taatacgactcactatagggaggcattcattcgccctttaccatgaactcaacagaggagagagttcatggtaaagggcaacctggcggcagcgcaaaagatg

SEQ ID NO: 55015 - DNA, 103 bp, Artificial Sequence
  Synthetic Polynucleotide
taatacgactcactatagggcttagaaaccatatgtgtcttggtcaataaaacagaggagattattgatgaagacacataacctggcggcagcgcaaaagatg

SEQ ID NO: 55016 - DNA, 103 bp, Artificial Sequence
  Synthetic Polynucleotide
taatacgactcactatagggtataaattgtgaatcattttctatgaccagaacagaggagactggtcatggaaaatgataacctggcggcagcgcaaaagatg

SEQ ID NO: 55017 - DNA, 103 bp, Artificial Sequence
  Synthetic Polynucleotide
taatacgactcactataggggaacatataaattgtgaatcattttctatgaacagaggagacatagaatgtgattcacaaacctggcggcagcgcaaaagatg

SEQ ID NO: 55018 - DNA, 103 bp, Artificial Sequence
  Synthetic Polynucleotide
taatacgactcactatagggccaatgaacatataaattgtgaatcattttaacagaggagaaaaatgatgcacaatttaaacctggcggcagcgcaaaagatg

SEQ ID NO: 55019 - DNA, 103 bp, Artificial Sequence
  Synthetic Polynucleotide
taatacgactcactatagggcacagccaatgaacatataaattgtgaatcaacagaggagagattcaatgtttatatgtaacctggcggcagcgcaaaagatg

SEQ ID NO: 55020 - DNA, 103 bp, Artificial Sequence
  Synthetic Polynucleotide
taatacgactcactataggggattccacagccaatgaacatataaattgtaacagaggagaacaattatgatgttcattaacctggcggcagcgcaaaagatg

SEQ ID NO: 55021 - DNA, 103 bp, Artificial Sequence
  Synthetic Polynucleotide
taatacgactcactataggggttctgattccacagccaatgaacatataaaacagaggagattatatatgcattggctgaacctggcggcagcgcaaaagatg

SEQ ID NO: 55022 - DNA, 103 bp, Artificial Sequence
  Synthetic Polynucleotide
taatacgactcactatagggtggaagttctgattccacagccaatgaacaaacagaggagatgttcaatggctgtggaaaacctggcggcagcgcaaaagatg

SEQ ID NO: 55023 - DNA, 103 bp, Artificial Sequence
  Synthetic Polynucleotide
taatacgactcactatagggtttattggaagttctgattccacagccaataacagaggagaattggcatgggaatcagaaacctggcggcagcgcaaaagatg

SEQ ID NO: 55024 - DNA, 103 bp, Artificial Sequence
  Synthetic Polynucleotide
taatacgactcactataggggtaattttattggaagttctgattccacagaacagaggagactgtggatgcagaacttcaacctggcggcagcgcaaaagatg

SEQ ID NO: 55025 - DNA, 103 bp, Artificial Sequence
  Synthetic Polynucleotide
taatacgactcactatagggtttaagtaattttattggaagttctgattcaacagaggagagaatcaatgcttccaataaacctggcggcagcgcaaaagatg

SEQ ID NO: 55026 - DNA, 103 bp, Artificial Sequence
  Synthetic Polynucleotide
taatacgactcactatagggatagacttagaaaccatatgtgtcttggtcaacagaggagagaccaaatgacatatggtaacctggcggcagcgcaaaagatg

SEQ ID NO: 55027 - DNA, 103 bp, Artificial Sequence
  Synthetic Polynucleotide
taatacgactcactatagggctatctttaagtaattttattggaagttctaacagaggagaagaactatgaataaaattaacctggcggcagcgcaaaagatg

SEQ ID NO: 55028 - DNA, 103 bp, Artificial Sequence
  Synthetic Polynucleotide
taatacgactcactatagggcatttctatctttaagtaattttattggaaaacagaggagattccaaatgaattacttaaacctggcggcagcgcaaaagatg

SEQ ID NO: 55029 - DNA, 103 bp, Artificial Sequence
  Synthetic Polynucleotide
taatacgactcactatagggtaattcatttctatctttaagtaattttataacagaggagaataaaaatgcttaaagataacctggcggcagcgcaaaagatg

SEQ ID NO: 55030 - DNA, 103 bp, Artificial Sequence
  Synthetic Polynucleotide
taatacgactcactataggggtaaataattcatttctatctttaagtaataacagaggagaattactatgagatagaaaaacctggcggcagcgcaaaagatg

SEQ ID NO: 55031 - DNA, 103 bp, Artificial Sequence
  Synthetic Polynucleotide
taatacgactcactatagggattttgtaaataattcatttctatctttaaaacagaggagattaaagatggaaatgaataacctggcggcagcgcaaaagatg

SEQ ID NO: 55032 - DNA, 103 bp, Artificial Sequence
  Synthetic Polynucleotide
taatacgactcactataggggatgaattttgtaaataattcatttctatcaacagaggagagatagaatggaattatttaacctggcggcagcgcaaaagatg

SEQ ID NO: 55033 - DNA, 103 bp, Artificial Sequence
  Synthetic Polynucleotide
taatacgactcactatagggtcgttgatgaattttgtaaataattcatttaacagaggagaaaatgaatgatttacaaaaacctggcggcagcgcaaaagatg

SEQ ID NO: 55034 - DNA, 103 bp, Artificial Sequence
  Synthetic Polynucleotide
taatacgactcactatagggttaactcgttgatgaattttgtaaataattaacagaggagaaattatatgcaaaattcaaacctggcggcagcgcaaaagatg

SEQ ID NO: 55035 - DNA, 103 bp, Artificial Sequence
  Synthetic Polynucleotide
taatacgactcactatagggcttttttaactcgttgatgaattttgtaaaaacagaggagatttacaatgttcatcaacaacctggcggcagcgcaaaagatg

SEQ ID NO: 55036 - DNA, 103 bp, Artificial Sequence
  Synthetic Polynucleotide
taatacgactcactatagggctggtcttttttaactcgttgatgaattttaacagaggagaaaaattatgcaacgagttaacctggcggcagcgcaaaagatg

SEQ ID NO: 55037 - DNA, 103 bp, Artificial Sequence
  Synthetic Polynucleotide
taatacgactcactatagggacttgatagacttagaaaccatatgtgtctaacagaggagaagacacatgtggtttctaaacctggcggcagcgcaaaagatg

SEQ ID NO: 55038 - DNA, 103 bp, Artificial Sequence
  Synthetic Polynucleotide
taatacgactcactatagggatgaactggtcttttttaactcgttgatgaaacagaggagatcatcaatgagttaaaaaaacctggcggcagcgcaaaagatg

SEQ ID NO: 55039 - DNA, 103 bp, Artificial Sequence
  Synthetic Polynucleotide
taatacgactcactatagggcttgaatgaactggtcttttttaactcgttaacagaggagaaacgagatgaaaaagaccaacctggcggcagcgcaaaagatg

SEQ ID NO: 55040 - DNA, 103 bp, Artificial Sequence
  Synthetic Polynucleotide
taatacgactcactatagggcttatcttgaatgaactggtcttttttaacaacagaggagagttaaaatggaccagttcaacctggcggcagcgcaaaagatg

SEQ ID NO: 55041 - DNA, 103 bp, Artificial Sequence
  Synthetic Polynucleotide
taatacgactcactataggggtttgcttatcttgaatgaactggtcttttaacagaggagaaaaagaatggttcattcaaacctggcggcagcgcaaaagatg

SEQ ID NO: 55042 - DNA, 103 bp, Artificial Sequence
  Synthetic Polynucleotide
taatacgactcactatagggatcacgtttgcttatcttgaatgaactggtaacagaggagaaccagtatgttcaagataaacctggcggcagcgcaaaagatg

SEQ ID NO: 55043 - DNA, 103 bp, Artificial Sequence
  Synthetic Polynucleotide
taatacgactcactatagggtccttatcacgtttgcttatcttgaatgaaaacagaggagattcattatggataagcaaaacctggcggcagcgcaaaagatg

SEQ ID NO: 55044 - DNA, 103 bp, Artificial Sequence
  Synthetic Polynucleotide
taatacgactcactatagggacgtatccttatcacgtttgcttatcttgaaacagaggagatcaagaatggcaaacgtgaacctggcggcagcgcaaaagatg

SEQ ID NO: 55045 - DNA, 103 bp, Artificial Sequence
  Synthetic Polynucleotide
taatacgactcactatagggtagtaacgtatccttatcacgtttgcttataacagaggagaataagcatgcgtgataagaacctggcggcagcgcaaaagatg

SEQ ID NO: 55046 - DNA, 103 bp, Artificial Sequence
  Synthetic Polynucleotide
taatacgactcactatagggtattttagtaacgtatccttatcacgtttgaacagaggagacaaacgatgtaaggatacaacctggcggcagcgcaaaagatg

SEQ ID NO: 55047 - DNA, 103 bp, Artificial Sequence
  Synthetic Polynucleotide
taatacgactcactatagggtaaaatattttagtaacgtatccttatcacaacagaggagagtgataatgatacgttacaacctggcggcagcgcaaaagatg

SEQ ID NO: 55048 - DNA, 103 bp, Artificial Sequence
  Synthetic Polynucleotide
taatacgactcactatagggccaccacttgatagacttagaaaccatatgaacagaggagacatatgatgtctaagtctaacctggcggcagcgcaaaagatg

SEQ ID NO: 55049 - DNA, 103 bp, Artificial Sequence
  Synthetic Polynucleotide
taatacgactcactatagggctaagtaaaatattttagtaacgtatccttaacagaggagaaaggatatgttactaaaaaacctggcggcagcgcaaaagatg

SEQ ID NO: 55050 - DNA, 103 bp, Artificial Sequence
  Synthetic Polynucleotide
taatacgactcactatagggaactcctaagtaaaatattttagtaacgtaaacagaggagatacgttatgaaaatatttaacctggcggcagcgcaaaagatg

SEQ ID NO: 55051 - DNA, 103 bp, Artificial Sequence
  Synthetic Polynucleotide
taatacgactcactatagggattctaactcctaagtaaaatattttagtaaacagaggagatactaaatgattttacttaacctggcggcagcgcaaaagatg

SEQ ID NO: 55052 - DNA, 103 bp, Artificial Sequence
  Synthetic Polynucleotide
taatacgactcactatagggtataaattctaactcctaagtaaaatatttaacagaggagaaaatatatgacttaggagaacctggcggcagcgcaaaagatg

SEQ ID NO: 55053 - DNA, 103 bp, Artificial Sequence
  Synthetic Polynucleotide
taatacgactcactatagggtcgtctataaattctaactcctaagtaaaaaacagaggagattttacatgggagttagaaacctggcggcagcgcaaaagatg

SEQ ID NO: 55054 - DNA, 103 bp, Artificial Sequence
  Synthetic Polynucleotide
taatacgactcactatagggatgagtcgtctataaattctaactcctaagaacagaggagacttaggatgtagaatttaaacctggcggcagcgcaaaagatg

SEQ ID NO: 55055 - DNA, 103 bp, Artificial Sequence
  Synthetic Polynucleotide
taatacgactcactatagggactaaatgagtcgtctataaattctaactcaacagaggagagagttaatgtttatagacaacctggcggcagcgcaaaagatg

SEQ ID NO: 55056 - DNA, 103 bp, Artificial Sequence
  Synthetic Polynucleotide
taatacgactcactatagggaataaactaaatgagtcgtctataaattctaacagaggagaagaattatgagacgactcaacctggcggcagcgcaaaagatg

SEQ ID NO: 55057 - DNA, 103 bp, Artificial Sequence
  Synthetic Polynucleotide
taatacgactcactatagggatagtaataaactaaatgagtcgtctataaaacagaggagattatagatgactcatttaaacctggcggcagcgcaaaagatg

SEQ ID NO: 55058 - DNA, 103 bp, Artificial Sequence
  Synthetic Polynucleotide
taatacgactcactatagggtagtaatagtaataaactaaatgagtcgtcaacagaggagagacgacatgtttagtttaaacctggcggcagcgcaaaagatg

SEQ ID NO: 55059 - DNA, 103 bp, Artificial Sequence
  Synthetic Polynucleotide
taatacgactcactataggggatccccaccacttgatagacttagaaaccaacagaggagaggtttcatggtctatcaaaacctggcggcagcgcaaaagatg

SEQ ID NO: 55060 - DNA, 103 bp, Artificial Sequence
  Synthetic Polynucleotide
taatacgactcactatagggaatgctagtaatagtaataaactaaatgagaacagaggagactcattatgtttattactaacctggcggcagcgcaaaagatg

SEQ ID NO: 55061 - DNA, 103 bp, Artificial Sequence
  Synthetic Polynucleotide
taatacgactcactatagggccaataatgctagtaatagtaataaactaaaacagaggagattagttatgtactattacaacctggcggcagcgcaaaagatg

SEQ ID NO: 55062 - DNA, 103 bp, Artificial Sequence
  Synthetic Polynucleotide
taatacgactcactataggggaataccaataatgctagtaatagtaataaaacagaggagattattaatgttactagcaaacctggcggcagcgcaaaagatg

SEQ ID NO: 55063 - DNA, 103 bp, Artificial Sequence
  Synthetic Polynucleotide
taatacgactcactatagggaagaagaataccaataatgctagtaatagtaacagaggagaactattatgagcattattaacctggcggcagcgcaaaagatg

SEQ ID NO: 55064 - DNA, 103 bp, Artificial Sequence
  Synthetic Polynucleotide
taatacgactcactatagggatgacaagaagaataccaataatgctagtaaacagaggagatactagatgtattggtataacctggcggcagcgcaaaagatg

SEQ ID NO: 55065 - DNA, 103 bp, Artificial Sequence
  Synthetic Polynucleotide
taatacgactcactatagggacaagatgacaagaagaataccaataatgcaacagaggagagcattaatggtattcttcaacctggcggcagcgcaaaagatg

SEQ ID NO: 55066 - DNA, 103 bp, Artificial Sequence
  Synthetic Polynucleotide
taatacgactcactatagggtctgaacaagatgacaagaagaataccaataacagaggagaattggtatgcttcttgtcaacctggcggcagcgcaaaagatg

SEQ ID NO: 55067 - DNA, 103 bp, Artificial Sequence
  Synthetic Polynucleotide
taatacgactcactatagggatatttctgaacaagatgacaagaagaataaacagaggagatattctatgtgtcatcttaacctggcggcagcgcaaaagatg

SEQ ID NO: 55068 - DNA, 103 bp, Artificial Sequence
  Synthetic Polynucleotide
taatacgactcactataggggttatatatttctgaacaagatgacaagaaaacagaggagattcttgatgtcttgttcaaacctggcggcagcgcaaaagatg

SEQ ID NO: 55069 - DNA, 103 bp, Artificial Sequence
  Synthetic Polynucleotide
taatacgactcactataggggcattgttatatatttctgaacaagatgacaacagaggagagtcatcatgttcagaaataacctggcggcagcgcaaaagatg

SEQ ID NO: 55070 - DNA, 103 bp, Artificial Sequence
  Synthetic Polynucleotide
taatacgactcactatagggctatggatccccaccacttgatagacttagaacagaggagactaagtatgtcaagtggtaacctggcggcagcgcaaaagatg

SEQ ID NO: 55071 - DNA, 103 bp, Artificial Sequence
  Synthetic Polynucleotide
taatacgactcactataggggtatagcattgttatatatttctgaacaagaacagaggagacttgttatgaaatatataaacctggcggcagcgcaaaagatg

SEQ ID NO: 55072 - DNA, 103 bp, Artificial Sequence
  Synthetic Polynucleotide
taatacgactcactatagggattaggtatagcattgttatatatttctgaaacagaggagatcagaaatgtataacaataacctggcggcagcgcaaaagatg

SEQ ID NO: 55073 - DNA, 103 bp, Artificial Sequence
  Synthetic Polynucleotide
taatacgactcactatagggttagtattaggtatagcattgttatatattaacagaggagaaatataatgcaatgctataacctggcggcagcgcaaaagatg

SEQ ID NO: 55074 - DNA, 103 bp, Artificial Sequence
  Synthetic Polynucleotide
taatacgactcactatagggtgtatttagtattaggtatagcattgttataacagaggagaataacaatgctatacctaaacctggcggcagcgcaaaagatg

SEQ ID NO: 55075 - DNA, 103 bp, Artificial Sequence
  Synthetic Polynucleotide
taatacgactcactataggggataatgtatttagtattaggtatagcattaacagaggagaaatgctatgcctaatactaacctggcggcagcgcaaaagatg

SEQ ID NO: 55076 - DNA, 103 bp, Artificial Sequence
  Synthetic Polynucleotide
taatacgactcactatagggagcatgataatgtatttagtattaggtataaacagaggagatataccatgtactaaataaacctggcggcagcgcaaaagatg

SEQ ID NO: 55077 - DNA, 103 bp, Artificial Sequence
  Synthetic Polynucleotide
taatacgactcactatagggttgcaagcatgataatgtatttagtattagaacagaggagactaataatgaatacattaaacctggcggcagcgcaaaagatg

SEQ ID NO: 55078 - DNA, 103 bp, Artificial Sequence
  Synthetic Polynucleotide
taatacgactcactatagggagccattgcaagcatgataatgtatttagtaacagaggagaactaaaatgattatcatgaacctggcggcagcgcaaaagatg

SEQ ID NO: 55079 - DNA, 103 bp, Artificial Sequence
  Synthetic Polynucleotide
taatacgactcactataggggttagagccattgcaagcatgataatgtataacagaggagaatacatatgcatgcttgcaacctggcggcagcgcaaaagatg

SEQ ID NO: 55080 - DNA, 103 bp, Artificial Sequence
  Synthetic Polynucleotide
taatacgactcactatagggtcgttgttagagccattgcaagcatgataaaacagaggagattatcaatgttgcaatggaacctggcggcagcgcaaaagatg

SEQ ID NO: 55081 - DNA, 103 bp, Artificial Sequence
  Synthetic Polynucleotide
taatacgactcactatagggcataactatggatccccaccacttgatagaaacagaggagatctatcatgtggtggggaaacctggcggcagcgcaaaagatg

SEQ ID NO: 55082 - DNA, 103 bp, Artificial Sequence
  Synthetic Polynucleotide
taatacgactcactataggggttcgtcgttgttagagccattgcaagcataacagaggagaatgcttatgatggctctaaacctggcggcagcgcaaaagatg

SEQ ID NO: 55083 - DNA, 103 bp, Artificial Sequence
  Synthetic Polynucleotide
taatacgactcactatagggttttggttcgtcgttgttagagccattgcaaacagaggagatgcaatatgtctaacaacaacctggcggcagcgcaaaagatg

SEQ ID NO: 55084 - DNA, 103 bp, Artificial Sequence
  Synthetic Polynucleotide
taatacgactcactatagggattcattttggttcgtcgttgttagagccaaacagaggagatggctcatgcaacgacgaaacctggcggcagcgcaaaagatg

SEQ ID NO: 55085 - DNA, 103 bp, Artificial Sequence
  Synthetic Polynucleotide
taatacgactcactatagggaccaaattcattttggttcgtcgttgttagaacagaggagactaacaatgacgaaccaaaacctggcggcagcgcaaaagatg

SEQ ID NO: 55086 - DNA, 103 bp, Artificial Sequence
  Synthetic Polynucleotide
taatacgactcactatagggctacgaccaaattcattttggttcgtcgttaacagaggagaaacgacatgccaaaatgaaacctggcggcagcgcaaaagatg

SEQ ID NO: 55087 - DNA, 103 bp, Artificial Sequence
  Synthetic Polynucleotide
taatacgactcactatagggaaaagctacgaccaaattcattttggttcgaacagaggagacgaaccatgatgaatttgaacctggcggcagcgcaaaagatg

SEQ ID NO: 55088 - DNA, 103 bp, Artificial Sequence
  Synthetic Polynucleotide
taatacgactcactatagggtgaacaaaagctacgaccaaattcattttgaacagaggagacaaaatatgtttggtcgtaacctggcggcagcgcaaaagatg

SEQ ID NO: 55089 - DNA, 103 bp, Artificial Sequence
  Synthetic Polynucleotide
taatacgactcactatagggttttgtgaacaaaagctacgaccaaattcaaacagaggagatgaattatgtcgtagcttaacctggcggcagcgcaaaagatg

SEQ ID NO: 55090 - DNA, 103 bp, Artificial Sequence
  Synthetic Polynucleotide
taatacgactcactatagggtgtatttttgtgaacaaaagctacgaccaaaacagaggagattggtcatggcttttgttaacctggcggcagcgcaaaagatg

SEQ ID NO: 55091 - DNA, 103 bp, Artificial Sequence
  Synthetic Polynucleotide
taatacgactcactatagggctttatgtatttttgtgaacaaaagctacgaacagaggagacgtagcatgtgttcacaaaacctggcggcagcgcaaaagatg

SEQ ID NO: 55092 - DNA, 103 bp, Artificial Sequence
  Synthetic Polynucleotide
taatacgactcactatagggtgcgtcataactatggatccccaccacttgaacagaggagacaagtgatggggatccataacctggcggcagcgcaaaagatg

SEQ ID NO: 55093 - DNA, 103 bp, Artificial Sequence
  Synthetic Polynucleotide
taatacgactcactatagggcatttctttatgtatttttgtgaacaaaagaacagaggagacttttgatgacaaaaataaacctggcggcagcgcaaaagatg

SEQ ID NO: 55094 - DNA, 103 bp, Artificial Sequence
  Synthetic Polynucleotide
taatacgactcactataggggtagacatttctttatgtatttttgtgaacaacagaggagagttcacatgaatacataaaacctggcggcagcgcaaaagatg

SEQ ID NO: 55095 - DNA, 103 bp, Artificial Sequence
  Synthetic Polynucleotide
taatacgactcactatagggtttatgtagacatttctttatgtatttttgaacagaggagacaaaaaatgataaagaaaaacctggcggcagcgcaaaagatg

SEQ ID NO: 55096 - DNA, 103 bp, Artificial Sequence
  Synthetic Polynucleotide
taatacgactcactatagggatagatttatgtagacatttctttatgtataacagaggagaatacatatggaaatgtctaacctggcggcagcgcaaaagatg

SEQ ID NO: 55097 - DNA, 103 bp, Artificial Sequence
  Synthetic Polynucleotide
taatacgactcactataggggcgccatagatttatgtagacatttctttaaacagaggagataaagaatggtctacataaacctggcggcagcgcaaaagatg

SEQ ID NO: 55098 - DNA, 103 bp, Artificial Sequence
  Synthetic Polynucleotide
taatacgactcactatagggcaatggcgccatagatttatgtagacatttaacagaggagaaaatgtatgcataaatctaacctggcggcagcgcaaaagatg

SEQ ID NO: 55099 - DNA, 103 bp, Artificial Sequence
  Synthetic Polynucleotide
taatacgactcactataggggatgccaatggcgccatagatttatgtagaaacagaggagatctacaatgatctatggcaacctggcggcagcgcaaaagatg

SEQ ID NO: 55100 - DNA, 103 bp, Artificial Sequence
  Synthetic Polynucleotide
taatacgactcactatagggttcaagatgccaatggcgccatagatttataacagaggagaataaatatgtggcgccataacctggcggcagcgcaaaagatg

SEQ ID NO: 55101 - DNA, 103 bp, Artificial Sequence
  Synthetic Polynucleotide
taatacgactcactataggggctatttcaagatgccaatggcgccatagaaacagaggagatctatgatgccattggcaaacctggcggcagcgcaaaagatg

SEQ ID NO: 55102 - DNA, 103 bp, Artificial Sequence
  Synthetic Polynucleotide
taatacgactcactatagggctggcgctatttcaagatgccaatggcgccaacagaggagaggcgccatgggcatcttgaacctggcggcagcgcaaaagatg

SEQ ID NO: 55103 - DNA, 103 bp, Artificial Sequence
  Synthetic Polynucleotide
taatacgactcactataggggttactgcgtcataactatggatccccaccaacagaggagaggtgggatgccatagttaaacctggcggcagcgcaaaagatg

SEQ ID NO: 55104 - DNA, 103 bp, Artificial Sequence
  Synthetic Polynucleotide
taatacgactcactataggggaggactggcgctatttcaagatgccaatgaacagaggagacattggatgcttgaaataaacctggcggcagcgcaaaagatg

SEQ ID NO: 55105 - DNA, 103 bp, Artificial Sequence
  Synthetic Polynucleotide
taatacgactcactatagggtgtaggaggactggcgctatttcaagatgcaacagaggagagcatctatgaatagcgccaacctggcggcagcgcaaaagatg

SEQ ID NO: 55106 - DNA, 103 bp, Artificial Sequence
  Synthetic Polynucleotide
taatacgactcactatagggaaatctgtaggaggactggcgctatttcaaaacagaggagattgaaaatgcgccagtccaacctggcggcagcgcaaaagatg

SEQ ID NO: 55107 - DNA, 103 bp, Artificial Sequence
  Synthetic Polynucleotide
taatacgactcactatagggtattaaaatctgtaggaggactggcgctataacagaggagaatagcgatggtcctcctaaacctggcggcagcgcaaaagatg

SEQ ID NO: 55108 - DNA, 103 bp, Artificial Sequence
  Synthetic Polynucleotide
taatacgactcactatagggagctatattaaaatctgtaggaggactggcaacagaggagagccagtatgcctacagataacctggcggcagcgcaaaagatg

SEQ ID NO: 55109 - DNA, 103 bp, Artificial Sequence
  Synthetic Polynucleotide
taatacgactcactatagggtatacagctatattaaaatctgtaggaggaaacagaggagatcctccatgagattttaaaacctggcggcagcgcaaaagatg

SEQ ID NO: 55110 - DNA, 103 bp, Artificial Sequence
  Synthetic Polynucleotide
taatacgactcactatagggcatgttatacagctatattaaaatctgtagaacagaggagactacagatgttaatatagaacctggcggcagcgcaaaagatg

SEQ ID NO: 55111 - DNA, 103 bp, Artificial Sequence
  Synthetic Polynucleotide
taatacgactcactatagggaatgtcatgttatacagctatattaaaatcaacagaggagagattttatgatagctgtaaacctggcggcagcgcaaaagatg

SEQ ID NO: 55112 - DNA, 103 bp, Artificial Sequence
  Synthetic Polynucleotide
taatacgactcactataggggaataaatgtcatgttatacagctatattaaacagaggagataatatatgtgtataacaaacctggcggcagcgcaaaagatg

SEQ ID NO: 55113 - DNA, 103 bp, Artificial Sequence
  Synthetic Polynucleotide
taatacgactcactatagggatgatgaataaatgtcatgttatacagctaaacagaggagatagctgatgaacatgacaaacctggcggcagcgcaaaagatg

SEQ ID NO: 55114 - DNA, 103 bp, Artificial Sequence
  Synthetic Polynucleotide
taatacgactcactatagggtctatgttactgcgtcataactatggatccaacagaggagaggatccatggttatgacgaacctggcggcagcgcaaaagatg

SEQ ID NO: 55115 - DNA, 103 bp, Artificial Sequence
  Synthetic Polynucleotide
taatacgactcactatagggttttgatgatgaataaatgtcatgttatacaacagaggagagtataaatggacatttataacctggcggcagcgcaaaagatg

SEQ ID NO: 55116 - DNA, 103 bp, Artificial Sequence
  Synthetic Polynucleotide
taatacgactcactataggggtctcttttgatgatgaataaatgtcatgtaacagaggagaacatgaatgttattcatcaacctggcggcagcgcaaaagatg

SEQ ID NO: 55117 - DNA, 103 bp, Artificial Sequence
  Synthetic Polynucleotide
taatacgactcactatagggactctgtctcttttgatgatgaataaatgtaacagaggagaacatttatgcatcatcaaaacctggcggcagcgcaaaagatg

SEQ ID NO: 55118 - DNA, 103 bp, Artificial Sequence
  Synthetic Polynucleotide
taatacgactcactatagggtggtgactctgtctcttttgatgatgaataaacagaggagatattcaatgtcaaaagagaacctggcggcagcgcaaaagatg

SEQ ID NO: 55119 - DNA, 103 bp, Artificial Sequence
  Synthetic Polynucleotide
taatacgactcactatagggacagatggtgactctgtctcttttgatgataacagaggagaatcatcatgagagacagaaacctggcggcagcgcaaaagatg

SEQ ID NO: 55120 - DNA, 103 bp, Artificial Sequence
  Synthetic Polynucleotide
taatacgactcactatagggatatgacagatggtgactctgtctcttttgaacagaggagacaaaagatgcagagtcacaacctggcggcagcgcaaaagatg

SEQ ID NO: 55121 - DNA, 103 bp, Artificial Sequence
  Synthetic Polynucleotide
taatacgactcactatagggtctaaatatgacagatggtgactctgtctcaacagaggagagagacaatgtcaccatctaacctggcggcagcgcaaaagatg

SEQ ID NO: 55122 - DNA, 103 bp, Artificial Sequence
  Synthetic Polynucleotide
taatacgactcactatagggaaaaatctaaatatgacagatggtgactctaacagaggagaagagtcatgatctgtcataacctggcggcagcgcaaaagatg

SEQ ID NO: 55123 - DNA, 103 bp, Artificial Sequence
  Synthetic Polynucleotide
taatacgactcactatagggtgaaaaaaaatctaaatatgacagatggtgaacagaggagacaccatatgtcatatttaaacctggcggcagcgcaaaagatg

SEQ ID NO: 55124 - DNA, 103 bp, Artificial Sequence
  Synthetic Polynucleotide
taatacgactcactatagggacacatgaaaaaaaatctaaatatgacagaaacagaggagatctgtcatgtttagatttaacctggcggcagcgcaaaagatg

SEQ ID NO: 55125 - DNA, 103 bp, Artificial Sequence
  Synthetic Polynucleotide
taatacgactcactataggggtgttataacttatcaaaacatatagatagaacagaggagactatctatgtgttttgataacctggcggcagcgcaaaagatg

SEQ ID NO: 55126 - DNA, 103 bp, Artificial Sequence
  Synthetic Polynucleotide
taatacgactcactatagggcaggcaggcattcattcgccctttaccatgaacagaggagacatggtatggggcgaatgaacctggcggcagcgcaaaagatg

SEQ ID NO: 55127 - DNA, 103 bp, Artificial Sequence
  Synthetic Polynucleotide
taatacgactcactatagggaataatctatgttactgcgtcataactatgaacagaggagacatagtatggacgcagtaaacctggcggcagcgcaaaagatg

SEQ ID NO: 55128 - DNA, 103 bp, Artificial Sequence
  Synthetic Polynucleotide
taatacgactcactatagggtttgaacacatgaaaaaaaatctaaatatgaacagaggagacatattatgattttttttaacctggcggcagcgcaaaagatg

SEQ ID NO: 55129 - DNA, 103 bp, Artificial Sequence
  Synthetic Polynucleotide
taatacgactcactataggggatactttgaacacatgaaaaaaaatctaaaacagaggagattagatatgttttcatgtaacctggcggcagcgcaaaagatg

SEQ ID NO: 55130 - DNA, 103 bp, Artificial Sequence
  Synthetic Polynucleotide
taatacgactcactatagggtagaggatactttgaacacatgaaaaaaaaaacagaggagattttttatgatgtgttcaaacctggcggcagcgcaaaagatg

SEQ ID NO: 55131 - DNA, 103 bp, Artificial Sequence
  Synthetic Polynucleotide
taatacgactcactatagggatgagtagaggatactttgaacacatgaaaaacagaggagatttcatatgttcaaagtaaacctggcggcagcgcaaaagatg

SEQ ID NO: 55132 - DNA, 103 bp, Artificial Sequence
  Synthetic Polynucleotide
taatacgactcactatagggatgaaatgagtagaggatactttgaacacaaacagaggagatgtgttatgagtatcctcaacctggcggcagcgcaaaagatg

SEQ ID NO: 55133 - DNA, 103 bp, Artificial Sequence
  Synthetic Polynucleotide
taatacgactcactatagggttataatgaaatgagtagaggatactttgaaacagaggagatcaaagatgcctctactcaacctggcggcagcgcaaaagatg

SEQ ID NO: 55134 - DNA, 103 bp, Artificial Sequence
  Synthetic Polynucleotide
taatacgactcactatagggaactattataatgaaatgagtagaggatacaacagaggagagtatccatgactcatttcaacctggcggcagcgcaaaagatg

SEQ ID NO: 55135 - DNA, 103 bp, Artificial Sequence
  Synthetic Polynucleotide
taatacgactcactatagggtgataaactattataatgaaatgagtagagaacagaggagactctacatgtttcattataacctggcggcagcgcaaaagatg

SEQ ID NO: 55136 - DNA, 103 bp, Artificial Sequence
  Synthetic Polynucleotide
taatacgactcactatagggaagtatgataaactattataatgaaatgagaacagaggagactcattatgttataatagaacctggcggcagcgcaaaagatg

SEQ ID NO: 55137 - DNA, 103 bp, Artificial Sequence
  Synthetic Polynucleotide
taatacgactcactatagggattctaagtatgataaactattataatgaaaacagaggagattcattatgatagtttataacctggcggcagcgcaaaagatg

SEQ ID NO: 55138 - DNA, 103 bp, Artificial Sequence
  Synthetic Polynucleotide
taatacgactcactatagggaaggtaataatctatgttactgcgtcataaaacagaggagattatgaatgagtaacataaacctggcggcagcgcaaaagatg

SEQ ID NO: 55139 - DNA, 103 bp, Artificial Sequence
  Synthetic Polynucleotide
taatacgactcactatagggctaaaattctaagtatgataaactattataaacagaggagatataatatgttatcatacaacctggcggcagcgcaaaagatg

SEQ ID NO: 55140 - DNA, 103 bp, Artificial Sequence
  Synthetic Polynucleotide
taatacgactcactatagggccgtcctaaaattctaagtatgataaactaaacagaggagatagtttatgatacttagaaacctggcggcagcgcaaaagatg

SEQ ID NO: 55141 - DNA, 103 bp, Artificial Sequence
  Synthetic Polynucleotide
taatacgactcactatagggttgatccgtcctaaaattctaagtatgataaacagaggagatatcatatgtagaattttaacctggcggcagcgcaaaagatg

SEQ ID NO: 55142 - DNA, 103 bp, Artificial Sequence
  Synthetic Polynucleotide
taatacgactcactatagggactcattgatccgtcctaaaattctaagtaaacagaggagatacttaatgttttaggacaacctggcggcagcgcaaaagatg

SEQ ID NO: 55143 - DNA, 103 bp, Artificial Sequence
  Synthetic Polynucleotide
taatacgactcactataggggtcttactcattgatccgtcctaaaattctaacagaggagaagaattatgggacggatcaacctggcggcagcgcaaaagatg

SEQ ID NO: 55144 - DNA, 103 bp, Artificial Sequence
  Synthetic Polynucleotide
taatacgactcactataggggtcaagtcttactcattgatccgtcctaaaaacagaggagatttaggatggatcaatgaaacctggcggcagcgcaaaagatg

SEQ ID NO: 55145 - DNA, 103 bp, Artificial Sequence
  Synthetic Polynucleotide
taatacgactcactatagggatttagtcaagtcttactcattgatccgtcaacagaggagagacggaatgatgagtaagaacctggcggcagcgcaaaagatg

SEQ ID NO: 55146 - DNA, 103 bp, Artificial Sequence
  Synthetic Polynucleotide
taatacgactcactatagggtgacgatttagtcaagtcttactcattgataacagaggagaatcaatatgtaagacttgaacctggcggcagcgcaaaagatg

SEQ ID NO: 55147 - DNA, 103 bp, Artificial Sequence
  Synthetic Polynucleotide
taatacgactcactatagggactactgacgatttagtcaagtcttactcaaacagaggagatgagtaatgcttgactaaaacctggcggcagcgcaaaagatg

SEQ ID NO: 55148 - DNA, 103 bp, Artificial Sequence
  Synthetic Polynucleotide
taatacgactcactatagggaaattactactgacgatttagtcaagtcttaacagaggagaaagactatgctaaatcgtaacctggcggcagcgcaaaagatg

SEQ ID NO: 55149 - DNA, 103 bp, Artificial Sequence
  Synthetic Polynucleotide
taatacgactcactatagggtcaagaaggtaataatctatgttactgcgtaacagaggagaacgcagatgcatagattaaacctggcggcagcgcaaaagatg

SEQ ID NO: 55150 - DNA, 103 bp, Artificial Sequence
  Synthetic Polynucleotide
taatacgactcactatagggtgcgcaaattactactgacgatttagtcaaaacagaggagattgactatgtcgtcagtaaacctggcggcagcgcaaaagatg

SEQ ID NO: 55151 - DNA, 103 bp, Artificial Sequence
  Synthetic Polynucleotide
taatacgactcactataggggacgatgcgcaaattactactgacgatttaaacagaggagataaatcatgagtagtaataacctggcggcagcgcaaaagatg

SEQ ID NO: 55152 - DNA, 103 bp, Artificial Sequence
  Synthetic Polynucleotide
taatacgactcactataggggaatagacgatgcgcaaattactactgacgaacagaggagacgtcagatgtaatttgcgaacctggcggcagcgcaaaagatg

SEQ ID NO: 55153 - DNA, 103 bp, Artificial Sequence
  Synthetic Polynucleotide
taatacgactcactatagggatgtagaatagacgatgcgcaaattactacaacagaggagagtagtaatgtgcgcatcgaacctggcggcagcgcaaaagatg

SEQ ID NO: 55154 - DNA, 103 bp, Artificial Sequence
  Synthetic Polynucleotide
taatacgactcactatagggagcggatgtagaatagacgatgcgcaaattaacagaggagaaatttgatgatcgtctataacctggcggcagcgcaaaagatg

SEQ ID NO: 55155 - DNA, 103 bp, Artificial Sequence
  Synthetic Polynucleotide
taatacgactcactataggggacgaagcggatgtagaatagacgatgcgcaacagaggagagcgcatatgctattctacaacctggcggcagcgcaaaagatg

SEQ ID NO: 55156 - DNA, 103 bp, Artificial Sequence
  Synthetic Polynucleotide
taatacgactcactatagggtattcgacgaagcggatgtagaatagacgaaacagaggagatcgtctatgctacatccgaacctggcggcagcgcaaaagatg

SEQ ID NO: 55157 - DNA, 103 bp, Artificial Sequence
  Synthetic Polynucleotide
taatacgactcactatagggtacattattcgacgaagcggatgtagaataaacagaggagatattctatgtccgcttcgaacctggcggcagcgcaaaagatg

SEQ ID NO: 55158 - DNA, 103 bp, Artificial Sequence
  Synthetic Polynucleotide
taatacgactcactatagggtgctatacattattcgacgaagcggatgtaaacagaggagatacatcatgttcgtcgaaaacctggcggcagcgcaaaagatg

SEQ ID NO: 55159 - DNA, 103 bp, Artificial Sequence
  Synthetic Polynucleotide
taatacgactcactatagggagcaatgctatacattattcgacgaagcggaacagaggagaccgcttatgcgaataatgaacctggcggcagcgcaaaagatg

SEQ ID NO: 55160 - DNA, 103 bp, Artificial Sequence
  Synthetic Polynucleotide
taatacgactcactataggggacagtcaagaaggtaataatctatgttacaacagaggagagtaacaatgattattaccaacctggcggcagcgcaaaagatg

SEQ ID NO: 55161 - DNA, 103 bp, Artificial Sequence
  Synthetic Polynucleotide
taatacgactcactatagggctcaaagcaatgctatacattattcgacgaaacagaggagatcgtcgatgaatgtatagaacctggcggcagcgcaaaagatg

SEQ ID NO: 55162 - DNA, 103 bp, Artificial Sequence
  Synthetic Polynucleotide
taatacgactcactatagggagaatctcaaagcaatgctatacattattcaacagaggagagaataaatgatagcattgaacctggcggcagcgcaaaagatg

SEQ ID NO: 55163 - DNA, 103 bp, Artificial Sequence
  Synthetic Polynucleotide
taatacgactcactatagggtatggagaatctcaaagcaatgctatacataacagaggagaatgtatatgattgctttgaacctggcggcagcgcaaaagatg

SEQ ID NO: 55164 - DNA, 103 bp, Artificial Sequence
  Synthetic Polynucleotide
taatacgactcactatagggatagctatggagaatctcaaagcaatgctaaacagaggagatagcatatgtttgagattaacctggcggcagcgcaaaagatg

SEQ ID NO: 55165 - DNA, 103 bp, Artificial Sequence
  Synthetic Polynucleotide
taatacgactcactatagggacttgatagctatggagaatctcaaagcaaaacagaggagattgcttatggattctccaaacctggcggcagcgcaaaagatg

SEQ ID NO: 55166 - DNA, 103 bp, Artificial Sequence
  Synthetic Polynucleotide
taatacgactcactatagggtaaagacttgatagctatggagaatctcaaaacagaggagattgagaatgtccatagctaacctggcggcagcgcaaaagatg

SEQ ID NO: 55167 - DNA, 103 bp, Artificial Sequence
  Synthetic Polynucleotide
taatacgactcactatagggttgtataaagacttgatagctatggagaataacagaggagaattctcatgagctatcaaaacctggcggcagcgcaaaagatg

SEQ ID NO: 55168 - DNA, 103 bp, Artificial Sequence
  Synthetic Polynucleotide
taatacgactcactatagggtgtcattgtataaagacttgatagctatggaacagaggagaccatagatgtcaagtcttaacctggcggcagcgcaaaagatg

SEQ ID NO: 55169 - DNA, 103 bp, Artificial Sequence
  Synthetic Polynucleotide
taatacgactcactatagggttccatgtcattgtataaagacttgatagcaacagaggagagctatcatgtctttatacaacctggcggcagcgcaaaagatg

SEQ ID NO: 55170 - DNA, 103 bp, Artificial Sequence
  Synthetic Polynucleotide
taatacgactcactataggggatatttccatgtcattgtataaagacttgaacagaggagacaagtcatgatacaatgaaacctggcggcagcgcaaaagatg

SEQ ID NO: 55171 - DNA, 103 bp, Artificial Sequence
  Synthetic Polynucleotide
taatacgactcactatagggttagcgacagtcaagaaggtaataatctataacagaggagaatagatatgtaccttcttaacctggcggcagcgcaaaagatg

SEQ ID NO: 55172 - DNA, 103 bp, Artificial Sequence
  Synthetic Polynucleotide
taatacgactcactatagggtcacagatatttccatgtcattgtataaagaacagaggagactttatatgatgacatggaacctggcggcagcgcaaaagatg

SEQ ID NO: 55173 - DNA, 103 bp, Artificial Sequence
  Synthetic Polynucleotide
taatacgactcactatagggagtgttcacagatatttccatgtcattgtaaacagaggagatacaatatgatggaaataaacctggcggcagcgcaaaagatg

SEQ ID NO: 55174 - DNA, 103 bp, Artificial Sequence
  Synthetic Polynucleotide
taatacgactcactatagggtataaagtgttcacagatatttccatgtcaaacagaggagatgacatatgaatatctgtaacctggcggcagcgcaaaagatg

SEQ ID NO: 55175 - DNA, 103 bp, Artificial Sequence
  Synthetic Polynucleotide
taatacgactcactatagggagaagtataaagtgttcacagatatttccaaacagaggagatggaaaatgctgtgaacaaacctggcggcagcgcaaaagatg

SEQ ID NO: 55176 - DNA, 103 bp, Artificial Sequence
  Synthetic Polynucleotide
taatacgactcactataggggttggagaagtataaagtgttcacagatataacagaggagaatatctatgaacactttaaacctggcggcagcgcaaaagatg

SEQ ID NO: 55177 - DNA, 103 bp, Artificial Sequence
  Synthetic Polynucleotide
taatacgactcactatagggtcgatgttggagaagtataaagtgttcacaaacagaggagatgtgaaatgtttatacttaacctggcggcagcgcaaaagatg

SEQ ID NO: 55178 - DNA, 103 bp, Artificial Sequence
  Synthetic Polynucleotide
taatacgactcactatagggaggcatcgatgttggagaagtataaagtgtaacagaggagaacacttatgacttctccaaacctggcggcagcgcaaaagatg

SEQ ID NO: 55179 - DNA, 103 bp, Artificial Sequence
  Synthetic Polynucleotide
taatacgactcactatagggtgttaaggcatcgatgttggagaagtataaaacagaggagattatacatgtccaacatcaacctggcggcagcgcaaaagatg

SEQ ID NO: 55180 - DNA, 103 bp, Artificial Sequence
  Synthetic Polynucleotide
taatacgactcactataggggatgatgttaaggcatcgatgttggagaagaacagaggagacttctcatgcatcgatgcaacctggcggcagcgcaaaagatg

SEQ ID NO: 55181 - DNA, 103 bp, Artificial Sequence
  Synthetic Polynucleotide
taatacgactcactatagggtaggtgatgatgttaaggcatcgatgttggaacagaggagaccaacaatgatgccttaaaacctggcggcagcgcaaaagatg

SEQ ID NO: 55182 - DNA, 103 bp, Artificial Sequence
  Synthetic Polynucleotide
taatacgactcactatagggagatattagcgacagtcaagaaggtaataaaacagaggagattattaatgtcttgactgaacctggcggcagcgcaaaagatg

SEQ ID NO: 55183 - DNA, 103 bp, Artificial Sequence
  Synthetic Polynucleotide
taatacgactcactatagggtaaagtaggtgatgatgttaaggcatcgataacagaggagaatcgatatgttaacatcaaacctggcggcagcgcaaaagatg

SEQ ID NO: 55184 - DNA, 103 bp, Artificial Sequence
  Synthetic Polynucleotide
taatacgactcactatagggaatgctaaagtaggtgatgatgttaaggcaaacagaggagatgccttatgatcatcaccaacctggcggcagcgcaaaagatg

SEQ ID NO: 55185 - DNA, 103 bp, Artificial Sequence
  Synthetic Polynucleotide
taatacgactcactatagggttttcaatgctaaagtaggtgatgatgttaaacagaggagataacatatgcacctacttaacctggcggcagcgcaaaagatg

SEQ ID NO: 55186 - DNA, 103 bp, Artificial Sequence
  Synthetic Polynucleotide
taatacgactcactatagggacgtattttcaatgctaaagtaggtgatgaaacagaggagatcatcaatgactttagcaaacctggcggcagcgcaaaagatg

SEQ ID NO: 55187 - DNA, 103 bp, Artificial Sequence
  Synthetic Polynucleotide
taatacgactcactatagggatagaacgtattttcaatgctaaagtaggtaacagaggagaacctacatgagcattgaaaacctggcggcagcgcaaaagatg

SEQ ID NO: 55188 - DNA, 103 bp, Artificial Sequence
  Synthetic Polynucleotide
taatacgactcactatagggacacaatagaacgtattttcaatgctaaagaacagaggagactttagatgtgaaaatacaacctggcggcagcgcaaaagatg

SEQ ID NO: 55189 - DNA, 103 bp, Artificial Sequence
  Synthetic Polynucleotide
taatacgactcactatagggcatctacacaatagaacgtattttcaatgcaacagaggagagcattgatgatacgttctaacctggcggcagcgcaaaagatg

SEQ ID NO: 55190 - DNA, 103 bp, Artificial Sequence
  Synthetic Polynucleotide
taatacgactcactatagggacatccatctacacaatagaacgtattttcaacagaggagagaaaatatgttctattgtaacctggcggcagcgcaaaagatg

SEQ ID NO: 55191 - DNA, 103 bp, Artificial Sequence
  Synthetic Polynucleotide
taatacgactcactatagggttgctacatccatctacacaatagaacgtaaacagaggagatacgttatgttgtgtagaaacctggcggcagcgcaaaagatg

SEQ ID NO: 55192 - DNA, 103 bp, Artificial Sequence
  Synthetic Polynucleotide
taatacgactcactatagggaaatcttgctacatccatctacacaatagaaacagaggagatctattatgtagatggataacctggcggcagcgcaaaagatg

SEQ ID NO: 55193 - DNA, 103 bp, Artificial Sequence
  Synthetic Polynucleotide
taatacgactcactatagggtatatagatattagcgacagtcaagaaggtaacagaggagaaccttcatgactgtcgctaacctggcggcagcgcaaaagatg

SEQ ID NO: 55194 - DNA, 103 bp, Artificial Sequence
  Synthetic Polynucleotide
taatacgactcactatagggtttaaaaatcttgctacatccatctacacaaacagaggagatgtgtaatgggatgtagcaacctggcggcagcgcaaaagatg

SEQ ID NO: 55195 - DNA, 103 bp, Artificial Sequence
  Synthetic Polynucleotide
taatacgactcactatagggtgttgtttaaaaatcttgctacatccatctaacagaggagaagatggatgtagcaagataacctggcggcagcgcaaaagatg

SEQ ID NO: 55196 - DNA, 103 bp, Artificial Sequence
  Synthetic Polynucleotide
taatacgactcactatagggggcattgttgtttaaaaatcttgctacatcaacagaggagagatgtaatgagatttttaaacctggcggcagcgcaaaagatg

SEQ ID NO: 55197 - DNA, 103 bp, Artificial Sequence
  Synthetic Polynucleotide
taatacgactcactatagggaagatggcattgttgtttaaaaatcttgctaacagaggagaagcaagatgtttaaacaaaacctggcggcagcgcaaaagatg

SEQ ID NO: 55198 - DNA, 103 bp, Artificial Sequence
  Synthetic Polynucleotide
taatacgactcactatagggcatgtaagatggcattgttgtttaaaaatcaacagaggagagattttatgacaacaatgaacctggcggcagcgcaaaagatg

SEQ ID NO: 55199 - DNA, 103 bp, Artificial Sequence
  Synthetic Polynucleotide
taatacgactcactatagggatcatcatgtaagatggcattgttgtttaaaacagaggagattaaacatgaatgccatcaacctggcggcagcgcaaaagatg

SEQ ID NO: 55200 - DNA, 103 bp, Artificial Sequence
  Synthetic Polynucleotide
taatacgactcactatagggaggcaatcatcatgtaagatggcattgttgaacagaggagacaacaaatgcatcttacaaacctggcggcagcgcaaaagatg

SEQ ID NO: 55201 - DNA, 103 bp, Artificial Sequence
  Synthetic Polynucleotide
taatacgactcactatagggacttaaggcaatcatcatgtaagatggcataacagaggagaatgccaatgtacatgatgaacctggcggcagcgcaaaagatg

SEQ ID NO: 55202 - DNA, 103 bp, Artificial Sequence
  Synthetic Polynucleotide
taatacgactcactatagggtggagacttaaggcaatcatcatgtaagataacagaggagaatcttaatggatgattgcaacctggcggcagcgcaaaagatg

SEQ ID NO: 55203 - DNA, 103 bp, Artificial Sequence
  Synthetic Polynucleotide
taatacgactcactatagggaagattggagacttaaggcaatcatcatgtaacagaggagaacatgaatgttgccttaaaacctggcggcagcgcaaaagatg

SEQ ID NO: 55204 - DNA, 103 bp, Artificial Sequence
  Synthetic Polynucleotide
taatacgactcactatagggataaatatatagatattagcgacagtcaagaacagaggagacttgacatgcgctaatataacctggcggcagcgcaaaagatg

SEQ ID NO: 55205 - DNA, 103 bp, Artificial Sequence
  Synthetic Polynucleotide
taatacgactcactatagggaacaaaagattggagacttaaggcaatcataacagaggagaatgattatgttaagtctcaacctggcggcagcgcaaaagatg

SEQ ID NO: 55206 - DNA, 103 bp, Artificial Sequence
  Synthetic Polynucleotide
taatacgactcactatagggttctaaacaaaagattggagacttaaggcaaacagaggagatgccttatgtctccaatcaacctggcggcagcgcaaaagatg

SEQ ID NO: 55207 - DNA, 103 bp, Artificial Sequence
  Synthetic Polynucleotide
taatacgactcactatagggaatcattctaaacaaaagattggagacttaaacagaggagataagtcatgaatcttttgaacctggcggcagcgcaaaagatg

SEQ ID NO: 55208 - DNA, 103 bp, Artificial Sequence
  Synthetic Polynucleotide
taatacgactcactatagggtagctaatcattctaaacaaaagattggagaacagaggagactccaaatgtttgtttagaacctggcggcagcgcaaaagatg

SEQ ID NO: 55209 - DNA, 103 bp, Artificial Sequence
  Synthetic Polynucleotide
taatacgactcactatagggctctgtagctaatcattctaaacaaaagataacagaggagaatctttatgttagaatgaaacctggcggcagcgcaaaagatg

SEQ ID NO: 55210 - DNA, 103 bp, Artificial Sequence
  Synthetic Polynucleotide
taatacgactcactatagggttggactctgtagctaatcattctaaacaaaacagaggagattgtttatgatgattagcaacctggcggcagcgcaaaagatg

SEQ ID NO: 55211 - DNA, 103 bp, Artificial Sequence
  Synthetic Polynucleotide
taatacgactcactatagggaagcgttggactctgtagctaatcattctaaacagaggagatagaatatgtagctacagaacctggcggcagcgcaaaagatg

SEQ ID NO: 55212 - DNA, 103 bp, Artificial Sequence
  Synthetic Polynucleotide
taatacgactcactatagggcagccaagcgttggactctgtagctaatcaaacagaggagatgattaatgacagagtccaacctggcggcagcgcaaaagatg

SEQ ID NO: 55213 - DNA, 103 bp, Artificial Sequence
  Synthetic Polynucleotide
taatacgactcactatagggctagtcagccaagcgttggactctgtagctaacagaggagaagctacatggtccaacgcaacctggcggcagcgcaaaagatg

SEQ ID NO: 55214 - DNA, 103 bp, Artificial Sequence
  Synthetic Polynucleotide
taatacgactcactatagggatatgctagtcagccaagcgttggactctgaacagaggagacagagtatgacgcttggcaacctggcggcagcgcaaaagatg

SEQ ID NO: 55215 - DNA, 103 bp, Artificial Sequence
  Synthetic Polynucleotide
taatacgactcactatagggtaacaataaatatatagatattagcgacagaacagaggagactgtcgatgatatctataaacctggcggcagcgcaaaagatg

SEQ ID NO: 55216 - DNA, 103 bp, Artificial Sequence
  Synthetic Polynucleotide
taatacgactcactatagggtaataatatgctagtcagccaagcgttggaaacagaggagatccaacatgtggctgactaacctggcggcagcgcaaaagatg

SEQ ID NO: 55217 - DNA, 103 bp, Artificial Sequence
  Synthetic Polynucleotide
taatacgactcactatagggaaagataataatatgctagtcagccaagcgaacagaggagacgcttgatggactagcataacctggcggcagcgcaaaagatg

SEQ ID NO: 55218 - DNA, 103 bp, Artificial Sequence
  Synthetic Polynucleotide
taatacgactcactatagggtttctaaagataataatatgctagtcagccaacagaggagaggctgaatggcatattataacctggcggcagcgcaaaagatg

SEQ ID NO: 55219 - DNA, 103 bp, Artificial Sequence
  Synthetic Polynucleotide
taatacgactcactatagggtacaatttctaaagataataatatgctagtaacagaggagaactagcatgttattatctaacctggcggcagcgcaaaagatg

SEQ ID NO: 55220 - DNA, 103 bp, Artificial Sequence
  Synthetic Polynucleotide
taatacgactcactatagggaagaatacaatttctaaagataataatatgaacagaggagacatattatgatctttagaaacctggcggcagcgcaaaagatg

SEQ ID NO: 55221 - DNA, 103 bp, Artificial Sequence
  Synthetic Polynucleotide
taatacgactcactatagggcattgaagaatacaatttctaaagataataaacagaggagatattatatgtagaaattgaacctggcggcagcgcaaaagatg

SEQ ID NO: 55222 - DNA, 103 bp, Artificial Sequence
  Synthetic Polynucleotide
taatacgactcactatagggcgcctcattgaagaatacaatttctaaagaaacagaggagatctttaatgattgtattcaacctggcggcagcgcaaaagatg

SEQ ID NO: 55223 - DNA, 103 bp, Artificial Sequence
  Synthetic Polynucleotide
taatacgactcactatagggataaacgcctcattgaagaatacaatttctaacagaggagaagaaatatgattcttcaaaacctggcggcagcgcaaaagatg

SEQ ID NO: 55224 - DNA, 103 bp, Artificial Sequence
  Synthetic Polynucleotide
taatacgactcactatagggatatgataaacgcctcattgaagaatacaaaacagaggagattgtatatgtcaatgaggaacctggcggcagcgcaaaagatg

SEQ ID NO: 55225 - DNA, 103 bp, Artificial Sequence
  Synthetic Polynucleotide
taatacgactcactatagggtacagatatgataaacgcctcattgaagaaaacagaggagattcttcatggaggcgtttaacctggcggcagcgcaaaagatg

SEQ ID NO: 55226 - DNA, 103 bp, Artificial Sequence
  Synthetic Polynucleotide
taatacgactcactatagggtacgataacaataaatatatagatattagcaacagaggagagctaatatgtatatatttaacctggcggcagcgcaaaagatg

SEQ ID NO: 55227 - DNA, 103 bp, Artificial Sequence
  Synthetic Polynucleotide
taatacgactcactataggggaaattacagatatgataaacgcctcattgaacagaggagacaatgaatggtttatcataacctggcggcagcgcaaaagatg

SEQ ID NO: 55228 - DNA, 103 bp, Artificial Sequence
  Synthetic Polynucleotide
taatacgactcactatagggctaacgaaattacagatatgataaacgcctaacagaggagaaggcgtatgtcatatctgaacctggcggcagcgcaaaagatg

SEQ ID NO: 55229 - DNA, 103 bp, Artificial Sequence
  Synthetic Polynucleotide
taatacgactcactatagggtatgactaacgaaattacagatatgataaaaacagaggagatttatcatgtctgtaattaacctggcggcagcgcaaaagatg

SEQ ID NO: 55230 - DNA, 103 bp, Artificial Sequence
  Synthetic Polynucleotide
taatacgactcactatagggtgtaatatgactaacgaaattacagatatgaacagaggagacatatcatgaatttcgttaacctggcggcagcgcaaaagatg

SEQ ID NO: 55231 - DNA, 103 bp, Artificial Sequence
  Synthetic Polynucleotide
taatacgactcactatagggcagactgtaatatgactaacgaaattacagaacagaggagactgtaaatgcgttagtcaaacctggcggcagcgcaaaagatg

SEQ ID NO: 55232 - DNA, 103 bp, Artificial Sequence
  Synthetic Polynucleotide
taatacgactcactatagggccagtcagactgtaatatgactaacgaaataacagaggagaatttcgatggtcatattaaacctggcggcagcgcaaaagatg

SEQ ID NO: 55233 - DNA, 103 bp, Artificial Sequence
  Synthetic Polynucleotide
taatacgactcactatagggacaacccagtcagactgtaatatgactaacaacagaggagagttagtatgattacagtcaacctggcggcagcgcaaaagatg

SEQ ID NO: 55234 - DNA, 103 bp, Artificial Sequence
  Synthetic Polynucleotide
taatacgactcactatagggacattacaacccagtcagactgtaatatgaaacagaggagatcatatatgagtctgactaacctggcggcagcgcaaaagatg

SEQ ID NO: 55235 - DNA, 103 bp, Artificial Sequence
  Synthetic Polynucleotide
taatacgactcactatagggggataacattacaacccagtcagactgtaaaacagaggagattacagatggactgggttaacctggcggcagcgcaaaagatg

SEQ ID NO: 55236 - DNA, 103 bp, Artificial Sequence
  Synthetic Polynucleotide
taatacgactcactatagggatgttggataacattacaacccagtcagacaacagaggagagtctgaatgggttgtaataacctggcggcagcgcaaaagatg

SEQ ID NO: 55237 - DNA, 103 bp, Artificial Sequence
  Synthetic Polynucleotide
taatacgactcactatagggtaatacaggcaggcattcattcgccctttaaacagaggagataaaggatgaatgaatgcaacctggcggcagcgcaaaagatg

SEQ ID NO: 55238 - DNA, 103 bp, Artificial Sequence
  Synthetic Polynucleotide
taatacgactcactatagggtccaatacgataacaataaatatatagataaacagaggagatatctaatgatttattgtaacctggcggcagcgcaaaagatg

SEQ ID NO: 55239 - DNA, 103 bp, Artificial Sequence
  Synthetic Polynucleotide
taatacgactcactataggggtgatatgttggataacattacaacccagtaacagaggagaactgggatgtaatgttataacctggcggcagcgcaaaagatg

SEQ ID NO: 55240 - DNA, 103 bp, Artificial Sequence
  Synthetic Polynucleotide
taatacgactcactatagggcataggtgatatgttggataacattacaacaacagaggagagttgtaatgttatccaacaacctggcggcagcgcaaaagatg

SEQ ID NO: 55241 - DNA, 103 bp, Artificial Sequence
  Synthetic Polynucleotide
taatacgactcactataggggtatccataggtgatatgttggataacattaacagaggagaaatgttatgcaacatatcaacctggcggcagcgcaaaagatg

SEQ ID NO: 55242 - DNA, 103 bp, Artificial Sequence
  Synthetic Polynucleotide
taatacgactcactataggggtaccgtatccataggtgatatgttggataaacagaggagatatccaatgtatcacctaaacctggcggcagcgcaaaagatg

SEQ ID NO: 55243 - DNA, 103 bp, Artificial Sequence
  Synthetic Polynucleotide
taatacgactcactatagggtacgtgtaccgtatccataggtgatatgttaacagaggagaaacataatgcctatggataacctggcggcagcgcaaaagatg

SEQ ID NO: 55244 - DNA, 103 bp, Artificial Sequence
  Synthetic Polynucleotide
taatacgactcactataggggctggtacgtgtaccgtatccataggtgataacagaggagaatcaccatgggatacggtaacctggcggcagcgcaaaagatg

SEQ ID NO: 55245 - DNA, 103 bp, Artificial Sequence
  Synthetic Polynucleotide
taatacgactcactatagggcaaatgctggtacgtgtaccgtatccatagaacagaggagactatggatgcggtacacgaacctggcggcagcgcaaaagatg

SEQ ID NO: 55246 - DNA, 103 bp, Artificial Sequence
  Synthetic Polynucleotide
taatacgactcactatagggtattacaaatgctggtacgtgtaccgtatcaacagaggagagatacgatgcacgtaccaaacctggcggcagcgcaaaagatg

SEQ ID NO: 55247 - DNA, 103 bp, Artificial Sequence
  Synthetic Polynucleotide
taatacgactcactatagggaggattattacaaatgctggtacgtgtaccaacagaggagaggtacaatgaccagcattaacctggcggcagcgcaaaagatg

SEQ ID NO: 55248 - DNA, 103 bp, Artificial Sequence
  Synthetic Polynucleotide
taatacgactcactatagggtagataggattattacaaatgctggtacgtaacagaggagaacgtacatgcatttgtaaaacctggcggcagcgcaaaagatg

SEQ ID NO: 55249 - DNA, 103 bp, Artificial Sequence
  Synthetic Polynucleotide
taatacgactcactatagggcagaatccaatacgataacaataaatatataacagaggagaatatatatgttgttatcgaacctggcggcagcgcaaaagatg

SEQ ID NO: 55250 - DNA, 103 bp, Artificial Sequence
  Synthetic Polynucleotide
taatacgactcactatagggcatcttagataggattattacaaatgctggaacagaggagaccagcaatggtaataatcaacctggcggcagcgcaaaagatg

SEQ ID NO: 55251 - DNA, 103 bp, Artificial Sequence
  Synthetic Polynucleotide
taatacgactcactatagggtacaacatcttagataggattattacaaataacagaggagaatttgtatgaatcctatcaacctggcggcagcgcaaaagatg

SEQ ID NO: 55252 - DNA, 103 bp, Artificial Sequence
  Synthetic Polynucleotide
taatacgactcactatagggtgccatacaacatcttagataggattattaaacagaggagataataaatgtatctaagaaacctggcggcagcgcaaaagatg

SEQ ID NO: 55253 - DNA, 103 bp, Artificial Sequence
  Synthetic Polynucleotide
taatacgactcactatagggcgcaatgccatacaacatcttagataggataacagaggagaatcctaatgaagatgttgaacctggcggcagcgcaaaagatg

SEQ ID NO: 55254 - DNA, 103 bp, Artificial Sequence
  Synthetic Polynucleotide
taatacgactcactatagggttctgcgcaatgccatacaacatcttagataacagaggagaatctaaatggttgtatggaacctggcggcagcgcaaaagatg

SEQ ID NO: 55255 - DNA, 103 bp, Artificial Sequence
  Synthetic Polynucleotide
taatacgactcactatagggatattttctgcgcaatgccatacaacatctaacagaggagaagatgtatgatggcattgaacctggcggcagcgcaaaagatg

SEQ ID NO: 55256 - DNA, 103 bp, Artificial Sequence
  Synthetic Polynucleotide
taatacgactcactatagggagaagatattttctgcgcaatgccatacaaaacagaggagattgtatatgattgcgcagaacctggcggcagcgcaaaagatg

SEQ ID NO: 55257 - DNA, 103 bp, Artificial Sequence
  Synthetic Polynucleotide
taatacgactcactatagggacaggagaagatattttctgcgcaatgccaaacagaggagatggcatatggcagaaaataacctggcggcagcgcaaaagatg

SEQ ID NO: 55258 - DNA, 103 bp, Artificial Sequence
  Synthetic Polynucleotide
taatacgactcactatagggatattacaggagaagatattttctgcgcaaaacagaggagattgcgcatgaaatatcttaacctggcggcagcgcaaaagatg

SEQ ID NO: 55259 - DNA, 103 bp, Artificial Sequence
  Synthetic Polynucleotide
taatacgactcactatagggtggagatattacaggagaagatattttctgaacagaggagacagaaaatgtcttctcctaacctggcggcagcgcaaaagatg

SEQ ID NO: 55260 - DNA, 103 bp, Artificial Sequence
  Synthetic Polynucleotide
taatacgactcactatagggatatgcagaatccaatacgataacaataaaaacagaggagatttattatgatcgtattgaacctggcggcagcgcaaaagatg

SEQ ID NO: 55261 - DNA, 103 bp, Artificial Sequence
  Synthetic Polynucleotide
taatacgactcactataggggagagtggagatattacaggagaagatattaacagaggagaaatatcatgtcctgtaataacctggcggcagcgcaaaagatg

SEQ ID NO: 55262 - DNA, 103 bp, Artificial Sequence
  Synthetic Polynucleotide
taatacgactcactatagggttatcgagagtggagatattacaggagaagaacagaggagacttctcatgtaatatctcaacctggcggcagcgcaaaagatg

SEQ ID NO: 55263 - DNA, 103 bp, Artificial Sequence
  Synthetic Polynucleotide
taatacgactcactatagggtagatttatcgagagtggagatattacaggaacagaggagacctgtaatgtctccactcaacctggcggcagcgcaaaagatg

SEQ ID NO: 55264 - DNA, 103 bp, Artificial Sequence
  Synthetic Polynucleotide
taatacgactcactatagggctaagtagatttatcgagagtggagatattaacagaggagaaatatcatgactctcgataacctggcggcagcgcaaaagatg

SEQ ID NO: 55265 - DNA, 103 bp, Artificial Sequence
  Synthetic Polynucleotide
taatacgactcactatagggataatctaagtagatttatcgagagtggagaacagaggagactccacatgcgataaatcaacctggcggcagcgcaaaagatg

SEQ ID NO: 55266 - DNA, 103 bp, Artificial Sequence
  Synthetic Polynucleotide
taatacgactcactatagggtaagaataatctaagtagatttatcgagagaacagaggagactctcgatgaatctacttaacctggcggcagcgcaaaagatg

SEQ ID NO: 55267 - DNA, 103 bp, Artificial Sequence
  Synthetic Polynucleotide
taatacgactcactataggggcatttaagaataatctaagtagatttatcaacagaggagagataaaatgacttagattaacctggcggcagcgcaaaagatg

SEQ ID NO: 55268 - DNA, 103 bp, Artificial Sequence
  Synthetic Polynucleotide
taatacgactcactatagggataaggcatttaagaataatctaagtagataacagaggagaatctacatggattattctaacctggcggcagcgcaaaagatg

SEQ ID NO: 55269 - DNA, 103 bp, Artificial Sequence
  Synthetic Polynucleotide
taatacgactcactatagggagagaataaggcatttaagaataatctaagaacagaggagacttagaatgttcttaaataacctggcggcagcgcaaaagatg

SEQ ID NO: 55270 - DNA, 103 bp, Artificial Sequence
  Synthetic Polynucleotide
taatacgactcactatagggtctccagagaataaggcatttaagaataataacagaggagaattattatgaaatgccttaacctggcggcagcgcaaaagatg

SEQ ID NO: 55271 - DNA, 103 bp, Artificial Sequence
  Synthetic Polynucleotide
taatacgactcactatagggcatctatatgcagaatccaatacgataacaaacagaggagatgttatatgattggattcaacctggcggcagcgcaaaagatg

SEQ ID NO: 55272 - DNA, 103 bp, Artificial Sequence
  Synthetic Polynucleotide
taatacgactcactatagggtcttttctccagagaataaggcatttaagaaacagaggagatcttaaatgccttattctaacctggcggcagcgcaaaagatg

SEQ ID NO: 55273 - DNA, 103 bp, Artificial Sequence
  Synthetic Polynucleotide
taatacgactcactatagggtgatatcttttctccagagaataaggcattaacagaggagaaatgccatgttctctggaaacctggcggcagcgcaaaagatg

SEQ ID NO: 55274 - DNA, 103 bp, Artificial Sequence
  Synthetic Polynucleotide
taatacgactcactataggggacactgatatcttttctccagagaataagaacagaggagacttattatgtggagaaaaaacctggcggcagcgcaaaagatg

SEQ ID NO: 55275 - DNA, 103 bp, Artificial Sequence
  Synthetic Polynucleotide
taatacgactcactatagggtgatggacactgatatcttttctccagagaaacagaggagatctctgatgaaaagatataacctggcggcagcgcaaaagatg

SEQ ID NO: 55276 - DNA, 103 bp, Artificial Sequence
  Synthetic Polynucleotide
taatacgactcactatagggtgaaatgatggacactgatatcttttctccaacagaggagaggagaaatgatatcagtgaacctggcggcagcgcaaaagatg

SEQ ID NO: 55277 - DNA, 103 bp, Artificial Sequence
  Synthetic Polynucleotide
taatacgactcactatagggattaatgaaatgatggacactgatatctttaacagaggagaaaagatatgagtgtccataacctggcggcagcgcaaaagatg

SEQ ID NO: 55278 - DNA, 103 bp, Artificial Sequence
  Synthetic Polynucleotide
taatacgactcactatagggatactattaatgaaatgatggacactgataaacagaggagatatcagatgccatcatttaacctggcggcagcgcaaaagatg

SEQ ID NO: 55279 - DNA, 103 bp, Artificial Sequence
  Synthetic Polynucleotide
taatacgactcactatagggtgcgtatactattaatgaaatgatggacacaacagaggagagtgtccatgatttcattaaacctggcggcagcgcaaaagatg

SEQ ID NO: 55280 - DNA, 103 bp, Artificial Sequence
  Synthetic Polynucleotide
taatacgactcactatagggttttctgcgtatactattaatgaaatgatgaacagaggagacatcatatgattaatagtaacctggcggcagcgcaaaagatg

SEQ ID NO: 55281 - DNA, 103 bp, Artificial Sequence
  Synthetic Polynucleotide
taatacgactcactataggggtatcttttctgcgtatactattaatgaaaaacagaggagatttcatatgtagtatacgaacctggcggcagcgcaaaagatg

SEQ ID NO: 55282 - DNA, 103 bp, Artificial Sequence
  Synthetic Polynucleotide
taatacgactcactatagggcaagccatctatatgcagaatccaatacgaaacagaggagatcgtatatgattctgcataacctggcggcagcgcaaaagatg

SEQ ID NO: 55283 - DNA, 103 bp, Artificial Sequence
  Synthetic Polynucleotide
taatacgactcactatagggtcgtggtatcttttctgcgtatactattaaaacagaggagattaataatgtacgcagaaaacctggcggcagcgcaaaagatg

SEQ ID NO: 55284 - DNA, 103 bp, Artificial Sequence
  Synthetic Polynucleotide
taatacgactcactataggggatactcgtggtatcttttctgcgtatactaacagaggagaagtataatgagaaaagataacctggcggcagcgcaaaagatg

SEQ ID NO: 55285 - DNA, 103 bp, Artificial Sequence
  Synthetic Polynucleotide
taatacgactcactataggggaattgatactcgtggtatcttttctgcgtaacagaggagaacgcagatgagataccacaacctggcggcagcgcaaaagatg

SEQ ID NO: 55286 - DNA, 103 bp, Artificial Sequence
  Synthetic Polynucleotide
taatacgactcactatagggggatagaattgatactcgtggtatcttttcaacagaggagagaaaagatgccacgagtaaacctggcggcagcgcaaaagatg

SEQ ID NO: 55287 - DNA, 103 bp, Artificial Sequence
  Synthetic Polynucleotide
taatacgactcactatagggatcttggatagaattgatactcgtggtatcaacagaggagagataccatgagtatcaataacctggcggcagcgcaaaagatg

SEQ ID NO: 55288 - DNA, 103 bp, Artificial Sequence
  Synthetic Polynucleotide
taatacgactcactatagggtaagtatcttggatagaattgatactcgtgaacagaggagacacgagatgcaattctataacctggcggcagcgcaaaagatg

SEQ ID NO: 55289 - DNA, 103 bp, Artificial Sequence
  Synthetic Polynucleotide
taatacgactcactatagggaccaataagtatcttggatagaattgatacaacagaggagagtatcaatgctatccaagaacctggcggcagcgcaaaagatg

SEQ ID NO: 55290 - DNA, 103 bp, Artificial Sequence
  Synthetic Polynucleotide
taatacgactcactatagggtcggaaccaataagtatcttggatagaattaacagaggagaaattctatgcaagatactaacctggcggcagcgcaaaagatg

SEQ ID NO: 55291 - DNA, 103 bp, Artificial Sequence
  Synthetic Polynucleotide
taatacgactcactataggggtgactcggaaccaataagtatcttggataaacagaggagatatccaatgtacttattgaacctggcggcagcgcaaaagatg

SEQ ID NO: 55292 - DNA, 103 bp, Artificial Sequence
  Synthetic Polynucleotide
taatacgactcactatagggtatttgtgactcggaaccaataagtatcttaacagaggagaaagataatgattggttccaacctggcggcagcgcaaaagatg

SEQ ID NO: 55293 - DNA, 103 bp, Artificial Sequence
  Synthetic Polynucleotide
taatacgactcactatagggacatacaagccatctatatgcagaatccaaaacagaggagattggatatggcatatagaaacctggcggcagcgcaaaagatg

SEQ ID NO: 55294 - DNA, 103 bp, Artificial Sequence
  Synthetic Polynucleotide
taatacgactcactatagggaccattatttgtgactcggaaccaataagtaacagaggagaacttatatgttccgagtcaacctggcggcagcgcaaaagatg

SEQ ID NO: 55295 - DNA, 103 bp, Artificial Sequence
  Synthetic Polynucleotide
taatacgactcactatagggaggaaaccattatttgtgactcggaaccaaaacagaggagattggttatgagtcacaaaaacctggcggcagcgcaaaagatg

SEQ ID NO: 55296 - DNA, 103 bp, Artificial Sequence
  Synthetic Polynucleotide
taatacgactcactatagggaggagaggaaaccattatttgtgactcggaaacagaggagatccgagatgcaaataatgaacctggcggcagcgcaaaagatg

SEQ ID NO: 55297 - DNA, 103 bp, Artificial Sequence
  Synthetic Polynucleotide
taatacgactcactatagggcctgaaggagaggaaaccattatttgtgacaacagaggagagtcacaatgaatggtttcaacctggcggcagcgcaaaagatg

SEQ ID NO: 55298 - DNA, 103 bp, Artificial Sequence
  Synthetic Polynucleotide
taatacgactcactataggggatctcctgaaggagaggaaaccattatttaacagaggagaaaataaatgtttcctctcaacctggcggcagcgcaaaagatg

SEQ ID NO: 55299 - DNA, 103 bp, Artificial Sequence
  Synthetic Polynucleotide
taatacgactcactatagggtgcaggatctcctgaaggagaggaaaccataacagaggagaatggttatgtctccttcaaacctggcggcagcgcaaaagatg

SEQ ID NO: 55300 - DNA, 103 bp, Artificial Sequence
  Synthetic Polynucleotide
taatacgactcactatagggttctatgcaggatctcctgaaggagaggaaaacagaggagattcctcatgttcaggagaaacctggcggcagcgcaaaagatg

SEQ ID NO: 55301 - DNA, 103 bp, Artificial Sequence
  Synthetic Polynucleotide
taatacgactcactataggggatatttctatgcaggatctcctgaaggagaacagaggagactccttatggagatcctgaacctggcggcagcgcaaaagatg

SEQ ID NO: 55302 - DNA, 103 bp, Artificial Sequence
  Synthetic Polynucleotide
taatacgactcactatagggtcctagatatttctatgcaggatctcctgaaacagaggagatcaggaatgcctgcatagaacctggcggcagcgcaaaagatg

SEQ ID NO: 55303 - DNA, 103 bp, Artificial Sequence
  Synthetic Polynucleotide
taatacgactcactatagggtattgtcctagatatttctatgcaggatctaacagaggagaagatccatgatagaaataaacctggcggcagcgcaaaagatg

SEQ ID NO: 55304 - DNA, 103 bp, Artificial Sequence
  Synthetic Polynucleotide
taatacgactcactatagggctttgacatacaagccatctatatgcagaaaacagaggagattctgcatgtagatggctaacctggcggcagcgcaaaagatg

SEQ ID NO: 55305 - DNA, 103 bp, Artificial Sequence
  Synthetic Polynucleotide
taatacgactcactataggggaaactattgtcctagatatttctatgcagaacagaggagactgcatatgaatatctagaacctggcggcagcgcaaaagatg

SEQ ID NO: 55306 - DNA, 103 bp, Artificial Sequence
  Synthetic Polynucleotide
taatacgactcactataggggtatagaaactattgtcctagatatttctaaacagaggagatagaaaatgctaggacaaaacctggcggcagcgcaaaagatg

SEQ ID NO: 55307 - DNA, 103 bp, Artificial Sequence
  Synthetic Polynucleotide
taatacgactcactatagggagacagtatagaaactattgtcctagatataacagaggagaatatctatgacaatagttaacctggcggcagcgcaaaagatg

SEQ ID NO: 55308 - DNA, 103 bp, Artificial Sequence
  Synthetic Polynucleotide
taatacgactcactataggggttacagacagtatagaaactattgtcctaaacagaggagataggacatgagtttctataacctggcggcagcgcaaaagatg

SEQ ID NO: 55309 - DNA, 103 bp, Artificial Sequence
  Synthetic Polynucleotide
taatacgactcactatagggtcagagttacagacagtatagaaactattgaacagaggagacaatagatgctatactgtaacctggcggcagcgcaaaagatg

SEQ ID NO: 55310 - DNA, 103 bp, Artificial Sequence
  Synthetic Polynucleotide
taatacgactcactataggggattatcagagttacagacagtatagaaacaacagaggagagtttctatgctgtctgtaaacctggcggcagcgcaaaagatg

SEQ ID NO: 55311 - DNA, 103 bp, Artificial Sequence
  Synthetic Polynucleotide
taatacgactcactatagggttagagattatcagagttacagacagtataaacagaggagatatactatgtgtaactctaacctggcggcagcgcaaaagatg

SEQ ID NO: 55312 - DNA, 103 bp, Artificial Sequence
  Synthetic Polynucleotide
taatacgactcactatagggtgactttagagattatcagagttacagacaaacagaggagatgtctgatgctctgataaaacctggcggcagcgcaaaagatg

SEQ ID NO: 55313 - DNA, 103 bp, Artificial Sequence
  Synthetic Polynucleotide
taatacgactcactataggggttagtgactttagagattatcagagttacaacagaggagagtaactatgataatctctaacctggcggcagcgcaaaagatg

SEQ ID NO: 55314 - DNA, 103 bp, Artificial Sequence
  Synthetic Polynucleotide
taatacgactcactatagggtatcagttagtgactttagagattatcagaaacagaggagatctgatatgctctaaagtaacctggcggcagcgcaaaagatg

SEQ ID NO: 55315 - DNA, 103 bp, Artificial Sequence
  Synthetic Polynucleotide
taatacgactcactatagggtatatctttgacatacaagccatctatatgaacagaggagacatataatgggcttgtataacctggcggcagcgcaaaagatg

SEQ ID NO: 55316 - DNA, 103 bp, Artificial Sequence
  Synthetic Polynucleotide
taatacgactcactatagggcatggtatcagttagtgactttagagattaaacagaggagataatctatgaagtcactaaacctggcggcagcgcaaaagatg

SEQ ID NO: 55317 - DNA, 103 bp, Artificial Sequence
  Synthetic Polynucleotide
taatacgactcactatagggaatttcatggtatcagttagtgactttagaaacagaggagatctaaaatgactaactgaaacctggcggcagcgcaaaagatg

SEQ ID NO: 55318 - DNA, 103 bp, Artificial Sequence
  Synthetic Polynucleotide
taatacgactcactatagggttctcaatttcatggtatcagttagtgactaacagaggagaagtcacatgctgataccaaacctggcggcagcgcaaaagatg

SEQ ID NO: 55319 - DNA, 103 bp, Artificial Sequence
  Synthetic Polynucleotide
taatacgactcactatagggtgatcttctcaatttcatggtatcagttagaacagaggagactaactatgaccatgaaaaacctggcggcagcgcaaaagatg

SEQ ID NO: 55320 - DNA, 103 bp, Artificial Sequence
  Synthetic Polynucleotide
taatacgactcactataggggcgtttgatcttctcaatttcatggtatcaaacagaggagatgatacatggaaattgagaacctggcggcagcgcaaaagatg

SEQ ID NO: 55321 - DNA, 103 bp, Artificial Sequence
  Synthetic Polynucleotide
taatacgactcactatagggcttcagcgtttgatcttctcaatttcatggaacagaggagaccatgaatgtgagaagataacctggcggcagcgcaaaagatg

SEQ ID NO: 55322 - DNA, 103 bp, Artificial Sequence
  Synthetic Polynucleotide
taatacgactcactataggggattacttcagcgtttgatcttctcaatttaacagaggagaaaattgatgagatcaaacaacctggcggcagcgcaaaagatg

SEQ ID NO: 55323 - DNA, 103 bp, Artificial Sequence
  Synthetic Polynucleotide
taatacgactcactatagggaaattgattacttcagcgtttgatcttctcaacagaggagagagaagatgaaacgctgaaacctggcggcagcgcaaaagatg

SEQ ID NO: 55324 - DNA, 103 bp, Artificial Sequence
  Synthetic Polynucleotide
taatacgactcactatagggcagaaaaattgattacttcagcgtttgatcaacagaggagagatcaaatgctgaagtaaaacctggcggcagcgcaaaagatg

SEQ ID NO: 55325 - DNA, 103 bp, Artificial Sequence
  Synthetic Polynucleotide
taatacgactcactatagggcgaggcagaaaaattgattacttcagcgttaacagaggagaaacgctatggtaatcaataacctggcggcagcgcaaaagatg

SEQ ID NO: 55326 - DNA, 103 bp, Artificial Sequence
  Synthetic Polynucleotide
taatacgactcactatagggtgttctatatctttgacatacaagccatctaacagaggagaagatggatggtatgtcaaaacctggcggcagcgcaaaagatg

SEQ ID NO: 55327 - DNA, 103 bp, Artificial Sequence
  Synthetic Polynucleotide
taatacgactcactatagggaaaaacgaggcagaaaaattgattacttcaaacagaggagatgaagtatgcaatttttcaacctggcggcagcgcaaaagatg

SEQ ID NO: 55328 - DNA, 103 bp, Artificial Sequence
  Synthetic Polynucleotide
taatacgactcactataggggtagtaaaaacgaggcagaaaaattgattaaacagaggagataatcaatgtttctgcctaacctggcggcagcgcaaaagatg

SEQ ID NO: 55329 - DNA, 103 bp, Artificial Sequence
  Synthetic Polynucleotide
taatacgactcactatagggtagttgtagtaaaaacgaggcagaaaaattaacagaggagaaattttatggcctcgtttaacctggcggcagcgcaaaagatg

SEQ ID NO: 55330 - DNA, 103 bp, Artificial Sequence
  Synthetic Polynucleotide
taatacgactcactatagggaaaactagttgtagtaaaaacgaggcagaaaacagaggagattctgcatggtttttactaacctggcggcagcgcaaaagatg

SEQ ID NO: 55331 - DNA, 103 bp, Artificial Sequence
  Synthetic Polynucleotide
taatacgactcactatagggtgatgaaaactagttgtagtaaaaacgaggaacagaggagacctcgtatgtactacaacaacctggcggcagcgcaaaagatg

SEQ ID NO: 55332 - DNA, 103 bp, Artificial Sequence
  Synthetic Polynucleotide
taatacgactcactatagggtacattgatgaaaactagttgtagtaaaaaaacagaggagatttttaatgcaactagttaacctggcggcagcgcaaaagatg

SEQ ID NO: 55333 - DNA, 103 bp, Artificial Sequence
  Synthetic Polynucleotide
taatacgactcactataggggtcactacattgatgaaaactagttgtagtaacagaggagaactacaatgagttttcataacctggcggcagcgcaaaagatg

SEQ ID NO: 55334 - DNA, 103 bp, Artificial Sequence
  Synthetic Polynucleotide
taatacgactcactatagggacatcgtcactacattgatgaaaactagttaacagaggagaaactagatgtcatcaatgaacctggcggcagcgcaaaagatg

SEQ ID NO: 55335 - DNA, 103 bp, Artificial Sequence
  Synthetic Polynucleotide
taatacgactcactatagggacaatacatcgtcactacattgatgaaaacaacagaggagagttttcatgaatgtagtgaacctggcggcagcgcaaaagatg

SEQ ID NO: 55336 - DNA, 103 bp, Artificial Sequence
  Synthetic Polynucleotide
taatacgactcactatagggactaaacaatacatcgtcactacattgatgaacagaggagacatcaaatgagtgacgataacctggcggcagcgcaaaagatg

SEQ ID NO: 55337 - DNA, 103 bp, Artificial Sequence
  Synthetic Polynucleotide
taatacgactcactatagggttatgtgttctatatctttgacatacaagcaacagaggagagcttgtatgtcaaagataaacctggcggcagcgcaaaagatg

SEQ ID NO: 55338 - DNA, 103 bp, Artificial Sequence
  Synthetic Polynucleotide
taatacgactcactataggggagtaactaaacaatacatcgtcactacataacagaggagaatgtagatgcgatgtattaacctggcggcagcgcaaaagatg

SEQ ID NO: 55339 - DNA, 103 bp, Artificial Sequence
  Synthetic Polynucleotide
taatacgactcactatagggaccaagagtaactaaacaatacatcgtcacaacagaggagagtgacgatgtattgtttaaacctggcggcagcgcaaaagatg

SEQ ID NO: 55340 - DNA, 103 bp, Artificial Sequence
  Synthetic Polynucleotide
taatacgactcactatagggattagaccaagagtaactaaacaatacatcaacagaggagagatgtaatgtttagttacaacctggcggcagcgcaaaagatg

SEQ ID NO: 55341 - DNA, 103 bp, Artificial Sequence
  Synthetic Polynucleotide
taatacgactcactatagggtcagtattagaccaagagtaactaaacaataacagaggagaattgttatgttactcttgaacctggcggcagcgcaaaagatg

SEQ ID NO: 55342 - DNA, 103 bp, Artificial Sequence
  Synthetic Polynucleotide
taatacgactcactatagggtatcatcagtattagaccaagagtaactaaaacagaggagattagttatgcttggtctaaacctggcggcagcgcaaaagatg

SEQ ID NO: 55343 - DNA, 103 bp, Artificial Sequence
  Synthetic Polynucleotide
taatacgactcactatagggatctctatcatcagtattagaccaagagtaaacagaggagatactctatgtctaatactaacctggcggcagcgcaaaagatg

SEQ ID NO: 55344 - DNA, 103 bp, Artificial Sequence
  Synthetic Polynucleotide
taatacgactcactatagggataatatctctatcatcagtattagaccaaaacagaggagattggtcatgtactgatgaaacctggcggcagcgcaaaagatg

SEQ ID NO: 55345 - DNA, 103 bp, Artificial Sequence
  Synthetic Polynucleotide
taatacgactcactatagggaagtaataatatctctatcatcagtattagaacagaggagactaataatgatgatagagaacctggcggcagcgcaaaagatg

SEQ ID NO: 55346 - DNA, 103 bp, Artificial Sequence
  Synthetic Polynucleotide
taatacgactcactatagggatgggaagtaataatatctctatcatcagtaacagaggagaactgatatgagagatattaacctggcggcagcgcaaaagatg

SEQ ID NO: 55347 - DNA, 103 bp, Artificial Sequence
  Synthetic Polynucleotide
taatacgactcactatagggccattatgggaagtaataatatctctatcaaacagaggagatgatagatgtattattacaacctggcggcagcgcaaaagatg

SEQ ID NO: 55348 - DNA, 103 bp, Artificial Sequence
  Synthetic Polynucleotide
taatacgactcactatagggtattataatacaggcaggcattcattcgccaacagaggagaggcgaaatgatgcctgccaacctggcggcagcgcaaaagatg

SEQ ID NO: 55349 - DNA, 103 bp, Artificial Sequence
  Synthetic Polynucleotide
taatacgactcactatagggattggttatgtgttctatatctttgacataaacagaggagatatgtcatggatatagaaaacctggcggcagcgcaaaagatg

SEQ ID NO: 55350 - DNA, 103 bp, Artificial Sequence
  Synthetic Polynucleotide
taatacgactcactatagggaagatccattatgggaagtaataatatctcaacagaggagagagataatgttacttcccaacctggcggcagcgcaaaagatg

SEQ ID NO: 55351 - DNA, 103 bp, Artificial Sequence
  Synthetic Polynucleotide
taatacgactcactatagggactagaagatccattatgggaagtaataataacagaggagaattattatgtcccataataacctggcggcagcgcaaaagatg

SEQ ID NO: 55352 - DNA, 103 bp, Artificial Sequence
  Synthetic Polynucleotide
taatacgactcactatagggtgactactagaagatccattatgggaagtaaacagaggagatacttcatgtaatggatcaacctggcggcagcgcaaaagatg

SEQ ID NO: 55353 - DNA, 103 bp, Artificial Sequence
  Synthetic Polynucleotide
taatacgactcactatagggtaaggtgactactagaagatccattatgggaacagaggagacccataatggatcttctaaacctggcggcagcgcaaaagatg

SEQ ID NO: 55354 - DNA, 103 bp, Artificial Sequence
  Synthetic Polynucleotide
taatacgactcactatagggggctttaaggtgactactagaagatccattaacagaggagaaatggaatgtctagtagtaacctggcggcagcgcaaaagatg

SEQ ID NO: 55355 - DNA, 103 bp, Artificial Sequence
  Synthetic Polynucleotide
taatacgactcactatagggcaatgggctttaaggtgactactagaagataacagaggagaatcttcatgtagtcacctaacctggcggcagcgcaaaagatg

SEQ ID NO: 55356 - DNA, 103 bp, Artificial Sequence
  Synthetic Polynucleotide
taatacgactcactatagggcgcatcaatgggctttaaggtgactactagaacagaggagactagtaatgaccttaaagaacctggcggcagcgcaaaagatg

SEQ ID NO: 55357 - DNA, 103 bp, Artificial Sequence
  Synthetic Polynucleotide
taatacgactcactatagggctattcgcatcaatgggctttaaggtgactaacagaggagaagtcacatgaaagcccataacctggcggcagcgcaaaagatg

SEQ ID NO: 55358 - DNA, 103 bp, Artificial Sequence
  Synthetic Polynucleotide
taatacgactcactatagggatctgctattcgcatcaatgggctttaaggaacagaggagaccttaaatgccattgatgaacctggcggcagcgcaaaagatg

SEQ ID NO: 55359 - DNA, 103 bp, Artificial Sequence
  Synthetic Polynucleotide
taatacgactcactatagggtatctatctgctattcgcatcaatgggcttaacagaggagaaagcccatggatgcgaataacctggcggcagcgcaaaagatg

SEQ ID NO: 55360 - DNA, 103 bp, Artificial Sequence
  Synthetic Polynucleotide
taatacgactcactatagggtataaattggttatgtgttctatatctttgaacagaggagacaaagaatgagaacacataacctggcggcagcgcaaaagatg

SEQ ID NO: 55361 - DNA, 103 bp, Artificial Sequence
  Synthetic Polynucleotide
taatacgactcactataggggactttatctatctgctattcgcatcaatgaacagaggagacattgaatggaatagcagaacctggcggcagcgcaaaagatg

SEQ ID NO: 55362 - DNA, 103 bp, Artificial Sequence
  Synthetic Polynucleotide
taatacgactcactatagggaccaagactttatctatctgctattcgcataacagaggagaatgcgaatggcagatagaaacctggcggcagcgcaaaagatg

SEQ ID NO: 55363 - DNA, 103 bp, Artificial Sequence
  Synthetic Polynucleotide
taatacgactcactataggggtcataccaagactttatctatctgctattaacagaggagaaatagcatgtagataaagaacctggcggcagcgcaaaagatg

SEQ ID NO: 55364 - DNA, 103 bp, Artificial Sequence
  Synthetic Polynucleotide
taatacgactcactatagggaaggagtcataccaagactttatctatctgaacagaggagacagataatgaaagtcttgaacctggcggcagcgcaaaagatg

SEQ ID NO: 55365 - DNA, 103 bp, Artificial Sequence
  Synthetic Polynucleotide
taatacgactcactatagggttagaaaggagtcataccaagactttatctaacagaggagaagataaatgcttggtatgaacctggcggcagcgcaaaagatg

SEQ ID NO: 55366 - DNA, 103 bp, Artificial Sequence
  Synthetic Polynucleotide
taatacgactcactatagggctatattagaaaggagtcataccaagacttaacagaggagaaagtctatgtatgactccaacctggcggcagcgcaaaagatg

SEQ ID NO: 55367 - DNA, 103 bp, Artificial Sequence
  Synthetic Polynucleotide
taatacgactcactatagggccgtactatattagaaaggagtcataccaaaacagaggagattggtaatgctcctttctaacctggcggcagcgcaaaagatg

SEQ ID NO: 55368 - DNA, 103 bp, Artificial Sequence
  Synthetic Polynucleotide
taatacgactcactataggggtagtccgtactatattagaaaggagtcataacagaggagaatgactatgttctaatataacctggcggcagcgcaaaagatg

SEQ ID NO: 55369 - DNA, 103 bp, Artificial Sequence
  Synthetic Polynucleotide
taatacgactcactatagggcaaaggtagtccgtactatattagaaaggaaacagaggagatcctttatgatatagtacaacctggcggcagcgcaaaagatg

SEQ ID NO: 55370 - DNA, 103 bp, Artificial Sequence
  Synthetic Polynucleotide
taatacgactcactatagggggtgacaaaggtagtccgtactatattagaaacagaggagatctaatatggtacggactaacctggcggcagcgcaaaagatg

SEQ ID NO: 55371 - DNA, 103 bp, Artificial Sequence
  Synthetic Polynucleotide
taatacgactcactataggggcgactataaattggttatgtgttctatataacagaggagaatatagatgacataaccaaacctggcggcagcgcaaaagatg

SEQ ID NO: 55372 - DNA, 103 bp, Artificial Sequence
  Synthetic Polynucleotide
taatacgactcactatagggagttgggtgacaaaggtagtccgtactataaacagaggagatatagtatggactaccttaacctggcggcagcgcaaaagatg

SEQ ID NO: 55373 - DNA, 103 bp, Artificial Sequence
  Synthetic Polynucleotide
taatacgactcactatagggtataaagttgggtgacaaaggtagtccgtaaacagaggagatacggaatgcctttgtcaaacctggcggcagcgcaaaagatg

SEQ ID NO: 55374 - DNA, 103 bp, Artificial Sequence
  Synthetic Polynucleotide
taatacgactcactataggggtgggtataaagttgggtgacaaaggtagtaacagaggagaactaccatggtcacccaaaacctggcggcagcgcaaaagatg

SEQ ID NO: 55375 - DNA, 103 bp, Artificial Sequence
  Synthetic Polynucleotide
taatacgactcactatagggcttatgtgggtataaagttgggtgacaaagaacagaggagactttgtatgccaactttaaacctggcggcagcgcaaaagatg

SEQ ID NO: 55376 - DNA, 103 bp, Artificial Sequence
  Synthetic Polynucleotide
taatacgactcactatagggtatggcttatgtgggtataaagttgggtgaaacagaggagatcacccatgtttatacccaacctggcggcagcgcaaaagatg

SEQ ID NO: 55377 - DNA, 103 bp, Artificial Sequence
  Synthetic Polynucleotide
taatacgactcactataggggttgttatggcttatgtgggtataaagttgaacagaggagacaacttatgacccacataaacctggcggcagcgcaaaagatg

SEQ ID NO: 55378 - DNA, 103 bp, Artificial Sequence
  Synthetic Polynucleotide
taatacgactcactatagggaagaggttgttatggcttatgtgggtataaaacagaggagattatacatgcataagccaaacctggcggcagcgcaaaagatg

SEQ ID NO: 55379 - DNA, 103 bp, Artificial Sequence
  Synthetic Polynucleotide
taatacgactcactatagggtattaaagaggttgttatggcttatgtgggaacagaggagacccacaatggccataacaaacctggcggcagcgcaaaagatg

SEQ ID NO: 55380 - DNA, 103 bp, Artificial Sequence
  Synthetic Polynucleotide
taatacgactcactatagggacggctattaaagaggttgttatggcttataacagaggagaataagcatgaacaacctcaacctggcggcagcgcaaaagatg

SEQ ID NO: 55381 - DNA, 103 bp, Artificial Sequence
  Synthetic Polynucleotide
taatacgactcactatagggatgaaacggctattaaagaggttgttatggaacagaggagaccataaatgcctctttaaaacctggcggcagcgcaaaagatg

SEQ ID NO: 55382 - DNA, 103 bp, Artificial Sequence
  Synthetic Polynucleotide
taatacgactcactatagggaaagcgcgactataaattggttatgtgttcaacagaggagagaacacatgaccaatttaaacctggcggcagcgcaaaagatg

SEQ ID NO: 55383 - DNA, 103 bp, Artificial Sequence
  Synthetic Polynucleotide
taatacgactcactatagggacctcatgaaacggctattaaagaggttgtaacagaggagaacaaccatgttaatagccaacctggcggcagcgcaaaagatg

SEQ ID NO: 55384 - DNA, 103 bp, Artificial Sequence
  Synthetic Polynucleotide
taatacgactcactataggggataaacctcatgaaacggctattaaagagaacagaggagactctttatgagccgtttcaacctggcggcagcgcaaaagatg

SEQ ID NO: 55385 - DNA, 103 bp, Artificial Sequence
  Synthetic Polynucleotide
taatacgactcactatagggtggctgataaacctcatgaaacggctattaaacagaggagataatagatgtttcatgagaacctggcggcagcgcaaaagatg

SEQ ID NO: 55386 - DNA, 103 bp, Artificial Sequence
  Synthetic Polynucleotide
taatacgactcactataggggctcatggctgataaacctcatgaaacggcaacagaggagagccgttatgtgaggtttaaacctggcggcagcgcaaaagatg

SEQ ID NO: 55387 - DNA, 103 bp, Artificial Sequence
  Synthetic Polynucleotide
taatacgactcactatagggcttaggctcatggctgataaacctcatgaaaacagaggagattcatgatgtttatcagcaacctggcggcagcgcaaaagatg

SEQ ID NO: 55388 - DNA, 103 bp, Artificial Sequence
  Synthetic Polynucleotide
taatacgactcactatagggaactacttaggctcatggctgataaacctcaacagaggagagaggttatgcagccatgaaacctggcggcagcgcaaaagatg

SEQ ID NO: 55389 - DNA, 103 bp, Artificial Sequence
  Synthetic Polynucleotide
taatacgactcactatagggcttccaactacttaggctcatggctgataaaacagaggagattatcaatgatgagcctaaacctggcggcagcgcaaaagatg

SEQ ID NO: 55390 - DNA, 103 bp, Artificial Sequence
  Synthetic Polynucleotide
taatacgactcactatagggagattcttccaactacttaggctcatggctaacagaggagaagccatatgcctaagtagaacctggcggcagcgcaaaagatg

SEQ ID NO: 55391 - DNA, 103 bp, Artificial Sequence
  Synthetic Polynucleotide
taatacgactcactatagggtcatgagattcttccaactacttaggctcaaacagaggagatgagccatggtagttggaaacctggcggcagcgcaaaagatg

SEQ ID NO: 55392 - DNA, 103 bp, Artificial Sequence
  Synthetic Polynucleotide
taatacgactcactataggggggattcatgagattcttccaactacttagaacagaggagactaagtatgtggaagaataacctggcggcagcgcaaaagatg

SEQ ID NO: 55393 - DNA, 103 bp, Artificial Sequence
  Synthetic Polynucleotide
taatacgactcactatagggaatgtaaagcgcgactataaattggttatgaacagaggagacataacatgtttatagtcaacctggcggcagcgcaaaagatg

SEQ ID NO: 55394 - DNA, 103 bp, Artificial Sequence
  Synthetic Polynucleotide
taatacgactcactataggggagacgggattcatgagattcttccaactaaacagaggagatagttgatggaatctcataacctggcggcagcgcaaaagatg

SEQ ID NO: 55395 - DNA, 103 bp, Artificial Sequence
  Synthetic Polynucleotide
taatacgactcactatagggtttctgagacgggattcatgagattcttccaacagaggagaggaagaatgtcatgaatcaacctggcggcagcgcaaaagatg

SEQ ID NO: 55396 - DNA, 103 bp, Artificial Sequence
  Synthetic Polynucleotide
taatacgactcactatagggaggactttctgagacgggattcatgagattaacagaggagaaatctcatgaatcccgtcaacctggcggcagcgcaaaagatg

SEQ ID NO: 55397 - DNA, 103 bp, Artificial Sequence
  Synthetic Polynucleotide
taatacgactcactatagggcatataggactttctgagacgggattcatgaacagaggagacatgaaatgcgtctcagaaacctggcggcagcgcaaaagatg

SEQ ID NO: 55398 - DNA, 103 bp, Artificial Sequence
  Synthetic Polynucleotide
taatacgactcactatagggtcatgcatataggactttctgagacgggataacagaggagaatcccgatgcagaaagtcaacctggcggcagcgcaaaagatg

SEQ ID NO: 55399 - DNA, 103 bp, Artificial Sequence
  Synthetic Polynucleotide
taatacgactcactatagggttctatcatgcatataggactttctgagacaacagaggagagtctcaatgagtcctataaacctggcggcagcgcaaaagatg

SEQ ID NO: 55400 - DNA, 103 bp, Artificial Sequence
  Synthetic Polynucleotide
taatacgactcactatagggaaatcttctatcatgcatataggactttctaacagaggagaagaaagatgtatatgcataacctggcggcagcgcaaaagatg

SEQ ID NO: 55401 - DNA, 103 bp, Artificial Sequence
  Synthetic Polynucleotide
taatacgactcactatagggaagataaatcttctatcatgcatataggacaacagaggagagtcctaatggcatgatagaacctggcggcagcgcaaaagatg

SEQ ID NO: 55402 - DNA, 103 bp, Artificial Sequence
  Synthetic Polynucleotide
taatacgactcactatagggcaagaaagataaatcttctatcatgcatataacagaggagaatatgcatgatagaagataacctggcggcagcgcaaaagatg

SEQ ID NO: 55403 - DNA, 103 bp, Artificial Sequence
  Synthetic Polynucleotide
taatacgactcactatagggtttcccaagaaagataaatcttctatcatgaacagaggagacatgatatgagatttatcaacctggcggcagcgcaaaagatg

SEQ ID NO: 55404 - DNA, 103 bp, Artificial Sequence
  Synthetic Polynucleotide
taatacgactcactatagggtcgagaatgtaaagcgcgactataaattggaacagaggagaccaattatgagtcgcgctaacctggcggcagcgcaaaagatg

SEQ ID NO: 55405 - DNA, 103 bp, Artificial Sequence
  Synthetic Polynucleotide
taatacgactcactataggggagagtttcccaagaaagataaatcttctaaacagaggagatagaagatgtatctttctaacctggcggcagcgcaaaagatg

SEQ ID NO: 55406 - DNA, 103 bp, Artificial Sequence
  Synthetic Polynucleotide
taatacgactcactatagggtatacgagagtttcccaagaaagataaatcaacagaggagagatttaatgttcttgggaaacctggcggcagcgcaaaagatg

SEQ ID NO: 55407 - DNA, 103 bp, Artificial Sequence
  Synthetic Polynucleotide
taatacgactcactatagggatgactatacgagagtttcccaagaaagataacagaggagaatctttatggggaaactcaacctggcggcagcgcaaaagatg

SEQ ID NO: 55408 - DNA, 103 bp, Artificial Sequence
  Synthetic Polynucleotide
taatacgactcactatagggcatctatgactatacgagagtttcccaagaaacagaggagatcttggatgactctcgtaaacctggcggcagcgcaaaagatg

SEQ ID NO: 55409 - DNA, 103 bp, Artificial Sequence
  Synthetic Polynucleotide
taatacgactcactatagggtatttcatctatgactatacgagagtttccaacagaggagaggaaacatgcgtatagtcaacctggcggcagcgcaaaagatg

SEQ ID NO: 55410 - DNA, 103 bp, Artificial Sequence
  Synthetic Polynucleotide
taatacgactcactatagggaagagtatttcatctatgactatacgagagaacagaggagactctcgatgagtcatagaaacctggcggcagcgcaaaagatg

SEQ ID NO: 55411 - DNA, 103 bp, Artificial Sequence
  Synthetic Polynucleotide
taatacgactcactatagggctttaaagagtatttcatctatgactatacaacagaggagagtatagatgtagatgaaaaacctggcggcagcgcaaaagatg

SEQ ID NO: 55412 - DNA, 103 bp, Artificial Sequence
  Synthetic Polynucleotide
taatacgactcactatagggagaaactttaaagagtatttcatctatgacaacagaggagagtcataatggaaatactcaacctggcggcagcgcaaaagatg

SEQ ID NO: 55413 - DNA, 103 bp, Artificial Sequence
  Synthetic Polynucleotide
taatacgactcactatagggatttcagaaactttaaagagtatttcatctaacagaggagaagatgaatgactctttaaaacctggcggcagcgcaaaagatg

SEQ ID NO: 55414 - DNA, 103 bp, Artificial Sequence
  Synthetic Polynucleotide
taatacgactcactatagggatcttatttcagaaactttaaagagtatttaacagaggagaaaatacatgttaaagtttaacctggcggcagcgcaaaagatg

SEQ ID NO: 55415 - DNA, 103 bp, Artificial Sequence
  Synthetic Polynucleotide
taatacgactcactatagggtagattcgagaatgtaaagcgcgactataaaacagaggagattatagatgcgctttacaaacctggcggcagcgcaaaagatg

SEQ ID NO: 55416 - DNA, 103 bp, Artificial Sequence
  Synthetic Polynucleotide
taatacgactcactatagggtactgatcttatttcagaaactttaaagagaacagaggagactctttatggtttctgaaaacctggcggcagcgcaaaagatg

SEQ ID NO: 55417 - DNA, 103 bp, Artificial Sequence
  Synthetic Polynucleotide
taatacgactcactatagggactgttactgatcttatttcagaaactttaaacagaggagataaagtatgtgaaataagaacctggcggcagcgcaaaagatg

SEQ ID NO: 55418 - DNA, 103 bp, Artificial Sequence
  Synthetic Polynucleotide
taatacgactcactataggggtaagactgttactgatcttatttcagaaaaacagaggagatttctgatgtaagatcagaacctggcggcagcgcaaaagatg

SEQ ID NO: 55419 - DNA, 103 bp, Artificial Sequence
  Synthetic Polynucleotide
taatacgactcactatagggcggaggtaagactgttactgatcttatttcaacagaggagagaaataatgtcagtaacaaacctggcggcagcgcaaaagatg

SEQ ID NO: 55420 - DNA, 103 bp, Artificial Sequence
  Synthetic Polynucleotide
taatacgactcactataggggtagtcggaggtaagactgttactgatcttaacagaggagaaagatcatgaacagtcttaacctggcggcagcgcaaaagatg

SEQ ID NO: 55421 - DNA, 103 bp, Artificial Sequence
  Synthetic Polynucleotide
taatacgactcactatagggccagagtagtcggaggtaagactgttactgaacagaggagacagtaaatgtcttacctcaacctggcggcagcgcaaaagatg

SEQ ID NO: 55422 - DNA, 103 bp, Artificial Sequence
  Synthetic Polynucleotide
taatacgactcactataggggttacccagagtagtcggaggtaagactgtaacagaggagaacagtcatgcctccgactaacctggcggcagcgcaaaagatg

SEQ ID NO: 55423 - DNA, 103 bp, Artificial Sequence
  Synthetic Polynucleotide
taatacgactcactatagggtgtttgttacccagagtagtcggaggtaagaacagaggagacttaccatggactactctaacctggcggcagcgcaaaagatg

SEQ ID NO: 55424 - DNA, 103 bp, Artificial Sequence
  Synthetic Polynucleotide
taatacgactcactataggggagtatgtttgttacccagagtagtcggagaacagaggagactccgaatgctctgggtaaacctggcggcagcgcaaaagatg

SEQ ID NO: 55425 - DNA, 103 bp, Artificial Sequence
  Synthetic Polynucleotide
taatacgactcactatagggtattagagtatgtttgttacccagagtagtaacagaggagaactactatgggtaacaaaaacctggcggcagcgcaaaagatg

SEQ ID NO: 55426 - DNA, 103 bp, Artificial Sequence
  Synthetic Polynucleotide
taatacgactcactatagggaactttagattcgagaatgtaaagcgcgacaacagaggagagtcgcgatgtacattctcaacctggcggcagcgcaaaagatg

SEQ ID NO: 55427 - DNA, 103 bp, Artificial Sequence
  Synthetic Polynucleotide
taatacgactcactatagggacacctattagagtatgtttgttacccagaaacagaggagatctgggatgcaaacatacaacctggcggcagcgcaaaagatg

SEQ ID NO: 55428 - DNA, 103 bp, Artificial Sequence
  Synthetic Polynucleotide
taatacgactcactatagggagaaaacacctattagagtatgtttgttacaacagaggagagtaacaatgatactctaaaacctggcggcagcgcaaaagatg

SEQ ID NO: 55429 - DNA, 103 bp, Artificial Sequence
  Synthetic Polynucleotide
taatacgactcactatagggcgcagagaaaacacctattagagtatgtttaacagaggagaaaacatatgctaataggtaacctggcggcagcgcaaaagatg

SEQ ID NO: 55430 - DNA, 103 bp, Artificial Sequence
  Synthetic Polynucleotide
taatacgactcactatagggatctccgcagagaaaacacctattagagtaaacagaggagatactctatgaggtgttttaacctggcggcagcgcaaaagatg

SEQ ID NO: 55431 - DNA, 103 bp, Artificial Sequence
  Synthetic Polynucleotide
taatacgactcactatagggatattatctccgcagagaaaacacctattaaacagaggagataatagatgttttctctgaacctggcggcagcgcaaaagatg

SEQ ID NO: 55432 - DNA, 103 bp, Artificial Sequence
  Synthetic Polynucleotide
taatacgactcactatagggttctgatattatctccgcagagaaaacaccaacagaggagaggtgttatgtctgcggagaacctggcggcagcgcaaaagatg

SEQ ID NO: 55433 - DNA, 103 bp, Artificial Sequence
  Synthetic Polynucleotide
taatacgactcactatagggatcctttctgatattatctccgcagagaaaaacagaggagatttctcatgggagataataacctggcggcagcgcaaaagatg

SEQ ID NO: 55434 - DNA, 103 bp, Artificial Sequence
  Synthetic Polynucleotide
taatacgactcactataggggctctatcctttctgatattatctccgcagaacagaggagactgcggatgtaatatcagaacctggcggcagcgcaaaagatg

SEQ ID NO: 55435 - DNA, 103 bp, Artificial Sequence
  Synthetic Polynucleotide
taatacgactcactatagggttattgctctatcctttctgatattatctcaacagaggagagagataatgtcagaaaggaacctggcggcagcgcaaaagatg

SEQ ID NO: 55436 - DNA, 103 bp, Artificial Sequence
  Synthetic Polynucleotide
taatacgactcactatagggactacttattgctctatcctttctgatattaacagaggagaaatatcatgaaggatagaaacctggcggcagcgcaaaagatg

SEQ ID NO: 55437 - DNA, 103 bp, Artificial Sequence
  Synthetic Polynucleotide
taatacgactcactatagggctcttaactttagattcgagaatgtaaagcaacagaggagagctttaatgtctcgaatcaacctggcggcagcgcaaaagatg

SEQ ID NO: 55438 - DNA, 103 bp, Artificial Sequence
  Synthetic Polynucleotide
taatacgactcactatagggataatactacttattgctctatcctttctgaacagaggagacagaaaatgtagagcaataacctggcggcagcgcaaaagatg

SEQ ID NO: 55439 - DNA, 103 bp, Artificial Sequence
  Synthetic Polynucleotide
taatacgactcactatagggtcacaataatactacttattgctctatcctaacagaggagaaggataatgcaataagtaaacctggcggcagcgcaaaagatg

SEQ ID NO: 55440 - DNA, 103 bp, Artificial Sequence
  Synthetic Polynucleotide
taatacgactcactatagggtataatcacaataatactacttattgctctaacagaggagaagagcaatgagtagtattaacctggcggcagcgcaaaagatg

SEQ ID NO: 55441 - DNA, 103 bp, Artificial Sequence
  Synthetic Polynucleotide
taatacgactcactataggggtctttataatcacaataatactacttattaacagaggagaaataagatgtattattgtaacctggcggcagcgcaaaagatg

SEQ ID NO: 55442 - DNA, 103 bp, Artificial Sequence
  Synthetic Polynucleotide
taatacgactcactatagggattcggtctttataatcacaataatactacaacagaggagagtagtaatgttgtgattaaacctggcggcagcgcaaaagatg

SEQ ID NO: 55443 - DNA, 103 bp, Artificial Sequence
  Synthetic Polynucleotide
taatacgactcactatagggtatgtattcggtctttataatcacaataataacagaggagaattattatgattataaagaacctggcggcagcgcaaaagatg

SEQ ID NO: 55444 - DNA, 103 bp, Artificial Sequence
  Synthetic Polynucleotide
taatacgactcactatagggcctgttatgtattcggtctttataatcacaaacagaggagatgtgatatgaaagaccgaaacctggcggcagcgcaaaagatg

SEQ ID NO: 55445 - DNA, 103 bp, Artificial Sequence
  Synthetic Polynucleotide
taatacgactcactatagggttctacctgttatgtattcggtctttataaaacagaggagattataaatgccgaatacaaacctggcggcagcgcaaaagatg

SEQ ID NO: 55446 - DNA, 103 bp, Artificial Sequence
  Synthetic Polynucleotide
taatacgactcactatagggataaattctacctgttatgtattcggtcttaacagaggagaaagaccatgtacataacaaacctggcggcagcgcaaaagatg

SEQ ID NO: 55447 - DNA, 103 bp, Artificial Sequence
  Synthetic Polynucleotide
taatacgactcactatagggtgtttataaattctacctgttatgtattcgaacagaggagacgaataatgaacaggtagaacctggcggcagcgcaaaagatg

SEQ ID NO: 55448 - DNA, 103 bp, Artificial Sequence
  Synthetic Polynucleotide
taatacgactcactatagggtaaatctcttaactttagattcgagaatgtaacagaggagaacattcatgaatctaaagaacctggcggcagcgcaaaagatg

SEQ ID NO: 55449 - DNA, 103 bp, Artificial Sequence
  Synthetic Polynucleotide
taatacgactcactatagggcatgatgtttataaattctacctgttatgtaacagaggagaacataaatggtagaatttaacctggcggcagcgcaaaagatg

SEQ ID NO: 55450 - DNA, 103 bp, Artificial Sequence
  Synthetic Polynucleotide
taatacgactcactatagggcaggacatgatgtttataaattctacctgtaacagaggagaacaggtatgatttataaaaacctggcggcagcgcaaaagatg

SEQ ID NO: 55451 - DNA, 103 bp, Artificial Sequence
  Synthetic Polynucleotide
taatacgactcactatagggaccttcaggacatgatgtttataaattctaaacagaggagatagaatatgtaaacatcaaacctggcggcagcgcaaaagatg

SEQ ID NO: 55452 - DNA, 103 bp, Artificial Sequence
  Synthetic Polynucleotide
taatacgactcactatagggtaaaaaccttcaggacatgatgtttataaaaacagaggagatttataatgatcatgtccaacctggcggcagcgcaaaagatg

SEQ ID NO: 55453 - DNA, 103 bp, Artificial Sequence
  Synthetic Polynucleotide
taatacgactcactatagggaagtctaaaaaccttcaggacatgatgtttaacagaggagaaaacatatggtcctgaagaacctggcggcagcgcaaaagatg

SEQ ID NO: 55454 - DNA, 103 bp, Artificial Sequence
  Synthetic Polynucleotide
taatacgactcactatagggaatacaagtctaaaaaccttcaggacatgaaacagaggagatcatgtatggaaggttttaacctggcggcagcgcaaaagatg

SEQ ID NO: 55455 - DNA, 103 bp, Artificial Sequence
  Synthetic Polynucleotide
taatacgactcactatagggcgaggaatacaagtctaaaaaccttcaggaaacagaggagatcctgaatgtttttagacaacctggcggcagcgcaaaagatg

SEQ ID NO: 55456 - DNA, 103 bp, Artificial Sequence
  Synthetic Polynucleotide
taatacgactcactataggggattacgaggaatacaagtctaaaaaccttaacagaggagaaaggttatgagacttgtaaacctggcggcagcgcaaaagatg

SEQ ID NO: 55457 - DNA, 103 bp, Artificial Sequence
  Synthetic Polynucleotide
taatacgactcactataggggtatggattacgaggaatacaagtctaaaaaacagaggagattttagatgtgtattcctaacctggcggcagcgcaaaagatg

SEQ ID NO: 55458 - DNA, 103 bp, Artificial Sequence
  Synthetic Polynucleotide
taatacgactcactatagggggacggtatggattacgaggaatacaagtcaacagaggagagacttgatgtcctcgtaaaacctggcggcagcgcaaaagatg

SEQ ID NO: 55459 - DNA, 103 bp, Artificial Sequence
  Synthetic Polynucleotide
taatacgactcactatagggatgtatattataatacaggcaggcattcataacagaggagaatgaatatgtgcctgtataacctggcggcagcgcaaaagatg

SEQ ID NO: 55460 - DNA, 103 bp, Artificial Sequence
  Synthetic Polynucleotide
taatacgactcactatagggttttctaaatctcttaactttagattcgagaacagaggagactcgaaatgaaagttaagaacctggcggcagcgcaaaagatg

SEQ ID NO: 55461 - DNA, 103 bp, Artificial Sequence
  Synthetic Polynucleotide
taatacgactcactatagggttttgggacggtatggattacgaggaatacaacagaggagagtattcatggtaatccataacctggcggcagcgcaaaagatg

SEQ ID NO: 55462 - DNA, 103 bp, Artificial Sequence
  Synthetic Polynucleotide
taatacgactcactatagggccatgttttgggacggtatggattacgaggaacagaggagacctcgtatgccataccgtaacctggcggcagcgcaaaagatg

SEQ ID NO: 55463 - DNA, 103 bp, Artificial Sequence
  Synthetic Polynucleotide
taatacgactcactatagggcaaatccatgttttgggacggtatggattaaacagaggagataatccatgccgtcccaaaacctggcggcagcgcaaaagatg

SEQ ID NO: 55464 - DNA, 103 bp, Artificial Sequence
  Synthetic Polynucleotide
taatacgactcactataggggttaccaaatccatgttttgggacggtatgaacagaggagacataccatgccaaaacataacctggcggcagcgcaaaagatg

SEQ ID NO: 55465 - DNA, 103 bp, Artificial Sequence
  Synthetic Polynucleotide
taatacgactcactatagggtcaaagttaccaaatccatgttttgggacgaacagaggagacgtcccatgacatggattaacctggcggcagcgcaaaagatg

SEQ ID NO: 55466 - DNA, 103 bp, Artificial Sequence
  Synthetic Polynucleotide
taatacgactcactatagggggctatcaaagttaccaaatccatgttttgaacagaggagacaaaacatggatttggtaaacctggcggcagcgcaaaagatg

SEQ ID NO: 55467 - DNA, 103 bp, Artificial Sequence
  Synthetic Polynucleotide
taatacgactcactatagggtctacggctatcaaagttaccaaatccatgaacagaggagacatggaatgggtaactttaacctggcggcagcgcaaaagatg

SEQ ID NO: 55468 - DNA, 103 bp, Artificial Sequence
  Synthetic Polynucleotide
taatacgactcactatagggaaagatctacggctatcaaagttaccaaataacagaggagaatttggatgctttgatagaacctggcggcagcgcaaaagatg

SEQ ID NO: 55469 - DNA, 103 bp, Artificial Sequence
  Synthetic Polynucleotide
taatacgactcactatagggggaacaaagatctacggctatcaaagttacaacagaggagagtaactatgatagccgtaaacctggcggcagcgcaaaagatg

SEQ ID NO: 55470 - DNA, 103 bp, Artificial Sequence
  Synthetic Polynucleotide
taatacgactcactataggggcgaaggaacaaagatctacggctatcaaaaacagaggagatttgatatgcgtagatctaacctggcggcagcgcaaaagatg

SEQ ID NO: 55471 - DNA, 103 bp, Artificial Sequence
  Synthetic Polynucleotide
taatacgactcactatagggtaatgttttctaaatctcttaactttagataacagaggagaatctaaatgtaagagattaacctggcggcagcgcaaaagatg

SEQ ID NO: 55472 - DNA, 103 bp, Artificial Sequence
  Synthetic Polynucleotide
taatacgactcactatagggtgttggcgaaggaacaaagatctacggctaaacagaggagatagccgatgatctttgttaacctggcggcagcgcaaaagatg

SEQ ID NO: 55473 - DNA, 103 bp, Artificial Sequence
  Synthetic Polynucleotide
taatacgactcactatagggtaacctgttggcgaaggaacaaagatctacaacagaggagagtagatatgtgttccttcaacctggcggcagcgcaaaagatg

SEQ ID NO: 55474 - DNA, 103 bp, Artificial Sequence
  Synthetic Polynucleotide
taatacgactcactatagggttctttaacctgttggcgaaggaacaaagaaacagaggagatctttgatgcttcgccaaaacctggcggcagcgcaaaagatg

SEQ ID NO: 55475 - DNA, 103 bp, Artificial Sequence
  Synthetic Polynucleotide
taatacgactcactatagggttaatttctttaacctgttggcgaaggaacaacagaggagagttcctatgccaacaggtaacctggcggcagcgcaaaagatg

SEQ ID NO: 55476 - DNA, 103 bp, Artificial Sequence
  Synthetic Polynucleotide
taatacgactcactatagggctttattaatttctttaacctgttggcgaaaacagaggagattcgccatgaggttaaagaacctggcggcagcgcaaaagatg

SEQ ID NO: 55477 - DNA, 103 bp, Artificial Sequence
  Synthetic Polynucleotide
taatacgactcactatagggaaattctttattaatttctttaacctgttgaacagaggagacaacagatgaaagaaattaacctggcggcagcgcaaaagatg

SEQ ID NO: 55478 - DNA, 103 bp, Artificial Sequence
  Synthetic Polynucleotide
taatacgactcactatagggacaacaaattctttattaatttctttaaccaacagaggagaggttaaatgaattaataaaacctggcggcagcgcaaaagatg

SEQ ID NO: 55479 - DNA, 103 bp, Artificial Sequence
  Synthetic Polynucleotide
taatacgactcactatagggtagaaacaacaaattctttattaatttcttaacagaggagaaagaaaatgataaagaataacctggcggcagcgcaaaagatg

SEQ ID NO: 55480 - DNA, 103 bp, Artificial Sequence
  Synthetic Polynucleotide
taatacgactcactatagggataaatagaaacaacaaattctttattaataacagaggagaattaatatggaatttgttaacctggcggcagcgcaaaagatg

SEQ ID NO: 55481 - DNA, 103 bp, Artificial Sequence
  Synthetic Polynucleotide
taatacgactcactatagggtggacataaatagaaacaacaaattctttaaacagaggagataaagaatgtgttgtttcaacctggcggcagcgcaaaagatg

SEQ ID NO: 55482 - DNA, 103 bp, Artificial Sequence
  Synthetic Polynucleotide
taatacgactcactatagggggatataatgttttctaaatctcttaacttaacagaggagaaagttaatggatttagaaaacctggcggcagcgcaaaagatg

SEQ ID NO: 55483 - DNA, 103 bp, Artificial Sequence
  Synthetic Polynucleotide
taatacgactcactatagggatttgtggacataaatagaaacaacaaattaacagaggagaaatttgatgtttctatttaacctggcggcagcgcaaaagatg

SEQ ID NO: 55484 - DNA, 103 bp, Artificial Sequence
  Synthetic Polynucleotide
taatacgactcactatagggatgcaatttgtggacataaatagaaacaacaacagaggagagttgttatgatttatgtcaacctggcggcagcgcaaaagatg

SEQ ID NO: 55485 - DNA, 103 bp, Artificial Sequence
  Synthetic Polynucleotide
taatacgactcactatagggcaaatatgcaatttgtggacataaatagaaaacagaggagattctatatgtgtccacaaaacctggcggcagcgcaaaagatg

SEQ ID NO: 55486 - DNA, 103 bp, Artificial Sequence
  Synthetic Polynucleotide
taatacgactcactatagggacttccaaatatgcaatttgtggacataaaaacagaggagatttatgatgacaaattgcaacctggcggcagcgcaaaagatg

SEQ ID NO: 55487 - DNA, 103 bp, Artificial Sequence
  Synthetic Polynucleotide
taatacgactcactataggggtgggacttccaaatatgcaatttgtggacaacagaggagagtccacatgttgcatattaacctggcggcagcgcaaaagatg

SEQ ID NO: 55488 - DNA, 103 bp, Artificial Sequence
  Synthetic Polynucleotide
taatacgactcactatagggtaacggtgggacttccaaatatgcaatttgaacagaggagacaaattatgtatttggaaaacctggcggcagcgcaaaagatg

SEQ ID NO: 55489 - DNA, 103 bp, Artificial Sequence
  Synthetic Polynucleotide
taatacgactcactataggggaacgtaacggtgggacttccaaatatgcaaacagaggagatgcataatgggaagtcccaacctggcggcagcgcaaaagatg

SEQ ID NO: 55490 - DNA, 103 bp, Artificial Sequence
  Synthetic Polynucleotide
taatacgactcactataggggcagtgaacgtaacggtgggacttccaaataacagaggagaatttggatgtcccaccgtaacctggcggcagcgcaaaagatg

SEQ ID NO: 55491 - DNA, 103 bp, Artificial Sequence
  Synthetic Polynucleotide
taatacgactcactatagggatgctgcagtgaacgtaacggtgggacttcaacagaggagagaagtcatgccgttacgtaacctggcggcagcgcaaaagatg

SEQ ID NO: 55492 - DNA, 103 bp, Artificial Sequence
  Synthetic Polynucleotide
taatacgactcactatagggtcaaaatgctgcagtgaacgtaacggtgggaacagaggagacccaccatgacgttcactaacctggcggcagcgcaaaagatg

SEQ ID NO: 55493 - DNA, 103 bp, Artificial Sequence
  Synthetic Polynucleotide
taatacgactcactatagggtccgaggatataatgttttctaaatctcttaacagaggagaaagagaatgagaaaacataacctggcggcagcgcaaaagatg

SEQ ID NO: 55494 - DNA, 103 bp, Artificial Sequence
  Synthetic Polynucleotide
taatacgactcactataggggatcctcaaaatgctgcagtgaacgtaacgaacagaggagacgttacatgcactgcagcaacctggcggcagcgcaaaagatg

SEQ ID NO: 55495 - DNA, 103 bp, Artificial Sequence
  Synthetic Polynucleotide
taatacgactcactatagggctcgagatcctcaaaatgctgcagtgaacgaacagaggagacgttcaatgcagcattttaacctggcggcagcgcaaaagatg

SEQ ID NO: 55496 - DNA, 103 bp, Artificial Sequence
  Synthetic Polynucleotide
taatacgactcactatagggtcatactcgagatcctcaaaatgctgcagtaacagaggagaactgcaatgttttgaggaaacctggcggcagcgcaaaagatg

SEQ ID NO: 55497 - DNA, 103 bp, Artificial Sequence
  Synthetic Polynucleotide
taatacgactcactataggggtacttcatactcgagatcctcaaaatgctaacagaggagaagcattatgaggatctcgaacctggcggcagcgcaaaagatg

SEQ ID NO: 55498 - DNA, 103 bp, Artificial Sequence
  Synthetic Polynucleotide
taatacgactcactatagggacatcgtacttcatactcgagatcctcaaaaacagaggagatttgagatgctcgagtataacctggcggcagcgcaaaagatg

SEQ ID NO: 55499 - DNA, 103 bp, Artificial Sequence
  Synthetic Polynucleotide
taatacgactcactatagggcaataacatcgtacttcatactcgagatccaacagaggagaggatctatggtatgaagtaacctggcggcagcgcaaaagatg

SEQ ID NO: 55500 - DNA, 103 bp, Artificial Sequence
  Synthetic Polynucleotide
taatacgactcactataggggtaaacaataacatcgtacttcatactcgaaacagaggagatcgagtatgaagtacgataacctggcggcagcgcaaaagatg

SEQ ID NO: 55501 - DNA, 103 bp, Artificial Sequence
  Synthetic Polynucleotide
taatacgactcactatagggtaccagtaaacaataacatcgtacttcataaacagaggagatatgaaatgcgatgttataacctggcggcagcgcaaaagatg

SEQ ID NO: 55502 - DNA, 103 bp, Artificial Sequence
  Synthetic Polynucleotide
taatacgactcactatagggagatataccagtaaacaataacatcgtactaacagaggagaagtacgatgttattgtttaacctggcggcagcgcaaaagatg

SEQ ID NO: 55503 - DNA, 103 bp, Artificial Sequence
  Synthetic Polynucleotide
taatacgactcactatagggtttccagatataccagtaaacaataacatcaacagaggagagatgttatggtttactggaacctggcggcagcgcaaaagatg

SEQ ID NO: 55504 - DNA, 103 bp, Artificial Sequence
  Synthetic Polynucleotide
taatacgactcactatagggcatcatccgaggatataatgttttctaaataacagaggagaatttagatgacattatataacctggcggcagcgcaaaagatg

SEQ ID NO: 55505 - DNA, 103 bp, Artificial Sequence
  Synthetic Polynucleotide
taatacgactcactatagggaattctttccagatataccagtaaacaataaacagaggagatattgtatgctggtatataacctggcggcagcgcaaaagatg

SEQ ID NO: 55506 - DNA, 103 bp, Artificial Sequence
  Synthetic Polynucleotide
taatacgactcactatagggggtagaattctttccagatataccagtaaaaacagaggagatttactatgatatctggaaacctggcggcagcgcaaaagatg

SEQ ID NO: 55507 - DNA, 103 bp, Artificial Sequence
  Synthetic Polynucleotide
taatacgactcactatagggagactggtagaattctttccagatataccaaacagaggagatggtatatgtggaaagaaaacctggcggcagcgcaaaagatg

SEQ ID NO: 55508 - DNA, 103 bp, Artificial Sequence
  Synthetic Polynucleotide
taatacgactcactatagggttcctagactggtagaattctttccagataaacagaggagatatctgatgagaattctaaacctggcggcagcgcaaaagatg

SEQ ID NO: 55509 - DNA, 103 bp, Artificial Sequence
  Synthetic Polynucleotide
taatacgactcactatagggtcttattcctagactggtagaattctttccaacagaggagaggaaagatgtctaccagtaacctggcggcagcgcaaaagatg

SEQ ID NO: 55510 - DNA, 103 bp, Artificial Sequence
  Synthetic Polynucleotide
taatacgactcactatagggcaatctcttattcctagactggtagaattcaacagaggagagaattcatgcagtctaggaacctggcggcagcgcaaaagatg

SEQ ID NO: 55511 - DNA, 103 bp, Artificial Sequence
  Synthetic Polynucleotide
taatacgactcactataggggatatcaatctcttattcctagactggtagaacagaggagactaccaatgtaggaataaaacctggcggcagcgcaaaagatg

SEQ ID NO: 55512 - DNA, 103 bp, Artificial Sequence
  Synthetic Polynucleotide
taatacgactcactatagggtatgcgatatcaatctcttattcctagactaacagaggagaagtctaatgataagagataacctggcggcagcgcaaaagatg

SEQ ID NO: 55513 - DNA, 103 bp, Artificial Sequence
  Synthetic Polynucleotide
taatacgactcactatagggatttctatgcgatatcaatctcttattcctaacagaggagaaggaatatgagattgataaacctggcggcagcgcaaaagatg

SEQ ID NO: 55514 - DNA, 103 bp, Artificial Sequence
  Synthetic Polynucleotide
taatacgactcactatagggtttgtatttctatgcgatatcaatctcttaaacagaggagataagagatggatatcgcaaacctggcggcagcgcaaaagatg

SEQ ID NO: 55515 - DNA, 103 bp, Artificial Sequence
  Synthetic Polynucleotide
taatacgactcactataggggataacatcatccgaggatataatgttttcaacagaggagagaaaacatgatatcctcgaacctggcggcagcgcaaaagatg

SEQ ID NO: 55516 - DNA, 103 bp, Artificial Sequence
  Synthetic Polynucleotide
taatacgactcactatagggtaacttttgtatttctatgcgatatcaatcaacagaggagagattgaatgcgcatagaaaacctggcggcagcgcaaaagatg

SEQ ID NO: 55517 - DNA, 103 bp, Artificial Sequence
  Synthetic Polynucleotide
taatacgactcactatagggattattaacttttgtatttctatgcgatataacagaggagaatatcgatgagaaatacaaacctggcggcagcgcaaaagatg

SEQ ID NO: 55518 - DNA, 103 bp, Artificial Sequence
  Synthetic Polynucleotide
taatacgactcactatagggatgagattattaacttttgtatttctatgcaacagaggagagcatagatgtacaaaagtaacctggcggcagcgcaaaagatg

SEQ ID NO: 55519 - DNA, 103 bp, Artificial Sequence
  Synthetic Polynucleotide
taatacgactcactatagggcgatgatgagattattaacttttgtatttcaacagaggagagaaataatgaagttaataaacctggcggcagcgcaaaagatg

SEQ ID NO: 55520 - DNA, 103 bp, Artificial Sequence
  Synthetic Polynucleotide
taatacgactcactatagggatcttcgatgatgagattattaacttttgtaacagaggagaacaaaaatgaataatctcaacctggcggcagcgcaaaagatg

SEQ ID NO: 55521 - DNA, 103 bp, Artificial Sequence
  Synthetic Polynucleotide
taatacgactcactataggggagtaatcttcgatgatgagattattaactaacagaggagaagttaaatgtctcatcataacctggcggcagcgcaaaagatg

SEQ ID NO: 55522 - DNA, 103 bp, Artificial Sequence
  Synthetic Polynucleotide
taatacgactcactatagggtaaccgagtaatcttcgatgatgagattataacagaggagaataatcatgtcatcgaagaacctggcggcagcgcaaaagatg

SEQ ID NO: 55523 - DNA, 103 bp, Artificial Sequence
  Synthetic Polynucleotide
taatacgactcactatagggaatggtaaccgagtaatcttcgatgatgagaacagaggagactcatcatggaagattacaacctggcggcagcgcaaaagatg

SEQ ID NO: 55524 - DNA, 103 bp, Artificial Sequence
  Synthetic Polynucleotide
taatacgactcactatagggattacaatggtaaccgagtaatcttcgatgaacagaggagacatcgaatgttactcggtaacctggcggcagcgcaaaagatg

SEQ ID NO: 55525 - DNA, 103 bp, Artificial Sequence
  Synthetic Polynucleotide
taatacgactcactatagggaatttattacaatggtaaccgagtaatcttaacagaggagaaagattatgcggttaccaaacctggcggcagcgcaaaagatg

SEQ ID NO: 55526 - DNA, 103 bp, Artificial Sequence
  Synthetic Polynucleotide
taatacgactcactatagggacagtgataacatcatccgaggatataatgaacagaggagacattatatgctcggatgaaacctggcggcagcgcaaaagatg

SEQ ID NO: 55527 - DNA, 103 bp, Artificial Sequence
  Synthetic Polynucleotide
taatacgactcactataggggtaccaatttattacaatggtaaccgagtaaacagaggagatactcgatgaccattgtaaacctggcggcagcgcaaaagatg

SEQ ID NO: 55528 - DNA, 103 bp, Artificial Sequence
  Synthetic Polynucleotide
taatacgactcactatagggatagagtaccaatttattacaatggtaaccaacagaggagaggttacatgtgtaataaaaacctggcggcagcgcaaaagatg

SEQ ID NO: 55529 - DNA, 103 bp, Artificial Sequence
  Synthetic Polynucleotide
taatacgactcactatagggttatgatagagtaccaatttattacaatggaacagaggagaccattgatgtaaattggtaacctggcggcagcgcaaaagatg

SEQ ID NO: 55530 - DNA, 103 bp, Artificial Sequence
  Synthetic Polynucleotide
taatacgactcactataggggacgattatgatagagtaccaatttattacaacagaggagagtaataatgtggtactctaacctggcggcagcgcaaaagatg

SEQ ID NO: 55531 - DNA, 103 bp, Artificial Sequence
  Synthetic Polynucleotide
taatacgactcactatagggttgtcgacgattatgatagagtaccaatttaacagaggagaaaattgatgctctatcataacctggcggcagcgcaaaagatg

SEQ ID NO: 55532 - DNA, 103 bp, Artificial Sequence
  Synthetic Polynucleotide
taatacgactcactataggggtactttgtcgacgattatgatagagtaccaacagaggagaggtactatgtcataatcgaacctggcggcagcgcaaaagatg

SEQ ID NO: 55533 - DNA, 103 bp, Artificial Sequence
  Synthetic Polynucleotide
taatacgactcactataggggaacagtactttgtcgacgattatgatagaaacagaggagatctatcatgatcgtcgacaacctggcggcagcgcaaaagatg

SEQ ID NO: 55534 - DNA, 103 bp, Artificial Sequence
  Synthetic Polynucleotide
taatacgactcactatagggtgtatgaacagtactttgtcgacgattatgaacagaggagacataatatgcgacaaagtaacctggcggcagcgcaaaagatg

SEQ ID NO: 55535 - DNA, 103 bp, Artificial Sequence
  Synthetic Polynucleotide
taatacgactcactatagggcatcatgtatgaacagtactttgtcgacgaaacagaggagatcgtcgatgaagtactgtaacctggcggcagcgcaaaagatg

SEQ ID NO: 55536 - DNA, 103 bp, Artificial Sequence
  Synthetic Polynucleotide
taatacgactcactatagggcatctcatcatgtatgaacagtactttgtcaacagaggagagacaaaatgctgttcataaacctggcggcagcgcaaaagatg

SEQ ID NO: 55537 - DNA, 103 bp, Artificial Sequence
  Synthetic Polynucleotide
taatacgactcactatagggcagaaacagtgataacatcatccgaggataaacagaggagatatcctatgatgatgttaaacctggcggcagcgcaaaagatg

SEQ ID NO: 55538 - DNA, 103 bp, Artificial Sequence
  Synthetic Polynucleotide
taatacgactcactatagggataaacatctcatcatgtatgaacagtactaacagaggagaagtactatgcatacatgaaacctggcggcagcgcaaaagatg

SEQ ID NO: 55539 - DNA, 103 bp, Artificial Sequence
  Synthetic Polynucleotide
taatacgactcactatagggaacatataaacatctcatcatgtatgaacaaacagaggagatgttcaatgatgatgagaaacctggcggcagcgcaaaagatg

SEQ ID NO: 55540 - DNA, 103 bp, Artificial Sequence
  Synthetic Polynucleotide
taatacgactcactatagggatgccaacatataaacatctcatcatgtataacagaggagaatacatatggagatgtttaacctggcggcagcgcaaaagatg

SEQ ID NO: 55541 - DNA, 103 bp, Artificial Sequence
  Synthetic Polynucleotide
taatacgactcactatagggctactatgccaacatataaacatctcatcaaacagaggagatgatgaatggtttatatgaacctggcggcagcgcaaaagatg

SEQ ID NO: 55542 - DNA, 103 bp, Artificial Sequence
  Synthetic Polynucleotide
taatacgactcactatagggtctcactactatgccaacatataaacatctaacagaggagaagatgtatgtatgttggcaacctggcggcagcgcaaaagatg

SEQ ID NO: 55543 - DNA, 103 bp, Artificial Sequence
  Synthetic Polynucleotide
taatacgactcactataggggtcgatctcactactatgccaacatataaaaacagaggagatttataatgtggcatagtaacctggcggcagcgcaaaagatg

SEQ ID NO: 55544 - DNA, 103 bp, Artificial Sequence
  Synthetic Polynucleotide
taatacgactcactatagggcaaacgtcgatctcactactatgccaacataacagaggagaatgttgatgtagtagtgaaacctggcggcagcgcaaaagatg

SEQ ID NO: 55545 - DNA, 103 bp, Artificial Sequence
  Synthetic Polynucleotide
taatacgactcactatagggattaccaaacgtcgatctcactactatgccaacagaggagaggcataatggtgagatcgaacctggcggcagcgcaaaagatg

SEQ ID NO: 55546 - DNA, 103 bp, Artificial Sequence
  Synthetic Polynucleotide
taatacgactcactatagggttgccattaccaaacgtcgatctcactactaacagaggagaagtagtatgatcgacgttaacctggcggcagcgcaaaagatg

SEQ ID NO: 55547 - DNA, 103 bp, Artificial Sequence
  Synthetic Polynucleotide
taatacgactcactatagggatacattgccattaccaaacgtcgatctcaaacagaggagatgagatatgcgtttggtaaacctggcggcagcgcaaaagatg

SEQ ID NO: 55548 - DNA, 103 bp, Artificial Sequence
  Synthetic Polynucleotide
taatacgactcactatagggtactccagaaacagtgataacatcatccgaaacagaggagatcggatatggttatcactaacctggcggcagcgcaaaagatg

SEQ ID NO: 55549 - DNA, 103 bp, Artificial Sequence
  Synthetic Polynucleotide
taatacgactcactatagggtcttaatacattgccattaccaaacgtcgaaacagaggagatcgacgatgggtaatggcaacctggcggcagcgcaaaagatg

SEQ ID NO: 55550 - DNA, 103 bp, Artificial Sequence
  Synthetic Polynucleotide
taatacgactcactataggggttaatcttaatacattgccattaccaaacaacagaggagagtttggatgtggcaatgtaacctggcggcagcgcaaaagatg

SEQ ID NO: 55551 - DNA, 103 bp, Artificial Sequence
  Synthetic Polynucleotide
taatacgactcactatagggatggagttaatcttaatacattgccattacaacagaggagagtaatgatgatgtattaaaacctggcggcagcgcaaaagatg

SEQ ID NO: 55552 - DNA, 103 bp, Artificial Sequence
  Synthetic Polynucleotide
taatacgactcactatagggacattatggagttaatcttaatacattgccaacagaggagaggcaatatgttaagattaaacctggcggcagcgcaaaagatg

SEQ ID NO: 55553 - DNA, 103 bp, Artificial Sequence
  Synthetic Polynucleotide
taatacgactcactataggggctagacattatggagttaatcttaatacaaacagaggagatgtattatgattaactccaacctggcggcagcgcaaaagatg

SEQ ID NO: 55554 - DNA, 103 bp, Artificial Sequence
  Synthetic Polynucleotide
taatacgactcactatagggatgctgctagacattatggagttaatcttaaacagaggagataagatatgctccataataacctggcggcagcgcaaaagatg

SEQ ID NO: 55555 - DNA, 103 bp, Artificial Sequence
  Synthetic Polynucleotide
taatacgactcactatagggcgcggatgctgctagacattatggagttaaaacagaggagattaactatgtaatgtctaaacctggcggcagcgcaaaagatg

SEQ ID NO: 55556 - DNA, 103 bp, Artificial Sequence
  Synthetic Polynucleotide
taatacgactcactataggggccatcgcggatgctgctagacattatggaaacagaggagatccataatgtctagcagcaacctggcggcagcgcaaaagatg

SEQ ID NO: 55557 - DNA, 103 bp, Artificial Sequence
  Synthetic Polynucleotide
taatacgactcactatagggcttatgccatcgcggatgctgctagacattaacagaggagaaatgtcatgcagcatccgaacctggcggcagcgcaaaagatg

SEQ ID NO: 55558 - DNA, 103 bp, Artificial Sequence
  Synthetic Polynucleotide
taatacgactcactatagggcaacacttatgccatcgcggatgctgctagaacagaggagactagcaatgtccgcgatgaacctggcggcagcgcaaaagatg

SEQ ID NO: 55559 - DNA, 103 bp, Artificial Sequence
  Synthetic Polynucleotide
taatacgactcactatagggtatcctactccagaaacagtgataacatcaaacagaggagatgatgtatgcactgtttcaacctggcggcagcgcaaaagatg

SEQ ID NO: 55560 - DNA, 103 bp, Artificial Sequence
  Synthetic Polynucleotide
taatacgactcactatagggtttgacaacacttatgccatcgcggatgctaacagaggagaagcatcatggatggcataaacctggcggcagcgcaaaagatg

SEQ ID NO: 55561 - DNA, 103 bp, Artificial Sequence
  Synthetic Polynucleotide
taatacgactcactatagggcccgctttgacaacacttatgccatcgcggaacagaggagaccgcgaatgcataagtgtaacctggcggcagcgcaaaagatg

SEQ ID NO: 55562 - DNA, 103 bp, Artificial Sequence
  Synthetic Polynucleotide
taatacgactcactatagggtcaaccccgctttgacaacacttatgccataacagaggagaatggcaatggtgttgtcaaacctggcggcagcgcaaaagatg

SEQ ID NO: 55563 - DNA, 103 bp, Artificial Sequence
  Synthetic Polynucleotide
taatacgactcactatagggcaagatcaaccccgctttgacaacacttataacagaggagaataagtatggtcaaagcgaacctggcggcagcgcaaaagatg

SEQ ID NO: 55564 - DNA, 103 bp, Artificial Sequence
  Synthetic Polynucleotide
taatacgactcactatagggcagcacaagatcaaccccgctttgacaacaaacagaggagatgttgtatgagcggggttaacctggcggcagcgcaaaagatg

SEQ ID NO: 55565 - DNA, 103 bp, Artificial Sequence
  Synthetic Polynucleotide
taatacgactcactatagggtataacagcacaagatcaaccccgctttgaaacagaggagatcaaagatgggttgatctaacctggcggcagcgcaaaagatg

SEQ ID NO: 55566 - DNA, 103 bp, Artificial Sequence
  Synthetic Polynucleotide
taatacgactcactatagggcaatatataacagcacaagatcaaccccgcaacagaggagagcggggatgatcttgtgcaacctggcggcagcgcaaaagatg

SEQ ID NO: 55567 - DNA, 103 bp, Artificial Sequence
  Synthetic Polynucleotide
taatacgactcactatagggttagacaatatataacagcacaagatcaacaacagaggagagttgatatggtgctgttaaacctggcggcagcgcaaaagatg

SEQ ID NO: 55568 - DNA, 103 bp, Artificial Sequence
  Synthetic Polynucleotide
taatacgactcactatagggaggtgttagacaatatataacagcacaagaaacagaggagatcttgtatggttatatataacctggcggcagcgcaaaagatg

SEQ ID NO: 55569 - DNA, 103 bp, Artificial Sequence
  Synthetic Polynucleotide
taatacgactcactatagggcttataggtgttagacaatatataacagcaaacagaggagatgctgtatgatattgtctaacctggcggcagcgcaaaagatg

SEQ ID NO: 55570 - DNA, 103 bp, Artificial Sequence
  Synthetic Polynucleotide
taatacgactcactatagggaacttatgtatattataatacaggcaggcaaacagaggagatgcctgatggtattataaaacctggcggcagcgcaaaagatg

SEQ ID NO: 55571 - DNA, 103 bp, Artificial Sequence
  Synthetic Polynucleotide
taatacgactcactatagggtaatatatcctactccagaaacagtgataaaacagaggagattatcaatgtttctggagaacctggcggcagcgcaaaagatg

SEQ ID NO: 55572 - DNA, 103 bp, Artificial Sequence
  Synthetic Polynucleotide
taatacgactcactatagggataatcttataggtgttagacaatatataaaacagaggagattatatatggtctaacacaacctggcggcagcgcaaaagatg

SEQ ID NO: 55573 - DNA, 103 bp, Artificial Sequence
  Synthetic Polynucleotide
taatacgactcactatagggttttgataatcttataggtgttagacaataaacagaggagatattgtatgacacctataaacctggcggcagcgcaaaagatg

SEQ ID NO: 55574 - DNA, 103 bp, Artificial Sequence
  Synthetic Polynucleotide
taatacgactcactatagggcaagattttgataatcttataggtgttagaaacagaggagatctaacatgtataagattaacctggcggcagcgcaaaagatg

SEQ ID NO: 55575 - DNA, 103 bp, Artificial Sequence
  Synthetic Polynucleotide
taatacgactcactataggggcagacaagattttgataatcttataggtgaacagaggagacacctaatggattatcaaaacctggcggcagcgcaaaagatg

SEQ ID NO: 55576 - DNA, 103 bp, Artificial Sequence
  Synthetic Polynucleotide
taatacgactcactatagggattaagcagacaagattttgataatcttataacagaggagaataagaatgtcaaaatctaacctggcggcagcgcaaaagatg

SEQ ID NO: 55577 - DNA, 103 bp, Artificial Sequence
  Synthetic Polynucleotide
taatacgactcactatagggggtgtattaagcagacaagattttgataataacagaggagaattatcatgatcttgtctaacctggcggcagcgcaaaagatg

SEQ ID NO: 55578 - DNA, 103 bp, Artificial Sequence
  Synthetic Polynucleotide
taatacgactcactatagggttaacggtgtattaagcagacaagattttgaacagaggagacaaaatatggtctgcttaaacctggcggcagcgcaaaagatg

SEQ ID NO: 55579 - DNA, 103 bp, Artificial Sequence
  Synthetic Polynucleotide
taatacgactcactatagggaattgttaacggtgtattaagcagacaagaaacagaggagatcttgtatgcttaatacaaacctggcggcagcgcaaaagatg

SEQ ID NO: 55580 - DNA, 103 bp, Artificial Sequence
  Synthetic Polynucleotide
taatacgactcactataggggcgaaaattgttaacggtgtattaagcagaaacagaggagatctgctatgtacaccgttaacctggcggcagcgcaaaagatg

SEQ ID NO: 55581 - DNA, 103 bp, Artificial Sequence
  Synthetic Polynucleotide
taatacgactcactatagggtcaaggcgaaaattgttaacggtgtattaaaacagaggagattaataatgcgttaacaaaacctggcggcagcgcaaaagatg

SEQ ID NO: 55582 - DNA, 103 bp, Artificial Sequence
  Synthetic Polynucleotide
taatacgactcactataggggactttaatatatcctactccagaaacagtaacagaggagaactgttatgggagtaggaaacctggcggcagcgcaaaagatg

SEQ ID NO: 55583 - DNA, 103 bp, Artificial Sequence
  Synthetic Polynucleotide
taatacgactcactatagggagaattcaaggcgaaaattgttaacggtgtaacagaggagaacaccgatgacaattttcaacctggcggcagcgcaaaagatg

SEQ ID NO: 55584 - DNA, 103 bp, Artificial Sequence
  Synthetic Polynucleotide
taatacgactcactatagggataaaagaattcaaggcgaaaattgttaacaacagaggagagttaacatgtttcgccttaacctggcggcagcgcaaaagatg

SEQ ID NO: 55585 - DNA, 103 bp, Artificial Sequence
  Synthetic Polynucleotide
taatacgactcactatagggcaccaataaaagaattcaaggcgaaaattgaacagaggagacaatttatgccttgaattaacctggcggcagcgcaaaagatg

SEQ ID NO: 55586 - DNA, 103 bp, Artificial Sequence
  Synthetic Polynucleotide
taatacgactcactatagggtaatgcaccaataaaagaattcaaggcgaaaacagaggagattcgccatgaattcttttaacctggcggcagcgcaaaagatg

SEQ ID NO: 55587 - DNA, 103 bp, Artificial Sequence
  Synthetic Polynucleotide
taatacgactcactataggggttattaatgcaccaataaaagaattcaagaacagaggagacttgaaatgttttattggaacctggcggcagcgcaaaagatg

SEQ ID NO: 55588 - DNA, 103 bp, Artificial Sequence
  Synthetic Polynucleotide
taatacgactcactatagggaggatgttattaatgcaccaataaaagaataacagaggagaattcttatgttggtgcataacctggcggcagcgcaaaagatg

SEQ ID NO: 55589 - DNA, 103 bp, Artificial Sequence
  Synthetic Polynucleotide
taatacgactcactatagggctataaggatgttattaatgcaccaataaaaacagaggagatttattatggcattaataaacctggcggcagcgcaaaagatg

SEQ ID NO: 55590 - DNA, 103 bp, Artificial Sequence
  Synthetic Polynucleotide
taatacgactcactatagggatcctctataaggatgttattaatgcaccaaacagaggagatggtgcatgaataacatcaacctggcggcagcgcaaaagatg

SEQ ID NO: 55591 - DNA, 103 bp, Artificial Sequence
  Synthetic Polynucleotide
taatacgactcactatagggttaacatcctctataaggatgttattaatgaacagaggagacattaaatgcatccttataacctggcggcagcgcaaaagatg

SEQ ID NO: 55592 - DNA, 103 bp, Artificial Sequence
  Synthetic Polynucleotide
taatacgactcactatagggtttgtttaacatcctctataaggatgttataacagaggagaataacaatgttatagaggaacctggcggcagcgcaaaagatg

SEQ ID NO: 55593 - DNA, 103 bp, Artificial Sequence
  Synthetic Polynucleotide
taatacgactcactataggggtaaagactttaatatatcctactccagaaaacagaggagattctggatgaggatatataacctggcggcagcgcaaaagatg

SEQ ID NO: 55594 - DNA, 103 bp, Artificial Sequence
  Synthetic Polynucleotide
taatacgactcactatagggacttatttgtttaacatcctctataaggataacagaggagaatccttatggaggatgttaacctggcggcagcgcaaaagatg

SEQ ID NO: 55595 - DNA, 103 bp, Artificial Sequence
  Synthetic Polynucleotide
taatacgactcactatagggataatacttatttgtttaacatcctctataaacagaggagatatagaatgtgttaaacaaacctggcggcagcgcaaaagatg

SEQ ID NO: 55596 - DNA, 103 bp, Artificial Sequence
  Synthetic Polynucleotide
taatacgactcactatagggctttgataatacttatttgtttaacatcctaacagaggagaaggatgatgaacaaataaaacctggcggcagcgcaaaagatg

SEQ ID NO: 55597 - DNA, 103 bp, Artificial Sequence
  Synthetic Polynucleotide
taatacgactcactatagggcttaactttgataatacttatttgtttaacaacagaggagagttaaaatgataagtattaacctggcggcagcgcaaaagatg

SEQ ID NO: 55598 - DNA, 103 bp, Artificial Sequence
  Synthetic Polynucleotide
taatacgactcactatagggcagatcttaactttgataatacttatttgtaacagaggagaacaaatatgtattatcaaaacctggcggcagcgcaaaagatg

SEQ ID NO: 55599 - DNA, 103 bp, Artificial Sequence
  Synthetic Polynucleotide
taatacgactcactatagggatacccagatcttaactttgataatacttaaacagaggagataagtaatgtcaaagttaaacctggcggcagcgcaaaagatg

SEQ ID NO: 55600 - DNA, 103 bp, Artificial Sequence
  Synthetic Polynucleotide
taatacgactcactatagggaagaaatacccagatcttaactttgataataacagaggagaattatcatggttaagatcaacctggcggcagcgcaaaagatg

SEQ ID NO: 55601 - DNA, 103 bp, Artificial Sequence
  Synthetic Polynucleotide
taatacgactcactatagggcagaaaagaaatacccagatcttaactttgaacagaggagacaaagtatggatctgggtaacctggcggcagcgcaaaagatg

SEQ ID NO: 55602 - DNA, 103 bp, Artificial Sequence
  Synthetic Polynucleotide
taatacgactcactatagggtctagcagaaaagaaatacccagatcttaaaacagaggagattaagaatggggtatttcaacctggcggcagcgcaaaagatg

SEQ ID NO: 55603 - DNA, 103 bp, Artificial Sequence
  Synthetic Polynucleotide
taatacgactcactataggggatgttctagcagaaaagaaatacccagataacagaggagaatctggatgtttcttttcaacctggcggcagcgcaaaagatg

SEQ ID NO: 55604 - DNA, 103 bp, Artificial Sequence
  Synthetic Polynucleotide
taatacgactcactatagggaatctgtaaagactttaatatatcctactcaacagaggagagagtagatgatattaaagaacctggcggcagcgcaaaagatg

SEQ ID NO: 55605 - DNA, 103 bp, Artificial Sequence
  Synthetic Polynucleotide
taatacgactcactatagggcaatggatgttctagcagaaaagaaataccaacagaggagaggtattatgtttctgctaaacctggcggcagcgcaaaagatg

SEQ ID NO: 55606 - DNA, 103 bp, Artificial Sequence
  Synthetic Polynucleotide
taatacgactcactatagggcgactcaatggatgttctagcagaaaagaaaacagaggagattctttatggctagaacaaacctggcggcagcgcaaaagatg

SEQ ID NO: 55607 - DNA, 103 bp, Artificial Sequence
  Synthetic Polynucleotide
taatacgactcactatagggggctccgactcaatggatgttctagcagaaaacagaggagattctgcatgaacatccataacctggcggcagcgcaaaagatg

SEQ ID NO: 55608 - DNA, 103 bp, Artificial Sequence
  Synthetic Polynucleotide
taatacgactcactatagggcagatggctccgactcaatggatgttctagaacagaggagactagaaatgccattgagtaacctggcggcagcgcaaaagatg

SEQ ID NO: 55609 - DNA, 103 bp, Artificial Sequence
  Synthetic Polynucleotide
taatacgactcactatagggtaaaccagatggctccgactcaatggatgtaacagaggagaacatccatggagtcggagaacctggcggcagcgcaaaagatg

SEQ ID NO: 55610 - DNA, 103 bp, Artificial Sequence
  Synthetic Polynucleotide
taatacgactcactatagggtatattaaaccagatggctccgactcaatgaacagaggagacattgaatgggagccatcaacctggcggcagcgcaaaagatg

SEQ ID NO: 55611 - DNA, 103 bp, Artificial Sequence
  Synthetic Polynucleotide
taatacgactcactataggggtggttatattaaaccagatggctccgactaacagaggagaagtcggatgcatctggttaacctggcggcagcgcaaaagatg

SEQ ID NO: 55612 - DNA, 103 bp, Artificial Sequence
  Synthetic Polynucleotide
taatacgactcactatagggtatcggtggttatattaaaccagatggctcaacagaggagagagccaatgggtttaataaacctggcggcagcgcaaaagatg

SEQ ID NO: 55613 - DNA, 103 bp, Artificial Sequence
  Synthetic Polynucleotide
taatacgactcactatagggagatttatcggtggttatattaaaccagataacagaggagaatctggatgaatataaccaacctggcggcagcgcaaaagatg

SEQ ID NO: 55614 - DNA, 103 bp, Artificial Sequence
  Synthetic Polynucleotide
taatacgactcactataggggagctagatttatcggtggttatattaaacaacagaggagagtttaaatgaaccaccgaaacctggcggcagcgcaaaagatg

SEQ ID NO: 55615 - DNA, 103 bp, Artificial Sequence
  Synthetic Polynucleotide
taatacgactcactataggggatgaaatctgtaaagactttaatatatccaacagaggagaggatatatgaaagtctttaacctggcggcagcgcaaaagatg

SEQ ID NO: 55616 - DNA, 103 bp, Artificial Sequence
  Synthetic Polynucleotide
taatacgactcactatagggatacagagctagatttatcggtggttatataacagaggagaatataaatgccgataaataacctggcggcagcgcaaaagatg

SEQ ID NO: 55617 - DNA, 103 bp, Artificial Sequence
  Synthetic Polynucleotide
taatacgactcactatagggacagaatacagagctagatttatcggtggtaacagaggagaaccaccatgaaatctagcaacctggcggcagcgcaaaagatg

SEQ ID NO: 55618 - DNA, 103 bp, Artificial Sequence
  Synthetic Polynucleotide
taatacgactcactatagggcggatacagaatacagagctagatttatcgaacagaggagacgataaatgtagctctgtaacctggcggcagcgcaaaagatg

SEQ ID NO: 55619 - DNA, 103 bp, Artificial Sequence
  Synthetic Polynucleotide
taatacgactcactatagggattgacggatacagaatacagagctagattaacagaggagaaatctaatgctgtattctaacctggcggcagcgcaaaagatg

SEQ ID NO: 55620 - DNA, 103 bp, Artificial Sequence
  Synthetic Polynucleotide
taatacgactcactatagggattagattgacggatacagaatacagagctaacagaggagaagctctatgttctgtatcaacctggcggcagcgcaaaagatg

SEQ ID NO: 55621 - DNA, 103 bp, Artificial Sequence
  Synthetic Polynucleotide
taatacgactcactatagggttaatattagattgacggatacagaatacaaacagaggagatgtattatgtatccgtcaaacctggcggcagcgcaaaagatg

SEQ ID NO: 55622 - DNA, 103 bp, Artificial Sequence
  Synthetic Polynucleotide
taatacgactcactatagggccttcttaatattagattgacggatacagaaacagaggagatctgtaatggtcaatctaaacctggcggcagcgcaaaagatg

SEQ ID NO: 55623 - DNA, 103 bp, Artificial Sequence
  Synthetic Polynucleotide
taatacgactcactatagggcaacaccttcttaatattagattgacggataacagaggagaatccgtatgtctaatattaacctggcggcagcgcaaaagatg

SEQ ID NO: 55624 - DNA, 103 bp, Artificial Sequence
  Synthetic Polynucleotide
taatacgactcactatagggtcactcaacaccttcttaatattagattgaaacagaggagatcaatcatgtattaagaaaacctggcggcagcgcaaaagatg

SEQ ID NO: 55625 - DNA, 103 bp, Artificial Sequence
  Synthetic Polynucleotide
taatacgactcactatagggacctttcactcaacaccttcttaatattagaacagaggagactaataatgagaaggtgtaacctggcggcagcgcaaaagatg

SEQ ID NO: 55626 - DNA, 103 bp, Artificial Sequence
  Synthetic Polynucleotide
taatacgactcactatagggaatcggatgaaatctgtaaagactttaataaacagaggagatattaaatgctttacagaaacctggcggcagcgcaaaagatg

SEQ ID NO: 55627 - DNA, 103 bp, Artificial Sequence
  Synthetic Polynucleotide
taatacgactcactatagggcttccacctttcactcaacaccttcttaataacagaggagaattaagatggtgttgagtaacctggcggcagcgcaaaagatg

SEQ ID NO: 55628 - DNA, 103 bp, Artificial Sequence
  Synthetic Polynucleotide
taatacgactcactatagggacgatcttccacctttcactcaacaccttcaacagaggagagaaggtatggagtgaaagaacctggcggcagcgcaaaagatg

SEQ ID NO: 55629 - DNA, 103 bp, Artificial Sequence
  Synthetic Polynucleotide
taatacgactcactatagggcttttacgatcttccacctttcactcaacaaacagaggagatgttgaatgaaaggtggaaacctggcggcagcgcaaaagatg

SEQ ID NO: 55630 - DNA, 103 bp, Artificial Sequence
  Synthetic Polynucleotide
taatacgactcactatagggcacagcttttacgatcttccacctttcactaacagaggagaagtgaaatgtggaagatcaacctggcggcagcgcaaaagatg

SEQ ID NO: 55631 - DNA, 103 bp, Artificial Sequence
  Synthetic Polynucleotide
taatacgactcactatagggatactcacagcttttacgatcttccaccttaacagaggagaaaggtgatggatcgtaaaaacctggcggcagcgcaaaagatg

SEQ ID NO: 55632 - DNA, 103 bp, Artificial Sequence
  Synthetic Polynucleotide
taatacgactcactatagggcattaatactcacagcttttacgatcttccaacagaggagaggaagaatgtaaaagctgaacctggcggcagcgcaaaagatg

SEQ ID NO: 55633 - DNA, 103 bp, Artificial Sequence
  Synthetic Polynucleotide
taatacgactcactatagggcctatcattaatactcacagcttttacgataacagaggagaatcgtaatggctgtgagtaacctggcggcagcgcaaaagatg

SEQ ID NO: 55634 - DNA, 103 bp, Artificial Sequence
  Synthetic Polynucleotide
taatacgactcactatagggctaaccctatcattaatactcacagcttttaacagaggagaaaaagcatggagtattaaaacctggcggcagcgcaaaagatg

SEQ ID NO: 55635 - DNA, 103 bp, Artificial Sequence
  Synthetic Polynucleotide
taatacgactcactatagggggaaactaaccctatcattaatactcacagaacagaggagactgtgaatgttaatgataaacctggcggcagcgcaaaagatg

SEQ ID NO: 55636 - DNA, 103 bp, Artificial Sequence
  Synthetic Polynucleotide
taatacgactcactatagggagttcggaaactaaccctatcattaatactaacagaggagaagtattatggatagggttaacctggcggcagcgcaaaagatg

SEQ ID NO: 55637 - DNA, 103 bp, Artificial Sequence
  Synthetic Polynucleotide
taatacgactcactatagggatttgaatcggatgaaatctgtaaagacttaacagaggagaaagtctatgcagatttcaaacctggcggcagcgcaaaagatg

SEQ ID NO: 55638 - DNA, 103 bp, Artificial Sequence
  Synthetic Polynucleotide
taatacgactcactatagggacattagttcggaaactaaccctatcattaaacagaggagataatgaatgggttagtttaacctggcggcagcgcaaaagatg

SEQ ID NO: 55639 - DNA, 103 bp, Artificial Sequence
  Synthetic Polynucleotide
taatacgactcactatagggaattaacattagttcggaaactaaccctataacagaggagaatagggatggtttccgaaaacctggcggcagcgcaaaagatg

SEQ ID NO: 55640 - DNA, 103 bp, Artificial Sequence
  Synthetic Polynucleotide
taatacgactcactatagggaccccaattaacattagttcggaaactaacaacagaggagagttagtatgcgaactaataacctggcggcagcgcaaaagatg

SEQ ID NO: 55641 - DNA, 103 bp, Artificial Sequence
  Synthetic Polynucleotide
taatacgactcactatagggttaataccccaattaacattagttcggaaaaacagaggagatttccgatgtaatgttaaaacctggcggcagcgcaaaagatg

SEQ ID NO: 55642 - DNA, 103 bp, Artificial Sequence
  Synthetic Polynucleotide
taatacgactcactatagggtattattaataccccaattaacattagttcaacagaggagagaactaatgttaattgggaacctggcggcagcgcaaaagatg

SEQ ID NO: 55643 - DNA, 103 bp, Artificial Sequence
  Synthetic Polynucleotide
taatacgactcactatagggatcgatattattaataccccaattaacattaacagaggagaaatgttatgtggggtattaacctggcggcagcgcaaaagatg

SEQ ID NO: 55644 - DNA, 103 bp, Artificial Sequence
  Synthetic Polynucleotide
taatacgactcactataggggaaatatcgatattattaataccccaattaaacagaggagataattgatgtattaataaaacctggcggcagcgcaaaagatg

SEQ ID NO: 55645 - DNA, 103 bp, Artificial Sequence
  Synthetic Polynucleotide
taatacgactcactatagggcgctggaaatatcgatattattaataccccaacagaggagaggggtaatgataatatcgaacctggcggcagcgcaaaagatg

SEQ ID NO: 55646 - DNA, 103 bp, Artificial Sequence
  Synthetic Polynucleotide
taatacgactcactatagggcttaacgctggaaatatcgatattattaataacagaggagaattaatatgatcgatattaacctggcggcagcgcaaaagatg

SEQ ID NO: 55647 - DNA, 103 bp, Artificial Sequence
  Synthetic Polynucleotide
taatacgactcactatagggttacacttaacgctggaaatatcgatattaaacagaggagataatatatgtatttccagaacctggcggcagcgcaaaagatg

SEQ ID NO: 55648 - DNA, 103 bp, Artificial Sequence
  Synthetic Polynucleotide
taatacgactcactataggggatttatttgaatcggatgaaatctgtaaaaacagaggagatttacaatgttcatccgaaacctggcggcagcgcaaaagatg

SEQ ID NO: 55649 - DNA, 103 bp, Artificial Sequence
  Synthetic Polynucleotide
taatacgactcactatagggtaatgttacacttaacgctggaaatatcgaaacagaggagatcgataatgccagcgttaaacctggcggcagcgcaaaagatg

SEQ ID NO: 55650 - DNA, 103 bp, Artificial Sequence
  Synthetic Polynucleotide
taatacgactcactatagggctgtttaatgttacacttaacgctggaaataacagaggagaatttccatggttaagtgtaacctggcggcagcgcaaaagatg

SEQ ID NO: 55651 - DNA, 103 bp, Artificial Sequence
  Synthetic Polynucleotide
taatacgactcactatagggtaaaactgtttaatgttacacttaacgctgaacagaggagacagcgtatggtgtaacataacctggcggcagcgcaaaagatg

SEQ ID NO: 55652 - DNA, 103 bp, Artificial Sequence
  Synthetic Polynucleotide
taatacgactcactatagggtgaattaaaactgtttaatgttacacttaaaacagaggagattaagtatgacattaaacaacctggcggcagcgcaaaagatg

SEQ ID NO: 55653 - DNA, 103 bp, Artificial Sequence
  Synthetic Polynucleotide
taatacgactcactatagggtcacgtgaattaaaactgtttaatgttacaaacagaggagatgtaacatgaaacagtttaacctggcggcagcgcaaaagatg

SEQ ID NO: 55654 - DNA, 103 bp, Artificial Sequence
  Synthetic Polynucleotide
taatacgactcactatagggccacgtcacgtgaattaaaactgtttaatgaacagaggagacattaaatggttttaattaacctggcggcagcgcaaaagatg

SEQ ID NO: 55655 - DNA, 103 bp, Artificial Sequence
  Synthetic Polynucleotide
taatacgactcactatagggtgataccacgtcacgtgaattaaaactgttaacagaggagaaacagtatgaattcacgtaacctggcggcagcgcaaaagatg

SEQ ID NO: 55656 - DNA, 103 bp, Artificial Sequence
  Synthetic Polynucleotide
taatacgactcactatagggttaattgataccacgtcacgtgaattaaaaaacagaggagattttaaatgacgtgacgtaacctggcggcagcgcaaaagatg

SEQ ID NO: 55657 - DNA, 103 bp, Artificial Sequence
  Synthetic Polynucleotide
taatacgactcactatagggattatttaattgataccacgtcacgtgaataacagaggagaattcacatgacgtggtataacctggcggcagcgcaaaagatg

SEQ ID NO: 55658 - DNA, 103 bp, Artificial Sequence
  Synthetic Polynucleotide
taatacgactcactatagggcattaattatttaattgataccacgtcacgaacagaggagacgtgacatggtatcaattaacctggcggcagcgcaaaagatg

SEQ ID NO: 55659 - DNA, 103 bp, Artificial Sequence
  Synthetic Polynucleotide
taatacgactcactatagggttagtgatttatttgaatcggatgaaatctaacagaggagaagatttatgccgattcaaaacctggcggcagcgcaaaagatg

SEQ ID NO: 55660 - DNA, 103 bp, Artificial Sequence
  Synthetic Polynucleotide
taatacgactcactatagggttgggcattaattatttaattgataccacgaacagaggagacgtggtatgaattaaataaacctggcggcagcgcaaaagatg

SEQ ID NO: 55661 - DNA, 103 bp, Artificial Sequence
  Synthetic Polynucleotide
taatacgactcactatagggccaaattgggcattaattatttaattgataaacagaggagatatcaaatgaataattaaaacctggcggcagcgcaaaagatg

SEQ ID NO: 55662 - DNA, 103 bp, Artificial Sequence
  Synthetic Polynucleotide
taatacgactcactatagggtatatccaaattgggcattaattatttaataacagaggagaattaaaatgttaatgcccaacctggcggcagcgcaaaagatg

SEQ ID NO: 55663 - DNA, 103 bp, Artificial Sequence
  Synthetic Polynucleotide
taatacgactcactataggggctgctatatccaaattgggcattaattataacagaggagaataattatggcccaatttaacctggcggcagcgcaaaagatg

SEQ ID NO: 55664 - DNA, 103 bp, Artificial Sequence
  Synthetic Polynucleotide
taatacgactcactatagggttcaggctgctatatccaaattgggcattaaacagaggagataatgcatgatttggataaacctggcggcagcgcaaaagatg

SEQ ID NO: 55665 - DNA, 103 bp, Artificial Sequence
  Synthetic Polynucleotide
taatacgactcactatagggtgagcttcaggctgctatatccaaattgggaacagaggagacccaatatggatatagcaaacctggcggcagcgcaaaagatg

SEQ ID NO: 55666 - DNA, 103 bp, Artificial Sequence
  Synthetic Polynucleotide
taatacgactcactatagggcaagatgagcttcaggctgctatatccaaaaacagaggagatttggaatgagcagcctgaacctggcggcagcgcaaaagatg

SEQ ID NO: 55667 - DNA, 103 bp, Artificial Sequence
  Synthetic Polynucleotide
taatacgactcactatagggctaaacaagatgagcttcaggctgctatataacagaggagaatatagatgcctgaagctaacctggcggcagcgcaaaagatg

SEQ ID NO: 55668 - DNA, 103 bp, Artificial Sequence
  Synthetic Polynucleotide
taatacgactcactatagggcgtaactaaacaagatgagcttcaggctgcaacagaggagagcagccatgagctcatctaacctggcggcagcgcaaaagatg

SEQ ID NO: 55669 - DNA, 103 bp, Artificial Sequence
  Synthetic Polynucleotide
taatacgactcactatagggggatccgtaactaaacaagatgagcttcagaacagaggagactgaagatgatcttgtttaacctggcggcagcgcaaaagatg

SEQ ID NO: 55670 - DNA, 103 bp, Artificial Sequence
  Synthetic Polynucleotide
taatacgactcactatagggattatttagtgatttatttgaatcggatgaaacagaggagatcatccatgtcaaataaaaacctggcggcagcgcaaaagatg

SEQ ID NO: 55671 - DNA, 103 bp, Artificial Sequence
  Synthetic Polynucleotide
taatacgactcactatagggcattaggatccgtaactaaacaagatgagcaacagaggagagctcatatggtttagttaaacctggcggcagcgcaaaagatg

SEQ ID NO: 55672 - DNA, 103 bp, Artificial Sequence
  Synthetic Polynucleotide
taatacgactcactatagggtaactcattaggatccgtaactaaacaagaaacagaggagatcttgtatggttacggataacctggcggcagcgcaaaagatg

SEQ ID NO: 55673 - DNA, 103 bp, Artificial Sequence
  Synthetic Polynucleotide
taatacgactcactatagggcttaataactcattaggatccgtaactaaaaacagaggagatttagtatgggatcctaaaacctggcggcagcgcaaaagatg

SEQ ID NO: 55674 - DNA, 103 bp, Artificial Sequence
  Synthetic Polynucleotide
taatacgactcactatagggtatttcttaataactcattaggatccgtaaaacagaggagattacggatgctaatgagtaacctggcggcagcgcaaaagatg

SEQ ID NO: 55675 - DNA, 103 bp, Artificial Sequence
  Synthetic Polynucleotide
taatacgactcactatagggtgatgtatttcttaataactcattaggatcaacagaggagagatcctatggagttattaaacctggcggcagcgcaaaagatg

SEQ ID NO: 55676 - DNA, 103 bp, Artificial Sequence
  Synthetic Polynucleotide
taatacgactcactatagggccgtttgatgtatttcttaataactcattaaacagaggagataatgaatgattaagaaaaacctggcggcagcgcaaaagatg

SEQ ID NO: 55677 - DNA, 103 bp, Artificial Sequence
  Synthetic Polynucleotide
taatacgactcactatagggttcatccgtttgatgtatttcttaataactaacagaggagaagttatatggaaatacataacctggcggcagcgcaaaagatg

SEQ ID NO: 55678 - DNA, 103 bp, Artificial Sequence
  Synthetic Polynucleotide
taatacgactcactatagggcttcgttcatccgtttgatgtatttcttaaaacagaggagattaagaatgacatcaaacaacctggcggcagcgcaaaagatg

SEQ ID NO: 55679 - DNA, 103 bp, Artificial Sequence
  Synthetic Polynucleotide
taatacgactcactatagggacaaccttcgttcatccgtttgatgtatttaacagaggagaaaatacatgaaacggatgaacctggcggcagcgcaaaagatg

SEQ ID NO: 55680 - DNA, 103 bp, Artificial Sequence
  Synthetic Polynucleotide
taatacgactcactatagggttaaaacaaccttcgttcatccgtttgatgaacagaggagacatcaaatggatgaacgaaacctggcggcagcgcaaaagatg

SEQ ID NO: 55681 - DNA, 103 bp, Artificial Sequence
  Synthetic Polynucleotide
taatacgactcactatagggctattaacttatgtatattataatacaggcaacagaggagagcctgtatgataatatacaacctggcggcagcgcaaaagatg

SEQ ID NO: 55682 - DNA, 103 bp, Artificial Sequence
  Synthetic Polynucleotide
taatacgactcactataggggggatattatttagtgatttatttgaatcgaacagaggagacgattcatgtaaatcactaacctggcggcagcgcaaaagatg

SEQ ID NO: 55683 - DNA, 103 bp, Artificial Sequence
  Synthetic Polynucleotide
taatacgactcactatagggccaacttaaaacaaccttcgttcatccgttaacagaggagaaacggaatgacgaaggttaacctggcggcagcgcaaaagatg

SEQ ID NO: 55684 - DNA, 103 bp, Artificial Sequence
  Synthetic Polynucleotide
taatacgactcactatagggtgtgaccaacttaaaacaaccttcgttcataacagaggagaatgaacatgggttgttttaacctggcggcagcgcaaaagatg

SEQ ID NO: 55685 - DNA, 103 bp, Artificial Sequence
  Synthetic Polynucleotide
taatacgactcactatagggaagtatgtgaccaacttaaaacaaccttcgaacagaggagacgaaggatgttttaagttaacctggcggcagcgcaaaagatg

SEQ ID NO: 55686 - DNA, 103 bp, Artificial Sequence
  Synthetic Polynucleotide
taatacgactcactatagggttacaaagtatgtgaccaacttaaaacaacaacagaggagagttgttatgagttggtcaaacctggcggcagcgcaaaagatg

SEQ ID NO: 55687 - DNA, 103 bp, Artificial Sequence
  Synthetic Polynucleotide
taatacgactcactatagggctagattacaaagtatgtgaccaacttaaaaacagaggagatttaagatggtcacatacaacctggcggcagcgcaaaagatg

SEQ ID NO: 55688 - DNA, 103 bp, Artificial Sequence
  Synthetic Polynucleotide
taatacgactcactatagggtatgtctagattacaaagtatgtgaccaacaacagaggagagttggtatgatactttgtaacctggcggcagcgcaaaagatg

SEQ ID NO: 55689 - DNA, 103 bp, Artificial Sequence
  Synthetic Polynucleotide
taatacgactcactataggggcatctatgtctagattacaaagtatgtgaaacagaggagatcacatatgttgtaatctaacctggcggcagcgcaaaagatg

SEQ ID NO: 55690 - DNA, 103 bp, Artificial Sequence
  Synthetic Polynucleotide
taatacgactcactatagggcttccgcatctatgtctagattacaaagtaaacagaggagatactttatgatctagacaaacctggcggcagcgcaaaagatg

SEQ ID NO: 55691 - DNA, 103 bp, Artificial Sequence
  Synthetic Polynucleotide
taatacgactcactatagggccgttcttccgcatctatgtctagattacaaacagaggagatgtaatatggacatagataacctggcggcagcgcaaaagatg

SEQ ID NO: 55692 - DNA, 103 bp, Artificial Sequence
  Synthetic Polynucleotide
taatacgactcactatagggttctaccgttcttccgcatctatgtctagaaacagaggagatctagaatgagatgcggaaacctggcggcagcgcaaaagatg

SEQ ID NO: 55693 - DNA, 103 bp, Artificial Sequence
  Synthetic Polynucleotide
taatacgactcactatagggaatgtgggatattatttagtgatttatttgaacagaggagacaaataatgcactaaataaacctggcggcagcgcaaaagatg

SEQ ID NO: 55694 - DNA, 103 bp, Artificial Sequence
  Synthetic Polynucleotide
taatacgactcactatagggatagtttctaccgttcttccgcatctatgtaacagaggagaacatagatgcggaagaacaacctggcggcagcgcaaaagatg

SEQ ID NO: 55695 - DNA, 103 bp, Artificial Sequence
  Synthetic Polynucleotide
taatacgactcactatagggttcgtatagtttctaccgttcttccgcatcaacagaggagagatgcgatggaacggtagaacctggcggcagcgcaaaagatg

SEQ ID NO: 55696 - DNA, 103 bp, Artificial Sequence
  Synthetic Polynucleotide
taatacgactcactatagggtctatttcgtatagtttctaccgttcttccaacagaggagaggaagaatggtagaaactaacctggcggcagcgcaaaagatg

SEQ ID NO: 55697 - DNA, 103 bp, Artificial Sequence
  Synthetic Polynucleotide
taatacgactcactataggggaatatctatttcgtatagtttctaccgttaacagaggagaaacggtatgaactatacgaacctggcggcagcgcaaaagatg

SEQ ID NO: 55698 - DNA, 103 bp, Artificial Sequence
  Synthetic Polynucleotide
taatacgactcactatagggactctgaatatctatttcgtatagtttctaaacagaggagatagaaaatgtacgaaataaacctggcggcagcgcaaaagatg

SEQ ID NO: 55699 - DNA, 103 bp, Artificial Sequence
  Synthetic Polynucleotide
taatacgactcactatagggagaggactctgaatatctatttcgtatagtaacagaggagaactataatgaatagatataacctggcggcagcgcaaaagatg

SEQ ID NO: 55700 - DNA, 103 bp, Artificial Sequence
  Synthetic Polynucleotide
taatacgactcactatagggcaattagaggactctgaatatctatttcgtaacagaggagaacgaaaatgatattcagaaacctggcggcagcgcaaaagatg

SEQ ID NO: 55701 - DNA, 103 bp, Artificial Sequence
  Synthetic Polynucleotide
taatacgactcactatagggttgatcaattagaggactctgaatatctataacagaggagaatagatatgcagagtcctaacctggcggcagcgcaaaagatg

SEQ ID NO: 55702 - DNA, 103 bp, Artificial Sequence
  Synthetic Polynucleotide
taatacgactcactatagggtactcttgatcaattagaggactctgaataaacagaggagatattcaatgtcctctaataacctggcggcagcgcaaaagatg

SEQ ID NO: 55703 - DNA, 103 bp, Artificial Sequence
  Synthetic Polynucleotide
taatacgactcactatagggatagttactcttgatcaattagaggactctaacagaggagaagagtcatgtaattgatcaacctggcggcagcgcaaaagatg

SEQ ID NO: 55704 - DNA, 103 bp, Artificial Sequence
  Synthetic Polynucleotide
taatacgactcactatagggatgacaatgtgggatattatttagtgatttaacagaggagaaaatcaatgaataatatcaacctggcggcagcgcaaaagatg

SEQ ID NO: 55705 - DNA, 103 bp, Artificial Sequence
  Synthetic Polynucleotide
taatacgactcactatagggagtcaatagttactcttgatcaattagaggaacagaggagacctctaatggatcaagagaacctggcggcagcgcaaaagatg

SEQ ID NO: 55706 - DNA, 103 bp, Artificial Sequence
  Synthetic Polynucleotide
taatacgactcactatagggtattaagtcaatagttactcttgatcaattaacagaggagaaattgaatgagagtaactaacctggcggcagcgcaaaagatg

SEQ ID NO: 55707 - DNA, 103 bp, Artificial Sequence
  Synthetic Polynucleotide
taatacgactcactatagggatgcctattaagtcaatagttactcttgataacagaggagaatcaagatgaactattgaaacctggcggcagcgcaaaagatg

SEQ ID NO: 55708 - DNA, 103 bp, Artificial Sequence
  Synthetic Polynucleotide
taatacgactcactatagggaaatgatgcctattaagtcaatagttactcaacagaggagagagtaaatgttgacttaaaacctggcggcagcgcaaaagatg

SEQ ID NO: 55709 - DNA, 103 bp, Artificial Sequence
  Synthetic Polynucleotide
taatacgactcactatagggtaaataaatgatgcctattaagtcaatagtaacagaggagaactattatgttaataggcaacctggcggcagcgcaaaagatg

SEQ ID NO: 55710 - DNA, 103 bp, Artificial Sequence
  Synthetic Polynucleotide
taatacgactcactatagggaatactaaataaatgatgcctattaagtcaaacagaggagatgacttatgaggcatcataacctggcggcagcgcaaaagatg

SEQ ID NO: 55711 - DNA, 103 bp, Artificial Sequence
  Synthetic Polynucleotide
taatacgactcactatagggcatttaatactaaataaatgatgcctattaaacagaggagataatagatgtcatttattaacctggcggcagcgcaaaagatg

SEQ ID NO: 55712 - DNA, 103 bp, Artificial Sequence
  Synthetic Polynucleotide
taatacgactcactataggggtcgtcatttaatactaaataaatgatgccaacagaggagaggcatcatgtatttagtaaacctggcggcagcgcaaaagatg

SEQ ID NO: 55713 - DNA, 103 bp, Artificial Sequence
  Synthetic Polynucleotide
taatacgactcactataggggtacggtcgtcatttaatactaaataaatgaacagaggagacatttaatgagtattaaaaacctggcggcagcgcaaaagatg

SEQ ID NO: 55714 - DNA, 103 bp, Artificial Sequence
  Synthetic Polynucleotide
taatacgactcactatagggcactggtacggtcgtcatttaatactaaataacagaggagaatttagatgtaaatgacgaacctggcggcagcgcaaaagatg

SEQ ID NO: 55715 - DNA, 103 bp, Artificial Sequence
  Synthetic Polynucleotide
taatacgactcactatagggaacagatgacaatgtgggatattatttagtaacagaggagaactaaaatgtatcccacaaacctggcggcagcgcaaaagatg

SEQ ID NO: 55716 - DNA, 103 bp, Artificial Sequence
  Synthetic Polynucleotide
taatacgactcactatagggtctgtcactggtacggtcgtcatttaatacaacagaggagagtattaatggacgaccgtaacctggcggcagcgcaaaagatg

SEQ ID NO: 55717 - DNA, 103 bp, Artificial Sequence
  Synthetic Polynucleotide
taatacgactcactataggggtatatctgtcactggtacggtcgtcatttaacagaggagaaaatgaatgccgtaccagaacctggcggcagcgcaaaagatg

SEQ ID NO: 55718 - DNA, 103 bp, Artificial Sequence
  Synthetic Polynucleotide
taatacgactcactataggggttttgtatatctgtcactggtacggtcgtaacagaggagaacgaccatgccagtgacaaacctggcggcagcgcaaaagatg

SEQ ID NO: 55719 - DNA, 103 bp, Artificial Sequence
  Synthetic Polynucleotide
taatacgactcactatagggaagtcgttttgtatatctgtcactggtacgaacagaggagacgtaccatggacagatataacctggcggcagcgcaaaagatg

SEQ ID NO: 55720 - DNA, 103 bp, Artificial Sequence
  Synthetic Polynucleotide
taatacgactcactatagggtaattaagtcgttttgtatatctgtcactgaacagaggagacagtgaatgatatacaaaaacctggcggcagcgcaaaagatg

SEQ ID NO: 55721 - DNA, 103 bp, Artificial Sequence
  Synthetic Polynucleotide
taatacgactcactatagggctctgtaattaagtcgttttgtatatctgtaacagaggagaacagatatgcaaaacgacaacctggcggcagcgcaaaagatg

SEQ ID NO: 55722 - DNA, 103 bp, Artificial Sequence
  Synthetic Polynucleotide
taatacgactcactataggggaaaactctgtaattaagtcgttttgtataaacagaggagatatacaatgcgacttaataacctggcggcagcgcaaaagatg

SEQ ID NO: 55723 - DNA, 103 bp, Artificial Sequence
  Synthetic Polynucleotide
taatacgactcactatagggcttctgaaaactctgtaattaagtcgttttaacagaggagaaaaacgatgtaattacagaacctggcggcagcgcaaaagatg

SEQ ID NO: 55724 - DNA, 103 bp, Artificial Sequence
  Synthetic Polynucleotide
taatacgactcactatagggattatcttctgaaaactctgtaattaagtcaacagaggagagacttaatgacagagtttaacctggcggcagcgcaaaagatg

SEQ ID NO: 55725 - DNA, 103 bp, Artificial Sequence
  Synthetic Polynucleotide
taatacgactcactatagggggataattatcttctgaaaactctgtaattaacagaggagaaattacatggttttcagaaacctggcggcagcgcaaaagatg

SEQ ID NO: 55726 - DNA, 103 bp, Artificial Sequence
  Synthetic Polynucleotide
taatacgactcactatagggactctaacagatgacaatgtgggatattataacagaggagaataataatgcacattgtcaacctggcggcagcgcaaaagatg

SEQ ID NO: 55727 - DNA, 103 bp, Artificial Sequence
  Synthetic Polynucleotide
taatacgactcactatagggtagatggataattatcttctgaaaactctgaacagaggagacagagtatgcagaagataaacctggcggcagcgcaaaagatg

SEQ ID NO: 55728 - DNA, 103 bp, Artificial Sequence
  Synthetic Polynucleotide
taatacgactcactatagggtttgttagatggataattatcttctgaaaaaacagaggagattttcaatggataattataacctggcggcagcgcaaaagatg

SEQ ID NO: 55729 - DNA, 103 bp, Artificial Sequence
  Synthetic Polynucleotide
taatacgactcactatagggtaatttttgttagatggataattatcttctaacagaggagaagaagaatgttatccatcaacctggcggcagcgcaaaagatg

SEQ ID NO: 55730 - DNA, 103 bp, Artificial Sequence
  Synthetic Polynucleotide
taatacgactcactatagggtttcataatttttgttagatggataattataacagaggagaataattatgcatctaacaaacctggcggcagcgcaaaagatg

SEQ ID NO: 55731 - DNA, 103 bp, Artificial Sequence
  Synthetic Polynucleotide
taatacgactcactatagggagttatttcataatttttgttagatggataaacagaggagatatccaatgaacaaaaataacctggcggcagcgcaaaagatg

SEQ ID NO: 55732 - DNA, 103 bp, Artificial Sequence
  Synthetic Polynucleotide
taatacgactcactatagggcgaagagttatttcataatttttgttagataacagaggagaatctaaatgaaattatgaaacctggcggcagcgcaaaagatg

SEQ ID NO: 55733 - DNA, 103 bp, Artificial Sequence
  Synthetic Polynucleotide
taatacgactcactatagggtttgacgaagagttatttcataatttttgtaacagaggagaacaaaaatgatgaaataaaacctggcggcagcgcaaaagatg

SEQ ID NO: 55734 - DNA, 103 bp, Artificial Sequence
  Synthetic Polynucleotide
taatacgactcactatagggagacatttgacgaagagttatttcataattaacagaggagaaattatatgataactcttaacctggcggcagcgcaaaagatg

SEQ ID NO: 55735 - DNA, 103 bp, Artificial Sequence
  Synthetic Polynucleotide
taatacgactcactatagggagaatagacatttgacgaagagttatttcaaacagaggagatgaaatatgtcttcgtcaaacctggcggcagcgcaaaagatg

SEQ ID NO: 55736 - DNA, 103 bp, Artificial Sequence
  Synthetic Polynucleotide
taatacgactcactataggggagttagaatagacatttgacgaagagttaaacagaggagataactcatggtcaaatgtaacctggcggcagcgcaaaagatg

SEQ ID NO: 55737 - DNA, 103 bp, Artificial Sequence
  Synthetic Polynucleotide
taatacgactcactatagggatactactctaacagatgacaatgtgggataacagaggagaatcccaatgtgtcatctgaacctggcggcagcgcaaaagatg

SEQ ID NO: 55738 - DNA, 103 bp, Artificial Sequence
  Synthetic Polynucleotide
taatacgactcactatagggaacgtgagttagaatagacatttgacgaagaacagaggagacttcgtatgatgtctattaacctggcggcagcgcaaaagatg

SEQ ID NO: 55739 - DNA, 103 bp, Artificial Sequence
  Synthetic Polynucleotide
taatacgactcactatagggttattaacgtgagttagaatagacatttgaaacagaggagatcaaatatgtattctaacaacctggcggcagcgcaaaagatg

SEQ ID NO: 55740 - DNA, 103 bp, Artificial Sequence
  Synthetic Polynucleotide
taatacgactcactatagggccacgttattaacgtgagttagaatagacaaacagaggagatgtctaatgtaactcacgaacctggcggcagcgcaaaagatg

SEQ ID NO: 55741 - DNA, 103 bp, Artificial Sequence
  Synthetic Polynucleotide
taatacgactcactatagggatctaccacgttattaacgtgagttagaataacagaggagaattctaatgcacgttaataacctggcggcagcgcaaaagatg

SEQ ID NO: 55742 - DNA, 103 bp, Artificial Sequence
  Synthetic Polynucleotide
taatacgactcactatagggtctctatctaccacgttattaacgtgagttaacagaggagaaactcaatgtaataacgtaacctggcggcagcgcaaaagatg

SEQ ID NO: 55743 - DNA, 103 bp, Artificial Sequence
  Synthetic Polynucleotide
taatacgactcactatagggtatgttctctatctaccacgttattaacgtaacagaggagaacgttaatgacgtggtagaacctggcggcagcgcaaaagatg

SEQ ID NO: 55744 - DNA, 103 bp, Artificial Sequence
  Synthetic Polynucleotide
taatacgactcactatagggggcattatgttctctatctaccacgttattaacagaggagaaataacatggtagatagaaacctggcggcagcgcaaaagatg

SEQ ID NO: 55745 - DNA, 103 bp, Artificial Sequence
  Synthetic Polynucleotide
taatacgactcactatagggacggcggcattatgttctctatctaccacgaacagaggagacgtggtatgtagagaacaaacctggcggcagcgcaaaagatg

SEQ ID NO: 55746 - DNA, 103 bp, Artificial Sequence
  Synthetic Polynucleotide
taatacgactcactatagggacactacggcggcattatgttctctatctaaacagaggagatagataatgaacataatgaacctggcggcagcgcaaaagatg

SEQ ID NO: 55747 - DNA, 103 bp, Artificial Sequence
  Synthetic Polynucleotide
taatacgactcactatagggagatgacactacggcggcattatgttctctaacagaggagaagagaaatgaatgccgccaacctggcggcagcgcaaaagatg

SEQ ID NO: 55748 - DNA, 103 bp, Artificial Sequence
  Synthetic Polynucleotide
taatacgactcactatagggtaatgatactactctaacagatgacaatgtaacagaggagaacattgatgtctgttagaaacctggcggcagcgcaaaagatg

SEQ ID NO: 55749 - DNA, 103 bp, Artificial Sequence
  Synthetic Polynucleotide
taatacgactcactatagggtctggagatgacactacggcggcattatgtaacagaggagaacataaatgcgccgtagtaacctggcggcagcgcaaaagatg

SEQ ID NO: 55750 - DNA, 103 bp, Artificial Sequence
  Synthetic Polynucleotide
taatacgactcactatagggtttcctctggagatgacactacggcggcataacagaggagaatgccgatgtagtgtcataacctggcggcagcgcaaaagatg

SEQ ID NO: 55751 - DNA, 103 bp, Artificial Sequence
  Synthetic Polynucleotide
taatacgactcactatagggtgatatttcctctggagatgacactacggcaacagaggagagccgtaatgtcatctccaaacctggcggcagcgcaaaagatg

SEQ ID NO: 55752 - DNA, 103 bp, Artificial Sequence
  Synthetic Polynucleotide
taatacgactcactatagggtgtgatgatatttcctctggagatgacactaacagaggagaagtgtcatgtccagaggaaacctggcggcagcgcaaaagatg

SEQ ID NO: 55753 - DNA, 103 bp, Artificial Sequence
  Synthetic Polynucleotide
taatacgactcactatagggtaagttgtgatgatatttcctctggagatgaacagaggagacatctcatgaggaaatataacctggcggcagcgcaaaagatg

SEQ ID NO: 55754 - DNA, 103 bp, Artificial Sequence
  Synthetic Polynucleotide
taatacgactcactatagggttcattaagttgtgatgatatttcctctggaacagaggagaccagagatgatatcatcaaacctggcggcagcgcaaaagatg

SEQ ID NO: 55755 - DNA, 103 bp, Artificial Sequence
  Synthetic Polynucleotide
taatacgactcactatagggaaatcttcattaagttgtgatgatatttccaacagaggagaggaaatatgatcacaactaacctggcggcagcgcaaaagatg

SEQ ID NO: 55756 - DNA, 103 bp, Artificial Sequence
  Synthetic Polynucleotide
taatacgactcactataggggaaataaatcttcattaagttgtgatgataaacagaggagatatcatatgaacttaatgaacctggcggcagcgcaaaagatg

SEQ ID NO: 55757 - DNA, 103 bp, Artificial Sequence
  Synthetic Polynucleotide
taatacgactcactataggggtctggaaataaatcttcattaagttgtgaaacagaggagatcacaaatgaatgaagataacctggcggcagcgcaaaagatg

SEQ ID NO: 55758 - DNA, 103 bp, Artificial Sequence
  Synthetic Polynucleotide
taatacgactcactatagggtcatcgtctggaaataaatcttcattaagtaacagaggagaacttaaatgagatttattaacctggcggcagcgcaaaagatg

SEQ ID NO: 55759 - DNA, 103 bp, Artificial Sequence
  Synthetic Polynucleotide
taatacgactcactatagggagatttaatgatactactctaacagatgacaacagaggagagtcatcatgtagagtagtaacctggcggcagcgcaaaagatg

SEQ ID NO: 55760 - DNA, 103 bp, Artificial Sequence
  Synthetic Polynucleotide
taatacgactcactataggggagaatcatcgtctggaaataaatcttcataacagaggagaatgaagatgtatttccagaacctggcggcagcgcaaaagatg

SEQ ID NO: 55761 - DNA, 103 bp, Artificial Sequence
  Synthetic Polynucleotide
taatacgactcactatagggggccggagaatcatcgtctggaaataaatcaacagaggagagatttaatgccagacgataacctggcggcagcgcaaaagatg

SEQ ID NO: 55762 - DNA, 103 bp, Artificial Sequence
  Synthetic Polynucleotide
taatacgactcactatagggatagtggccggagaatcatcgtctggaaataacagaggagaatttccatgcgatgattcaacctggcggcagcgcaaaagatg

SEQ ID NO: 55763 - DNA, 103 bp, Artificial Sequence
  Synthetic Polynucleotide
taatacgactcactatagggcaataatagtggccggagaatcatcgtctgaacagaggagacagacgatgattctccggaacctggcggcagcgcaaaagatg

SEQ ID NO: 55764 - DNA, 103 bp, Artificial Sequence
  Synthetic Polynucleotide
taatacgactcactatagggtctttcaataatagtggccggagaatcatcaacagaggagagatgatatgccggccactaacctggcggcagcgcaaaagatg

SEQ ID NO: 55765 - DNA, 103 bp, Artificial Sequence
  Synthetic Polynucleotide
taatacgactcactatagggtgtactctttcaataatagtggccggagaaaacagaggagattctccatgcactattataacctggcggcagcgcaaaagatg

SEQ ID NO: 55766 - DNA, 103 bp, Artificial Sequence
  Synthetic Polynucleotide
taatacgactcactataggggttgttgtactctttcaataatagtggccgaacagaggagacggccaatgttattgaaaaacctggcggcagcgcaaaagatg

SEQ ID NO: 55767 - DNA, 103 bp, Artificial Sequence
  Synthetic Polynucleotide
taatacgactcactatagggatgcggttgttgtactctttcaataatagtaacagaggagaactattatggaaagagtaaacctggcggcagcgcaaaagatg

SEQ ID NO: 55768 - DNA, 103 bp, Artificial Sequence
  Synthetic Polynucleotide
taatacgactcactataggggtagtatgcggttgttgtactctttcaataaacagaggagatattgaatgagtacaacaaacctggcggcagcgcaaaagatg

SEQ ID NO: 55769 - DNA, 103 bp, Artificial Sequence
  Synthetic Polynucleotide
taatacgactcactatagggtaatagtagtatgcggttgttgtactctttaacagaggagaaaagagatgaacaaccgcaacctggcggcagcgcaaaagatg

SEQ ID NO: 55770 - DNA, 103 bp, Artificial Sequence
  Synthetic Polynucleotide
taatacgactcactatagggataatagatttaatgatactactctaacagaacagaggagactgttaatgtagtatcataacctggcggcagcgcaaaagatg

SEQ ID NO: 55771 - DNA, 103 bp, Artificial Sequence
  Synthetic Polynucleotide
taatacgactcactataggggtcaataatagtagtatgcggttgttgtacaacagaggagagtacaaatgccgcatactaacctggcggcagcgcaaaagatg

SEQ ID NO: 55772 - DNA, 103 bp, Artificial Sequence
  Synthetic Polynucleotide
taatacgactcactataggggtatcgtcaataatagtagtatgcggttgtaacagaggagaacaaccatgtactactataacctggcggcagcgcaaaagatg

SEQ ID NO: 55773 - DNA, 103 bp, Artificial Sequence
  Synthetic Polynucleotide
taatacgactcactataggggtggcgtatcgtcaataatagtagtatgcgaacagaggagacgcataatgctattattgaacctggcggcagcgcaaaagatg

SEQ ID NO: 55774 - DNA, 103 bp, Artificial Sequence
  Synthetic Polynucleotide
taatacgactcactatagggaggaggtggcgtatcgtcaataatagtagtaacagaggagaactactatgattgacgataacctggcggcagcgcaaaagatg

SEQ ID NO: 55775 - DNA, 103 bp, Artificial Sequence
  Synthetic Polynucleotide
taatacgactcactatagggaacgtaggaggtggcgtatcgtcaataataaacagaggagatattatatgcgatacgccaacctggcggcagcgcaaaagatg

SEQ ID NO: 55776 - DNA, 103 bp, Artificial Sequence
  Synthetic Polynucleotide
taatacgactcactatagggtacgaaacgtaggaggtggcgtatcgtcaaaacagaggagattgacgatgcgccacctcaacctggcggcagcgcaaaagatg

SEQ ID NO: 55777 - DNA, 103 bp, Artificial Sequence
  Synthetic Polynucleotide
taatacgactcactatagggctctctacgaaacgtaggaggtggcgtatcaacagaggagagatacgatgcctcctacgaacctggcggcagcgcaaaagatg

SEQ ID NO: 55778 - DNA, 103 bp, Artificial Sequence
  Synthetic Polynucleotide
taatacgactcactatagggaataactctctacgaaacgtaggaggtggcaacagaggagagccaccatgtacgtttcgaacctggcggcagcgcaaaagatg

SEQ ID NO: 55779 - DNA, 103 bp, Artificial Sequence
  Synthetic Polynucleotide
taatacgactcactatagggatatcaataactctctacgaaacgtaggagaacagaggagactcctaatgttcgtagagaacctggcggcagcgcaaaagatg

SEQ ID NO: 55780 - DNA, 103 bp, Artificial Sequence
  Synthetic Polynucleotide
taatacgactcactatagggttccgatatcaataactctctacgaaacgtaacagaggagaacgtttatgagagagttaaacctggcggcagcgcaaaagatg

SEQ ID NO: 55781 - DNA, 103 bp, Artificial Sequence
  Synthetic Polynucleotide
taatacgactcactatagggaaaatataatagatttaatgatactactctaacagaggagaagagtaatgtcattaaataacctggcggcagcgcaaaagatg

SEQ ID NO: 55782 - DNA, 103 bp, Artificial Sequence
  Synthetic Polynucleotide
taatacgactcactatagggcgttgttccgatatcaataactctctacgaaacagaggagatcgtagatggttattgataacctggcggcagcgcaaaagatg

SEQ ID NO: 55783 - DNA, 103 bp, Artificial Sequence
  Synthetic Polynucleotide
taatacgactcactataggggctgacgttgttccgatatcaataactctcaacagaggagagagagtatgtgatatcggaacctggcggcagcgcaaaagatg

SEQ ID NO: 55784 - DNA, 103 bp, Artificial Sequence
  Synthetic Polynucleotide
taatacgactcactatagggtcgttgctgacgttgttccgatatcaataaaacagaggagattattgatgtcggaacaaaacctggcggcagcgcaaaagatg

SEQ ID NO: 55785 - DNA, 103 bp, Artificial Sequence
  Synthetic Polynucleotide
taatacgactcactatagggttttctcgttgctgacgttgttccgatatcaacagaggagagatatcatgacaacgtcaaacctggcggcagcgcaaaagatg

SEQ ID NO: 55786 - DNA, 103 bp, Artificial Sequence
  Synthetic Polynucleotide
taatacgactcactatagggatcttttttctcgttgctgacgttgttccgaacagaggagacggaacatggtcagcaacaacctggcggcagcgcaaaagatg

SEQ ID NO: 55787 - DNA, 103 bp, Artificial Sequence
  Synthetic Polynucleotide
taatacgactcactatagggattaaatcttttttctcgttgctgacgttgaacagaggagacaacgtatgcaacgagaaaacctggcggcagcgcaaaagatg

SEQ ID NO: 55788 - DNA, 103 bp, Artificial Sequence
  Synthetic Polynucleotide
taatacgactcactataggggtaatattaaatcttttttctcgttgctgaaacagaggagatcagcaatgagaaaaaagaacctggcggcagcgcaaaagatg

SEQ ID NO: 55789 - DNA, 103 bp, Artificial Sequence
  Synthetic Polynucleotide
taatacgactcactatagggataccgtaatattaaatcttttttctcgttaacagaggagaaacgagatgaaagatttaaacctggcggcagcgcaaaagatg

SEQ ID NO: 55790 - DNA, 103 bp, Artificial Sequence
  Synthetic Polynucleotide
taatacgactcactatagggttttgataccgtaatattaaatcttttttcaacagaggagagaaaaaatgtttaatattaacctggcggcagcgcaaaagatg

SEQ ID NO: 55791 - DNA, 103 bp, Artificial Sequence
  Synthetic Polynucleotide
taatacgactcactataggggcattttttgataccgtaatattaaatcttaacagaggagaaagattatgtattacggtaacctggcggcagcgcaaaagatg

SEQ ID NO: 55792 - DNA, 103 bp, Artificial Sequence
  Synthetic Polynucleotide
taatacgactcactatagggaaaaactattaacttatgtatattataataaacagaggagatattatatgatacataagaacctggcggcagcgcaaaagatg

SEQ ID NO: 55793 - DNA, 103 bp, Artificial Sequence
  Synthetic Polynucleotide
taatacgactcactatagggttcataaaatataatagatttaatgatactaacagaggagaagtatcatgaaatctattaacctggcggcagcgcaaaagatg

SEQ ID NO: 55794 - DNA, 103 bp, Artificial Sequence
  Synthetic Polynucleotide
taatacgactcactatagggcttcggcattttttgataccgtaatattaaaacagaggagattaataatgcggtatcaaaacctggcggcagcgcaaaagatg

SEQ ID NO: 55795 - DNA, 103 bp, Artificial Sequence
  Synthetic Polynucleotide
taatacgactcactatagggtatcgcttcggcattttttgataccgtaataacagaggagaattacgatgtcaaaaaataacctggcggcagcgcaaaagatg

SEQ ID NO: 55796 - DNA, 103 bp, Artificial Sequence
  Synthetic Polynucleotide
taatacgactcactatagggtccattatcgcttcggcattttttgataccaacagaggagaggtatcatgaaatgccgaaacctggcggcagcgcaaaagatg

SEQ ID NO: 55797 - DNA, 103 bp, Artificial Sequence
  Synthetic Polynucleotide
taatacgactcactatagggtagattccattatcgcttcggcattttttgaacagaggagacaaaaaatgccgaagcgaaacctggcggcagcgcaaaagatg

SEQ ID NO: 55798 - DNA, 103 bp, Artificial Sequence
  Synthetic Polynucleotide
taatacgactcactatagggcgatctagattccattatcgcttcggcattaacagaggagaaatgccatggcgataatgaacctggcggcagcgcaaaagatg

SEQ ID NO: 55799 - DNA, 103 bp, Artificial Sequence
  Synthetic Polynucleotide
taatacgactcactatagggatcatcgatctagattccattatcgcttcgaacagaggagacgaagcatgaatggaatcaacctggcggcagcgcaaaagatg

SEQ ID NO: 55800 - DNA, 103 bp, Artificial Sequence
  Synthetic Polynucleotide
taatacgactcactatagggaagttatcatcgatctagattccattatcgaacagaggagacgataaatgaatctagataacctggcggcagcgcaaaagatg

SEQ ID NO: 55801 - DNA, 103 bp, Artificial Sequence
  Synthetic Polynucleotide
taatacgactcactatagggcatagaagttatcatcgatctagattccataacagaggagaatggaaatgagatcgatgaacctggcggcagcgcaaaagatg

SEQ ID NO: 55802 - DNA, 103 bp, Artificial Sequence
  Synthetic Polynucleotide
taatacgactcactataggggttggcatagaagttatcatcgatctagataacagaggagaatctagatggatgataacaacctggcggcagcgcaaaagatg

SEQ ID NO: 55803 - DNA, 103 bp, Artificial Sequence
  Synthetic Polynucleotide
taatacgactcactatagggtttgtgttggcatagaagttatcatcgatcaacagaggagagatcgaatgtaacttctaaacctggcggcagcgcaaaagatg

SEQ ID NO: 55804 - DNA, 103 bp, Artificial Sequence
  Synthetic Polynucleotide
taatacgactcactatagggtatctttcataaaatataatagatttaatgaacagaggagacattaaatgtattatattaacctggcggcagcgcaaaagatg

SEQ ID NO: 55805 - DNA, 103 bp, Artificial Sequence
  Synthetic Polynucleotide
taatacgactcactatagggtggtgtttgtgttggcatagaagttatcataacagaggagaatgataatgtctatgccaaacctggcggcagcgcaaaagatg

SEQ ID NO: 55806 - DNA, 103 bp, Artificial Sequence
  Synthetic Polynucleotide
taatacgactcactatagggaaggatggtgtttgtgttggcatagaagttaacagaggagaaacttcatggccaacacaaacctggcggcagcgcaaaagatg

SEQ ID NO: 55807 - DNA, 103 bp, Artificial Sequence
  Synthetic Polynucleotide
taatacgactcactatagggctcccaaggatggtgtttgtgttggcatagaacagaggagactatgcatgcacaaacacaacctggcggcagcgcaaaagatg

SEQ ID NO: 55808 - DNA, 103 bp, Artificial Sequence
  Synthetic Polynucleotide
taatacgactcactatagggaactactcccaaggatggtgtttgtgttggaacagaggagaccaacaatgacaccatccaacctggcggcagcgcaaaagatg

SEQ ID NO: 55809 - DNA, 103 bp, Artificial Sequence
  Synthetic Polynucleotide
taatacgactcactatagggtcataaactactcccaaggatggtgtttgtaacagaggagaacaaacatgatccttgggaacctggcggcagcgcaaaagatg

SEQ ID NO: 55810 - DNA, 103 bp, Artificial Sequence
  Synthetic Polynucleotide
taatacgactcactatagggctttatcataaactactcccaaggatggtgaacagaggagacaccatatgtgggagtagaacctggcggcagcgcaaaagatg

SEQ ID NO: 55811 - DNA, 103 bp, Artificial Sequence
  Synthetic Polynucleotide
taatacgactcactatagggtttatctttatcataaactactcccaaggaaacagaggagatccttgatggtagtttataacctggcggcagcgcaaaagatg

SEQ ID NO: 55812 - DNA, 103 bp, Artificial Sequence
  Synthetic Polynucleotide
taatacgactcactatagggattcttttatctttatcataaactactcccaacagaggagagggagtatgttatgataaaacctggcggcagcgcaaaagatg

SEQ ID NO: 55813 - DNA, 103 bp, Artificial Sequence
  Synthetic Polynucleotide
taatacgactcactatagggtctgaattcttttatctttatcataaactaaacagaggagatagtttatgataaagataaacctggcggcagcgcaaaagatg

SEQ ID NO: 55814 - DNA, 103 bp, Artificial Sequence
  Synthetic Polynucleotide
taatacgactcactatagggtagcatctgaattcttttatctttatcataaacagaggagatatgatatggataaaagaaacctggcggcagcgcaaaagatg

SEQ ID NO: 55815 - DNA, 103 bp, Artificial Sequence
  Synthetic Polynucleotide
taatacgactcactatagggtaatatatctttcataaaatataatagattaacagaggagaaatctaatgtattttatgaacctggcggcagcgcaaaagatg

SEQ ID NO: 55816 - DNA, 103 bp, Artificial Sequence
  Synthetic Polynucleotide
taatacgactcactatagggtcctctagcatctgaattcttttatctttaaacagaggagataaagaatgaagaattcaaacctggcggcagcgcaaaagatg

SEQ ID NO: 55817 - DNA, 103 bp, Artificial Sequence
  Synthetic Polynucleotide
taatacgactcactatagggcttcatcctctagcatctgaattcttttataacagaggagaataaaaatgttcagatgcaacctggcggcagcgcaaaagatg

SEQ ID NO: 55818 - DNA, 103 bp, Artificial Sequence
  Synthetic Polynucleotide
taatacgactcactatagggaaccacttcatcctctagcatctgaattctaacagaggagaagaattatgatgctagagaacctggcggcagcgcaaaagatg

SEQ ID NO: 55819 - DNA, 103 bp, Artificial Sequence
  Synthetic Polynucleotide
taatacgactcactatagggagattaaccacttcatcctctagcatctgaaacagaggagatcagatatgagaggatgaaacctggcggcagcgcaaaagatg

SEQ ID NO: 55820 - DNA, 103 bp, Artificial Sequence
  Synthetic Polynucleotide
taatacgactcactatagggttctaagattaaccacttcatcctctagcaaacagaggagatgctagatgatgaagtggaacctggcggcagcgcaaaagatg

SEQ ID NO: 55821 - DNA, 103 bp, Artificial Sequence
  Synthetic Polynucleotide
taatacgactcactatagggttgatttctaagattaaccacttcatcctcaacagaggagagaggatatggtggttaataacctggcggcagcgcaaaagatg

SEQ ID NO: 55822 - DNA, 103 bp, Artificial Sequence
  Synthetic Polynucleotide
taatacgactcactataggggattgttgatttctaagattaaccacttcaaacagaggagatgaagtatgtaatcttagaacctggcggcagcgcaaaagatg

SEQ ID NO: 55823 - DNA, 103 bp, Artificial Sequence
  Synthetic Polynucleotide
taatacgactcactatagggtattagattgttgatttctaagattaaccaaacagaggagatggttaatgttagaaatcaacctggcggcagcgcaaaagatg

SEQ ID NO: 55824 - DNA, 103 bp, Artificial Sequence
  Synthetic Polynucleotide
taatacgactcactatagggttttgtattagattgttgatttctaagattaacagaggagaaatcttatgaatcaacaaaacctggcggcagcgcaaaagatg

SEQ ID NO: 55825 - DNA, 103 bp, Artificial Sequence
  Synthetic Polynucleotide
taatacgactcactataggggatgattttgtattagattgttgatttctaaacagaggagatagaaaatgacaatctaaaacctggcggcagcgcaaaagatg

SEQ ID NO: 55826 - DNA, 103 bp, Artificial Sequence
  Synthetic Polynucleotide
taatacgactcactatagggagcagtaatatatctttcataaaatataataacagaggagaattataatgtatgaaagaaacctggcggcagcgcaaaagatg

SEQ ID NO: 55827 - DNA, 103 bp, Artificial Sequence
  Synthetic Polynucleotide
taatacgactcactatagggtattagatgattttgtattagattgttgataacagaggagaatcaacatgctaatacaaaacctggcggcagcgcaaaagatg

SEQ ID NO: 55828 - DNA, 103 bp, Artificial Sequence
  Synthetic Polynucleotide
taatacgactcactatagggcaaattattagatgattttgtattagattgaacagaggagacaatctatgacaaaatcaaacctggcggcagcgcaaaagatg

SEQ ID NO: 55829 - DNA, 103 bp, Artificial Sequence
  Synthetic Polynucleotide
taatacgactcactatagggttatccaaattattagatgattttgtattaaacagaggagataatacatgatcatctaaaacctggcggcagcgcaaaagatg

SEQ ID NO: 55830 - DNA, 103 bp, Artificial Sequence
  Synthetic Polynucleotide
taatacgactcactatagggtaaaattatccaaattattagatgattttgaacagaggagacaaaatatgctaataattaacctggcggcagcgcaaaagatg

SEQ ID NO: 55831 - DNA, 103 bp, Artificial Sequence
  Synthetic Polynucleotide
taatacgactcactatagggtctggtaaaattatccaaattattagatgaaacagaggagatcatctatgaatttggataacctggcggcagcgcaaaagatg

SEQ ID NO: 55832 - DNA, 103 bp, Artificial Sequence
  Synthetic Polynucleotide
taatacgactcactatagggagtattctggtaaaattatccaaattattaaacagaggagataataaatgggataatttaacctggcggcagcgcaaaagatg

SEQ ID NO: 55833 - DNA, 103 bp, Artificial Sequence
  Synthetic Polynucleotide
taatacgactcactatagggcaaatagtattctggtaaaattatccaaataacagaggagaatttggatgattttaccaaacctggcggcagcgcaaaagatg

SEQ ID NO: 55834 - DNA, 103 bp, Artificial Sequence
  Synthetic Polynucleotide
taatacgactcactatagggcttaccaaatagtattctggtaaaattatcaacagaggagagataatatgaccagaataaacctggcggcagcgcaaaagatg

SEQ ID NO: 55835 - DNA, 103 bp, Artificial Sequence
  Synthetic Polynucleotide
taatacgactcactatagggggagtcttaccaaatagtattctggtaaaaaacagaggagattttacatgaatactattaacctggcggcagcgcaaaagatg

SEQ ID NO: 55836 - DNA, 103 bp, Artificial Sequence
  Synthetic Polynucleotide
taatacgactcactatagggtatacggagtcttaccaaatagtattctggaacagaggagaccagaaatgtatttggtaaacctggcggcagcgcaaaagatg

SEQ ID NO: 55837 - DNA, 103 bp, Artificial Sequence
  Synthetic Polynucleotide
taatacgactcactatagggaggtgagcagtaatatatctttcataaaataacagaggagaattttaatgaagatatataacctggcggcagcgcaaaagatg

SEQ ID NO: 55838 - DNA, 103 bp, Artificial Sequence
  Synthetic Polynucleotide
taatacgactcactatagggtgatttatacggagtcttaccaaatagtataacagaggagaatactaatgggtaagactaacctggcggcagcgcaaaagatg

SEQ ID NO: 55839 - DNA, 103 bp, Artificial Sequence
  Synthetic Polynucleotide
taatacgactcactatagggtctgttgatttatacggagtcttaccaaataacagaggagaatttggatggactccgtaaacctggcggcagcgcaaaagatg

SEQ ID NO: 55840 - DNA, 103 bp, Artificial Sequence
  Synthetic Polynucleotide
taatacgactcactatagggtaacttctgttgatttatacggagtcttacaacagaggagagtaagaatgcgtataaataacctggcggcagcgcaaaagatg

SEQ ID NO: 55841 - DNA, 103 bp, Artificial Sequence
  Synthetic Polynucleotide
taatacgactcactatagggcttattaacttctgttgatttatacggagtaacagaggagaactccgatgaaatcaacaaacctggcggcagcgcaaaagatg

SEQ ID NO: 55842 - DNA, 103 bp, Artificial Sequence
  Synthetic Polynucleotide
taatacgactcactatagggatacgcttattaacttctgttgatttatacaacagaggagagtataaatgaacagaagtaacctggcggcagcgcaaaagatg

SEQ ID NO: 55843 - DNA, 103 bp, Artificial Sequence
  Synthetic Polynucleotide
taatacgactcactatagggtggctatacgcttattaacttctgttgattaacagaggagaaatcaaatgaagttaataaacctggcggcagcgcaaaagatg

SEQ ID NO: 55844 - DNA, 103 bp, Artificial Sequence
  Synthetic Polynucleotide
taatacgactcactatagggaacgatggctatacgcttattaacttctgtaacagaggagaacagaaatgaataagcgtaacctggcggcagcgcaaaagatg

SEQ ID NO: 55845 - DNA, 103 bp, Artificial Sequence
  Synthetic Polynucleotide
taatacgactcactatagggtaattaacgatggctatacgcttattaactaacagaggagaagttaaatggcgtatagcaacctggcggcagcgcaaaagatg

SEQ ID NO: 55846 - DNA, 103 bp, Artificial Sequence
  Synthetic Polynucleotide
taatacgactcactatagggttgcataattaacgatggctatacgcttataacagaggagaataagcatgtagccatcgaacctggcggcagcgcaaaagatg

SEQ ID NO: 55847 - DNA, 103 bp, Artificial Sequence
  Synthetic Polynucleotide
taatacgactcactatagggcaaatttgcataattaacgatggctatacgaacagaggagacgtataatgatcgttaataacctggcggcagcgcaaaagatg

SEQ ID NO: 55848 - DNA, 103 bp, Artificial Sequence
  Synthetic Polynucleotide
taatacgactcactatagggtatagaggtgagcagtaatatatctttcataacagaggagaatgaaaatgatattactgaacctggcggcagcgcaaaagatg

SEQ ID NO: 55849 - DNA, 103 bp, Artificial Sequence
  Synthetic Polynucleotide
taatacgactcactatagggccattcaaatttgcataattaacgatggctaacagaggagaagccatatgtaattatgcaacctggcggcagcgcaaaagatg

SEQ ID NO: 55850 - DNA, 103 bp, Artificial Sequence
  Synthetic Polynucleotide
taatacgactcactataggggggacccattcaaatttgcataattaacgaaacagaggagatcgttaatgatgcaaattaacctggcggcagcgcaaaagatg

SEQ ID NO: 55851 - DNA, 103 bp, Artificial Sequence
  Synthetic Polynucleotide
taatacgactcactatagggtaagggggacccattcaaatttgcataattaacagaggagaaattatatgaatttgaataacctggcggcagcgcaaaagatg

SEQ ID NO: 55852 - DNA, 103 bp, Artificial Sequence
  Synthetic Polynucleotide
taatacgactcactatagggactgataagggggacccattcaaatttgcaaacagaggagatgcaaaatggaatgggtcaacctggcggcagcgcaaaagatg

SEQ ID NO: 55853 - DNA, 103 bp, Artificial Sequence
  Synthetic Polynucleotide
taatacgactcactatagggcctctactgataagggggacccattcaaataacagaggagaatttgaatgggtccccctaacctggcggcagcgcaaaagatg

SEQ ID NO: 55854 - DNA, 103 bp, Artificial Sequence
  Synthetic Polynucleotide
taatacgactcactatagggcaagtcctctactgataagggggacccattaacagaggagaaatgggatgcccttatcaaacctggcggcagcgcaaaagatg

SEQ ID NO: 55855 - DNA, 103 bp, Artificial Sequence
  Synthetic Polynucleotide
taatacgactcactatagggacatccaagtcctctactgataagggggacaacagaggagagtccccatgatcagtagaaacctggcggcagcgcaaaagatg

SEQ ID NO: 55856 - DNA, 103 bp, Artificial Sequence
  Synthetic Polynucleotide
taatacgactcactatagggaacaaacatccaagtcctctactgataaggaacagaggagaccttatatgtagaggactaacctggcggcagcgcaaaagatg

SEQ ID NO: 55857 - DNA, 103 bp, Artificial Sequence
  Synthetic Polynucleotide
taatacgactcactatagggctctgaacaaacatccaagtcctctactgaaacagaggagatcagtaatggacttggataacctggcggcagcgcaaaagatg

SEQ ID NO: 55858 - DNA, 103 bp, Artificial Sequence
  Synthetic Polynucleotide
taatacgactcactatagggtcatcctctgaacaaacatccaagtcctctaacagaggagaagaggaatgggatgtttgaacctggcggcagcgcaaaagatg

SEQ ID NO: 55859 - DNA, 103 bp, Artificial Sequence
  Synthetic Polynucleotide
taatacgactcactatagggcgaaatatagaggtgagcagtaatatatctaacagaggagaagatatatgactgctcacaacctggcggcagcgcaaaagatg

SEQ ID NO: 55860 - DNA, 103 bp, Artificial Sequence
  Synthetic Polynucleotide
taatacgactcactatagggctatttcatcctctgaacaaacatccaagtaacagaggagaacttggatgtttgttcagaacctggcggcagcgcaaaagatg

SEQ ID NO: 55861 - DNA, 103 bp, Artificial Sequence
  Synthetic Polynucleotide
taatacgactcactatagggtctatctatttcatcctctgaacaaacatcaacagaggagagatgttatgtcagaggataacctggcggcagcgcaaaagatg

SEQ ID NO: 55862 - DNA, 103 bp, Artificial Sequence
  Synthetic Polynucleotide
taatacgactcactatagggtagattctatctatttcatcctctgaacaaaacagaggagattgttcatgggatgaaataacctggcggcagcgcaaaagatg

SEQ ID NO: 55863 - DNA, 103 bp, Artificial Sequence
  Synthetic Polynucleotide
taatacgactcactatagggttttatagattctatctatttcatcctctgaacagaggagacagaggatgaaatagataaacctggcggcagcgcaaaagatg

SEQ ID NO: 55864 - DNA, 103 bp, Artificial Sequence
  Synthetic Polynucleotide
taatacgactcactatagggaatcgttttatagattctatctatttcatcaacagaggagagatgaaatggatagaatcaacctggcggcagcgcaaaagatg

SEQ ID NO: 55865 - DNA, 103 bp, Artificial Sequence
  Synthetic Polynucleotide
taatacgactcactatagggtgtttaatcgttttatagattctatctattaacagaggagaaatagaatgaatctataaaacctggcggcagcgcaaaagatg

SEQ ID NO: 55866 - DNA, 103 bp, Artificial Sequence
  Synthetic Polynucleotide
taatacgactcactataggggatattgtttaatcgttttatagattctataacagaggagaatagaaatgataaaacgaaacctggcggcagcgcaaaagatg

SEQ ID NO: 55867 - DNA, 103 bp, Artificial Sequence
  Synthetic Polynucleotide
taatacgactcactatagggttcgtgatattgtttaatcgttttatagataacagaggagaatctatatgacgattaaaaacctggcggcagcgcaaaagatg

SEQ ID NO: 55868 - DNA, 103 bp, Artificial Sequence
  Synthetic Polynucleotide
taatacgactcactatagggctactttcgtgatattgtttaatcgttttaaacagaggagataaaacatgtaaacaataaacctggcggcagcgcaaaagatg

SEQ ID NO: 55869 - DNA, 103 bp, Artificial Sequence
  Synthetic Polynucleotide
taatacgactcactataggggttttctactttcgtgatattgtttaatcgaacagaggagacgattaatgaatatcacgaacctggcggcagcgcaaaagatg

SEQ ID NO: 55870 - DNA, 103 bp, Artificial Sequence
  Synthetic Polynucleotide
taatacgactcactatagggatgtacgaaatatagaggtgagcagtaataaacagaggagatattacatgtcacctctaaacctggcggcagcgcaaaagatg

SEQ ID NO: 55871 - DNA, 103 bp, Artificial Sequence
  Synthetic Polynucleotide
taatacgactcactatagggttttcgttttctactttcgtgatattgtttaacagaggagaaaacaaatgcacgaaagtaacctggcggcagcgcaaaagatg

SEQ ID NO: 55872 - DNA, 103 bp, Artificial Sequence
  Synthetic Polynucleotide
taatacgactcactatagggataatttttcgttttctactttcgtgatataacagaggagaatatcaatgaagtagaaaaacctggcggcagcgcaaaagatg

SEQ ID NO: 55873 - DNA, 103 bp, Artificial Sequence
  Synthetic Polynucleotide
taatacgactcactatagggtaacgataatttttcgttttctactttcgtaacagaggagaacgaaaatggaaaacgaaaacctggcggcagcgcaaaagatg

SEQ ID NO: 55874 - DNA, 103 bp, Artificial Sequence
  Synthetic Polynucleotide
taatacgactcactataggggttagtaacgataatttttcgttttctactaacagaggagaagtagaatgcgaaaaattaacctggcggcagcgcaaaagatg

SEQ ID NO: 55875 - DNA, 103 bp, Artificial Sequence
  Synthetic Polynucleotide
taatacgactcactatagggatcacgttagtaacgataatttttcgttttaacagaggagaaaaacgatgaattatcgtaacctggcggcagcgcaaaagatg

SEQ ID NO: 55876 - DNA, 103 bp, Artificial Sequence
  Synthetic Polynucleotide
taatacgactcactatagggtaataatcacgttagtaacgataatttttcaacagaggagagaaaaaatgtcgttactaaacctggcggcagcgcaaaagatg

SEQ ID NO: 55877 - DNA, 103 bp, Artificial Sequence
  Synthetic Polynucleotide
taatacgactcactataggggacaataataatcacgttagtaacgataataacagaggagaattatcatgactaacgtgaacctggcggcagcgcaaaagatg

SEQ ID NO: 55878 - DNA, 103 bp, Artificial Sequence
  Synthetic Polynucleotide
taatacgactcactatagggtttatgacaataataatcacgttagtaacgaacagaggagacgttacatgcgtgattataacctggcggcagcgcaaaagatg

SEQ ID NO: 55879 - DNA, 103 bp, Artificial Sequence
  Synthetic Polynucleotide
taatacgactcactatagggtaatgtttatgacaataataatcacgttagaacagaggagactaacgatgttattattgaacctggcggcagcgcaaaagatg

SEQ ID NO: 55880 - DNA, 103 bp, Artificial Sequence
  Synthetic Polynucleotide
taatacgactcactatagggttcaataatgtttatgacaataataatcacaacagaggagagtgattatgattgtcataaacctggcggcagcgcaaaagatg

SEQ ID NO: 55881 - DNA, 103 bp, Artificial Sequence
  Synthetic Polynucleotide
taatacgactcactatagggtaaaaatgtacgaaatatagaggtgagcagaacagaggagactgctcatgtctatatttaacctggcggcagcgcaaaagatg

SEQ ID NO: 55882 - DNA, 103 bp, Artificial Sequence
  Synthetic Polynucleotide
taatacgactcactataggggcctgttcaataatgtttatgacaataataaacagaggagatattatatgcataaacataacctggcggcagcgcaaaagatg

SEQ ID NO: 55883 - DNA, 103 bp, Artificial Sequence
  Synthetic Polynucleotide
taatacgactcactataggggcaatgcctgttcaataatgtttatgacaaaacagaggagattgtcaatgacattattgaacctggcggcagcgcaaaagatg

SEQ ID NO: 55884 - DNA, 103 bp, Artificial Sequence
  Synthetic Polynucleotide
taatacgactcactatagggttttagcaatgcctgttcaataatgtttataacagaggagaataaacatgattgaacagaacctggcggcagcgcaaaagatg

SEQ ID NO: 55885 - DNA, 103 bp, Artificial Sequence
  Synthetic Polynucleotide
taatacgactcactatagggccaagttttagcaatgcctgttcaataatgaacagaggagacattatatgacaggcattaacctggcggcagcgcaaaagatg

SEQ ID NO: 55886 - DNA, 103 bp, Artificial Sequence
  Synthetic Polynucleotide
taatacgactcactatagggcaaatccaagttttagcaatgcctgttcaaaacagaggagattgaacatgcattgctaaaacctggcggcagcgcaaaagatg

SEQ ID NO: 55887 - DNA, 103 bp, Artificial Sequence
  Synthetic Polynucleotide
taatacgactcactatagggttcgtcaaatccaagttttagcaatgcctgaacagaggagacaggcaatgctaaaacttaacctggcggcagcgcaaaagatg

SEQ ID NO: 55888 - DNA, 103 bp, Artificial Sequence
  Synthetic Polynucleotide
taatacgactcactatagggttgatttcgtcaaatccaagttttagcaataacagaggagaattgctatgacttggattaacctggcggcagcgcaaaagatg

SEQ ID NO: 55889 - DNA, 103 bp, Artificial Sequence
  Synthetic Polynucleotide
taatacgactcactataggggtcctttgatttcgtcaaatccaagttttaaacagaggagataaaacatggatttgacgaacctggcggcagcgcaaaagatg

SEQ ID NO: 55890 - DNA, 103 bp, Artificial Sequence
  Synthetic Polynucleotide
taatacgactcactatagggactcagtcctttgatttcgtcaaatccaagaacagaggagacttggaatggacgaaatcaacctggcggcagcgcaaaagatg

SEQ ID NO: 55891 - DNA, 103 bp, Artificial Sequence
  Synthetic Polynucleotide
taatacgactcactatagggtcggtactcagtcctttgatttcgtcaaataacagaggagaatttgaatgaatcaaaggaacctggcggcagcgcaaaagatg

SEQ ID NO: 55892 - DNA, 103 bp, Artificial Sequence
  Synthetic Polynucleotide
taatacgactcactatagggcagtttaaaaatgtacgaaatatagaggtgaacagaggagacacctcatgatttcgtacaacctggcggcagcgcaaaagatg

SEQ ID NO: 55893 - DNA, 103 bp, Artificial Sequence
  Synthetic Polynucleotide
taatacgactcactatagggtgatgtcggtactcagtcctttgatttcgtaacagaggagaacgaaaatgaaggactgaaacctggcggcagcgcaaaagatg

SEQ ID NO: 55894 - DNA, 103 bp, Artificial Sequence
  Synthetic Polynucleotide
taatacgactcactatagggtgaagtgatgtcggtactcagtcctttgataacagaggagaatcaaaatgctgagtaccaacctggcggcagcgcaaaagatg

SEQ ID NO: 55895 - DNA, 103 bp, Artificial Sequence
  Synthetic Polynucleotide
taatacgactcactatagggatttctgaagtgatgtcggtactcagtcctaacagaggagaaggactatgtaccgacataacctggcggcagcgcaaaagatg

SEQ ID NO: 55896 - DNA, 103 bp, Artificial Sequence
  Synthetic Polynucleotide
taatacgactcactatagggcgataatttctgaagtgatgtcggtactcaaacagaggagatgagtaatgacatcacttaacctggcggcagcgcaaaagatg

SEQ ID NO: 55897 - DNA, 103 bp, Artificial Sequence
  Synthetic Polynucleotide
taatacgactcactatagggcacatcgataatttctgaagtgatgtcggtaacagaggagaaccgacatgacttcagaaaacctggcggcagcgcaaaagatg

SEQ ID NO: 55898 - DNA, 103 bp, Artificial Sequence
  Synthetic Polynucleotide
taatacgactcactatagggatctccacatcgataatttctgaagtgatgaacagaggagacatcacatgagaaattataacctggcggcagcgcaaaagatg

SEQ ID NO: 55899 - DNA, 103 bp, Artificial Sequence
  Synthetic Polynucleotide
taatacgactcactatagggctccgatctccacatcgataatttctgaagaacagaggagacttcagatgttatcgatgaacctggcggcagcgcaaaagatg

SEQ ID NO: 55900 - DNA, 103 bp, Artificial Sequence
  Synthetic Polynucleotide
taatacgactcactataggggtcgtctccgatctccacatcgataatttcaacagaggagagaaattatggatgtggagaacctggcggcagcgcaaaagatg

SEQ ID NO: 55901 - DNA, 103 bp, Artificial Sequence
  Synthetic Polynucleotide
taatacgactcactatagggtcacagtcgtctccgatctccacatcgataaacagaggagatatcgaatgggagatcggaacctggcggcagcgcaaaagatg

SEQ ID NO: 55902 - DNA, 103 bp, Artificial Sequence
  Synthetic Polynucleotide
taatacgactcactatagggcagcatcacagtcgtctccgatctccacataacagaggagaatgtggatgtcggagacgaacctggcggcagcgcaaaagatg

SEQ ID NO: 55903 - DNA, 103 bp, Artificial Sequence
  Synthetic Polynucleotide
taatacgactcactatagggatgataaaaactattaacttatgtatattaaacagaggagataatatatgtaagttaataacctggcggcagcgcaaaagatg

SEQ ID NO: 55904 - DNA, 103 bp, Artificial Sequence
  Synthetic Polynucleotide
taatacgactcactatagggacaaacagtttaaaaatgtacgaaatatagaacagaggagactatatatggtacattttaacctggcggcagcgcaaaagatg

SEQ ID NO: 55905 - DNA, 103 bp, Artificial Sequence
  Synthetic Polynucleotide
taatacgactcactatagggtgctacagcatcacagtcgtctccgatctcaacagaggagagagatcatggacgactgtaacctggcggcagcgcaaaagatg

SEQ ID NO: 55906 - DNA, 103 bp, Artificial Sequence
  Synthetic Polynucleotide
taatacgactcactatagggtttgatgctacagcatcacagtcgtctccgaacagaggagacggagaatgctgtgatgcaacctggcggcagcgcaaaagatg

SEQ ID NO: 55907 - DNA, 103 bp, Artificial Sequence
  Synthetic Polynucleotide
taatacgactcactatagggctagttttgatgctacagcatcacagtcgtaacagaggagaacgactatgatgctgtagaacctggcggcagcgcaaaagatg

SEQ ID NO: 55908 - DNA, 103 bp, Artificial Sequence
  Synthetic Polynucleotide
taatacgactcactataggggattcctagttttgatgctacagcatcacaaacagaggagatgtgatatggtagcatcaaacctggcggcagcgcaaaagatg

SEQ ID NO: 55909 - DNA, 103 bp, Artificial Sequence
  Synthetic Polynucleotide
taatacgactcactatagggttgccgattcctagttttgatgctacagcaaacagaggagatgctgtatgatcaaaactaacctggcggcagcgcaaaagatg

SEQ ID NO: 55910 - DNA, 103 bp, Artificial Sequence
  Synthetic Polynucleotide
taatacgactcactataggggactgttgccgattcctagttttgatgctaaacagaggagatagcatatgaactaggaaaacctggcggcagcgcaaaagatg

SEQ ID NO: 55911 - DNA, 103 bp, Artificial Sequence
  Synthetic Polynucleotide
taatacgactcactatagggaaccggactgttgccgattcctagttttgaaacagaggagatcaaaaatgggaatcggcaacctggcggcagcgcaaaagatg

SEQ ID NO: 55912 - DNA, 103 bp, Artificial Sequence
  Synthetic Polynucleotide
taatacgactcactatagggttaagaaccggactgttgccgattcctagtaacagaggagaactaggatgcggcaacagaacctggcggcagcgcaaaagatg

SEQ ID NO: 55913 - DNA, 103 bp, Artificial Sequence
  Synthetic Polynucleotide
taatacgactcactatagggcaatattaagaaccggactgttgccgattcaacagaggagagaatcgatgacagtccggaacctggcggcagcgcaaaagatg

SEQ ID NO: 55914 - DNA, 103 bp, Artificial Sequence
  Synthetic Polynucleotide
taatacgactcactatagggcaatacaatattaagaaccggactgttgccaacagaggagaggcaacatgccggttcttaacctggcggcagcgcaaaagatg

SEQ ID NO: 55915 - DNA, 103 bp, Artificial Sequence
  Synthetic Polynucleotide
taatacgactcactatagggattatacaaacagtttaaaaatgtacgaaaaacagaggagatttcgtatgtttttaaacaacctggcggcagcgcaaaagatg

SEQ ID NO: 55916 - DNA, 103 bp, Artificial Sequence
  Synthetic Polynucleotide
taatacgactcactatagggataaacaatacaatattaagaaccggactgaacagaggagacagtccatgtcttaatataacctggcggcagcgcaaaagatg

SEQ ID NO: 55917 - DNA, 103 bp, Artificial Sequence
  Synthetic Polynucleotide
taatacgactcactatagggtgagtataaacaatacaatattaagaaccgaacagaggagacggttcatgatattgtataacctggcggcagcgcaaaagatg

SEQ ID NO: 55918 - DNA, 103 bp, Artificial Sequence
  Synthetic Polynucleotide
taatacgactcactatagggtatcttgagtataaacaatacaatattaagaacagaggagacttaatatggtattgtttaacctggcggcagcgcaaaagatg

SEQ ID NO: 55919 - DNA, 103 bp, Artificial Sequence
  Synthetic Polynucleotide
taatacgactcactatagggacaaatatcttgagtataaacaatacaataaacagaggagatattgtatggtttatactaacctggcggcagcgcaaaagatg

SEQ ID NO: 55920 - DNA, 103 bp, Artificial Sequence
  Synthetic Polynucleotide
taatacgactcactataggggtttaacaaatatcttgagtataaacaataaacagaggagatattgtatgtactcaagaaacctggcggcagcgcaaaagatg

SEQ ID NO: 55921 - DNA, 103 bp, Artificial Sequence
  Synthetic Polynucleotide
taatacgactcactatagggaattcgtttaacaaatatcttgagtataaaaacagaggagatttataatgaagatatttaacctggcggcagcgcaaaagatg

SEQ ID NO: 55922 - DNA, 103 bp, Artificial Sequence
  Synthetic Polynucleotide
taatacgactcactatagggattttaattcgtttaacaaatatcttgagtaacagaggagaactcaaatgatttgttaaaacctggcggcagcgcaaaagatg

SEQ ID NO: 55923 - DNA, 103 bp, Artificial Sequence
  Synthetic Polynucleotide
taatacgactcactatagggaaataattttaattcgtttaacaaatatctaacagaggagaagatatatgttaaacgaaaacctggcggcagcgcaaaagatg

SEQ ID NO: 55924 - DNA, 103 bp, Artificial Sequence
  Synthetic Polynucleotide
taatacgactcactatagggaaattaaataattttaattcgtttaacaaaaacagaggagatttgttatgcgaattaaaaacctggcggcagcgcaaaagatg

SEQ ID NO: 55925 - DNA, 103 bp, Artificial Sequence
  Synthetic Polynucleotide
taatacgactcactataggggtattaaattaaataattttaattcgtttaaacagaggagataaacgatgtaaaattataacctggcggcagcgcaaaagatg

SEQ ID NO: 55926 - DNA, 103 bp, Artificial Sequence
  Synthetic Polynucleotide
taatacgactcactataggggagatattatacaaacagtttaaaaatgtaaacagaggagatacattatgaaactgtttaacctggcggcagcgcaaaagatg

SEQ ID NO: 55927 - DNA, 103 bp, Artificial Sequence
  Synthetic Polynucleotide
taatacgactcactatagggggaatgtattaaattaaataattttaattcaacagaggagagaattaatgttatttaataacctggcggcagcgcaaaagatg

SEQ ID NO: 55928 - DNA, 103 bp, Artificial Sequence
  Synthetic Polynucleotide
taatacgactcactatagggatatgggaatgtattaaattaaataattttaacagaggagaaaaattatgtaatttaataacctggcggcagcgcaaaagatg

SEQ ID NO: 55929 - DNA, 103 bp, Artificial Sequence
  Synthetic Polynucleotide
taatacgactcactatagggtctggatatgggaatgtattaaattaaataaacagaggagatatttaatgtaatacattaacctggcggcagcgcaaaagatg

SEQ ID NO: 55930 - DNA, 103 bp, Artificial Sequence
  Synthetic Polynucleotide
taatacgactcactatagggtgttgtctggatatgggaatgtattaaattaacagaggagaaatttaatgcattcccataacctggcggcagcgcaaaagatg

SEQ ID NO: 55931 - DNA, 103 bp, Artificial Sequence
  Synthetic Polynucleotide
taatacgactcactatagggacgattgttgtctggatatgggaatgtattaacagaggagaaatacaatgccatatccaaacctggcggcagcgcaaaagatg

SEQ ID NO: 55932 - DNA, 103 bp, Artificial Sequence
  Synthetic Polynucleotide
taatacgactcactatagggtccaaacgattgttgtctggatatgggaataacagaggagaattcccatgtccagacaaaacctggcggcagcgcaaaagatg

SEQ ID NO: 55933 - DNA, 103 bp, Artificial Sequence
  Synthetic Polynucleotide
taatacgactcactatagggattaatccaaacgattgttgtctggatatgaacagaggagacatatcatgacaacaatcaacctggcggcagcgcaaaagatg

SEQ ID NO: 55934 - DNA, 103 bp, Artificial Sequence
  Synthetic Polynucleotide
taatacgactcactatagggaacagattaatccaaacgattgttgtctggaacagaggagaccagacatgaatcgtttgaacctggcggcagcgcaaaagatg

SEQ ID NO: 55935 - DNA, 103 bp, Artificial Sequence
  Synthetic Polynucleotide
taatacgactcactatagggacaggaacagattaatccaaacgattgttgaacagaggagacaacaaatgtttggattaaacctggcggcagcgcaaaagatg

SEQ ID NO: 55936 - DNA, 103 bp, Artificial Sequence
  Synthetic Polynucleotide
taatacgactcactatagggagacgacaggaacagattaatccaaacgataacagaggagaatcgttatgattaatctgaacctggcggcagcgcaaaagatg

SEQ ID NO: 55937 - DNA, 103 bp, Artificial Sequence
  Synthetic Polynucleotide
taatacgactcactatagggtcagagagatattatacaaacagtttaaaaaacagaggagattttaaatggtttgtataaacctggcggcagcgcaaaagatg

SEQ ID NO: 55938 - DNA, 103 bp, Artificial Sequence
  Synthetic Polynucleotide
taatacgactcactataggggtatgagacgacaggaacagattaatccaaaacagaggagattggatatgtctgttcctaacctggcggcagcgcaaaagatg

SEQ ID NO: 55939 - DNA, 103 bp, Artificial Sequence
  Synthetic Polynucleotide
taatacgactcactataggggtccggtatgagacgacaggaacagattaaaacagaggagattaatcatgtcctgtcgtaacctggcggcagcgcaaaagatg

SEQ ID NO: 55940 - DNA, 103 bp, Artificial Sequence
  Synthetic Polynucleotide
taatacgactcactatagggatgtcgtccggtatgagacgacaggaacagaacagaggagactgttcatgtcgtctcataacctggcggcagcgcaaaagatg

SEQ ID NO: 55941 - DNA, 103 bp, Artificial Sequence
  Synthetic Polynucleotide
taatacgactcactatagggttaatatgtcgtccggtatgagacgacaggaacagaggagacctgtcatgtcataccggaacctggcggcagcgcaaaagatg

SEQ ID NO: 55942 - DNA, 103 bp, Artificial Sequence
  Synthetic Polynucleotide
taatacgactcactatagggaaagattaatatgtcgtccggtatgagacgaacagaggagacgtctcatgccggacgacaacctggcggcagcgcaaaagatg

SEQ ID NO: 55943 - DNA, 103 bp, Artificial Sequence
  Synthetic Polynucleotide
taatacgactcactatagggaataaaaagattaatatgtcgtccggtatgaacagaggagacataccatgcgacatattaacctggcggcagcgcaaaagatg

SEQ ID NO: 55944 - DNA, 103 bp, Artificial Sequence
  Synthetic Polynucleotide
taatacgactcactatagggccactaataaaaagattaatatgtcgtccgaacagaggagacggacgatgtattaatctaacctggcggcagcgcaaaagatg

SEQ ID NO: 55945 - DNA, 103 bp, Artificial Sequence
  Synthetic Polynucleotide
taatacgactcactataggggatgcccactaataaaaagattaatatgtcaacagaggagagacataatgatctttttaaacctggcggcagcgcaaaagatg

SEQ ID NO: 55946 - DNA, 103 bp, Artificial Sequence
  Synthetic Polynucleotide
taatacgactcactatagggaaaaagatgcccactaataaaaagattaataacagaggagaattaatatgtttattagtaacctggcggcagcgcaaaagatg

SEQ ID NO: 55947 - DNA, 103 bp, Artificial Sequence
  Synthetic Polynucleotide
taatacgactcactatagggcatctaaaaagatgcccactaataaaaagaaacagaggagatcttttatgtagtgggcaaacctggcggcagcgcaaaagatg

SEQ ID NO: 55948 - DNA, 103 bp, Artificial Sequence
  Synthetic Polynucleotide
taatacgactcactatagggttgtatcagagagatattatacaaacagttaacagaggagaaactgtatgtataatatcaacctggcggcagcgcaaaagatg

SEQ ID NO: 55949 - DNA, 103 bp, Artificial Sequence
  Synthetic Polynucleotide
taatacgactcactataggggaaaccatctaaaaagatgcccactaataaaacagaggagattattaatgggcatctttaacctggcggcagcgcaaaagatg

SEQ ID NO: 55950 - DNA, 103 bp, Artificial Sequence
  Synthetic Polynucleotide
taatacgactcactatagggaaaaagaaaccatctaaaaagatgcccactaacagaggagaagtgggatgctttttagaaacctggcggcagcgcaaaagatg

SEQ ID NO: 55951 - DNA, 103 bp, Artificial Sequence
  Synthetic Polynucleotide
taatacgactcactatagggctgggaaaaagaaaccatctaaaaagatgcaacagaggagagcatctatgtagatggttaacctggcggcagcgcaaaagatg

SEQ ID NO: 55952 - DNA, 103 bp, Artificial Sequence
  Synthetic Polynucleotide
taatacgactcactatagggtaatgctgggaaaaagaaaccatctaaaaaaacagaggagatttttaatgggtttctttaacctggcggcagcgcaaaagatg

SEQ ID NO: 55953 - DNA, 103 bp, Artificial Sequence
  Synthetic Polynucleotide
taatacgactcactatagggtcagttaatgctgggaaaaagaaaccatctaacagaggagaagatggatgctttttcccaacctggcggcagcgcaaaagatg

SEQ ID NO: 55954 - DNA, 103 bp, Artificial Sequence
  Synthetic Polynucleotide
taatacgactcactatagggtcgaatcagttaatgctgggaaaaagaaacaacagaggagagtttctatgtcccagcataacctggcggcagcgcaaaagatg

SEQ ID NO: 55955 - DNA, 103 bp, Artificial Sequence
  Synthetic Polynucleotide
taatacgactcactatagggaggtatcgaatcagttaatgctgggaaaaaaacagaggagatttttcatggcattaactaacctggcggcagcgcaaaagatg

SEQ ID NO: 55956 - DNA, 103 bp, Artificial Sequence
  Synthetic Polynucleotide
taatacgactcactatagggcttctaggtatcgaatcagttaatgctgggaacagaggagacccagcatgaactgattcaacctggcggcagcgcaaaagatg

SEQ ID NO: 55957 - DNA, 103 bp, Artificial Sequence
  Synthetic Polynucleotide
taatacgactcactatagggacgatcttctaggtatcgaatcagttaatgaacagaggagacattaaatgattcgatacaacctggcggcagcgcaaaagatg

SEQ ID NO: 55958 - DNA, 103 bp, Artificial Sequence
  Synthetic Polynucleotide
taatacgactcactatagggcaatcacgatcttctaggtatcgaatcagtaacagaggagaactgatatgatacctagaaacctggcggcagcgcaaaagatg

SEQ ID NO: 55959 - DNA, 103 bp, Artificial Sequence
  Synthetic Polynucleotide
taatacgactcactatagggtctaattgtatcagagagatattatacaaaaacagaggagatttgtaatgtatctctctaacctggcggcagcgcaaaagatg

SEQ ID NO: 55960 - DNA, 103 bp, Artificial Sequence
  Synthetic Polynucleotide
taatacgactcactataggggagatcaatcacgatcttctaggtatcgaaaacagaggagattcgatatgtagaagatcaacctggcggcagcgcaaaagatg

SEQ ID NO: 55961 - DNA, 103 bp, Artificial Sequence
  Synthetic Polynucleotide
taatacgactcactatagggtcggagagatcaatcacgatcttctaggtaaacagaggagatacctaatggatcgtgataacctggcggcagcgcaaaagatg

SEQ ID NO: 55962 - DNA, 103 bp, Artificial Sequence
  Synthetic Polynucleotide
taatacgactcactatagggaatggtcggagagatcaatcacgatcttctaacagaggagaagaagaatgtgattgatcaacctggcggcagcgcaaaagatg

SEQ ID NO: 55963 - DNA, 103 bp, Artificial Sequence
  Synthetic Polynucleotide
taatacgactcactatagggcgtggaatggtcggagagatcaatcacgataacagaggagaatcgtgatggatctctccaacctggcggcagcgcaaaagatg

SEQ ID NO: 55964 - DNA, 103 bp, Artificial Sequence
  Synthetic Polynucleotide
taatacgactcactatagggaagttcgtggaatggtcggagagatcaatcaacagaggagagattgaatgctccgaccaaacctggcggcagcgcaaaagatg

SEQ ID NO: 55965 - DNA, 103 bp, Artificial Sequence
  Synthetic Polynucleotide
taatacgactcactatagggattagaagttcgtggaatggtcggagagataacagaggagaatctctatgaccattccaaacctggcggcagcgcaaaagatg

SEQ ID NO: 55966 - DNA, 103 bp, Artificial Sequence
  Synthetic Polynucleotide
taatacgactcactatagggggtcaattagaagttcgtggaatggtcggaaacagaggagatccgacatgtccacgaacaacctggcggcagcgcaaaagatg

SEQ ID NO: 55967 - DNA, 103 bp, Artificial Sequence
  Synthetic Polynucleotide
taatacgactcactataggggagacggtcaattagaagttcgtggaatggaacagaggagaccattcatggaacttctaaacctggcggcagcgcaaaagatg

SEQ ID NO: 55968 - DNA, 103 bp, Artificial Sequence
  Synthetic Polynucleotide
taatacgactcactatagggcgttagagacggtcaattagaagttcgtggaacagaggagaccacgaatgtctaattgaaacctggcggcagcgcaaaagatg

SEQ ID NO: 55969 - DNA, 103 bp, Artificial Sequence
  Synthetic Polynucleotide
taatacgactcactatagggggtaccgttagagacggtcaattagaagttaacagaggagaaacttcatgttgaccgtcaacctggcggcagcgcaaaagatg

SEQ ID NO: 55970 - DNA, 103 bp, Artificial Sequence
  Synthetic Polynucleotide
taatacgactcactatagggatatatctaattgtatcagagagatattataacagaggagaataataatgctctgatacaacctggcggcagcgcaaaagatg

SEQ ID NO: 55971 - DNA, 103 bp, Artificial Sequence
  Synthetic Polynucleotide
taatacgactcactatagggtttatggtaccgttagagacggtcaattagaacagaggagactaattatgcgtctctaaaacctggcggcagcgcaaaagatg

SEQ ID NO: 55972 - DNA, 103 bp, Artificial Sequence
  Synthetic Polynucleotide
taatacgactcactatagggaatagtttatggtaccgttagagacggtcaaacagaggagatgaccgatgctaacggtaaacctggcggcagcgcaaaagatg

SEQ ID NO: 55973 - DNA, 103 bp, Artificial Sequence
  Synthetic Polynucleotide
taatacgactcactatagggggtaaaatagtttatggtaccgttagagacaacagaggagagtctctatgggtaccataaacctggcggcagcgcaaaagatg

SEQ ID NO: 55974 - DNA, 103 bp, Artificial Sequence
  Synthetic Polynucleotide
taatacgactcactatagggatgctggtaaaatagtttatggtaccgttaaacagaggagataacggatgcataaactaaacctggcggcagcgcaaaagatg

SEQ ID NO: 55975 - DNA, 103 bp, Artificial Sequence
  Synthetic Polynucleotide
taatacgactcactatagggtactaatgctggtaaaatagtttatggtacaacagaggagagtaccaatgactattttaaacctggcggcagcgcaaaagatg

SEQ ID NO: 55976 - DNA, 103 bp, Artificial Sequence
  Synthetic Polynucleotide
taatacgactcactataggggctgttactaatgctggtaaaatagtttataacagaggagaataaacatgtttaccagcaacctggcggcagcgcaaaagatg

SEQ ID NO: 55977 - DNA, 103 bp, Artificial Sequence
  Synthetic Polynucleotide
taatacgactcactatagggtccaagctgttactaatgctggtaaaatagaacagaggagactatttatgcagcattagaacctggcggcagcgcaaaagatg

SEQ ID NO: 55978 - DNA, 103 bp, Artificial Sequence
  Synthetic Polynucleotide
taatacgactcactataggggattgtccaagctgttactaatgctggtaaaacagaggagattaccaatgttagtaacaaacctggcggcagcgcaaaagatg

SEQ ID NO: 55979 - DNA, 103 bp, Artificial Sequence
  Synthetic Polynucleotide
taatacgactcactatagggggtcagattgtccaagctgttactaatgctaacagaggagaagcattatgaacagcttgaacctggcggcagcgcaaaagatg

SEQ ID NO: 55980 - DNA, 103 bp, Artificial Sequence
  Synthetic Polynucleotide
taatacgactcactatagggtggatggtcagattgtccaagctgttactaaacagaggagatagtaaatgcttggacaaaacctggcggcagcgcaaaagatg

SEQ ID NO: 55981 - DNA, 103 bp, Artificial Sequence
  Synthetic Polynucleotide
taatacgactcactatagggaatagatatatctaattgtatcagagagataacagaggagaatctctatgatacaattaaacctggcggcagcgcaaaagatg

SEQ ID NO: 55982 - DNA, 103 bp, Artificial Sequence
  Synthetic Polynucleotide
taatacgactcactatagggcgcaatggatggtcagattgtccaagctgtaacagaggagaacagctatgacaatctgaaacctggcggcagcgcaaaagatg

SEQ ID NO: 55983 - DNA, 103 bp, Artificial Sequence
  Synthetic Polynucleotide
taatacgactcactatagggttcaacgcaatggatggtcagattgtccaaaacagaggagattggacatgctgaccatcaacctggcggcagcgcaaaagatg

SEQ ID NO: 55984 - DNA, 103 bp, Artificial Sequence
  Synthetic Polynucleotide
taatacgactcactatagggcatcattcaacgcaatggatggtcagattgaacagaggagacaatctatgcatccattgaacctggcggcagcgcaaaagatg

SEQ ID NO: 55985 - DNA, 103 bp, Artificial Sequence
  Synthetic Polynucleotide
taatacgactcactatagggaactacatcattcaacgcaatggatggtcaaacagaggagatgaccaatgattgcgttgaacctggcggcagcgcaaaagatg

SEQ ID NO: 55986 - DNA, 103 bp, Artificial Sequence
  Synthetic Polynucleotide
taatacgactcactatagggacagcaactacatcattcaacgcaatggataacagaggagaatccatatggttgaatgaaacctggcggcagcgcaaaagatg

SEQ ID NO: 55987 - DNA, 103 bp, Artificial Sequence
  Synthetic Polynucleotide
taatacgactcactataggggaacaacagcaactacatcattcaacgcaaaacagaggagattgcgtatgatgatgtagaacctggcggcagcgcaaaagatg

SEQ ID NO: 55988 - DNA, 103 bp, Artificial Sequence
  Synthetic Polynucleotide
taatacgactcactatagggacgtagaacaacagcaactacatcattcaaaacagaggagattgaatatggtagttgctaacctggcggcagcgcaaaagatg

SEQ ID NO: 55989 - DNA, 103 bp, Artificial Sequence
  Synthetic Polynucleotide
taatacgactcactatagggcctagacgtagaacaacagcaactacatcaaacagaggagatgatgtatgtgctgttgtaacctggcggcagcgcaaaagatg

SEQ ID NO: 55990 - DNA, 103 bp, Artificial Sequence
  Synthetic Polynucleotide
taatacgactcactataggggtgctcctagacgtagaacaacagcaactaaacagaggagatagttgatgttgttctacaacctggcggcagcgcaaaagatg

SEQ ID NO: 55991 - DNA, 103 bp, Artificial Sequence
  Synthetic Polynucleotide
taatacgactcactatagggttctggtgctcctagacgtagaacaacagcaacagaggagagctgttatgctacgtctaaacctggcggcagcgcaaaagatg

SEQ ID NO: 55992 - DNA, 103 bp, Artificial Sequence
  Synthetic Polynucleotide
taatacgactcactataggggacacaatagatatatctaattgtatcagaaacagaggagatctgatatgattagatataacctggcggcagcgcaaaagatg

SEQ ID NO: 55993 - DNA, 103 bp, Artificial Sequence
  Synthetic Polynucleotide
taatacgactcactatagggaatacttctggtgctcctagacgtagaacaaacagaggagatgttctatgtctaggagcaacctggcggcagcgcaaaagatg

SEQ ID NO: 55994 - DNA, 103 bp, Artificial Sequence
  Synthetic Polynucleotide
taatacgactcactatagggctaaaaatacttctggtgctcctagacgtaaacagaggagatacgtcatggagcaccagaacctggcggcagcgcaaaagatg

SEQ ID NO: 55995 - DNA, 103 bp, Artificial Sequence
  Synthetic Polynucleotide
taatacgactcactataggggagctctaaaaatacttctggtgctcctagaacagaggagactaggaatgccagaagtaaacctggcggcagcgcaaaagatg

SEQ ID NO: 55996 - DNA, 103 bp, Artificial Sequence
  Synthetic Polynucleotide
taatacgactcactatagggtccaagagctctaaaaatacttctggtgctaacagaggagaagcaccatgagtatttttaacctggcggcagcgcaaaagatg

SEQ ID NO: 55997 - DNA, 103 bp, Artificial Sequence
  Synthetic Polynucleotide
taatacgactcactatagggcaacatccaagagctctaaaaatacttctgaacagaggagacagaagatgttttagagcaacctggcggcagcgcaaaagatg

SEQ ID NO: 55998 - DNA, 103 bp, Artificial Sequence
  Synthetic Polynucleotide
taatacgactcactatagggtacatcaacatccaagagctctaaaaatacaacagaggagagtatttatggagctcttgaacctggcggcagcgcaaaagatg

SEQ ID NO: 55999 - DNA, 103 bp, Artificial Sequence
  Synthetic Polynucleotide
taatacgactcactatagggtcttctacatcaacatccaagagctctaaaaacagaggagatttagaatgcttggatgtaacctggcggcagcgcaaaagatg

SEQ ID NO: 56000 - DNA, 103 bp, Artificial Sequence
  Synthetic Polynucleotide
taatacgactcactatagggcgtcttcttctacatcaacatccaagagctaacagaggagaagctctatgatgttgatgaacctggcggcagcgcaaaagatg

SEQ ID NO: 56001 - DNA, 103 bp, Artificial Sequence
  Synthetic Polynucleotide
taatacgactcactatagggatcctcgtcttcttctacatcaacatccaaaacagaggagattggatatggatgtagaaaacctggcggcagcgcaaaagatg

SEQ ID NO: 56002 - DNA, 103 bp, Artificial Sequence
  Synthetic Polynucleotide
taatacgactcactatagggtcaaaatcctcgtcttcttctacatcaacaaacagaggagatgttgaatgagaagaagaaacctggcggcagcgcaaaagatg

SEQ ID NO: 56003 - DNA, 103 bp, Artificial Sequence
  Synthetic Polynucleotide
taatacgactcactatagggctaccgacacaatagatatatctaattgtaaacagaggagatacaatatgatatatctaaacctggcggcagcgcaaaagatg

SEQ ID NO: 56004 - DNA, 103 bp, Artificial Sequence
  Synthetic Polynucleotide
taatacgactcactataggggtaaatcaaaatcctcgtcttcttctacataacagaggagaatgtagatgaagacgaggaacctggcggcagcgcaaaagatg

SEQ ID NO: 56005 - DNA, 103 bp, Artificial Sequence
  Synthetic Polynucleotide
taatacgactcactatagggcacatgtaaatcaaaatcctcgtcttcttcaacagaggagagaagaaatggaggattttaacctggcggcagcgcaaaagatg

SEQ ID NO: 56006 - DNA, 103 bp, Artificial Sequence
  Synthetic Polynucleotide
taatacgactcactatagggtgtatcacatgtaaatcaaaatcctcgtctaacagaggagaagacgaatgttttgatttaacctggcggcagcgcaaaagatg

SEQ ID NO: 56007 - DNA, 103 bp, Artificial Sequence
  Synthetic Polynucleotide
taatacgactcactatagggcaaaatgtatcacatgtaaatcaaaatcctaacagaggagaaggattatgatttacatgaacctggcggcagcgcaaaagatg

SEQ ID NO: 56008 - DNA, 103 bp, Artificial Sequence
  Synthetic Polynucleotide
taatacgactcactataggggagttcaaaatgtatcacatgtaaatcaaaaacagaggagatttgatatgcatgtgataaacctggcggcagcgcaaaagatg

SEQ ID NO: 56009 - DNA, 103 bp, Artificial Sequence
  Synthetic Polynucleotide
taatacgactcactatagggtcaaagagttcaaaatgtatcacatgtaaaaacagaggagatttacaatggatacatttaacctggcggcagcgcaaaagatg

SEQ ID NO: 56010 - DNA, 103 bp, Artificial Sequence
  Synthetic Polynucleotide
taatacgactcactatagggcaaaatcaaagagttcaaaatgtatcacataacagaggagaatgtgaatgattttgaacaacctggcggcagcgcaaaagatg

SEQ ID NO: 56011 - DNA, 103 bp, Artificial Sequence
  Synthetic Polynucleotide
taatacgactcactatagggtgacacaaaatcaaagagttcaaaatgtataacagaggagaatacatatggaactctttaacctggcggcagcgcaaaagatg

SEQ ID NO: 56012 - DNA, 103 bp, Artificial Sequence
  Synthetic Polynucleotide
taatacgactcactataggggcatgtgacacaaaatcaaagagttcaaaaaacagaggagattttgaatgctttgatttaacctggcggcagcgcaaaagatg

SEQ ID NO: 56013 - DNA, 103 bp, Artificial Sequence
  Synthetic Polynucleotide
taatacgactcactatagggccggcgcatgtgacacaaaatcaaagagttaacagaggagaaactctatgattttgtgtaacctggcggcagcgcaaaagatg

SEQ ID NO: 56014 - DNA, 103 bp, Artificial Sequence
  Synthetic Polynucleotide
taatacgactcactatagggaaaatatgataaaaactattaacttatgtaaacagaggagatacataatgtaatagtttaacctggcggcagcgcaaaagatg

SEQ ID NO: 56015 - DNA, 103 bp, Artificial Sequence
  Synthetic Polynucleotide
taatacgactcactatagggatcgtctaccgacacaatagatatatctaaaacagaggagattagatatgtctattgtgaacctggcggcagcgcaaaagatg

SEQ ID NO: 56016 - DNA, 103 bp, Artificial Sequence
  Synthetic Polynucleotide
taatacgactcactataggggactgccggcgcatgtgacacaaaatcaaaaacagaggagatttgatatggtgtcacataacctggcggcagcgcaaaagatg

SEQ ID NO: 56017 - DNA, 103 bp, Artificial Sequence
  Synthetic Polynucleotide
taatacgactcactataggggatgtgactgccggcgcatgtgacacaaaaaacagaggagattttgtatgacatgcgccaacctggcggcagcgcaaaagatg

SEQ ID NO: 56018 - DNA, 103 bp, Artificial Sequence
  Synthetic Polynucleotide
taatacgactcactatagggaaacagatgtgactgccggcgcatgtgacaaacagaggagatgtcacatgcgccggcagaacctggcggcagcgcaaaagatg

SEQ ID NO: 56019 - DNA, 103 bp, Artificial Sequence
  Synthetic Polynucleotide
taatacgactcactatagggttctcaaacagatgtgactgccggcgcatgaacagaggagacatgcgatggcagtcacaaacctggcggcagcgcaaaagatg

SEQ ID NO: 56020 - DNA, 103 bp, Artificial Sequence
  Synthetic Polynucleotide
taatacgactcactatagggcttaattctcaaacagatgtgactgccggcaacagaggagagccggcatgcacatctgtaacctggcggcagcgcaaaagatg

SEQ ID NO: 56021 - DNA, 103 bp, Artificial Sequence
  Synthetic Polynucleotide
taatacgactcactatagggataatcttaattctcaaacagatgtgactgaacagaggagacagtcaatgctgtttgagaacctggcggcagcgcaaaagatg

SEQ ID NO: 56022 - DNA, 103 bp, Artificial Sequence
  Synthetic Polynucleotide
taatacgactcactatagggcaacaataatcttaattctcaaacagatgtaacagaggagaacatctatgtgagaattaaacctggcggcagcgcaaaagatg

SEQ ID NO: 56023 - DNA, 103 bp, Artificial Sequence
  Synthetic Polynucleotide
taatacgactcactatagggggaggcaacaataatcttaattctcaaacaaacagaggagatgtttgatgattaagattaacctggcggcagcgcaaaagatg

SEQ ID NO: 56024 - DNA, 103 bp, Artificial Sequence
  Synthetic Polynucleotide
taatacgactcactatagggtcaaaggaggcaacaataatcttaattctcaacagaggagagagaatatggattattgtaacctggcggcagcgcaaaagatg

SEQ ID NO: 56025 - DNA, 103 bp, Artificial Sequence
  Synthetic Polynucleotide
taatacgactcactatagggagccgtcaaaggaggcaacaataatcttaaaacagaggagattaagaatgttgttgcctaacctggcggcagcgcaaaagatg

SEQ ID NO: 56026 - DNA, 103 bp, Artificial Sequence
  Synthetic Polynucleotide
taatacgactcactatagggacggtatcgtctaccgacacaatagatataaacagaggagatatatcatgtgtgtcggtaacctggcggcagcgcaaaagatg

SEQ ID NO: 56027 - DNA, 103 bp, Artificial Sequence
  Synthetic Polynucleotide
taatacgactcactataggggatgcagccgtcaaaggaggcaacaataataacagaggagaattattatggcctcctttaacctggcggcagcgcaaaagatg

SEQ ID NO: 56028 - DNA, 103 bp, Artificial Sequence
  Synthetic Polynucleotide
taatacgactcactataggggtggagatgcagccgtcaaaggaggcaacaaacagaggagatgttgcatgctttgacggaacctggcggcagcgcaaaagatg

SEQ ID NO: 56029 - DNA, 103 bp, Artificial Sequence
  Synthetic Polynucleotide
taatacgactcactataggggatcggtggagatgcagccgtcaaaggaggaacagaggagacctcctatgacggctgcaaacctggcggcagcgcaaaagatg

SEQ ID NO: 56030 - DNA, 103 bp, Artificial Sequence
  Synthetic Polynucleotide
taatacgactcactataggggcacagatcggtggagatgcagccgtcaaaaacagaggagatttgacatgtgcatctccaacctggcggcagcgcaaaagatg

SEQ ID NO: 56031 - DNA, 103 bp, Artificial Sequence
  Synthetic Polynucleotide
taatacgactcactatagggtactagcacagatcggtggagatgcagccgaacagaggagacggctgatgctccaccgaaacctggcggcagcgcaaaagatg

SEQ ID NO: 56032 - DNA, 103 bp, Artificial Sequence
  Synthetic Polynucleotide
taatacgactcactatagggaaatctactagcacagatcggtggagatgcaacagaggagagcatctatgccgatctgtaacctggcggcagcgcaaaagatg

SEQ ID NO: 56033 - DNA, 103 bp, Artificial Sequence
  Synthetic Polynucleotide
taatacgactcactatagggcttaaaaatctactagcacagatcggtggaaacagaggagatccaccatgctgtgctagaacctggcggcagcgcaaaagatg

SEQ ID NO: 56034 - DNA, 103 bp, Artificial Sequence
  Synthetic Polynucleotide
taatacgactcactatagggcacagcttaaaaatctactagcacagatcgaacagaggagacgatctatgctagtagataacctggcggcagcgcaaaagatg

SEQ ID NO: 56035 - DNA, 103 bp, Artificial Sequence
  Synthetic Polynucleotide
taatacgactcactatagggtacaccacagcttaaaaatctactagcacaaacagaggagatgtgctatgagatttttaaacctggcggcagcgcaaaagatg

SEQ ID NO: 56036 - DNA, 103 bp, Artificial Sequence
  Synthetic Polynucleotide
taatacgactcactatagggaagattacaccacagcttaaaaatctactaaacagaggagatagtagatgtttaagctgaacctggcggcagcgcaaaagatg

SEQ ID NO: 56037 - DNA, 103 bp, Artificial Sequence
  Synthetic Polynucleotide
taatacgactcactatagggatgtaacggtatcgtctaccgacacaatagaacagaggagactattgatgcggtagacgaacctggcggcagcgcaaaagatg

SEQ ID NO: 56038 - DNA, 103 bp, Artificial Sequence
  Synthetic Polynucleotide
taatacgactcactatagggttaataagattacaccacagcttaaaaatcaacagaggagagattttatggctgtggtgaacctggcggcagcgcaaaagatg

SEQ ID NO: 56039 - DNA, 103 bp, Artificial Sequence
  Synthetic Polynucleotide
taatacgactcactatagggaacagttaataagattacaccacagcttaaaacagaggagattaagcatgggtgtaatcaacctggcggcagcgcaaaagatg

SEQ ID NO: 56040 - DNA, 103 bp, Artificial Sequence
  Synthetic Polynucleotide
taatacgactcactatagggatcgaaacagttaataagattacaccacagaacagaggagactgtggatgaatcttattaacctggcggcagcgcaaaagatg

SEQ ID NO: 56041 - DNA, 103 bp, Artificial Sequence
  Synthetic Polynucleotide
taatacgactcactatagggattatatcgaaacagttaataagattacacaacagaggagagtgtaaatgtattaactgaacctggcggcagcgcaaaagatg

SEQ ID NO: 56042 - DNA, 103 bp, Artificial Sequence
  Synthetic Polynucleotide
taatacgactcactatagggcgatgattatatcgaaacagttaataagataacagaggagaatcttaatgactgtttcgaacctggcggcagcgcaaaagatg

SEQ ID NO: 56043 - DNA, 103 bp, Artificial Sequence
  Synthetic Polynucleotide
taatacgactcactatagggagttacgatgattatatcgaaacagttaataacagaggagaattaacatgttcgatataaacctggcggcagcgcaaaagatg

SEQ ID NO: 56044 - DNA, 103 bp, Artificial Sequence
  Synthetic Polynucleotide
taatacgactcactataggggaagcagttacgatgattatatcgaaacagaacagaggagactgtttatgtataatcataacctggcggcagcgcaaaagatg

SEQ ID NO: 56045 - DNA, 103 bp, Artificial Sequence
  Synthetic Polynucleotide
taatacgactcactatagggcgttagaagcagttacgatgattatatcgaaacagaggagatcgataatgtcatcgtaaaacctggcggcagcgcaaaagatg

SEQ ID NO: 56046 - DNA, 103 bp, Artificial Sequence
  Synthetic Polynucleotide
taatacgactcactatagggttagccgttagaagcagttacgatgattataacagaggagaataatcatggtaactgctaacctggcggcagcgcaaaagatg

SEQ ID NO: 56047 - DNA, 103 bp, Artificial Sequence
  Synthetic Polynucleotide
taatacgactcactatagggaaaatttagccgttagaagcagttacgatgaacagaggagacatcgtatgtgcttctaaaacctggcggcagcgcaaaagatg

SEQ ID NO: 56048 - DNA, 103 bp, Artificial Sequence
  Synthetic Polynucleotide
taatacgactcactatagggttcaaatgtaacggtatcgtctaccgacacaacagaggagagtgtcgatggacgataccaacctggcggcagcgcaaaagatg

SEQ ID NO: 56049 - DNA, 103 bp, Artificial Sequence
  Synthetic Polynucleotide
taatacgactcactatagggtaaaaaaaatttagccgttagaagcagttaaacagaggagataactgatgctaacggctaacctggcggcagcgcaaaagatg

SEQ ID NO: 56050 - DNA, 103 bp, Artificial Sequence
  Synthetic Polynucleotide
taatacgactcactataggggcggataaaaaaaatttagccgttagaagcaacagaggagagcttctatgggctaaattaacctggcggcagcgcaaaagatg

SEQ ID NO: 56051 - DNA, 103 bp, Artificial Sequence
  Synthetic Polynucleotide
taatacgactcactatagggaaatggcggataaaaaaaatttagccgttaaacagaggagataacggatgaatttttttaacctggcggcagcgcaaaagatg

SEQ ID NO: 56052 - DNA, 103 bp, Artificial Sequence
  Synthetic Polynucleotide
taatacgactcactatagggcttctaaatggcggataaaaaaaatttagcaacagaggagagctaaaatgtttttatccaacctggcggcagcgcaaaagatg

SEQ ID NO: 56053 - DNA, 103 bp, Artificial Sequence
  Synthetic Polynucleotide
taatacgactcactatagggtttagcttctaaatggcggataaaaaaaataacagaggagaatttttatgatccgccataacctggcggcagcgcaaaagatg

SEQ ID NO: 56054 - DNA, 103 bp, Artificial Sequence
  Synthetic Polynucleotide
taatacgactcactatagggatatttttagcttctaaatggcggataaaaaacagaggagattttatatgccatttagaaacctggcggcagcgcaaaagatg

SEQ ID NO: 56055 - DNA, 103 bp, Artificial Sequence
  Synthetic Polynucleotide
taatacgactcactatagggtaaaaatatttttagcttctaaatggcggaaacagaggagatccgccatgtagaagctaaacctggcggcagcgcaaaagatg

SEQ ID NO: 56056 - DNA, 103 bp, Artificial Sequence
  Synthetic Polynucleotide
taatacgactcactatagggataaataaaaatatttttagcttctaaatgaacagaggagacatttaatggctaaaaataacctggcggcagcgcaaaagatg

SEQ ID NO: 56057 - DNA, 103 bp, Artificial Sequence
  Synthetic Polynucleotide
taatacgactcactatagggtctgtataaataaaaatatttttagcttctaacagaggagaagaagcatgaaatattttaacctggcggcagcgcaaaagatg

SEQ ID NO: 56058 - DNA, 103 bp, Artificial Sequence
  Synthetic Polynucleotide
taatacgactcactatagggaatcttctgtataaataaaaatatttttagaacagaggagactaaaaatgtttttatttaacctggcggcagcgcaaaagatg

SEQ ID NO: 56059 - DNA, 103 bp, Artificial Sequence
  Synthetic Polynucleotide
taatacgactcactatagggattaattcaaatgtaacggtatcgtctaccaacagaggagaggtagaatgtaccgttacaacctggcggcagcgcaaaagatg

SEQ ID NO: 56060 - DNA, 103 bp, Artificial Sequence
  Synthetic Polynucleotide
taatacgactcactatagggagttaaatcttctgtataaataaaaatattaacagaggagaaatattatgatttatacaaacctggcggcagcgcaaaagatg

SEQ ID NO: 56061 - DNA, 103 bp, Artificial Sequence
  Synthetic Polynucleotide
taatacgactcactatagggaatctagttaaatcttctgtataaataaaaaacagaggagattttatatgtacagaagaaacctggcggcagcgcaaaagatg

SEQ ID NO: 56062 - DNA, 103 bp, Artificial Sequence
  Synthetic Polynucleotide
taatacgactcactatagggtgtataatctagttaaatcttctgtataaaaacagaggagatttataatgaagatttaaaacctggcggcagcgcaaaagatg

SEQ ID NO: 56063 - DNA, 103 bp, Artificial Sequence
  Synthetic Polynucleotide
taatacgactcactatagggttcattgtataatctagttaaatcttctgtaacagaggagaacagaaatgttaactagaaacctggcggcagcgcaaaagatg

SEQ ID NO: 56064 - DNA, 103 bp, Artificial Sequence
  Synthetic Polynucleotide
taatacgactcactatagggattagttcattgtataatctagttaaatctaacagaggagaagatttatgtagattataaacctggcggcagcgcaaaagatg

SEQ ID NO: 56065 - DNA, 103 bp, Artificial Sequence
  Synthetic Polynucleotide
taatacgactcactatagggatcatattagttcattgtataatctagttaaacagaggagataactaatgtatacaatgaacctggcggcagcgcaaaagatg

SEQ ID NO: 56066 - DNA, 103 bp, Artificial Sequence
  Synthetic Polynucleotide
taatacgactcactatagggaaaggatcatattagttcattgtataatctaacagaggagaagattaatgaatgaactaaacctggcggcagcgcaaaagatg

SEQ ID NO: 56067 - DNA, 103 bp, Artificial Sequence
  Synthetic Polynucleotide
taatacgactcactatagggctggaaaaggatcatattagttcattgtataacagaggagaatacaaatgactaatatgaacctggcggcagcgcaaaagatg

SEQ ID NO: 56068 - DNA, 103 bp, Artificial Sequence
  Synthetic Polynucleotide
taatacgactcactatagggataatctggaaaaggatcatattagttcataacagaggagaatgaacatgtatgatcctaacctggcggcagcgcaaaagatg

SEQ ID NO: 56069 - DNA, 103 bp, Artificial Sequence
  Synthetic Polynucleotide
taatacgactcactatagggtgtaaataatctggaaaaggatcatattagaacagaggagactaataatgtccttttccaacctggcggcagcgcaaaagatg

SEQ ID NO: 56070 - DNA, 103 bp, Artificial Sequence
  Synthetic Polynucleotide
taatacgactcactatagggacaccattaattcaaatgtaacggtatcgtaacagaggagaacgataatgttacatttgaacctggcggcagcgcaaaagatg

SEQ ID NO: 56071 - DNA, 103 bp, Artificial Sequence
  Synthetic Polynucleotide
taatacgactcactatagggaggtttgtaaataatctggaaaaggatcataacagaggagaatgatcatgttccagattaacctggcggcagcgcaaaagatg

SEQ ID NO: 56072 - DNA, 103 bp, Artificial Sequence
  Synthetic Polynucleotide
taatacgactcactatagggataccaggtttgtaaataatctggaaaaggaacagaggagaccttttatggattatttaaacctggcggcagcgcaaaagatg

SEQ ID NO: 56073 - DNA, 103 bp, Artificial Sequence
  Synthetic Polynucleotide
taatacgactcactatagggaagaaataccaggtttgtaaataatctggaaacagaggagatccagaatgtttacaaacaacctggcggcagcgcaaaagatg

SEQ ID NO: 56074 - DNA, 103 bp, Artificial Sequence
  Synthetic Polynucleotide
taatacgactcactataggggaaacaagaaataccaggtttgtaaataataacagaggagaattattatgaaacctggtaacctggcggcagcgcaaaagatg

SEQ ID NO: 56075 - DNA, 103 bp, Artificial Sequence
  Synthetic Polynucleotide
taatacgactcactatagggctccagaaacaagaaataccaggtttgtaaaacagaggagattacaaatgtggtatttcaacctggcggcagcgcaaaagatg

SEQ ID NO: 56076 - DNA, 103 bp, Artificial Sequence
  Synthetic Polynucleotide
taatacgactcactataggggcctcctccagaaacaagaaataccaggttaacagaggagaaacctgatgtttcttgttaacctggcggcagcgcaaaagatg

SEQ ID NO: 56077 - DNA, 103 bp, Artificial Sequence
  Synthetic Polynucleotide
taatacgactcactatagggaacttgcctcctccagaaacaagaaataccaacagaggagaggtattatgtgtttctggaacctggcggcagcgcaaaagatg

SEQ ID NO: 56078 - DNA, 103 bp, Artificial Sequence
  Synthetic Polynucleotide
taatacgactcactatagggatgtaaacttgcctcctccagaaacaagaaaacagaggagattcttgatgctggaggagaacctggcggcagcgcaaaagatg

SEQ ID NO: 56079 - DNA, 103 bp, Artificial Sequence
  Synthetic Polynucleotide
taatacgactcactatagggtccgaatgtaaacttgcctcctccagaaacaacagaggagagtttctatgggaggcaagaacctggcggcagcgcaaaagatg

SEQ ID NO: 56080 - DNA, 103 bp, Artificial Sequence
  Synthetic Polynucleotide
taatacgactcactatagggccaagtccgaatgtaaacttgcctcctccaaacagaggagatggaggatgcaagtttacaacctggcggcagcgcaaaagatg

SEQ ID NO: 56081 - DNA, 103 bp, Artificial Sequence
  Synthetic Polynucleotide
taatacgactcactatagggatggaacaccattaattcaaatgtaacggtaacagaggagaaccgttatgtttgaattaaacctggcggcagcgcaaaagatg

SEQ ID NO: 56082 - DNA, 103 bp, Artificial Sequence
  Synthetic Polynucleotide
taatacgactcactatagggaaaatccaagtccgaatgtaaacttgcctcaacagaggagagaggcaatgttacattcgaacctggcggcagcgcaaaagatg

SEQ ID NO: 56083 - DNA, 103 bp, Artificial Sequence
  Synthetic Polynucleotide
taatacgactcactatagggctcacaaaatccaagtccgaatgtaaacttaacagaggagaaagtttatgttcggacttaacctggcggcagcgcaaaagatg

SEQ ID NO: 56084 - DNA, 103 bp, Artificial Sequence
  Synthetic Polynucleotide
taatacgactcactatagggaagaactcacaaaatccaagtccgaatgtaaacagaggagatacattatgacttggattaacctggcggcagcgcaaaagatg

SEQ ID NO: 56085 - DNA, 103 bp, Artificial Sequence
  Synthetic Polynucleotide
taatacgactcactatagggagatcaagaactcacaaaatccaagtccgaaacagaggagatcggacatggattttgtgaacctggcggcagcgcaaaagatg

SEQ ID NO: 56086 - DNA, 103 bp, Artificial Sequence
  Synthetic Polynucleotide
taatacgactcactatagggtaataagatcaagaactcacaaaatccaagaacagaggagacttggaatgtgtgagttcaacctggcggcagcgcaaaagatg

SEQ ID NO: 56087 - DNA, 103 bp, Artificial Sequence
  Synthetic Polynucleotide
taatacgactcactatagggatgtataataagatcaagaactcacaaaataacagaggagaattttgatggttcttgataacctggcggcagcgcaaaagatg

SEQ ID NO: 56088 - DNA, 103 bp, Artificial Sequence
  Synthetic Polynucleotide
taatacgactcactatagggacgcgatgtataataagatcaagaactcacaacagaggagagtgagtatgtgatcttataacctggcggcagcgcaaaagatg

SEQ ID NO: 56089 - DNA, 103 bp, Artificial Sequence
  Synthetic Polynucleotide
taatacgactcactatagggcctatacgcgatgtataataagatcaagaaaacagaggagattcttgatgttattatacaacctggcggcagcgcaaaagatg

SEQ ID NO: 56090 - DNA, 103 bp, Artificial Sequence
  Synthetic Polynucleotide
taatacgactcactataggggccatcctatacgcgatgtataataagatcaacagaggagagatcttatgatacatcgcaacctggcggcagcgcaaaagatg

SEQ ID NO: 56091 - DNA, 103 bp, Artificial Sequence
  Synthetic Polynucleotide
taatacgactcactatagggccgtcgccatcctatacgcgatgtataataaacagaggagatattatatgtcgcgtataaacctggcggcagcgcaaaagatg

SEQ ID NO: 56092 - DNA, 103 bp, Artificial Sequence
  Synthetic Polynucleotide
taatacgactcactataggggtaaaatggaacaccattaattcaaatgtaaacagaggagatacattatgattaatggtaacctggcggcagcgcaaaagatg

SEQ ID NO: 56093 - DNA, 103 bp, Artificial Sequence
  Synthetic Polynucleotide
taatacgactcactatagggagttaccgtcgccatcctatacgcgatgtaaacagaggagatacatcatgtataggatgaacctggcggcagcgcaaaagatg

SEQ ID NO: 56094 - DNA, 103 bp, Artificial Sequence
  Synthetic Polynucleotide
taatacgactcactataggggtagcagttaccgtcgccatcctatacgcgaacagaggagacgcgtaatggatggcgacaacctggcggcagcgcaaaagatg

SEQ ID NO: 56095 - DNA, 103 bp, Artificial Sequence
  Synthetic Polynucleotide
taatacgactcactatagggtttgtgtagcagttaccgtcgccatcctataacagaggagaataggaatgcgacggtaaaacctggcggcagcgcaaaagatg

SEQ ID NO: 56096 - DNA, 103 bp, Artificial Sequence
  Synthetic Polynucleotide
taatacgactcactatagggtggtatttgtgtagcagttaccgtcgccataacagaggagaatggcgatggtaactgctaacctggcggcagcgcaaaagatg

SEQ ID NO: 56097 - DNA, 103 bp, Artificial Sequence
  Synthetic Polynucleotide
taatacgactcactatagggttgattggtatttgtgtagcagttaccgtcaacagaggagagacggtatgtgctacacaaacctggcggcagcgcaaaagatg

SEQ ID NO: 56098 - DNA, 103 bp, Artificial Sequence
  Synthetic Polynucleotide
taatacgactcactatagggttcttttgattggtatttgtgtagcagttaaacagaggagataactgatgcacaaatacaacctggcggcagcgcaaaagatg

SEQ ID NO: 56099 - DNA, 103 bp, Artificial Sequence
  Synthetic Polynucleotide
taatacgactcactatagggtattcttcttttgattggtatttgtgtagcaacagaggagagctacaatgataccaatcaacctggcggcagcgcaaaagatg

SEQ ID NO: 56100 - DNA, 103 bp, Artificial Sequence
  Synthetic Polynucleotide
taatacgactcactatagggattggtattcttcttttgattggtatttgtaacagaggagaacaaatatgaatcaaaagaacctggcggcagcgcaaaagatg

SEQ ID NO: 56101 - DNA, 103 bp, Artificial Sequence
  Synthetic Polynucleotide
taatacgactcactatagggaaatgattggtattcttcttttgattggtaaacagaggagataccaaatgaaagaagaaaacctggcggcagcgcaaaagatg

SEQ ID NO: 56102 - DNA, 103 bp, Artificial Sequence
  Synthetic Polynucleotide
taatacgactcactatagggtcaataaatgattggtattcttcttttgataacagaggagaatcaaaatgagaataccaaacctggcggcagcgcaaaagatg

SEQ ID NO: 56103 - DNA, 103 bp, Artificial Sequence
  Synthetic Polynucleotide
taatacgactcactatagggaagttgtaaaatggaacaccattaattcaaaacagaggagattgaatatgtggtgttccaacctggcggcagcgcaaaagatg

SEQ ID NO: 56104 - DNA, 103 bp, Artificial Sequence
  Synthetic Polynucleotide
taatacgactcactatagggtattatcaataaatgattggtattcttcttaacagaggagaaagaagatgaccaatcataacctggcggcagcgcaaaagatg

SEQ ID NO: 56105 - DNA, 103 bp, Artificial Sequence
  Synthetic Polynucleotide
taatacgactcactataggggaagttattatcaataaatgattggtattcaacagaggagagaatacatgtcatttattaacctggcggcagcgcaaaagatg

SEQ ID NO: 56106 - DNA, 103 bp, Artificial Sequence
  Synthetic Polynucleotide
taatacgactcactatagggatagtgaagttattatcaataaatgattggaacagaggagaccaatcatgtattgataaaacctggcggcagcgcaaaagatg

SEQ ID NO: 56107 - DNA, 103 bp, Artificial Sequence
  Synthetic Polynucleotide
taatacgactcactataggggatcaatagtgaagttattatcaataaatgaacagaggagacatttaatgataataactaacctggcggcagcgcaaaagatg

SEQ ID NO: 56108 - DNA, 103 bp, Artificial Sequence
  Synthetic Polynucleotide
taatacgactcactatagggtacttgatcaatagtgaagttattatcaataacagaggagaattgatatgaacttcactaacctggcggcagcgcaaaagatg

SEQ ID NO: 56109 - DNA, 103 bp, Artificial Sequence
  Synthetic Polynucleotide
taatacgactcactatagggttgtatacttgatcaatagtgaagttattaaacagaggagataataaatgcactattgaaacctggcggcagcgcaaaagatg

SEQ ID NO: 56110 - DNA, 103 bp, Artificial Sequence
  Synthetic Polynucleotide
taatacgactcactatagggatatattgtatacttgatcaatagtgaagtaacagaggagaacttcaatgttgatcaagaacctggcggcagcgcaaaagatg

SEQ ID NO: 56111 - DNA, 103 bp, Artificial Sequence
  Synthetic Polynucleotide
taatacgactcactatagggagatgatatattgtatacttgatcaatagtaacagaggagaactattatgcaagtatacaacctggcggcagcgcaaaagatg

SEQ ID NO: 56112 - DNA, 103 bp, Artificial Sequence
  Synthetic Polynucleotide
taatacgactcactatagggtgaaaagatgatatattgtatacttgatcaaacagaggagatgatcaatgatacaatataacctggcggcagcgcaaaagatg

SEQ ID NO: 56113 - DNA, 103 bp, Artificial Sequence
  Synthetic Polynucleotide
taatacgactcactatagggtttagtgaaaagatgatatattgtatacttaacagaggagaaagtatatgatatatcataacctggcggcagcgcaaaagatg

SEQ ID NO: 56114 - DNA, 103 bp, Artificial Sequence
  Synthetic Polynucleotide
taatacgactcactataggggttaaaagttgtaaaatggaacaccattaaaacagaggagattaatgatgttccattttaacctggcggcagcgcaaaagatg

SEQ ID NO: 56115 - DNA, 103 bp, Artificial Sequence
  Synthetic Polynucleotide
taatacgactcactatagggacttatttagtgaaaagatgatatattgtaaacagaggagatacaatatgtcatcttttaacctggcggcagcgcaaaagatg

SEQ ID NO: 56116 - DNA, 103 bp, Artificial Sequence
  Synthetic Polynucleotide
taatacgactcactatagggttactacttatttagtgaaaagatgatataaacagaggagatatatcatgttttcactaaacctggcggcagcgcaaaagatg

SEQ ID NO: 56117 - DNA, 103 bp, Artificial Sequence
  Synthetic Polynucleotide
taatacgactcactatagggcattattactacttatttagtgaaaagatgaacagaggagacatcttatgactaaataaaacctggcggcagcgcaaaagatg

SEQ ID NO: 56118 - DNA, 103 bp, Artificial Sequence
  Synthetic Polynucleotide
taatacgactcactatagggtgaatcattattactacttatttagtgaaaaacagaggagatttcacatgataagtagtaacctggcggcagcgcaaaagatg

SEQ ID NO: 56119 - DNA, 103 bp, Artificial Sequence
  Synthetic Polynucleotide
taatacgactcactatagggattgttgaatcattattactacttatttagaacagaggagactaaatatgtagtaataaaacctggcggcagcgcaaaagatg

SEQ ID NO: 56120 - DNA, 103 bp, Artificial Sequence
  Synthetic Polynucleotide
taatacgactcactatagggtcgacattgttgaatcattattactacttaaacagaggagataagtaatgataatgattaacctggcggcagcgcaaaagatg

SEQ ID NO: 56121 - DNA, 103 bp, Artificial Sequence
  Synthetic Polynucleotide
taatacgactcactatagggatatctcgacattgttgaatcattattactaacagaggagaagtaatatggattcaacaaacctggcggcagcgcaaaagatg

SEQ ID NO: 56122 - DNA, 103 bp, Artificial Sequence
  Synthetic Polynucleotide
taatacgactcactatagggttcatatatctcgacattgttgaatcattaaacagaggagataatgaatgaacaatgtcaacctggcggcagcgcaaaagatg

SEQ ID NO: 56123 - DNA, 103 bp, Artificial Sequence
  Synthetic Polynucleotide
taatacgactcactatagggtatcgttcatatatctcgacattgttgaataacagaggagaattcaaatgtgtcgagataacctggcggcagcgcaaaagatg

SEQ ID NO: 56124 - DNA, 103 bp, Artificial Sequence
  Synthetic Polynucleotide
taatacgactcactataggggttattatcgttcatatatctcgacattgtaacagaggagaacaatgatgagatatatgaacctggcggcagcgcaaaagatg

SEQ ID NO: 56125 - DNA, 103 bp, Artificial Sequence
  Synthetic Polynucleotide
taatacgactcactatagggttagaaaaatatgataaaaactattaacttaacagaggagaaagttaatggtttttatcaacctggcggcagcgcaaaagatg

SEQ ID NO: 56126 - DNA, 103 bp, Artificial Sequence
  Synthetic Polynucleotide
taatacgactcactatagggaacttgttaaaagttgtaaaatggaacaccaacagaggagaggtgttatgttttacaacaacctggcggcagcgcaaaagatg

SEQ ID NO: 56127 - DNA, 103 bp, Artificial Sequence
  Synthetic Polynucleotide
taatacgactcactatagggactaagttattatcgttcatatatctcgacaacagaggagagtcgagatgtatgaacgaaacctggcggcagcgcaaaagatg

SEQ ID NO: 56128 - DNA, 103 bp, Artificial Sequence
  Synthetic Polynucleotide
taatacgactcactatagggcgtaaactaagttattatcgttcatatatcaacagaggagagatataatgacgataataaacctggcggcagcgcaaaagatg

SEQ ID NO: 56129 - DNA, 103 bp, Artificial Sequence
  Synthetic Polynucleotide
taatacgactcactatagggatttccgtaaactaagttattatcgttcataacagaggagaatgaacatgaataacttaaacctggcggcagcgcaaaagatg

SEQ ID NO: 56130 - DNA, 103 bp, Artificial Sequence
  Synthetic Polynucleotide
taatacgactcactataggggcgatatttccgtaaactaagttattatcgaacagaggagacgataaatgcttagtttaaacctggcggcagcgcaaaagatg

SEQ ID NO: 56131 - DNA, 103 bp, Artificial Sequence
  Synthetic Polynucleotide
taatacgactcactatagggtcatagcgatatttccgtaaactaagttataacagaggagaataactatgtttacggaaaacctggcggcagcgcaaaagatg

SEQ ID NO: 56132 - DNA, 103 bp, Artificial Sequence
  Synthetic Polynucleotide
taatacgactcactatagggaccaatcatagcgatatttccgtaaactaaaacagaggagattagttatgggaaatatcaacctggcggcagcgcaaaagatg

SEQ ID NO: 56133 - DNA, 103 bp, Artificial Sequence
  Synthetic Polynucleotide
taatacgactcactatagggttcataccaatcatagcgatatttccgtaaaacagaggagattacggatgtatcgctataacctggcggcagcgcaaaagatg

SEQ ID NO: 56134 - DNA, 103 bp, Artificial Sequence
  Synthetic Polynucleotide
taatacgactcactatagggagtcattcataccaatcatagcgatatttcaacagaggagagaaataatgctatgattgaacctggcggcagcgcaaaagatg

SEQ ID NO: 56135 - DNA, 103 bp, Artificial Sequence
  Synthetic Polynucleotide
taatacgactcactatagggagtggagtcattcataccaatcatagcgataacagaggagaatcgctatgattggtatgaacctggcggcagcgcaaaagatg

SEQ ID NO: 56136 - DNA, 103 bp, Artificial Sequence
  Synthetic Polynucleotide
taatacgactcactataggggagttagtggagtcattcataccaatcataaacagaggagatatgatatgtatgaatgaaacctggcggcagcgcaaaagatg

SEQ ID NO: 56137 - DNA, 103 bp, Artificial Sequence
  Synthetic Polynucleotide
taatacgactcactatagggtggtcaacttgttaaaagttgtaaaatggaaacagaggagatccattatgcaacttttaaacctggcggcagcgcaaaagatg

SEQ ID NO: 56138 - DNA, 103 bp, Artificial Sequence
  Synthetic Polynucleotide
taatacgactcactatagggccacagagttagtggagtcattcataccaaaacagaggagattggtaatgatgactccaaacctggcggcagcgcaaaagatg

SEQ ID NO: 56139 - DNA, 103 bp, Artificial Sequence
  Synthetic Polynucleotide
taatacgactcactataggggcaccccacagagttagtggagtcattcataacagaggagaatgaatatgtccactaacaacctggcggcagcgcaaaagatg

SEQ ID NO: 56140 - DNA, 103 bp, Artificial Sequence
  Synthetic Polynucleotide
taatacgactcactatagggactgcgcaccccacagagttagtggagtcaaacagaggagatgactcatgtaactctgtaacctggcggcagcgcaaaagatg

SEQ ID NO: 56141 - DNA, 103 bp, Artificial Sequence
  Synthetic Polynucleotide
taatacgactcactatagggaaagcactgcgcaccccacagagttagtggaacagaggagaccactaatgctgtggggtaacctggcggcagcgcaaaagatg

SEQ ID NO: 56142 - DNA, 103 bp, Artificial Sequence
  Synthetic Polynucleotide
taatacgactcactatagggtggggaaagcactgcgcaccccacagagttaacagaggagaaactctatggggtgcgcaaacctggcggcagcgcaaaagatg

SEQ ID NO: 56143 - DNA, 103 bp, Artificial Sequence
  Synthetic Polynucleotide
taatacgactcactatagggctatgtggggaaagcactgcgcaccccacaaacagaggagatgtgggatgcgcagtgctaacctggcggcagcgcaaaagatg

SEQ ID NO: 56144 - DNA, 103 bp, Artificial Sequence
  Synthetic Polynucleotide
taatacgactcactatagggttattctatgtggggaaagcactgcgcaccaacagaggagaggtgcgatgtgctttcccaacctggcggcagcgcaaaagatg

SEQ ID NO: 56145 - DNA, 103 bp, Artificial Sequence
  Synthetic Polynucleotide
taatacgactcactatagggctaatttattctatgtggggaaagcactgcaacagaggagagcagtgatgtccccacataacctggcggcagcgcaaaagatg

SEQ ID NO: 56146 - DNA, 103 bp, Artificial Sequence
  Synthetic Polynucleotide
taatacgactcactataggggaatgctaatttattctatgtggggaaagcaacagaggagagctttcatgacatagaataacctggcggcagcgcaaaagatg

SEQ ID NO: 56147 - DNA, 103 bp, Artificial Sequence
  Synthetic Polynucleotide
taatacgactcactatagggagtcggaatgctaatttattctatgtggggaacagaggagaccccacatggaataaattaacctggcggcagcgcaaaagatg

SEQ ID NO: 56148 - DNA, 103 bp, Artificial Sequence
  Synthetic Polynucleotide
taatacgactcactatagggtaaattggtcaacttgttaaaagttgtaaaaacagaggagatttacaatgtttaacaagaacctggcggcagcgcaaaagatg

SEQ ID NO: 56149 - DNA, 103 bp, Artificial Sequence
  Synthetic Polynucleotide
taatacgactcactatagggatcacagtcggaatgctaatttattctatgaacagaggagacatagaatgaattagcataacctggcggcagcgcaaaagatg

SEQ ID NO: 56150 - DNA, 103 bp, Artificial Sequence
  Synthetic Polynucleotide
taatacgactcactatagggttattatcacagtcggaatgctaatttattaacagaggagaaataaaatggcattccgaaacctggcggcagcgcaaaagatg

SEQ ID NO: 56151 - DNA, 103 bp, Artificial Sequence
  Synthetic Polynucleotide
taatacgactcactatagggtggtattattatcacagtcggaatgctaataacagaggagaattagcatgccgactgtgaacctggcggcagcgcaaaagatg

SEQ ID NO: 56152 - DNA, 103 bp, Artificial Sequence
  Synthetic Polynucleotide
taatacgactcactatagggatacttggtattattatcacagtcggaatgaacagaggagacattccatgtgtgataataacctggcggcagcgcaaaagatg

SEQ ID NO: 56153 - DNA, 103 bp, Artificial Sequence
  Synthetic Polynucleotide
taatacgactcactatagggcgtttatacttggtattattatcacagtcgaacagaggagacgactgatgtaataatacaacctggcggcagcgcaaaagatg

SEQ ID NO: 56154 - DNA, 103 bp, Artificial Sequence
  Synthetic Polynucleotide
taatacgactcactatagggtatgtcgtttatacttggtattattatcacaacagaggagagtgataatgataccaagtaacctggcggcagcgcaaaagatg

SEQ ID NO: 56155 - DNA, 103 bp, Artificial Sequence
  Synthetic Polynucleotide
taatacgactcactatagggagtattatgtcgtttatacttggtattattaacagaggagaaataatatgaagtataaaaacctggcggcagcgcaaaagatg

SEQ ID NO: 56156 - DNA, 103 bp, Artificial Sequence
  Synthetic Polynucleotide
taatacgactcactatagggtattgagtattatgtcgtttatacttggtaaacagaggagataccaaatgtaaacgacaaacctggcggcagcgcaaaagatg

SEQ ID NO: 56157 - DNA, 103 bp, Artificial Sequence
  Synthetic Polynucleotide
taatacgactcactataggggaaagtattgagtattatgtcgtttatactaacagaggagaagtataatggacataataaacctggcggcagcgcaaaagatg

SEQ ID NO: 56158 - DNA, 103 bp, Artificial Sequence
  Synthetic Polynucleotide
taatacgactcactatagggacatggaaagtattgagtattatgtcgtttaacagaggagaaaacgaatgaatactcaaaacctggcggcagcgcaaaagatg

SEQ ID NO: 56159 - DNA, 103 bp, Artificial Sequence
  Synthetic Polynucleotide
taatacgactcactatagggagaaataaattggtcaacttgttaaaagttaacagaggagaaactttatgcaagttgacaacctggcggcagcgcaaaagatg

SEQ ID NO: 56160 - DNA, 103 bp, Artificial Sequence
  Synthetic Polynucleotide
taatacgactcactatagggctcgtacatggaaagtattgagtattatgtaacagaggagaacataaatgtcaatacttaacctggcggcagcgcaaaagatg

SEQ ID NO: 56161 - DNA, 103 bp, Artificial Sequence
  Synthetic Polynucleotide
taatacgactcactatagggtcccactcgtacatggaaagtattgagtataacagaggagaatactcatgactttccataacctggcggcagcgcaaaagatg

SEQ ID NO: 56162 - DNA, 103 bp, Artificial Sequence
  Synthetic Polynucleotide
taatacgactcactatagggaccagtcccactcgtacatggaaagtattgaacagaggagacaatacatgccatgtacgaacctggcggcagcgcaaaagatg

SEQ ID NO: 56163 - DNA, 103 bp, Artificial Sequence
  Synthetic Polynucleotide
taatacgactcactatagggagtctaccagtcccactcgtacatggaaagaacagaggagactttccatgtacgagtggaacctggcggcagcgcaaaagatg

SEQ ID NO: 56164 - DNA, 103 bp, Artificial Sequence
  Synthetic Polynucleotide
taatacgactcactatagggtagtaagtctaccagtcccactcgtacatgaacagaggagacatgtaatggtgggactgaacctggcggcagcgcaaaagatg

SEQ ID NO: 56165 - DNA, 103 bp, Artificial Sequence
  Synthetic Polynucleotide
taatacgactcactataggggactttagtaagtctaccagtcccactcgtaacagaggagaacgagtatgactggtagaaacctggcggcagcgcaaaagatg

SEQ ID NO: 56166 - DNA, 103 bp, Artificial Sequence
  Synthetic Polynucleotide
taatacgactcactatagggttattgactttagtaagtctaccagtcccaaacagaggagatgggacatgtagacttacaacctggcggcagcgcaaaagatg

SEQ ID NO: 56167 - DNA, 103 bp, Artificial Sequence
  Synthetic Polynucleotide
taatacgactcactatagggtgcctttattgactttagtaagtctaccagaacagaggagactggtaatgttactaaagaacctggcggcagcgcaaaagatg

SEQ ID NO: 56168 - DNA, 103 bp, Artificial Sequence
  Synthetic Polynucleotide
taatacgactcactatagggatctttgcctttattgactttagtaagtctaacagaggagaagacttatgaaagtcaataacctggcggcagcgcaaaagatg

SEQ ID NO: 56169 - DNA, 103 bp, Artificial Sequence
  Synthetic Polynucleotide
taatacgactcactatagggcgtgtatctttgcctttattgactttagtaaacagaggagatactaaatgcaataaaggaacctggcggcagcgcaaaagatg

SEQ ID NO: 56170 - DNA, 103 bp, Artificial Sequence
  Synthetic Polynucleotide
taatacgactcactatagggctattagaaataaattggtcaacttgttaaaacagaggagattaacaatgtgaccaattaacctggcggcagcgcaaaagatg

SEQ ID NO: 56171 - DNA, 103 bp, Artificial Sequence
  Synthetic Polynucleotide
taatacgactcactatagggtctttcgtgtatctttgcctttattgacttaacagaggagaaagtcaatgaaggcaaagaacctggcggcagcgcaaaagatg

SEQ ID NO: 56172 - DNA, 103 bp, Artificial Sequence
  Synthetic Polynucleotide
taatacgactcactatagggttgattctttcgtgtatctttgcctttattaacagaggagaaataaaatgaaagatacaaacctggcggcagcgcaaaagatg

SEQ ID NO: 56173 - DNA, 103 bp, Artificial Sequence
  Synthetic Polynucleotide
taatacgactcactatagggttcttttgattctttcgtgtatctttgcctaacagaggagaaggcaaatgtacacgaaaaacctggcggcagcgcaaaagatg

SEQ ID NO: 56174 - DNA, 103 bp, Artificial Sequence
  Synthetic Polynucleotide
taatacgactcactatagggaatcattcttttgattctttcgtgtatcttaacagaggagaaagataatggaaagaatcaacctggcggcagcgcaaaagatg

SEQ ID NO: 56175 - DNA, 103 bp, Artificial Sequence
  Synthetic Polynucleotide
taatacgactcactataggggctggaatcattcttttgattctttcgtgtaacagaggagaacacgaatgaatcaaaagaacctggcggcagcgcaaaagatg

SEQ ID NO: 56176 - DNA, 103 bp, Artificial Sequence
  Synthetic Polynucleotide
taatacgactcactatagggtaattgctggaatcattcttttgattctttaacagaggagaaaagaaatgaaagaatgaaacctggcggcagcgcaaaagatg

SEQ ID NO: 56177 - DNA, 103 bp, Artificial Sequence
  Synthetic Polynucleotide
taatacgactcactatagggagtgttaattgctggaatcattcttttgataacagaggagaatcaaaatgatgattccaaacctggcggcagcgcaaaagatg

SEQ ID NO: 56178 - DNA, 103 bp, Artificial Sequence
  Synthetic Polynucleotide
taatacgactcactatagggtccggagtgttaattgctggaatcattcttaacagaggagaaagaatatgtccagcaataacctggcggcagcgcaaaagatg

SEQ ID NO: 56179 - DNA, 103 bp, Artificial Sequence
  Synthetic Polynucleotide
taatacgactcactatagggatttttccggagtgttaattgctggaatcaaacagaggagatgattcatgcaattaacaaacctggcggcagcgcaaaagatg

SEQ ID NO: 56180 - DNA, 103 bp, Artificial Sequence
  Synthetic Polynucleotide
taatacgactcactatagggaaattatttttccggagtgttaattgctggaacagaggagaccagcaatgaacactccgaacctggcggcagcgcaaaagatg

SEQ ID NO: 56181 - DNA, 103 bp, Artificial Sequence
  Synthetic Polynucleotide
taatacgactcactatagggtgatactattagaaataaattggtcaacttaacagaggagaaagttgatgaatttatttaacctggcggcagcgcaaaagatg

SEQ ID NO: 56182 - DNA, 103 bp, Artificial Sequence
  Synthetic Polynucleotide
taatacgactcactatagggattggaaattatttttccggagtgttaattaacagaggagaaattaaatgtccggaaaaaacctggcggcagcgcaaaagatg

SEQ ID NO: 56183 - DNA, 103 bp, Artificial Sequence
  Synthetic Polynucleotide
taatacgactcactatagggttatgattggaaattatttttccggagtgtaacagaggagaacactcatgaaaaataataacctggcggcagcgcaaaagatg

SEQ ID NO: 56184 - DNA, 103 bp, Artificial Sequence
  Synthetic Polynucleotide
taatacgactcactataggggatgcttatgattggaaattatttttccggaacagaggagaccggaaatgtaatttccaaacctggcggcagcgcaaaagatg

SEQ ID NO: 56185 - DNA, 103 bp, Artificial Sequence
  Synthetic Polynucleotide
taatacgactcactataggggacatgatgcttatgattggaaattattttaacagaggagaaaaataatgtccaatcataacctggcggcagcgcaaaagatg

SEQ ID NO: 56186 - DNA, 103 bp, Artificial Sequence
  Synthetic Polynucleotide
taatacgactcactatagggaaatggacatgatgcttatgattggaaattaacagaggagaaatttcatgtcataagcaaacctggcggcagcgcaaaagatg

SEQ ID NO: 56187 - DNA, 103 bp, Artificial Sequence
  Synthetic Polynucleotide
taatacgactcactatagggtagttaaatggacatgatgcttatgattggaacagaggagaccaatcatgagcatcatgaacctggcggcagcgcaaaagatg

SEQ ID NO: 56188 - DNA, 103 bp, Artificial Sequence
  Synthetic Polynucleotide
taatacgactcactatagggtttattagttaaatggacatgatgcttatgaacagaggagacataagatgcatgtccataacctggcggcagcgcaaaagatg

SEQ ID NO: 56189 - DNA, 103 bp, Artificial Sequence
  Synthetic Polynucleotide
taatacgactcactatagggaaatttttattagttaaatggacatgatgcaacagaggagagcatcaatgccatttaacaacctggcggcagcgcaaaagatg

SEQ ID NO: 56190 - DNA, 103 bp, Artificial Sequence
  Synthetic Polynucleotide
taatacgactcactatagggatttaaaatttttattagttaaatggacataacagaggagaatgtccatgtaactaataaacctggcggcagcgcaaaagatg

SEQ ID NO: 56191 - DNA, 103 bp, Artificial Sequence
  Synthetic Polynucleotide
taatacgactcactatagggcggcgatttaaaatttttattagttaaatgaacagaggagacatttaatgaataaaaataacctggcggcagcgcaaaagatg

SEQ ID NO: 56192 - DNA, 103 bp, Artificial Sequence
  Synthetic Polynucleotide
taatacgactcactataggggagtttgatactattagaaataaattggtcaacagaggagagaccaaatgatttctaataacctggcggcagcgcaaaagatg

SEQ ID NO: 56193 - DNA, 103 bp, Artificial Sequence
  Synthetic Polynucleotide
taatacgactcactatagggtcattcggcgatttaaaatttttattagttaacagaggagaaactaaatgaaattttaaaacctggcggcagcgcaaaagatg

SEQ ID NO: 56194 - DNA, 103 bp, Artificial Sequence
  Synthetic Polynucleotide
taatacgactcactatagggtttgttcattcggcgatttaaaatttttataacagaggagaataaaaatgttaaatcgcaacctggcggcagcgcaaaagatg

SEQ ID NO: 56195 - DNA, 103 bp, Artificial Sequence
  Synthetic Polynucleotide
taatacgactcactatagggtccactttgttcattcggcgatttaaaattaacagaggagaaattttatgtcgccgaataacctggcggcagcgcaaaagatg

SEQ ID NO: 56196 - DNA, 103 bp, Artificial Sequence
  Synthetic Polynucleotide
taatacgactcactatagggtatattccactttgttcattcggcgatttaaacagaggagataaatcatggaatgaacaaacctggcggcagcgcaaaagatg

SEQ ID NO: 56197 - DNA, 103 bp, Artificial Sequence
  Synthetic Polynucleotide
taatacgactcactatagggtggtttatattccactttgttcattcggcgaacagaggagacgccgaatgaacaaagtgaacctggcggcagcgcaaaagatg

SEQ ID NO: 56198 - DNA, 103 bp, Artificial Sequence
  Synthetic Polynucleotide
taatacgactcactatagggttatatggtttatattccactttgttcattaacagaggagaaatgaaatgagtggaataaacctggcggcagcgcaaaagatg

SEQ ID NO: 56199 - DNA, 103 bp, Artificial Sequence
  Synthetic Polynucleotide
taatacgactcactatagggtgtttttatatggtttatattccactttgtaacagaggagaacaaagatgaatataaacaacctggcggcagcgcaaaagatg

SEQ ID NO: 56200 - DNA, 103 bp, Artificial Sequence
  Synthetic Polynucleotide
taatacgactcactatagggactattgtttttatatggtttatattccacaacagaggagagtggaaatgaaaccatataacctggcggcagcgcaaaagatg

SEQ ID NO: 56201 - DNA, 103 bp, Artificial Sequence
  Synthetic Polynucleotide
taatacgactcactatagggtacaaactattgtttttatatggtttatataacagaggagaatataaatgatataaaaaaacctggcggcagcgcaaaagatg

SEQ ID NO: 56202 - DNA, 103 bp, Artificial Sequence
  Synthetic Polynucleotide
taatacgactcactatagggtgcagtacaaactattgtttttatatggttaacagaggagaaaccatatgaaaacaataaacctggcggcagcgcaaaagatg

SEQ ID NO: 56203 - DNA, 103 bp, Artificial Sequence
  Synthetic Polynucleotide
taatacgactcactatagggatggagagtttgatactattagaaataaataacagaggagaatttatatgtaatagtataacctggcggcagcgcaaaagatg

SEQ ID NO: 56204 - DNA, 103 bp, Artificial Sequence
  Synthetic Polynucleotide
taatacgactcactatagggatttttgcagtacaaactattgtttttataaacagaggagatataaaatgaatagtttgaacctggcggcagcgcaaaagatg

SEQ ID NO: 56205 - DNA, 103 bp, Artificial Sequence
  Synthetic Polynucleotide
taatacgactcactatagggatattatttttgcagtacaaactattgtttaacagaggagaaaacaaatgtttgtactgaacctggcggcagcgcaaaagatg

SEQ ID NO: 56206 - DNA, 103 bp, Artificial Sequence
  Synthetic Polynucleotide
taatacgactcactatagggaatagatattatttttgcagtacaaactataacagaggagaatagttatgactgcaaaaaacctggcggcagcgcaaaagatg

SEQ ID NO: 56207 - DNA, 103 bp, Artificial Sequence
  Synthetic Polynucleotide
taatacgactcactatagggacaaaaatagatattatttttgcagtacaaaacagaggagattgtacatgaaaaataataacctggcggcagcgcaaaagatg

SEQ ID NO: 56208 - DNA, 103 bp, Artificial Sequence
  Synthetic Polynucleotide
taatacgactcactatagggcgaaaacaaaaatagatattatttttgcagaacagaggagactgcaaatgtaatatctaaacctggcggcagcgcaaaagatg

SEQ ID NO: 56209 - DNA, 103 bp, Artificial Sequence
  Synthetic Polynucleotide
taatacgactcactatagggatcttcgaaaacaaaaatagatattattttaacagaggagaaaaataatgtctatttttaacctggcggcagcgcaaaagatg

SEQ ID NO: 56210 - DNA, 103 bp, Artificial Sequence
  Synthetic Polynucleotide
taatacgactcactatagggaccatatcttcgaaaacaaaaatagatattaacagaggagaaatatcatgttttgttttaacctggcggcagcgcaaaagatg

SEQ ID NO: 56211 - DNA, 103 bp, Artificial Sequence
  Synthetic Polynucleotide
taatacgactcactatagggattttaccatatcttcgaaaacaaaaatagaacagaggagactatttatgttttcgaagaacctggcggcagcgcaaaagatg

SEQ ID NO: 56212 - DNA, 103 bp, Artificial Sequence
  Synthetic Polynucleotide
taatacgactcactatagggatttaattttaccatatcttcgaaaacaaaaacagaggagatttgttatggaagatatgaacctggcggcagcgcaaaagatg

SEQ ID NO: 56213 - DNA, 103 bp, Artificial Sequence
  Synthetic Polynucleotide
taatacgactcactatagggctactatttaattttaccatatcttcgaaaaacagaggagatttcgaatgtatggtaaaaacctggcggcagcgcaaaagatg

SEQ ID NO: 56214 - DNA, 103 bp, Artificial Sequence
  Synthetic Polynucleotide
taatacgactcactatagggtaatcatggagagtttgatactattagaaaaacagaggagatttctaatggtatcaaacaacctggcggcagcgcaaaagatg

SEQ ID NO: 56215 - DNA, 103 bp, Artificial Sequence
  Synthetic Polynucleotide
taatacgactcactataggggtgtactactatttaattttaccatatcttaacagaggagaaagataatgtaaaattaaaacctggcggcagcgcaaaagatg

SEQ ID NO: 56216 - DNA, 103 bp, Artificial Sequence
  Synthetic Polynucleotide
taatacgactcactatagggatgttgtgtactactatttaattttaccataacagaggagaatggtaatgttaaatagtaacctggcggcagcgcaaaagatg

SEQ ID NO: 56217 - DNA, 103 bp, Artificial Sequence
  Synthetic Polynucleotide
taatacgactcactatagggataacatgttgtgtactactatttaattttaacagaggagaaaaattatgtagtagtacaacctggcggcagcgcaaaagatg

SEQ ID NO: 56218 - DNA, 103 bp, Artificial Sequence
  Synthetic Polynucleotide
taatacgactcactatagggtagttataacatgttgtgtactactatttaaacagaggagataaataatggtacacaacaacctggcggcagcgcaaaagatg

SEQ ID NO: 56219 - DNA, 103 bp, Artificial Sequence
  Synthetic Polynucleotide
taatacgactcactataggggctgttagttataacatgttgtgtactactaacagaggagaagtagtatgcaacatgttaacctggcggcagcgcaaaagatg

SEQ ID NO: 56220 - DNA, 103 bp, Artificial Sequence
  Synthetic Polynucleotide
taatacgactcactatagggttgctgctgttagttataacatgttgtgtaaacagaggagatacacaatgtgttataacaacctggcggcagcgcaaaagatg

SEQ ID NO: 56221 - DNA, 103 bp, Artificial Sequence
  Synthetic Polynucleotide
taatacgactcactatagggaaccgttgctgctgttagttataacatgttaacagaggagaaacatgatgtaactaacaaacctggcggcagcgcaaaagatg

SEQ ID NO: 56222 - DNA, 103 bp, Artificial Sequence
  Synthetic Polynucleotide
taatacgactcactatagggttacgaaccgttgctgctgttagttataacaacagaggagagttataatgaacagcagcaacctggcggcagcgcaaaagatg

SEQ ID NO: 56223 - DNA, 103 bp, Artificial Sequence
  Synthetic Polynucleotide
taatacgactcactatagggagtaattacgaaccgttgctgctgttagttaacagaggagaaactaaatgcagcaacggaacctggcggcagcgcaaaagatg

SEQ ID NO: 56224 - DNA, 103 bp, Artificial Sequence
  Synthetic Polynucleotide
taatacgactcactatagggtgataagtaattacgaaccgttgctgctgtaacagaggagaacagcaatgacggttcgtaacctggcggcagcgcaaaagatg

SEQ ID NO: 56225 - DNA, 103 bp, Artificial Sequence
  Synthetic Polynucleotide
taatacgactcactatagggatatttaatcatggagagtttgatactattaacagaggagaaatagtatgaaactctccaacctggcggcagcgcaaaagatg

SEQ ID NO: 56226 - DNA, 103 bp, Artificial Sequence
  Synthetic Polynucleotide
taatacgactcactataggggtaaatgataagtaattacgaaccgttgctaacagaggagaagcaacatgtcgtaattaaacctggcggcagcgcaaaagatg

SEQ ID NO: 56227 - DNA, 103 bp, Artificial Sequence
  Synthetic Polynucleotide
taatacgactcactataggggtctagtaaatgataagtaattacgaaccgaacagaggagacggttcatgattacttataacctggcggcagcgcaaaagatg

SEQ ID NO: 56228 - DNA, 103 bp, Artificial Sequence
  Synthetic Polynucleotide
taatacgactcactatagggttttcgtctagtaaatgataagtaattacgaacagaggagacgtaatatgttatcatttaacctggcggcagcgcaaaagatg

SEQ ID NO: 56229 - DNA, 103 bp, Artificial Sequence
  Synthetic Polynucleotide
taatacgactcactatagggccaccttttcgtctagtaaatgataagtaaaacagaggagattacttatgatttactagaacctggcggcagcgcaaaagatg

SEQ ID NO: 56230 - DNA, 103 bp, Artificial Sequence
  Synthetic Polynucleotide
taatacgactcactatagggtcccgccaccttttcgtctagtaaatgataaacagaggagatatcatatgctagacgaaaacctggcggcagcgcaaaagatg

SEQ ID NO: 56231 - DNA, 103 bp, Artificial Sequence
  Synthetic Polynucleotide
taatacgactcactatagggaaatatcccgccaccttttcgtctagtaaaaacagaggagatttactatgcgaaaaggtaacctggcggcagcgcaaaagatg

SEQ ID NO: 56232 - DNA, 103 bp, Artificial Sequence
  Synthetic Polynucleotide
taatacgactcactatagggcaagaaaatatcccgccaccttttcgtctaaacagaggagatagacgatgaggtggcggaacctggcggcagcgcaaaagatg

SEQ ID NO: 56233 - DNA, 103 bp, Artificial Sequence
  Synthetic Polynucleotide
taatacgactcactatagggttgagcaagaaaatatcccgccaccttttcaacagaggagagaaaagatggcgggatataacctggcggcagcgcaaaagatg

SEQ ID NO: 56234 - DNA, 103 bp, Artificial Sequence
  Synthetic Polynucleotide
taatacgactcactatagggattatttgagcaagaaaatatcccgccaccaacagaggagaggtggcatgatattttctaacctggcggcagcgcaaaagatg

SEQ ID NO: 56235 - DNA, 103 bp, Artificial Sequence
  Synthetic Polynucleotide
taatacgactcactatagggttcgtattatttgagcaagaaaatatcccgaacagaggagacgggatatgttcttgctcaacctggcggcagcgcaaaagatg

SEQ ID NO: 56236 - DNA, 103 bp, Artificial Sequence
  Synthetic Polynucleotide
taatacgactcactataggggaaacgtgttataacttatcaaaacatataaacagaggagatatatgatgtgataagttaacctggcggcagcgcaaaagatg

SEQ ID NO: 56237 - DNA, 103 bp, Artificial Sequence
  Synthetic Polynucleotide
taatacgactcactatagggtagtattagaaaaatatgataaaaactattaacagaggagaaatagtatgtatcatattaacctggcggcagcgcaaaagatg

SEQ ID NO: 56238 - DNA, 103 bp, Artificial Sequence
  Synthetic Polynucleotide
taatacgactcactatagggttaaaatatttaatcatggagagtttgataaacagaggagatatcaaatgctccatgataacctggcggcagcgcaaaagatg

SEQ ID NO: 56239 - DNA, 103 bp, Artificial Sequence
  Synthetic Polynucleotide
taatacgactcactatagggatatattcgtattatttgagcaagaaaataaacagaggagatattttatggctcaaataaacctggcggcagcgcaaaagatg

SEQ ID NO: 56240 - DNA, 103 bp, Artificial Sequence
  Synthetic Polynucleotide
taatacgactcactataggggggtaatatattcgtattatttgagcaagaaacagaggagatcttgcatgaataatacgaacctggcggcagcgcaaaagatg

SEQ ID NO: 56241 - DNA, 103 bp, Artificial Sequence
  Synthetic Polynucleotide
taatacgactcactatagggtggatgggtaatatattcgtattatttgagaacagaggagactcaaaatgtacgaatataacctggcggcagcgcaaaagatg

SEQ ID NO: 56242 - DNA, 103 bp, Artificial Sequence
  Synthetic Polynucleotide
taatacgactcactatagggtaaaatggatgggtaatatattcgtattataacagaggagaataataatgatatattacaacctggcggcagcgcaaaagatg

SEQ ID NO: 56243 - DNA, 103 bp, Artificial Sequence
  Synthetic Polynucleotide
taatacgactcactatagggtcgcataaaatggatgggtaatatattcgtaacagaggagaacgaatatgttacccatcaacctggcggcagcgcaaaagatg

SEQ ID NO: 56244 - DNA, 103 bp, Artificial Sequence
  Synthetic Polynucleotide
taatacgactcactatagggaaacatcgcataaaatggatgggtaatataaacagaggagatatattatgcatccatttaacctggcggcagcgcaaaagatg

SEQ ID NO: 56245 - DNA, 103 bp, Artificial Sequence
  Synthetic Polynucleotide
taatacgactcactatagggtatataaacatcgcataaaatggatgggtaaacagaggagatacccaatgattttatgcaacctggcggcagcgcaaaagatg

SEQ ID NO: 56246 - DNA, 103 bp, Artificial Sequence
  Synthetic Polynucleotide
taatacgactcactatagggtagagtatataaacatcgcataaaatggataacagaggagaatccatatgatgcgatgtaacctggcggcagcgcaaaagatg

SEQ ID NO: 56247 - DNA, 103 bp, Artificial Sequence
  Synthetic Polynucleotide
taatacgactcactatagggaagattagagtatataaacatcgcataaaaaacagaggagattttatatgatgtttataaacctggcggcagcgcaaaagatg

SEQ ID NO: 56248 - DNA, 103 bp, Artificial Sequence
  Synthetic Polynucleotide
taatacgactcactatagggtattaaagattagagtatataaacatcgcaaacagaggagatgcgatatgtatatactcaacctggcggcagcgcaaaagatg

SEQ ID NO: 56249 - DNA, 103 bp, Artificial Sequence
  Synthetic Polynucleotide
taatacgactcactatagggtactattaaaatatttaatcatggagagttaacagaggagaaactctatgtgattaaataacctggcggcagcgcaaaagatg

SEQ ID NO: 56250 - DNA, 103 bp, Artificial Sequence
  Synthetic Polynucleotide
taatacgactcactatagggagatctattaaagattagagtatataaacaaacagaggagatgtttaatgactctaatcaacctggcggcagcgcaaaagatg

SEQ ID NO: 56251 - DNA, 103 bp, Artificial Sequence
  Synthetic Polynucleotide
taatacgactcactatagggtctatagatctattaaagattagagtatataacagaggagaatatacatgaatctttaaaacctggcggcagcgcaaaagatg

SEQ ID NO: 56252 - DNA, 103 bp, Artificial Sequence
  Synthetic Polynucleotide
taatacgactcactatagggcgtcgtctatagatctattaaagattagagaacagaggagactctaaatgttaatagataacctggcggcagcgcaaaagatg

SEQ ID NO: 56253 - DNA, 103 bp, Artificial Sequence
  Synthetic Polynucleotide
taatacgactcactatagggaaacccgtcgtctatagatctattaaagataacagaggagaatctttatgagatctataaacctggcggcagcgcaaaagatg

SEQ ID NO: 56254 - DNA, 103 bp, Artificial Sequence
  Synthetic Polynucleotide
taatacgactcactatagggttggtaaacccgtcgtctatagatctattaaacagaggagataatagatgtatagacgaaacctggcggcagcgcaaaagatg

SEQ ID NO: 56255 - DNA, 103 bp, Artificial Sequence
  Synthetic Polynucleotide
taatacgactcactatagggtattgttggtaaacccgtcgtctatagatcaacagaggagagatctaatgacgacgggtaacctggcggcagcgcaaaagatg

SEQ ID NO: 56256 - DNA, 103 bp, Artificial Sequence
  Synthetic Polynucleotide
taatacgactcactatagggatctatattgttggtaaacccgtcgtctataacagaggagaatagacatggggtttaccaacctggcggcagcgcaaaagatg

SEQ ID NO: 56257 - DNA, 103 bp, Artificial Sequence
  Synthetic Polynucleotide
taatacgactcactatagggataaaatctatattgttggtaaacccgtcgaacagaggagacgacggatgtaccaacaaaacctggcggcagcgcaaaagatg

SEQ ID NO: 56258 - DNA, 103 bp, Artificial Sequence
  Synthetic Polynucleotide
taatacgactcactatagggaatcgataaaatctatattgttggtaaaccaacagaggagaggtttaatgacaatatagaacctggcggcagcgcaaaagatg

SEQ ID NO: 56259 - DNA, 103 bp, Artificial Sequence
  Synthetic Polynucleotide
taatacgactcactatagggagatgaatcgataaaatctatattgttggtaacagaggagaaccaacatgatagattttaacctggcggcagcgcaaaagatg

SEQ ID NO: 56260 - DNA, 103 bp, Artificial Sequence
  Synthetic Polynucleotide
taatacgactcactatagggatggatactattaaaatatttaatcatggaaacagaggagatccatgatgaaatattttaacctggcggcagcgcaaaagatg

SEQ ID NO: 56261 - DNA, 103 bp, Artificial Sequence
  Synthetic Polynucleotide
taatacgactcactatagggaaattagatgaatcgataaaatctatattgaacagaggagacaatatatgttttatcgaaacctggcggcagcgcaaaagatg

SEQ ID NO: 56262 - DNA, 103 bp, Artificial Sequence
  Synthetic Polynucleotide
taatacgactcactatagggggtttaaattagatgaatcgataaaatctaaacagaggagatagattatgtcgattcataacctggcggcagcgcaaaagatg

SEQ ID NO: 56263 - DNA, 103 bp, Artificial Sequence
  Synthetic Polynucleotide
taatacgactcactatagggggaagggtttaaattagatgaatcgataaaaacagaggagatttatcatgtcatctaataacctggcggcagcgcaaaagatg

SEQ ID NO: 56264 - DNA, 103 bp, Artificial Sequence
  Synthetic Polynucleotide
taatacgactcactatagggtttaaggaagggtttaaattagatgaatcgaacagaggagacgattcatgtaatttaaaaacctggcggcagcgcaaaagatg

SEQ ID NO: 56265 - DNA, 103 bp, Artificial Sequence
  Synthetic Polynucleotide
taatacgactcactatagggtcacgtttaaggaagggtttaaattagatgaacagaggagacatctaatgtaaacccttaacctggcggcagcgcaaaagatg

SEQ ID NO: 56266 - DNA, 103 bp, Artificial Sequence
  Synthetic Polynucleotide
taatacgactcactatagggatcattcacgtttaaggaagggtttaaattaacagaggagaaatttaatgccttccttaaacctggcggcagcgcaaaagatg

SEQ ID NO: 56267 - DNA, 103 bp, Artificial Sequence
  Synthetic Polynucleotide
taatacgactcactatagggaatagatcattcacgtttaaggaagggtttaacagaggagaaaacccatgcttaaacgtaacctggcggcagcgcaaaagatg

SEQ ID NO: 56268 - DNA, 103 bp, Artificial Sequence
  Synthetic Polynucleotide
taatacgactcactatagggcagataatagatcattcacgtttaaggaagaacagaggagacttcctatgacgtgaatgaacctggcggcagcgcaaaagatg

SEQ ID NO: 56269 - DNA, 103 bp, Artificial Sequence
  Synthetic Polynucleotide
taatacgactcactatagggtatgccagataatagatcattcacgtttaaaacagaggagattaaacatgaatgatctaaacctggcggcagcgcaaaagatg

SEQ ID NO: 56270 - DNA, 103 bp, Artificial Sequence
  Synthetic Polynucleotide
taatacgactcactatagggatcgttatgccagataatagatcattcacgaacagaggagacgtgaaatgtctattatcaacctggcggcagcgcaaaagatg

SEQ ID NO: 56271 - DNA, 103 bp, Artificial Sequence
  Synthetic Polynucleotide
taatacgactcactatagggataaaatggatactattaaaatatttaatcaacagaggagagattaaatgttttaatagaacctggcggcagcgcaaaagatg

SEQ ID NO: 56272 - DNA, 103 bp, Artificial Sequence
  Synthetic Polynucleotide
taatacgactcactataggggggtcatcgttatgccagataatagatcataacagaggagaatgatcatgtatctggcaaacctggcggcagcgcaaaagatg

SEQ ID NO: 56273 - DNA, 103 bp, Artificial Sequence
  Synthetic Polynucleotide
taatacgactcactatagggaggtagggtcatcgttatgccagataatagaacagaggagactattaatgggcataacgaacctggcggcagcgcaaaagatg

SEQ ID NO: 56274 - DNA, 103 bp, Artificial Sequence
  Synthetic Polynucleotide
taatacgactcactatagggtcatcaggtagggtcatcgttatgccagataacagaggagaatctggatgaacgatgacaacctggcggcagcgcaaaagatg

SEQ ID NO: 56275 - DNA, 103 bp, Artificial Sequence
  Synthetic Polynucleotide
taatacgactcactatagggctgattcatcaggtagggtcatcgttatgcaacagaggagagcataaatgtgaccctacaacctggcggcagcgcaaaagatg

SEQ ID NO: 56276 - DNA, 103 bp, Artificial Sequence
  Synthetic Polynucleotide
taatacgactcactatagggattgtctgattcatcaggtagggtcatcgtaacagaggagaacgatgatgctacctgataacctggcggcagcgcaaaagatg

SEQ ID NO: 56277 - DNA, 103 bp, Artificial Sequence
  Synthetic Polynucleotide
taatacgactcactatagggagtacattgtctgattcatcaggtagggtcaacagaggagagaccctatgtgatgaatcaacctggcggcagcgcaaaagatg

SEQ ID NO: 56278 - DNA, 103 bp, Artificial Sequence
  Synthetic Polynucleotide
taatacgactcactatagggggcccagtacattgtctgattcatcaggtaaacagaggagatacctgatgaatcagacaaacctggcggcagcgcaaaagatg

SEQ ID NO: 56279 - DNA, 103 bp, Artificial Sequence
  Synthetic Polynucleotide
taatacgactcactatagggtacatggcccagtacattgtctgattcatcaacagaggagagatgaaatggacaatgtaaacctggcggcagcgcaaaagatg

SEQ ID NO: 56280 - DNA, 103 bp, Artificial Sequence
  Synthetic Polynucleotide
taatacgactcactatagggtattctacatggcccagtacattgtctgataacagaggagaatcagaatgtgtactgggaacctggcggcagcgcaaaagatg

SEQ ID NO: 56281 - DNA, 103 bp, Artificial Sequence
  Synthetic Polynucleotide
taatacgactcactatagggtaatttattctacatggcccagtacattgtaacagaggagaacaatgatgtgggccatgaacctggcggcagcgcaaaagatg

SEQ ID NO: 56282 - DNA, 103 bp, Artificial Sequence
  Synthetic Polynucleotide
taatacgactcactatagggttgatataaaatggatactattaaaatattaacagaggagaaatattatgatagtatccaacctggcggcagcgcaaaagatg

SEQ ID NO: 56283 - DNA, 103 bp, Artificial Sequence
  Synthetic Polynucleotide
taatacgactcactataggggttgataatttattctacatggcccagtacaacagaggagagtactgatgcatgtagaaaacctggcggcagcgcaaaagatg

SEQ ID NO: 56284 - DNA, 103 bp, Artificial Sequence
  Synthetic Polynucleotide
taatacgactcactataggggattcgttgataatttattctacatggcccaacagaggagagggccaatgagaataaataacctggcggcagcgcaaaagatg

SEQ ID NO: 56285 - DNA, 103 bp, Artificial Sequence
  Synthetic Polynucleotide
taatacgactcactatagggacgatgattcgttgataatttattctacataacagaggagaatgtagatgaaattatcaaacctggcggcagcgcaaaagatg

SEQ ID NO: 56286 - DNA, 103 bp, Artificial Sequence
  Synthetic Polynucleotide
taatacgactcactatagggcgtagacgatgattcgttgataatttattcaacagaggagagaataaatgatcaacgaaaacctggcggcagcgcaaaagatg

SEQ ID NO: 56287 - DNA, 103 bp, Artificial Sequence
  Synthetic Polynucleotide
taatacgactcactatagggatgttcgtagacgatgattcgttgataattaacagaggagaaattatatgcgaatcatcaacctggcggcagcgcaaaagatg

SEQ ID NO: 56288 - DNA, 103 bp, Artificial Sequence
  Synthetic Polynucleotide
taatacgactcactatagggtataaatgttcgtagacgatgattcgttgaaacagaggagatcaacgatgcatcgtctaaacctggcggcagcgcaaaagatg

SEQ ID NO: 56289 - DNA, 103 bp, Artificial Sequence
  Synthetic Polynucleotide
taatacgactcactatagggaatgatataaatgttcgtagacgatgattcaacagaggagagaatcaatgtctacgaacaacctggcggcagcgcaaaagatg

SEQ ID NO: 56290 - DNA, 103 bp, Artificial Sequence
  Synthetic Polynucleotide
taatacgactcactatagggaaacaaatgatataaatgttcgtagacgataacagaggagaatcgtcatggaacatttaaacctggcggcagcgcaaaagatg

SEQ ID NO: 56291 - DNA, 103 bp, Artificial Sequence
  Synthetic Polynucleotide
taatacgactcactatagggaattaaaacaaatgatataaatgttcgtagaacagaggagactacgaatgtttatatcaaacctggcggcagcgcaaaagatg

SEQ ID NO: 56292 - DNA, 103 bp, Artificial Sequence
  Synthetic Polynucleotide
taatacgactcactatagggcctaaaattaaaacaaatgatataaatgttaacagaggagaaacattatgatcatttgtaacctggcggcagcgcaaaagatg

SEQ ID NO: 56293 - DNA, 103 bp, Artificial Sequence
  Synthetic Polynucleotide
taatacgactcactataggggtccgttgatataaaatggatactattaaaaacagaggagatttaatatgatccattttaacctggcggcagcgcaaaagatg

SEQ ID NO: 56294 - DNA, 103 bp, Artificial Sequence
  Synthetic Polynucleotide
taatacgactcactatagggcgcgtcctaaaattaaaacaaatgatataaaacagaggagattatatatgttgttttaaaacctggcggcagcgcaaaagatg

SEQ ID NO: 56295 - DNA, 103 bp, Artificial Sequence
  Synthetic Polynucleotide
taatacgactcactatagggttattcgcgtcctaaaattaaaacaaatgaaacagaggagatcatttatgttaattttaaacctggcggcagcgcaaaagatg

SEQ ID NO: 56296 - DNA, 103 bp, Artificial Sequence
  Synthetic Polynucleotide
taatacgactcactatagggtctatttattcgcgtcctaaaattaaaacaaacagaggagatgttttatgtttaggacgaacctggcggcagcgcaaaagatg

SEQ ID NO: 56297 - DNA, 103 bp, Artificial Sequence
  Synthetic Polynucleotide
taatacgactcactatagggttatatctatttattcgcgtcctaaaattaaacagaggagataatttatggacgcgaataacctggcggcagcgcaaaagatg

SEQ ID NO: 56298 - DNA, 103 bp, Artificial Sequence
  Synthetic Polynucleotide
taatacgactcactatagggctattttatatctatttattcgcgtcctaaaacagaggagattaggaatggaataaataaacctggcggcagcgcaaaagatg

SEQ ID NO: 56299 - DNA, 103 bp, Artificial Sequence
  Synthetic Polynucleotide
taatacgactcactatagggattttctattttatatctatttattcgcgtaacagaggagaacgcgaatgaatagatataacctggcggcagcgcaaaagatg

SEQ ID NO: 56300 - DNA, 103 bp, Artificial Sequence
  Synthetic Polynucleotide
taatacgactcactatagggctgttattttctattttatatctatttattaacagaggagaaataaaatgatataaaataacctggcggcagcgcaaaagatg

SEQ ID NO: 56301 - DNA, 103 bp, Artificial Sequence
  Synthetic Polynucleotide
taatacgactcactatagggaatatctgttattttctattttatatctataacagaggagaatagatatgaaatagaaaaacctggcggcagcgcaaaagatg

SEQ ID NO: 56302 - DNA, 103 bp, Artificial Sequence
  Synthetic Polynucleotide
taatacgactcactataggggttgtaatatctgttattttctattttataaacagaggagatataaaatggaaaataacaacctggcggcagcgcaaaagatg

SEQ ID NO: 56303 - DNA, 103 bp, Artificial Sequence
  Synthetic Polynucleotide
taatacgactcactatagggcactggttgtaatatctgttattttctattaacagaggagaaatagaatgtaacagataaacctggcggcagcgcaaaagatg

SEQ ID NO: 56304 - DNA, 103 bp, Artificial Sequence
  Synthetic Polynucleotide
taatacgactcactatagggtttgtgtccgttgatataaaatggatactaaacagaggagatagtatatgttttatatcaacctggcggcagcgcaaaagatg

SEQ ID NO: 56305 - DNA, 103 bp, Artificial Sequence
  Synthetic Polynucleotide
taatacgactcactatagggcataacactggttgtaatatctgttattttaacagaggagaaaaataatggatattacaaacctggcggcagcgcaaaagatg

SEQ ID NO: 56306 - DNA, 103 bp, Artificial Sequence
  Synthetic Polynucleotide
taatacgactcactataggggcggccataacactggttgtaatatctgttaacagaggagaaacagaatgtacaaccagaacctggcggcagcgcaaaagatg

SEQ ID NO: 56307 - DNA, 103 bp, Artificial Sequence
  Synthetic Polynucleotide
taatacgactcactatagggtgggtgcggccataacactggttgtaatataacagaggagaatattaatgccagtgttaaacctggcggcagcgcaaaagatg

SEQ ID NO: 56308 - DNA, 103 bp, Artificial Sequence
  Synthetic Polynucleotide
taatacgactcactatagggctggttgggtgcggccataacactggttgtaacagaggagaacaaccatggttatggccaacctggcggcagcgcaaaagatg

SEQ ID NO: 56309 - DNA, 103 bp, Artificial Sequence
  Synthetic Polynucleotide
taatacgactcactatagggcctacctggttgggtgcggccataacactgaacagaggagacagtgtatgggccgcaccaacctggcggcagcgcaaaagatg

SEQ ID NO: 56310 - DNA, 103 bp, Artificial Sequence
  Synthetic Polynucleotide
taatacgactcactatagggaactgcctacctggttgggtgcggccataaaacagaggagattatggatgcacccaaccaacctggcggcagcgcaaaagatg

SEQ ID NO: 56311 - DNA, 103 bp, Artificial Sequence
  Synthetic Polynucleotide
taatacgactcactatagggaataaaactgcctacctggttgggtgcggcaacagaggagagccgcaatgaaccaggtaaacctggcggcagcgcaaaagatg

SEQ ID NO: 56312 - DNA, 103 bp, Artificial Sequence
  Synthetic Polynucleotide
taatacgactcactataggggataaaataaaactgcctacctggttgggtaacagaggagaacccaaatgggtaggcagaacctggcggcagcgcaaaagatg

SEQ ID NO: 56313 - DNA, 103 bp, Artificial Sequence
  Synthetic Polynucleotide
taatacgactcactatagggtaaaagataaaataaaactgcctacctggtaacagaggagaaccaggatggcagttttaaacctggcggcagcgcaaaagatg

SEQ ID NO: 56314 - DNA, 103 bp, Artificial Sequence
  Synthetic Polynucleotide
taatacgactcactatagggtgtagtaaaagataaaataaaactgcctacaacagaggagagtaggcatgtttattttaaacctggcggcagcgcaaaagatg

SEQ ID NO: 56315 - DNA, 103 bp, Artificial Sequence
  Synthetic Polynucleotide
taatacgactcactataggggctactttgtgtccgttgatataaaatggaaacagaggagatccattatgtatcaacggaacctggcggcagcgcaaaagatg

SEQ ID NO: 56316 - DNA, 103 bp, Artificial Sequence
  Synthetic Polynucleotide
taatacgactcactataggggaacctgtagtaaaagataaaataaaactgaacagaggagacagtttatgtttatctttaacctggcggcagcgcaaaagatg

SEQ ID NO: 56317 - DNA, 103 bp, Artificial Sequence
  Synthetic Polynucleotide
taatacgactcactatagggcaggagaacctgtagtaaaagataaaataaaacagaggagattatttatgcttttactaaacctggcggcagcgcaaaagatg

SEQ ID NO: 56318 - DNA, 103 bp, Artificial Sequence
  Synthetic Polynucleotide
taatacgactcactatagggacatccaggagaacctgtagtaaaagataaaacagaggagattatctatgactacaggtaacctggcggcagcgcaaaagatg

SEQ ID NO: 56319 - DNA, 103 bp, Artificial Sequence
  Synthetic Polynucleotide
taatacgactcactataggggacatacatccaggagaacctgtagtaaaaaacagaggagattttacatgaggttctccaacctggcggcagcgcaaaagatg

SEQ ID NO: 56320 - DNA, 103 bp, Artificial Sequence
  Synthetic Polynucleotide
taatacgactcactatagggttggtgacatacatccaggagaacctgtagaacagaggagactacagatgctcctggataacctggcggcagcgcaaaagatg

SEQ ID NO: 56321 - DNA, 103 bp, Artificial Sequence
  Synthetic Polynucleotide
taatacgactcactatagggtacagttggtgacatacatccaggagaaccaacagaggagaggttctatgggatgtatgaacctggcggcagcgcaaaagatg

SEQ ID NO: 56322 - DNA, 103 bp, Artificial Sequence
  Synthetic Polynucleotide
taatacgactcactatagggacgtctacagttggtgacatacatccaggaaacagaggagatcctggatgtatgtcaccaacctggcggcagcgcaaaagatg

SEQ ID NO: 56323 - DNA, 103 bp, Artificial Sequence
  Synthetic Polynucleotide
taatacgactcactataggggaactacgtctacagttggtgacatacatcaacagaggagagatgtaatgcaccaactgaacctggcggcagcgcaaaagatg

SEQ ID NO: 56324 - DNA, 103 bp, Artificial Sequence
  Synthetic Polynucleotide
taatacgactcactatagggtactagaactacgtctacagttggtgacataacagaggagaatgtcaatgactgtagacaacctggcggcagcgcaaaagatg

SEQ ID NO: 56325 - DNA, 103 bp, Artificial Sequence
  Synthetic Polynucleotide
taatacgactcactatagggaattgtactagaactacgtctacagttggtaacagaggagaaccaacatgagacgtagtaacctggcggcagcgcaaaagatg

SEQ ID NO: 56326 - DNA, 103 bp, Artificial Sequence
  Synthetic Polynucleotide
taatacgactcactatagggtgttagctactttgtgtccgttgatataaaaacagaggagatttataatgacggacacaaacctggcggcagcgcaaaagatg

SEQ ID NO: 56327 - DNA, 103 bp, Artificial Sequence
  Synthetic Polynucleotide
taatacgactcactatagggcgtctaattgtactagaactacgtctacagaacagaggagactgtagatgtagttctagaacctggcggcagcgcaaaagatg

SEQ ID NO: 56328 - DNA, 103 bp, Artificial Sequence
  Synthetic Polynucleotide
taatacgactcactatagggacttacgtctaattgtactagaactacgtcaacagaggagagacgtaatgctagtacaaaacctggcggcagcgcaaaagatg

SEQ ID NO: 56329 - DNA, 103 bp, Artificial Sequence
  Synthetic Polynucleotide
taatacgactcactataggggcggaacttacgtctaattgtactagaactaacagaggagaagttctatgacaattagaaacctggcggcagcgcaaaagatg

SEQ ID NO: 56330 - DNA, 103 bp, Artificial Sequence
  Synthetic Polynucleotide
taatacgactcactatagggcccaagcggaacttacgtctaattgtactaaacagaggagatagtacatgtagacgtaaaacctggcggcagcgcaaaagatg

SEQ ID NO: 56331 - DNA, 103 bp, Artificial Sequence
  Synthetic Polynucleotide
taatacgactcactatagggaaattcccaagcggaacttacgtctaattgaacagaggagacaattaatggtaagttccaacctggcggcagcgcaaaagatg

SEQ ID NO: 56332 - DNA, 103 bp, Artificial Sequence
  Synthetic Polynucleotide
taatacgactcactatagggttaaaaaattcccaagcggaacttacgtctaacagaggagaagacgtatgttccgcttgaacctggcggcagcgcaaaagatg

SEQ ID NO: 56333 - DNA, 103 bp, Artificial Sequence
  Synthetic Polynucleotide
taatacgactcactatagggtagcgttaaaaaattcccaagcggaacttaaacagaggagataagttatgcttgggaataacctggcggcagcgcaaaagatg

SEQ ID NO: 56334 - DNA, 103 bp, Artificial Sequence
  Synthetic Polynucleotide
taatacgactcactatagggctctttagcgttaaaaaattcccaagcggaaacagaggagatccgctatggaattttttaacctggcggcagcgcaaaagatg

SEQ ID NO: 56335 - DNA, 103 bp, Artificial Sequence
  Synthetic Polynucleotide
taatacgactcactataggggttaactctttagcgttaaaaaattcccaaaacagaggagattgggaatgttttaacgcaacctggcggcagcgcaaaagatg

SEQ ID NO: 56336 - DNA, 103 bp, Artificial Sequence
  Synthetic Polynucleotide
taatacgactcactatagggttaacgttaactctttagcgttaaaaaattaacagaggagaaattttatgacgctaaagaacctggcggcagcgcaaaagatg

SEQ ID NO: 56337 - DNA, 103 bp, Artificial Sequence
  Synthetic Polynucleotide
taatacgactcactataggggtttatgttagctactttgtgtccgttgataacagaggagaatcaacatgcacaaagtaaacctggcggcagcgcaaaagatg

SEQ ID NO: 56338 - DNA, 103 bp, Artificial Sequence
  Synthetic Polynucleotide
taatacgactcactatagggtacgattaacgttaactctttagcgttaaaaacagaggagatttaacatgaaagagttaaacctggcggcagcgcaaaagatg

SEQ ID NO: 56339 - DNA, 103 bp, Artificial Sequence
  Synthetic Polynucleotide
taatacgactcactataggggggtgtacgattaacgttaactctttagcgaacagaggagacgctaaatggttaacgttaacctggcggcagcgcaaaagatg

SEQ ID NO: 56340 - DNA, 103 bp, Artificial Sequence
  Synthetic Polynucleotide
taatacgactcactatagggacgttgggtgtacgattaacgttaactcttaacagaggagaaagagtatgcgttaatcgaacctggcggcagcgcaaaagatg

SEQ ID NO: 56341 - DNA, 103 bp, Artificial Sequence
  Synthetic Polynucleotide
taatacgactcactatagggtaaatacgttgggtgtacgattaacgttaaaacagaggagattaacgatgatcgtacacaacctggcggcagcgcaaaagatg

SEQ ID NO: 56342 - DNA, 103 bp, Artificial Sequence
  Synthetic Polynucleotide
taatacgactcactatagggagatgtaaatacgttgggtgtacgattaacaacagaggagagttaatatgacacccaacaacctggcggcagcgcaaaagatg

SEQ ID NO: 56343 - DNA, 103 bp, Artificial Sequence
  Synthetic Polynucleotide
taatacgactcactataggggaactagatgtaaatacgttgggtgtacgaaacagaggagatcgtacatgcaacgtattaacctggcggcagcgcaaaagatg

SEQ ID NO: 56344 - DNA, 103 bp, Artificial Sequence
  Synthetic Polynucleotide
taatacgactcactatagggtcaaagaactagatgtaaatacgttgggtgaacagaggagacacccaatgtatttacataacctggcggcagcgcaaaagatg

SEQ ID NO: 56345 - DNA, 103 bp, Artificial Sequence
  Synthetic Polynucleotide
taatacgactcactataggggatgttcaaagaactagatgtaaatacgttaacagaggagaaacgtaatgacatctagtaacctggcggcagcgcaaaagatg

SEQ ID NO: 56346 - DNA, 103 bp, Artificial Sequence
  Synthetic Polynucleotide
taatacgactcactatagggatcaagatgttcaaagaactagatgtaaataacagaggagaatttacatgtagttctttaacctggcggcagcgcaaaagatg

SEQ ID NO: 56347 - DNA, 103 bp, Artificial Sequence
  Synthetic Polynucleotide
taatacgactcactatagggttataatcaagatgttcaaagaactagatgaacagaggagacatctaatgctttgaacaaacctggcggcagcgcaaaagatg

SEQ ID NO: 56348 - DNA, 103 bp, Artificial Sequence
  Synthetic Polynucleotide
taatacgactcactatagggttatatagtattagaaaaatatgataaaaaaacagaggagatttttaatgtatttttctaacctggcggcagcgcaaaagatg

SEQ ID NO: 56349 - DNA, 103 bp, Artificial Sequence
  Synthetic Polynucleotide
taatacgactcactatagggcaatggtttatgttagctactttgtgtccgaacagaggagacggacaatgagtagctaaaacctggcggcagcgcaaaagatg

SEQ ID NO: 56350 - DNA, 103 bp, Artificial Sequence
  Synthetic Polynucleotide
taatacgactcactatagggttatattataatcaagatgttcaaagaactaacagaggagaagttctatgaacatcttgaacctggcggcagcgcaaaagatg

SEQ ID NO: 56351 - DNA, 103 bp, Artificial Sequence
  Synthetic Polynucleotide
taatacgactcactatagggaatggttatattataatcaagatgttcaaaaacagaggagatttgaaatgcttgattataacctggcggcagcgcaaaagatg

SEQ ID NO: 56352 - DNA, 103 bp, Artificial Sequence
  Synthetic Polynucleotide
taatacgactcactatagggtagaaaatggttatattataatcaagatgtaacagaggagaacatctatgttataatataacctggcggcagcgcaaaagatg

SEQ ID NO: 56353 - DNA, 103 bp, Artificial Sequence
  Synthetic Polynucleotide
taatacgactcactatagggagagatagaaaatggttatattataatcaaaacagaggagattgattatgatataaccaaacctggcggcagcgcaaaagatg

SEQ ID NO: 56354 - DNA, 103 bp, Artificial Sequence
  Synthetic Polynucleotide
taatacgactcactatagggaatctagagatagaaaatggttatattataaacagaggagatataatatgaccattttcaacctggcggcagcgcaaaagatg

SEQ ID NO: 56355 - DNA, 103 bp, Artificial Sequence
  Synthetic Polynucleotide
taatacgactcactatagggtgacgaatctagagatagaaaatggttataaacagaggagatataacatgtttctatctaacctggcggcagcgcaaaagatg

SEQ ID NO: 56356 - DNA, 103 bp, Artificial Sequence
  Synthetic Polynucleotide
taatacgactcactatagggtgcactgacgaatctagagatagaaaatggaacagaggagaccatttatgatctctagaaacctggcggcagcgcaaaagatg

SEQ ID NO: 56357 - DNA, 103 bp, Artificial Sequence
  Synthetic Polynucleotide
taatacgactcactatagggatgagtgcactgacgaatctagagatagaaaacagaggagattctatatgtagattcgtaacctggcggcagcgcaaaagatg

SEQ ID NO: 56358 - DNA, 103 bp, Artificial Sequence
  Synthetic Polynucleotide
taatacgactcactataggggttacatgagtgcactgacgaatctagagaaacagaggagatctctaatgtcgtcagtgaacctggcggcagcgcaaaagatg

SEQ ID NO: 56359 - DNA, 103 bp, Artificial Sequence
  Synthetic Polynucleotide
taatacgactcactatagggtgttggttacatgagtgcactgacgaatctaacagaggagaagattcatgagtgcactcaacctggcggcagcgcaaaagatg

SEQ ID NO: 56360 - DNA, 103 bp, Artificial Sequence
  Synthetic Polynucleotide
taatacgactcactatagggttatacaatggtttatgttagctactttgtaacagaggagaacaaagatgctaacataaaacctggcggcagcgcaaaagatg

SEQ ID NO: 56361 - DNA, 103 bp, Artificial Sequence
  Synthetic Polynucleotide
taatacgactcactataggggggtatgttggttacatgagtgcactgacgaacagaggagacgtcagatgactcatgtaaacctggcggcagcgcaaaagatg

SEQ ID NO: 56362 - DNA, 103 bp, Artificial Sequence
  Synthetic Polynucleotide
taatacgactcactatagggacctagggtatgttggttacatgagtgcacaacagaggagagtgcacatgtgtaaccaaaacctggcggcagcgcaaaagatg

SEQ ID NO: 56363 - DNA, 103 bp, Artificial Sequence
  Synthetic Polynucleotide
taatacgactcactatagggttaggacctagggtatgttggttacatgagaacagaggagactcatgatgccaacatacaacctggcggcagcgcaaaagatg

SEQ ID NO: 56364 - DNA, 103 bp, Artificial Sequence
  Synthetic Polynucleotide
taatacgactcactatagggaatatttaggacctagggtatgttggttacaacagaggagagtaaccatgataccctagaacctggcggcagcgcaaaagatg

SEQ ID NO: 56365 - DNA, 103 bp, Artificial Sequence
  Synthetic Polynucleotide
taatacgactcactatagggagataaatatttaggacctagggtatgttgaacagaggagacaacatatgctaggtcctaacctggcggcagcgcaaaagatg

SEQ ID NO: 56366 - DNA, 103 bp, Artificial Sequence
  Synthetic Polynucleotide
taatacgactcactatagggtccggagataaatatttaggacctagggtaaacagaggagataccctatgtcctaaataaacctggcggcagcgcaaaagatg

SEQ ID NO: 56367 - DNA, 103 bp, Artificial Sequence
  Synthetic Polynucleotide
taatacgactcactatagggctaattccggagataaatatttaggacctaaacagaggagataggtcatgaatatttataacctggcggcagcgcaaaagatg

SEQ ID NO: 56368 - DNA, 103 bp, Artificial Sequence
  Synthetic Polynucleotide
taatacgactcactatagggaaaatctaattccggagataaatatttaggaacagaggagacctaaaatgttatctccgaacctggcggcagcgcaaaagatg

SEQ ID NO: 56369 - DNA, 103 bp, Artificial Sequence
  Synthetic Polynucleotide
taatacgactcactatagggtatccaaaatctaattccggagataaatataacagaggagaatatttatgtccggaattaacctggcggcagcgcaaaagatg

SEQ ID NO: 56370 - DNA, 103 bp, Artificial Sequence
  Synthetic Polynucleotide
taatacgactcactatagggcgaattatccaaaatctaattccggagataaacagaggagatatctcatgaattagattaacctggcggcagcgcaaaagatg

SEQ ID NO: 56371 - DNA, 103 bp, Artificial Sequence
  Synthetic Polynucleotide
taatacgactcactatagggaaaaattatacaatggtttatgttagctacaacagaggagagtagctatgataaaccataacctggcggcagcgcaaaagatg

SEQ ID NO: 56372 - DNA, 103 bp, Artificial Sequence
  Synthetic Polynucleotide
taatacgactcactataggggtgtgcgaattatccaaaatctaattccggaacagaggagaccggaaatggattttggaaacctggcggcagcgcaaaagatg

SEQ ID NO: 56373 - DNA, 103 bp, Artificial Sequence
  Synthetic Polynucleotide
taatacgactcactatagggtgttggtgtgcgaattatccaaaatctaataacagaggagaattagaatgtggataattaacctggcggcagcgcaaaagatg

SEQ ID NO: 56374 - DNA, 103 bp, Artificial Sequence
  Synthetic Polynucleotide
taatacgactcactataggggaaattgttggtgtgcgaattatccaaaataacagaggagaattttgatgaattcgcacaacctggcggcagcgcaaaagatg

SEQ ID NO: 56375 - DNA, 103 bp, Artificial Sequence
  Synthetic Polynucleotide
taatacgactcactatagggaaatagaaattgttggtgtgcgaattatccaacagaggagaggataaatggcacaccaaaacctggcggcagcgcaaaagatg

SEQ ID NO: 56376 - DNA, 103 bp, Artificial Sequence
  Synthetic Polynucleotide
taatacgactcactatagggaaaggaaatagaaattgttggtgtgcgaataacagaggagaattcgcatgccaacaattaacctggcggcagcgcaaaagatg

SEQ ID NO: 56377 - DNA, 103 bp, Artificial Sequence
  Synthetic Polynucleotide
taatacgactcactatagggatcataaaggaaatagaaattgttggtgtgaacagaggagacacaccatgaatttctataacctggcggcagcgcaaaagatg

SEQ ID NO: 56378 - DNA, 103 bp, Artificial Sequence
  Synthetic Polynucleotide
taatacgactcactatagggtaacgatcataaaggaaatagaaattgttgaacagaggagacaacaaatgctatttcctaacctggcggcagcgcaaaagatg

SEQ ID NO: 56379 - DNA, 103 bp, Artificial Sequence
  Synthetic Polynucleotide
taatacgactcactatagggttttgtaacgatcataaaggaaatagaaataacagaggagaatttctatgtcctttatgaacctggcggcagcgcaaaagatg

SEQ ID NO: 56380 - DNA, 103 bp, Artificial Sequence
  Synthetic Polynucleotide
taatacgactcactatagggacgtcttttgtaacgatcataaaggaaataaacagaggagatatttcatgtatgatcgtaacctggcggcagcgcaaaagatg

SEQ ID NO: 56381 - DNA, 103 bp, Artificial Sequence
  Synthetic Polynucleotide
taatacgactcactatagggattatacgtcttttgtaacgatcataaaggaacagaggagacctttaatgtcgttacaaaacctggcggcagcgcaaaagatg

SEQ ID NO: 56382 - DNA, 103 bp, Artificial Sequence
  Synthetic Polynucleotide
taatacgactcactatagggaacataaaaattatacaatggtttatgttaaacagaggagataacatatgccattgtataacctggcggcagcgcaaaagatg

SEQ ID NO: 56383 - DNA, 103 bp, Artificial Sequence
  Synthetic Polynucleotide
taatacgactcactatagggacggcattatacgtcttttgtaacgatcataacagaggagaatgatcatgacaaaagacaacctggcggcagcgcaaaagatg

SEQ ID NO: 56384 - DNA, 103 bp, Artificial Sequence
  Synthetic Polynucleotide
taatacgactcactataggggggatacggcattatacgtcttttgtaacgaacagaggagacgttacatgagacgtataaacctggcggcagcgcaaaagatg

SEQ ID NO: 56385 - DNA, 103 bp, Artificial Sequence
  Synthetic Polynucleotide
taatacgactcactatagggttttggggatacggcattatacgtcttttgaacagaggagacaaaagatgtataatgccaacctggcggcagcgcaaaagatg

SEQ ID NO: 56386 - DNA, 103 bp, Artificial Sequence
  Synthetic Polynucleotide
taatacgactcactatagggtttacttttggggatacggcattatacgtcaacagaggagagacgtaatgtgccgtatcaacctggcggcagcgcaaaagatg

SEQ ID NO: 56387 - DNA, 103 bp, Artificial Sequence
  Synthetic Polynucleotide
taatacgactcactatagggattattttacttttggggatacggcattataacagaggagaataatgatgtatccccaaaacctggcggcagcgcaaaagatg

SEQ ID NO: 56388 - DNA, 103 bp, Artificial Sequence
  Synthetic Polynucleotide
taatacgactcactatagggtcctgattattttacttttggggatacggcaacagaggagagccgtaatgccaaaagtaaacctggcggcagcgcaaaagatg

SEQ ID NO: 56389 - DNA, 103 bp, Artificial Sequence
  Synthetic Polynucleotide
taatacgactcactatagggattcgtcctgattattttacttttggggataacagaggagaatccccatgagtaaaataaacctggcggcagcgcaaaagatg

SEQ ID NO: 56390 - DNA, 103 bp, Artificial Sequence
  Synthetic Polynucleotide
taatacgactcactataggggaattattcgtcctgattattttacttttgaacagaggagacaaaagatgaataatcagaacctggcggcagcgcaaaagatg

SEQ ID NO: 56391 - DNA, 103 bp, Artificial Sequence
  Synthetic Polynucleotide
taatacgactcactatagggtattagaattattcgtcctgattattttacaacagaggagagtaaaaatgtcaggacgaaacctggcggcagcgcaaaagatg

SEQ ID NO: 56392 - DNA, 103 bp, Artificial Sequence
  Synthetic Polynucleotide
taatacgactcactataggggagtttattagaattattcgtcctgattataacagaggagaataatcatgacgaataataacctggcggcagcgcaaaagatg

SEQ ID NO: 56393 - DNA, 103 bp, Artificial Sequence
  Synthetic Polynucleotide
taatacgactcactatagggcataaaacataaaaattatacaatggtttaaacagaggagataaaccatggtataatttaacctggcggcagcgcaaaagatg

SEQ ID NO: 56394 - DNA, 103 bp, Artificial Sequence
  Synthetic Polynucleotide
taatacgactcactataggggttctgagtttattagaattattcgtcctgaacagaggagacaggacatgtaattctaaaacctggcggcagcgcaaaagatg

SEQ ID NO: 56395 - DNA, 103 bp, Artificial Sequence
  Synthetic Polynucleotide
taatacgactcactatagggatattgttctgagtttattagaattattcgaacagaggagacgaataatgctaataaacaacctggcggcagcgcaaaagatg

SEQ ID NO: 56396 - DNA, 103 bp, Artificial Sequence
  Synthetic Polynucleotide
taatacgactcactataggggcgagatattgttctgagtttattagaattaacagaggagaaattctatgaaactcagaaacctggcggcagcgcaaaagatg

SEQ ID NO: 56397 - DNA, 103 bp, Artificial Sequence
  Synthetic Polynucleotide
taatacgactcactatagggtggatgcgagatattgttctgagtttattaaacagaggagataataaatgcagaacaataacctggcggcagcgcaaaagatg

SEQ ID NO: 56398 - DNA, 103 bp, Artificial Sequence
  Synthetic Polynucleotide
taatacgactcactatagggacatatggatgcgagatattgttctgagttaacagaggagaaactcaatgcaatatctcaacctggcggcagcgcaaaagatg

SEQ ID NO: 56399 - DNA, 103 bp, Artificial Sequence
  Synthetic Polynucleotide
taatacgactcactatagggtccaaacatatggatgcgagatattgttctaacagaggagaagaacaatgtctcgcatcaacctggcggcagcgcaaaagatg

SEQ ID NO: 56400 - DNA, 103 bp, Artificial Sequence
  Synthetic Polynucleotide
taatacgactcactatagggtttgctccaaacatatggatgcgagatattaacagaggagaaatatcatgcatccatataacctggcggcagcgcaaaagatg

SEQ ID NO: 56401 - DNA, 103 bp, Artificial Sequence
  Synthetic Polynucleotide
taatacgactcactatagggcgatatttgctccaaacatatggatgcgagaacagaggagactcgcaatgatatgtttgaacctggcggcagcgcaaaagatg

SEQ ID NO: 56402 - DNA, 103 bp, Artificial Sequence
  Synthetic Polynucleotide
taatacgactcactatagggtattccgatatttgctccaaacatatggataacagaggagaatccatatgtttggagcaaacctggcggcagcgcaaaagatg

SEQ ID NO: 56403 - DNA, 103 bp, Artificial Sequence
  Synthetic Polynucleotide
taatacgactcactatagggctacttattccgatatttgctccaaacataaacagaggagatatgttatgagcaaatataacctggcggcagcgcaaaagatg

SEQ ID NO: 56404 - DNA, 103 bp, Artificial Sequence
  Synthetic Polynucleotide
taatacgactcactatagggataaacataaaacataaaaattatacaatgaacagaggagacattgtatgatttttatgaacctggcggcagcgcaaaagatg

SEQ ID NO: 56405 - DNA, 103 bp, Artificial Sequence
  Synthetic Polynucleotide
taatacgactcactatagggtatgtctacttattccgatatttgctccaaaacagaggagattggagatgatatcggaaaacctggcggcagcgcaaaagatg

SEQ ID NO: 56406 - DNA, 103 bp, Artificial Sequence
  Synthetic Polynucleotide
taatacgactcactatagggccggctatgtctacttattccgatatttgcaacagaggagagcaaatatgggaataagtaacctggcggcagcgcaaaagatg

SEQ ID NO: 56407 - DNA, 103 bp, Artificial Sequence
  Synthetic Polynucleotide
taatacgactcactatagggggaaaccggctatgtctacttattccgataaacagaggagatatcggatgaagtagacaaacctggcggcagcgcaaaagatg

SEQ ID NO: 56408 - DNA, 103 bp, Artificial Sequence
  Synthetic Polynucleotide
taatacgactcactatagggaaaacggaaaccggctatgtctacttattcaacagaggagagaataaatggacatagccaacctggcggcagcgcaaaagatg

SEQ ID NO: 56409 - DNA, 103 bp, Artificial Sequence
  Synthetic Polynucleotide
taatacgactcactatagggcgtgtaaaacggaaaccggctatgtctactaacagaggagaagtagaatgagccggtttaacctggcggcagcgcaaaagatg

SEQ ID NO: 56410 - DNA, 103 bp, Artificial Sequence
  Synthetic Polynucleotide
taatacgactcactatagggggttacgtgtaaaacggaaaccggctatgtaacagaggagaacatagatggtttccgttaacctggcggcagcgcaaaagatg

SEQ ID NO: 56411 - DNA, 103 bp, Artificial Sequence
  Synthetic Polynucleotide
taatacgactcactatagggagaatggttacgtgtaaaacggaaaccggcaacagaggagagccggtatgcgttttacaaacctggcggcagcgcaaaagatg

SEQ ID NO: 56412 - DNA, 103 bp, Artificial Sequence
  Synthetic Polynucleotide
taatacgactcactatagggtgtttagaatggttacgtgtaaaacggaaaaacagaggagatttccgatgtacacgtaaaacctggcggcagcgcaaaagatg

SEQ ID NO: 56413 - DNA, 103 bp, Artificial Sequence
  Synthetic Polynucleotide
taatacgactcactatagggccaattgtttagaatggttacgtgtaaaacaacagaggagagttttaatggtaaccattaacctggcggcagcgcaaaagatg

SEQ ID NO: 56414 - DNA, 103 bp, Artificial Sequence
  Synthetic Polynucleotide
taatacgactcactatagggaaaccccaattgtttagaatggttacgtgtaacagaggagaacacgtatgcattctaaaaacctggcggcagcgcaaaagatg

SEQ ID NO: 56415 - DNA, 103 bp, Artificial Sequence
  Synthetic Polynucleotide
taatacgactcactatagggcgctaataaacataaaacataaaaattataaacagaggagatataatatgtatgttttaaacctggcggcagcgcaaaagatg

SEQ ID NO: 56416 - DNA, 103 bp, Artificial Sequence
  Synthetic Polynucleotide
taatacgactcactatagggcctggaaaccccaattgtttagaatggttaaacagaggagataaccaatgtaaacaattaacctggcggcagcgcaaaagatg

SEQ ID NO: 56417 - DNA, 103 bp, Artificial Sequence
  Synthetic Polynucleotide
taatacgactcactatagggacgatcctggaaaccccaattgtttagaataacagaggagaattctaatgaattggggtaacctggcggcagcgcaaaagatg

SEQ ID NO: 56418 - DNA, 103 bp, Artificial Sequence
  Synthetic Polynucleotide
taatacgactcactatagggtagaaacgatcctggaaaccccaattgtttaacagaggagaaaacaaatggggtttccaaacctggcggcagcgcaaaagatg

SEQ ID NO: 56419 - DNA, 103 bp, Artificial Sequence
  Synthetic Polynucleotide
taatacgactcactatagggttttgtagaaacgatcctggaaaccccaataacagaggagaattgggatgtccaggatcaacctggcggcagcgcaaaagatg

SEQ ID NO: 56420 - DNA, 103 bp, Artificial Sequence
  Synthetic Polynucleotide
taatacgactcactatagggctggattttgtagaaacgatcctggaaaccaacagaggagaggtttcatggatcgtttcaacctggcggcagcgcaaaagatg

SEQ ID NO: 56421 - DNA, 103 bp, Artificial Sequence
  Synthetic Polynucleotide
taatacgactcactatagggtatgactggattttgtagaaacgatcctggaacagaggagaccaggaatgtttctacaaaacctggcggcagcgcaaaagatg

SEQ ID NO: 56422 - DNA, 103 bp, Artificial Sequence
  Synthetic Polynucleotide
taatacgactcactataggggattttatgactggattttgtagaaacgataacagaggagaatcgttatgacaaaatccaacctggcggcagcgcaaaagatg

SEQ ID NO: 56423 - DNA, 103 bp, Artificial Sequence
  Synthetic Polynucleotide
taatacgactcactataggggtgacgattttatgactggattttgtagaaaacagaggagattctacatgatccagtcaaacctggcggcagcgcaaaagatg

SEQ ID NO: 56424 - DNA, 103 bp, Artificial Sequence
  Synthetic Polynucleotide
taatacgactcactatagggacattgtgacgattttatgactggattttgaacagaggagacaaaatatggtcataaaaaacctggcggcagcgcaaaagatg

SEQ ID NO: 56425 - DNA, 103 bp, Artificial Sequence
  Synthetic Polynucleotide
taatacgactcactatagggacagaacattgtgacgattttatgactggaaacagaggagatccagtatgaaaatcgtcaacctggcggcagcgcaaaagatg

SEQ ID NO: 56426 - DNA, 103 bp, Artificial Sequence
  Synthetic Polynucleotide
taatacgactcactataggggtgtacgctaataaacataaaacataaaaaaacagaggagatttttaatgtttatgtttaacctggcggcagcgcaaaagatg

SEQ ID NO: 56427 - DNA, 103 bp, Artificial Sequence
  Synthetic Polynucleotide
taatacgactcactatagggacaagacagaacattgtgacgattttatgaaacagaggagatcataaatgcgtcacaataacctggcggcagcgcaaaagatg

SEQ ID NO: 56428 - DNA, 103 bp, Artificial Sequence
  Synthetic Polynucleotide
taatacgactcactatagggtaattacaagacagaacattgtgacgatttaacagaggagaaaatcgatgcaatgttctaacctggcggcagcgcaaaagatg

SEQ ID NO: 56429 - DNA, 103 bp, Artificial Sequence
  Synthetic Polynucleotide
taatacgactcactatagggaataataattacaagacagaacattgtgacaacagaggagagtcacaatgttctgtcttaacctggcggcagcgcaaaagatg

SEQ ID NO: 56430 - DNA, 103 bp, Artificial Sequence
  Synthetic Polynucleotide
taatacgactcactatagggtatttaataataattacaagacagaacattaacagaggagaaatgttatgtcttgtaataacctggcggcagcgcaaaagatg

SEQ ID NO: 56431 - DNA, 103 bp, Artificial Sequence
  Synthetic Polynucleotide
taatacgactcactatagggaaaaatatttaataataattacaagacagaaacagaggagatctgtcatgtaattattaaacctggcggcagcgcaaaagatg

SEQ ID NO: 56432 - DNA, 103 bp, Artificial Sequence
  Synthetic Polynucleotide
taatacgactcactatagggtgtccaaaaatatttaataataattacaagaacagaggagacttgtaatgattattaaaaacctggcggcagcgcaaaagatg

SEQ ID NO: 56433 - DNA, 103 bp, Artificial Sequence
  Synthetic Polynucleotide
taatacgactcactatagggaacactgtccaaaaatatttaataataattaacagaggagaaattatatgtaaatatttaacctggcggcagcgcaaaagatg

SEQ ID NO: 56434 - DNA, 103 bp, Artificial Sequence
  Synthetic Polynucleotide
taatacgactcactatagggtaccaaacactgtccaaaaatatttaataaaacagaggagattattaatgatttttggaaacctggcggcagcgcaaaagatg

SEQ ID NO: 56435 - DNA, 103 bp, Artificial Sequence
  Synthetic Polynucleotide
taatacgactcactatagggacaaataccaaacactgtccaaaaatatttaacagaggagaaaatatatgtggacagtgaacctggcggcagcgcaaaagatg

SEQ ID NO: 56436 - DNA, 103 bp, Artificial Sequence
  Synthetic Polynucleotide
taatacgactcactatagggcaaagacaaataccaaacactgtccaaaaaaacagaggagatttttgatgagtgtttggaacctggcggcagcgcaaaagatg

SEQ ID NO: 56437 - DNA, 103 bp, Artificial Sequence
  Synthetic Polynucleotide
taatacgactcactatagggaaaatgtgtacgctaataaacataaaacataacagaggagaatgtttatggtttattagaacctggcggcagcgcaaaagatg

SEQ ID NO: 56438 - DNA, 103 bp, Artificial Sequence
  Synthetic Polynucleotide
taatacgactcactatagggttgttcaaagacaaataccaaacactgtccaacagaggagaggacagatgttggtatttaacctggcggcagcgcaaaagatg

SEQ ID NO: 56439 - DNA, 103 bp, Artificial Sequence
  Synthetic Polynucleotide
taatacgactcactatagggaaatgttgttcaaagacaaataccaaacacaacagaggagagtgtttatgatttgtcttaacctggcggcagcgcaaaagatg

SEQ ID NO: 56440 - DNA, 103 bp, Artificial Sequence
  Synthetic Polynucleotide
taatacgactcactatagggtagcaaaatgttgttcaaagacaaataccaaacagaggagatggtatatgtctttgaacaacctggcggcagcgcaaaagatg

SEQ ID NO: 56441 - DNA, 103 bp, Artificial Sequence
  Synthetic Polynucleotide
taatacgactcactatagggtagcgtagcaaaatgttgttcaaagacaaaaacagaggagatttgtcatggaacaacataacctggcggcagcgcaaaagatg

SEQ ID NO: 56442 - DNA, 103 bp, Artificial Sequence
  Synthetic Polynucleotide
taatacgactcactatagggagtgatagcgtagcaaaatgttgttcaaagaacagaggagactttgaatgacattttgcaacctggcggcagcgcaaaagatg

SEQ ID NO: 56443 - DNA, 103 bp, Artificial Sequence
  Synthetic Polynucleotide
taatacgactcactataggggagatagtgatagcgtagcaaaatgttgttaacagaggagaaacaacatgttgctacgcaacctggcggcagcgcaaaagatg

SEQ ID NO: 56444 - DNA, 103 bp, Artificial Sequence
  Synthetic Polynucleotide
taatacgactcactatagggcctgggagatagtgatagcgtagcaaaatgaacagaggagacattttatgacgctatcaaacctggcggcagcgcaaaagatg

SEQ ID NO: 56445 - DNA, 103 bp, Artificial Sequence
  Synthetic Polynucleotide
taatacgactcactatagggtatctcctgggagatagtgatagcgtagcaaacagaggagatgctacatgatcactatcaacctggcggcagcgcaaaagatg

SEQ ID NO: 56446 - DNA, 103 bp, Artificial Sequence
  Synthetic Polynucleotide
taatacgactcactatagggaggattatctcctgggagatagtgatagcgaacagaggagacgctatatgtatctcccaaacctggcggcagcgcaaaagatg

SEQ ID NO: 56447 - DNA, 103 bp, Artificial Sequence
  Synthetic Polynucleotide
taatacgactcactatagggaaaaaaggattatctcctgggagatagtgaaacagaggagatcactaatgcccaggagaaacctggcggcagcgcaaaagatg

SEQ ID NO: 56448 - DNA, 103 bp, Artificial Sequence
  Synthetic Polynucleotide
taatacgactcactatagggcttccaaaatgtgtacgctaataaacataaaacagaggagattatgtatgttagcgtacaacctggcggcagcgcaaaagatg

SEQ ID NO: 56449 - DNA, 103 bp, Artificial Sequence
  Synthetic Polynucleotide
taatacgactcactatagggtttataaaaaaggattatctcctgggagataacagaggagaatctccatggagataatcaacctggcggcagcgcaaaagatg

SEQ ID NO: 56450 - DNA, 103 bp, Artificial Sequence
  Synthetic Polynucleotide
taatacgactcactataggggtcattttataaaaaaggattatctcctggaacagaggagaccaggaatgaatccttttaacctggcggcagcgcaaaagatg

SEQ ID NO: 56451 - DNA, 103 bp, Artificial Sequence
  Synthetic Polynucleotide
taatacgactcactatagggacgatgtcattttataaaaaaggattatctaacagaggagaagataaatgttttttataaacctggcggcagcgcaaaagatg

SEQ ID NO: 56452 - DNA, 103 bp, Artificial Sequence
  Synthetic Polynucleotide
taatacgactcactataggggggcaacgatgtcattttataaaaaaggataacagaggagaatccttatgtataaaatgaacctggcggcagcgcaaaagatg

SEQ ID NO: 56453 - DNA, 103 bp, Artificial Sequence
  Synthetic Polynucleotide
taatacgactcactatagggcatccgggcaacgatgtcattttataaaaaaacagaggagatttttaatgaatgacatcaacctggcggcagcgcaaaagatg

SEQ ID NO: 56454 - DNA, 103 bp, Artificial Sequence
  Synthetic Polynucleotide
taatacgactcactatagggtatagcatccgggcaacgatgtcattttataacagaggagaataaaaatgcatcgttgcaacctggcggcagcgcaaaagatg

SEQ ID NO: 56455 - DNA, 103 bp, Artificial Sequence
  Synthetic Polynucleotide
taatacgactcactataggggattatatagcatccgggcaacgatgtcataacagaggagaatgacaatgttgcccggaaacctggcggcagcgcaaaagatg

SEQ ID NO: 56456 - DNA, 103 bp, Artificial Sequence
  Synthetic Polynucleotide
taatacgactcactatagggctactgattatatagcatccgggcaacgataacagaggagaatcgttatgcggatgctaaacctggcggcagcgcaaaagatg

SEQ ID NO: 56457 - DNA, 103 bp, Artificial Sequence
  Synthetic Polynucleotide
taatacgactcactatagggacacgctactgattatatagcatccgggcaaacagaggagatgcccgatggctatataaaacctggcggcagcgcaaaagatg

SEQ ID NO: 56458 - DNA, 103 bp, Artificial Sequence
  Synthetic Polynucleotide
taatacgactcactatagggttaaaacacgctactgattatatagcatccaacagaggagaggatgcatgataatcagtaacctggcggcagcgcaaaagatg

SEQ ID NO: 56459 - DNA, 103 bp, Artificial Sequence
  Synthetic Polynucleotide
taatacgactcactatagggtatttttatatagtattagaaaaatatgataacagaggagaatcataatgttctaatacaacctggcggcagcgcaaaagatg

SEQ ID NO: 56460 - DNA, 103 bp, Artificial Sequence
  Synthetic Polynucleotide
taatacgactcactatagggcggaacttccaaaatgtgtacgctaataaaaacagaggagatttattatggtacacattaacctggcggcagcgcaaaagatg

SEQ ID NO: 56461 - DNA, 103 bp, Artificial Sequence
  Synthetic Polynucleotide
taatacgactcactatagggaggatttaaaacacgctactgattatatagaacagaggagactatatatgcagtagcgtaacctggcggcagcgcaaaagatg

SEQ ID NO: 56462 - DNA, 103 bp, Artificial Sequence
  Synthetic Polynucleotide
taatacgactcactatagggtattaaggatttaaaacacgctactgattaaacagaggagataatcaatggcgtgttttaacctggcggcagcgcaaaagatg

SEQ ID NO: 56463 - DNA, 103 bp, Artificial Sequence
  Synthetic Polynucleotide
taatacgactcactataggggaatatattaaggatttaaaacacgctactaacagaggagaagtagcatgttttaaatcaacctggcggcagcgcaaaagatg

SEQ ID NO: 56464 - DNA, 103 bp, Artificial Sequence
  Synthetic Polynucleotide
taatacgactcactatagggctcctgaatatattaaggatttaaaacacgaacagaggagacgtgttatgaatccttaaaacctggcggcagcgcaaaagatg

SEQ ID NO: 56465 - DNA, 103 bp, Artificial Sequence
  Synthetic Polynucleotide
taatacgactcactatagggggtaactcctgaatatattaaggatttaaaaacagaggagatttaaaatgttaatatataacctggcggcagcgcaaaagatg

SEQ ID NO: 56466 - DNA, 103 bp, Artificial Sequence
  Synthetic Polynucleotide
taatacgactcactatagggaacgaggtaactcctgaatatattaaggataacagaggagaatccttatgatattcaggaacctggcggcagcgcaaaagatg

SEQ ID NO: 56467 - DNA, 103 bp, Artificial Sequence
  Synthetic Polynucleotide
taatacgactcactatagggatcagaacgaggtaactcctgaatatattaaacagaggagataatatatgcaggagttaaacctggcggcagcgcaaaagatg

SEQ ID NO: 56468 - DNA, 103 bp, Artificial Sequence
  Synthetic Polynucleotide
taatacgactcactatagggctattatcagaacgaggtaactcctgaataaacagaggagatattcaatggttacctcgaacctggcggcagcgcaaaagatg

SEQ ID NO: 56469 - DNA, 103 bp, Artificial Sequence
  Synthetic Polynucleotide
taatacgactcactatagggttaatctattatcagaacgaggtaactcctaacagaggagaaggagtatgctcgttctgaacctggcggcagcgcaaaagatg

SEQ ID NO: 56470 - DNA, 103 bp, Artificial Sequence
  Synthetic Polynucleotide
taatacgactcactataggggaacattaatctattatcagaacgaggtaaaacagaggagattacctatgtctgataataacctggcggcagcgcaaaagatg

SEQ ID NO: 56471 - DNA, 103 bp, Artificial Sequence
  Synthetic Polynucleotide
taatacgactcactataggggcaaccggaacttccaaaatgtgtacgctaaacagaggagatagcgtatgcattttggaaacctggcggcagcgcaaaagatg

SEQ ID NO: 56472 - DNA, 103 bp, Artificial Sequence
  Synthetic Polynucleotide
taatacgactcactatagggtcctggaacattaatctattatcagaacgaaacagaggagatcgttcatgtaatagattaacctggcggcagcgcaaaagatg

SEQ ID NO: 56473 - DNA, 103 bp, Artificial Sequence
  Synthetic Polynucleotide
taatacgactcactatagggtttcgtcctggaacattaatctattatcagaacagaggagactgataatggattaatgtaacctggcggcagcgcaaaagatg

SEQ ID NO: 56474 - DNA, 103 bp, Artificial Sequence
  Synthetic Polynucleotide
taatacgactcactatagggtcaaatttcgtcctggaacattaatctattaacagaggagaaatagaatgatgttccagaacctggcggcagcgcaaaagatg

SEQ ID NO: 56475 - DNA, 103 bp, Artificial Sequence
  Synthetic Polynucleotide
taatacgactcactatagggttctttcaaatttcgtcctggaacattaataacagaggagaattaatatgccaggacgaaacctggcggcagcgcaaaagatg

SEQ ID NO: 56476 - DNA, 103 bp, Artificial Sequence
  Synthetic Polynucleotide
taatacgactcactatagggtgtagttctttcaaatttcgtcctggaacaaacagaggagatgttccatgacgaaatttaacctggcggcagcgcaaaagatg

SEQ ID NO: 56477 - DNA, 103 bp, Artificial Sequence
  Synthetic Polynucleotide
taatacgactcactatagggaaccatgtagttctttcaaatttcgtcctgaacagaggagacaggacatgatttgaaagaacctggcggcagcgcaaaagatg

SEQ ID NO: 56478 - DNA, 103 bp, Artificial Sequence
  Synthetic Polynucleotide
taatacgactcactatagggtggagaaccatgtagttctttcaaatttcgaacagaggagacgaaatatgaaagaactaaacctggcggcagcgcaaaagatg

SEQ ID NO: 56479 - DNA, 103 bp, Artificial Sequence
  Synthetic Polynucleotide
taatacgactcactatagggattcatggagaaccatgtagttctttcaaaaacagaggagatttgaaatgactacatggaacctggcggcagcgcaaaagatg

SEQ ID NO: 56480 - DNA, 103 bp, Artificial Sequence
  Synthetic Polynucleotide
taatacgactcactatagggtattaattcatggagaaccatgtagttcttaacagaggagaaagaacatgatggttctcaacctggcggcagcgcaaaagatg

SEQ ID NO: 56481 - DNA, 103 bp, Artificial Sequence
  Synthetic Polynucleotide
taatacgactcactatagggatatgtattaattcatggagaaccatgtagaacagaggagactacatatgtctccatgaaacctggcggcagcgcaaaagatg

SEQ ID NO: 56482 - DNA, 103 bp, Artificial Sequence
  Synthetic Polynucleotide
taatacgactcactatagggacatggcaaccggaacttccaaaatgtgtaaacagaggagatacacaatgtggaagttcaacctggcggcagcgcaaaagatg

SEQ ID NO: 56483 - DNA, 103 bp, Artificial Sequence
  Synthetic Polynucleotide
taatacgactcactatagggaaacaatatgtattaattcatggagaaccaaacagaggagatggttcatgatgaattaaaacctggcggcagcgcaaaagatg

SEQ ID NO: 56484 - DNA, 103 bp, Artificial Sequence
  Synthetic Polynucleotide
taatacgactcactatagggttgctaaacaatatgtattaattcatggagaacagaggagactccatatgttaatacataacctggcggcagcgcaaaagatg

SEQ ID NO: 56485 - DNA, 103 bp, Artificial Sequence
  Synthetic Polynucleotide
taatacgactcactatagggtgagtttgctaaacaatatgtattaattcaaacagaggagatgaattatgacatattgtaacctggcggcagcgcaaaagatg

SEQ ID NO: 56486 - DNA, 103 bp, Artificial Sequence
  Synthetic Polynucleotide
taatacgactcactataggggttcctgagtttgctaaacaatatgtattaaacagaggagataatacatgttgtttagcaacctggcggcagcgcaaaagatg

SEQ ID NO: 56487 - DNA, 103 bp, Artificial Sequence
  Synthetic Polynucleotide
taatacgactcactatagggttatagttcctgagtttgctaaacaatatgaacagaggagacatattatgtagcaaactaacctggcggcagcgcaaaagatg

SEQ ID NO: 56488 - DNA, 103 bp, Artificial Sequence
  Synthetic Polynucleotide
taatacgactcactatagggtagttttatagttcctgagtttgctaaacaaacagaggagatgtttaatgaactcaggaaacctggcggcagcgcaaaagatg

SEQ ID NO: 56489 - DNA, 103 bp, Artificial Sequence
  Synthetic Polynucleotide
taatacgactcactatagggtgtagtagttttatagttcctgagtttgctaacagaggagaagcaaaatgaggaactataacctggcggcagcgcaaaagatg

SEQ ID NO: 56490 - DNA, 103 bp, Artificial Sequence
  Synthetic Polynucleotide
taatacgactcactatagggatcattgtagtagttttatagttcctgagtaacagaggagaactcagatgctataaaacaacctggcggcagcgcaaaagatg

SEQ ID NO: 56491 - DNA, 103 bp, Artificial Sequence
  Synthetic Polynucleotide
taatacgactcactataggggatagatcattgtagtagttttatagttccaacagaggagaggaactatgaaactactaaacctggcggcagcgcaaaagatg

SEQ ID NO: 56492 - DNA, 103 bp, Artificial Sequence
  Synthetic Polynucleotide
taatacgactcactatagggatgtcgatagatcattgtagtagttttataaacagaggagatataaaatgactacaatgaacctggcggcagcgcaaaagatg

SEQ ID NO: 56493 - DNA, 103 bp, Artificial Sequence
  Synthetic Polynucleotide
taatacgactcactataggggaaatacatggcaaccggaacttccaaaataacagaggagaattttgatggttccggttaacctggcggcagcgcaaaagatg

SEQ ID NO: 56494 - DNA, 103 bp, Artificial Sequence
  Synthetic Polynucleotide
taatacgactcactatagggatggtatgtcgatagatcattgtagtagttaacagaggagaaactacatgaatgatctaaacctggcggcagcgcaaaagatg

SEQ ID NO: 56495 - DNA, 103 bp, Artificial Sequence
  Synthetic Polynucleotide
taatacgactcactataggggatagatggtatgtcgatagatcattgtagaacagaggagactacaaatgtctatcgacaacctggcggcagcgcaaaagatg

SEQ ID NO: 56496 - DNA, 103 bp, Artificial Sequence
  Synthetic Polynucleotide
taatacgactcactatagggtgtttgatagatggtatgtcgatagatcataacagaggagaatgatcatgcgacataccaacctggcggcagcgcaaaagatg

SEQ ID NO: 56497 - DNA, 103 bp, Artificial Sequence
  Synthetic Polynucleotide
taatacgactcactatagggaattttgtttgatagatggtatgtcgatagaacagaggagactatcgatgtaccatctaaacctggcggcagcgcaaaagatg

SEQ ID NO: 56498 - DNA, 103 bp, Artificial Sequence
  Synthetic Polynucleotide
taatacgactcactatagggacccaaattttgtttgatagatggtatgtcaacagaggagagacataatgtctatcaaaaacctggcggcagcgcaaaagatg

SEQ ID NO: 56499 - DNA, 103 bp, Artificial Sequence
  Synthetic Polynucleotide
taatacgactcactatagggattaaacccaaattttgtttgatagatggtaacagaggagaaccatcatgcaaacaaaaaacctggcggcagcgcaaaagatg

SEQ ID NO: 56500 - DNA, 103 bp, Artificial Sequence
  Synthetic Polynucleotide
taatacgactcactataggggagaaattaaacccaaattttgtttgatagaacagaggagactatcaatgaaaatttggaacctggcggcagcgcaaaagatg

SEQ ID NO: 56501 - DNA, 103 bp, Artificial Sequence
  Synthetic Polynucleotide
taatacgactcactatagggtccaggagaaattaaacccaaattttgtttaacagaggagaaaacaaatgttgggtttaaacctggcggcagcgcaaaagatg

SEQ ID NO: 56502 - DNA, 103 bp, Artificial Sequence
  Synthetic Polynucleotide
taatacgactcactatagggacgtctccaggagaaattaaacccaaatttaacagaggagaaaatttatgtttaatttcaacctggcggcagcgcaaaagatg

SEQ ID NO: 56503 - DNA, 103 bp, Artificial Sequence
  Synthetic Polynucleotide
taatacgactcactatagggatgaaacgtctccaggagaaattaaacccaaacagaggagatgggttatgtttctcctgaacctggcggcagcgcaaaagatg

SEQ ID NO: 56504 - DNA, 103 bp, Artificial Sequence
  Synthetic Polynucleotide
taatacgactcactatagggtccaggaaatacatggcaaccggaacttccaacagaggagaggaagtatgggttgccataacctggcggcagcgcaaaagatg

SEQ ID NO: 56505 - DNA, 103 bp, Artificial Sequence
  Synthetic Polynucleotide
taatacgactcactatagggttattatgaaacgtctccaggagaaattaaaacagaggagattaattatgcctggagacaacctggcggcagcgcaaaagatg

SEQ ID NO: 56506 - DNA, 103 bp, Artificial Sequence
  Synthetic Polynucleotide
taatacgactcactatagggatgtattattatgaaacgtctccaggagaaaacagaggagattctccatgagacgtttcaacctggcggcagcgcaaaagatg

SEQ ID NO: 56507 - DNA, 103 bp, Artificial Sequence
  Synthetic Polynucleotide
taatacgactcactataggggttatatgtattattatgaaacgtctccagaacagaggagactggagatgtttcataataacctggcggcagcgcaaaagatg

SEQ ID NO: 56508 - DNA, 103 bp, Artificial Sequence
  Synthetic Polynucleotide
taatacgactcactatagggagaaagttatatgtattattatgaaacgtcaacagaggagagacgttatgtaataatacaacctggcggcagcgcaaaagatg

SEQ ID NO: 56509 - DNA, 103 bp, Artificial Sequence
  Synthetic Polynucleotide
taatacgactcactataggggccgaagaaagttatatgtattattatgaaaacagaggagattcataatgatacatataaacctggcggcagcgcaaaagatg

SEQ ID NO: 56510 - DNA, 103 bp, Artificial Sequence
  Synthetic Polynucleotide
taatacgactcactatagggagtttgccgaagaaagttatatgtattattaacagaggagaaataatatgtataactttaacctggcggcagcgcaaaagatg

SEQ ID NO: 56511 - DNA, 103 bp, Artificial Sequence
  Synthetic Polynucleotide
taatacgactcactatagggtgttaagtttgccgaagaaagttatatgtaaacagaggagatacataatgctttcttcgaacctggcggcagcgcaaaagatg

SEQ ID NO: 56512 - DNA, 103 bp, Artificial Sequence
  Synthetic Polynucleotide
taatacgactcactatagggagaactgttaagtttgccgaagaaagttataacagaggagaataactatgttcggcaaaaacctggcggcagcgcaaaagatg

SEQ ID NO: 56513 - DNA, 103 bp, Artificial Sequence
  Synthetic Polynucleotide
taatacgactcactatagggataatagaactgttaagtttgccgaagaaaaacagaggagatttcttatgcaaacttaaaacctggcggcagcgcaaaagatg

SEQ ID NO: 56514 - DNA, 103 bp, Artificial Sequence
  Synthetic Polynucleotide
taatacgactcactatagggtaaatataatagaactgttaagtttgccgaaacagaggagatcggcaatgttaacagttaacctggcggcagcgcaaaagatg

SEQ ID NO: 56515 - DNA, 103 bp, Artificial Sequence
  Synthetic Polynucleotide
taatacgactcactatagggtgctctccaggaaatacatggcaaccggaaaacagaggagattccggatgccatgtattaacctggcggcagcgcaaaagatg

SEQ ID NO: 56516 - DNA, 103 bp, Artificial Sequence
  Synthetic Polynucleotide
taatacgactcactatagggtatcctaaatataatagaactgttaagtttaacagaggagaaaacttatgagttctattaacctggcggcagcgcaaaagatg

SEQ ID NO: 56517 - DNA, 103 bp, Artificial Sequence
  Synthetic Polynucleotide
taatacgactcactatagggttaattatcctaaatataatagaactgttaaacagaggagataacagatgtattatattaacctggcggcagcgcaaaagatg

SEQ ID NO: 56518 - DNA, 103 bp, Artificial Sequence
  Synthetic Polynucleotide
taatacgactcactatagggaggttttaattatcctaaatataatagaacaacagaggagagttctaatgtatttaggaaacctggcggcagcgcaaaagatg

SEQ ID NO: 56519 - DNA, 103 bp, Artificial Sequence
  Synthetic Polynucleotide
taatacgactcactataggggaattaggttttaattatcctaaatataataacagaggagaattataatgaggataattaacctggcggcagcgcaaaagatg

SEQ ID NO: 56520 - DNA, 103 bp, Artificial Sequence
  Synthetic Polynucleotide
taatacgactcactatagggatatggaattaggttttaattatcctaaataacagaggagaatttagatgaattaaaacaacctggcggcagcgcaaaagatg

SEQ ID NO: 56521 - DNA, 103 bp, Artificial Sequence
  Synthetic Polynucleotide
taatacgactcactatagggcaaatatatggaattaggttttaattatccaacagaggagaggataaatgaaacctaataacctggcggcagcgcaaaagatg

SEQ ID NO: 56522 - DNA, 103 bp, Artificial Sequence
  Synthetic Polynucleotide
taatacgactcactatagggcgagacaaatatatggaattaggttttaataacagaggagaattaaaatgtaattccataacctggcggcagcgcaaaagatg

SEQ ID NO: 56523 - DNA, 103 bp, Artificial Sequence
  Synthetic Polynucleotide
taatacgactcactatagggatatacgagacaaatatatggaattaggttaacagaggagaaacctaatgccatatattaacctggcggcagcgcaaaagatg

SEQ ID NO: 56524 - DNA, 103 bp, Artificial Sequence
  Synthetic Polynucleotide
taatacgactcactatagggagcagatatacgagacaaatatatggaattaacagaggagaaattccatgtatttgtctaacctggcggcagcgcaaaagatg

SEQ ID NO: 56525 - DNA, 103 bp, Artificial Sequence
  Synthetic Polynucleotide
taatacgactcactatagggggaatagcagatatacgagacaaatatatgaacagaggagacatataatggtctcgtataacctggcggcagcgcaaaagatg

SEQ ID NO: 56526 - DNA, 103 bp, Artificial Sequence
  Synthetic Polynucleotide
taatacgactcactatagggctacttgctctccaggaaatacatggcaacaacagaggagagttgccatgtatttcctgaacctggcggcagcgcaaaagatg

SEQ ID NO: 56527 - DNA, 103 bp, Artificial Sequence
  Synthetic Polynucleotide
taatacgactcactatagggcatcaggaatagcagatatacgagacaaataacagaggagaatttgtatggtatatctgaacctggcggcagcgcaaaagatg

SEQ ID NO: 56528 - DNA, 103 bp, Artificial Sequence
  Synthetic Polynucleotide
taatacgactcactatagggcatagcatcaggaatagcagatatacgagaaacagaggagatctcgtatgtctgctattaacctggcggcagcgcaaaagatg

SEQ ID NO: 56529 - DNA, 103 bp, Artificial Sequence
  Synthetic Polynucleotide
taatacgactcactatagggatcaacatagcatcaggaatagcagatataaacagaggagatatatcatgtattcctgaaacctggcggcagcgcaaaagatg

SEQ ID NO: 56530 - DNA, 103 bp, Artificial Sequence
  Synthetic Polynucleotide
taatacgactcactatagggatagaatcaacatagcatcaggaatagcagaacagaggagactgctaatgctgatgctaaacctggcggcagcgcaaaagatg

SEQ ID NO: 56531 - DNA, 103 bp, Artificial Sequence
  Synthetic Polynucleotide
taatacgactcactatagggtcttaatagaatcaacatagcatcaggaataacagaggagaattcctatggctatgttgaacctggcggcagcgcaaaagatg

SEQ ID NO: 56532 - DNA, 103 bp, Artificial Sequence
  Synthetic Polynucleotide
taatacgactcactataggggttactcttaatagaatcaacatagcatcaaacagaggagatgatgcatggttgattctaacctggcggcagcgcaaaagatg

SEQ ID NO: 56533 - DNA, 103 bp, Artificial Sequence
  Synthetic Polynucleotide
taatacgactcactatagggcagccgttactcttaatagaatcaacatagaacagaggagactatgtatgttctattaaaacctggcggcagcgcaaaagatg

SEQ ID NO: 56534 - DNA, 103 bp, Artificial Sequence
  Synthetic Polynucleotide
taatacgactcactataggggggggcagccgttactcttaatagaatcaaaacagaggagattgattatgttaagagtaaacctggcggcagcgcaaaagatg

SEQ ID NO: 56535 - DNA, 103 bp, Artificial Sequence
  Synthetic Polynucleotide
taatacgactcactatagggagaatgggggcagccgttactcttaatagaaacagaggagatctattatgagtaacggcaacctggcggcagcgcaaaagatg

SEQ ID NO: 56536 - DNA, 103 bp, Artificial Sequence
  Synthetic Polynucleotide
taatacgactcactatagggtattaagaatgggggcagccgttactcttaaacagaggagataagagatgcggctgcccaacctggcggcagcgcaaaagatg

SEQ ID NO: 56537 - DNA, 103 bp, Artificial Sequence
  Synthetic Polynucleotide
taatacgactcactatagggatcatctacttgctctccaggaaatacatgaacagaggagacatgtaatgcctggagagaacctggcggcagcgcaaaagatg

SEQ ID NO: 56538 - DNA, 103 bp, Artificial Sequence
  Synthetic Polynucleotide
taatacgactcactatagggacgattattaagaatgggggcagccgttacaacagaggagagtaacgatggcccccattaacctggcggcagcgcaaaagatg

SEQ ID NO: 56539 - DNA, 103 bp, Artificial Sequence
  Synthetic Polynucleotide
taatacgactcactatagggtactgacgattattaagaatgggggcagccaacagaggagaggctgcatgcattcttaaaacctggcggcagcgcaaaagatg

SEQ ID NO: 56540 - DNA, 103 bp, Artificial Sequence
  Synthetic Polynucleotide
taatacgactcactatagggttaaatactgacgattattaagaatgggggaacagaggagacccccaatgttaataatcaacctggcggcagcgcaaaagatg

SEQ ID NO: 56541 - DNA, 103 bp, Artificial Sequence
  Synthetic Polynucleotide
taatacgactcactatagggacagtttaaatactgacgattattaagaataacagaggagaattcttatgaatcgtcagaacctggcggcagcgcaaaagatg

SEQ ID NO: 56542 - DNA, 103 bp, Artificial Sequence
  Synthetic Polynucleotide
taatacgactcactatagggatttaacagtttaaatactgacgattattaaacagaggagataataaatgtcagtatttaacctggcggcagcgcaaaagatg

SEQ ID NO: 56543 - DNA, 103 bp, Artificial Sequence
  Synthetic Polynucleotide
taatacgactcactatagggccaacatttaacagtttaaatactgacgataacagaggagaatcgtcatgatttaaactaacctggcggcagcgcaaaagatg

SEQ ID NO: 56544 - DNA, 103 bp, Artificial Sequence
  Synthetic Polynucleotide
taatacgactcactatagggatataccaacatttaacagtttaaatactgaacagaggagacagtatatgaactgttaaaacctggcggcagcgcaaaagatg

SEQ ID NO: 56545 - DNA, 103 bp, Artificial Sequence
  Synthetic Polynucleotide
taatacgactcactatagggtgttgatataccaacatttaacagtttaaaaacagaggagatttaaaatgttaaatgttaacctggcggcagcgcaaaagatg

SEQ ID NO: 56546 - DNA, 103 bp, Artificial Sequence
  Synthetic Polynucleotide
taatacgactcactataggggtagatgttgatataccaacatttaacagtaacagaggagaactgttatgtgttggtataacctggcggcagcgcaaaagatg

SEQ ID NO: 56547 - DNA, 103 bp, Artificial Sequence
  Synthetic Polynucleotide
taatacgactcactatagggataaggtagatgttgatataccaacatttaaacagaggagataaatgatggtatatcaaaacctggcggcagcgcaaaagatg

SEQ ID NO: 56548 - DNA, 103 bp, Artificial Sequence
  Synthetic Polynucleotide
taatacgactcactatagggtcctcatcatctacttgctctccaggaaataacagaggagaatttccatgagagcaagtaacctggcggcagcgcaaaagatg

SEQ ID NO: 56549 - DNA, 103 bp, Artificial Sequence
  Synthetic Polynucleotide
taatacgactcactataggggggaaataaggtagatgttgatataccaacaacagaggagagttggtatgtcaacatctaacctggcggcagcgcaaaagatg

SEQ ID NO: 56550 - DNA, 103 bp, Artificial Sequence
  Synthetic Polynucleotide
taatacgactcactatagggactgcgggaaataaggtagatgttgatataaacagaggagatatatcatgatctaccttaacctggcggcagcgcaaaagatg

SEQ ID NO: 56551 - DNA, 103 bp, Artificial Sequence
  Synthetic Polynucleotide
taatacgactcactatagggcttatactgcgggaaataaggtagatgttgaacagaggagacaacatatgccttatttcaacctggcggcagcgcaaaagatg

SEQ ID NO: 56552 - DNA, 103 bp, Artificial Sequence
  Synthetic Polynucleotide
taatacgactcactatagggcaaaccttatactgcgggaaataaggtagaaacagaggagatctaccatgtttcccgcaaacctggcggcagcgcaaaagatg

SEQ ID NO: 56553 - DNA, 103 bp, Artificial Sequence
  Synthetic Polynucleotide
taatacgactcactatagggtgcaacaaaccttatactgcgggaaataagaacagaggagacttattatgcgcagtataaacctggcggcagcgcaaaagatg

SEQ ID NO: 56554 - DNA, 103 bp, Artificial Sequence
  Synthetic Polynucleotide
taatacgactcactatagggatacctgcaacaaaccttatactgcgggaaaacagaggagattcccgatgtataaggttaacctggcggcagcgcaaaagatg

SEQ ID NO: 56555 - DNA, 103 bp, Artificial Sequence
  Synthetic Polynucleotide
taatacgactcactatagggacagtatacctgcaacaaaccttatactgcaacagaggagagcagtaatgggtttgttgaacctggcggcagcgcaaaagatg

SEQ ID NO: 56556 - DNA, 103 bp, Artificial Sequence
  Synthetic Polynucleotide
taatacgactcactatagggcctgaacagtatacctgcaacaaaccttataacagaggagaataaggatggttgcaggtaacctggcggcagcgcaaaagatg

SEQ ID NO: 56557 - DNA, 103 bp, Artificial Sequence
  Synthetic Polynucleotide
taatacgactcactatagggccattcctgaacagtatacctgcaacaaacaacagaggagagtttgtatgaggtatactaacctggcggcagcgcaaaagatg

SEQ ID NO: 56558 - DNA, 103 bp, Artificial Sequence
  Synthetic Polynucleotide
taatacgactcactatagggtgtaaccattcctgaacagtatacctgcaaaacagaggagattgcagatgtactgttcaaacctggcggcagcgcaaaagatg

SEQ ID NO: 56559 - DNA, 103 bp, Artificial Sequence
  Synthetic Polynucleotide
taatacgactcactatagggctggttcctcatcatctacttgctctccagaacagaggagactggagatgaagtagatgaacctggcggcagcgcaaaagatg

SEQ ID NO: 56560 - DNA, 103 bp, Artificial Sequence
  Synthetic Polynucleotide
taatacgactcactatagggataaatgtaaccattcctgaacagtataccaacagaggagaggtataatgttcaggaataacctggcggcagcgcaaaagatg

SEQ ID NO: 56561 - DNA, 103 bp, Artificial Sequence
  Synthetic Polynucleotide
taatacgactcactataggggaagtataaatgtaaccattcctgaacagtaacagaggagaactgttatggaatggttaaacctggcggcagcgcaaaagatg

SEQ ID NO: 56562 - DNA, 103 bp, Artificial Sequence
  Synthetic Polynucleotide
taatacgactcactatagggtagaagaagtataaatgtaaccattcctgaaacagaggagatcaggaatggttacatttaacctggcggcagcgcaaaagatg

SEQ ID NO: 56563 - DNA, 103 bp, Artificial Sequence
  Synthetic Polynucleotide
taatacgactcactataggggactatagaagaagtataaatgtaaccattaacagaggagaaatggtatgatttatactaacctggcggcagcgcaaaagatg

SEQ ID NO: 56564 - DNA, 103 bp, Artificial Sequence
  Synthetic Polynucleotide
taatacgactcactataggggacaggactatagaagaagtataaatgtaaaacagaggagattacatatgtacttcttcaacctggcggcagcgcaaaagatg

SEQ ID NO: 56565 - DNA, 103 bp, Artificial Sequence
  Synthetic Polynucleotide
taatacgactcactatagggcgaaagacaggactatagaagaagtataaaaacagaggagatttataatgcttctatagaacctggcggcagcgcaaaagatg

SEQ ID NO: 56566 - DNA, 103 bp, Artificial Sequence
  Synthetic Polynucleotide
taatacgactcactatagggaacatcgaaagacaggactatagaagaagtaacagaggagaacttctatgatagtcctgaacctggcggcagcgcaaaagatg

SEQ ID NO: 56567 - DNA, 103 bp, Artificial Sequence
  Synthetic Polynucleotide
taatacgactcactatagggtgatgaacatcgaaagacaggactatagaaaacagaggagattctatatgcctgtctttaacctggcggcagcgcaaaagatg

SEQ ID NO: 56568 - DNA, 103 bp, Artificial Sequence
  Synthetic Polynucleotide
taatacgactcactatagggatatgtgatgaacatcgaaagacaggactaaacagaggagatagtccatgctttcgatgaacctggcggcagcgcaaaagatg

SEQ ID NO: 56569 - DNA, 103 bp, Artificial Sequence
  Synthetic Polynucleotide
taatacgactcactatagggtttgcatatgtgatgaacatcgaaagacagaacagaggagactgtctatggatgttcataacctggcggcagcgcaaaagatg

SEQ ID NO: 56570 - DNA, 103 bp, Artificial Sequence
  Synthetic Polynucleotide
taatacgactcactatagggaatgatatttttatatagtattagaaaaataacagaggagaatttttatgatactatataacctggcggcagcgcaaaagatg

SEQ ID NO: 56571 - DNA, 103 bp, Artificial Sequence
  Synthetic Polynucleotide
taatacgactcactatagggactatctggttcctcatcatctacttgctcaacagaggagagagcaaatggatgatgagaacctggcggcagcgcaaaagatg

SEQ ID NO: 56572 - DNA, 103 bp, Artificial Sequence
  Synthetic Polynucleotide
taatacgactcactatagggtgttctttgcatatgtgatgaacatcgaaaaacagaggagatttcgaatgtcatcacataacctggcggcagcgcaaaagatg

SEQ ID NO: 56573 - DNA, 103 bp, Artificial Sequence
  Synthetic Polynucleotide
taatacgactcactatagggtattttgttctttgcatatgtgatgaacataacagaggagaatgttcatgacatatgcaaacctggcggcagcgcaaaagatg

SEQ ID NO: 56574 - DNA, 103 bp, Artificial Sequence
  Synthetic Polynucleotide
taatacgactcactatagggttgtttattttgttctttgcatatgtgatgaacagaggagacatcacatgtgcaaagaaaacctggcggcagcgcaaaagatg

SEQ ID NO: 56575 - DNA, 103 bp, Artificial Sequence
  Synthetic Polynucleotide
taatacgactcactatagggttattttgtttattttgttctttgcatatgaacagaggagacatatgatgagaacaaaaaacctggcggcagcgcaaaagatg

SEQ ID NO: 56576 - DNA, 103 bp, Artificial Sequence
  Synthetic Polynucleotide
taatacgactcactatagggttacattattttgtttattttgttctttgcaacagaggagagcaaagatgaaaataaacaacctggcggcagcgcaaaagatg

SEQ ID NO: 56577 - DNA, 103 bp, Artificial Sequence
  Synthetic Polynucleotide
taatacgactcactatagggatttcttacattattttgtttattttgttcaacagaggagagaacaaatgaaacaaaataacctggcggcagcgcaaaagatg

SEQ ID NO: 56578 - DNA, 103 bp, Artificial Sequence
  Synthetic Polynucleotide
taatacgactcactatagggatattatttcttacattattttgtttatttaacagaggagaaaataaatgaaataatgtaacctggcggcagcgcaaaagatg

SEQ ID NO: 56579 - DNA, 103 bp, Artificial Sequence
  Synthetic Polynucleotide
taatacgactcactatagggatttaatattatttcttacattattttgttaacagaggagaaacaaaatgatgtaagaaaacctggcggcagcgcaaaagatg

SEQ ID NO: 56580 - DNA, 103 bp, Artificial Sequence
  Synthetic Polynucleotide
taatacgactcactatagggcagatatttaatattatttcttacattattaacagaggagaaataatatgagaaataataacctggcggcagcgcaaaagatg

SEQ ID NO: 56581 - DNA, 103 bp, Artificial Sequence
  Synthetic Polynucleotide
taatacgactcactatagggattcacagatatttaatattatttcttacaaacagaggagatgtaagatgtaatattaaaacctggcggcagcgcaaaagatg

SEQ ID NO: 56582 - DNA, 103 bp, Artificial Sequence
  Synthetic Polynucleotide
taatacgactcactatagggtataaactatctggttcctcatcatctactaacagaggagaagtagaatgtgaggaaccaacctggcggcagcgcaaaagatg

SEQ ID NO: 56583 - DNA, 103 bp, Artificial Sequence
  Synthetic Polynucleotide
taatacgactcactatagggtacgaattcacagatatttaatattatttcaacagaggagagaaataatgttaaatatcaacctggcggcagcgcaaaagatg

SEQ ID NO: 56584 - DNA, 103 bp, Artificial Sequence
  Synthetic Polynucleotide
taatacgactcactataggggtatttacgaattcacagatatttaatattaacagaggagaaatattatgtatctgtgaaacctggcggcagcgcaaaagatg

SEQ ID NO: 56585 - DNA, 103 bp, Artificial Sequence
  Synthetic Polynucleotide
taatacgactcactatagggttaatgtatttacgaattcacagatatttaaacagaggagataaataatggtgaattcgaacctggcggcagcgcaaaagatg

SEQ ID NO: 56586 - DNA, 103 bp, Artificial Sequence
  Synthetic Polynucleotide
taatacgactcactatagggggcaattaatgtatttacgaattcacagataacagaggagaatctgtatgttcgtaaataacctggcggcagcgcaaaagatg

SEQ ID NO: 56587 - DNA, 103 bp, Artificial Sequence
  Synthetic Polynucleotide
taatacgactcactatagggattatggcaattaatgtatttacgaattcaaacagaggagatgaattatgaaatacattaacctggcggcagcgcaaaagatg

SEQ ID NO: 56588 - DNA, 103 bp, Artificial Sequence
  Synthetic Polynucleotide
taatacgactcactatagggtaattattatggcaattaatgtatttacgaaacagaggagatcgtaaatgcattaattgaacctggcggcagcgcaaaagatg

SEQ ID NO: 56589 - DNA, 103 bp, Artificial Sequence
  Synthetic Polynucleotide
taatacgactcactatagggtgctgtaattattatggcaattaatgtattaacagaggagaaatacaatgattgccataaacctggcggcagcgcaaaagatg

SEQ ID NO: 56590 - DNA, 103 bp, Artificial Sequence
  Synthetic Polynucleotide
taatacgactcactataggggtagctgctgtaattattatggcaattaataacagaggagaattaatatgcataataataacctggcggcagcgcaaaagatg

SEQ ID NO: 56591 - DNA, 103 bp, Artificial Sequence
  Synthetic Polynucleotide
taatacgactcactataggggtattgtagctgctgtaattattatggcaaaacagaggagattgccaatgtaattacagaacctggcggcagcgcaaaagatg

SEQ ID NO: 56592 - DNA, 103 bp, Artificial Sequence
  Synthetic Polynucleotide
taatacgactcactatagggtgtgtgtattgtagctgctgtaattattataacagaggagaataataatgacagcagctaacctggcggcagcgcaaaagatg

SEQ ID NO: 56593 - DNA, 103 bp, Artificial Sequence
  Synthetic Polynucleotide
taatacgactcactatagggacggatataaactatctggttcctcatcataacagaggagaatgatgatgaaccagataaacctggcggcagcgcaaaagatg

SEQ ID NO: 56594 - DNA, 103 bp, Artificial Sequence
  Synthetic Polynucleotide
taatacgactcactatagggtctattgtgtgtattgtagctgctgtaattaacagaggagaaattacatgagctacaataacctggcggcagcgcaaaagatg

SEQ ID NO: 56595 - DNA, 103 bp, Artificial Sequence
  Synthetic Polynucleotide
taatacgactcactataggggaatgtctattgtgtgtattgtagctgctgaacagaggagacagcagatgcaatacacaaacctggcggcagcgcaaaagatg

SEQ ID NO: 56596 - DNA, 103 bp, Artificial Sequence
  Synthetic Polynucleotide
taatacgactcactatagggtgtgggaatgtctattgtgtgtattgtagcaacagaggagagctacaatgcacacaataaacctggcggcagcgcaaaagatg

SEQ ID NO: 56597 - DNA, 103 bp, Artificial Sequence
  Synthetic Polynucleotide
taatacgactcactatagggaacactgtgggaatgtctattgtgtgtattaacagaggagaaatacaatgaatagacataacctggcggcagcgcaaaagatg

SEQ ID NO: 56598 - DNA, 103 bp, Artificial Sequence
  Synthetic Polynucleotide
taatacgactcactatagggatggcaacactgtgggaatgtctattgtgtaacagaggagaacacaaatgacattcccaaacctggcggcagcgcaaaagatg

SEQ ID NO: 56599 - DNA, 103 bp, Artificial Sequence
  Synthetic Polynucleotide
taatacgactcactatagggaggtaatggcaacactgtgggaatgtctataacagaggagaatagacatgcccacagtgaacctggcggcagcgcaaaagatg

SEQ ID NO: 56600 - DNA, 103 bp, Artificial Sequence
  Synthetic Polynucleotide
taatacgactcactatagggcgtggaggtaatggcaacactgtgggaatgaacagaggagacattccatgagtgttgccaacctggcggcagcgcaaaagatg

SEQ ID NO: 56601 - DNA, 103 bp, Artificial Sequence
  Synthetic Polynucleotide
taatacgactcactatagggtgtatcgtggaggtaatggcaacactgtggaacagaggagaccacagatgtgccattacaacctggcggcagcgcaaaagatg

SEQ ID NO: 56602 - DNA, 103 bp, Artificial Sequence
  Synthetic Polynucleotide
taatacgactcactatagggtcaaatgtatcgtggaggtaatggcaacacaacagaggagagtgttgatgttacctccaaacctggcggcagcgcaaaagatg

SEQ ID NO: 56603 - DNA, 103 bp, Artificial Sequence
  Synthetic Polynucleotide
taatacgactcactataggggtaactcaaatgtatcgtggaggtaatggcaacagaggagagccattatgtccacgataaacctggcggcagcgcaaaagatg

SEQ ID NO: 56604 - DNA, 103 bp, Artificial Sequence
  Synthetic Polynucleotide
taatacgactcactatagggcaagtacggatataaactatctggttcctcaacagaggagagaggaaatggatagtttaaacctggcggcagcgcaaaagatg

SEQ ID NO: 56605 - DNA, 103 bp, Artificial Sequence
  Synthetic Polynucleotide
taatacgactcactataggggcttagtaactcaaatgtatcgtggaggtaaacagaggagatacctcatggatacatttaacctggcggcagcgcaaaagatg

SEQ ID NO: 56606 - DNA, 103 bp, Artificial Sequence
  Synthetic Polynucleotide
taatacgactcactatagggctattgcttagtaactcaaatgtatcgtggaacagaggagaccacgaatgatttgagttaacctggcggcagcgcaaaagatg

SEQ ID NO: 56607 - DNA, 103 bp, Artificial Sequence
  Synthetic Polynucleotide
taatacgactcactatagggattacctattgcttagtaactcaaatgtataacagaggagaatacatatgagttactaaaacctggcggcagcgcaaaagatg

SEQ ID NO: 56608 - DNA, 103 bp, Artificial Sequence
  Synthetic Polynucleotide
taatacgactcactatagggtagttattacctattgcttagtaactcaaaaacagaggagatttgagatgctaagcaataacctggcggcagcgcaaaagatg

SEQ ID NO: 56609 - DNA, 103 bp, Artificial Sequence
  Synthetic Polynucleotide
taatacgactcactatagggtagcttagttattacctattgcttagtaacaacagaggagagttactatgcaataggtaaacctggcggcagcgcaaaagatg

SEQ ID NO: 56610 - DNA, 103 bp, Artificial Sequence
  Synthetic Polynucleotide
taatacgactcactatagggcttactagcttagttattacctattgcttaaacagaggagataagcaatgggtaataacaacctggcggcagcgcaaaagatg

SEQ ID NO: 56611 - DNA, 103 bp, Artificial Sequence
  Synthetic Polynucleotide
taatacgactcactatagggtgcctcttactagcttagttattacctattaacagaggagaaataggatgtaactaagcaacctggcggcagcgcaaaagatg

SEQ ID NO: 56612 - DNA, 103 bp, Artificial Sequence
  Synthetic Polynucleotide
taatacgactcactatagggtctattgcctcttactagcttagttattacaacagaggagagtaataatgaagctagtaaacctggcggcagcgcaaaagatg

SEQ ID NO: 56613 - DNA, 103 bp, Artificial Sequence
  Synthetic Polynucleotide
taatacgactcactatagggtcttttctattgcctcttactagcttagttaacagaggagaaactaaatgagtaagaggaacctggcggcagcgcaaaagatg

SEQ ID NO: 56614 - DNA, 103 bp, Artificial Sequence
  Synthetic Polynucleotide
taatacgactcactatagggtctcatcttttctattgcctcttactagctaacagaggagaagctagatggaggcaataaacctggcggcagcgcaaaagatg

SEQ ID NO: 56615 - DNA, 103 bp, Artificial Sequence
  Synthetic Polynucleotide
taatacgactcactatagggacgtgcaagtacggatataaactatctggtaacagaggagaaccagaatgtttatatccaacctggcggcagcgcaaaagatg

SEQ ID NO: 56616 - DNA, 103 bp, Artificial Sequence
  Synthetic Polynucleotide
taatacgactcactatagggatttatctcatcttttctattgcctcttacaacagaggagagtaagaatgaatagaaaaaacctggcggcagcgcaaaagatg

SEQ ID NO: 56617 - DNA, 103 bp, Artificial Sequence
  Synthetic Polynucleotide
taatacgactcactatagggatgatatttatctcatcttttctattgcctaacagaggagaaggcaaatgaaaagatgaaacctggcggcagcgcaaaagatg

SEQ ID NO: 56618 - DNA, 103 bp, Artificial Sequence
  Synthetic Polynucleotide
taatacgactcactatagggtattgatgatatttatctcatcttttctataacagaggagaatagaaatgatgagataaaacctggcggcagcgcaaaagatg

SEQ ID NO: 56619 - DNA, 103 bp, Artificial Sequence
  Synthetic Polynucleotide
taatacgactcactatagggctctatattgatgatatttatctcatctttaacagaggagaaaagatatgataaatatcaacctggcggcagcgcaaaagatg

SEQ ID NO: 56620 - DNA, 103 bp, Artificial Sequence
  Synthetic Polynucleotide
taatacgactcactatagggctaatctctatattgatgatatttatctcaaacagaggagatgagatatgtatcatcaaaacctggcggcagcgcaaaagatg

SEQ ID NO: 56621 - DNA, 103 bp, Artificial Sequence
  Synthetic Polynucleotide
taatacgactcactatagggctcctctaatctctatattgatgatatttaaacagaggagataaataatgtcaatatagaacctggcggcagcgcaaaagatg

SEQ ID NO: 56622 - DNA, 103 bp, Artificial Sequence
  Synthetic Polynucleotide
taatacgactcactatagggtagccctcctctaatctctatattgatgataacagaggagaatcatcatgatagagattaacctggcggcagcgcaaaagatg

SEQ ID NO: 56623 - DNA, 103 bp, Artificial Sequence
  Synthetic Polynucleotide
taatacgactcactatagggctatatagccctcctctaatctctatattgaacagaggagacaatatatggattagaggaacctggcggcagcgcaaaagatg

SEQ ID NO: 56624 - DNA, 103 bp, Artificial Sequence
  Synthetic Polynucleotide
taatacgactcactatagggtggctctatatagccctcctctaatctctaaacagaggagatagagaatggaggagggcaacctggcggcagcgcaaaagatg

SEQ ID NO: 56625 - DNA, 103 bp, Artificial Sequence
  Synthetic Polynucleotide
taatacgactcactatagggcgtcttggctctatatagccctcctctaataacagaggagaattagaatggggctatataacctggcggcagcgcaaaagatg

SEQ ID NO: 56626 - DNA, 103 bp, Artificial Sequence
  Synthetic Polynucleotide
taatacgactcactatagggactttacgtgcaagtacggatataaactataacagaggagaatagttatgatccgtactaacctggcggcagcgcaaaagatg

SEQ ID NO: 56627 - DNA, 103 bp, Artificial Sequence
  Synthetic Polynucleotide
taatacgactcactatagggttgttcgtcttggctctatatagccctcctaacagaggagaaggaggatgatatagagcaacctggcggcagcgcaaaagatg

SEQ ID NO: 56628 - DNA, 103 bp, Artificial Sequence
  Synthetic Polynucleotide
taatacgactcactatagggtgattttgttcgtcttggctctatatagccaacagaggagaggctatatggagccaagaaacctggcggcagcgcaaaagatg

SEQ ID NO: 56629 - DNA, 103 bp, Artificial Sequence
  Synthetic Polynucleotide
taatacgactcactatagggcggtttgattttgttcgtcttggctctataaacagaggagatatagaatgaagacgaacaacctggcggcagcgcaaaagatg

SEQ ID NO: 56630 - DNA, 103 bp, Artificial Sequence
  Synthetic Polynucleotide
taatacgactcactatagggttactcggtttgattttgttcgtcttggctaacagaggagaagccaaatggaacaaaataacctggcggcagcgcaaaagatg

SEQ ID NO: 56631 - DNA, 103 bp, Artificial Sequence
  Synthetic Polynucleotide
taatacgactcactataggggaacgttactcggtttgattttgttcgtctaacagaggagaagacgaatgaaatcaaacaacctggcggcagcgcaaaagatg

SEQ ID NO: 56632 - DNA, 103 bp, Artificial Sequence
  Synthetic Polynucleotide
taatacgactcactatagggtgttagaacgttactcggtttgattttgttaacagaggagaaacaaaatgaaaccgagtaacctggcggcagcgcaaaagatg

SEQ ID NO: 56633 - DNA, 103 bp, Artificial Sequence
  Synthetic Polynucleotide
taatacgactcactatagggaatgatgttagaacgttactcggtttgattaacagaggagaaatcaaatggagtaacgtaacctggcggcagcgcaaaagatg

SEQ ID NO: 56634 - DNA, 103 bp, Artificial Sequence
  Synthetic Polynucleotide
taatacgactcactatagggaaaataatgatgttagaacgttactcggttaacagaggagaaaccgaatgacgttctaaaacctggcggcagcgcaaaagatg

SEQ ID NO: 56635 - DNA, 103 bp, Artificial Sequence
  Synthetic Polynucleotide
taatacgactcactatagggcttcaaaaataatgatgttagaacgttactaacagaggagaagtaacatgctaacatcaaacctggcggcagcgcaaaagatg

SEQ ID NO: 56636 - DNA, 103 bp, Artificial Sequence
  Synthetic Polynucleotide
taatacgactcactatagggggaatcttcaaaaataatgatgttagaacgaacagaggagacgttctatgatcattattaacctggcggcagcgcaaaagatg

SEQ ID NO: 56637 - DNA, 103 bp, Artificial Sequence
  Synthetic Polynucleotide
taatacgactcactatagggtgtagactttacgtgcaagtacggatataaaacagaggagattatatatgtacttgcacaacctggcggcagcgcaaaagatg

SEQ ID NO: 56638 - DNA, 103 bp, Artificial Sequence
  Synthetic Polynucleotide
taatacgactcactatagggatttgggaatcttcaaaaataatgatgttaaacagaggagataacatatgtatttttgaaacctggcggcagcgcaaaagatg

SEQ ID NO: 56639 - DNA, 103 bp, Artificial Sequence
  Synthetic Polynucleotide
taatacgactcactatagggtgattatttgggaatcttcaaaaataatgaaacagaggagatcattaatgttgaagattaacctggcggcagcgcaaaagatg

SEQ ID NO: 56640 - DNA, 103 bp, Artificial Sequence
  Synthetic Polynucleotide
taatacgactcactatagggatgaatgattatttgggaatcttcaaaaataacagaggagaatttttatggattcccaaaacctggcggcagcgcaaaagatg

SEQ ID NO: 56641 - DNA, 103 bp, Artificial Sequence
  Synthetic Polynucleotide
taatacgactcactataggggaggaatgaatgattatttgggaatcttcaaacagaggagatgaagaatgccaaataataacctggcggcagcgcaaaagatg

SEQ ID NO: 56642 - DNA, 103 bp, Artificial Sequence
  Synthetic Polynucleotide
taatacgactcactatagggttatggaggaatgaatgattatttgggaataacagaggagaattcccatgtaatcattcaacctggcggcagcgcaaaagatg

SEQ ID NO: 56643 - DNA, 103 bp, Artificial Sequence
  Synthetic Polynucleotide
taatacgactcactatagggaacgattatggaggaatgaatgattatttgaacagaggagacaaataatgattcattccaacctggcggcagcgcaaaagatg

SEQ ID NO: 56644 - DNA, 103 bp, Artificial Sequence
  Synthetic Polynucleotide
taatacgactcactatagggtgcaaaacgattatggaggaatgaatgattaacagaggagaaatcatatgttcctccataacctggcggcagcgcaaaagatg

SEQ ID NO: 56645 - DNA, 103 bp, Artificial Sequence
  Synthetic Polynucleotide
taatacgactcactatagggtatgatgcaaaacgattatggaggaatgaaaacagaggagattcattatgccataatcgaacctggcggcagcgcaaaagatg

SEQ ID NO: 56646 - DNA, 103 bp, Artificial Sequence
  Synthetic Polynucleotide
taatacgactcactatagggggaggtatgatgcaaaacgattatggaggaaacagaggagatcctccatgatcgttttgaacctggcggcagcgcaaaagatg

SEQ ID NO: 56647 - DNA, 103 bp, Artificial Sequence
  Synthetic Polynucleotide
taatacgactcactatagggaagatggaggtatgatgcaaaacgattatgaacagaggagacataatatgtttgcatcaaacctggcggcagcgcaaaagatg

SEQ ID NO: 56648 - DNA, 103 bp, Artificial Sequence
  Synthetic Polynucleotide
taatacgactcactataggggacaatgtagactttacgtgcaagtacggaaacagaggagatccgtaatggcacgtaaaaacctggcggcagcgcaaaagatg

SEQ ID NO: 56649 - DNA, 103 bp, Artificial Sequence
  Synthetic Polynucleotide
taatacgactcactataggggcctaaagatggaggtatgatgcaaaacgaaacagaggagatcgtttatgatcatacctaacctggcggcagcgcaaaagatg

SEQ ID NO: 56650 - DNA, 103 bp, Artificial Sequence
  Synthetic Polynucleotide
taatacgactcactatagggtttatgcctaaagatggaggtatgatgcaaaacagaggagattgcatatgacctccatcaacctggcggcagcgcaaaagatg

SEQ ID NO: 56651 - DNA, 103 bp, Artificial Sequence
  Synthetic Polynucleotide
taatacgactcactatagggaatcgtttatgcctaaagatggaggtatgaaacagaggagatcatacatgcatctttagaacctggcggcagcgcaaaagatg

SEQ ID NO: 56652 - DNA, 103 bp, Artificial Sequence
  Synthetic Polynucleotide
taatacgactcactataggggcagcaatcgtttatgcctaaagatggaggaacagaggagacctccaatgttaggcataaacctggcggcagcgcaaaagatg

SEQ ID NO: 56653 - DNA, 103 bp, Artificial Sequence
  Synthetic Polynucleotide
taatacgactcactataggggaacagcagcaatcgtttatgcctaaagataacagaggagaatctttatgcataaacgaaacctggcggcagcgcaaaagatg

SEQ ID NO: 56654 - DNA, 103 bp, Artificial Sequence
  Synthetic Polynucleotide
taatacgactcactatagggcagaggaacagcagcaatcgtttatgcctaaacagaggagataggcaatgacgattgctaacctggcggcagcgcaaaagatg

SEQ ID NO: 56655 - DNA, 103 bp, Artificial Sequence
  Synthetic Polynucleotide
taatacgactcactatagggatttacagaggaacagcagcaatcgtttataacagaggagaataaacatgtgctgctgtaacctggcggcagcgcaaaagatg

SEQ ID NO: 56656 - DNA, 103 bp, Artificial Sequence
  Synthetic Polynucleotide
taatacgactcactataggggatttatttacagaggaacagcagcaatcgaacagaggagacgattgatgctgttcctcaacctggcggcagcgcaaaagatg

SEQ ID NO: 56657 - DNA, 103 bp, Artificial Sequence
  Synthetic Polynucleotide
taatacgactcactatagggataaagatttatttacagaggaacagcagcaacagaggagagctgctatgcctctgtaaaacctggcggcagcgcaaaagatg

SEQ ID NO: 56658 - DNA, 103 bp, Artificial Sequence
  Synthetic Polynucleotide
taatacgactcactataggggcttgataaagatttatttacagaggaacaaacagaggagatgttccatggtaaataaaaacctggcggcagcgcaaaagatg

SEQ ID NO: 56659 - DNA, 103 bp, Artificial Sequence
  Synthetic Polynucleotide
taatacgactcactatagggataatgacaatgtagactttacgtgcaagtaacagaggagaacttgcatgtaaagtctaaacctggcggcagcgcaaaagatg

SEQ ID NO: 56660 - DNA, 103 bp, Artificial Sequence
  Synthetic Polynucleotide
taatacgactcactatagggggagtgcttgataaagatttatttacagagaacagaggagactctgtatgtaaatctttaacctggcggcagcgcaaaagatg

SEQ ID NO: 56661 - DNA, 103 bp, Artificial Sequence
  Synthetic Polynucleotide
taatacgactcactataggggtgctggagtgcttgataaagatttatttaaacagaggagataaataatgctttatcaaaacctggcggcagcgcaaaagatg

SEQ ID NO: 56662 - DNA, 103 bp, Artificial Sequence
  Synthetic Polynucleotide
taatacgactcactatagggtgcgggtgctggagtgcttgataaagatttaacagaggagaaaatctatgtcaagcactaacctggcggcagcgcaaaagatg

SEQ ID NO: 56663 - DNA, 103 bp, Artificial Sequence
  Synthetic Polynucleotide
taatacgactcactatagggttctctgcgggtgctggagtgcttgataaaaacagaggagatttatcatgcactccagcaacctggcggcagcgcaaaagatg

SEQ ID NO: 56664 - DNA, 103 bp, Artificial Sequence
  Synthetic Polynucleotide
taatacgactcactatagggacgacttctctgcgggtgctggagtgcttgaacagaggagacaagcaatgcagcacccgaacctggcggcagcgcaaaagatg

SEQ ID NO: 56665 - DNA, 103 bp, Artificial Sequence
  Synthetic Polynucleotide
taatacgactcactataggggcttgacgacttctctgcgggtgctggagtaacagaggagaactccaatgcccgcagagaacctggcggcagcgcaaaagatg

SEQ ID NO: 56666 - DNA, 103 bp, Artificial Sequence
  Synthetic Polynucleotide
taatacgactcactatagggaatatgcttgacgacttctctgcgggtgctaacagaggagaagcaccatgagagaagtcaacctggcggcagcgcaaaagatg

SEQ ID NO: 56667 - DNA, 103 bp, Artificial Sequence
  Synthetic Polynucleotide
taatacgactcactatagggattacaatatgcttgacgacttctctgcggaacagaggagaccgcagatgagtcgtcaaaacctggcggcagcgcaaaagatg

SEQ ID NO: 56668 - DNA, 103 bp, Artificial Sequence
  Synthetic Polynucleotide
taatacgactcactatagggaagatattacaatatgcttgacgacttctcaacagaggagagagaagatgtcaagcataaacctggcggcagcgcaaaagatg

SEQ ID NO: 56669 - DNA, 103 bp, Artificial Sequence
  Synthetic Polynucleotide
taatacgactcactatagggtatttaagatattacaatatgcttgacgacaacagaggagagtcgtcatgcatattgtaaacctggcggcagcgcaaaagatg

SEQ ID NO: 56670 - DNA, 103 bp, Artificial Sequence
  Synthetic Polynucleotide
taatacgactcactatagggttcgtataatgacaatgtagactttacgtgaacagaggagacacgtaatgtctacattgaacctggcggcagcgcaaaagatg

SEQ ID NO: 56671 - DNA, 103 bp, Artificial Sequence
  Synthetic Polynucleotide
taatacgactcactatagggtgagttatttaagatattacaatatgcttgaacagaggagacaagcaatgtgtaatatcaacctggcggcagcgcaaaagatg

SEQ ID NO: 56672 - DNA, 103 bp, Artificial Sequence
  Synthetic Polynucleotide
taatacgactcactatagggataaatgagttatttaagatattacaatataacagaggagaatattgatgtatcttaaaaacctggcggcagcgcaaaagatg

SEQ ID NO: 56673 - DNA, 103 bp, Artificial Sequence
  Synthetic Polynucleotide
taatacgactcactatagggaatatataaatgagttatttaagatattacaacagaggagagtaataatgtaaataactaacctggcggcagcgcaaaagatg

SEQ ID NO: 56674 - DNA, 103 bp, Artificial Sequence
  Synthetic Polynucleotide
taatacgactcactatagggtttttaatatataaatgagttatttaagataacagaggagaatcttaatgaactcatttaacctggcggcagcgcaaaagatg

SEQ ID NO: 56675 - DNA, 103 bp, Artificial Sequence
  Synthetic Polynucleotide
taatacgactcactataggggacattttttaatatataaatgagttatttaacagaggagaaaataaatgatttatataaacctggcggcagcgcaaaagatg

SEQ ID NO: 56676 - DNA, 103 bp, Artificial Sequence
  Synthetic Polynucleotide
taatacgactcactatagggatagtgacattttttaatatataaatgagtaacagaggagaactcatatgtatattaaaaacctggcggcagcgcaaaagatg

SEQ ID NO: 56677 - DNA, 103 bp, Artificial Sequence
  Synthetic Polynucleotide
taatacgactcactatagggctttaatagtgacattttttaatatataaaaacagaggagatttataatgtaaaaaatgaacctggcggcagcgcaaaagatg

SEQ ID NO: 56678 - DNA, 103 bp, Artificial Sequence
  Synthetic Polynucleotide
taatacgactcactatagggtccatctttaatagtgacattttttaatataacagaggagaatattaatgaatgtcactaacctggcggcagcgcaaaagatg

SEQ ID NO: 56679 - DNA, 103 bp, Artificial Sequence
  Synthetic Polynucleotide
taatacgactcactatagggtatactccatctttaatagtgacattttttaacagaggagaaaaaaaatgcactattaaaacctggcggcagcgcaaaagatg

SEQ ID NO: 56680 - DNA, 103 bp, Artificial Sequence
  Synthetic Polynucleotide
taatacgactcactatagggaagattatactccatctttaatagtgacataacagaggagaatgtcaatgttaaagatgaacctggcggcagcgcaaaagatg

SEQ ID NO: 56681 - DNA, 103 bp, Artificial Sequence
  Synthetic Polynucleotide
taatacgactcactatagggtacataatgatatttttatatagtattagaaacagaggagatctaatatgatataaaaaaacctggcggcagcgcaaaagatg

SEQ ID NO: 56682 - DNA, 103 bp, Artificial Sequence
  Synthetic Polynucleotide
taatacgactcactatagggtcatattcgtataatgacaatgtagactttaacagaggagaaaagtcatgattgtcattaacctggcggcagcgcaaaagatg

SEQ ID NO: 56683 - DNA, 103 bp, Artificial Sequence
  Synthetic Polynucleotide
taatacgactcactataggggcataaagattatactccatctttaatagtaacagaggagaactattatggatggagtaaacctggcggcagcgcaaaagatg

SEQ ID NO: 56684 - DNA, 103 bp, Artificial Sequence
  Synthetic Polynucleotide
taatacgactcactataggggttcggcataaagattatactccatctttaaacagaggagataaagaatgagtataatcaacctggcggcagcgcaaaagatg

SEQ ID NO: 56685 - DNA, 103 bp, Artificial Sequence
  Synthetic Polynucleotide
taatacgactcactatagggttttagttcggcataaagattatactccataacagaggagaatggagatgaatctttataacctggcggcagcgcaaaagatg

SEQ ID NO: 56686 - DNA, 103 bp, Artificial Sequence
  Synthetic Polynucleotide
taatacgactcactatagggattttttttagttcggcataaagattatacaacagaggagagtataaatgttatgccgaaacctggcggcagcgcaaaagatg

SEQ ID NO: 56687 - DNA, 103 bp, Artificial Sequence
  Synthetic Polynucleotide
taatacgactcactatagggaagttattttttttagttcggcataaagataacagaggagaatctttatgccgaactaaaacctggcggcagcgcaaaagatg

SEQ ID NO: 56688 - DNA, 103 bp, Artificial Sequence
  Synthetic Polynucleotide
taatacgactcactatagggaccacaagttattttttttagttcggcataaacagaggagatatgccatgctaaaaaaaaacctggcggcagcgcaaaagatg

SEQ ID NO: 56689 - DNA, 103 bp, Artificial Sequence
  Synthetic Polynucleotide
taatacgactcactataggggattgaccacaagttattttttttagttcgaacagaggagacgaactatgaaaaataacaacctggcggcagcgcaaaagatg

SEQ ID NO: 56690 - DNA, 103 bp, Artificial Sequence
  Synthetic Polynucleotide
taatacgactcactatagggttagggattgaccacaagttattttttttaaacagaggagataaaaaatgtaacttgtgaacctggcggcagcgcaaaagatg

SEQ ID NO: 56691 - DNA, 103 bp, Artificial Sequence
  Synthetic Polynucleotide
taatacgactcactatagggaagacttagggattgaccacaagttattttaacagaggagaaaaataatgtgtggtcaaaacctggcggcagcgcaaaagatg

SEQ ID NO: 56692 - DNA, 103 bp, Artificial Sequence
  Synthetic Polynucleotide
taatacgactcactatagggttaaaaagacttagggattgaccacaagttaacagaggagaaacttgatgtcaatccctaacctggcggcagcgcaaaagatg

SEQ ID NO: 56693 - DNA, 103 bp, Artificial Sequence
  Synthetic Polynucleotide
taatacgactcactatagggaaagatcatattcgtataatgacaatgtagaacagaggagactacatatgcattatacgaacctggcggcagcgcaaaagatg

SEQ ID NO: 56694 - DNA, 103 bp, Artificial Sequence
  Synthetic Polynucleotide
taatacgactcactatagggcttcgttaaaaagacttagggattgaccacaacagaggagagtggtcatgccctaagtcaacctggcggcagcgcaaaagatg

SEQ ID NO: 56695 - DNA, 103 bp, Artificial Sequence
  Synthetic Polynucleotide
taatacgactcactatagggcccgtcttcgttaaaaagacttagggattgaacagaggagacaatccatgagtctttttaacctggcggcagcgcaaaagatg

SEQ ID NO: 56696 - DNA, 103 bp, Artificial Sequence
  Synthetic Polynucleotide
taatacgactcactatagggaaatccccgtcttcgttaaaaagacttaggaacagaggagacctaagatgttttaacgaaacctggcggcagcgcaaaagatg

SEQ ID NO: 56697 - DNA, 103 bp, Artificial Sequence
  Synthetic Polynucleotide
taatacgactcactatagggctacgaaatccccgtcttcgttaaaaagacaacagaggagagtctttatgacgaagacgaacctggcggcagcgcaaaagatg

SEQ ID NO: 56698 - DNA, 103 bp, Artificial Sequence
  Synthetic Polynucleotide
taatacgactcactatagggaacttctacgaaatccccgtcttcgttaaaaacagaggagatttaacatggacggggataacctggcggcagcgcaaaagatg

SEQ ID NO: 56699 - DNA, 103 bp, Artificial Sequence
  Synthetic Polynucleotide
taatacgactcactatagggggttcaacttctacgaaatccccgtcttcgaacagaggagacgaagaatgggatttcgtaacctggcggcagcgcaaaagatg

SEQ ID NO: 56700 - DNA, 103 bp, Artificial Sequence
  Synthetic Polynucleotide
taatacgactcactatagggatcccggttcaacttctacgaaatccccgtaacagaggagaacggggatgtcgtagaagaacctggcggcagcgcaaaagatg

SEQ ID NO: 56701 - DNA, 103 bp, Artificial Sequence
  Synthetic Polynucleotide
taatacgactcactatagggtaatgatcccggttcaacttctacgaaatcaacagaggagagatttcatggaagttgaaaacctggcggcagcgcaaaagatg

SEQ ID NO: 56702 - DNA, 103 bp, Artificial Sequence
  Synthetic Polynucleotide
taatacgactcactatagggttaaataatgatcccggttcaacttctacgaacagaggagacgtagaatgtgaaccgggaacctggcggcagcgcaaaagatg

SEQ ID NO: 56703 - DNA, 103 bp, Artificial Sequence
  Synthetic Polynucleotide
taatacgactcactatagggaaaacttaaataatgatcccggttcaacttaacagaggagaaagttgatgcgggatcataacctggcggcagcgcaaaagatg

SEQ ID NO: 56704 - DNA, 103 bp, Artificial Sequence
  Synthetic Polynucleotide
taatacgactcactataggggtttaaaagatcatattcgtataatgacaaaacagaggagattgtcaatgtacgaatataacctggcggcagcgcaaaagatg

SEQ ID NO: 56705 - DNA, 103 bp, Artificial Sequence
  Synthetic Polynucleotide
taatacgactcactatagggtatcaaaaacttaaataatgatcccggttcaacagaggagagaaccgatgtcattatttaacctggcggcagcgcaaaagatg

SEQ ID NO: 56706 - DNA, 103 bp, Artificial Sequence
  Synthetic Polynucleotide
taatacgactcactatagggttaggtatcaaaaacttaaataatgatcccaacagaggagagggatcatgatttaagttaacctggcggcagcgcaaaagatg

SEQ ID NO: 56707 - DNA, 103 bp, Artificial Sequence
  Synthetic Polynucleotide
taatacgactcactatagggatcccttaggtatcaaaaacttaaataatgaacagaggagacattatatgagtttttgaaacctggcggcagcgcaaaagatg

SEQ ID NO: 56708 - DNA, 103 bp, Artificial Sequence
  Synthetic Polynucleotide
taatacgactcactataggggtaaaatcccttaggtatcaaaaacttaaaaacagaggagatttaagatgttgatacctaacctggcggcagcgcaaaagatg

SEQ ID NO: 56709 - DNA, 103 bp, Artificial Sequence
  Synthetic Polynucleotide
taatacgactcactataggggaggagtaaaatcccttaggtatcaaaaacaacagaggagagtttttatgacctaagggaacctggcggcagcgcaaaagatg

SEQ ID NO: 56710 - DNA, 103 bp, Artificial Sequence
  Synthetic Polynucleotide
taatacgactcactatagggaaggagaggagtaaaatcccttaggtatcaaacagaggagatgatacatgagggattttaacctggcggcagcgcaaaagatg

SEQ ID NO: 56711 - DNA, 103 bp, Artificial Sequence
  Synthetic Polynucleotide
taatacgactcactatagggtacggaaggagaggagtaaaatcccttaggaacagaggagacctaagatgttttactccaacctggcggcagcgcaaaagatg

SEQ ID NO: 56712 - DNA, 103 bp, Artificial Sequence
  Synthetic Polynucleotide
taatacgactcactataggggtctttacggaaggagaggagtaaaatcccaacagaggagagggattatgctcctctccaacctggcggcagcgcaaaagatg

SEQ ID NO: 56713 - DNA, 103 bp, Artificial Sequence
  Synthetic Polynucleotide
taatacgactcactatagggaactcgtctttacggaaggagaggagtaaaaacagaggagatttactatgctccttccgaacctggcggcagcgcaaaagatg

SEQ ID NO: 56714 - DNA, 103 bp, Artificial Sequence
  Synthetic Polynucleotide
taatacgactcactatagggtactaaactcgtctttacggaaggagaggaaacagaggagatcctctatgtccgtaaagaacctggcggcagcgcaaaagatg

SEQ ID NO: 56715 - DNA, 103 bp, Artificial Sequence
  Synthetic Polynucleotide
taatacgactcactatagggagcgggtttaaaagatcatattcgtataataacagaggagaattataatgatatgatctaacctggcggcagcgcaaaagatg

SEQ ID NO: 56716 - DNA, 103 bp, Artificial Sequence
  Synthetic Polynucleotide
taatacgactcactatagggtcgaatactaaactcgtctttacggaaggaaacagaggagatccttcatgaaagacgagaacctggcggcagcgcaaaagatg

SEQ ID NO: 56717 - DNA, 103 bp, Artificial Sequence
  Synthetic Polynucleotide
taatacgactcactatagggatgtctcgaatactaaactcgtctttacggaacagaggagaccgtaaatgcgagtttagaacctggcggcagcgcaaaagatg

SEQ ID NO: 56718 - DNA, 103 bp, Artificial Sequence
  Synthetic Polynucleotide
taatacgactcactatagggtgttaatgtctcgaatactaaactcgtcttaacagaggagaaagacgatgttagtattcaacctggcggcagcgcaaaagatg

SEQ ID NO: 56719 - DNA, 103 bp, Artificial Sequence
  Synthetic Polynucleotide
taatacgactcactataggggtcgttgttaatgtctcgaatactaaactcaacagaggagagagtttatgattcgagacaacctggcggcagcgcaaaagatg

SEQ ID NO: 56720 - DNA, 103 bp, Artificial Sequence
  Synthetic Polynucleotide
taatacgactcactatagggtatcggtcgttgttaatgtctcgaatactaaacagaggagatagtatatgagacattaaaacctggcggcagcgcaaaagatg

SEQ ID NO: 56721 - DNA, 103 bp, Artificial Sequence
  Synthetic Polynucleotide
taatacgactcactatagggtttattatcggtcgttgttaatgtctcgaaaacagaggagattcgagatgttaacaacgaacctggcggcagcgcaaaagatg

SEQ ID NO: 56722 - DNA, 103 bp, Artificial Sequence
  Synthetic Polynucleotide
taatacgactcactataggggtaattttattatcggtcgttgttaatgtcaacagaggagagacattatgaacgaccgaaacctggcggcagcgcaaaagatg

SEQ ID NO: 56723 - DNA, 103 bp, Artificial Sequence
  Synthetic Polynucleotide
taatacgactcactatagggtactagtaattttattatcggtcgttgttaaacagaggagataacaaatgccgataataaacctggcggcagcgcaaaagatg

SEQ ID NO: 56724 - DNA, 103 bp, Artificial Sequence
  Synthetic Polynucleotide
taatacgactcactatagggattgatactagtaattttattatcggtcgtaacagaggagaacgaccatgaataaaattaacctggcggcagcgcaaaagatg

SEQ ID NO: 56725 - DNA, 103 bp, Artificial Sequence
  Synthetic Polynucleotide
taatacgactcactataggggttggattgatactagtaattttattatcgaacagaggagacgataaatgaattactagaacctggcggcagcgcaaaagatg

SEQ ID NO: 56726 - DNA, 103 bp, Artificial Sequence
  Synthetic Polynucleotide
taatacgactcactatagggtgtctagcgggtttaaaagatcatattcgtaacagaggagaacgaatatgatcttttaaaacctggcggcagcgcaaaagatg

SEQ ID NO: 56727 - DNA, 103 bp, Artificial Sequence
  Synthetic Polynucleotide
taatacgactcactatagggcatttgttggattgatactagtaattttataacagaggagaataaaaatgctagtatcaaacctggcggcagcgcaaaagatg

SEQ ID NO: 56728 - DNA, 103 bp, Artificial Sequence
  Synthetic Polynucleotide
taatacgactcactatagggtggtgcatttgttggattgatactagtaataacagaggagaattactatgatcaatccaaacctggcggcagcgcaaaagatg

SEQ ID NO: 56729 - DNA, 103 bp, Artificial Sequence
  Synthetic Polynucleotide
taatacgactcactatagggaactttggtgcatttgttggattgatactaaacagaggagatagtatatgtccaacaaaaacctggcggcagcgcaaaagatg

SEQ ID NO: 56730 - DNA, 103 bp, Artificial Sequence
  Synthetic Polynucleotide
taatacgactcactataggggatataactttggtgcatttgttggattgaaacagaggagatcaatcatgcaaatgcacaacctggcggcagcgcaaaagatg

SEQ ID NO: 56731 - DNA, 103 bp, Artificial Sequence
  Synthetic Polynucleotide
taatacgactcactatagggaagaggatataactttggtgcatttgttggaacagaggagaccaacaatggcaccaaagaacctggcggcagcgcaaaagatg

SEQ ID NO: 56732 - DNA, 103 bp, Artificial Sequence
  Synthetic Polynucleotide
taatacgactcactatagggtgttgaagaggatataactttggtgcatttaacagaggagaaaatgcatgaaagttataaacctggcggcagcgcaaaagatg

SEQ ID NO: 56733 - DNA, 103 bp, Artificial Sequence
  Synthetic Polynucleotide
taatacgactcactatagggctttgtgttgaagaggatataactttggtgaacagaggagacaccaaatgtatatcctcaacctggcggcagcgcaaaagatg

SEQ ID NO: 56734 - DNA, 103 bp, Artificial Sequence
  Synthetic Polynucleotide
taatacgactcactatagggtacgactttgtgttgaagaggatataacttaacagaggagaaagttaatgcctcttcaaaacctggcggcagcgcaaaagatg

SEQ ID NO: 56735 - DNA, 103 bp, Artificial Sequence
  Synthetic Polynucleotide
taatacgactcactatagggtcagatacgactttgtgttgaagaggatataacagaggagaatatccatgtcaacacaaaacctggcggcagcgcaaaagatg

SEQ ID NO: 56736 - DNA, 103 bp, Artificial Sequence
  Synthetic Polynucleotide
taatacgactcactatagggctacttcagatacgactttgtgttgaagagaacagaggagactcttcatgacaaagtcgaacctggcggcagcgcaaaagatg

SEQ ID NO: 56737 - DNA, 103 bp, Artificial Sequence
  Synthetic Polynucleotide
taatacgactcactatagggatacttgtctagcgggtttaaaagatcataaacagaggagatatgatatgttaaacccgaacctggcggcagcgcaaaagatg

SEQ ID NO: 56738 - DNA, 103 bp, Artificial Sequence
  Synthetic Polynucleotide
taatacgactcactatagggagaaactacttcagatacgactttgtgttgaacagaggagacaacacatggtcgtatctaacctggcggcagcgcaaaagatg

SEQ ID NO: 56739 - DNA, 103 bp, Artificial Sequence
  Synthetic Polynucleotide
taatacgactcactatagggatattagaaactacttcagatacgactttgaacagaggagacaaagtatgatctgaagtaacctggcggcagcgcaaaagatg

SEQ ID NO: 56740 - DNA, 103 bp, Artificial Sequence
  Synthetic Polynucleotide
taatacgactcactatagggtcctcatattagaaactacttcagatacgaaacagaggagatcgtatatgaagtagtttaacctggcggcagcgcaaaagatg

SEQ ID NO: 56741 - DNA, 103 bp, Artificial Sequence
  Synthetic Polynucleotide
taatacgactcactatagggcattttcctcatattagaaactacttcagaaacagaggagatctgaaatggtttctaataacctggcggcagcgcaaaagatg

SEQ ID NO: 56742 - DNA, 103 bp, Artificial Sequence
  Synthetic Polynucleotide
taatacgactcactatagggttaatcattttcctcatattagaaactactaacagaggagaagtagtatgtaatatgagaacctggcggcagcgcaaaagatg

SEQ ID NO: 56743 - DNA, 103 bp, Artificial Sequence
  Synthetic Polynucleotide
taatacgactcactatagggttaatttaatcattttcctcatattagaaaaacagaggagatttctaatgtgaggaaaaaacctggcggcagcgcaaaagatg

SEQ ID NO: 56744 - DNA, 103 bp, Artificial Sequence
  Synthetic Polynucleotide
taatacgactcactatagggacgttttaatttaatcattttcctcatattaacagaggagaaatatgatgaaaatgattaacctggcggcagcgcaaaagatg

SEQ ID NO: 56745 - DNA, 103 bp, Artificial Sequence
  Synthetic Polynucleotide
taatacgactcactatagggagaggacgttttaatttaatcattttcctcaacagaggagagaggaaatggattaaattaacctggcggcagcgcaaaagatg

SEQ ID NO: 56746 - DNA, 103 bp, Artificial Sequence
  Synthetic Polynucleotide
taatacgactcactatagggtgtatagaggacgttttaatttaatcatttaacagaggagaaaatgaatgaattaaaacaacctggcggcagcgcaaaagatg

SEQ ID NO: 56747 - DNA, 103 bp, Artificial Sequence
  Synthetic Polynucleotide
taatacgactcactatagggagtgatgtatagaggacgttttaatttaataacagaggagaattaaaatgaaacgtcctaacctggcggcagcgcaaaagatg

SEQ ID NO: 56748 - DNA, 103 bp, Artificial Sequence
  Synthetic Polynucleotide
taatacgactcactatagggaacggatacttgtctagcgggtttaaaagaaacagaggagatcttttatgcccgctagaaacctggcggcagcgcaaaagatg

SEQ ID NO: 56749 - DNA, 103 bp, Artificial Sequence
  Synthetic Polynucleotide
taatacgactcactatagggtgaagagtgatgtatagaggacgttttaataacagaggagaattaaaatgtcctctataaacctggcggcagcgcaaaagatg

SEQ ID NO: 56750 - DNA, 103 bp, Artificial Sequence
  Synthetic Polynucleotide
taatacgactcactatagggccaagtgaagagtgatgtatagaggacgttaacagaggagaaacgtcatgtatacatcaaacctggcggcagcgcaaaagatg

SEQ ID NO: 56751 - DNA, 103 bp, Artificial Sequence
  Synthetic Polynucleotide
taatacgactcactatagggacacgccaagtgaagagtgatgtatagaggaacagaggagacctctaatgatcactcttaacctggcggcagcgcaaaagatg

SEQ ID NO: 56752 - DNA, 103 bp, Artificial Sequence
  Synthetic Polynucleotide
taatacgactcactatagggaatccacacgccaagtgaagagtgatgtataacagaggagaatacatatgtcttcacttaacctggcggcagcgcaaaagatg

SEQ ID NO: 56753 - DNA, 103 bp, Artificial Sequence
  Synthetic Polynucleotide
taatacgactcactatagggtaccaaatccacacgccaagtgaagagtgaaacagaggagatcactcatgacttggcgtaacctggcggcagcgcaaaagatg

SEQ ID NO: 56754 - DNA, 103 bp, Artificial Sequence
  Synthetic Polynucleotide
taatacgactcactatagggagtcttaccaaatccacacgccaagtgaagaacagaggagacttcacatggcgtgtggaaacctggcggcagcgcaaaagatg

SEQ ID NO: 56755 - DNA, 103 bp, Artificial Sequence
  Synthetic Polynucleotide
taatacgactcactataggggtaatagtcttaccaaatccacacgccaagaacagaggagacttggcatgtggatttggaacctggcggcagcgcaaaagatg

SEQ ID NO: 56756 - DNA, 103 bp, Artificial Sequence
  Synthetic Polynucleotide
taatacgactcactatagggacgtggtaatagtcttaccaaatccacacgaacagaggagacgtgtgatgttggtaagaaacctggcggcagcgcaaaagatg

SEQ ID NO: 56757 - DNA, 103 bp, Artificial Sequence
  Synthetic Polynucleotide
taatacgactcactatagggataacacgtggtaatagtcttaccaaatccaacagaggagaggatttatgaagactattaacctggcggcagcgcaaaagatg

SEQ ID NO: 56758 - DNA, 103 bp, Artificial Sequence
  Synthetic Polynucleotide
taatacgactcactatagggataagataacacgtggtaatagtcttaccaaacagaggagatggtaaatgtattaccacaacctggcggcagcgcaaaagatg

SEQ ID NO: 56759 - DNA, 103 bp, Artificial Sequence
  Synthetic Polynucleotide
taatacgactcactatagggtattaaacggatacttgtctagcgggtttaaacagaggagataaaccatgtagacaagtaacctggcggcagcgcaaaagatg

SEQ ID NO: 56760 - DNA, 103 bp, Artificial Sequence
  Synthetic Polynucleotide
taatacgactcactatagggtagccataagataacacgtggtaatagtctaacagaggagaagactaatgccacgtgttaacctggcggcagcgcaaaagatg

SEQ ID NO: 56761 - DNA, 103 bp, Artificial Sequence
  Synthetic Polynucleotide
taatacgactcactataggggtgtgtagccataagataacacgtggtaataacagaggagaattaccatgtgttatcttaacctggcggcagcgcaaaagatg

SEQ ID NO: 56762 - DNA, 103 bp, Artificial Sequence
  Synthetic Polynucleotide
taatacgactcactatagggcttccgtgtgtagccataagataacacgtgaacagaggagacacgtgatgtcttatggcaacctggcggcagcgcaaaagatg

SEQ ID NO: 56763 - DNA, 103 bp, Artificial Sequence
  Synthetic Polynucleotide
taatacgactcactatagggtttttcttccgtgtgtagccataagataacaacagaggagagttatcatgtggctacacaacctggcggcagcgcaaaagatg

SEQ ID NO: 56764 - DNA, 103 bp, Artificial Sequence
  Synthetic Polynucleotide
taatacgactcactataggggacggtttttcttccgtgtgtagccataagaacagaggagacttatgatgacacacggaaacctggcggcagcgcaaaagatg

SEQ ID NO: 56765 - DNA, 103 bp, Artificial Sequence
  Synthetic Polynucleotide
taatacgactcactatagggcaaatgacggtttttcttccgtgtgtagccaacagaggagaggctacatgcggaagaaaaacctggcggcagcgcaaaagatg

SEQ ID NO: 56766 - DNA, 103 bp, Artificial Sequence
  Synthetic Polynucleotide
taatacgactcactataggggtacacaaatgacggtttttcttccgtgtgaacagaggagacacacgatggaaaaaccgaacctggcggcagcgcaaaagatg

SEQ ID NO: 56767 - DNA, 103 bp, Artificial Sequence
  Synthetic Polynucleotide
taatacgactcactatagggattgggtacacaaatgacggtttttcttccaacagaggagaggaagaatgaccgtcattaacctggcggcagcgcaaaagatg

SEQ ID NO: 56768 - DNA, 103 bp, Artificial Sequence
  Synthetic Polynucleotide
taatacgactcactatagggattttattgggtacacaaatgacggtttttaacagaggagaaaaaacatgcatttgtgtaacctggcggcagcgcaaaagatg

SEQ ID NO: 56769 - DNA, 103 bp, Artificial Sequence
  Synthetic Polynucleotide
taatacgactcactatagggttaacattttattgggtacacaaatgacggaacagaggagaccgtcaatggtgtacccaaacctggcggcagcgcaaaagatg

SEQ ID NO: 56770 - DNA, 103 bp, Artificial Sequence
  Synthetic Polynucleotide
taatacgactcactatagggtacaatattaaacggatacttgtctagcggaacagaggagaccgctaatgaagtatccgaacctggcggcagcgcaaaagatg

SEQ ID NO: 56771 - DNA, 103 bp, Artificial Sequence
  Synthetic Polynucleotide
taatacgactcactatagggatgtattaacattttattgggtacacaaataacagaggagaatttgtatgcccaataaaaacctggcggcagcgcaaaagatg

SEQ ID NO: 56772 - DNA, 103 bp, Artificial Sequence
  Synthetic Polynucleotide
taatacgactcactatagggcattgatgtattaacattttattgggtacaaacagaggagatgtaccatgtaaaatgttaacctggcggcagcgcaaaagatg

SEQ ID NO: 56773 - DNA, 103 bp, Artificial Sequence
  Synthetic Polynucleotide
taatacgactcactatagggtcttccattgatgtattaacattttattggaacagaggagaccaataatgtgttaatacaacctggcggcagcgcaaaagatg

SEQ ID NO: 56774 - DNA, 103 bp, Artificial Sequence
  Synthetic Polynucleotide
taatacgactcactatagggctgtgtcttccattgatgtattaacattttaacagaggagaaaaatgatgatacatcaaaacctggcggcagcgcaaaagatg

SEQ ID NO: 56775 - DNA, 103 bp, Artificial Sequence
  Synthetic Polynucleotide
taatacgactcactatagggtctacctgtgtcttccattgatgtattaacaacagaggagagttaatatgtcaatggaaaacctggcggcagcgcaaaagatg

SEQ ID NO: 56776 - DNA, 103 bp, Artificial Sequence
  Synthetic Polynucleotide
taatacgactcactatagggctgcctctacctgtgtcttccattgatgtaaacagaggagatacatcatgggaagacacaacctggcggcagcgcaaaagatg

SEQ ID NO: 56777 - DNA, 103 bp, Artificial Sequence
  Synthetic Polynucleotide
taatacgactcactatagggtccgactgcctctacctgtgtcttccattgaacagaggagacaatggatgacacaggtaaacctggcggcagcgcaaaagatg

SEQ ID NO: 56778 - DNA, 103 bp, Artificial Sequence
  Synthetic Polynucleotide
taatacgactcactatagggtccaatccgactgcctctacctgtgtcttcaacagaggagagaagacatgggtagaggcaacctggcggcagcgcaaaagatg

SEQ ID NO: 56779 - DNA, 103 bp, Artificial Sequence
  Synthetic Polynucleotide
taatacgactcactatagggtatgttccaatccgactgcctctacctgtgaacagaggagacacaggatgaggcagtcgaacctggcggcagcgcaaaagatg

SEQ ID NO: 56780 - DNA, 103 bp, Artificial Sequence
  Synthetic Polynucleotide
taatacgactcactatagggtatcttatgttccaatccgactgcctctacaacagaggagagtagagatggtcggattgaacctggcggcagcgcaaaagatg

SEQ ID NO: 56781 - DNA, 103 bp, Artificial Sequence
  Synthetic Polynucleotide
taatacgactcactatagggcatcctacaatattaaacggatacttgtctaacagaggagaagacaaatgtccgtttaaaacctggcggcagcgcaaaagatg

SEQ ID NO: 56782 - DNA, 103 bp, Artificial Sequence
  Synthetic Polynucleotide
taatacgactcactatagggatagatatcttatgttccaatccgactgccaacagaggagaggcagtatgattggaacaaacctggcggcagcgcaaaagatg

SEQ ID NO: 56783 - DNA, 103 bp, Artificial Sequence
  Synthetic Polynucleotide
taatacgactcactatagggcatctatagatatcttatgttccaatccgaaacagaggagatcggatatgaacataagaaacctggcggcagcgcaaaagatg

SEQ ID NO: 56784 - DNA, 103 bp, Artificial Sequence
  Synthetic Polynucleotide
taatacgactcactatagggtactccatctatagatatcttatgttccaaaacagaggagattggaaatgaagatatctaacctggcggcagcgcaaaagatg

SEQ ID NO: 56785 - DNA, 103 bp, Artificial Sequence
  Synthetic Polynucleotide
taatacgactcactatagggctacttactccatctatagatatcttatgtaacagaggagaacataaatgatctatagaaacctggcggcagcgcaaaagatg

SEQ ID NO: 56786 - DNA, 103 bp, Artificial Sequence
  Synthetic Polynucleotide
taatacgactcactatagggataaactacttactccatctatagatatctaacagaggagaagatatatgtagatggagaacctggcggcagcgcaaaagatg

SEQ ID NO: 56787 - DNA, 103 bp, Artificial Sequence
  Synthetic Polynucleotide
taatacgactcactatagggctttaataaactacttactccatctatagaaacagaggagatctataatgggagtaagtaacctggcggcagcgcaaaagatg

SEQ ID NO: 56788 - DNA, 103 bp, Artificial Sequence
  Synthetic Polynucleotide
taatacgactcactatagggagttcctttaataaactacttactccatctaacagaggagaagatggatgaagtagtttaacctggcggcagcgcaaaagatg

SEQ ID NO: 56789 - DNA, 103 bp, Artificial Sequence
  Synthetic Polynucleotide
taatacgactcactatagggtctttagttcctttaataaactacttactcaacagaggagagagtaaatggtttattaaaacctggcggcagcgcaaaagatg

SEQ ID NO: 56790 - DNA, 103 bp, Artificial Sequence
  Synthetic Polynucleotide
taatacgactcactatagggttgagtctttagttcctttaataaactactaacagaggagaagtagtatgttaaaggaaaacctggcggcagcgcaaaagatg

SEQ ID NO: 56791 - DNA, 103 bp, Artificial Sequence
  Synthetic Polynucleotide
taatacgactcactatagggggactttgagtctttagttcctttaataaaaacagaggagatttattatgggaactaaaaacctggcggcagcgcaaaagatg

SEQ ID NO: 56792 - DNA, 103 bp, Artificial Sequence
  Synthetic Polynucleotide
taatacgactcactataggggattatacataatgatatttttatatagtaaacagaggagatactatatgaaaatatcaaacctggcggcagcgcaaaagatg

SEQ ID NO: 56793 - DNA, 103 bp, Artificial Sequence
  Synthetic Polynucleotide
taatacgactcactataggggtccacatcctacaatattaaacggatactaacagaggagaagtatcatgttaatattgaacctggcggcagcgcaaaagatg

SEQ ID NO: 56794 - DNA, 103 bp, Artificial Sequence
  Synthetic Polynucleotide
taatacgactcactatagggcatccggactttgagtctttagttcctttaaacagaggagataaaggatgtaaagactcaacctggcggcagcgcaaaagatg

SEQ ID NO: 56795 - DNA, 103 bp, Artificial Sequence
  Synthetic Polynucleotide
taatacgactcactatagggtaatacatccggactttgagtctttagttcaacagaggagagaactaatgactcaaagtaacctggcggcagcgcaaaagatg

SEQ ID NO: 56796 - DNA, 103 bp, Artificial Sequence
  Synthetic Polynucleotide
taatacgactcactatagggactattaatacatccggactttgagtctttaacagaggagaaaagacatgaagtccggaaacctggcggcagcgcaaaagatg

SEQ ID NO: 56797 - DNA, 103 bp, Artificial Sequence
  Synthetic Polynucleotide
taatacgactcactatagggtaactactattaatacatccggactttgagaacagaggagactcaaaatgcggatgtataacctggcggcagcgcaaaagatg

SEQ ID NO: 56798 - DNA, 103 bp, Artificial Sequence
  Synthetic Polynucleotide
taatacgactcactatagggtctactaactactattaatacatccggactaacagaggagaagtccgatggtattaataaacctggcggcagcgcaaaagatg

SEQ ID NO: 56799 - DNA, 103 bp, Artificial Sequence
  Synthetic Polynucleotide
taatacgactcactatagggagatgtctactaactactattaatacatccaacagaggagaggatgtatgaatagtagtaacctggcggcagcgcaaaagatg

SEQ ID NO: 56800 - DNA, 103 bp, Artificial Sequence
  Synthetic Polynucleotide
taatacgactcactatagggttgtcagatgtctactaactactattaataaacagaggagatattaaatgtagttagtaaacctggcggcagcgcaaaagatg

SEQ ID NO: 56801 - DNA, 103 bp, Artificial Sequence
  Synthetic Polynucleotide
taatacgactcactatagggatcgtttgtcagatgtctactaactactataacagaggagaatagtaatgagtagacataacctggcggcagcgcaaaagatg

SEQ ID NO: 56802 - DNA, 103 bp, Artificial Sequence
  Synthetic Polynucleotide
taatacgactcactatagggaaggcatcgtttgtcagatgtctactaactaacagaggagaagttagatgacatctgacaacctggcggcagcgcaaaagatg

SEQ ID NO: 56803 - DNA, 103 bp, Artificial Sequence
  Synthetic Polynucleotide
taatacgactcactatagggtacaaaaggcatcgtttgtcagatgtctacaacagaggagagtagacatgtgacaaacgaacctggcggcagcgcaaaagatg

SEQ ID NO: 56804 - DNA, 103 bp, Artificial Sequence
  Synthetic Polynucleotide
taatacgactcactatagggtaaatgtccacatcctacaatattaaacggaacagaggagaccgtttatgattgtaggaaacctggcggcagcgcaaaagatg

SEQ ID NO: 56805 - DNA, 103 bp, Artificial Sequence
  Synthetic Polynucleotide
taatacgactcactatagggatatttacaaaaggcatcgtttgtcagatgaacagaggagacatctgatgaacgatgccaacctggcggcagcgcaaaagatg

SEQ ID NO: 56806 - DNA, 103 bp, Artificial Sequence
  Synthetic Polynucleotide
taatacgactcactatagggttgatatatttacaaaaggcatcgtttgtcaacagaggagagacaaaatgtgccttttgaacctggcggcagcgcaaaagatg

SEQ ID NO: 56807 - DNA, 103 bp, Artificial Sequence
  Synthetic Polynucleotide
taatacgactcactataggggcttattgatatatttacaaaaggcatcgtaacagaggagaacgatgatgtttgtaaataacctggcggcagcgcaaaagatg

SEQ ID NO: 56808 - DNA, 103 bp, Artificial Sequence
  Synthetic Polynucleotide
taatacgactcactatagggataatgcttattgatatatttacaaaaggcaacagaggagagcctttatgaaatatatcaacctggcggcagcgcaaaagatg

SEQ ID NO: 56809 - DNA, 103 bp, Artificial Sequence
  Synthetic Polynucleotide
taatacgactcactatagggaaatcataatgcttattgatatatttacaaaacagaggagattgtaaatgtatcaataaaacctggcggcagcgcaaaagatg

SEQ ID NO: 56810 - DNA, 103 bp, Artificial Sequence
  Synthetic Polynucleotide
taatacgactcactatagggtgaacaaatcataatgcttattgatatattaacagaggagaaatataatgataagcattaacctggcggcagcgcaaaagatg

SEQ ID NO: 56811 - DNA, 103 bp, Artificial Sequence
  Synthetic Polynucleotide
taatacgactcactatagggcaagatgaacaaatcataatgcttattgataacagaggagaatcaatatgcattatgataacctggcggcagcgcaaaagatg

SEQ ID NO: 56812 - DNA, 103 bp, Artificial Sequence
  Synthetic Polynucleotide
taatacgactcactatagggtcatccaagatgaacaaatcataatgcttaaacagaggagataagcaatgtgatttgttaacctggcggcagcgcaaaagatg

SEQ ID NO: 56813 - DNA, 103 bp, Artificial Sequence
  Synthetic Polynucleotide
taatacgactcactataggggtgattcatccaagatgaacaaatcataataacagaggagaattatgatgtgttcatctaacctggcggcagcgcaaaagatg

SEQ ID NO: 56814 - DNA, 103 bp, Artificial Sequence
  Synthetic Polynucleotide
taatacgactcactatagggcgtatgtgattcatccaagatgaacaaatcaacagaggagagatttgatgatcttggataacctggcggcagcgcaaaagatg

SEQ ID NO: 56815 - DNA, 103 bp, Artificial Sequence
  Synthetic Polynucleotide
taatacgactcactatagggattgttaaatgtccacatcctacaatattaaacagaggagataatatatgaggatgtggaacctggcggcagcgcaaaagatg

SEQ ID NO: 56816 - DNA, 103 bp, Artificial Sequence
  Synthetic Polynucleotide
taatacgactcactatagggttatacgtatgtgattcatccaagatgaacaacagaggagagttcatatgggatgaatcaacctggcggcagcgcaaaagatg

SEQ ID NO: 56817 - DNA, 103 bp, Artificial Sequence
  Synthetic Polynucleotide
taatacgactcactatagggtcagattatacgtatgtgattcatccaagaaacagaggagatcttggatgaatcacataaacctggcggcagcgcaaaagatg

SEQ ID NO: 56818 - DNA, 103 bp, Artificial Sequence
  Synthetic Polynucleotide
taatacgactcactataggggttcatcagattatacgtatgtgattcatcaacagaggagagatgaaatgcatacgtataacctggcggcagcgcaaaagatg

SEQ ID NO: 56819 - DNA, 103 bp, Artificial Sequence
  Synthetic Polynucleotide
taatacgactcactataggggtattgttcatcagattatacgtatgtgataacagaggagaatcacaatggtataatctaacctggcggcagcgcaaaagatg

SEQ ID NO: 56820 - DNA, 103 bp, Artificial Sequence
  Synthetic Polynucleotide
taatacgactcactatagggctgctgtattgttcatcagattatacgtataacagaggagaatacgtatgatctgatgaaacctggcggcagcgcaaaagatg

SEQ ID NO: 56821 - DNA, 103 bp, Artificial Sequence
  Synthetic Polynucleotide
taatacgactcactatagggtgtaactgctgtattgttcatcagattataaacagaggagatataatatgatgaacaataacctggcggcagcgcaaaagatg

SEQ ID NO: 56822 - DNA, 103 bp, Artificial Sequence
  Synthetic Polynucleotide
taatacgactcactatagggaatcttgtaactgctgtattgttcatcagaaacagaggagatctgatatgcaatacagcaacctggcggcagcgcaaaagatg

SEQ ID NO: 56823 - DNA, 103 bp, Artificial Sequence
  Synthetic Polynucleotide
taatacgactcactatagggctaaaaatcttgtaactgctgtattgttcaaacagaggagatgaacaatgcagcagttaaacctggcggcagcgcaaaagatg

SEQ ID NO: 56824 - DNA, 103 bp, Artificial Sequence
  Synthetic Polynucleotide
taatacgactcactatagggatacgctaaaaatcttgtaactgctgtattaacagaggagaaatacaatggttacaagaaacctggcggcagcgcaaaagatg

SEQ ID NO: 56825 - DNA, 103 bp, Artificial Sequence
  Synthetic Polynucleotide
taatacgactcactatagggggataatacgctaaaaatcttgtaactgctaacagaggagaagcagtatgaagatttttaacctggcggcagcgcaaaagatg

SEQ ID NO: 56826 - DNA, 103 bp, Artificial Sequence
  Synthetic Polynucleotide
taatacgactcactataggggtcagattgttaaatgtccacatcctacaaaacagaggagattgtagatggtggacattaacctggcggcagcgcaaaagatg

SEQ ID NO: 56827 - DNA, 103 bp, Artificial Sequence
  Synthetic Polynucleotide
taatacgactcactatagggtcggaggataatacgctaaaaatcttgtaaaacagaggagattacaaatgttttagcgtaacctggcggcagcgcaaaagatg

SEQ ID NO: 56828 - DNA, 103 bp, Artificial Sequence
  Synthetic Polynucleotide
taatacgactcactatagggcatcatcggaggataatacgctaaaaatctaacagaggagaagatttatggcgtattataacctggcggcagcgcaaaagatg

SEQ ID NO: 56829 - DNA, 103 bp, Artificial Sequence
  Synthetic Polynucleotide
taatacgactcactatagggtaacacatcatcggaggataatacgctaaaaacagaggagatttagcatgttatcctccaacctggcggcagcgcaaaagatg

SEQ ID NO: 56830 - DNA, 103 bp, Artificial Sequence
  Synthetic Polynucleotide
taatacgactcactatagggaaaaataacacatcatcggaggataatacgaacagaggagacgtattatgctccgatgaaacctggcggcagcgcaaaagatg

SEQ ID NO: 56831 - DNA, 103 bp, Artificial Sequence
  Synthetic Polynucleotide
taatacgactcactatagggagttaaaaaataacacatcatcggaggataaacagaggagatatcctatgatgatgtgtaacctggcggcagcgcaaaagatg

SEQ ID NO: 56832 - DNA, 103 bp, Artificial Sequence
  Synthetic Polynucleotide
taatacgactcactataggggtagcagttaaaaaataacacatcatcggaaacagaggagatccgatatggtgttatttaacctggcggcagcgcaaaagatg

SEQ ID NO: 56833 - DNA, 103 bp, Artificial Sequence
  Synthetic Polynucleotide
taatacgactcactatagggtaggtgtagcagttaaaaaataacacatcaaacagaggagatgatgtatgattttttaaaacctggcggcagcgcaaaagatg

SEQ ID NO: 56834 - DNA, 103 bp, Artificial Sequence
  Synthetic Polynucleotide
taatacgactcactatagggtggtctaggtgtagcagttaaaaaataacaaacagaggagatgttatatgttaactgctaacctggcggcagcgcaaaagatg

SEQ ID NO: 56835 - DNA, 103 bp, Artificial Sequence
  Synthetic Polynucleotide
taatacgactcactatagggttagatggtctaggtgtagcagttaaaaaaaacagaggagattttttatgtgctacaccaacctggcggcagcgcaaaagatg

SEQ ID NO: 56836 - DNA, 103 bp, Artificial Sequence
  Synthetic Polynucleotide
taatacgactcactatagggttctgttagatggtctaggtgtagcagttaaacagaggagataactgatgcacctagacaacctggcggcagcgcaaaagatg

SEQ ID NO: 56837 - DNA, 103 bp, Artificial Sequence
  Synthetic Polynucleotide
taatacgactcactatagggcacgtgtcagattgttaaatgtccacatccaacagaggagaggatgtatgcatttaacaaacctggcggcagcgcaaaagatg

SEQ ID NO: 56838 - DNA, 103 bp, Artificial Sequence
  Synthetic Polynucleotide
taatacgactcactatagggataaattctgttagatggtctaggtgtagcaacagaggagagctacaatgagaccatctaacctggcggcagcgcaaaagatg

SEQ ID NO: 56839 - DNA, 103 bp, Artificial Sequence
  Synthetic Polynucleotide
taatacgactcactatagggttacaataaattctgttagatggtctaggtaacagaggagaacctagatgatctaacagaacctggcggcagcgcaaaagatg

SEQ ID NO: 56840 - DNA, 103 bp, Artificial Sequence
  Synthetic Polynucleotide
taatacgactcactatagggtactgttacaataaattctgttagatggtcaacagaggagagaccatatgacagaatttaacctggcggcagcgcaaaagatg

SEQ ID NO: 56841 - DNA, 103 bp, Artificial Sequence
  Synthetic Polynucleotide
taatacgactcactatagggaataatactgttacaataaattctgttagaaacagaggagatctaacatgatttattgtaacctggcggcagcgcaaaagatg

SEQ ID NO: 56842 - DNA, 103 bp, Artificial Sequence
  Synthetic Polynucleotide
taatacgactcactatagggatattaataatactgttacaataaattctgaacagaggagacagaatatgttgtaacagaacctggcggcagcgcaaaagatg

SEQ ID NO: 56843 - DNA, 103 bp, Artificial Sequence
  Synthetic Polynucleotide
taatacgactcactatagggtggcaatattaataatactgttacaataaaaacagaggagatttattatgacagtattaaacctggcggcagcgcaaaagatg

SEQ ID NO: 56844 - DNA, 103 bp, Artificial Sequence
  Synthetic Polynucleotide
taatacgactcactatagggtaacttggcaatattaataatactgttacaaacagaggagatgtaacatgattattaataacctggcggcagcgcaaaagatg

SEQ ID NO: 56845 - DNA, 103 bp, Artificial Sequence
  Synthetic Polynucleotide
taatacgactcactatagggtcggataacttggcaatattaataatactgaacagaggagacagtatatgtaatattgcaacctggcggcagcgcaaaagatg

SEQ ID NO: 56846 - DNA, 103 bp, Artificial Sequence
  Synthetic Polynucleotide
taatacgactcactatagggttagatcggataacttggcaatattaataaaacagaggagattattaatgttgccaagtaacctggcggcagcgcaaaagatg

SEQ ID NO: 56847 - DNA, 103 bp, Artificial Sequence
  Synthetic Polynucleotide
taatacgactcactatagggtttttttagatcggataacttggcaatattaacagaggagaaatattatgaagttatccaacctggcggcagcgcaaaagatg

SEQ ID NO: 56848 - DNA, 103 bp, Artificial Sequence
  Synthetic Polynucleotide
taatacgactcactatagggccacccacgtgtcagattgttaaatgtccaaacagaggagatggacaatgaacaatctgaacctggcggcagcgcaaaagatg

SEQ ID NO: 56849 - DNA, 103 bp, Artificial Sequence
  Synthetic Polynucleotide
taatacgactcactatagggatagttttttttagatcggataacttggcaaacagaggagatgccaaatgatccgatctaacctggcggcagcgcaaaagatg

SEQ ID NO: 56850 - DNA, 103 bp, Artificial Sequence
  Synthetic Polynucleotide
taatacgactcactatagggcatagatagttttttttagatcggataactaacagaggagaagttatatgatctaaaaaaacctggcggcagcgcaaaagatg

SEQ ID NO: 56851 - DNA, 103 bp, Artificial Sequence
  Synthetic Polynucleotide
taatacgactcactatagggtacagcatagatagttttttttagatcggaaacagaggagatccgatatgaaaaaaactaacctggcggcagcgcaaaagatg

SEQ ID NO: 56852 - DNA, 103 bp, Artificial Sequence
  Synthetic Polynucleotide
taatacgactcactatagggctatctacagcatagatagttttttttagaaacagaggagatctaaaatgaactatctaaacctggcggcagcgcaaaagatg

SEQ ID NO: 56853 - DNA, 103 bp, Artificial Sequence
  Synthetic Polynucleotide
taatacgactcactatagggaaaaactatctacagcatagatagttttttaacagaggagaaaaaaaatgtctatgctgaacctggcggcagcgcaaaagatg

SEQ ID NO: 56854 - DNA, 103 bp, Artificial Sequence
  Synthetic Polynucleotide
taatacgactcactatagggctcaaaaaaactatctacagcatagatagtaacagaggagaactatcatggctgtagataacctggcggcagcgcaaaagatg

SEQ ID NO: 56855 - DNA, 103 bp, Artificial Sequence
  Synthetic Polynucleotide
taatacgactcactatagggtatggctcaaaaaaactatctacagcatagaacagaggagactatgcatgagatagtttaacctggcggcagcgcaaaagatg

SEQ ID NO: 56856 - DNA, 103 bp, Artificial Sequence
  Synthetic Polynucleotide
taatacgactcactatagggtggaatatggctcaaaaaaactatctacagaacagaggagactgtagatggtttttttgaacctggcggcagcgcaaaagatg

SEQ ID NO: 56857 - DNA, 103 bp, Artificial Sequence
  Synthetic Polynucleotide
taatacgactcactatagggatctgtggaatatggctcaaaaaaactatcaacagaggagagatagtatgtttgagccaaacctggcggcagcgcaaaagatg

SEQ ID NO: 56858 - DNA, 103 bp, Artificial Sequence
  Synthetic Polynucleotide
taatacgactcactatagggatattatctgtggaatatggctcaaaaaaaaacagaggagattttttatggccatattcaacctggcggcagcgcaaaagatg

SEQ ID NO: 56859 - DNA, 103 bp, Artificial Sequence
  Synthetic Polynucleotide
taatacgactcactatagggctaatccacccacgtgtcagattgttaaataacagaggagaatttaaatgtctgacacgaacctggcggcagcgcaaaagatg

SEQ ID NO: 56860 - DNA, 103 bp, Artificial Sequence
  Synthetic Polynucleotide
taatacgactcactataggggtctaatattatctgtggaatatggctcaaaacagaggagattgagcatgattccacagaacctggcggcagcgcaaaagatg

SEQ ID NO: 56861 - DNA, 103 bp, Artificial Sequence
  Synthetic Polynucleotide
taatacgactcactatagggcatatgtctaatattatctgtggaatatggaacagaggagaccatatatgacagataataacctggcggcagcgcaaaagatg

SEQ ID NO: 56862 - DNA, 103 bp, Artificial Sequence
  Synthetic Polynucleotide
taatacgactcactatagggtttatcatatgtctaatattatctgtggaaaacagaggagattccacatgtaatattagaacctggcggcagcgcaaaagatg

SEQ ID NO: 56863 - DNA, 103 bp, Artificial Sequence
  Synthetic Polynucleotide
taatacgactcactataggggtcgttttatcatatgtctaatattatctgaacagaggagacagataatgttagacataaacctggcggcagcgcaaaagatg

SEQ ID NO: 56864 - DNA, 103 bp, Artificial Sequence
  Synthetic Polynucleotide
taatacgactcactatagggatctagtcgttttatcatatgtctaatattaacagaggagaaatattatgcatatgataaacctggcggcagcgcaaaagatg

SEQ ID NO: 56865 - DNA, 103 bp, Artificial Sequence
  Synthetic Polynucleotide
taatacgactcactatagggggtccatctagtcgttttatcatatgtctaaacagaggagatagacaatggataaaacgaacctggcggcagcgcaaaagatg

SEQ ID NO: 56866 - DNA, 103 bp, Artificial Sequence
  Synthetic Polynucleotide
taatacgactcactatagggtagatggtccatctagtcgttttatcatataacagaggagaatatgaatgaacgactagaacctggcggcagcgcaaaagatg

SEQ ID NO: 56867 - DNA, 103 bp, Artificial Sequence
  Synthetic Polynucleotide
taatacgactcactatagggtttattagatggtccatctagtcgttttataacagaggagaataaaaatgctagatggaaacctggcggcagcgcaaaagatg

SEQ ID NO: 56868 - DNA, 103 bp, Artificial Sequence
  Synthetic Polynucleotide
taatacgactcactatagggtgatatttattagatggtccatctagtcgtaacagaggagaacgactatgtggaccatcaacctggcggcagcgcaaaagatg

SEQ ID NO: 56869 - DNA, 103 bp, Artificial Sequence
  Synthetic Polynucleotide
taatacgactcactatagggatatatgatatttattagatggtccatctaaacagaggagatagatgatgcatctaataaacctggcggcagcgcaaaagatg

SEQ ID NO: 56870 - DNA, 103 bp, Artificial Sequence
  Synthetic Polynucleotide
taatacgactcactatagggatggtctaatccacccacgtgtcagattgtaacagaggagaacaatcatgcacgtgggtaacctggcggcagcgcaaaagatg

SEQ ID NO: 56871 - DNA, 103 bp, Artificial Sequence
  Synthetic Polynucleotide
taatacgactcactatagggagtatatatatgatatttattagatggtccaacagaggagaggaccaatgaataaatataacctggcggcagcgcaaaagatg

SEQ ID NO: 56872 - DNA, 103 bp, Artificial Sequence
  Synthetic Polynucleotide
taatacgactcactatagggttttcagtatatatatgatatttattagataacagaggagaatctaaatgatatcatataacctggcggcagcgcaaaagatg

SEQ ID NO: 56873 - DNA, 103 bp, Artificial Sequence
  Synthetic Polynucleotide
taatacgactcactatagggataacttttcagtatatatatgatatttataacagaggagaataaatatgatatatataaacctggcggcagcgcaaaagatg

SEQ ID NO: 56874 - DNA, 103 bp, Artificial Sequence
  Synthetic Polynucleotide
taatacgactcactatagggagataataacttttcagtatatatatgataaacagaggagatatcatatgtatactgaaaacctggcggcagcgcaaaagatg

SEQ ID NO: 56875 - DNA, 103 bp, Artificial Sequence
  Synthetic Polynucleotide
taatacgactcactatagggtctacagataataacttttcagtatatataaacagaggagatatataatgtgaaaagttaacctggcggcagcgcaaaagatg

SEQ ID NO: 56876 - DNA, 103 bp, Artificial Sequence
  Synthetic Polynucleotide
taatacgactcactataggggctcgtctacagataataacttttcagtataacagaggagaatactgatgagttattataacctggcggcagcgcaaaagatg

SEQ ID NO: 56877 - DNA, 103 bp, Artificial Sequence
  Synthetic Polynucleotide
taatacgactcactatagggtctaggctcgtctacagataataacttttcaacagaggagagaaaagatgttatctgtaaacctggcggcagcgcaaaagatg

SEQ ID NO: 56878 - DNA, 103 bp, Artificial Sequence
  Synthetic Polynucleotide
taatacgactcactatagggtgatttctaggctcgtctacagataataacaacagaggagagttattatgtgtagacgaaacctggcggcagcgcaaaagatg

SEQ ID NO: 56879 - DNA, 103 bp, Artificial Sequence
  Synthetic Polynucleotide
taatacgactcactatagggtaagttgatttctaggctcgtctacagataaacagaggagatatctgatgacgagcctaaacctggcggcagcgcaaaagatg

SEQ ID NO: 56880 - DNA, 103 bp, Artificial Sequence
  Synthetic Polynucleotide
taatacgactcactatagggaagaataagttgatttctaggctcgtctacaacagaggagagtagacatgcctagaaataacctggcggcagcgcaaaagatg

SEQ ID NO: 56881 - DNA, 103 bp, Artificial Sequence
  Synthetic Polynucleotide
taatacgactcactatagggggagaatggtctaatccacccacgtgtcagaacagaggagactgacaatggggtggattaacctggcggcagcgcaaaagatg

SEQ ID NO: 56882 - DNA, 103 bp, Artificial Sequence
  Synthetic Polynucleotide
taatacgactcactataggggtattaagaataagttgatttctaggctcgaacagaggagacgagccatgaaatcaactaacctggcggcagcgcaaaagatg

SEQ ID NO: 56883 - DNA, 103 bp, Artificial Sequence
  Synthetic Polynucleotide
taatacgactcactatagggccagggtattaagaataagttgatttctagaacagaggagactagaaatgaacttattcaacctggcggcagcgcaaaagatg

SEQ ID NO: 56884 - DNA, 103 bp, Artificial Sequence
  Synthetic Polynucleotide
taatacgactcactatagggttctaccagggtattaagaataagttgattaacagaggagaaatcaaatgattcttaataacctggcggcagcgcaaaagatg

SEQ ID NO: 56885 - DNA, 103 bp, Artificial Sequence
  Synthetic Polynucleotide
taatacgactcactatagggaattcttctaccagggtattaagaataagtaacagaggagaacttatatgtaataccctaacctggcggcagcgcaaaagatg

SEQ ID NO: 56886 - DNA, 103 bp, Artificial Sequence
  Synthetic Polynucleotide
taatacgactcactatagggacttgaattcttctaccagggtattaagaaaacagaggagattcttaatgccctggtagaacctggcggcagcgcaaaagatg

SEQ ID NO: 56887 - DNA, 103 bp, Artificial Sequence
  Synthetic Polynucleotide
taatacgactcactatagggtcctgacttgaattcttctaccagggtattaacagaggagaaataccatggtagaagaaaacctggcggcagcgcaaaagatg

SEQ ID NO: 56888 - DNA, 103 bp, Artificial Sequence
  Synthetic Polynucleotide
taatacgactcactatagggatagttcctgacttgaattcttctaccaggaacagaggagacctggtatgagaattcaaaacctggcggcagcgcaaaagatg

SEQ ID NO: 56889 - DNA, 103 bp, Artificial Sequence
  Synthetic Polynucleotide
taatacgactcactataggggattaatagttcctgacttgaattcttctaaacagaggagatagaagatgtcaagtcagaacctggcggcagcgcaaaagatg

SEQ ID NO: 56890 - DNA, 103 bp, Artificial Sequence
  Synthetic Polynucleotide
taatacgactcactatagggaacgcgattaatagttcctgacttgaattcaacagaggagagaattcatgtcaggaactaacctggcggcagcgcaaaagatg

SEQ ID NO: 56891 - DNA, 103 bp, Artificial Sequence
  Synthetic Polynucleotide
taatacgactcactatagggactaaaacgcgattaatagttcctgacttgaacagaggagacaagtcatgaactattaaaacctggcggcagcgcaaaagatg

SEQ ID NO: 56892 - DNA, 103 bp, Artificial Sequence
  Synthetic Polynucleotide
taatacgactcactatagggcaggaggagaatggtctaatccacccacgtaacagaggagaacgtggatggattagaccaacctggcggcagcgcaaaagatg

SEQ ID NO: 56893 - DNA, 103 bp, Artificial Sequence
  Synthetic Polynucleotide
taatacgactcactatagggtaataactaaaacgcgattaatagttcctgaacagaggagacaggaaatgttaatcgcgaacctggcggcagcgcaaaagatg

SEQ ID NO: 56894 - DNA, 103 bp, Artificial Sequence
  Synthetic Polynucleotide
taatacgactcactatagggtttagtaataactaaaacgcgattaatagtaacagaggagaactattatgcgcgttttaaacctggcggcagcgcaaaagatg

SEQ ID NO: 56895 - DNA, 103 bp, Artificial Sequence
  Synthetic Polynucleotide
taatacgactcactatagggcgtagtttagtaataactaaaacgcgattaaacagaggagataatcgatgtttagttataacctggcggcagcgcaaaagatg

SEQ ID NO: 56896 - DNA, 103 bp, Artificial Sequence
  Synthetic Polynucleotide
taatacgactcactataggggttcacgtagtttagtaataactaaaacgcaacagaggagagcgtttatgttattactaaacctggcggcagcgcaaaagatg

SEQ ID NO: 56897 - DNA, 103 bp, Artificial Sequence
  Synthetic Polynucleotide
taatacgactcactatagggcatatgttcacgtagtttagtaataactaaaacagaggagattagttatgactaaactaaacctggcggcagcgcaaaagatg

SEQ ID NO: 56898 - DNA, 103 bp, Artificial Sequence
  Synthetic Polynucleotide
taatacgactcactatagggaataccatatgttcacgtagtttagtaataaacagaggagatattacatgactacgtgaaacctggcggcagcgcaaaagatg

SEQ ID NO: 56899 - DNA, 103 bp, Artificial Sequence
  Synthetic Polynucleotide
taatacgactcactatagggagaataataccatatgttcacgtagtttagaacagaggagactaaacatggtgaacataaacctggcggcagcgcaaaagatg

SEQ ID NO: 56900 - DNA, 103 bp, Artificial Sequence
  Synthetic Polynucleotide
taatacgactcactatagggtttgtagaataataccatatgttcacgtagaacagaggagactacgtatgcatatggtaaacctggcggcagcgcaaaagatg

SEQ ID NO: 56901 - DNA, 103 bp, Artificial Sequence
  Synthetic Polynucleotide
taatacgactcactatagggaatcgtttgtagaataataccatatgttcaaacagaggagatgaacaatgggtattattaacctggcggcagcgcaaaagatg

SEQ ID NO: 56902 - DNA, 103 bp, Artificial Sequence
  Synthetic Polynucleotide
taatacgactcactatagggctaataatcgtttgtagaataataccatataacagaggagaatatggatgtattctacaaacctggcggcagcgcaaaagatg

SEQ ID NO: 56903 - DNA, 103 bp, Artificial Sequence
  Synthetic Polynucleotide
taatacgactcactataggggtaatgattatacataatgatatttttataaacagaggagatataaaatgatcattatgaacctggcggcagcgcaaaagatg

SEQ ID NO: 56904 - DNA, 103 bp, Artificial Sequence
  Synthetic Polynucleotide
taatacgactcactataggggtgttcaggaggagaatggtctaatccaccaacagaggagaggtggaatggaccattctaacctggcggcagcgcaaaagatg

SEQ ID NO: 56905 - DNA, 103 bp, Artificial Sequence
  Synthetic Polynucleotide
taatacgactcactatagggaagatctaataatcgtttgtagaataatacaacagaggagagtattaatgtacaaacgaaacctggcggcagcgcaaaagatg

SEQ ID NO: 56906 - DNA, 103 bp, Artificial Sequence
  Synthetic Polynucleotide
taatacgactcactatagggccgaaaagatctaataatcgtttgtagaataacagaggagaattctaatgacgattattaacctggcggcagcgcaaaagatg

SEQ ID NO: 56907 - DNA, 103 bp, Artificial Sequence
  Synthetic Polynucleotide
taatacgactcactatagggctggtccgaaaagatctaataatcgtttgtaacagaggagaacaaacatgtattagatcaacctggcggcagcgcaaaagatg

SEQ ID NO: 56908 - DNA, 103 bp, Artificial Sequence
  Synthetic Polynucleotide
taatacgactcactatagggaacctctggtccgaaaagatctaataatcgaacagaggagacgattaatggatcttttcaacctggcggcagcgcaaaagatg

SEQ ID NO: 56909 - DNA, 103 bp, Artificial Sequence
  Synthetic Polynucleotide
taatacgactcactatagggaatacaacctctggtccgaaaagatctaataacagaggagaattagaatgtttcggaccaacctggcggcagcgcaaaagatg

SEQ ID NO: 56910 - DNA, 103 bp, Artificial Sequence
  Synthetic Polynucleotide
taatacgactcactatagggctataaatacaacctctggtccgaaaagataacagaggagaatctttatggaccagaggaacctggcggcagcgcaaaagatg

SEQ ID NO: 56911 - DNA, 103 bp, Artificial Sequence
  Synthetic Polynucleotide
taatacgactcactataggggtctcctataaatacaacctctggtccgaaaacagaggagattcggaatggaggttgtaaacctggcggcagcgcaaaagatg

SEQ ID NO: 56912 - DNA, 103 bp, Artificial Sequence
  Synthetic Polynucleotide
taatacgactcactatagggtgagcgtctcctataaatacaacctctggtaacagaggagaaccagaatgtgtatttataacctggcggcagcgcaaaagatg

SEQ ID NO: 56913 - DNA, 103 bp, Artificial Sequence
  Synthetic Polynucleotide
taatacgactcactatagggtattttgagcgtctcctataaatacaacctaacagaggagaaggttgatgttataggagaacctggcggcagcgcaaaagatg

SEQ ID NO: 56914 - DNA, 103 bp, Artificial Sequence
  Synthetic Polynucleotide
taatacgactcactatagggacgtctattttgagcgtctcctataaatacaacagaggagagtatttatgggagacgctaacctggcggcagcgcaaaagatg

SEQ ID NO: 56915 - DNA, 103 bp, Artificial Sequence
  Synthetic Polynucleotide
taatacgactcactataggggtcctgtgttcaggaggagaatggtctaataacagaggagaattagaatgttctcctccaacctggcggcagcgcaaaagatg

SEQ ID NO: 56916 - DNA, 103 bp, Artificial Sequence
  Synthetic Polynucleotide
taatacgactcactatagggggagtacgtctattttgagcgtctcctataaacagaggagatataggatgcgctcaaaaaacctggcggcagcgcaaaagatg

SEQ ID NO: 56917 - DNA, 103 bp, Artificial Sequence
  Synthetic Polynucleotide
taatacgactcactatagggtatctggagtacgtctattttgagcgtctcaacagaggagagagacgatgaaaatagacaacctggcggcagcgcaaaagatg

SEQ ID NO: 56918 - DNA, 103 bp, Artificial Sequence
  Synthetic Polynucleotide
taatacgactcactatagggaaccatatctggagtacgtctattttgagcaacagaggagagctcaaatgagacgtactaacctggcggcagcgcaaaagatg

SEQ ID NO: 56919 - DNA, 103 bp, Artificial Sequence
  Synthetic Polynucleotide
taatacgactcactataggggatttaaccatatctggagtacgtctatttaacagaggagaaaatagatgtactccagaaacctggcggcagcgcaaaagatg

SEQ ID NO: 56920 - DNA, 103 bp, Artificial Sequence
  Synthetic Polynucleotide
taatacgactcactatagggtgattgatttaaccatatctggagtacgtcaacagaggagagacgtaatgcagatatggaacctggcggcagcgcaaaagatg

SEQ ID NO: 56921 - DNA, 103 bp, Artificial Sequence
  Synthetic Polynucleotide
taatacgactcactatagggttccttgattgatttaaccatatctggagtaacagaggagaactccaatgatggttaaaaacctggcggcagcgcaaaagatg

SEQ ID NO: 56922 - DNA, 103 bp, Artificial Sequence
  Synthetic Polynucleotide
taatacgactcactatagggtttagttccttgattgatttaaccatatctaacagaggagaagatatatgtaaatcaataacctggcggcagcgcaaaagatg

SEQ ID NO: 56923 - DNA, 103 bp, Artificial Sequence
  Synthetic Polynucleotide
taatacgactcactatagggatctatttagttccttgattgatttaaccaaacagaggagatggttaatgcaatcaaggaacctggcggcagcgcaaaagatg

SEQ ID NO: 56924 - DNA, 103 bp, Artificial Sequence
  Synthetic Polynucleotide
taatacgactcactatagggtataaatctatttagttccttgattgatttaacagaggagaaaatcaatgaaggaactaaacctggcggcagcgcaaaagatg

SEQ ID NO: 56925 - DNA, 103 bp, Artificial Sequence
  Synthetic Polynucleotide
taatacgactcactatagggacgaatataaatctatttagttccttgattaacagaggagaaatcaaatgactaaatagaacctggcggcagcgcaaaagatg

SEQ ID NO: 56926 - DNA, 103 bp, Artificial Sequence
  Synthetic Polynucleotide
taatacgactcactatagggctggtgtcctgtgttcaggaggagaatggtaacagaggagaaccattatgctcctgaacaacctggcggcagcgcaaaagatg

SEQ ID NO: 56927 - DNA, 103 bp, Artificial Sequence
  Synthetic Polynucleotide
taatacgactcactatagggtggatacgaatataaatctatttagttcctaacagaggagaaggaacatgatagatttaaacctggcggcagcgcaaaagatg

SEQ ID NO: 56928 - DNA, 103 bp, Artificial Sequence
  Synthetic Polynucleotide
taatacgactcactatagggtaaggtggatacgaatataaatctatttagaacagaggagactaaatatgtttatattcaacctggcggcagcgcaaaagatg

SEQ ID NO: 56929 - DNA, 103 bp, Artificial Sequence
  Synthetic Polynucleotide
taatacgactcactatagggtaaaataaggtggatacgaatataaatctaaacagaggagatagattatgattcgtatcaacctggcggcagcgcaaaagatg

SEQ ID NO: 56930 - DNA, 103 bp, Artificial Sequence
  Synthetic Polynucleotide
taatacgactcactatagggcggaataaaataaggtggatacgaatataaaacagaggagattatatatgtatccacctaacctggcggcagcgcaaaagatg

SEQ ID NO: 56931 - DNA, 103 bp, Artificial Sequence
  Synthetic Polynucleotide
taatacgactcactatagggagtaccggaataaaataaggtggatacgaaaacagaggagattcgtaatgaccttatttaacctggcggcagcgcaaaagatg

SEQ ID NO: 56932 - DNA, 103 bp, Artificial Sequence
  Synthetic Polynucleotide
taatacgactcactatagggaaaccagtaccggaataaaataaggtggataacagaggagaatccacatgattttattcaacctggcggcagcgcaaaagatg

SEQ ID NO: 56933 - DNA, 103 bp, Artificial Sequence
  Synthetic Polynucleotide
taatacgactcactatagggtatctaaaccagtaccggaataaaataaggaacagaggagaccttatatgattccggtaaacctggcggcagcgcaaaagatg

SEQ ID NO: 56934 - DNA, 103 bp, Artificial Sequence
  Synthetic Polynucleotide
taatacgactcactatagggaggaatatctaaaccagtaccggaataaaaaacagaggagattttatatgggtactggtaacctggcggcagcgcaaaagatg

SEQ ID NO: 56935 - DNA, 103 bp, Artificial Sequence
  Synthetic Polynucleotide
taatacgactcactatagggaaactaggaatatctaaaccagtaccggaaaacagaggagattccggatgtggtttagaaacctggcggcagcgcaaaagatg

SEQ ID NO: 56936 - DNA, 103 bp, Artificial Sequence
  Synthetic Polynucleotide
taatacgactcactatagggaatccaaactaggaatatctaaaccagtacaacagaggagagtactgatgtagatattcaacctggcggcagcgcaaaagatg

SEQ ID NO: 56937 - DNA, 103 bp, Artificial Sequence
  Synthetic Polynucleotide
taatacgactcactatagggtaactctggtgtcctgtgttcaggaggagaaacagaggagatctcctatggaacacaggaacctggcggcagcgcaaaagatg

SEQ ID NO: 56938 - DNA, 103 bp, Artificial Sequence
  Synthetic Polynucleotide
taatacgactcactatagggcaacgaatccaaactaggaatatctaaaccaacagaggagaggtttaatgattcctagtaacctggcggcagcgcaaaagatg

SEQ ID NO: 56939 - DNA, 103 bp, Artificial Sequence
  Synthetic Polynucleotide
taatacgactcactatagggatgaacaacgaatccaaactaggaatatctaacagaggagaagatatatgtagtttggaaacctggcggcagcgcaaaagatg

SEQ ID NO: 56940 - DNA, 103 bp, Artificial Sequence
  Synthetic Polynucleotide
taatacgactcactatagggagcaaatgaacaacgaatccaaactaggaaaacagaggagattcctaatgtggattcgtaacctggcggcagcgcaaaagatg

SEQ ID NO: 56941 - DNA, 103 bp, Artificial Sequence
  Synthetic Polynucleotide
taatacgactcactatagggtgccgagcaaatgaacaacgaatccaaactaacagaggagaagtttgatgtcgttgttcaacctggcggcagcgcaaaagatg

SEQ ID NO: 56942 - DNA, 103 bp, Artificial Sequence
  Synthetic Polynucleotide
taatacgactcactatagggattactgccgagcaaatgaacaacgaatccaacagaggagaggattcatggttcatttgaacctggcggcagcgcaaaagatg

SEQ ID NO: 56943 - DNA, 103 bp, Artificial Sequence
  Synthetic Polynucleotide
taatacgactcactatagggtgttgattactgccgagcaaatgaacaacgaacagaggagacgttgtatgtttgctcggaacctggcggcagcgcaaaagatg

SEQ ID NO: 56944 - DNA, 103 bp, Artificial Sequence
  Synthetic Polynucleotide
taatacgactcactatagggcatattgttgattactgccgagcaaatgaaaacagaggagattcattatgtcggcagtaaacctggcggcagcgcaaaagatg

SEQ ID NO: 56945 - DNA, 103 bp, Artificial Sequence
  Synthetic Polynucleotide
taatacgactcactatagggatttgcatattgttgattactgccgagcaaaacagaggagattgctcatgagtaatcaaaacctggcggcagcgcaaaagatg

SEQ ID NO: 56946 - DNA, 103 bp, Artificial Sequence
  Synthetic Polynucleotide
taatacgactcactataggggctctatttgcatattgttgattactgccgaacagaggagacggcagatgtcaacaataaacctggcggcagcgcaaaagatg

SEQ ID NO: 56947 - DNA, 103 bp, Artificial Sequence
  Synthetic Polynucleotide
taatacgactcactatagggtaattgctctatttgcatattgttgattacaacagaggagagtaatcatgaatatgcaaaacctggcggcagcgcaaaagatg

SEQ ID NO: 56948 - DNA, 103 bp, Artificial Sequence
  Synthetic Polynucleotide
taatacgactcactatagggattggtaactctggtgtcctgtgttcaggaaacagaggagatcctgaatgcaggacaccaacctggcggcagcgcaaaagatg

SEQ ID NO: 56949 - DNA, 103 bp, Artificial Sequence
  Synthetic Polynucleotide
taatacgactcactatagggcctagtaattgctctatttgcatattgttgaacagaggagacaacaaatggcaaatagaaacctggcggcagcgcaaaagatg

SEQ ID NO: 56950 - DNA, 103 bp, Artificial Sequence
  Synthetic Polynucleotide
taatacgactcactatagggccctccctagtaattgctctatttgcatataacagaggagaatatgcatgtagagcaataacctggcggcagcgcaaaagatg

SEQ ID NO: 56951 - DNA, 103 bp, Artificial Sequence
  Synthetic Polynucleotide
taatacgactcactatagggacataccctccctagtaattgctctatttgaacagaggagacaaataatgcaattactaaacctggcggcagcgcaaaagatg

SEQ ID NO: 56952 - DNA, 103 bp, Artificial Sequence
  Synthetic Polynucleotide
taatacgactcactatagggtctcgacataccctccctagtaattgctctaacagaggagaagagcaatgactagggagaacctggcggcagcgcaaaagatg

SEQ ID NO: 56953 - DNA, 103 bp, Artificial Sequence
  Synthetic Polynucleotide
taatacgactcactatagggctgtttctcgacataccctccctagtaattaacagaggagaaattacatgggagggtataacctggcggcagcgcaaaagatg

SEQ ID NO: 56954 - DNA, 103 bp, Artificial Sequence
  Synthetic Polynucleotide
taatacgactcactatagggtagttctgtttctcgacataccctccctagaacagaggagactagggatggtatgtcgaaacctggcggcagcgcaaaagatg

SEQ ID NO: 56955 - DNA, 103 bp, Artificial Sequence
  Synthetic Polynucleotide
taatacgactcactatagggtctaatagttctgtttctcgacataccctcaacagaggagagagggtatgtcgagaaacaacctggcggcagcgcaaaagatg

SEQ ID NO: 56956 - DNA, 103 bp, Artificial Sequence
  Synthetic Polynucleotide
taatacgactcactatagggtcctatctaatagttctgtttctcgacataaacagaggagatatgtcatgaaacagaacaacctggcggcagcgcaaaagatg

SEQ ID NO: 56957 - DNA, 103 bp, Artificial Sequence
  Synthetic Polynucleotide
taatacgactcactatagggtaccgtcctatctaatagttctgtttctcgaacagaggagacgagaaatggaactattaaacctggcggcagcgcaaaagatg

SEQ ID NO: 56958 - DNA, 103 bp, Artificial Sequence
  Synthetic Polynucleotide
taatacgactcactatagggacatataccgtcctatctaatagttctgttaacagaggagaaacagaatgattagatagaacctggcggcagcgcaaaagatg

SEQ ID NO: 56959 - DNA, 103 bp, Artificial Sequence
  Synthetic Polynucleotide
taatacgactcactatagggcgttgattggtaactctggtgtcctgtgttaacagaggagaaacacaatgcaccagagtaacctggcggcagcgcaaaagatg

SEQ ID NO: 56960 - DNA, 103 bp, Artificial Sequence
  Synthetic Polynucleotide
taatacgactcactataggggaaatacatataccgtcctatctaatagttaacagaggagaaactatatgataggacggaacctggcggcagcgcaaaagatg

SEQ ID NO: 56961 - DNA, 103 bp, Artificial Sequence
  Synthetic Polynucleotide
taatacgactcactataggggttaggaaatacatataccgtcctatctaaaacagaggagattagatatgacggtatataacctggcggcagcgcaaaagatg

SEQ ID NO: 56962 - DNA, 103 bp, Artificial Sequence
  Synthetic Polynucleotide
taatacgactcactataggggatgtgttaggaaatacatataccgtcctaaacagaggagataggacatgatatgtattaacctggcggcagcgcaaaagatg

SEQ ID NO: 56963 - DNA, 103 bp, Artificial Sequence
  Synthetic Polynucleotide
taatacgactcactatagggtgacggatgtgttaggaaatacatataccgaacagaggagacggtatatgtatttcctaaacctggcggcagcgcaaaagatg

SEQ ID NO: 56964 - DNA, 103 bp, Artificial Sequence
  Synthetic Polynucleotide
taatacgactcactatagggttctttgacggatgtgttaggaaatacataaacagaggagatatgtaatgcctaacacaaacctggcggcagcgcaaaagatg

SEQ ID NO: 56965 - DNA, 103 bp, Artificial Sequence
  Synthetic Polynucleotide
taatacgactcactatagggtttatttctttgacggatgtgttaggaaataacagaggagaatttccatgcacatccgtaacctggcggcagcgcaaaagatg

SEQ ID NO: 56966 - DNA, 103 bp, Artificial Sequence
  Synthetic Polynucleotide
taatacgactcactatagggtgtactttatttctttgacggatgtgttagaacagaggagactaacaatgccgtcaaagaacctggcggcagcgcaaaagatg

SEQ ID NO: 56967 - DNA, 103 bp, Artificial Sequence
  Synthetic Polynucleotide
taatacgactcactatagggtatcatgtactttatttctttgacggatgtaacagaggagaacatccatgaaagaaataaacctggcggcagcgcaaaagatg

SEQ ID NO: 56968 - DNA, 103 bp, Artificial Sequence
  Synthetic Polynucleotide
taatacgactcactatagggtttcctatcatgtactttatttctttgacgaacagaggagacgtcaaatgaataaagtaaacctggcggcagcgcaaaagatg

SEQ ID NO: 56969 - DNA, 103 bp, Artificial Sequence
  Synthetic Polynucleotide
taatacgactcactatagggcaaaatttcctatcatgtactttatttcttaacagaggagaaagaaaatgagtacatgaaacctggcggcagcgcaaaagatg

SEQ ID NO: 56970 - DNA, 103 bp, Artificial Sequence
  Synthetic Polynucleotide
taatacgactcactatagggatattcgttgattggtaactctggtgtcctaacagaggagaaggacaatggagttaccaaacctggcggcagcgcaaaagatg

SEQ ID NO: 56971 - DNA, 103 bp, Artificial Sequence
  Synthetic Polynucleotide
taatacgactcactatagggttgcacaaaatttcctatcatgtactttataacagaggagaataaagatgatgataggaaacctggcggcagcgcaaaagatg

SEQ ID NO: 56972 - DNA, 103 bp, Artificial Sequence
  Synthetic Polynucleotide
taatacgactcactatagggattcgttgcacaaaatttcctatcatgtacaacagaggagagtacatatgaggaaatttaacctggcggcagcgcaaaagatg

SEQ ID NO: 56973 - DNA, 103 bp, Artificial Sequence
  Synthetic Polynucleotide
taatacgactcactatagggtaataattcgttgcacaaaatttcctatcaaacagaggagatgatagatgattttgtgcaacctggcggcagcgcaaaagatg

SEQ ID NO: 56974 - DNA, 103 bp, Artificial Sequence
  Synthetic Polynucleotide
taatacgactcactatagggcagactaataattcgttgcacaaaatttccaacagaggagaggaaatatggtgcaacgaaacctggcggcagcgcaaaagatg

SEQ ID NO: 56975 - DNA, 103 bp, Artificial Sequence
  Synthetic Polynucleotide
taatacgactcactatagggacagacagactaataattcgttgcacaaaaaacagaggagattttgtatgacgaattataacctggcggcagcgcaaaagatg

SEQ ID NO: 56976 - DNA, 103 bp, Artificial Sequence
  Synthetic Polynucleotide
taatacgactcactatagggtatctacagacagactaataattcgttgcaaacagaggagatgcaacatgttattagtcaacctggcggcagcgcaaaagatg

SEQ ID NO: 56977 - DNA, 103 bp, Artificial Sequence
  Synthetic Polynucleotide
taatacgactcactatagggtagtttatctacagacagactaataattcgaacagaggagacgaattatgagtctgtctaacctggcggcagcgcaaaagatg

SEQ ID NO: 56978 - DNA, 103 bp, Artificial Sequence
  Synthetic Polynucleotide
taatacgactcactatagggaatcctagtttatctacagacagactaataaacagaggagatattagatggtctgtagaaacctggcggcagcgcaaaagatg

SEQ ID NO: 56979 - DNA, 103 bp, Artificial Sequence
  Synthetic Polynucleotide
taatacgactcactataggggtttaaatcctagtttatctacagacagacaacagaggagagtctgtatgtagataaacaacctggcggcagcgcaaaagatg

SEQ ID NO: 56980 - DNA, 103 bp, Artificial Sequence
  Synthetic Polynucleotide
taatacgactcactatagggttcttgtttaaatcctagtttatctacagaaacagaggagatctgtaatgaaactaggaaacctggcggcagcgcaaaagatg

SEQ ID NO: 56981 - DNA, 103 bp, Artificial Sequence
  Synthetic Polynucleotide
taatacgactcactatagggagtggatattcgttgattggtaactctggtaacagaggagaaccagaatgaccaatcaaaacctggcggcagcgcaaaagatg

SEQ ID NO: 56982 - DNA, 103 bp, Artificial Sequence
  Synthetic Polynucleotide
taatacgactcactatagggtaactttcttgtttaaatcctagtttatctaacagaggagaagataaatgaggatttaaaacctggcggcagcgcaaaagatg

SEQ ID NO: 56983 - DNA, 103 bp, Artificial Sequence
  Synthetic Polynucleotide
taatacgactcactatagggtccgataactttcttgtttaaatcctagttaacagaggagaaactagatgttaaacaagaacctggcggcagcgcaaaagatg

SEQ ID NO: 56984 - DNA, 103 bp, Artificial Sequence
  Synthetic Polynucleotide
taatacgactcactatagggatgtttccgataactttcttgtttaaatccaacagaggagaggatttatgcaagaaagtaacctggcggcagcgcaaaagatg

SEQ ID NO: 56985 - DNA, 103 bp, Artificial Sequence
  Synthetic Polynucleotide
taatacgactcactatagggtcttgatgtttccgataactttcttgtttaaacagaggagataaacaatgaagttatcgaacctggcggcagcgcaaaagatg

SEQ ID NO: 56986 - DNA, 103 bp, Artificial Sequence
  Synthetic Polynucleotide
taatacgactcactatagggcggattcttgatgtttccgataactttcttaacagaggagaaagaaaatgatcggaaacaacctggcggcagcgcaaaagatg

SEQ ID NO: 56987 - DNA, 103 bp, Artificial Sequence
  Synthetic Polynucleotide
taatacgactcactataggggggatcggattcttgatgtttccgataactaacagaggagaagttatatgaaacatcaaaacctggcggcagcgcaaaagatg

SEQ ID NO: 56988 - DNA, 103 bp, Artificial Sequence
  Synthetic Polynucleotide
taatacgactcactataggggaagtgggatcggattcttgatgtttccgaaacagaggagatcggaaatgtcaagaatcaacctggcggcagcgcaaaagatg

SEQ ID NO: 56989 - DNA, 103 bp, Artificial Sequence
  Synthetic Polynucleotide
taatacgactcactatagggatacagaagtgggatcggattcttgatgttaacagaggagaaacatcatgaatccgatcaacctggcggcagcgcaaaagatg

SEQ ID NO: 56990 - DNA, 103 bp, Artificial Sequence
  Synthetic Polynucleotide
taatacgactcactatagggtgtacatacagaagtgggatcggattcttgaacagaggagacaagaaatggatcccactaacctggcggcagcgcaaaagatg

SEQ ID NO: 56991 - DNA, 103 bp, Artificial Sequence
  Synthetic Polynucleotide
taatacgactcactataggggatgctgtacatacagaagtgggatcggataacagaggagaatccgaatgcacttctgtaacctggcggcagcgcaaaagatg

SEQ ID NO: 56992 - DNA, 103 bp, Artificial Sequence
  Synthetic Polynucleotide
taatacgactcactataggggcaatagtggatattcgttgattggtaactaacagaggagaagttacatgtcaacgaataacctggcggcagcgcaaaagatg

SEQ ID NO: 56993 - DNA, 103 bp, Artificial Sequence
  Synthetic Polynucleotide
taatacgactcactatagggtggaggatgctgtacatacagaagtgggataacagaggagaatcccaatgctgtatgtaaacctggcggcagcgcaaaagatg

SEQ ID NO: 56994 - DNA, 103 bp, Artificial Sequence
  Synthetic Polynucleotide
taatacgactcactatagggttctctggaggatgctgtacatacagaagtaacagaggagaacttctatgtgtacagcaaacctggcggcagcgcaaaagatg

SEQ ID NO: 56995 - DNA, 103 bp, Artificial Sequence
  Synthetic Polynucleotide
taatacgactcactatagggcgttcttctctggaggatgctgtacatacaaacagaggagatgtatgatgagcatcctcaacctggcggcagcgcaaaagatg

SEQ ID NO: 56996 - DNA, 103 bp, Artificial Sequence
  Synthetic Polynucleotide
taatacgactcactatagggatacacgttcttctctggaggatgctgtacaacagaggagagtacagatgcctccagagaacctggcggcagcgcaaaagatg

SEQ ID NO: 56997 - DNA, 103 bp, Artificial Sequence
  Synthetic Polynucleotide
taatacgactcactatagggatttaatacacgttcttctctggaggatgcaacagaggagagcatccatgagagaagaaaacctggcggcagcgcaaaagatg

SEQ ID NO: 56998 - DNA, 103 bp, Artificial Sequence
  Synthetic Polynucleotide
taatacgactcactatagggattctatttaatacacgttcttctctggagaacagaggagactccagatgagaacgtgtaacctggcggcagcgcaaaagatg

SEQ ID NO: 56999 - DNA, 103 bp, Artificial Sequence
  Synthetic Polynucleotide
taatacgactcactatagggtaaatattctatttaatacacgttcttctcaacagaggagagagaagatggtgtattaaaacctggcggcagcgcaaaagatg

SEQ ID NO: 57000 - DNA, 103 bp, Artificial Sequence
  Synthetic Polynucleotide
taatacgactcactatagggcgagttaaatattctatttaatacacgttcaacagaggagagaacgtatgttaaatagaaacctggcggcagcgcaaaagatg

SEQ ID NO: 57001 - DNA, 103 bp, Artificial Sequence
  Synthetic Polynucleotide
taatacgactcactatagggttttgcgagttaaatattctatttaatacaaacagaggagatgtattatgtagaatattaacctggcggcagcgcaaaagatg

SEQ ID NO: 57002 - DNA, 103 bp, Artificial Sequence
  Synthetic Polynucleotide
taatacgactcactatagggaacgattttgcgagttaaatattctatttaaacagaggagataaataatgtatttaactaacctggcggcagcgcaaaagatg

SEQ ID NO: 57003 - DNA, 103 bp, Artificial Sequence
  Synthetic Polynucleotide
taatacgactcactatagggtagttgcaatagtggatattcgttgattggaacagaggagaccaatcatggaatatccaaacctggcggcagcgcaaaagatg

SEQ ID NO: 57004 - DNA, 103 bp, Artificial Sequence
  Synthetic Polynucleotide
taatacgactcactatagggttcttaacgattttgcgagttaaatattctaacagaggagaagaataatgaactcgcaaaacctggcggcagcgcaaaagatg

SEQ ID NO: 57005 - DNA, 103 bp, Artificial Sequence
  Synthetic Polynucleotide
taatacgactcactatagggtaaacttcttaacgattttgcgagttaaataacagaggagaatttaaatggcaaaatcgaacctggcggcagcgcaaaagatg

SEQ ID NO: 57006 - DNA, 103 bp, Artificial Sequence
  Synthetic Polynucleotide
taatacgactcactatagggtcgcttaaacttcttaacgattttgcgagtaacagaggagaactcgcatgatcgttaagaacctggcggcagcgcaaaagatg

SEQ ID NO: 57007 - DNA, 103 bp, Artificial Sequence
  Synthetic Polynucleotide
taatacgactcactataggggatcgtcgcttaaacttcttaacgattttgaacagaggagacaaaatatgtaagaagttaacctggcggcagcgcaaaagatg

SEQ ID NO: 57008 - DNA, 103 bp, Artificial Sequence
  Synthetic Polynucleotide
taatacgactcactatagggatgtggatcgtcgcttaaacttcttaacgaaacagaggagatcgttaatgagtttaagcaacctggcggcagcgcaaaagatg

SEQ ID NO: 57009 - DNA, 103 bp, Artificial Sequence
  Synthetic Polynucleotide
taatacgactcactatagggacagcatgtggatcgtcgcttaaacttcttaacagaggagaaagaagatgaagcgacgaaacctggcggcagcgcaaaagatg

SEQ ID NO: 57010 - DNA, 103 bp, Artificial Sequence
  Synthetic Polynucleotide
taatacgactcactatagggcctgtacagcatgtggatcgtcgcttaaacaacagaggagagtttaaatgacgatccacaacctggcggcagcgcaaaagatg

SEQ ID NO: 57011 - DNA, 103 bp, Artificial Sequence
  Synthetic Polynucleotide
taatacgactcactatagggactggcctgtacagcatgtggatcgtcgctaacagaggagaagcgacatgccacatgctaacctggcggcagcgcaaaagatg

SEQ ID NO: 57012 - DNA, 103 bp, Artificial Sequence
  Synthetic Polynucleotide
taatacgactcactatagggaatacactggcctgtacagcatgtggatcgaacagaggagacgatccatgtgctgtacaaacctggcggcagcgcaaaagatg

SEQ ID NO: 57013 - DNA, 103 bp, Artificial Sequence
  Synthetic Polynucleotide
taatacgactcactatagggggggtaatacactggcctgtacagcatgtgaacagaggagacacatgatgtacaggccaaacctggcggcagcgcaaaagatg

SEQ ID NO: 57014 - DNA, 103 bp, Artificial Sequence
  Synthetic Polynucleotide
taatacgactcactatagggcgacagtaatgattatacataatgatatttaacagaggagaaaatatatgtatgtataaaacctggcggcagcgcaaaagatg

SEQ ID NO: 57015 - DNA, 103 bp, Artificial Sequence
  Synthetic Polynucleotide
taatacgactcactatagggacttatagttgcaatagtggatattcgttgaacagaggagacaacgaatgtccactattaacctggcggcagcgcaaaagatg

SEQ ID NO: 57016 - DNA, 103 bp, Artificial Sequence
  Synthetic Polynucleotide
taatacgactcactatagggtatgaggggtaatacactggcctgtacagcaacagaggagagctgtaatggccagtgtaaacctggcggcagcgcaaaagatg

SEQ ID NO: 57017 - DNA, 103 bp, Artificial Sequence
  Synthetic Polynucleotide
taatacgactcactatagggaatactatgaggggtaatacactggcctgtaacagaggagaacaggcatgtgtattaccaacctggcggcagcgcaaaagatg

SEQ ID NO: 57018 - DNA, 103 bp, Artificial Sequence
  Synthetic Polynucleotide
taatacgactcactatagggatattaatactatgaggggtaatacactggaacagaggagaccagtgatgtacccctcaaacctggcggcagcgcaaaagatg

SEQ ID NO: 57019 - DNA, 103 bp, Artificial Sequence
  Synthetic Polynucleotide
taatacgactcactatagggggattatattaatactatgaggggtaatacaacagaggagagtattaatgctcatagtaaacctggcggcagcgcaaaagatg

SEQ ID NO: 57020 - DNA, 103 bp, Artificial Sequence
  Synthetic Polynucleotide
taatacgactcactatagggtcattggattatattaatactatgaggggtaacagaggagaacccctatgagtattaataacctggcggcagcgcaaaagatg

SEQ ID NO: 57021 - DNA, 103 bp, Artificial Sequence
  Synthetic Polynucleotide
taatacgactcactatagggaagtatcattggattatattaatactatgaaacagaggagatcatagatgtaatataataacctggcggcagcgcaaaagatg

SEQ ID NO: 57022 - DNA, 103 bp, Artificial Sequence
  Synthetic Polynucleotide
taatacgactcactatagggcacaaaagtatcattggattatattaatacaacagaggagagtattaatgtaatccaataacctggcggcagcgcaaaagatg

SEQ ID NO: 57023 - DNA, 103 bp, Artificial Sequence
  Synthetic Polynucleotide
taatacgactcactataggggacatcacaaaagtatcattggattatattaacagaggagaaatataatgcaatgatacaacctggcggcagcgcaaaagatg

SEQ ID NO: 57024 - DNA, 103 bp, Artificial Sequence
  Synthetic Polynucleotide
taatacgactcactatagggtttccgacatcacaaaagtatcattggattaacagaggagaaatccaatgatacttttgaacctggcggcagcgcaaaagatg

SEQ ID NO: 57025 - DNA, 103 bp, Artificial Sequence
  Synthetic Polynucleotide
taatacgactcactatagggtaagatttccgacatcacaaaagtatcattaacagaggagaaatgatatgtttgtgatgaacctggcggcagcgcaaaagatg

SEQ ID NO: 57026 - DNA, 103 bp, Artificial Sequence
  Synthetic Polynucleotide
taatacgactcactatagggttgtaacttatagttgcaatagtggatattaacagaggagaaatatcatgtattgcaacaacctggcggcagcgcaaaagatg

SEQ ID NO: 57027 - DNA, 103 bp, Artificial Sequence
  Synthetic Polynucleotide
taatacgactcactatagggttggttaagatttccgacatcacaaaagtaaacagaggagatactttatggatgtcggaaacctggcggcagcgcaaaagatg

SEQ ID NO: 57028 - DNA, 103 bp, Artificial Sequence
  Synthetic Polynucleotide
taatacgactcactatagggctaaattggttaagatttccgacatcacaaaacagaggagattgtgaatgcggaaatctaacctggcggcagcgcaaaagatg

SEQ ID NO: 57029 - DNA, 103 bp, Artificial Sequence
  Synthetic Polynucleotide
taatacgactcactatagggtcagtctaaattggttaagatttccgacataacagaggagaatgtcgatgatcttaaccaacctggcggcagcgcaaaagatg

SEQ ID NO: 57030 - DNA, 103 bp, Artificial Sequence
  Synthetic Polynucleotide
taatacgactcactataggggtctgtcagtctaaattggttaagatttccaacagaggagaggaaatatgaaccaatttaacctggcggcagcgcaaaagatg

SEQ ID NO: 57031 - DNA, 103 bp, Artificial Sequence
  Synthetic Polynucleotide
taatacgactcactataggggttctgtctgtcagtctaaattggttaagaaacagaggagatcttaaatgatttagactaacctggcggcagcgcaaaagatg

SEQ ID NO: 57032 - DNA, 103 bp, Artificial Sequence
  Synthetic Polynucleotide
taatacgactcactataggggacgtgttctgtctgtcagtctaaattggtaacagaggagaaccaatatggactgacagaacctggcggcagcgcaaaagatg

SEQ ID NO: 57033 - DNA, 103 bp, Artificial Sequence
  Synthetic Polynucleotide
taatacgactcactatagggtgcatgacgtgttctgtctgtcagtctaaaaacagaggagatttagaatgacagacagaaacctggcggcagcgcaaaagatg

SEQ ID NO: 57034 - DNA, 103 bp, Artificial Sequence
  Synthetic Polynucleotide
taatacgactcactatagggatgattgcatgacgtgttctgtctgtcagtaacagaggagaactgacatgcagaacacgaacctggcggcagcgcaaaagatg

SEQ ID NO: 57035 - DNA, 103 bp, Artificial Sequence
  Synthetic Polynucleotide
taatacgactcactatagggtgaggatgattgcatgacgtgttctgtctgaacagaggagacagacaatgcacgtcatgaacctggcggcagcgcaaaagatg

SEQ ID NO: 57036 - DNA, 103 bp, Artificial Sequence
  Synthetic Polynucleotide
taatacgactcactatagggatcgatgaggatgattgcatgacgtgttctaacagaggagaagaacaatgcatgcaatcaacctggcggcagcgcaaaagatg

SEQ ID NO: 57037 - DNA, 103 bp, Artificial Sequence
  Synthetic Polynucleotide
taatacgactcactatagggaagcgttgtaacttatagttgcaatagtggaacagaggagaccactaatgcaactataaaacctggcggcagcgcaaaagatg

SEQ ID NO: 57038 - DNA, 103 bp, Artificial Sequence
  Synthetic Polynucleotide
taatacgactcactatagggcagttatcgatgaggatgattgcatgacgtaacagaggagaacgtcaatgaatcatcctaacctggcggcagcgcaaaagatg

SEQ ID NO: 57039 - DNA, 103 bp, Artificial Sequence
  Synthetic Polynucleotide
taatacgactcactataggggactacagttatcgatgaggatgattgcataacagaggagaatgcaaatgtcctcatcgaacctggcggcagcgcaaaagatg

SEQ ID NO: 57040 - DNA, 103 bp, Artificial Sequence
  Synthetic Polynucleotide
taatacgactcactatagggcctaagactacagttatcgatgaggatgataacagaggagaatcatcatgatcgataacaacctggcggcagcgcaaaagatg

SEQ ID NO: 57041 - DNA, 103 bp, Artificial Sequence
  Synthetic Polynucleotide
taatacgactcactatagggagaagcctaagactacagttatcgatgaggaacagaggagacctcatatgtaactgtagaacctggcggcagcgcaaaagatg

SEQ ID NO: 57042 - DNA, 103 bp, Artificial Sequence
  Synthetic Polynucleotide
taatacgactcactatagggcaaaaagaagcctaagactacagttatcgaaacagaggagatcgataatggtagtcttaaacctggcggcagcgcaaaagatg

SEQ ID NO: 57043 - DNA, 103 bp, Artificial Sequence
  Synthetic Polynucleotide
taatacgactcactatagggagtcgcaaaaagaagcctaagactacagttaacagaggagaaactgtatgcttaggcttaacctggcggcagcgcaaaagatg

SEQ ID NO: 57044 - DNA, 103 bp, Artificial Sequence
  Synthetic Polynucleotide
taatacgactcactatagggtgaagagtcgcaaaaagaagcctaagactaaacagaggagatagtctatggcttcttttaacctggcggcagcgcaaaagatg

SEQ ID NO: 57045 - DNA, 103 bp, Artificial Sequence
  Synthetic Polynucleotide
taatacgactcactatagggcggaatgaagagtcgcaaaaagaagcctaaaacagaggagattaggcatgtttttgcgaaacctggcggcagcgcaaaagatg

SEQ ID NO: 57046 - DNA, 103 bp, Artificial Sequence
  Synthetic Polynucleotide
taatacgactcactatagggcgttccggaatgaagagtcgcaaaaagaagaacagaggagacttcttatggcgactcttaacctggcggcagcgcaaaagatg

SEQ ID NO: 57047 - DNA, 103 bp, Artificial Sequence
  Synthetic Polynucleotide
taatacgactcactatagggatgcgcgttccggaatgaagagtcgcaaaaaacagaggagattttgcatgtcttcattcaacctggcggcagcgcaaaagatg

SEQ ID NO: 57048 - DNA, 103 bp, Artificial Sequence
  Synthetic Polynucleotide
taatacgactcactataggggatggaagcgttgtaacttatagttgcaataacagaggagaattgcaatgataagttacaacctggcggcagcgcaaaagatg

SEQ ID NO: 57049 - DNA, 103 bp, Artificial Sequence
  Synthetic Polynucleotide
taatacgactcactatagggcaccaatgcgcgttccggaatgaagagtcgaacagaggagacgactcatgattccggaaaacctggcggcagcgcaaaagatg

SEQ ID NO: 57050 - DNA, 103 bp, Artificial Sequence
  Synthetic Polynucleotide
taatacgactcactataggggatagcaccaatgcgcgttccggaatgaagaacagaggagacttcatatgggaacgcgcaacctggcggcagcgcaaaagatg

SEQ ID NO: 57051 - DNA, 103 bp, Artificial Sequence
  Synthetic Polynucleotide
taatacgactcactatagggaaatggatagcaccaatgcgcgttccggaaaacagaggagattccggatggcgcattggaacctggcggcagcgcaaaagatg

SEQ ID NO: 57052 - DNA, 103 bp, Artificial Sequence
  Synthetic Polynucleotide
taatacgactcactatagggtacctaaatggatagcaccaatgcgcgttcaacagaggagagaacgcatgttggtgctaaacctggcggcagcgcaaaagatg

SEQ ID NO: 57053 - DNA, 103 bp, Artificial Sequence
  Synthetic Polynucleotide
taatacgactcactatagggtttactacctaaatggatagcaccaatgcgaacagaggagacgcattatggctatccataacctggcggcagcgcaaaagatg

SEQ ID NO: 57054 - DNA, 103 bp, Artificial Sequence
  Synthetic Polynucleotide
taatacgactcactatagggtattttttactacctaaatggatagcaccaaacagaggagatggtgcatgccatttaggaacctggcggcagcgcaaaagatg

SEQ ID NO: 57055 - DNA, 103 bp, Artificial Sequence
  Synthetic Polynucleotide
taatacgactcactatagggtgacttattttttactacctaaatggatagaacagaggagactatccatgtaggtagtaaacctggcggcagcgcaaaagatg

SEQ ID NO: 57056 - DNA, 103 bp, Artificial Sequence
  Synthetic Polynucleotide
taatacgactcactatagggtattctgacttattttttactacctaaatgaacagaggagacatttaatgagtaaaaaaaacctggcggcagcgcaaaagatg

SEQ ID NO: 57057 - DNA, 103 bp, Artificial Sequence
  Synthetic Polynucleotide
taatacgactcactataggggggcatattctgacttattttttactacctaacagaggagaaggtagatgaaaataagtaacctggcggcagcgcaaaagatg

SEQ ID NO: 57058 - DNA, 103 bp, Artificial Sequence
  Synthetic Polynucleotide
taatacgactcactatagggctatagggcatattctgacttattttttacaacagaggagagtaaaaatgaagtcagaaaacctggcggcagcgcaaaagatg

SEQ ID NO: 57059 - DNA, 103 bp, Artificial Sequence
  Synthetic Polynucleotide
taatacgactcactatagggataccgatggaagcgttgtaacttatagttaacagaggagaaactatatgttacaacgcaacctggcggcagcgcaaaagatg

SEQ ID NO: 57060 - DNA, 103 bp, Artificial Sequence
  Synthetic Polynucleotide
taatacgactcactatagggtcgtgctatagggcatattctgacttatttaacagaggagaaaataaatgagaatatgcaacctggcggcagcgcaaaagatg

SEQ ID NO: 57061 - DNA, 103 bp, Artificial Sequence
  Synthetic Polynucleotide
taatacgactcactatagggcacgatcgtgctatagggcatattctgactaacagaggagaagtcagatgatgccctataacctggcggcagcgcaaaagatg

SEQ ID NO: 57062 - DNA, 103 bp, Artificial Sequence
  Synthetic Polynucleotide
taatacgactcactatagggttttacacgatcgtgctatagggcatattcaacagaggagagaatatatgctatagcacaacctggcggcagcgcaaaagatg

SEQ ID NO: 57063 - DNA, 103 bp, Artificial Sequence
  Synthetic Polynucleotide
taatacgactcactatagggccaggttttacacgatcgtgctatagggcaaacagaggagatgccctatggcacgatcgaacctggcggcagcgcaaaagatg

SEQ ID NO: 57064 - DNA, 103 bp, Artificial Sequence
  Synthetic Polynucleotide
taatacgactcactatagggatataccaggttttacacgatcgtgctataaacagaggagatatagcatgatcgtgtaaaacctggcggcagcgcaaaagatg

SEQ ID NO: 57065 - DNA, 103 bp, Artificial Sequence
  Synthetic Polynucleotide
taatacgactcactatagggagacgatataccaggttttacacgatcgtgaacagaggagacacgatatggtaaaacctaacctggcggcagcgcaaaagatg

SEQ ID NO: 57066 - DNA, 103 bp, Artificial Sequence
  Synthetic Polynucleotide
taatacgactcactataggggatagagacgatataccaggttttacacgaaacagaggagatcgtgtatgacctggtataacctggcggcagcgcaaaagatg

SEQ ID NO: 57067 - DNA, 103 bp, Artificial Sequence
  Synthetic Polynucleotide
taatacgactcactatagggataaagatagagacgatataccaggttttaaacagaggagataaaacatggtatatcgtaacctggcggcagcgcaaaagatg

SEQ ID NO: 57068 - DNA, 103 bp, Artificial Sequence
  Synthetic Polynucleotide
taatacgactcactatagggctgtgataaagatagagacgatataccaggaacagaggagacctggtatgtcgtctctaaacctggcggcagcgcaaaagatg

SEQ ID NO: 57069 - DNA, 103 bp, Artificial Sequence
  Synthetic Polynucleotide
taatacgactcactatagggctatactgtgataaagatagagacgatataaacagaggagatatatcatgtctatctttaacctggcggcagcgcaaaagatg

SEQ ID NO: 57070 - DNA, 103 bp, Artificial Sequence
  Synthetic Polynucleotide
taatacgactcactatagggtttttataccgatggaagcgttgtaacttaaacagaggagataagttatgacgcttccaaacctggcggcagcgcaaaagatg

SEQ ID NO: 57071 - DNA, 103 bp, Artificial Sequence
  Synthetic Polynucleotide
taatacgactcactatagggatacactatactgtgataaagatagagacgaacagaggagacgtctcatgctttatcacaacctggcggcagcgcaaaagatg

SEQ ID NO: 57072 - DNA, 103 bp, Artificial Sequence
  Synthetic Polynucleotide
taatacgactcactatagggtgtcgatacactatactgtgataaagatagaacagaggagactatctatgtcacagtataacctggcggcagcgcaaaagatg

SEQ ID NO: 57073 - DNA, 103 bp, Artificial Sequence
  Synthetic Polynucleotide
taatacgactcactatagggaaagatgtcgatacactatactgtgataaaaacagaggagatttatcatggtatagtgtaacctggcggcagcgcaaaagatg

SEQ ID NO: 57074 - DNA, 103 bp, Artificial Sequence
  Synthetic Polynucleotide
taatacgactcactatagggataataaagatgtcgatacactatactgtgaacagaggagacacagtatggtgtatcgaaacctggcggcagcgcaaaagatg

SEQ ID NO: 57075 - DNA, 103 bp, Artificial Sequence
  Synthetic Polynucleotide
taatacgactcactatagggcaataataataaagatgtcgatacactataaacagaggagatatagtatgtcgacatctaacctggcggcagcgcaaaagatg

SEQ ID NO: 57076 - DNA, 103 bp, Artificial Sequence
  Synthetic Polynucleotide
taatacgactcactataggggaggtcaataataataaagatgtcgatacaaacagaggagatgtatcatgatctttattaacctggcggcagcgcaaaagatg

SEQ ID NO: 57077 - DNA, 103 bp, Artificial Sequence
  Synthetic Polynucleotide
taatacgactcactatagggtaaacgaggtcaataataataaagatgtcgaacagaggagacgacatatgtattattataacctggcggcagcgcaaaagatg

SEQ ID NO: 57078 - DNA, 103 bp, Artificial Sequence
  Synthetic Polynucleotide
taatacgactcactatagggcgagataaacgaggtcaataataataaagaaacagaggagatctttaatgttattgaccaacctggcggcagcgcaaaagatg

SEQ ID NO: 57079 - DNA, 103 bp, Artificial Sequence
  Synthetic Polynucleotide
taatacgactcactatagggtgttccgagataaacgaggtcaataataataacagaggagaattattatggacctcgttaacctggcggcagcgcaaaagatg

SEQ ID NO: 57080 - DNA, 103 bp, Artificial Sequence
  Synthetic Polynucleotide
taatacgactcactatagggttccatgttccgagataaacgaggtcaataaacagaggagatattgaatgcgtttatctaacctggcggcagcgcaaaagatg

SEQ ID NO: 57081 - DNA, 103 bp, Artificial Sequence
  Synthetic Polynucleotide
taatacgactcactatagggaatgatttttataccgatggaagcgttgtaaacagaggagatacaacatgtccatcggtaacctggcggcagcgcaaaagatg

SEQ ID NO: 57082 - DNA, 103 bp, Artificial Sequence
  Synthetic Polynucleotide
taatacgactcactatagggtcccattccatgttccgagataaacgaggtaacagaggagaacctcgatgatctcggaaaacctggcggcagcgcaaaagatg

SEQ ID NO: 57083 - DNA, 103 bp, Artificial Sequence
  Synthetic Polynucleotide
taatacgactcactatagggaatgttcccattccatgttccgagataaacaacagaggagagtttatatgggaacatggaacctggcggcagcgcaaaagatg

SEQ ID NO: 57084 - DNA, 103 bp, Artificial Sequence
  Synthetic Polynucleotide
taatacgactcactatagggacaaaaatgttcccattccatgttccgagaaacagaggagatctcggatgatggaatggaacctggcggcagcgcaaaagatg

SEQ ID NO: 57085 - DNA, 103 bp, Artificial Sequence
  Synthetic Polynucleotide
taatacgactcactatagggtgataacaaaaatgttcccattccatgttcaacagaggagagaacatatgatgggaacaaacctggcggcagcgcaaaagatg

SEQ ID NO: 57086 - DNA, 103 bp, Artificial Sequence
  Synthetic Polynucleotide
taatacgactcactataggggccgttgataacaaaaatgttcccattccaaacagaggagatggaatatgaacatttttaacctggcggcagcgcaaaagatg

SEQ ID NO: 57087 - DNA, 103 bp, Artificial Sequence
  Synthetic Polynucleotide
taatacgactcactatagggaggtggccgttgataacaaaaatgttcccaaacagaggagatgggaaatgttttgttataacctggcggcagcgcaaaagatg

SEQ ID NO: 57088 - DNA, 103 bp, Artificial Sequence
  Synthetic Polynucleotide
taatacgactcactatagggggcaaaggtggccgttgataacaaaaatgtaacagaggagaacatttatgttatcaacgaacctggcggcagcgcaaaagatg

SEQ ID NO: 57089 - DNA, 103 bp, Artificial Sequence
  Synthetic Polynucleotide
taatacgactcactatagggattaaggcaaaggtggccgttgataacaaaaacagaggagatttgttatgaacggccacaacctggcggcagcgcaaaagatg

SEQ ID NO: 57090 - DNA, 103 bp, Artificial Sequence
  Synthetic Polynucleotide
taatacgactcactatagggctggaattaaggcaaaggtggccgttgataaacagaggagatatcaaatgccacctttgaacctggcggcagcgcaaaagatg

SEQ ID NO: 57091 - DNA, 103 bp, Artificial Sequence
  Synthetic Polynucleotide
taatacgactcactatagggaacatctggaattaaggcaaaggtggccgtaacagaggagaacggccatgtttgccttaaacctggcggcagcgcaaaagatg

SEQ ID NO: 57092 - DNA, 103 bp, Artificial Sequence
  Synthetic Polynucleotide
taatacgactcactataggggatataatgatttttataccgatggaagcgaacagaggagacgcttcatgcggtataaaaacctggcggcagcgcaaaagatg

SEQ ID NO: 57093 - DNA, 103 bp, Artificial Sequence
  Synthetic Polynucleotide
taatacgactcactatagggtttacaacatctggaattaaggcaaaggtgaacagaggagacaccttatgcttaattccaacctggcggcagcgcaaaagatg

SEQ ID NO: 57094 - DNA, 103 bp, Artificial Sequence
  Synthetic Polynucleotide
taatacgactcactatagggataattttacaacatctggaattaaggcaaaacagaggagattgcctatgttccagatgaacctggcggcagcgcaaaagatg

SEQ ID NO: 57095 - DNA, 103 bp, Artificial Sequence
  Synthetic Polynucleotide
taatacgactcactatagggtagttataattttacaacatctggaattaaaacagaggagattaattatggatgttgtaaacctggcggcagcgcaaaagatg

SEQ ID NO: 57096 - DNA, 103 bp, Artificial Sequence
  Synthetic Polynucleotide
taatacgactcactatagggctgtttagttataattttacaacatctggaaacagaggagatccagaatgtgtaaaattaacctggcggcagcgcaaaagatg

SEQ ID NO: 57097 - DNA, 103 bp, Artificial Sequence
  Synthetic Polynucleotide
taatacgactcactatagggatagactgtttagttataattttacaacataacagaggagaatgttgatgaattataacaacctggcggcagcgcaaaagatg

SEQ ID NO: 57098 - DNA, 103 bp, Artificial Sequence
  Synthetic Polynucleotide
taatacgactcactatagggcgatgatagactgtttagttataattttacaacagaggagagtaaaaatgtaactaaacaacctggcggcagcgcaaaagatg

SEQ ID NO: 57099 - DNA, 103 bp, Artificial Sequence
  Synthetic Polynucleotide
taatacgactcactatagggtgtgtcgatgatagactgtttagttataataacagaggagaattataatgaaacagtctaacctggcggcagcgcaaaagatg

SEQ ID NO: 57100 - DNA, 103 bp, Artificial Sequence
  Synthetic Polynucleotide
taatacgactcactatagggtcatttgtgtcgatgatagactgtttagttaacagaggagaaactaaatggtctatcataacctggcggcagcgcaaaagatg

SEQ ID NO: 57101 - DNA, 103 bp, Artificial Sequence
  Synthetic Polynucleotide
taatacgactcactatagggaaatttcatttgtgtcgatgatagactgttaacagaggagaaacagtatgtcatcgacaaacctggcggcagcgcaaaagatg

SEQ ID NO: 57102 - DNA, 103 bp, Artificial Sequence
  Synthetic Polynucleotide
taatacgactcactatagggaacaaaaatttcatttgtgtcgatgatagaaacagaggagatctatcatggacacaaataacctggcggcagcgcaaaagatg

SEQ ID NO: 57103 - DNA, 103 bp, Artificial Sequence
  Synthetic Polynucleotide
taatacgactcactatagggtaacggatataatgatttttataccgatggaacagaggagaccatcgatgtaaaaatcaaacctggcggcagcgcaaaagatg

SEQ ID NO: 57104 - DNA, 103 bp, Artificial Sequence
  Synthetic Polynucleotide
taatacgactcactataggggtttaaacaaaaatttcatttgtgtcgatgaacagaggagacatcgaatgaaatgaaataacctggcggcagcgcaaaagatg

SEQ ID NO: 57105 - DNA, 103 bp, Artificial Sequence
  Synthetic Polynucleotide
taatacgactcactatagggcaaacgtttaaacaaaaatttcatttgtgtaacagaggagaacacaaatgaaatttttgaacctggcggcagcgcaaaagatg

SEQ ID NO: 57106 - DNA, 103 bp, Artificial Sequence
  Synthetic Polynucleotide
taatacgactcactatagggaactacaaacgtttaaacaaaaatttcattaacagaggagaaatgaaatgtttgtttaaaacctggcggcagcgcaaaagatg

SEQ ID NO: 57107 - DNA, 103 bp, Artificial Sequence
  Synthetic Polynucleotide
taatacgactcactatagggacgtaaactacaaacgtttaaacaaaaattaacagaggagaaattttatgttaaacgttaacctggcggcagcgcaaaagatg

SEQ ID NO: 57108 - DNA, 103 bp, Artificial Sequence
  Synthetic Polynucleotide
taatacgactcactatagggcgcatacgtaaactacaaacgtttaaacaaaacagaggagattgtttatgcgtttgtagaacctggcggcagcgcaaaagatg

SEQ ID NO: 57109 - DNA, 103 bp, Artificial Sequence
  Synthetic Polynucleotide
taatacgactcactatagggcgagccgcatacgtaaactacaaacgtttaaacagaggagataaacgatggtagtttacaacctggcggcagcgcaaaagatg

SEQ ID NO: 57110 - DNA, 103 bp, Artificial Sequence
  Synthetic Polynucleotide
taatacgactcactataggggagaacgagccgcatacgtaaactacaaacaacagaggagagtttgtatgttacgtatgaacctggcggcagcgcaaaagatg

SEQ ID NO: 57111 - DNA, 103 bp, Artificial Sequence
  Synthetic Polynucleotide
taatacgactcactataggggagacgagaacgagccgcatacgtaaactaaacagaggagatagtttatgtatgcggctaacctggcggcagcgcaaaagatg

SEQ ID NO: 57112 - DNA, 103 bp, Artificial Sequence
  Synthetic Polynucleotide
taatacgactcactatagggaaaatgagacgagaacgagccgcatacgtaaacagaggagatacgtaatgggctcgttcaacctggcggcagcgcaaaagatg

SEQ ID NO: 57113 - DNA, 103 bp, Artificial Sequence
  Synthetic Polynucleotide
taatacgactcactatagggctgaaaaaatgagacgagaacgagccgcataacagaggagaatgcggatggttctcgtcaacctggcggcagcgcaaaagatg

SEQ ID NO: 57114 - DNA, 103 bp, Artificial Sequence
  Synthetic Polynucleotide
taatacgactcactatagggagacataacggatataatgatttttataccaacagaggagaggtataatgatcattataaacctggcggcagcgcaaaagatg

SEQ ID NO: 57115 - DNA, 103 bp, Artificial Sequence
  Synthetic Polynucleotide
taatacgactcactatagggaatatctgaaaaaatgagacgagaacgagcaacagaggagagctcgtatgcgtctcattaacctggcggcagcgcaaaagatg

SEQ ID NO: 57116 - DNA, 103 bp, Artificial Sequence
  Synthetic Polynucleotide
taatacgactcactatagggcctgcaatatctgaaaaaatgagacgagaaaacagaggagattctcgatgcattttttcaacctggcggcagcgcaaaagatg

SEQ ID NO: 57117 - DNA, 103 bp, Artificial Sequence
  Synthetic Polynucleotide
taatacgactcactatagggtagtacctgcaatatctgaaaaaatgagacaacagaggagagtctcaatgtttcagataaacctggcggcagcgcaaaagatg

SEQ ID NO: 57118 - DNA, 103 bp, Artificial Sequence
  Synthetic Polynucleotide
taatacgactcactatagggtattatagtacctgcaatatctgaaaaaataacagaggagaatttttatggatattgcaaacctggcggcagcgcaaaagatg

SEQ ID NO: 57119 - DNA, 103 bp, Artificial Sequence
  Synthetic Polynucleotide
taatacgactcactatagggtttaatattatagtacctgcaatatctgaaaacagaggagattcagaatgtgcaggtacaacctggcggcagcgcaaaagatg

SEQ ID NO: 57120 - DNA, 103 bp, Artificial Sequence
  Synthetic Polynucleotide
taatacgactcactatagggttatttttaatattatagtacctgcaatataacagaggagaatattgatggtactataaaacctggcggcagcgcaaaagatg

SEQ ID NO: 57121 - DNA, 103 bp, Artificial Sequence
  Synthetic Polynucleotide
taatacgactcactatagggcattcttatttttaatattatagtacctgcaacagaggagagcaggtatgataatattaaacctggcggcagcgcaaaagatg

SEQ ID NO: 57122 - DNA, 103 bp, Artificial Sequence
  Synthetic Polynucleotide
taatacgactcactatagggtatttcattcttatttttaatattatagtaaacagaggagatactatatgattaaaaataacctggcggcagcgcaaaagatg

SEQ ID NO: 57123 - DNA, 103 bp, Artificial Sequence
  Synthetic Polynucleotide
taatacgactcactatagggtatgttatttcattcttatttttaatattaaacagaggagataatatatgaaataagaaaacctggcggcagcgcaaaagatg

SEQ ID NO: 57124 - DNA, 103 bp, Artificial Sequence
  Synthetic Polynucleotide
taatacgactcactatagggaatcctatgttatttcattcttatttttaaaacagaggagattaaaaatgagaatgaaaaacctggcggcagcgcaaaagatg

SEQ ID NO: 57125 - DNA, 103 bp, Artificial Sequence
  Synthetic Polynucleotide
taatacgactcactataggggatagcgacagtaatgattatacataatgaaacagaggagatcattaatgataatcattaacctggcggcagcgcaaaagatg

SEQ ID NO: 57126 - DNA, 103 bp, Artificial Sequence
  Synthetic Polynucleotide
taatacgactcactatagggacggaagacataacggatataatgatttttaacagaggagaaaaaatatgtatatccgtaacctggcggcagcgcaaaagatg

SEQ ID NO: 57127 - DNA, 103 bp, Artificial Sequence
  Synthetic Polynucleotide
taatacgactcactatagggtttttaatcctatgttatttcattcttattaacagaggagaaataagatggaaataacaaacctggcggcagcgcaaaagatg

SEQ ID NO: 57128 - DNA, 103 bp, Artificial Sequence
  Synthetic Polynucleotide
taatacgactcactatagggctttatttttaatcctatgttatttcattcaacagaggagagaatgaatgaacataggaaacctggcggcagcgcaaaagatg

SEQ ID NO: 57129 - DNA, 103 bp, Artificial Sequence
  Synthetic Polynucleotide
taatacgactcactataggggataactttatttttaatcctatgttatttaacagaggagaaaataaatgaggattaaaaacctggcggcagcgcaaaagatg

SEQ ID NO: 57130 - DNA, 103 bp, Artificial Sequence
  Synthetic Polynucleotide
taatacgactcactataggggtcatgataactttatttttaatcctatgtaacagaggagaacatagatgtaaaaataaaacctggcggcagcgcaaaagatg

SEQ ID NO: 57131 - DNA, 103 bp, Artificial Sequence
  Synthetic Polynucleotide
taatacgactcactatagggtagaagtcatgataactttatttttaatccaacagaggagaggattaatgataaagttaaacctggcggcagcgcaaaagatg

SEQ ID NO: 57132 - DNA, 103 bp, Artificial Sequence
  Synthetic Polynucleotide
taatacgactcactatagggagcgctagaagtcatgataactttatttttaacagaggagaaaaaatatggttatcatgaacctggcggcagcgcaaaagatg

SEQ ID NO: 57133 - DNA, 103 bp, Artificial Sequence
  Synthetic Polynucleotide
taatacgactcactatagggaaatcagcgctagaagtcatgataactttaaacagaggagataaagtatgcatgacttcaacctggcggcagcgcaaaagatg

SEQ ID NO: 57134 - DNA, 103 bp, Artificial Sequence
  Synthetic Polynucleotide
taatacgactcactatagggtagttaaatcagcgctagaagtcatgataaaacagaggagattatcaatgcttctagcgaacctggcggcagcgcaaaagatg

SEQ ID NO: 57135 - DNA, 103 bp, Artificial Sequence
  Synthetic Polynucleotide
taatacgactcactatagggtaagttagttaaatcagcgctagaagtcataacagaggagaatgactatgagcgctgataacctggcggcagcgcaaaagatg

SEQ ID NO: 57136 - DNA, 103 bp, Artificial Sequence
  Synthetic Polynucleotide
taatacgactcactatagggtcttttaagttagttaaatcagcgctagaaaacagaggagattctagatgtgatttaacaacctggcggcagcgcaaaagatg

SEQ ID NO: 57137 - DNA, 103 bp, Artificial Sequence
  Synthetic Polynucleotide
taatacgactcactatagggatccaacggaagacataacggatataatgaaacagaggagatcattaatgccgttatgtaacctggcggcagcgcaaaagatg

SEQ ID NO: 57138 - DNA, 103 bp, Artificial Sequence
  Synthetic Polynucleotide
taatacgactcactataggggtaattcttttaagttagttaaatcagcgcaacagaggagagcgctgatgtaactaactaacctggcggcagcgcaaaagatg

SEQ ID NO: 57139 - DNA, 103 bp, Artificial Sequence
  Synthetic Polynucleotide
taatacgactcactatagggactaagtaattcttttaagttagttaaatcaacagaggagagatttaatgaacttaaaaaacctggcggcagcgcaaaagatg

SEQ ID NO: 57140 - DNA, 103 bp, Artificial Sequence
  Synthetic Polynucleotide
taatacgactcactatagggtacagactaagtaattcttttaagttagttaacagaggagaaactaaatgaaaagaattaacctggcggcagcgcaaaagatg

SEQ ID NO: 57141 - DNA, 103 bp, Artificial Sequence
  Synthetic Polynucleotide
taatacgactcactatagggttttgtacagactaagtaattcttttaagtaacagaggagaacttaaatgaattacttaaacctggcggcagcgcaaaagatg

SEQ ID NO: 57142 - DNA, 103 bp, Artificial Sequence
  Synthetic Polynucleotide
taatacgactcactatagggcaaacttttgtacagactaagtaattctttaacagaggagaaaagaaatgcttagtctgaacctggcggcagcgcaaaagatg

SEQ ID NO: 57143 - DNA, 103 bp, Artificial Sequence
  Synthetic Polynucleotide
taatacgactcactatagggaatctcaaacttttgtacagactaagtaataacagaggagaattactatgtctgtacaaaacctggcggcagcgcaaaagatg

SEQ ID NO: 57144 - DNA, 103 bp, Artificial Sequence
  Synthetic Polynucleotide
taatacgactcactatagggctgaaaatctcaaacttttgtacagactaaaacagaggagattagtcatgacaaaagttaacctggcggcagcgcaaaagatg

SEQ ID NO: 57145 - DNA, 103 bp, Artificial Sequence
  Synthetic Polynucleotide
taatacgactcactatagggagaatctgaaaatctcaaacttttgtacagaacagaggagactgtacatgagtttgagaaacctggcggcagcgcaaaagatg

SEQ ID NO: 57146 - DNA, 103 bp, Artificial Sequence
  Synthetic Polynucleotide
taatacgactcactataggggccgcagaatctgaaaatctcaaacttttgaacagaggagacaaaagatggagattttcaacctggcggcagcgcaaaagatg

SEQ ID NO: 57147 - DNA, 103 bp, Artificial Sequence
  Synthetic Polynucleotide
taatacgactcactatagggctatagccgcagaatctgaaaatctcaaacaacagaggagagtttgaatgtttcagattaacctggcggcagcgcaaaagatg

SEQ ID NO: 57148 - DNA, 103 bp, Artificial Sequence
  Synthetic Polynucleotide
taatacgactcactatagggtctatatccaacggaagacataacggatataacagaggagaatatccatgatgtcttccaacctggcggcagcgcaaaagatg

SEQ ID NO: 57149 - DNA, 103 bp, Artificial Sequence
  Synthetic Polynucleotide
taatacgactcactatagggcttctctatagccgcagaatctgaaaatctaacagaggagaagatttatggattctgcgaacctggcggcagcgcaaaagatg

SEQ ID NO: 57150 - DNA, 103 bp, Artificial Sequence
  Synthetic Polynucleotide
taatacgactcactatagggttatacttctctatagccgcagaatctgaaaacagaggagattcagaatgtgcggctataacctggcggcagcgcaaaagatg

SEQ ID NO: 57151 - DNA, 103 bp, Artificial Sequence
  Synthetic Polynucleotide
taatacgactcactatagggaagaattatacttctctatagccgcagaataacagaggagaattctgatgctatagagaaacctggcggcagcgcaaaagatg

SEQ ID NO: 57152 - DNA, 103 bp, Artificial Sequence
  Synthetic Polynucleotide
taatacgactcactatagggtaccaaagaattatacttctctatagccgcaacagaggagagcggctatggagaagtataacctggcggcagcgcaaaagatg

SEQ ID NO: 57153 - DNA, 103 bp, Artificial Sequence
  Synthetic Polynucleotide
taatacgactcactatagggcattctaccaaagaattatacttctctataaacagaggagatatagaatggtataattcaacctggcggcagcgcaaaagatg

SEQ ID NO: 57154 - DNA, 103 bp, Artificial Sequence
  Synthetic Polynucleotide
taatacgactcactatagggttccccattctaccaaagaattatacttctaacagaggagaagaagtatgattctttggaacctggcggcagcgcaaaagatg

SEQ ID NO: 57155 - DNA, 103 bp, Artificial Sequence
  Synthetic Polynucleotide
taatacgactcactatagggagatgttccccattctaccaaagaattataaacagaggagatataatatgttggtagaaaacctggcggcagcgcaaaagatg

SEQ ID NO: 57156 - DNA, 103 bp, Artificial Sequence
  Synthetic Polynucleotide
taatacgactcactatagggtaagtagatgttccccattctaccaaagaaaacagaggagattctttatgagaatggggaacctggcggcagcgcaaaagatg

SEQ ID NO: 57157 - DNA, 103 bp, Artificial Sequence
  Synthetic Polynucleotide
taatacgactcactatagggtccagtaagtagatgttccccattctaccaaacagaggagatggtagatgggggaacataacctggcggcagcgcaaaagatg

SEQ ID NO: 57158 - DNA, 103 bp, Artificial Sequence
  Synthetic Polynucleotide
taatacgactcactatagggtattttccagtaagtagatgttccccattcaacagaggagagaatggatgacatctactaacctggcggcagcgcaaaagatg

SEQ ID NO: 57159 - DNA, 103 bp, Artificial Sequence
  Synthetic Polynucleotide
taatacgactcactatagggctccatctatatccaacggaagacataacgaacagaggagacgttatatgttccgttggaacctggcggcagcgcaaaagatg

SEQ ID NO: 57160 - DNA, 103 bp, Artificial Sequence
  Synthetic Polynucleotide
taatacgactcactatagggacgcctattttccagtaagtagatgttcccaacagaggagagggaacatgtacttactgaacctggcggcagcgcaaaagatg

SEQ ID NO: 57161 - DNA, 103 bp, Artificial Sequence
  Synthetic Polynucleotide
taatacgactcactatagggtttgtacgcctattttccagtaagtagatgaacagaggagacatctaatgactggaaaaaacctggcggcagcgcaaaagatg

SEQ ID NO: 57162 - DNA, 103 bp, Artificial Sequence
  Synthetic Polynucleotide
taatacgactcactatagggtaccttttgtacgcctattttccagtaagtaacagaggagaacttacatgaaaataggcaacctggcggcagcgcaaaagatg

SEQ ID NO: 57163 - DNA, 103 bp, Artificial Sequence
  Synthetic Polynucleotide
taatacgactcactatagggttagctaccttttgtacgcctattttccagaacagaggagactggaaatgaggcgtacaaacctggcggcagcgcaaaagatg

SEQ ID NO: 57164 - DNA, 103 bp, Artificial Sequence
  Synthetic Polynucleotide
taatacgactcactatagggcgacattagctaccttttgtacgcctatttaacagaggagaaaatagatgtacaaaaggaacctggcggcagcgcaaaagatg

SEQ ID NO: 57165 - DNA, 103 bp, Artificial Sequence
  Synthetic Polynucleotide
taatacgactcactatagggcgtctcgacattagctaccttttgtacgccaacagaggagaggcgtaatgaaggtagctaacctggcggcagcgcaaaagatg

SEQ ID NO: 57166 - DNA, 103 bp, Artificial Sequence
  Synthetic Polynucleotide
taatacgactcactatagggatggacgtctcgacattagctaccttttgtaacagaggagaacaaaaatgagctaatgtaacctggcggcagcgcaaaagatg

SEQ ID NO: 57167 - DNA, 103 bp, Artificial Sequence
  Synthetic Polynucleotide
taatacgactcactatagggcagatatggacgtctcgacattagctacctaacagaggagaaggtagatgatgtcgagaaacctggcggcagcgcaaaagatg

SEQ ID NO: 57168 - DNA, 103 bp, Artificial Sequence
  Synthetic Polynucleotide
taatacgactcactatagggataatcagatatggacgtctcgacattagcaacagaggagagctaatatggagacgtccaacctggcggcagcgcaaaagatg

SEQ ID NO: 57169 - DNA, 103 bp, Artificial Sequence
  Synthetic Polynucleotide
taatacgactcactatagggtcataataatcagatatggacgtctcgacaaacagaggagatgtcgaatggtccatatcaacctggcggcagcgcaaaagatg

SEQ ID NO: 57170 - DNA, 103 bp, Artificial Sequence
  Synthetic Polynucleotide
taatacgactcactatagggattacctccatctatatccaacggaagacaaacagaggagatgtcttatgttggatataaacctggcggcagcgcaaaagatg

SEQ ID NO: 57171 - DNA, 103 bp, Artificial Sequence
  Synthetic Polynucleotide
taatacgactcactatagggcctcatcataataatcagatatggacgtctaacagaggagaagacgtatgtatctgattaacctggcggcagcgcaaaagatg

SEQ ID NO: 57172 - DNA, 103 bp, Artificial Sequence
  Synthetic Polynucleotide
taatacgactcactatagggttttacctcatcataataatcagatatggaaacagaggagatccataatggattattataacctggcggcagcgcaaaagatg

SEQ ID NO: 57173 - DNA, 103 bp, Artificial Sequence
  Synthetic Polynucleotide
taatacgactcactatagggttattttttacctcatcataataatcagataacagaggagaatctgaatgttatgatgaaacctggcggcagcgcaaaagatg

SEQ ID NO: 57174 - DNA, 103 bp, Artificial Sequence
  Synthetic Polynucleotide
taatacgactcactatagggacggtttattttttacctcatcataataataacagaggagaattattatgatgaggtaaaacctggcggcagcgcaaaagatg

SEQ ID NO: 57175 - DNA, 103 bp, Artificial Sequence
  Synthetic Polynucleotide
taatacgactcactatagggattaaacggtttattttttacctcatcataaacagaggagatatgatatggtaaaaaataacctggcggcagcgcaaaagatg

SEQ ID NO: 57176 - DNA, 103 bp, Artificial Sequence
  Synthetic Polynucleotide
taatacgactcactatagggtcaatattaaacggtttattttttacctcaaacagaggagatgaggtatgaaataaaccaacctggcggcagcgcaaaagatg

SEQ ID NO: 57177 - DNA, 103 bp, Artificial Sequence
  Synthetic Polynucleotide
taatacgactcactatagggctggatcaatattaaacggtttattttttaaacagaggagataaaaaatgaaccgtttaaacctggcggcagcgcaaaagatg

SEQ ID NO: 57178 - DNA, 103 bp, Artificial Sequence
  Synthetic Polynucleotide
taatacgactcactatagggataccctggatcaatattaaacggtttattaacagaggagaaataaaatgtttaatattaacctggcggcagcgcaaaagatg

SEQ ID NO: 57179 - DNA, 103 bp, Artificial Sequence
  Synthetic Polynucleotide
taatacgactcactatagggatataataccctggatcaatattaaacggtaacagaggagaaccgttatgtattgatccaacctggcggcagcgcaaaagatg

SEQ ID NO: 57180 - DNA, 103 bp, Artificial Sequence
  Synthetic Polynucleotide
taatacgactcactatagggagaaaatataataccctggatcaatattaaaacagaggagattaataatgatccagggtaacctggcggcagcgcaaaagatg

SEQ ID NO: 57181 - DNA, 103 bp, Artificial Sequence
  Synthetic Polynucleotide
taatacgactcactatagggtgccaattacctccatctatatccaacggaaacagaggagatccgttatgtatagatggaacctggcggcagcgcaaaagatg

SEQ ID NO: 57182 - DNA, 103 bp, Artificial Sequence
  Synthetic Polynucleotide
taatacgactcactatagggcggtaagaaaatataataccctggatcaataacagaggagaattgatatggggtattataacctggcggcagcgcaaaagatg

SEQ ID NO: 57183 - DNA, 103 bp, Artificial Sequence
  Synthetic Polynucleotide
taatacgactcactatagggtataccggtaagaaaatataataccctggaaacagaggagatccaggatgttatattttaacctggcggcagcgcaaaagatg

SEQ ID NO: 57184 - DNA, 103 bp, Artificial Sequence
  Synthetic Polynucleotide
taatacgactcactatagggcaaaatataccggtaagaaaatataataccaacagaggagaggtattatgttttcttacaacctggcggcagcgcaaaagatg

SEQ ID NO: 57185 - DNA, 103 bp, Artificial Sequence
  Synthetic Polynucleotide
taatacgactcactataggggcttccaaaatataccggtaagaaaatataaacagaggagatatattatgttaccggtaaacctggcggcagcgcaaaagatg

SEQ ID NO: 57186 - DNA, 103 bp, Artificial Sequence
  Synthetic Polynucleotide
taatacgactcactatagggaagacgcttccaaaatataccggtaagaaaaacagaggagatttcttatgggtatatttaacctggcggcagcgcaaaagatg

SEQ ID NO: 57187 - DNA, 103 bp, Artificial Sequence
  Synthetic Polynucleotide
taatacgactcactatagggaaataaagacgcttccaaaatataccggtaaacagaggagataccggatgattttggaaaacctggcggcagcgcaaaagatg

SEQ ID NO: 57188 - DNA, 103 bp, Artificial Sequence
  Synthetic Polynucleotide
taatacgactcactatagggcgaataaataaagacgcttccaaaatatacaacagaggagagtatatatgggaagcgtcaacctggcggcagcgcaaaagatg

SEQ ID NO: 57189 - DNA, 103 bp, Artificial Sequence
  Synthetic Polynucleotide
taatacgactcactatagggcccttcgaataaataaagacgcttccaaaaaacagaggagattttggatgcgtctttataacctggcggcagcgcaaaagatg

SEQ ID NO: 57190 - DNA, 103 bp, Artificial Sequence
  Synthetic Polynucleotide
taatacgactcactatagggttttacccttcgaataaataaagacgcttcaacagaggagagaagcgatgttatttattaacctggcggcagcgcaaaagatg

SEQ ID NO: 57191 - DNA, 103 bp, Artificial Sequence
  Synthetic Polynucleotide
taatacgactcactatagggcatatttttacccttcgaataaataaagacaacagaggagagtctttatgtattcgaagaacctggcggcagcgcaaaagatg

SEQ ID NO: 57192 - DNA, 103 bp, Artificial Sequence
  Synthetic Polynucleotide
taatacgactcactatagggttaaatgccaattacctccatctatatccaaacagaggagatggataatgatggaggtaaacctggcggcagcgcaaaagatg

SEQ ID NO: 57193 - DNA, 103 bp, Artificial Sequence
  Synthetic Polynucleotide
taatacgactcactatagggtctaccatatttttacccttcgaataaataaacagaggagatatttaatggaagggtaaaacctggcggcagcgcaaaagatg

SEQ ID NO: 57194 - DNA, 103 bp, Artificial Sequence
  Synthetic Polynucleotide
taatacgactcactatagggcaagttctaccatatttttacccttcgaataacagaggagaattcgaatggtaaaaataaacctggcggcagcgcaaaagatg

SEQ ID NO: 57195 - DNA, 103 bp, Artificial Sequence
  Synthetic Polynucleotide
taatacgactcactatagggagatccaagttctaccatatttttacccttaacagaggagaaagggtatgaatatggtaaacctggcggcagcgcaaaagatg

SEQ ID NO: 57196 - DNA, 103 bp, Artificial Sequence
  Synthetic Polynucleotide
taatacgactcactatagggtttccagatccaagttctaccatatttttaaacagaggagataaaaaatgggtagaactaacctggcggcagcgcaaaagatg

SEQ ID NO: 57197 - DNA, 103 bp, Artificial Sequence
  Synthetic Polynucleotide
taatacgactcactatagggaagagtttccagatccaagttctaccatataacagaggagaatatggatgaacttggataacctggcggcagcgcaaaagatg

SEQ ID NO: 57198 - DNA, 103 bp, Artificial Sequence
  Synthetic Polynucleotide
taatacgactcactatagggttgaaaagagtttccagatccaagttctacaacagaggagagtagaaatgggatctggaaacctggcggcagcgcaaaagatg

SEQ ID NO: 57199 - DNA, 103 bp, Artificial Sequence
  Synthetic Polynucleotide
taatacgactcactatagggggtatttgaaaagagtttccagatccaagtaacagaggagaacttggatgtggaaactcaacctggcggcagcgcaaaagatg

SEQ ID NO: 57200 - DNA, 103 bp, Artificial Sequence
  Synthetic Polynucleotide
taatacgactcactatagggcatctggtatttgaaaagagtttccagatcaacagaggagagatctgatgactcttttcaacctggcggcagcgcaaaagatg

SEQ ID NO: 57201 - DNA, 103 bp, Artificial Sequence
  Synthetic Polynucleotide
taatacgactcactatagggcatatcatctggtatttgaaaagagtttccaacagaggagaggaaacatgtttcaaataaacctggcggcagcgcaaaagatg

SEQ ID NO: 57202 - DNA, 103 bp, Artificial Sequence
  Synthetic Polynucleotide
taatacgactcactatagggcttcgcatatcatctggtatttgaaaagagaacagaggagactctttatgaataccagaaacctggcggcagcgcaaaagatg

SEQ ID NO: 57203 - DNA, 103 bp, Artificial Sequence
  Synthetic Polynucleotide
taatacgactcactatagggatctgttaaatgccaattacctccatctataacagaggagaatagatatgggtaattggaacctggcggcagcgcaaaagatg

SEQ ID NO: 57204 - DNA, 103 bp, Artificial Sequence
  Synthetic Polynucleotide
taatacgactcactatagggacacacttcgcatatcatctggtatttgaaaacagaggagattcaaaatgcagatgataaacctggcggcagcgcaaaagatg

SEQ ID NO: 57205 - DNA, 103 bp, Artificial Sequence
  Synthetic Polynucleotide
taatacgactcactataggggttacacacacttcgcatatcatctggtataacagaggagaataccaatggatatgcgaaacctggcggcagcgcaaaagatg

SEQ ID NO: 57206 - DNA, 103 bp, Artificial Sequence
  Synthetic Polynucleotide
taatacgactcactatagggactttgttacacacacttcgcatatcatctaacagaggagaagatgaatggcgaagtgtaacctggcggcagcgcaaaagatg

SEQ ID NO: 57207 - DNA, 103 bp, Artificial Sequence
  Synthetic Polynucleotide
taatacgactcactatagggctaatactttgttacacacacttcgcatataacagaggagaatatgcatggtgtgtgtaaacctggcggcagcgcaaaagatg

SEQ ID NO: 57208 - DNA, 103 bp, Artificial Sequence
  Synthetic Polynucleotide
taatacgactcactataggggccgtctaatactttgttacacacacttcgaacagaggagacgaagtatgtgtaacaaaaacctggcggcagcgcaaaagatg

SEQ ID NO: 57209 - DNA, 103 bp, Artificial Sequence
  Synthetic Polynucleotide
taatacgactcactatagggttatcgccgtctaatactttgttacacacaaacagaggagatgtgtgatgcaaagtattaacctggcggcagcgcaaaagatg

SEQ ID NO: 57210 - DNA, 103 bp, Artificial Sequence
  Synthetic Polynucleotide
taatacgactcactatagggttccgttatcgccgtctaatactttgttacaacagaggagagtaacaatgtattagacgaacctggcggcagcgcaaaagatg

SEQ ID NO: 57211 - DNA, 103 bp, Artificial Sequence
  Synthetic Polynucleotide
taatacgactcactataggggtctattccgttatcgccgtctaatactttaacagaggagaaaagtaatggacggcgataacctggcggcagcgcaaaagatg

SEQ ID NO: 57212 - DNA, 103 bp, Artificial Sequence
  Synthetic Polynucleotide
taatacgactcactatagggagaaagtctattccgttatcgccgtctaataacagaggagaattagaatgcgataacggaacctggcggcagcgcaaaagatg

SEQ ID NO: 57213 - DNA, 103 bp, Artificial Sequence
  Synthetic Polynucleotide
taatacgactcactatagggatctcagaaagtctattccgttatcgccgtaacagaggagaacggcgatgacggaatagaacctggcggcagcgcaaaagatg

SEQ ID NO: 57214 - DNA, 103 bp, Artificial Sequence
  Synthetic Polynucleotide
taatacgactcactatagggtgcgaatctgttaaatgccaattacctccaaacagaggagatggaggatgttggcatttaacctggcggcagcgcaaaagatg

SEQ ID NO: 57215 - DNA, 103 bp, Artificial Sequence
  Synthetic Polynucleotide
taatacgactcactatagggaacaaatctcagaaagtctattccgttatcaacagaggagagataacatgatagactttaacctggcggcagcgcaaaagatg

SEQ ID NO: 57216 - DNA, 103 bp, Artificial Sequence
  Synthetic Polynucleotide
taatacgactcactatagggaacaaaacaaatctcagaaagtctattccgaacagaggagacggaatatgctttctgagaacctggcggcagcgcaaaagatg

SEQ ID NO: 57217 - DNA, 103 bp, Artificial Sequence
  Synthetic Polynucleotide
taatacgactcactatagggtgtttaacaaaacaaatctcagaaagtctaaacagaggagatagactatgtgagatttgaacctggcggcagcgcaaaagatg

SEQ ID NO: 57218 - DNA, 103 bp, Artificial Sequence
  Synthetic Polynucleotide
taatacgactcactatagggtctattgtttaacaaaacaaatctcagaaaaacagaggagatttctgatgtttgttttgaacctggcggcagcgcaaaagatg

SEQ ID NO: 57219 - DNA, 103 bp, Artificial Sequence
  Synthetic Polynucleotide
taatacgactcactatagggatccatctattgtttaacaaaacaaatctcaacagaggagagagattatgtttgttaaaaacctggcggcagcgcaaaagatg

SEQ ID NO: 57220 - DNA, 103 bp, Artificial Sequence
  Synthetic Polynucleotide
taatacgactcactatagggccattatccatctattgtttaacaaaacaaaacagaggagattgtttatgtaaacaataaacctggcggcagcgcaaaagatg

SEQ ID NO: 57221 - DNA, 103 bp, Artificial Sequence
  Synthetic Polynucleotide
taatacgactcactataggggtcttccattatccatctattgtttaacaaaacagaggagattgttaatgaatagatggaacctggcggcagcgcaaaagatg

SEQ ID NO: 57222 - DNA, 103 bp, Artificial Sequence
  Synthetic Polynucleotide
taatacgactcactatagggatagcgtcttccattatccatctattgtttaacagaggagaaaacaaatgatggataataacctggcggcagcgcaaaagatg

SEQ ID NO: 57223 - DNA, 103 bp, Artificial Sequence
  Synthetic Polynucleotide
taatacgactcactatagggttgatatagcgtcttccattatccatctataacagaggagaatagatatgtaatggaagaacctggcggcagcgcaaaagatg

SEQ ID NO: 57224 - DNA, 103 bp, Artificial Sequence
  Synthetic Polynucleotide
taatacgactcactatagggatattttgatatagcgtcttccattatccaaacagaggagatggataatggaagacgctaacctggcggcagcgcaaaagatg

SEQ ID NO: 57225 - DNA, 103 bp, Artificial Sequence
  Synthetic Polynucleotide
taatacgactcactatagggctatttgcgaatctgttaaatgccaattacaacagaggagagtaattatgatttaacagaacctggcggcagcgcaaaagatg

SEQ ID NO: 57226 - DNA, 103 bp, Artificial Sequence
  Synthetic Polynucleotide
taatacgactcactataggggactgatattttgatatagcgtcttccattaacagaggagaaatggaatgcgctatatcaacctggcggcagcgcaaaagatg

SEQ ID NO: 57227 - DNA, 103 bp, Artificial Sequence
  Synthetic Polynucleotide
taatacgactcactatagggctggtgactgatattttgatatagcgtcttaacagaggagaaagacgatgtatcaaaataacctggcggcagcgcaaaagatg

SEQ ID NO: 57228 - DNA, 103 bp, Artificial Sequence
  Synthetic Polynucleotide
taatacgactcactatagggattaactggtgactgatattttgatatagcaacagaggagagctataatgaaatatcagaacctggcggcagcgcaaaagatg

SEQ ID NO: 57229 - DNA, 103 bp, Artificial Sequence
  Synthetic Polynucleotide
taatacgactcactatagggaatatattaactggtgactgatattttgataacagaggagaatcaaaatgtcagtcaccaacctggcggcagcgcaaaagatg

SEQ ID NO: 57230 - DNA, 103 bp, Artificial Sequence
  Synthetic Polynucleotide
taatacgactcactataggggtttaaatatattaactggtgactgatattaacagaggagaaatatcatgcaccagttaaacctggcggcagcgcaaaagatg

SEQ ID NO: 57231 - DNA, 103 bp, Artificial Sequence
  Synthetic Polynucleotide
taatacgactcactatagggcgctagtttaaatatattaactggtgactgaacagaggagacagtcaatggttaatataaacctggcggcagcgcaaaagatg

SEQ ID NO: 57232 - DNA, 103 bp, Artificial Sequence
  Synthetic Polynucleotide
taatacgactcactatagggtcactcgctagtttaaatatattaactggtaacagaggagaaccagtatgtatatttaaaacctggcggcagcgcaaaagatg

SEQ ID NO: 57233 - DNA, 103 bp, Artificial Sequence
  Synthetic Polynucleotide
taatacgactcactatagggcgtactcactcgctagtttaaatatattaaaacagaggagattaataatgttaaactagaacctggcggcagcgcaaaagatg

SEQ ID NO: 57234 - DNA, 103 bp, Artificial Sequence
  Synthetic Polynucleotide
taatacgactcactatagggtaatccgtactcactcgctagtttaaatataacagaggagaatatttatgctagcgagtaacctggcggcagcgcaaaagatg

SEQ ID NO: 57235 - DNA, 103 bp, Artificial Sequence
  Synthetic Polynucleotide
taatacgactcactatagggatgtttaatccgtactcactcgctagtttaaacagaggagataaactatggagtgagtaaacctggcggcagcgcaaaagatg

SEQ ID NO: 57236 - DNA, 103 bp, Artificial Sequence
  Synthetic Polynucleotide
taatacgactcactatagggataatgatagcgacagtaatgattatacataacagaggagaatgtatatgcattactgtaacctggcggcagcgcaaaagatg

SEQ ID NO: 57237 - DNA, 103 bp, Artificial Sequence
  Synthetic Polynucleotide
taatacgactcactatagggggcacctatttgcgaatctgttaaatgccaaacagaggagatggcatatgacagattcgaacctggcggcagcgcaaaagatg

SEQ ID NO: 57238 - DNA, 103 bp, Artificial Sequence
  Synthetic Polynucleotide
taatacgactcactatagggtgggtatgtttaatccgtactcactcgctaaacagaggagatagcgaatgagtacggataacctggcggcagcgcaaaagatg

SEQ ID NO: 57239 - DNA, 103 bp, Artificial Sequence
  Synthetic Polynucleotide
taatacgactcactatagggatagttgggtatgtttaatccgtactcactaacagaggagaagtgagatgggattaaacaacctggcggcagcgcaaaagatg

SEQ ID NO: 57240 - DNA, 103 bp, Artificial Sequence
  Synthetic Polynucleotide
taatacgactcactatagggtctaaatagttgggtatgtttaatccgtacaacagaggagagtacggatgaaacataccaacctggcggcagcgcaaaagatg

SEQ ID NO: 57241 - DNA, 103 bp, Artificial Sequence
  Synthetic Polynucleotide
taatacgactcactatagggcaatttctaaatagttgggtatgtttaatcaacagaggagagattaaatgtacccaactaacctggcggcagcgcaaaagatg

SEQ ID NO: 57242 - DNA, 103 bp, Artificial Sequence
  Synthetic Polynucleotide
taatacgactcactatagggtatttcaatttctaaatagttgggtatgttaacagaggagaaacataatgaactatttaaacctggcggcagcgcaaaagatg

SEQ ID NO: 57243 - DNA, 103 bp, Artificial Sequence
  Synthetic Polynucleotide
taatacgactcactatagggtcctctatttcaatttctaaatagttgggtaacagaggagaacccaaatgtttagaaataacctggcggcagcgcaaaagatg

SEQ ID NO: 57244 - DNA, 103 bp, Artificial Sequence
  Synthetic Polynucleotide
taatacgactcactatagggtgtcttcctctatttcaatttctaaatagtaacagaggagaactattatgaaattgaaaaacctggcggcagcgcaaaagatg

SEQ ID NO: 57245 - DNA, 103 bp, Artificial Sequence
  Synthetic Polynucleotide
taatacgactcactatagggtaatgtgtcttcctctatttcaatttctaaaacagaggagattagaaatggaaatagagaacctggcggcagcgcaaaagatg

SEQ ID NO: 57246 - DNA, 103 bp, Artificial Sequence
  Synthetic Polynucleotide
taatacgactcactatagggtcaaataatgtgtcttcctctatttcaattaacagaggagaaattgaatgagaggaagaaacctggcggcagcgcaaaagatg

SEQ ID NO: 57247 - DNA, 103 bp, Artificial Sequence
  Synthetic Polynucleotide
taatacgactcactatagggcgtcgtcaaataatgtgtcttcctctatttaacagaggagaaaatagatgaagacacataacctggcggcagcgcaaaagatg

SEQ ID NO: 57248 - DNA, 103 bp, Artificial Sequence
  Synthetic Polynucleotide
taatacgactcactatagggcccaaggcacctatttgcgaatctgttaaaaacagaggagatttaacatgttcgcaaataacctggcggcagcgcaaaagatg

SEQ ID NO: 57249 - DNA, 103 bp, Artificial Sequence
  Synthetic Polynucleotide
taatacgactcactatagggtaactcgtcgtcaaataatgtgtcttcctcaacagaggagagaggaaatgacattatttaacctggcggcagcgcaaaagatg

SEQ ID NO: 57250 - DNA, 103 bp, Artificial Sequence
  Synthetic Polynucleotide
taatacgactcactataggggagtataactcgtcgtcaaataatgtgtctaacagaggagaagacacatgatttgacgaaacctggcggcagcgcaaaagatg

SEQ ID NO: 57251 - DNA, 103 bp, Artificial Sequence
  Synthetic Polynucleotide
taatacgactcactatagggtaatagagtataactcgtcgtcaaataatgaacagaggagacattatatgacgacgagtaacctggcggcagcgcaaaagatg

SEQ ID NO: 57252 - DNA, 103 bp, Artificial Sequence
  Synthetic Polynucleotide
taatacgactcactatagggttctataatagagtataactcgtcgtcaaaaacagaggagatttgacatggagttatacaacctggcggcagcgcaaaagatg

SEQ ID NO: 57253 - DNA, 103 bp, Artificial Sequence
  Synthetic Polynucleotide
taatacgactcactataggggagcgttctataatagagtataactcgtcgaacagaggagacgacgaatgatactctataacctggcggcagcgcaaaagatg

SEQ ID NO: 57254 - DNA, 103 bp, Artificial Sequence
  Synthetic Polynucleotide
taatacgactcactatagggcgaaagagcgttctataatagagtataactaacagaggagaagttatatgctattatagaacctggcggcagcgcaaaagatg

SEQ ID NO: 57255 - DNA, 103 bp, Artificial Sequence
  Synthetic Polynucleotide
taatacgactcactatagggatcatcgaaagagcgttctataatagagtaaacagaggagatactctatgatagaacgcaacctggcggcagcgcaaaagatg

SEQ ID NO: 57256 - DNA, 103 bp, Artificial Sequence
  Synthetic Polynucleotide
taatacgactcactatagggaaattatcatcgaaagagcgttctataataaacagaggagatattatatgacgctctttaacctggcggcagcgcaaaagatg

SEQ ID NO: 57257 - DNA, 103 bp, Artificial Sequence
  Synthetic Polynucleotide
taatacgactcactatagggttggaaaattatcatcgaaagagcgttctaaacagaggagatagaacatgctttcgatgaacctggcggcagcgcaaaagatg

SEQ ID NO: 57258 - DNA, 103 bp, Artificial Sequence
  Synthetic Polynucleotide
taatacgactcactatagggtatttttggaaaattatcatcgaaagagcgaacagaggagacgctctatggatgataataacctggcggcagcgcaaaagatg

SEQ ID NO: 57259 - DNA, 103 bp, Artificial Sequence
  Synthetic Polynucleotide
taatacgactcactatagggggaatcccaaggcacctatttgcgaatctgaacagaggagacagattatgaaataggtgaacctggcggcagcgcaaaagatg

SEQ ID NO: 57260 - DNA, 103 bp, Artificial Sequence
  Synthetic Polynucleotide
taatacgactcactatagggatggatatttttggaaaattatcatcgaaaaacagaggagatttcgaatgtaattttccaacctggcggcagcgcaaaagatg

SEQ ID NO: 57261 - DNA, 103 bp, Artificial Sequence
  Synthetic Polynucleotide
taatacgactcactatagggacgatatggatatttttggaaaattatcataacagaggagaatgataatgttccaaaaaaacctggcggcagcgcaaaagatg

SEQ ID NO: 57262 - DNA, 103 bp, Artificial Sequence
  Synthetic Polynucleotide
taatacgactcactatagggaatatacgatatggatatttttggaaaattaacagaggagaaattttatgaaaatatccaacctggcggcagcgcaaaagatg

SEQ ID NO: 57263 - DNA, 103 bp, Artificial Sequence
  Synthetic Polynucleotide
taatacgactcactatagggaacttaatatacgatatggatatttttggaaacagaggagatccaaaatgatccatatcaacctggcggcagcgcaaaagatg

SEQ ID NO: 57264 - DNA, 103 bp, Artificial Sequence
  Synthetic Polynucleotide
taatacgactcactatagggctcccaacttaatatacgatatggatatttaacagaggagaaaatatatgtatcgtataaacctggcggcagcgcaaaagatg

SEQ ID NO: 57265 - DNA, 103 bp, Artificial Sequence
  Synthetic Polynucleotide
taatacgactcactatagggaagttctcccaacttaatatacgatatggaaacagaggagatccataatgtatattaagaacctggcggcagcgcaaaagatg

SEQ ID NO: 57266 - DNA, 103 bp, Artificial Sequence
  Synthetic Polynucleotide
taatacgactcactatagggcgcctaagttctcccaacttaatatacgataacagaggagaatcgtaatgtaagttgggaacctggcggcagcgcaaaagatg

SEQ ID NO: 57267 - DNA, 103 bp, Artificial Sequence
  Synthetic Polynucleotide
taatacgactcactatagggcttgccgcctaagttctcccaacttaatataacagaggagaatattaatgtgggagaacaacctggcggcagcgcaaaagatg

SEQ ID NO: 57268 - DNA, 103 bp, Artificial Sequence
  Synthetic Polynucleotide
taatacgactcactatagggtacaacttgccgcctaagttctcccaacttaacagaggagaaagttgatggaacttaggaacctggcggcagcgcaaaagatg

SEQ ID NO: 57269 - DNA, 103 bp, Artificial Sequence
  Synthetic Polynucleotide
taatacgactcactatagggaagtctacaacttgccgcctaagttctcccaacagaggagagggagaatgtaggcggcaaacctggcggcagcgcaaaagatg

SEQ ID NO: 57270 - DNA, 103 bp, Artificial Sequence
  Synthetic Polynucleotide
taatacgactcactatagggggtatggaatcccaaggcacctatttgcgaaacagaggagatcgcaaatgggtgccttgaacctggcggcagcgcaaaagatg

SEQ ID NO: 57271 - DNA, 103 bp, Artificial Sequence
  Synthetic Polynucleotide
taatacgactcactatagggtgaaaaagtctacaacttgccgcctaagttaacagaggagaaacttaatgggcaagttgaacctggcggcagcgcaaaagatg

SEQ ID NO: 57272 - DNA, 103 bp, Artificial Sequence
  Synthetic Polynucleotide
taatacgactcactataggggaatttgaaaaagtctacaacttgccgcctaacagaggagaaggcggatggttgtagacaacctggcggcagcgcaaaagatg

SEQ ID NO: 57273 - DNA, 103 bp, Artificial Sequence
  Synthetic Polynucleotide
taatacgactcactatagggaatgagaatttgaaaaagtctacaacttgcaacagaggagagcaagtatgagactttttaacctggcggcagcgcaaaagatg

SEQ ID NO: 57274 - DNA, 103 bp, Artificial Sequence
  Synthetic Polynucleotide
taatacgactcactatagggacatgaatgagaatttgaaaaagtctacaaaacagaggagattgtagatgttttcaaataacctggcggcagcgcaaaagatg

SEQ ID NO: 57275 - DNA, 103 bp, Artificial Sequence
  Synthetic Polynucleotide
taatacgactcactatagggaatatacatgaatgagaatttgaaaaagtcaacagaggagagactttatgaaattctcaaacctggcggcagcgcaaaagatg

SEQ ID NO: 57276 - DNA, 103 bp, Artificial Sequence
  Synthetic Polynucleotide
taatacgactcactataggggactcaatatacatgaatgagaatttgaaaaacagaggagatttcaaatgctcattcataacctggcggcagcgcaaaagatg

SEQ ID NO: 57277 - DNA, 103 bp, Artificial Sequence
  Synthetic Polynucleotide
taatacgactcactatagggtgatggactcaatatacatgaatgagaattaacagaggagaaattctatgtcatgtataaacctggcggcagcgcaaaagatg

SEQ ID NO: 57278 - DNA, 103 bp, Artificial Sequence
  Synthetic Polynucleotide
taatacgactcactatagggtaccttgatggactcaatatacatgaatgaaacagaggagatcattcatgtatattgagaacctggcggcagcgcaaaagatg

SEQ ID NO: 57279 - DNA, 103 bp, Artificial Sequence
  Synthetic Polynucleotide
taatacgactcactatagggcgatctaccttgatggactcaatatacatgaacagaggagacatgtaatgtgagtccataacctggcggcagcgcaaaagatg

SEQ ID NO: 57280 - DNA, 103 bp, Artificial Sequence
  Synthetic Polynucleotide
taatacgactcactatagggctatacgatctaccttgatggactcaatataacagaggagaatattgatgccatcaaggaacctggcggcagcgcaaaagatg

SEQ ID NO: 57281 - DNA, 103 bp, Artificial Sequence
  Synthetic Polynucleotide
taatacgactcactatagggtctatggtatggaatcccaaggcacctattaacagaggagaaataggatgcttgggattaacctggcggcagcgcaaaagatg

SEQ ID NO: 57282 - DNA, 103 bp, Artificial Sequence
  Synthetic Polynucleotide
taatacgactcactatagggatcccctatacgatctaccttgatggactcaacagaggagagagtccatgaaggtagataacctggcggcagcgcaaaagatg

SEQ ID NO: 57283 - DNA, 103 bp, Artificial Sequence
  Synthetic Polynucleotide
taatacgactcactatagggatattatcccctatacgatctaccttgatgaacagaggagacatcaaatgagatcgtataacctggcggcagcgcaaaagatg

SEQ ID NO: 57284 - DNA, 103 bp, Artificial Sequence
  Synthetic Polynucleotide
taatacgactcactatagggtaaaaatattatcccctatacgatctacctaacagaggagaaggtagatggtataggggaacctggcggcagcgcaaaagatg

SEQ ID NO: 57285 - DNA, 103 bp, Artificial Sequence
  Synthetic Polynucleotide
taatacgactcactatagggaggaataaaaatattatcccctatacgatcaacagaggagagatcgtatgggggataataacctggcggcagcgcaaaagatg

SEQ ID NO: 57286 - DNA, 103 bp, Artificial Sequence
  Synthetic Polynucleotide
taatacgactcactatagggacgctaggaataaaaatattatcccctataaacagaggagatataggatgtaatattttaacctggcggcagcgcaaaagatg

SEQ ID NO: 57287 - DNA, 103 bp, Artificial Sequence
  Synthetic Polynucleotide
taatacgactcactatagggttataacgctaggaataaaaatattatcccaacagaggagagggataatgtttttattcaacctggcggcagcgcaaaagatg

SEQ ID NO: 57288 - DNA, 103 bp, Artificial Sequence
  Synthetic Polynucleotide
taatacgactcactatagggttttgttataacgctaggaataaaaatattaacagaggagaaatattatgattcctagcaacctggcggcagcgcaaaagatg

SEQ ID NO: 57289 - DNA, 103 bp, Artificial Sequence
  Synthetic Polynucleotide
taatacgactcactatagggcctgattttgttataacgctaggaataaaaaacagaggagattttatatgtagcgttataacctggcggcagcgcaaaagatg

SEQ ID NO: 57290 - DNA, 103 bp, Artificial Sequence
  Synthetic Polynucleotide
taatacgactcactatagggtttttcctgattttgttataacgctaggaaaacagaggagattcctaatgttataacaaaacctggcggcagcgcaaaagatg

SEQ ID NO: 57291 - DNA, 103 bp, Artificial Sequence
  Synthetic Polynucleotide
taatacgactcactatagggtatcttttttcctgattttgttataacgctaacagaggagaagcgttatgacaaaatcaaacctggcggcagcgcaaaagatg

SEQ ID NO: 57292 - DNA, 103 bp, Artificial Sequence
  Synthetic Polynucleotide
taatacgactcactatagggctggatctatggtatggaatcccaaggcacaacagaggagagtgcctatggattccataaacctggcggcagcgcaaaagatg

SEQ ID NO: 57293 - DNA, 103 bp, Artificial Sequence
  Synthetic Polynucleotide
taatacgactcactatagggactaatatcttttttcctgattttgttataaacagaggagatataacatgatcaggaaaaacctggcggcagcgcaaaagatg

SEQ ID NO: 57294 - DNA, 103 bp, Artificial Sequence
  Synthetic Polynucleotide
taatacgactcactatagggcttttactaatatcttttttcctgattttgaacagaggagacaaaatatggaaaaaagaaacctggcggcagcgcaaaagatg

SEQ ID NO: 57295 - DNA, 103 bp, Artificial Sequence
  Synthetic Polynucleotide
taatacgactcactatagggtacatcttttactaatatcttttttcctgaaacagaggagatcaggaatgaagatattaaacctggcggcagcgcaaaagatg

SEQ ID NO: 57296 - DNA, 103 bp, Artificial Sequence
  Synthetic Polynucleotide
taatacgactcactatagggtggtctacatcttttactaatatcttttttaacagaggagaaaaaaaatgattagtaaaaacctggcggcagcgcaaaagatg

SEQ ID NO: 57297 - DNA, 103 bp, Artificial Sequence
  Synthetic Polynucleotide
taatacgactcactatagggttaaatggtctacatcttttactaatatctaacagaggagaagatatatgtaaaagatgaacctggcggcagcgcaaaagatg

SEQ ID NO: 57298 - DNA, 103 bp, Artificial Sequence
  Synthetic Polynucleotide
taatacgactcactatagggtcgtattaaatggtctacatcttttactaaaacagaggagattagtaatggatgtagacaacctggcggcagcgcaaaagatg

SEQ ID NO: 57299 - DNA, 103 bp, Artificial Sequence
  Synthetic Polynucleotide
taatacgactcactatagggttggatcgtattaaatggtctacatcttttaacagaggagaaaaagaatgagaccatttaacctggcggcagcgcaaaagatg

SEQ ID NO: 57300 - DNA, 103 bp, Artificial Sequence
  Synthetic Polynucleotide
taatacgactcactatagggtaaccttggatcgtattaaatggtctacataacagaggagaatgtagatgatttaatacaacctggcggcagcgcaaaagatg

SEQ ID NO: 57301 - DNA, 103 bp, Artificial Sequence
  Synthetic Polynucleotide
taatacgactcactatagggttctctaaccttggatcgtattaaatggtcaacagaggagagaccatatgatacgatccaacctggcggcagcgcaaaagatg

SEQ ID NO: 57302 - DNA, 103 bp, Artificial Sequence
  Synthetic Polynucleotide
taatacgactcactataggggtatgttctctaaccttggatcgtattaaaaacagaggagatttaatatgatccaaggtaacctggcggcagcgcaaaagatg

SEQ ID NO: 57303 - DNA, 103 bp, Artificial Sequence
  Synthetic Polynucleotide
taatacgactcactatagggatctactggatctatggtatggaatcccaaaacagaggagattgggaatgcataccataaacctggcggcagcgcaaaagatg

SEQ ID NO: 57304 - DNA, 103 bp, Artificial Sequence
  Synthetic Polynucleotide
taatacgactcactatagggcaaatgtatgttctctaaccttggatcgtaaacagaggagatacgatatgaggttagagaacctggcggcagcgcaaaagatg

SEQ ID NO: 57305 - DNA, 103 bp, Artificial Sequence
  Synthetic Polynucleotide
taatacgactcactatagggttttacaaatgtatgttctctaaccttggaaacagaggagatccaagatgagagaacataacctggcggcagcgcaaaagatg

SEQ ID NO: 57306 - DNA, 103 bp, Artificial Sequence
  Synthetic Polynucleotide
taatacgactcactatagggtttacttttacaaatgtatgttctctaaccaacagaggagaggttagatgacatacattaacctggcggcagcgcaaaagatg

SEQ ID NO: 57307 - DNA, 103 bp, Artificial Sequence
  Synthetic Polynucleotide
taatacgactcactatagggtcttttttacttttacaaatgtatgttctcaacagaggagagagaacatgcatttgtaaaacctggcggcagcgcaaaagatg

SEQ ID NO: 57308 - DNA, 103 bp, Artificial Sequence
  Synthetic Polynucleotide
taatacgactcactataggggtttttcttttttacttttacaaatgtatgaacagaggagacatacaatggtaaaagtaaacctggcggcagcgcaaaagatg

SEQ ID NO: 57309 - DNA, 103 bp, Artificial Sequence
  Synthetic Polynucleotide
taatacgactcactatagggaatgtgtttttcttttttacttttacaaataacagaggagaatttgtatgagtaaaaaaaacctggcggcagcgcaaaagatg

SEQ ID NO: 57310 - DNA, 103 bp, Artificial Sequence
  Synthetic Polynucleotide
taatacgactcactatagggtggaaaatgtgtttttcttttttacttttaaacagaggagataaaagatgaaaagaaaaaacctggcggcagcgcaaaagatg

SEQ ID NO: 57311 - DNA, 103 bp, Artificial Sequence
  Synthetic Polynucleotide
taatacgactcactatagggtaaaatggaaaatgtgtttttcttttttacaacagaggagagtaaaaatgaaaaacacaaacctggcggcagcgcaaaagatg

SEQ ID NO: 57312 - DNA, 103 bp, Artificial Sequence
  Synthetic Polynucleotide
taatacgactcactatagggtcgtataaaatggaaaatgtgtttttctttaacagaggagaaaagaaatgcacattttcaacctggcggcagcgcaaaagatg

SEQ ID NO: 57313 - DNA, 103 bp, Artificial Sequence
  Synthetic Polynucleotide
taatacgactcactatagggcatagtcgtataaaatggaaaatgtgttttaacagaggagaaaaacaatgtttccatttaacctggcggcagcgcaaaagatg

SEQ ID NO: 57314 - DNA, 103 bp, Artificial Sequence
  Synthetic Polynucleotide
taatacgactcactatagggttaggatctactggatctatggtatggaataacagaggagaattccaatgcatagatccaacctggcggcagcgcaaaagatg

SEQ ID NO: 57315 - DNA, 103 bp, Artificial Sequence
  Synthetic Polynucleotide
taatacgactcactatagggcccatcatagtcgtataaaatggaaaatgtaacagaggagaacatttatgattttatacaacctggcggcagcgcaaaagatg

SEQ ID NO: 57316 - DNA, 103 bp, Artificial Sequence
  Synthetic Polynucleotide
taatacgactcactatagggccgttcccatcatagtcgtataaaatggaaaacagaggagattccatatgatacgactaaacctggcggcagcgcaaaagatg

SEQ ID NO: 57317 - DNA, 103 bp, Artificial Sequence
  Synthetic Polynucleotide
taatacgactcactatagggctgttccgttcccatcatagtcgtataaaaaacagaggagattttatatgactatgatgaacctggcggcagcgcaaaagatg

SEQ ID NO: 57318 - DNA, 103 bp, Artificial Sequence
  Synthetic Polynucleotide
taatacgactcactatagggagtttctgttccgttcccatcatagtcgtaaacagaggagatacgacatggatgggaacaacctggcggcagcgcaaaagatg

SEQ ID NO: 57319 - DNA, 103 bp, Artificial Sequence
  Synthetic Polynucleotide
taatacgactcactatagggcctctagtttctgttccgttcccatcatagaacagaggagactatgaatggaacggaacaacctggcggcagcgcaaaagatg

SEQ ID NO: 57320 - DNA, 103 bp, Artificial Sequence
  Synthetic Polynucleotide
taatacgactcactatagggcttctcctctagtttctgttccgttcccataacagaggagaatgggaatggaacagaaaaacctggcggcagcgcaaaagatg

SEQ ID NO: 57321 - DNA, 103 bp, Artificial Sequence
  Synthetic Polynucleotide
taatacgactcactatagggtattacttctcctctagtttctgttccgttaacagaggagaaacggaatggaaactagaaacctggcggcagcgcaaaagatg

SEQ ID NO: 57322 - DNA, 103 bp, Artificial Sequence
  Synthetic Polynucleotide
taatacgactcactatagggcgttttattacttctcctctagtttctgttaacagaggagaaacagaatgtagaggagaaacctggcggcagcgcaaaagatg

SEQ ID NO: 57323 - DNA, 103 bp, Artificial Sequence
  Synthetic Polynucleotide
taatacgactcactatagggtaattcgttttattacttctcctctagtttaacagaggagaaaactaatggagaagtaaaacctggcggcagcgcaaaagatg

SEQ ID NO: 57324 - DNA, 103 bp, Artificial Sequence
  Synthetic Polynucleotide
taatacgactcactataggggtctataattcgttttattacttctcctctaacagaggagaagaggaatggtaataaaaaacctggcggcagcgcaaaagatg

SEQ ID NO: 57325 - DNA, 103 bp, Artificial Sequence
  Synthetic Polynucleotide
taatacgactcactataggggtaaattaggatctactggatctatggtataacagaggagaataccaatgatccagtagaacctggcggcagcgcaaaagatg

SEQ ID NO: 57326 - DNA, 103 bp, Artificial Sequence
  Synthetic Polynucleotide
taatacgactcactatagggatagtgtctataattcgttttattacttctaacagaggagaagaagtatgaaaacgaataacctggcggcagcgcaaaagatg

SEQ ID NO: 57327 - DNA, 103 bp, Artificial Sequence
  Synthetic Polynucleotide
taatacgactcactataggggtcctatagtgtctataattcgttttattaaacagaggagataataaatggaattatagaacctggcggcagcgcaaaagatg

SEQ ID NO: 57328 - DNA, 103 bp, Artificial Sequence
  Synthetic Polynucleotide
taatacgactcactataggggtctcgtcctatagtgtctataattcgtttaacagaggagaaaacgaatgatagacactaacctggcggcagcgcaaaagatg

SEQ ID NO: 57329 - DNA, 103 bp, Artificial Sequence
  Synthetic Polynucleotide
taatacgactcactatagggtaatagtctcgtcctatagtgtctataattaacagaggagaaattatatgcactataggaacctggcggcagcgcaaaagatg

SEQ ID NO: 57330 - DNA, 103 bp, Artificial Sequence
  Synthetic Polynucleotide
taatacgactcactatagggtaacataatagtctcgtcctatagtgtctaaacagaggagatagacaatgtaggacgagaacctggcggcagcgcaaaagatg

SEQ ID NO: 57331 - DNA, 103 bp, Artificial Sequence
  Synthetic Polynucleotide
taatacgactcactatagggtccgttaacataatagtctcgtcctatagtaacagaggagaactataatgcgagactataacctggcggcagcgcaaaagatg

SEQ ID NO: 57332 - DNA, 103 bp, Artificial Sequence
  Synthetic Polynucleotide
taatacgactcactatagggtactttccgttaacataatagtctcgtcctaacagaggagaaggacgatgctattatgtaacctggcggcagcgcaaaagatg

SEQ ID NO: 57333 - DNA, 103 bp, Artificial Sequence
  Synthetic Polynucleotide
taatacgactcactatagggagaaatactttccgttaacataatagtctcaacagaggagagagactatgatgttaacgaacctggcggcagcgcaaaagatg

SEQ ID NO: 57334 - DNA, 103 bp, Artificial Sequence
  Synthetic Polynucleotide
taatacgactcactatagggcttagagaaatactttccgttaacataataaacagaggagatattatatgaacggaaagaacctggcggcagcgcaaaagatg

SEQ ID NO: 57335 - DNA, 103 bp, Artificial Sequence
  Synthetic Polynucleotide
taatacgactcactatagggccaaccttagagaaatactttccgttaacaaacagaggagatgttaaatgaaagtatttaacctggcggcagcgcaaaagatg

SEQ ID NO: 57336 - DNA, 103 bp, Artificial Sequence
  Synthetic Polynucleotide
taatacgactcactataggggtattgtaaattaggatctactggatctataacagaggagaatagatatggtagatcctaacctggcggcagcgcaaaagatg

SEQ ID NO: 57337 - DNA, 103 bp, Artificial Sequence
  Synthetic Polynucleotide
taatacgactcactatagggcactaccaaccttagagaaatactttccgtaacagaggagaacggaaatgatttctctaaacctggcggcagcgcaaaagatg

SEQ ID NO: 57338 - DNA, 103 bp, Artificial Sequence
  Synthetic Polynucleotide
taatacgactcactataggggcccgcactaccaaccttagagaaatacttaacagaggagaaagtatatgtctaaggttaacctggcggcagcgcaaaagatg

SEQ ID NO: 57339 - DNA, 103 bp, Artificial Sequence
  Synthetic Polynucleotide
taatacgactcactatagggtttaagcccgcactaccaaccttagagaaaaacagaggagatttctcatgggttggtagaacctggcggcagcgcaaaagatg

SEQ ID NO: 57340 - DNA, 103 bp, Artificial Sequence
  Synthetic Polynucleotide
taatacgactcactatagggattgctttaagcccgcactaccaaccttagaacagaggagactaaggatggtagtgcggaacctggcggcagcgcaaaagatg

SEQ ID NO: 57341 - DNA, 103 bp, Artificial Sequence
  Synthetic Polynucleotide
taatacgactcactatagggagtcaattgctttaagcccgcactaccaacaacagaggagagttggtatggcgggcttaaacctggcggcagcgcaaaagatg

SEQ ID NO: 57342 - DNA, 103 bp, Artificial Sequence
  Synthetic Polynucleotide
taatacgactcactatagggttattagtcaattgctttaagcccgcactaaacagaggagatagtgcatgcttaaagcaaacctggcggcagcgcaaaagatg

SEQ ID NO: 57343 - DNA, 103 bp, Artificial Sequence
  Synthetic Polynucleotide
taatacgactcactatagggttaatttattagtcaattgctttaagcccgaacagaggagacgggctatgagcaattgaaacctggcggcagcgcaaaagatg

SEQ ID NO: 57344 - DNA, 103 bp, Artificial Sequence
  Synthetic Polynucleotide
taatacgactcactatagggaatatttaatttattagtcaattgctttaaaacagaggagattaaagatgttgactaataacctggcggcagcgcaaaagatg

SEQ ID NO: 57345 - DNA, 103 bp, Artificial Sequence
  Synthetic Polynucleotide
taatacgactcactatagggtcattaatatttaatttattagtcaattgcaacagaggagagcaattatgtaataaattaacctggcggcagcgcaaaagatg

SEQ ID NO: 57346 - DNA, 103 bp, Artificial Sequence
  Synthetic Polynucleotide
taatacgactcactatagggtgcactcattaatatttaatttattagtcaaacagaggagatgactaatgaattaaataaacctggcggcagcgcaaaagatg

SEQ ID NO: 57347 - DNA, 103 bp, Artificial Sequence
  Synthetic Polynucleotide
taatacgactcactatagggagattgaaacgtgttataacttatcaaaacaacagaggagagttttgatgagttataacaacctggcggcagcgcaaaagatg

SEQ ID NO: 57348 - DNA, 103 bp, Artificial Sequence
  Synthetic Polynucleotide
taatacgactcactatagggacacaataatgatagcgacagtaatgattaaacagaggagataatcaatgctgtcgctaaacctggcggcagcgcaaaagatg

SEQ ID NO: 57349 - DNA, 103 bp, Artificial Sequence
  Synthetic Polynucleotide
taatacgactcactatagggaaatcgtattgtaaattaggatctactggaaacagaggagatccagtatgtcctaatttaacctggcggcagcgcaaaagatg

SEQ ID NO: 57350 - DNA, 103 bp, Artificial Sequence
  Synthetic Polynucleotide
taatacgactcactatagggagttgtgcactcattaatatttaatttattaacagaggagaaataaaatgaatattaataacctggcggcagcgcaaaagatg

SEQ ID NO: 57351 - DNA, 103 bp, Artificial Sequence
  Synthetic Polynucleotide
taatacgactcactatagggtcgacagttgtgcactcattaatatttaataacagaggagaattaaaatgtaatgagtgaacctggcggcagcgcaaaagatg

SEQ ID NO: 57352 - DNA, 103 bp, Artificial Sequence
  Synthetic Polynucleotide
taatacgactcactatagggactcatcgacagttgtgcactcattaatataacagaggagaatattaatgagtgcacaaaacctggcggcagcgcaaaagatg

SEQ ID NO: 57353 - DNA, 103 bp, Artificial Sequence
  Synthetic Polynucleotide
taatacgactcactatagggaactaactcatcgacagttgtgcactcattaacagaggagaaatgagatgacaactgtcaacctggcggcagcgcaaaagatg

SEQ ID NO: 57354 - DNA, 103 bp, Artificial Sequence
  Synthetic Polynucleotide
taatacgactcactatagggtcatcaactaactcatcgacagttgtgcacaacagaggagagtgcacatgtgtcgatgaaacctggcggcagcgcaaaagatg

SEQ ID NO: 57355 - DNA, 103 bp, Artificial Sequence
  Synthetic Polynucleotide
taatacgactcactatagggtaatctcatcaactaactcatcgacagttgaacagaggagacaactgatgatgagttagaacctggcggcagcgcaaaagatg

SEQ ID NO: 57356 - DNA, 103 bp, Artificial Sequence
  Synthetic Polynucleotide
taatacgactcactatagggtttattaatctcatcaactaactcatcgacaacagaggagagtcgatatgttagttgataacctggcggcagcgcaaaagatg

SEQ ID NO: 57357 - DNA, 103 bp, Artificial Sequence
  Synthetic Polynucleotide
taatacgactcactatagggccggatttattaatctcatcaactaactcaaacagaggagatgagttatgtgatgagataacctggcggcagcgcaaaagatg

SEQ ID NO: 57358 - DNA, 103 bp, Artificial Sequence
  Synthetic Polynucleotide
taatacgactcactatagggcagttccggatttattaatctcatcaactaaacagaggagatagttgatgagattaataaacctggcggcagcgcaaaagatg

SEQ ID NO: 57359 - DNA, 103 bp, Artificial Sequence
  Synthetic Polynucleotide
taatacgactcactatagggttttacagttccggatttattaatctcatcaacagaggagagatgagatgaataaatccaacctggcggcagcgcaaaagatg

SEQ ID NO: 57360 - DNA, 103 bp, Artificial Sequence
  Synthetic Polynucleotide
taatacgactcactatagggaatataaatcgtattgtaaattaggatctaaacagaggagatagatcatgatttacaataacctggcggcagcgcaaaagatg

SEQ ID NO: 57361 - DNA, 103 bp, Artificial Sequence
  Synthetic Polynucleotide
taatacgactcactatagggtttcgttttacagttccggatttattaatcaacagaggagagattaaatgatccggaacaacctggcggcagcgcaaaagatg

SEQ ID NO: 57362 - DNA, 103 bp, Artificial Sequence
  Synthetic Polynucleotide
taatacgactcactatagggttatttttcgttttacagttccggatttataacagaggagaataaatatggaactgtaaaacctggcggcagcgcaaaagatg

SEQ ID NO: 57363 - DNA, 103 bp, Artificial Sequence
  Synthetic Polynucleotide
taatacgactcactatagggggtttttatttttcgttttacagttccggaaacagaggagatccggaatggtaaaacgaaacctggcggcagcgcaaaagatg

SEQ ID NO: 57364 - DNA, 103 bp, Artificial Sequence
  Synthetic Polynucleotide
taatacgactcactataggggattgggtttttatttttcgttttacagttaacagaggagaaactgtatgacgaaaaataacctggcggcagcgcaaaagatg

SEQ ID NO: 57365 - DNA, 103 bp, Artificial Sequence
  Synthetic Polynucleotide
taatacgactcactatagggatgctgattgggtttttatttttcgttttaaacagaggagataaaacatgaaataaaaaaacctggcggcagcgcaaaagatg

SEQ ID NO: 57366 - DNA, 103 bp, Artificial Sequence
  Synthetic Polynucleotide
taatacgactcactatagggatcaaatgctgattgggtttttatttttcgaacagaggagacgaaaaatgaaaacccaaaacctggcggcagcgcaaaagatg

SEQ ID NO: 57367 - DNA, 103 bp, Artificial Sequence
  Synthetic Polynucleotide
taatacgactcactatagggcttaaatcaaatgctgattgggtttttattaacagaggagaaataaaatgccaatcagcaacctggcggcagcgcaaaagatg

SEQ ID NO: 57368 - DNA, 103 bp, Artificial Sequence
  Synthetic Polynucleotide
taatacgactcactatagggctctacttaaatcaaatgctgattgggtttaacagaggagaaaacccatgcagcatttgaacctggcggcagcgcaaaagatg

SEQ ID NO: 57369 - DNA, 103 bp, Artificial Sequence
  Synthetic Polynucleotide
taatacgactcactatagggacattctctacttaaatcaaatgctgattgaacagaggagacaatcaatgtttgatttaaacctggcggcagcgcaaaagatg

SEQ ID NO: 57370 - DNA, 103 bp, Artificial Sequence
  Synthetic Polynucleotide
taatacgactcactatagggcccaaacattctctacttaaatcaaatgctaacagaggagaagcattatgtttaagtagaacctggcggcagcgcaaaagatg

SEQ ID NO: 57371 - DNA, 103 bp, Artificial Sequence
  Synthetic Polynucleotide
taatacgactcactatagggtggtgaatataaatcgtattgtaaattaggaacagaggagacctaatatgcaatacgataacctggcggcagcgcaaaagatg

SEQ ID NO: 57372 - DNA, 103 bp, Artificial Sequence
  Synthetic Polynucleotide
taatacgactcactataggggatatcccaaacattctctacttaaatcaaaacagaggagattgattatggtagagaataacctggcggcagcgcaaaagatg

SEQ ID NO: 57373 - DNA, 103 bp, Artificial Sequence
  Synthetic Polynucleotide
taatacgactcactatagggttctggatatcccaaacattctctacttaaaacagaggagattaagtatggaatgtttgaacctggcggcagcgcaaaagatg

SEQ ID NO: 57374 - DNA, 103 bp, Artificial Sequence
  Synthetic Polynucleotide
taatacgactcactatagggtccgcttctggatatcccaaacattctctaaacagaggagatagagaatgtttgggataaacctggcggcagcgcaaaagatg

SEQ ID NO: 57375 - DNA, 103 bp, Artificial Sequence
  Synthetic Polynucleotide
taatacgactcactatagggtaaaatccgcttctggatatcccaaacattaacagaggagaaatgttatggatatccagaacctggcggcagcgcaaaagatg

SEQ ID NO: 57376 - DNA, 103 bp, Artificial Sequence
  Synthetic Polynucleotide
taatacgactcactatagggcgttataaaatccgcttctggatatcccaaaacagaggagattgggaatgccagaagcgaacctggcggcagcgcaaaagatg

SEQ ID NO: 57377 - DNA, 103 bp, Artificial Sequence
  Synthetic Polynucleotide
taatacgactcactatagggactaacgttataaaatccgcttctggatataacagaggagaatatccatgagcggatttaacctggcggcagcgcaaaagatg

SEQ ID NO: 57378 - DNA, 103 bp, Artificial Sequence
  Synthetic Polynucleotide
taatacgactcactatagggtattaactaacgttataaaatccgcttctgaacagaggagacagaagatgattttataaaacctggcggcagcgcaaaagatg

SEQ ID NO: 57379 - DNA, 103 bp, Artificial Sequence
  Synthetic Polynucleotide
taatacgactcactatagggcatgttattaactaacgttataaaatccgcaacagaggagagcggatatgataacgttaaacctggcggcagcgcaaaagatg

SEQ ID NO: 57380 - DNA, 103 bp, Artificial Sequence
  Synthetic Polynucleotide
taatacgactcactatagggaaccgcatgttattaactaacgttataaaaaacagaggagattttatatggttagttaaaacctggcggcagcgcaaaagatg

SEQ ID NO: 57381 - DNA, 103 bp, Artificial Sequence
  Synthetic Polynucleotide
taatacgactcactatagggttttgaaccgcatgttattaactaacgttaaacagaggagataacgtatgttaataacaaacctggcggcagcgcaaaagatg

SEQ ID NO: 57382 - DNA, 103 bp, Artificial Sequence
  Synthetic Polynucleotide
taatacgactcactatagggttgattggtgaatataaatcgtattgtaaaaacagaggagatttacaatgcgatttataaacctggcggcagcgcaaaagatg

SEQ ID NO: 57383 - DNA, 103 bp, Artificial Sequence
  Synthetic Polynucleotide
taatacgactcactatagggttctattttgaaccgcatgttattaactaaaacagaggagattagttatgaacatgcggaacctggcggcagcgcaaaagatg

SEQ ID NO: 57384 - DNA, 103 bp, Artificial Sequence
  Synthetic Polynucleotide
taatacgactcactatagggcaattttctattttgaaccgcatgttattaaacagaggagataataaatggcggttcaaaacctggcggcagcgcaaaagatg

SEQ ID NO: 57385 - DNA, 103 bp, Artificial Sequence
  Synthetic Polynucleotide
taatacgactcactatagggccttacaattttctattttgaaccgcatgtaacagaggagaacatgcatgtcaaaatagaacctggcggcagcgcaaaagatg

SEQ ID NO: 57386 - DNA, 103 bp, Artificial Sequence
  Synthetic Polynucleotide
taatacgactcactatagggtacaaccttacaattttctattttgaaccgaacagaggagacggttcatgatagaaaataacctggcggcagcgcaaaagatg

SEQ ID NO: 57387 - DNA, 103 bp, Artificial Sequence
  Synthetic Polynucleotide
taatacgactcactatagggaaatttacaaccttacaattttctattttgaacagaggagacaaaatatgaaattgtaaaacctggcggcagcgcaaaagatg

SEQ ID NO: 57388 - DNA, 103 bp, Artificial Sequence
  Synthetic Polynucleotide
taatacgactcactatagggtattaaaatttacaaccttacaattttctaaacagaggagatagaaaatggtaaggttgaacctggcggcagcgcaaaagatg

SEQ ID NO: 57389 - DNA, 103 bp, Artificial Sequence
  Synthetic Polynucleotide
taatacgactcactatagggttcaatattaaaatttacaaccttacaattaacagaggagaaattgtatggttgtaaataacctggcggcagcgcaaaagatg

SEQ ID NO: 57390 - DNA, 103 bp, Artificial Sequence
  Synthetic Polynucleotide
taatacgactcactataggggtattttcaatattaaaatttacaaccttaaacagaggagataaggtatgaaattttaaaacctggcggcagcgcaaaagatg

SEQ ID NO: 57391 - DNA, 103 bp, Artificial Sequence
  Synthetic Polynucleotide
taatacgactcactatagggaattagtattttcaatattaaaatttacaaaacagaggagattgtaaatgttaatattgaacctggcggcagcgcaaaagatg

SEQ ID NO: 57392 - DNA, 103 bp, Artificial Sequence
  Synthetic Polynucleotide
taatacgactcactatagggtaaacaattagtattttcaatattaaaattaacagaggagaaattttatgattgaaaataacctggcggcagcgcaaaagatg

SEQ ID NO: 57393 - DNA, 103 bp, Artificial Sequence
  Synthetic Polynucleotide
taatacgactcactatagggattatttgattggtgaatataaatcgtattaacagaggagaaatacgatgtatattcacaacctggcggcagcgcaaaagatg

SEQ ID NO: 57394 - DNA, 103 bp, Artificial Sequence
  Synthetic Polynucleotide
taatacgactcactatagggttatttaaacaattagtattttcaatattaaacagaggagataatatatgaaatactaaaacctggcggcagcgcaaaagatg

SEQ ID NO: 57395 - DNA, 103 bp, Artificial Sequence
  Synthetic Polynucleotide
taatacgactcactatagggttgggttatttaaacaattagtattttcaaaacagaggagattgaaaatgctaattgttaacctggcggcagcgcaaaagatg

SEQ ID NO: 57396 - DNA, 103 bp, Artificial Sequence
  Synthetic Polynucleotide
taatacgactcactatagggaatacttgggttatttaaacaattagtattaacagaggagaaatactatgtgtttaaataacctggcggcagcgcaaaagatg

SEQ ID NO: 57397 - DNA, 103 bp, Artificial Sequence
  Synthetic Polynucleotide
taatacgactcactataggggtttcaatacttgggttatttaaacaattaaacagaggagataattgatgaaataacccaacctggcggcagcgcaaaagatg

SEQ ID NO: 57398 - DNA, 103 bp, Artificial Sequence
  Synthetic Polynucleotide
taatacgactcactatagggatatagtttcaatacttgggttatttaaacaacagaggagagtttaaatgacccaagtaaacctggcggcagcgcaaaagatg

SEQ ID NO: 57399 - DNA, 103 bp, Artificial Sequence
  Synthetic Polynucleotide
taatacgactcactatagggtccatatatagtttcaatacttgggttattaacagaggagaaataacatgagtattgaaaacctggcggcagcgcaaaagatg

SEQ ID NO: 57400 - DNA, 103 bp, Artificial Sequence
  Synthetic Polynucleotide
taatacgactcactatagggaagtttccatatatagtttcaatacttgggaacagaggagacccaagatgtgaaactataacctggcggcagcgcaaaagatg

SEQ ID NO: 57401 - DNA, 103 bp, Artificial Sequence
  Synthetic Polynucleotide
taatacgactcactatagggggttaaagtttccatatatagtttcaatacaacagaggagagtattgatgctatatatgaacctggcggcagcgcaaaagatg

SEQ ID NO: 57402 - DNA, 103 bp, Artificial Sequence
  Synthetic Polynucleotide
taatacgactcactataggggaactggttaaagtttccatatatagtttcaacagaggagagaaactatgtatggaaacaacctggcggcagcgcaaaagatg

SEQ ID NO: 57403 - DNA, 103 bp, Artificial Sequence
  Synthetic Polynucleotide
taatacgactcactataggggagacgaactggttaaagtttccatatataaacagaggagatatataatgaaactttaaaacctggcggcagcgcaaaagatg

SEQ ID NO: 57404 - DNA, 103 bp, Artificial Sequence
  Synthetic Polynucleotide
taatacgactcactatagggcggatattatttgattggtgaatataaatcaacagaggagagatttaatgtcaccaatcaacctggcggcagcgcaaaagatg

SEQ ID NO: 57405 - DNA, 103 bp, Artificial Sequence
  Synthetic Polynucleotide
taatacgactcactatagggagattgagacgaactggttaaagtttccataacagaggagaatggaaatgttaaccagtaacctggcggcagcgcaaaagatg

SEQ ID NO: 57406 - DNA, 103 bp, Artificial Sequence
  Synthetic Polynucleotide
taatacgactcactatagggattaaagattgagacgaactggttaaagttaacagaggagaaactttatgcagttcgtcaacctggcggcagcgcaaaagatg

SEQ ID NO: 57407 - DNA, 103 bp, Artificial Sequence
  Synthetic Polynucleotide
taatacgactcactatagggacgatattaaagattgagacgaactggttaaacagaggagataaccaatgcgtctcaataacctggcggcagcgcaaaagatg

SEQ ID NO: 57408 - DNA, 103 bp, Artificial Sequence
  Synthetic Polynucleotide
taatacgactcactatagggcggtgacgatattaaagattgagacgaactaacagaggagaagttcgatgcaatctttaaacctggcggcagcgcaaaagatg

SEQ ID NO: 57409 - DNA, 103 bp, Artificial Sequence
  Synthetic Polynucleotide
taatacgactcactataggggacatcggtgacgatattaaagattgagacaacagaggagagtctcaatgtttaatatcaacctggcggcagcgcaaaagatg

SEQ ID NO: 57410 - DNA, 103 bp, Artificial Sequence
  Synthetic Polynucleotide
taatacgactcactatagggtttttgacatcggtgacgatattaaagattaacagaggagaaatcttatgtatcgtcacaacctggcggcagcgcaaaagatg

SEQ ID NO: 57411 - DNA, 103 bp, Artificial Sequence
  Synthetic Polynucleotide
taatacgactcactatagggatctttttttgacatcggtgacgatattaaaacagaggagattaataatgtcaccgatgaacctggcggcagcgcaaaagatg

SEQ ID NO: 57412 - DNA, 103 bp, Artificial Sequence
  Synthetic Polynucleotide
taatacgactcactataggggaataatctttttttgacatcggtgacgataacagaggagaatcgtcatggatgtcaaaaacctggcggcagcgcaaaagatg

SEQ ID NO: 57413 - DNA, 103 bp, Artificial Sequence
  Synthetic Polynucleotide
taatacgactcactatagggcactcgaataatctttttttgacatcggtgaacagaggagacaccgaatgcaaaaaaagaacctggcggcagcgcaaaagatg

SEQ ID NO: 57414 - DNA, 103 bp, Artificial Sequence
  Synthetic Polynucleotide
taatacgactcactatagggtatttcactcgaataatctttttttgacataacagaggagaatgtcaatgaaagattataacctggcggcagcgcaaaagatg

SEQ ID NO: 57415 - DNA, 103 bp, Artificial Sequence
  Synthetic Polynucleotide
taatacgactcactatagggaatagcggatattatttgattggtgaatataacagaggagaatattcatgaatcaaataaacctggcggcagcgcaaaagatg

SEQ ID NO: 57416 - DNA, 103 bp, Artificial Sequence
  Synthetic Polynucleotide
taatacgactcactatagggcatattatttcactcgaataatctttttttaacagaggagaaaaaaaatgttattcgagaacctggcggcagcgcaaaagatg

SEQ ID NO: 57417 - DNA, 103 bp, Artificial Sequence
  Synthetic Polynucleotide
taatacgactcactatagggaggcacatattatttcactcgaataatcttaacagaggagaaagattatgcgagtgaaaaacctggcggcagcgcaaaagatg

SEQ ID NO: 57418 - DNA, 103 bp, Artificial Sequence
  Synthetic Polynucleotide
taatacgactcactatagggatcaaaggcacatattatttcactcgaataaacagaggagatattcgatggaaataataaacctggcggcagcgcaaaagatg

SEQ ID NO: 57419 - DNA, 103 bp, Artificial Sequence
  Synthetic Polynucleotide
taatacgactcactatagggcctatatcaaaggcacatattatttcactcaacagaggagagagtgaatgaatatgtgcaacctggcggcagcgcaaaagatg

SEQ ID NO: 57420 - DNA, 103 bp, Artificial Sequence
  Synthetic Polynucleotide
taatacgactcactatagggttgcacctatatcaaaggcacatattatttaacagaggagaaaataaatggtgcctttgaacctggcggcagcgcaaaagatg

SEQ ID NO: 57421 - DNA, 103 bp, Artificial Sequence
  Synthetic Polynucleotide
taatacgactcactatagggattttttgcacctatatcaaaggcacatataacagaggagaatatgtatgtttgatataaacctggcggcagcgcaaaagatg

SEQ ID NO: 57422 - DNA, 103 bp, Artificial Sequence
  Synthetic Polynucleotide
taatacgactcactataggggcaggattttttgcacctatatcaaaggcaaacagaggagatgccttatgtataggtgcaacctggcggcagcgcaaaagatg

SEQ ID NO: 57423 - DNA, 103 bp, Artificial Sequence
  Synthetic Polynucleotide
taatacgactcactatagggttctggcaggattttttgcacctatatcaaaacagaggagattgataatggtgcaaaaaaacctggcggcagcgcaaaagatg

SEQ ID NO: 57424 - DNA, 103 bp, Artificial Sequence
  Synthetic Polynucleotide
taatacgactcactatagggaacagttctggcaggattttttgcacctataacagaggagaataggtatgaaaaatcctaacctggcggcagcgcaaaagatg

SEQ ID NO: 57425 - DNA, 103 bp, Artificial Sequence
  Synthetic Polynucleotide
taatacgactcactatagggtctaaaacagttctggcaggattttttgcaaacagaggagatgcaaaatgtcctgccagaacctggcggcagcgcaaaagatg

SEQ ID NO: 57426 - DNA, 103 bp, Artificial Sequence
  Synthetic Polynucleotide
taatacgactcactatagggcttgtaatagcggatattatttgattggtgaacagaggagacaccaaatgaataatatcaacctggcggcagcgcaaaagatg

SEQ ID NO: 57427 - DNA, 103 bp, Artificial Sequence
  Synthetic Polynucleotide
taatacgactcactatagggtgacttctaaaacagttctggcaggattttaacagaggagaaaaatcatgccagaactgaacctggcggcagcgcaaaagatg

SEQ ID NO: 57428 - DNA, 103 bp, Artificial Sequence
  Synthetic Polynucleotide
taatacgactcactatagggatccttgacttctaaaacagttctggcaggaacagaggagacctgccatgactgttttaaacctggcggcagcgcaaaagatg

SEQ ID NO: 57429 - DNA, 103 bp, Artificial Sequence
  Synthetic Polynucleotide
taatacgactcactataggggagttatccttgacttctaaaacagttctgaacagaggagacagaacatgtttagaagtaacctggcggcagcgcaaaagatg

SEQ ID NO: 57430 - DNA, 103 bp, Artificial Sequence
  Synthetic Polynucleotide
taatacgactcactatagggtaacggagttatccttgacttctaaaacagaacagaggagactgtttatgaagtcaaggaacctggcggcagcgcaaaagatg

SEQ ID NO: 57431 - DNA, 103 bp, Artificial Sequence
  Synthetic Polynucleotide
taatacgactcactatagggtaccctaacggagttatccttgacttctaaaacagaggagattagaaatgaaggataacaacctggcggcagcgcaaaagatg

SEQ ID NO: 57432 - DNA, 103 bp, Artificial Sequence
  Synthetic Polynucleotide
taatacgactcactatagggtccaataccctaacggagttatccttgactaacagaggagaagtcaaatgtaactccgtaacctggcggcagcgcaaaagatg

SEQ ID NO: 57433 - DNA, 103 bp, Artificial Sequence
  Synthetic Polynucleotide
taatacgactcactatagggatatatccaataccctaacggagttatcctaacagaggagaaggataatgccgttagggaacctggcggcagcgcaaaagatg

SEQ ID NO: 57434 - DNA, 103 bp, Artificial Sequence
  Synthetic Polynucleotide
taatacgactcactatagggttttgatatatccaataccctaacggagttaacagaggagaaactccatgagggtattgaacctggcggcagcgcaaaagatg

SEQ ID NO: 57435 - DNA, 103 bp, Artificial Sequence
  Synthetic Polynucleotide
taatacgactcactatagggtctaattttgatatatccaataccctaacgaacagaggagacgttagatgattggatataacctggcggcagcgcaaaagatg

SEQ ID NO: 57436 - DNA, 103 bp, Artificial Sequence
  Synthetic Polynucleotide
taatacgactcactatagggtccagtctaattttgatatatccaatacccaacagaggagagggtatatgatatatcaaaacctggcggcagcgcaaaagatg

SEQ ID NO: 57437 - DNA, 103 bp, Artificial Sequence
  Synthetic Polynucleotide
taatacgactcactataggggtactcttgtaatagcggatattatttgataacagaggagaatcaaaatgtatccgctaaacctggcggcagcgcaaaagatg

SEQ ID NO: 57438 - DNA, 103 bp, Artificial Sequence
  Synthetic Polynucleotide
taatacgactcactatagggagaactccagtctaattttgatatatccaaaacagaggagattggatatgtcaaaattaaacctggcggcagcgcaaaagatg

SEQ ID NO: 57439 - DNA, 103 bp, Artificial Sequence
  Synthetic Polynucleotide
taatacgactcactatagggcaatcagaactccagtctaattttgatataaacagaggagatatatcatgattagactgaacctggcggcagcgcaaaagatg

SEQ ID NO: 57440 - DNA, 103 bp, Artificial Sequence
  Synthetic Polynucleotide
taatacgactcactatagggtttcccaatcagaactccagtctaattttgaacagaggagacaaaatatgactggagttaacctggcggcagcgcaaaagatg

SEQ ID NO: 57441 - DNA, 103 bp, Artificial Sequence
  Synthetic Polynucleotide
taatacgactcactataggggcgcctttcccaatcagaactccagtctaaaacagaggagattagacatgagttctgataacctggcggcagcgcaaaagatg

SEQ ID NO: 57442 - DNA, 103 bp, Artificial Sequence
  Synthetic Polynucleotide
taatacgactcactataggggctatgcgcctttcccaatcagaactccagaacagaggagactggagatgtgattgggaaacctggcggcagcgcaaaagatg

SEQ ID NO: 57443 - DNA, 103 bp, Artificial Sequence
  Synthetic Polynucleotide
taatacgactcactatagggctttagctatgcgcctttcccaatcagaacaacagaggagagttctgatggggaaaggcaacctggcggcagcgcaaaagatg

SEQ ID NO: 57444 - DNA, 103 bp, Artificial Sequence
  Synthetic Polynucleotide
taatacgactcactatagggcaaatctttagctatgcgcctttcccaatcaacagaggagagattggatgaggcgcataaacctggcggcagcgcaaaagatg

SEQ ID NO: 57445 - DNA, 103 bp, Artificial Sequence
  Synthetic Polynucleotide
taatacgactcactatagggtgtgacaaatctttagctatgcgcctttccaacagaggagaggaaagatgcatagctaaaacctggcggcagcgcaaaagatg

SEQ ID NO: 57446 - DNA, 103 bp, Artificial Sequence
  Synthetic Polynucleotide
taatacgactcactatagggcatattgtgacaaatctttagctatgcgccaacagaggagaggcgcaatgctaaagattaacctggcggcagcgcaaaagatg

SEQ ID NO: 57447 - DNA, 103 bp, Artificial Sequence
  Synthetic Polynucleotide
taatacgactcactataggggtattcatattgtgacaaatctttagctataacagaggagaatagctatggatttgtcaaacctggcggcagcgcaaaagatg

SEQ ID NO: 57448 - DNA, 103 bp, Artificial Sequence
  Synthetic Polynucleotide
taatacgactcactatagggataacgtactcttgtaatagcggatattataacagaggagaataataatggctattacaaacctggcggcagcgcaaaagatg

SEQ ID NO: 57449 - DNA, 103 bp, Artificial Sequence
  Synthetic Polynucleotide
taatacgactcactataggggtagtgtattcatattgtgacaaatctttaaacagaggagataaagaatggtcacaataaacctggcggcagcgcaaaagatg

SEQ ID NO: 57450 - DNA, 103 bp, Artificial Sequence
  Synthetic Polynucleotide
taatacgactcactataggggaactgtagtgtattcatattgtgacaaataacagaggagaatttgtatgaatatgaataacctggcggcagcgcaaaagatg

SEQ ID NO: 57451 - DNA, 103 bp, Artificial Sequence
  Synthetic Polynucleotide
taatacgactcactatagggtagaagaactgtagtgtattcatattgtgaaacagaggagatcacaaatggaatacactaacctggcggcagcgcaaaagatg

SEQ ID NO: 57452 - DNA, 103 bp, Artificial Sequence
  Synthetic Polynucleotide
taatacgactcactatagggcgttctagaagaactgtagtgtattcatataacagaggagaatatgaatgcactacagtaacctggcggcagcgcaaaagatg

SEQ ID NO: 57453 - DNA, 103 bp, Artificial Sequence
  Synthetic Polynucleotide
taatacgactcactataggggctgacgttctagaagaactgtagtgtattaacagaggagaaatacaatgcagttcttcaacctggcggcagcgcaaaagatg

SEQ ID NO: 57454 - DNA, 103 bp, Artificial Sequence
  Synthetic Polynucleotide
taatacgactcactatagggtctaggctgacgttctagaagaactgtagtaacagaggagaactacaatgcttctagaaaacctggcggcagcgcaaaagatg

SEQ ID NO: 57455 - DNA, 103 bp, Artificial Sequence
  Synthetic Polynucleotide
taatacgactcactataggggaccttctaggctgacgttctagaagaactaacagaggagaagttctatgagaacgtcaaacctggcggcagcgcaaaagatg

SEQ ID NO: 57456 - DNA, 103 bp, Artificial Sequence
  Synthetic Polynucleotide
taatacgactcactatagggatggcgaccttctaggctgacgttctagaaaacagaggagattctagatggtcagcctaaacctggcggcagcgcaaaagatg

SEQ ID NO: 57457 - DNA, 103 bp, Artificial Sequence
  Synthetic Polynucleotide
taatacgactcactataggggacgtatggcgaccttctaggctgacgttcaacagaggagagaacgtatgcctagaaggaacctggcggcagcgcaaaagatg

SEQ ID NO: 57458 - DNA, 103 bp, Artificial Sequence
  Synthetic Polynucleotide
taatacgactcactatagggaatttgacgtatggcgaccttctaggctgaaacagaggagatcagccatgaaggtcgccaacctggcggcagcgcaaaagatg

SEQ ID NO: 57459 - DNA, 103 bp, Artificial Sequence
  Synthetic Polynucleotide
taatacgactcactatagggcacaaacacaataatgatagcgacagtaataacagaggagaattactatggctatcattaacctggcggcagcgcaaaagatg

SEQ ID NO: 57460 - DNA, 103 bp, Artificial Sequence
  Synthetic Polynucleotide
taatacgactcactatagggctagtataacgtactcttgtaatagcggataacagaggagaatccgcatgtacaagagtaacctggcggcagcgcaaaagatg

SEQ ID NO: 57461 - DNA, 103 bp, Artificial Sequence
  Synthetic Polynucleotide
taatacgactcactatagggagataaatttgacgtatggcgaccttctagaacagaggagactagaaatgcgccatacgaacctggcggcagcgcaaaagatg

SEQ ID NO: 57462 - DNA, 103 bp, Artificial Sequence
  Synthetic Polynucleotide
taatacgactcactatagggaaaatagataaatttgacgtatggcgacctaacagaggagaaggtcgatgtacgtcaaaaacctggcggcagcgcaaaagatg

SEQ ID NO: 57463 - DNA, 103 bp, Artificial Sequence
  Synthetic Polynucleotide
taatacgactcactatagggttaataaaatagataaatttgacgtatggcaacagaggagagccataatgcaaatttataacctggcggcagcgcaaaagatg

SEQ ID NO: 57464 - DNA, 103 bp, Artificial Sequence
  Synthetic Polynucleotide
taatacgactcactatagggagcctttaataaaatagataaatttgacgtaacagaggagaacgtcaatgttatctattaacctggcggcagcgcaaaagatg

SEQ ID NO: 57465 - DNA, 103 bp, Artificial Sequence
  Synthetic Polynucleotide
taatacgactcactatagggtaaaaagcctttaataaaatagataaatttaacagaggagaaaatttatgtattttattaacctggcggcagcgcaaaagatg

SEQ ID NO: 57466 - DNA, 103 bp, Artificial Sequence
  Synthetic Polynucleotide
taatacgactcactatagggtgatataaaaagcctttaataaaatagataaacagaggagatatctaatgtattaaaggaacctggcggcagcgcaaaagatg

SEQ ID NO: 57467 - DNA, 103 bp, Artificial Sequence
  Synthetic Polynucleotide
taatacgactcactatagggatgtatgatataaaaagcctttaataaaataacagaggagaattttaatgaaggcttttaacctggcggcagcgcaaaagatg

SEQ ID NO: 57468 - DNA, 103 bp, Artificial Sequence
  Synthetic Polynucleotide
taatacgactcactatagggagccgatgtatgatataaaaagcctttaataacagaggagaattaaaatgtttttatataacctggcggcagcgcaaaagatg

SEQ ID NO: 57469 - DNA, 103 bp, Artificial Sequence
  Synthetic Polynucleotide
taatacgactcactatagggttggtagccgatgtatgatataaaaagcctaacagaggagaaggcttatgatatcatacaacctggcggcagcgcaaaagatg

SEQ ID NO: 57470 - DNA, 103 bp, Artificial Sequence
  Synthetic Polynucleotide
taatacgactcactatagggtaactttggtagccgatgtatgatataaaaaacagaggagattttatatgatacatcggaacctggcggcagcgcaaaagatg

SEQ ID NO: 57471 - DNA, 103 bp, Artificial Sequence
  Synthetic Polynucleotide
taatacgactcactatagggtggctctagtataacgtactcttgtaatagaacagaggagactattaatggagtacgttaacctggcggcagcgcaaaagatg

SEQ ID NO: 57472 - DNA, 103 bp, Artificial Sequence
  Synthetic Polynucleotide
taatacgactcactatagggacaaataactttggtagccgatgtatgataaacagaggagatatcatatgtcggctaccaacctggcggcagcgcaaaagatg

SEQ ID NO: 57473 - DNA, 103 bp, Artificial Sequence
  Synthetic Polynucleotide
taatacgactcactataggggagacacaaataactttggtagccgatgtaaacagaggagatacatcatgtaccaaagtaacctggcggcagcgcaaaagatg

SEQ ID NO: 57474 - DNA, 103 bp, Artificial Sequence
  Synthetic Polynucleotide
taatacgactcactatagggcaggcgagacacaaataactttggtagccgaacagaggagacggctaatgaagttatttaacctggcggcagcgcaaaagatg

SEQ ID NO: 57475 - DNA, 103 bp, Artificial Sequence
  Synthetic Polynucleotide
taatacgactcactatagggcatgacaggcgagacacaaataactttggtaacagaggagaaccaaaatgatttgtgtcaacctggcggcagcgcaaaagatg

SEQ ID NO: 57476 - DNA, 103 bp, Artificial Sequence
  Synthetic Polynucleotide
taatacgactcactatagggccagacatgacaggcgagacacaaataactaacagaggagaagttatatgtgtctcgccaacctggcggcagcgcaaaagatg

SEQ ID NO: 57477 - DNA, 103 bp, Artificial Sequence
  Synthetic Polynucleotide
taatacgactcactatagggaattaccagacatgacaggcgagacacaaaaacagaggagatttgtgatgcgcctgtcaaacctggcggcagcgcaaaagatg

SEQ ID NO: 57478 - DNA, 103 bp, Artificial Sequence
  Synthetic Polynucleotide
taatacgactcactatagggatatgaattaccagacatgacaggcgagacaacagaggagagtctcgatggtcatgtctaacctggcggcagcgcaaaagatg

SEQ ID NO: 57479 - DNA, 103 bp, Artificial Sequence
  Synthetic Polynucleotide
taatacgactcactatagggtctctatatgaattaccagacatgacaggcaacagaggagagcctgtatggtctggtaaaacctggcggcagcgcaaaagatg

SEQ ID NO: 57480 - DNA, 103 bp, Artificial Sequence
  Synthetic Polynucleotide
taatacgactcactatagggttcgatctctatatgaattaccagacatgaaacagaggagatcatgtatggtaattcataacctggcggcagcgcaaaagatg

SEQ ID NO: 57481 - DNA, 103 bp, Artificial Sequence
  Synthetic Polynucleotide
taatacgactcactatagggcttttttcgatctctatatgaattaccagaaacagaggagatctggtatgtcatatagaaacctggcggcagcgcaaaagatg

SEQ ID NO: 57482 - DNA, 103 bp, Artificial Sequence
  Synthetic Polynucleotide
taatacgactcactataggggactttggctctagtataacgtactcttgtaacagaggagaacaagaatgcgttatactaacctggcggcagcgcaaaagatg

SEQ ID NO: 57483 - DNA, 103 bp, Artificial Sequence
  Synthetic Polynucleotide
taatacgactcactataggggatctcttttttcgatctctatatgaattaaacagaggagataattcatgtagagatcgaacctggcggcagcgcaaaagatg

SEQ ID NO: 57484 - DNA, 103 bp, Artificial Sequence
  Synthetic Polynucleotide
taatacgactcactatagggcgacagatctcttttttcgatctctatatgaacagaggagacatataatgatcgaaaaaaacctggcggcagcgcaaaagatg

SEQ ID NO: 57485 - DNA, 103 bp, Artificial Sequence
  Synthetic Polynucleotide
taatacgactcactatagggtgcttcgacagatctcttttttcgatctctaacagaggagaagagatatgaaaaagagaaacctggcggcagcgcaaaagatg

SEQ ID NO: 57486 - DNA, 103 bp, Artificial Sequence
  Synthetic Polynucleotide
taatacgactcactatagggaaaaatgcttcgacagatctcttttttcgaaacagaggagatcgaaaatggagatctgtaacctggcggcagcgcaaaagatg

SEQ ID NO: 57487 - DNA, 103 bp, Artificial Sequence
  Synthetic Polynucleotide
taatacgactcactatagggaatcaaaaaatgcttcgacagatctcttttaacagaggagaaaaagaatgctgtcgaagaacctggcggcagcgcaaaagatg

SEQ ID NO: 57488 - DNA, 103 bp, Artificial Sequence
  Synthetic Polynucleotide
taatacgactcactatagggcatccaatcaaaaaatgcttcgacagatctaacagaggagaagatctatggaagcatttaacctggcggcagcgcaaaagatg

SEQ ID NO: 57489 - DNA, 103 bp, Artificial Sequence
  Synthetic Polynucleotide
taatacgactcactatagggatgtccatccaatcaaaaaatgcttcgacaaacagaggagatgtcgaatgattttttgaaacctggcggcagcgcaaaagatg

SEQ ID NO: 57490 - DNA, 103 bp, Artificial Sequence
  Synthetic Polynucleotide
taatacgactcactatagggcgaatatgtccatccaatcaaaaaatgcttaacagaggagaaagcatatgttgattggaaacctggcggcagcgcaaaagatg

SEQ ID NO: 57491 - DNA, 103 bp, Artificial Sequence
  Synthetic Polynucleotide
taatacgactcactatagggcaatccgaatatgtccatccaatcaaaaaaaacagaggagattttttatgtggatggacaacctggcggcagcgcaaaagatg

SEQ ID NO: 57492 - DNA, 103 bp, Artificial Sequence
  Synthetic Polynucleotide
taatacgactcactatagggtctcgcaatccgaatatgtccatccaatcaaacagaggagatgattgatgggacatattaacctggcggcagcgcaaaagatg

SEQ ID NO: 57493 - DNA, 103 bp, Artificial Sequence
  Synthetic Polynucleotide
taatacgactcactataggggagtagactttggctctagtataacgtactaacagaggagaagtacgatgtactagagcaacctggcggcagcgcaaaagatg

SEQ ID NO: 57494 - DNA, 103 bp, Artificial Sequence
  Synthetic Polynucleotide
taatacgactcactatagggcggagtctcgcaatccgaatatgtccatccaacagaggagaggatggatgtattcggataacctggcggcagcgcaaaagatg

SEQ ID NO: 57495 - DNA, 103 bp, Artificial Sequence
  Synthetic Polynucleotide
taatacgactcactatagggtggaacggagtctcgcaatccgaatatgtcaacagaggagagacataatgggattgcgaaacctggcggcagcgcaaaagatg

SEQ ID NO: 57496 - DNA, 103 bp, Artificial Sequence
  Synthetic Polynucleotide
taatacgactcactatagggctatctggaacggagtctcgcaatccgaataacagaggagaattcggatggcgagactcaacctggcggcagcgcaaaagatg

SEQ ID NO: 57497 - DNA, 103 bp, Artificial Sequence
  Synthetic Polynucleotide
taatacgactcactatagggtgcgtctatctggaacggagtctcgcaatcaacagaggagagattgcatgactccgttcaacctggcggcagcgcaaaagatg

SEQ ID NO: 57498 - DNA, 103 bp, Artificial Sequence
  Synthetic Polynucleotide
taatacgactcactatagggtaatttgcgtctatctggaacggagtctcgaacagaggagacgagacatggttccagataacctggcggcagcgcaaaagatg

SEQ ID NO: 57499 - DNA, 103 bp, Artificial Sequence
  Synthetic Polynucleotide
taatacgactcactatagggtcgtctaatttgcgtctatctggaacggagaacagaggagactccgtatgagatagacgaacctggcggcagcgcaaaagatg

SEQ ID NO: 57500 - DNA, 103 bp, Artificial Sequence
  Synthetic Polynucleotide
taatacgactcactatagggctacatcgtctaatttgcgtctatctggaaaacagaggagattccagatggacgcaaataacctggcggcagcgcaaaagatg

SEQ ID NO: 57501 - DNA, 103 bp, Artificial Sequence
  Synthetic Polynucleotide
taatacgactcactatagggatccgctacatcgtctaatttgcgtctatcaacagaggagagatagaatgaaattagacaacctggcggcagcgcaaaagatg

SEQ ID NO: 57502 - DNA, 103 bp, Artificial Sequence
  Synthetic Polynucleotide
taatacgactcactatagggaaactatccgctacatcgtctaatttgcgtaacagaggagaacgcaaatgagacgatgtaacctggcggcagcgcaaaagatg

SEQ ID NO: 57503 - DNA, 103 bp, Artificial Sequence
  Synthetic Polynucleotide
taatacgactcactatagggaattgaaactatccgctacatcgtctaattaacagaggagaaattagatgatgtagcggaacctggcggcagcgcaaaagatg

SEQ ID NO: 57504 - DNA, 103 bp, Artificial Sequence
  Synthetic Polynucleotide
taatacgactcactatagggtggcggagtagactttggctctagtataacaacagaggagagttataatggagccaaagaacctggcggcagcgcaaaagatg

SEQ ID NO: 57505 - DNA, 103 bp, Artificial Sequence
  Synthetic Polynucleotide
taatacgactcactatagggagccaaattgaaactatccgctacatcgtcaacagaggagagacgatatggcggatagtaacctggcggcagcgcaaaagatg

SEQ ID NO: 57506 - DNA, 103 bp, Artificial Sequence
  Synthetic Polynucleotide
taatacgactcactatagggctcatagccaaattgaaactatccgctacaaacagaggagatgtagcatgtagtttcaaaacctggcggcagcgcaaaagatg

SEQ ID NO: 57507 - DNA, 103 bp, Artificial Sequence
  Synthetic Polynucleotide
taatacgactcactatagggcgtatctcatagccaaattgaaactatccgaacagaggagacggataatgtcaatttggaacctggcggcagcgcaaaagatg

SEQ ID NO: 57508 - DNA, 103 bp, Artificial Sequence
  Synthetic Polynucleotide
taatacgactcactatagggtaatacgtatctcatagccaaattgaaactaacagaggagaagtttcatgttggctatgaacctggcggcagcgcaaaagatg

SEQ ID NO: 57509 - DNA, 103 bp, Artificial Sequence
  Synthetic Polynucleotide
taatacgactcactatagggttatctaatacgtatctcatagccaaattgaacagaggagacaatttatgtatgagataaacctggcggcagcgcaaaagatg

SEQ ID NO: 57510 - DNA, 103 bp, Artificial Sequence
  Synthetic Polynucleotide
taatacgactcactatagggtccatttatctaatacgtatctcatagccaaacagaggagatggctaatggatacgtataacctggcggcagcgcaaaagatg

SEQ ID NO: 57511 - DNA, 103 bp, Artificial Sequence
  Synthetic Polynucleotide
taatacgactcactatagggagtattccatttatctaatacgtatctcataacagaggagaatgagaatggtattagataacctggcggcagcgcaaaagatg

SEQ ID NO: 57512 - DNA, 103 bp, Artificial Sequence
  Synthetic Polynucleotide
taatacgactcactatagggtaattagtattccatttatctaatacgtataacagaggagaatacgtatgagataaatgaacctggcggcagcgcaaaagatg

SEQ ID NO: 57513 - DNA, 103 bp, Artificial Sequence
  Synthetic Polynucleotide
taatacgactcactataggggtgtataattagtattccatttatctaataaacagaggagatattagatgaatggaataaacctggcggcagcgcaaaagatg

SEQ ID NO: 57514 - DNA, 103 bp, Artificial Sequence
  Synthetic Polynucleotide
taatacgactcactatagggataatgtgtataattagtattccatttatcaacagaggagagataaaatgaatactaataacctggcggcagcgcaaaagatg

SEQ ID NO: 57515 - DNA, 103 bp, Artificial Sequence
  Synthetic Polynucleotide
taatacgactcactataggggatattggcggagtagactttggctctagtaacagaggagaactagaatgaaagtctacaacctggcggcagcgcaaaagatg

SEQ ID NO: 57516 - DNA, 103 bp, Artificial Sequence
  Synthetic Polynucleotide
taatacgactcactatagggctattataatgtgtataattagtattccataacagaggagaatggaaatgtaattatacaacctggcggcagcgcaaaagatg

SEQ ID NO: 57517 - DNA, 103 bp, Artificial Sequence
  Synthetic Polynucleotide
taatacgactcactatagggtacacctattataatgtgtataattagtataacagaggagaatactaatgatacacattaacctggcggcagcgcaaaagatg

SEQ ID NO: 57518 - DNA, 103 bp, Artificial Sequence
  Synthetic Polynucleotide
taatacgactcactatagggagatttacacctattataatgtgtataattaacagaggagaaattatatgcattataataacctggcggcagcgcaaaagatg

SEQ ID NO: 57519 - DNA, 103 bp, Artificial Sequence
  Synthetic Polynucleotide
taatacgactcactatagggtttctagatttacacctattataatgtgtaaacagaggagatacacaatgtaataggtgaacctggcggcagcgcaaaagatg

SEQ ID NO: 57520 - DNA, 103 bp, Artificial Sequence
  Synthetic Polynucleotide
taatacgactcactatagggtgtaatttctagatttacacctattataataacagaggagaattataatgggtgtaaataacctggcggcagcgcaaaagatg

SEQ ID NO: 57521 - DNA, 103 bp, Artificial Sequence
  Synthetic Polynucleotide
taatacgactcactatagggttttatgtaatttctagatttacacctattaacagaggagaaataggatgaaatctagaaacctggcggcagcgcaaaagatg

SEQ ID NO: 57522 - DNA, 103 bp, Artificial Sequence
  Synthetic Polynucleotide
taatacgactcactatagggattttttttatgtaatttctagatttacacaacagaggagagtgtaaatgtagaaattaaacctggcggcagcgcaaaagatg

SEQ ID NO: 57523 - DNA, 103 bp, Artificial Sequence
  Synthetic Polynucleotide
taatacgactcactatagggattacattttttttatgtaatttctagattaacagaggagaaatctaatgattacataaaacctggcggcagcgcaaaagatg

SEQ ID NO: 57524 - DNA, 103 bp, Artificial Sequence
  Synthetic Polynucleotide
taatacgactcactatagggacgttattacattttttttatgtaatttctaacagaggagaagaaatatgataaaaaaaaacctggcggcagcgcaaaagatg

SEQ ID NO: 57525 - DNA, 103 bp, Artificial Sequence
  Synthetic Polynucleotide
taatacgactcactatagggtactaacgttattacattttttttatgtaaaacagaggagattacatatgaaaaatgtaaacctggcggcagcgcaaaagatg

SEQ ID NO: 57526 - DNA, 103 bp, Artificial Sequence
  Synthetic Polynucleotide
taatacgactcactatagggatcttgatattggcggagtagactttggctaacagaggagaagccaaatgctactccgcaacctggcggcagcgcaaaagatg

SEQ ID NO: 57527 - DNA, 103 bp, Artificial Sequence
  Synthetic Polynucleotide
taatacgactcactatagggggcgttactaacgttattacattttttttaaacagaggagataaaaaatgtgtaataacaacctggcggcagcgcaaaagatg

SEQ ID NO: 57528 - DNA, 103 bp, Artificial Sequence
  Synthetic Polynucleotide
taatacgactcactatagggataatggcgttactaacgttattacattttaacagaggagaaaaatgatgtaacgttagaacctggcggcagcgcaaaagatg

SEQ ID NO: 57529 - DNA, 103 bp, Artificial Sequence
  Synthetic Polynucleotide
taatacgactcactatagggtatccataatggcgttactaacgttattacaacagaggagagtaataatgttagtaacgaacctggcggcagcgcaaaagatg

SEQ ID NO: 57530 - DNA, 103 bp, Artificial Sequence
  Synthetic Polynucleotide
taatacgactcactatagggtagattatccataatggcgttactaacgttaacagaggagaaacgttatgaacgccattaacctggcggcagcgcaaaagatg

SEQ ID NO: 57531 - DNA, 103 bp, Artificial Sequence
  Synthetic Polynucleotide
taatacgactcactataggggtaaatagattatccataatggcgttactaaacagaggagatagtaaatgcattatggaaacctggcggcagcgcaaaagatg

SEQ ID NO: 57532 - DNA, 103 bp, Artificial Sequence
  Synthetic Polynucleotide
taatacgactcactataggggaaaggtaaatagattatccataatggcgtaacagaggagaacgccaatgtggataatcaacctggcggcagcgcaaaagatg

SEQ ID NO: 57533 - DNA, 103 bp, Artificial Sequence
  Synthetic Polynucleotide
taatacgactcactatagggatgtagaaaggtaaatagattatccataataacagaggagaattatgatgaatctatttaacctggcggcagcgcaaaagatg

SEQ ID NO: 57534 - DNA, 103 bp, Artificial Sequence
  Synthetic Polynucleotide
taatacgactcactatagggatttcatgtagaaaggtaaatagattatccaacagaggagaggataaatgatttaccttaacctggcggcagcgcaaaagatg

SEQ ID NO: 57535 - DNA, 103 bp, Artificial Sequence
  Synthetic Polynucleotide
taatacgactcactatagggcttctatttcatgtagaaaggtaaatagataacagaggagaatctatatgcctttctacaacctggcggcagcgcaaaagatg

SEQ ID NO: 57536 - DNA, 103 bp, Artificial Sequence
  Synthetic Polynucleotide
taatacgactcactatagggtctatcttctatttcatgtagaaaggtaaaaacagaggagatttaccatgctacatgaaaacctggcggcagcgcaaaagatg

SEQ ID NO: 57537 - DNA, 103 bp, Artificial Sequence
  Synthetic Polynucleotide
taatacgactcactatagggtggccatcttgatattggcggagtagacttaacagaggagaaagtctatgccgccaataaacctggcggcagcgcaaaagatg

SEQ ID NO: 57538 - DNA, 103 bp, Artificial Sequence
  Synthetic Polynucleotide
taatacgactcactataggggtatatctatcttctatttcatgtagaaagaacagaggagactttctatgtgaaatagaaacctggcggcagcgcaaaagatg

SEQ ID NO: 57539 - DNA, 103 bp, Artificial Sequence
  Synthetic Polynucleotide
taatacgactcactatagggttctggtatatctatcttctatttcatgtaaacagaggagatacatgatgtagaagataaacctggcggcagcgcaaaagatg

SEQ ID NO: 57540 - DNA, 103 bp, Artificial Sequence
  Synthetic Polynucleotide
taatacgactcactatagggaatagttctggtatatctatcttctatttcaacagaggagagaaataatggatagatataacctggcggcagcgcaaaagatg

SEQ ID NO: 57541 - DNA, 103 bp, Artificial Sequence
  Synthetic Polynucleotide
taatacgactcactatagggttaaaaatagttctggtatatctatcttctaacagaggagaagaagaatgatataccagaacctggcggcagcgcaaaagatg

SEQ ID NO: 57542 - DNA, 103 bp, Artificial Sequence
  Synthetic Polynucleotide
taatacgactcactataggggaaagttaaaaatagttctggtatatctataacagaggagaatagatatgccagaactaaacctggcggcagcgcaaaagatg

SEQ ID NO: 57543 - DNA, 103 bp, Artificial Sequence
  Synthetic Polynucleotide
taatacgactcactatagggtagatgaaagttaaaaatagttctggtataaacagaggagatataccatgactatttttaacctggcggcagcgcaaaagatg

SEQ ID NO: 57544 - DNA, 103 bp, Artificial Sequence
  Synthetic Polynucleotide
taatacgactcactatagggcttattagatgaaagttaaaaatagttctgaacagaggagacagaacatgttttaacttaacctggcggcagcgcaaaagatg

SEQ ID NO: 57545 - DNA, 103 bp, Artificial Sequence
  Synthetic Polynucleotide
taatacgactcactatagggcgcaacttattagatgaaagttaaaaatagaacagaggagactatttatgactttcatcaacctggcggcagcgcaaaagatg

SEQ ID NO: 57546 - DNA, 103 bp, Artificial Sequence
  Synthetic Polynucleotide
taatacgactcactatagggttcatcgcaacttattagatgaaagttaaaaacagaggagatttaacatgcatctaataaacctggcggcagcgcaaaagatg

SEQ ID NO: 57547 - DNA, 103 bp, Artificial Sequence
  Synthetic Polynucleotide
taatacgactcactatagggcctatttcatcgcaacttattagatgaaagaacagaggagactttcaatgaataagttgaacctggcggcagcgcaaaagatg

SEQ ID NO: 57548 - DNA, 103 bp, Artificial Sequence
  Synthetic Polynucleotide
taatacgactcactataggggataatggccatcttgatattggcggagtaaacagaggagatactccatgaatatcaagaacctggcggcagcgcaaaagatg

SEQ ID NO: 57549 - DNA, 103 bp, Artificial Sequence
  Synthetic Polynucleotide
taatacgactcactatagggtatctcctatttcatcgcaacttattagataacagaggagaatctaaatggttgcgatgaacctggcggcagcgcaaaagatg

SEQ ID NO: 57550 - DNA, 103 bp, Artificial Sequence
  Synthetic Polynucleotide
taatacgactcactatagggatatatatctcctatttcatcgcaacttataacagaggagaataagtatggatgaaataaacctggcggcagcgcaaaagatg

SEQ ID NO: 57551 - DNA, 103 bp, Artificial Sequence
  Synthetic Polynucleotide
taatacgactcactatagggagaccatatatatctcctatttcatcgcaaaacagaggagattgcgaatgaataggagaaacctggcggcagcgcaaaagatg

SEQ ID NO: 57552 - DNA, 103 bp, Artificial Sequence
  Synthetic Polynucleotide
taatacgactcactatagggtcataagaccatatatatctcctatttcataacagaggagaatgaaaatggagatatataacctggcggcagcgcaaaagatg

SEQ ID NO: 57553 - DNA, 103 bp, Artificial Sequence
  Synthetic Polynucleotide
taatacgactcactatagggttctttcataagaccatatatatctcctataacagaggagaataggaatgatatatggtaacctggcggcagcgcaaaagatg

SEQ ID NO: 57554 - DNA, 103 bp, Artificial Sequence
  Synthetic Polynucleotide
taatacgactcactatagggatgcgttctttcataagaccatatatatctaacagaggagaagatatatgtggtcttataacctggcggcagcgcaaaagatg

SEQ ID NO: 57555 - DNA, 103 bp, Artificial Sequence
  Synthetic Polynucleotide
taatacgactcactatagggaggaaatgcgttctttcataagaccatataaacagaggagatatatgatgttatgaaagaacctggcggcagcgcaaaagatg

SEQ ID NO: 57556 - DNA, 103 bp, Artificial Sequence
  Synthetic Polynucleotide
taatacgactcactatagggctctgaggaaatgcgttctttcataagaccaacagaggagaggtcttatgaaagaacgcaacctggcggcagcgcaaaagatg

SEQ ID NO: 57557 - DNA, 103 bp, Artificial Sequence
  Synthetic Polynucleotide
taatacgactcactatagggatatcctctgaggaaatgcgttctttcataaacagaggagatatgaaatgacgcatttcaacctggcggcagcgcaaaagatg

SEQ ID NO: 57558 - DNA, 103 bp, Artificial Sequence
  Synthetic Polynucleotide
taatacgactcactatagggcaaacatatcctctgaggaaatgcgttcttaacagaggagaaagaacatgtttcctcagaacctggcggcagcgcaaaagatg

SEQ ID NO: 57559 - DNA, 103 bp, Artificial Sequence
  Synthetic Polynucleotide
taatacgactcactatagggatatcgataatggccatcttgatattggcgaacagaggagacgccaaatgcaagatggcaacctggcggcagcgcaaaagatg

SEQ ID NO: 57560 - DNA, 103 bp, Artificial Sequence
  Synthetic Polynucleotide
taatacgactcactatagggattatcaaacatatcctctgaggaaatgcgaacagaggagacgcattatgtcagaggataacctggcggcagcgcaaaagatg

SEQ ID NO: 57561 - DNA, 103 bp, Artificial Sequence
  Synthetic Polynucleotide
taatacgactcactatagggactatattatcaaacatatcctctgaggaaaacagaggagattcctcatgggatatgttaacctggcggcagcgcaaaagatg

SEQ ID NO: 57562 - DNA, 103 bp, Artificial Sequence
  Synthetic Polynucleotide
taatacgactcactatagggtatatactatattatcaaacatatcctctgaacagaggagacagaggatgtgtttgataaacctggcggcagcgcaaaagatg

SEQ ID NO: 57563 - DNA, 103 bp, Artificial Sequence
  Synthetic Polynucleotide
taatacgactcactatagggtttattatatactatattatcaaacatatcaacagaggagagatatgatggataatataaacctggcggcagcgcaaaagatg

SEQ ID NO: 57564 - DNA, 103 bp, Artificial Sequence
  Synthetic Polynucleotide
taatacgactcactatagggatatctttattatatactatattatcaaacaacagaggagagtttgaatgtatagtataaacctggcggcagcgcaaaagatg

SEQ ID NO: 57565 - DNA, 103 bp, Artificial Sequence
  Synthetic Polynucleotide
taatacgactcactataggggatgtatatctttattatatactatattataacagaggagaataataatgtatataataaacctggcggcagcgcaaaagatg

SEQ ID NO: 57566 - DNA, 103 bp, Artificial Sequence
  Synthetic Polynucleotide
taatacgactcactatagggggcaggatgtatatctttattatatactataacagaggagaatagtaatgaataaagataacctggcggcagcgcaaaagatg

SEQ ID NO: 57567 - DNA, 103 bp, Artificial Sequence
  Synthetic Polynucleotide
taatacgactcactatagggttaatggcaggatgtatatctttattatataacagaggagaatataaatgagatatacaaacctggcggcagcgcaaaagatg

SEQ ID NO: 57568 - DNA, 103 bp, Artificial Sequence
  Synthetic Polynucleotide
taatacgactcactataggggtttcttaatggcaggatgtatatctttataacagaggagaataaagatgtacatcctgaacctggcggcagcgcaaaagatg

SEQ ID NO: 57569 - DNA, 103 bp, Artificial Sequence
  Synthetic Polynucleotide
taatacgactcactatagggaactagtttcttaatggcaggatgtatatcaacagaggagagatataatgcctgccattaacctggcggcagcgcaaaagatg

SEQ ID NO: 57570 - DNA, 103 bp, Artificial Sequence
  Synthetic Polynucleotide
taatacgactcactatagggaactacacaaacacaataatgatagcgacaaacagaggagatgtcgcatgcattattgtaacctggcggcagcgcaaaagatg

SEQ ID NO: 57571 - DNA, 103 bp, Artificial Sequence
  Synthetic Polynucleotide
taatacgactcactatagggtcgagatatcgataatggccatcttgatataacagaggagaatatcaatgtggccattaaacctggcggcagcgcaaaagatg

SEQ ID NO: 57572 - DNA, 103 bp, Artificial Sequence
  Synthetic Polynucleotide
taatacgactcactatagggcaataaactagtttcttaatggcaggatgtaacagaggagaacatccatgcattaagaaaacctggcggcagcgcaaaagatg

SEQ ID NO: 57573 - DNA, 103 bp, Artificial Sequence
  Synthetic Polynucleotide
taatacgactcactatagggtgtcacaataaactagtttcttaatggcagaacagaggagactgccaatgagaaactagaacctggcggcagcgcaaaagatg

SEQ ID NO: 57574 - DNA, 103 bp, Artificial Sequence
  Synthetic Polynucleotide
taatacgactcactatagggttgaatgtcacaataaactagtttcttaataacagaggagaattaagatgctagtttataacctggcggcagcgcaaaagatg

SEQ ID NO: 57575 - DNA, 103 bp, Artificial Sequence
  Synthetic Polynucleotide
taatacgactcactataggggtaagttgaatgtcacaataaactagtttcaacagaggagagaaactatgttattgtgaaacctggcggcagcgcaaaagatg

SEQ ID NO: 57576 - DNA, 103 bp, Artificial Sequence
  Synthetic Polynucleotide
taatacgactcactataggggtttagtaagttgaatgtcacaataaactaaacagaggagatagtttatggtgacattcaacctggcggcagcgcaaaagatg

SEQ ID NO: 57577 - DNA, 103 bp, Artificial Sequence
  Synthetic Polynucleotide
taatacgactcactatagggaatgtgtttagtaagttgaatgtcacaataaacagaggagatattgtatgattcaacttaacctggcggcagcgcaaaagatg

SEQ ID NO: 57578 - DNA, 103 bp, Artificial Sequence
  Synthetic Polynucleotide
taatacgactcactatagggttaataatgtgtttagtaagttgaatgtcaaacagaggagatgacatatgacttactaaaacctggcggcagcgcaaaagatg

SEQ ID NO: 57579 - DNA, 103 bp, Artificial Sequence
  Synthetic Polynucleotide
taatacgactcactatagggtctgattaataatgtgtttagtaagttgaaaacagaggagattcaacatgctaaacacaaacctggcggcagcgcaaaagatg

SEQ ID NO: 57580 - DNA, 103 bp, Artificial Sequence
  Synthetic Polynucleotide
taatacgactcactatagggcgtattctgattaataatgtgtttagtaagaacagaggagacttactatgcacattattaacctggcggcagcgcaaaagatg

SEQ ID NO: 57581 - DNA, 103 bp, Artificial Sequence
  Synthetic Polynucleotide
taatacgactcactatagggggatacgtattctgattaataatgtgtttaaacagaggagataaacaatgtattaatcaaacctggcggcagcgcaaaagatg

SEQ ID NO: 57582 - DNA, 103 bp, Artificial Sequence
  Synthetic Polynucleotide
taatacgactcactatagggtcgcctcgagatatcgataatggccatcttaacagaggagaaagatgatgattatcgataacctggcggcagcgcaaaagatg

SEQ ID NO: 57583 - DNA, 103 bp, Artificial Sequence
  Synthetic Polynucleotide
taatacgactcactatagggataccggatacgtattctgattaataatgtaacagaggagaacattaatgatcagaataaacctggcggcagcgcaaaagatg

SEQ ID NO: 57584 - DNA, 103 bp, Artificial Sequence
  Synthetic Polynucleotide
taatacgactcactataggggttaaataccggatacgtattctgattaataacagaggagaattaatatgaatacgtataacctggcggcagcgcaaaagatg

SEQ ID NO: 57585 - DNA, 103 bp, Artificial Sequence
  Synthetic Polynucleotide
taatacgactcactataggggaatcgttaaataccggatacgtattctgaaacagaggagatcagaaatggtatccggtaacctggcggcagcgcaaaagatg

SEQ ID NO: 57586 - DNA, 103 bp, Artificial Sequence
  Synthetic Polynucleotide
taatacgactcactataggggtgaagaatcgttaaataccggatacgtataacagaggagaatacgtatgcggtatttaaacctggcggcagcgcaaaagatg

SEQ ID NO: 57587 - DNA, 103 bp, Artificial Sequence
  Synthetic Polynucleotide
taatacgactcactatagggcacttgtgaagaatcgttaaataccggataaacagaggagatatccgatgtttaacgataacctggcggcagcgcaaaagatg

SEQ ID NO: 57588 - DNA, 103 bp, Artificial Sequence
  Synthetic Polynucleotide
taatacgactcactatagggcatttcacttgtgaagaatcgttaaataccaacagaggagaggtattatgcgattcttcaacctggcggcagcgcaaaagatg

SEQ ID NO: 57589 - DNA, 103 bp, Artificial Sequence
  Synthetic Polynucleotide
taatacgactcactataggggacaacatttcacttgtgaagaatcgttaaaacagaggagattaacgatgcttcacaagaacctggcggcagcgcaaaagatg

SEQ ID NO: 57590 - DNA, 103 bp, Artificial Sequence
  Synthetic Polynucleotide
taatacgactcactatagggataatgacaacatttcacttgtgaagaatcaacagaggagagattctatgcaagtgaaaaacctggcggcagcgcaaaagatg

SEQ ID NO: 57591 - DNA, 103 bp, Artificial Sequence
  Synthetic Polynucleotide
taatacgactcactatagggtcgaaataatgacaacatttcacttgtgaaaacagaggagattcacaatggaaatgttgaacctggcggcagcgcaaaagatg

SEQ ID NO: 57592 - DNA, 103 bp, Artificial Sequence
  Synthetic Polynucleotide
taatacgactcactatagggttatatcgaaataatgacaacatttcacttaacagaggagaaagtgaatggttgtcattaacctggcggcagcgcaaaagatg

SEQ ID NO: 57593 - DNA, 103 bp, Artificial Sequence
  Synthetic Polynucleotide
taatacgactcactataggggcccgtcgcctcgagatatcgataatggccaacagaggagaggccatatgcgatatctcaacctggcggcagcgcaaaagatg

SEQ ID NO: 57594 - DNA, 103 bp, Artificial Sequence
  Synthetic Polynucleotide
taatacgactcactatagggtgagtttatatcgaaataatgacaacatttaacagaggagaaaatgtatgcattatttcaacctggcggcagcgcaaaagatg

SEQ ID NO: 57595 - DNA, 103 bp, Artificial Sequence
  Synthetic Polynucleotide
taatacgactcactatagggttatctgagtttatatcgaaataatgacaaaacagaggagattgtcaatgtttcgatataacctggcggcagcgcaaaagatg

SEQ ID NO: 57596 - DNA, 103 bp, Artificial Sequence
  Synthetic Polynucleotide
taatacgactcactatagggtgctattatctgagtttatatcgaaataataacagaggagaattattatgatataaactaacctggcggcagcgcaaaagatg

SEQ ID NO: 57597 - DNA, 103 bp, Artificial Sequence
  Synthetic Polynucleotide
taatacgactcactatagggaatattgctattatctgagtttatatcgaaaacagaggagattcgatatgaactcagataacctggcggcagcgcaaaagatg

SEQ ID NO: 57598 - DNA, 103 bp, Artificial Sequence
  Synthetic Polynucleotide
taatacgactcactataggggagctaatattgctattatctgagtttataaacagaggagatataaaatgagataatagaacctggcggcagcgcaaaagatg

SEQ ID NO: 57599 - DNA, 103 bp, Artificial Sequence
  Synthetic Polynucleotide
taatacgactcactatagggtacgagagctaatattgctattatctgagtaacagaggagaactcagatgatagcaataaacctggcggcagcgcaaaagatg

SEQ ID NO: 57600 - DNA, 103 bp, Artificial Sequence
  Synthetic Polynucleotide
taatacgactcactatagggtactgtacgagagctaatattgctattatcaacagaggagagataatatgaatattagcaacctggcggcagcgcaaaagatg

SEQ ID NO: 57601 - DNA, 103 bp, Artificial Sequence
  Synthetic Polynucleotide
taatacgactcactatagggatctctactgtacgagagctaatattgctaaacagaggagatagcaaatgtagctctcgaacctggcggcagcgcaaaagatg

SEQ ID NO: 57602 - DNA, 103 bp, Artificial Sequence
  Synthetic Polynucleotide
taatacgactcactatagggcaaatatctctactgtacgagagctaatataacagaggagaatattaatgctcgtacagaacctggcggcagcgcaaaagatg

SEQ ID NO: 57603 - DNA, 103 bp, Artificial Sequence
  Synthetic Polynucleotide
taatacgactcactatagggcctctcaaatatctctactgtacgagagctaacagaggagaagctctatgacagtagagaacctggcggcagcgcaaaagatg

SEQ ID NO: 57604 - DNA, 103 bp, Artificial Sequence
  Synthetic Polynucleotide
taatacgactcactataggggagatgcccgtcgcctcgagatatcgataaaacagaggagattatcgatgtctcgaggcaacctggcggcagcgcaaaagatg

SEQ ID NO: 57605 - DNA, 103 bp, Artificial Sequence
  Synthetic Polynucleotide
taatacgactcactatagggttttccctctcaaatatctctactgtacgaaacagaggagatcgtacatgagagatattaacctggcggcagcgcaaaagatg

SEQ ID NO: 57606 - DNA, 103 bp, Artificial Sequence
  Synthetic Polynucleotide
taatacgactcactatagggatgacttttccctctcaaatatctctactgaacagaggagacagtagatgtatttgagaaacctggcggcagcgcaaaagatg

SEQ ID NO: 57607 - DNA, 103 bp, Artificial Sequence
  Synthetic Polynucleotide
taatacgactcactatagggaagagatgacttttccctctcaaatatctcaacagaggagagagataatggagagggaaaacctggcggcagcgcaaaagatg

SEQ ID NO: 57608 - DNA, 103 bp, Artificial Sequence
  Synthetic Polynucleotide
taatacgactcactataggggatacaagagatgacttttccctctcaaataacagaggagaatttgaatgggaaaagtcaacctggcggcagcgcaaaagatg

SEQ ID NO: 57609 - DNA, 103 bp, Artificial Sequence
  Synthetic Polynucleotide
taatacgactcactatagggtatatgatacaagagatgacttttccctctaacagaggagaagagggatgagtcatctcaacctggcggcagcgcaaaagatg

SEQ ID NO: 57610 - DNA, 103 bp, Artificial Sequence
  Synthetic Polynucleotide
taatacgactcactatagggtttaatatatgatacaagagatgacttttcaacagaggagagaaaagatgtctcttgtaaacctggcggcagcgcaaaagatg

SEQ ID NO: 57611 - DNA, 103 bp, Artificial Sequence
  Synthetic Polynucleotide
taatacgactcactataggggtagttttaatatatgatacaagagatgacaacagaggagagtcatcatgtgtatcataaacctggcggcagcgcaaaagatg

SEQ ID NO: 57612 - DNA, 103 bp, Artificial Sequence
  Synthetic Polynucleotide
taatacgactcactatagggtattggtagttttaatatatgatacaagagaacagaggagactcttgatgcatatattaaacctggcggcagcgcaaaagatg

SEQ ID NO: 57613 - DNA, 103 bp, Artificial Sequence
  Synthetic Polynucleotide
taatacgactcactatagggcttcttattggtagttttaatatatgatacaacagaggagagtatcaatgattaaaactaacctggcggcagcgcaaaagatg

SEQ ID NO: 57614 - DNA, 103 bp, Artificial Sequence
  Synthetic Polynucleotide
taatacgactcactatagggtttctcttcttattggtagttttaatatataacagaggagaatatatatgaactaccaaaacctggcggcagcgcaaaagatg

SEQ ID NO: 57615 - DNA, 103 bp, Artificial Sequence
  Synthetic Polynucleotide
taatacgactcactatagggaaacggagatgcccgtcgcctcgagatatcaacagaggagagatatcatgaggcgacggaacctggcggcagcgcaaaagatg

SEQ ID NO: 57616 - DNA, 103 bp, Artificial Sequence
  Synthetic Polynucleotide
taatacgactcactatagggtgacttttctcttcttattggtagttttaaaacagaggagattaaaaatgccaataagaaacctggcggcagcgcaaaagatg

SEQ ID NO: 57617 - DNA, 103 bp, Artificial Sequence
  Synthetic Polynucleotide
taatacgactcactatagggataattgacttttctcttcttattggtagtaacagaggagaactaccatgaagaagagaaacctggcggcagcgcaaaagatg

SEQ ID NO: 57618 - DNA, 103 bp, Artificial Sequence
  Synthetic Polynucleotide
taatacgactcactatagggtccccataattgacttttctcttcttattgaacagaggagacaataaatggagaaaagtaacctggcggcagcgcaaaagatg

SEQ ID NO: 57619 - DNA, 103 bp, Artificial Sequence
  Synthetic Polynucleotide
taatacgactcactatagggttatttccccataattgacttttctcttctaacagaggagaagaagaatgaagtcaattaacctggcggcagcgcaaaagatg

SEQ ID NO: 57620 - DNA, 103 bp, Artificial Sequence
  Synthetic Polynucleotide
taatacgactcactatagggtttctttatttccccataattgacttttctaacagaggagaagaaaaatgaattatgggaacctggcggcagcgcaaaagatg

SEQ ID NO: 57621 - DNA, 103 bp, Artificial Sequence
  Synthetic Polynucleotide
taatacgactcactatagggacagttttctttatttccccataattgactaacagaggagaagtcaaatgtggggaaataacctggcggcagcgcaaaagatg

SEQ ID NO: 57622 - DNA, 103 bp, Artificial Sequence
  Synthetic Polynucleotide
taatacgactcactatagggcatgtacagttttctttatttccccataataacagaggagaattatgatgaaataaagaaacctggcggcagcgcaaaagatg

SEQ ID NO: 57623 - DNA, 103 bp, Artificial Sequence
  Synthetic Polynucleotide
taatacgactcactataggggcctccatgtacagttttctttatttccccaacagaggagaggggaaatgaagaaaactaacctggcggcagcgcaaaagatg

SEQ ID NO: 57624 - DNA, 103 bp, Artificial Sequence
  Synthetic Polynucleotide
taatacgactcactatagggttagtgcctccatgtacagttttctttattaacagaggagaaataaaatgaactgtacaaacctggcggcagcgcaaaagatg

SEQ ID NO: 57625 - DNA, 103 bp, Artificial Sequence
  Synthetic Polynucleotide
taatacgactcactatagggttgcattagtgcctccatgtacagttttctaacagaggagaagaaaaatgtacatggagaacctggcggcagcgcaaaagatg

SEQ ID NO: 57626 - DNA, 103 bp, Artificial Sequence
  Synthetic Polynucleotide
taatacgactcactataggggtattaaacggagatgcccgtcgcctcgagaacagaggagactcgagatgacgggcatcaacctggcggcagcgcaaaagatg

SEQ ID NO: 57627 - DNA, 103 bp, Artificial Sequence
  Synthetic Polynucleotide
taatacgactcactataggggtaatttgcattagtgcctccatgtacagtaacagaggagaactgtaatgggaggcactaacctggcggcagcgcaaaagatg

SEQ ID NO: 57628 - DNA, 103 bp, Artificial Sequence
  Synthetic Polynucleotide
taatacgactcactataggggaaaagtaatttgcattagtgcctccatgtaacagaggagaacatggatgcactaatgcaacctggcggcagcgcaaaagatg

SEQ ID NO: 57629 - DNA, 103 bp, Artificial Sequence
  Synthetic Polynucleotide
taatacgactcactatagggtaccggaaaagtaatttgcattagtgcctcaacagaggagagaggcaatgatgcaaattaacctggcggcagcgcaaaagatg

SEQ ID NO: 57630 - DNA, 103 bp, Artificial Sequence
  Synthetic Polynucleotide
taatacgactcactatagggttttttaccggaaaagtaatttgcattagtaacagaggagaactaatatgaattactttaacctggcggcagcgcaaaagatg

SEQ ID NO: 57631 - DNA, 103 bp, Artificial Sequence
  Synthetic Polynucleotide
taatacgactcactatagggtcagattttttaccggaaaagtaatttgcaaacagaggagatgcaaaatgcttttccggaacctggcggcagcgcaaaagatg

SEQ ID NO: 57632 - DNA, 103 bp, Artificial Sequence
  Synthetic Polynucleotide
taatacgactcactatagggactcatcagattttttaccggaaaagtaataacagaggagaattactatgccggtaaaaaacctggcggcagcgcaaaagatg

SEQ ID NO: 57633 - DNA, 103 bp, Artificial Sequence
  Synthetic Polynucleotide
taatacgactcactatagggcagatactcatcagattttttaccggaaaaaacagaggagattttccatgaaaaaatctaacctggcggcagcgcaaaagatg

SEQ ID NO: 57634 - DNA, 103 bp, Artificial Sequence
  Synthetic Polynucleotide
taatacgactcactataggggtgctcagatactcatcagattttttaccgaacagaggagacggtaaatgatctgatgaaacctggcggcagcgcaaaagatg

SEQ ID NO: 57635 - DNA, 103 bp, Artificial Sequence
  Synthetic Polynucleotide
taatacgactcactatagggctgtagtgctcagatactcatcagatttttaacagaggagaaaaaatatgatgagtatcaacctggcggcagcgcaaaagatg

SEQ ID NO: 57636 - DNA, 103 bp, Artificial Sequence
  Synthetic Polynucleotide
taatacgactcactatagggcctgactgtagtgctcagatactcatcagaaacagaggagatctgatatgtatctgagcaacctggcggcagcgcaaaagatg

SEQ ID NO: 57637 - DNA, 103 bp, Artificial Sequence
  Synthetic Polynucleotide
taatacgactcactatagggtcaatgtattaaacggagatgcccgtcgccaacagaggagaggcgacatgcatctccgtaacctggcggcagcgcaaaagatg

SEQ ID NO: 57638 - DNA, 103 bp, Artificial Sequence
  Synthetic Polynucleotide
taatacgactcactatagggttggacctgactgtagtgctcagatactcaaacagaggagatgagtaatggagcactacaacctggcggcagcgcaaaagatg

SEQ ID NO: 57639 - DNA, 103 bp, Artificial Sequence
  Synthetic Polynucleotide
taatacgactcactatagggtaatattggacctgactgtagtgctcagataacagaggagaatctgaatgctacagtcaaacctggcggcagcgcaaaagatg

SEQ ID NO: 57640 - DNA, 103 bp, Artificial Sequence
  Synthetic Polynucleotide
taatacgactcactatagggttgattaatattggacctgactgtagtgctaacagaggagaagcactatggtcaggtccaacctggcggcagcgcaaaagatg

SEQ ID NO: 57641 - DNA, 103 bp, Artificial Sequence
  Synthetic Polynucleotide
taatacgactcactatagggcaaggttgattaatattggacctgactgtaaacagaggagatacagtatggtccaatataacctggcggcagcgcaaaagatg

SEQ ID NO: 57642 - DNA, 103 bp, Artificial Sequence
  Synthetic Polynucleotide
taatacgactcactatagggtgatccaaggttgattaatattggacctgaaacagaggagatcaggtatgatattaatcaacctggcggcagcgcaaaagatg

SEQ ID NO: 57643 - DNA, 103 bp, Artificial Sequence
  Synthetic Polynucleotide
taatacgactcactatagggggttttgatccaaggttgattaatattggaaacagaggagatccaatatgaatcaacctaacctggcggcagcgcaaaagatg

SEQ ID NO: 57644 - DNA, 103 bp, Artificial Sequence
  Synthetic Polynucleotide
taatacgactcactataggggagatggttttgatccaaggttgattaataaacagaggagatattaaatgaccttggataacctggcggcagcgcaaaagatg

SEQ ID NO: 57645 - DNA, 103 bp, Artificial Sequence
  Synthetic Polynucleotide
taatacgactcactatagggtcttagagatggttttgatccaaggttgataacagaggagaatcaacatgggatcaaaaaacctggcggcagcgcaaaagatg

SEQ ID NO: 57646 - DNA, 103 bp, Artificial Sequence
  Synthetic Polynucleotide
taatacgactcactatagggcatcctcttagagatggttttgatccaaggaacagaggagaccttggatgaaaaccatcaacctggcggcagcgcaaaagatg

SEQ ID NO: 57647 - DNA, 103 bp, Artificial Sequence
  Synthetic Polynucleotide
taatacgactcactatagggactctcatcctcttagagatggttttgatcaacagaggagagatcaaatgcatctctaaaacctggcggcagcgcaaaagatg

SEQ ID NO: 57648 - DNA, 103 bp, Artificial Sequence
  Synthetic Polynucleotide
taatacgactcactatagggtttaatcaatgtattaaacggagatgcccgaacagaggagacgggcaatgccgtttaataacctggcggcagcgcaaaagatg

SEQ ID NO: 57649 - DNA, 103 bp, Artificial Sequence
  Synthetic Polynucleotide
taatacgactcactatagggtattgactctcatcctcttagagatggtttaacagaggagaaaaccaatgctaagaggaaacctggcggcagcgcaaaagatg

SEQ ID NO: 57650 - DNA, 103 bp, Artificial Sequence
  Synthetic Polynucleotide
taatacgactcactatagggaatgatattgactctcatcctcttagagataacagaggagaatctctatgaggatgagaaacctggcggcagcgcaaaagatg

SEQ ID NO: 57651 - DNA, 103 bp, Artificial Sequence
  Synthetic Polynucleotide
taatacgactcactatagggtgattaatgatattgactctcatcctcttaaacagaggagataagagatggagagtcaaaacctggcggcagcgcaaaagatg

SEQ ID NO: 57652 - DNA, 103 bp, Artificial Sequence
  Synthetic Polynucleotide
taatacgactcactatagggtagagtgattaatgatattgactctcatccaacagaggagaggatgaatgtcaatatcaaacctggcggcagcgcaaaagatg

SEQ ID NO: 57653 - DNA, 103 bp, Artificial Sequence
  Synthetic Polynucleotide
taatacgactcactatagggtactatagagtgattaatgatattgactctaacagaggagaagagtcatgatcattaataacctggcggcagcgcaaaagatg

SEQ ID NO: 57654 - DNA, 103 bp, Artificial Sequence
  Synthetic Polynucleotide
taatacgactcactatagggcgcgttactatagagtgattaatgatattgaacagaggagacaatatatgtaatcactcaacctggcggcagcgcaaaagatg

SEQ ID NO: 57655 - DNA, 103 bp, Artificial Sequence
  Synthetic Polynucleotide
taatacgactcactatagggttccacgcgttactatagagtgattaatgaaacagaggagatcattaatgactctatagaacctggcggcagcgcaaaagatg

SEQ ID NO: 57656 - DNA, 103 bp, Artificial Sequence
  Synthetic Polynucleotide
taatacgactcactataggggctttttccacgcgttactatagagtgattaacagaggagaaatcacatgatagtaacgaacctggcggcagcgcaaaagatg

SEQ ID NO: 57657 - DNA, 103 bp, Artificial Sequence
  Synthetic Polynucleotide
taatacgactcactatagggatggagctttttccacgcgttactatagagaacagaggagactctatatgaacgcgtggaacctggcggcagcgcaaaagatg

SEQ ID NO: 57658 - DNA, 103 bp, Artificial Sequence
  Synthetic Polynucleotide
taatacgactcactataggggtaatatggagctttttccacgcgttactaaacagaggagatagtaaatggtggaaaaaaacctggcggcagcgcaaaagatg

SEQ ID NO: 57659 - DNA, 103 bp, Artificial Sequence
  Synthetic Polynucleotide
taatacgactcactatagggcactctttaatcaatgtattaaacggagataacagaggagaatctccatgtaatacattaacctggcggcagcgcaaaagatg

SEQ ID NO: 57660 - DNA, 103 bp, Artificial Sequence
  Synthetic Polynucleotide
taatacgactcactatagggagtttgtaatatggagctttttccacgcgtaacagaggagaacgcgtatgaaaagctccaacctggcggcagcgcaaaagatg

SEQ ID NO: 57661 - DNA, 103 bp, Artificial Sequence
  Synthetic Polynucleotide
taatacgactcactatagggtctatagtttgtaatatggagctttttccaaacagaggagatggaaaatgctccatattaacctggcggcagcgcaaaagatg

SEQ ID NO: 57662 - DNA, 103 bp, Artificial Sequence
  Synthetic Polynucleotide
taatacgactcactatagggtaatttctatagtttgtaatatggagctttaacagaggagaaaagctatgtattacaaaaacctggcggcagcgcaaaagatg

SEQ ID NO: 57663 - DNA, 103 bp, Artificial Sequence
  Synthetic Polynucleotide
taatacgactcactatagggaaaaataatttctatagtttgtaatatggaaacagaggagatccataatgcaaactataaacctggcggcagcgcaaaagatg

SEQ ID NO: 57664 - DNA, 103 bp, Artificial Sequence
  Synthetic Polynucleotide
taatacgactcactatagggttagtaaaaataatttctatagtttgtaataacagaggagaattacaatgtatagaaataacctggcggcagcgcaaaagatg

SEQ ID NO: 57665 - DNA, 103 bp, Artificial Sequence
  Synthetic Polynucleotide
taatacgactcactatagggttctattagtaaaaataatttctatagtttaacagaggagaaaactaatgaaattatttaacctggcggcagcgcaaaagatg

SEQ ID NO: 57666 - DNA, 103 bp, Artificial Sequence
  Synthetic Polynucleotide
taatacgactcactatagggacatgttctattagtaaaaataatttctataacagaggagaatagaaatgatttttactaacctggcggcagcgcaaaagatg

SEQ ID NO: 57667 - DNA, 103 bp, Artificial Sequence
  Synthetic Polynucleotide
taatacgactcactatagggttcacacatgttctattagtaaaaataattaacagaggagaaattatatgtactaatagaacctggcggcagcgcaaaagatg

SEQ ID NO: 57668 - DNA, 103 bp, Artificial Sequence
  Synthetic Polynucleotide
taatacgactcactatagggatattttcacacatgttctattagtaaaaaaacagaggagatttttaatgatagaacataacctggcggcagcgcaaaagatg

SEQ ID NO: 57669 - DNA, 103 bp, Artificial Sequence
  Synthetic Polynucleotide
taatacgactcactatagggcttgaatattttcacacatgttctattagtaacagaggagaactaatatgacatgtgtgaacctggcggcagcgcaaaagatg

SEQ ID NO: 57670 - DNA, 103 bp, Artificial Sequence
  Synthetic Polynucleotide
taatacgactcactatagggatggacactctttaatcaatgtattaaacgaacagaggagacgtttaatgcattgattaaacctggcggcagcgcaaaagatg

SEQ ID NO: 57671 - DNA, 103 bp, Artificial Sequence
  Synthetic Polynucleotide
taatacgactcactataggggaatccttgaatattttcacacatgttctaaacagaggagatagaacatgtgtgaaaataacctggcggcagcgcaaaagatg

SEQ ID NO: 57672 - DNA, 103 bp, Artificial Sequence
  Synthetic Polynucleotide
taatacgactcactatagggtagtagaatccttgaatattttcacacatgaacagaggagacatgtgatgaaatattcaaacctggcggcagcgcaaaagatg

SEQ ID NO: 57673 - DNA, 103 bp, Artificial Sequence
  Synthetic Polynucleotide
taatacgactcactataggggtgcatagtagaatccttgaatattttcacaacagaggagagtgaaaatgttcaaggataacctggcggcagcgcaaaagatg

SEQ ID NO: 57674 - DNA, 103 bp, Artificial Sequence
  Synthetic Polynucleotide
taatacgactcactatagggataatgtgcatagtagaatccttgaatattaacagaggagaaatattatgggattctacaacctggcggcagcgcaaaagatg

SEQ ID NO: 57675 - DNA, 103 bp, Artificial Sequence
  Synthetic Polynucleotide
taatacgactcactatagggatagaataatgtgcatagtagaatccttgaaacagaggagatcaaggatgctactatgcaacctggcggcagcgcaaaagatg

SEQ ID NO: 57676 - DNA, 103 bp, Artificial Sequence
  Synthetic Polynucleotide
taatacgactcactatagggcttggatagaataatgtgcatagtagaatcaacagaggagagattctatgatgcacattaacctggcggcagcgcaaaagatg

SEQ ID NO: 57677 - DNA, 103 bp, Artificial Sequence
  Synthetic Polynucleotide
taatacgactcactatagggttgtccttggatagaataatgtgcatagtaaacagaggagatactatatgcattattctaacctggcggcagcgcaaaagatg

SEQ ID NO: 57678 - DNA, 103 bp, Artificial Sequence
  Synthetic Polynucleotide
taatacgactcactatagggcatccttgtccttggatagaataatgtgcaaacagaggagatgcacaatgttctatccaaacctggcggcagcgcaaaagatg

SEQ ID NO: 57679 - DNA, 103 bp, Artificial Sequence
  Synthetic Polynucleotide
taatacgactcactatagggcttttcatccttgtccttggatagaataataacagaggagaattattatgtccaaggacaacctggcggcagcgcaaaagatg

SEQ ID NO: 57680 - DNA, 103 bp, Artificial Sequence
  Synthetic Polynucleotide
taatacgactcactatagggcaccccttttcatccttgtccttggatagaaacagaggagatctatcatgggacaaggaaacctggcggcagcgcaaaagatg

SEQ ID NO: 57681 - DNA, 103 bp, Artificial Sequence
  Synthetic Polynucleotide
taatacgactcactatagggaacagaactacacaaacacaataatgatagaacagaggagactatcaatgttgtgtttgaacctggcggcagcgcaaaagatg

SEQ ID NO: 57682 - DNA, 103 bp, Artificial Sequence
  Synthetic Polynucleotide
taatacgactcactatagggactggatggacactctttaatcaatgtattaacagaggagaaatacaatgattaaagagaacctggcggcagcgcaaaagatg

SEQ ID NO: 57683 - DNA, 103 bp, Artificial Sequence
  Synthetic Polynucleotide
taatacgactcactataggggtatacaccccttttcatccttgtccttggaacagaggagaccaaggatgaggatgaaaaacctggcggcagcgcaaaagatg

SEQ ID NO: 57684 - DNA, 103 bp, Artificial Sequence
  Synthetic Polynucleotide
taatacgactcactatagggcatgtgtatacaccccttttcatccttgtcaacagaggagagacaagatggaaaaggggaacctggcggcagcgcaaaagatg

SEQ ID NO: 57685 - DNA, 103 bp, Artificial Sequence
  Synthetic Polynucleotide
taatacgactcactatagggtcaatcatgtgtatacaccccttttcatccaacagaggagaggatgaatgggggtgtataacctggcggcagcgcaaaagatg

SEQ ID NO: 57686 - DNA, 103 bp, Artificial Sequence
  Synthetic Polynucleotide
taatacgactcactatagggatttgtcaatcatgtgtatacaccccttttaacagaggagaaaaaggatggtatacacaaacctggcggcagcgcaaaagatg

SEQ ID NO: 57687 - DNA, 103 bp, Artificial Sequence
  Synthetic Polynucleotide
taatacgactcactataggggaataatttgtcaatcatgtgtatacacccaacagaggagagggtgtatgcacatgattaacctggcggcagcgcaaaagatg

SEQ ID NO: 57688 - DNA, 103 bp, Artificial Sequence
  Synthetic Polynucleotide
taatacgactcactatagggacatagaataatttgtcaatcatgtgtataaacagaggagatatacaatggattgacaaaacctggcggcagcgcaaaagatg

SEQ ID NO: 57689 - DNA, 103 bp, Artificial Sequence
  Synthetic Polynucleotide
taatacgactcactatagggaatagacatagaataatttgtcaatcatgtaacagaggagaacatgaatgacaaattataacctggcggcagcgcaaaagatg

SEQ ID NO: 57690 - DNA, 103 bp, Artificial Sequence
  Synthetic Polynucleotide
taatacgactcactatagggattataatagacatagaataatttgtcaataacagaggagaattgacatgttattctataacctggcggcagcgcaaaagatg

SEQ ID NO: 57691 - DNA, 103 bp, Artificial Sequence
  Synthetic Polynucleotide
taatacgactcactatagggaataaattataatagacatagaataatttgaacagaggagacaaattatgctatgtctaaacctggcggcagcgcaaaagatg

SEQ ID NO: 57692 - DNA, 103 bp, Artificial Sequence
  Synthetic Polynucleotide
taatacgactcactatagggacagaaataaattataatagacatagaataaacagaggagatattctatgtctattataaacctggcggcagcgcaaaagatg

SEQ ID NO: 57693 - DNA, 103 bp, Artificial Sequence
  Synthetic Polynucleotide
taatacgactcactatagggcaggtactggatggacactctttaatcaataacagaggagaattgatatgagagtgtccaacctggcggcagcgcaaaagatg

SEQ ID NO: 57694 - DNA, 103 bp, Artificial Sequence
  Synthetic Polynucleotide
taatacgactcactataggggaacaacagaaataaattataatagacataaacagaggagatatgtcatgtataatttaaacctggcggcagcgcaaaagatg

SEQ ID NO: 57695 - DNA, 103 bp, Artificial Sequence
  Synthetic Polynucleotide
taatacgactcactatagggtcctcgaacaacagaaataaattataatagaacagaggagactattaatgtttatttctaacctggcggcagcgcaaaagatg

SEQ ID NO: 57696 - DNA, 103 bp, Artificial Sequence
  Synthetic Polynucleotide
taatacgactcactatagggtgatatcctcgaacaacagaaataaattataacagaggagaataattatgttctgttgtaacctggcggcagcgcaaaagatg

SEQ ID NO: 57697 - DNA, 103 bp, Artificial Sequence
  Synthetic Polynucleotide
taatacgactcactatagggttggatgatatcctcgaacaacagaaataaaacagaggagattatttatgttgttcgagaacctggcggcagcgcaaaagatg

SEQ ID NO: 57698 - DNA, 103 bp, Artificial Sequence
  Synthetic Polynucleotide
taatacgactcactatagggtcgttttggatgatatcctcgaacaacagaaacagaggagatctgttatgcgaggatataacctggcggcagcgcaaaagatg

SEQ ID NO: 57699 - DNA, 103 bp, Artificial Sequence
  Synthetic Polynucleotide
taatacgactcactatagggagtactcgttttggatgatatcctcgaacaaacagaggagatgttcgatgatatcatccaacctggcggcagcgcaaaagatg

SEQ ID NO: 57700 - DNA, 103 bp, Artificial Sequence
  Synthetic Polynucleotide
taatacgactcactatagggtttaaagtactcgttttggatgatatcctcaacagaggagagaggatatgatccaaaacaacctggcggcagcgcaaaagatg

SEQ ID NO: 57701 - DNA, 103 bp, Artificial Sequence
  Synthetic Polynucleotide
taatacgactcactatagggacttctttaaagtactcgttttggatgataaacagaggagatatcatatgaaacgagtaaacctggcggcagcgcaaaagatg

SEQ ID NO: 57702 - DNA, 103 bp, Artificial Sequence
  Synthetic Polynucleotide
taatacgactcactatagggtagctacttctttaaagtactcgttttggaaacagaggagatccaaaatgagtactttaaacctggcggcagcgcaaaagatg

SEQ ID NO: 57703 - DNA, 103 bp, Artificial Sequence
  Synthetic Polynucleotide
taatacgactcactatagggaacattagctacttctttaaagtactcgttaacagaggagaaacgagatgtttaaagaaaacctggcggcagcgcaaaagatg

SEQ ID NO: 57704 - DNA, 103 bp, Artificial Sequence
  Synthetic Polynucleotide
taatacgactcactatagggatgtacaggtactggatggacactctttaaaacagaggagattaaagatggtccatccaaacctggcggcagcgcaaaagatg

SEQ ID NO: 57705 - DNA, 103 bp, Artificial Sequence
  Synthetic Polynucleotide
taatacgactcactatagggttcacaacattagctacttctttaaagtacaacagaggagagtacttatgagaagtagcaacctggcggcagcgcaaaagatg

SEQ ID NO: 57706 - DNA, 103 bp, Artificial Sequence
  Synthetic Polynucleotide
taatacgactcactatagggcatggttcacaacattagctacttctttaaaacagaggagattaaagatgtagctaatgaacctggcggcagcgcaaaagatg

SEQ ID NO: 57707 - DNA, 103 bp, Artificial Sequence
  Synthetic Polynucleotide
taatacgactcactataggggagtacatggttcacaacattagctacttcaacagaggagagaagtaatgaatgttgtgaacctggcggcagcgcaaaagatg

SEQ ID NO: 57708 - DNA, 103 bp, Artificial Sequence
  Synthetic Polynucleotide
taatacgactcactataggggccgtgagtacatggttcacaacattagctaacagaggagaagctaaatgtgtgaaccaaacctggcggcagcgcaaaagatg

SEQ ID NO: 57709 - DNA, 103 bp, Artificial Sequence
  Synthetic Polynucleotide
taatacgactcactatagggccgtagccgtgagtacatggttcacaacataacagaggagaatgttgatgaccatgtacaacctggcggcagcgcaaaagatg

SEQ ID NO: 57710 - DNA, 103 bp, Artificial Sequence
  Synthetic Polynucleotide
taatacgactcactatagggtaatgccgtagccgtgagtacatggttcacaacagaggagagtgaacatggtactcacgaacctggcggcagcgcaaaagatg

SEQ ID NO: 57711 - DNA, 103 bp, Artificial Sequence
  Synthetic Polynucleotide
taatacgactcactatagggtcatctaatgccgtagccgtgagtacatggaacagaggagaccatgtatgcacggctacaacctggcggcagcgcaaaagatg

SEQ ID NO: 57712 - DNA, 103 bp, Artificial Sequence
  Synthetic Polynucleotide
taatacgactcactatagggatttctcatctaatgccgtagccgtgagtaaacagaggagatactcaatgctacggcataacctggcggcagcgcaaaagatg

SEQ ID NO: 57713 - DNA, 103 bp, Artificial Sequence
  Synthetic Polynucleotide
taatacgactcactataggggaataatttctcatctaatgccgtagccgtaacagaggagaacggctatggcattagataacctggcggcagcgcaaaagatg

SEQ ID NO: 57714 - DNA, 103 bp, Artificial Sequence
  Synthetic Polynucleotide
taatacgactcactatagggattaggaataatttctcatctaatgccgtaaacagaggagatacggcatgagatgagaaaacctggcggcagcgcaaaagatg

SEQ ID NO: 57715 - DNA, 103 bp, Artificial Sequence
  Synthetic Polynucleotide
taatacgactcactataggggctaaatgtacaggtactggatggacactcaacagaggagagagtgtatgtccagtaccaacctggcggcagcgcaaaagatg

SEQ ID NO: 57716 - DNA, 103 bp, Artificial Sequence
  Synthetic Polynucleotide
taatacgactcactatagggtcttaattaggaataatttctcatctaatgaacagaggagacattagatgagaaattataacctggcggcagcgcaaaagatg

SEQ ID NO: 57717 - DNA, 103 bp, Artificial Sequence
  Synthetic Polynucleotide
taatacgactcactatagggcattttcttaattaggaataatttctcatcaacagaggagagatgagatgttattcctaaacctggcggcagcgcaaaagatg

SEQ ID NO: 57718 - DNA, 103 bp, Artificial Sequence
  Synthetic Polynucleotide
taatacgactcactatagggttagccattttcttaattaggaataatttcaacagaggagagaaattatgcctaattaaaacctggcggcagcgcaaaagatg

SEQ ID NO: 57719 - DNA, 103 bp, Artificial Sequence
  Synthetic Polynucleotide
taatacgactcactatagggcgtgtttagccattttcttaattaggaataaacagaggagatattccatgttaagaaaaaacctggcggcagcgcaaaagatg

SEQ ID NO: 57720 - DNA, 103 bp, Artificial Sequence
  Synthetic Polynucleotide
taatacgactcactatagggaacatcgtgtttagccattttcttaattagaacagaggagactaattatgaaaatggctaacctggcggcagcgcaaaagatg

SEQ ID NO: 57721 - DNA, 103 bp, Artificial Sequence
  Synthetic Polynucleotide
taatacgactcactatagggccataaacatcgtgtttagccattttcttaaacagaggagataagaaatgggctaaacaaacctggcggcagcgcaaaagatg

SEQ ID NO: 57722 - DNA, 103 bp, Artificial Sequence
  Synthetic Polynucleotide
taatacgactcactatagggtaactccataaacatcgtgtttagccatttaacagaggagaaaatggatgaacacgatgaacctggcggcagcgcaaaagatg

SEQ ID NO: 57723 - DNA, 103 bp, Artificial Sequence
  Synthetic Polynucleotide
taatacgactcactatagggattgctaactccataaacatcgtgtttagcaacagaggagagctaaaatggatgtttataacctggcggcagcgcaaaagatg

SEQ ID NO: 57724 - DNA, 103 bp, Artificial Sequence
  Synthetic Polynucleotide
taatacgactcactatagggttgaaattgctaactccataaacatcgtgtaacagaggagaacacgaatgttatggagtaacctggcggcagcgcaaaagatg

SEQ ID NO: 57725 - DNA, 103 bp, Artificial Sequence
  Synthetic Polynucleotide
taatacgactcactatagggctattttgaaattgctaactccataaacataacagaggagaatgtttatggagttagcaaacctggcggcagcgcaaaagatg

SEQ ID NO: 57726 - DNA, 103 bp, Artificial Sequence
  Synthetic Polynucleotide
taatacgactcactatagggtatatgctaaatgtacaggtactggatggaaacagaggagatccatcatgtacctgtacaacctggcggcagcgcaaaagatg

SEQ ID NO: 57727 - DNA, 103 bp, Artificial Sequence
  Synthetic Polynucleotide
taatacgactcactatagggcatccctattttgaaattgctaactccataaacagaggagatatggaatgagcaatttcaacctggcggcagcgcaaaagatg

SEQ ID NO: 57728 - DNA, 103 bp, Artificial Sequence
  Synthetic Polynucleotide
taatacgactcactatagggttaaacatccctattttgaaattgctaactaacagaggagaagttagatgtttcaaaataacctggcggcagcgcaaaagatg

SEQ ID NO: 57729 - DNA, 103 bp, Artificial Sequence
  Synthetic Polynucleotide
taatacgactcactatagggtcaagttaaacatccctattttgaaattgcaacagaggagagcaattatgaaatagggaaacctggcggcagcgcaaaagatg

SEQ ID NO: 57730 - DNA, 103 bp, Artificial Sequence
  Synthetic Polynucleotide
taatacgactcactatagggaaatgtcaagttaaacatccctattttgaaaacagaggagattcaaaatggggatgtttaacctggcggcagcgcaaaagatg

SEQ ID NO: 57731 - DNA, 103 bp, Artificial Sequence
  Synthetic Polynucleotide
taatacgactcactatagggttaataaatgtcaagttaaacatccctattaacagaggagaaataggatggtttaacttaacctggcggcagcgcaaaagatg

SEQ ID NO: 57732 - DNA, 103 bp, Artificial Sequence
  Synthetic Polynucleotide
taatacgactcactatagggatgacttaataaatgtcaagttaaacatccaacagaggagaggatgtatgacttgacataacctggcggcagcgcaaaagatg

SEQ ID NO: 57733 - DNA, 103 bp, Artificial Sequence
  Synthetic Polynucleotide
taatacgactcactatagggatccaatgacttaataaatgtcaagttaaaaacagaggagatttaacatgacatttattaacctggcggcagcgcaaaagatg

SEQ ID NO: 57734 - DNA, 103 bp, Artificial Sequence
  Synthetic Polynucleotide
taatacgactcactataggggtatgatccaatgacttaataaatgtcaagaacagaggagacttgacatgtattaagtcaacctggcggcagcgcaaaagatg

SEQ ID NO: 57735 - DNA, 103 bp, Artificial Sequence
  Synthetic Polynucleotide
taatacgactcactatagggaaacggtatgatccaatgacttaataaatgaacagaggagacatttaatgagtcattggaacctggcggcagcgcaaaagatg

SEQ ID NO: 57736 - DNA, 103 bp, Artificial Sequence
  Synthetic Polynucleotide
taatacgactcactatagggggggaaaacggtatgatccaatgacttaataacagaggagaattaagatgttggatcataacctggcggcagcgcaaaagatg

SEQ ID NO: 57737 - DNA, 103 bp, Artificial Sequence
  Synthetic Polynucleotide
taatacgactcactatagggacctatatatgctaaatgtacaggtactggaacagaggagaccagtaatggtacatttaaacctggcggcagcgcaaaagatg

SEQ ID NO: 57738 - DNA, 103 bp, Artificial Sequence
  Synthetic Polynucleotide
taatacgactcactatagggagagaggggaaaacggtatgatccaatgacaacagaggagagtcattatgtcataccgtaacctggcggcagcgcaaaagatg

SEQ ID NO: 57739 - DNA, 103 bp, Artificial Sequence
  Synthetic Polynucleotide
taatacgactcactatagggctaacagagaggggaaaacggtatgatccaaacagaggagatggatcatgccgttttccaacctggcggcagcgcaaaagatg

SEQ ID NO: 57740 - DNA, 103 bp, Artificial Sequence
  Synthetic Polynucleotide
taatacgactcactatagggctcatctaacagagaggggaaaacggtatgaacagaggagacataccatgttcccctctaacctggcggcagcgcaaaagatg

SEQ ID NO: 57741 - DNA, 103 bp, Artificial Sequence
  Synthetic Polynucleotide
taatacgactcactatagggctatcctcatctaacagagaggggaaaacgaacagaggagacgttttatgctctctgttaacctggcggcagcgcaaaagatg

SEQ ID NO: 57742 - DNA, 103 bp, Artificial Sequence
  Synthetic Polynucleotide
taatacgactcactatagggttttactatcctcatctaacagagaggggaaacagaggagatcccctatgtgttagatgaacctggcggcagcgcaaaagatg

SEQ ID NO: 57743 - DNA, 103 bp, Artificial Sequence
  Synthetic Polynucleotide
taatacgactcactatagggctttattttactatcctcatctaacagagaaacagaggagatctctgatggatgaggataacctggcggcagcgcaaaagatg

SEQ ID NO: 57744 - DNA, 103 bp, Artificial Sequence
  Synthetic Polynucleotide
taatacgactcactatagggaaaaactttattttactatcctcatctaacaacagaggagagttagaatgggatagtaaaacctggcggcagcgcaaaagatg

SEQ ID NO: 57745 - DNA, 103 bp, Artificial Sequence
  Synthetic Polynucleotide
taatacgactcactatagggccttaaaaaactttattttactatcctcataacagaggagaatgaggatggtaaaataaaacctggcggcagcgcaaaagatg

SEQ ID NO: 57746 - DNA, 103 bp, Artificial Sequence
  Synthetic Polynucleotide
taatacgactcactatagggtttccccttaaaaaactttattttactatcaacagaggagagatagtatgataaagtttaacctggcggcagcgcaaaagatg

SEQ ID NO: 57747 - DNA, 103 bp, Artificial Sequence
  Synthetic Polynucleotide
taatacgactcactatagggagctttttccccttaaaaaactttattttaaacagaggagataaaatatggttttttaaaacctggcggcagcgcaaaagatg

SEQ ID NO: 57748 - DNA, 103 bp, Artificial Sequence
  Synthetic Polynucleotide
taatacgactcactatagggatgggacctatatatgctaaatgtacaggtaacagaggagaacctgtatgtttagcataaacctggcggcagcgcaaaagatg

SEQ ID NO: 57749 - DNA, 103 bp, Artificial Sequence
  Synthetic Polynucleotide
taatacgactcactatagggtattgagctttttccccttaaaaaactttaaacagaggagataaagtatgttaaggggaaacctggcggcagcgcaaaagatg

SEQ ID NO: 57750 - DNA, 103 bp, Artificial Sequence
  Synthetic Polynucleotide
taatacgactcactatagggtacaatattgagctttttccccttaaaaaaaacagaggagattttttatggggaaaaagaacctggcggcagcgcaaaagatg

SEQ ID NO: 57751 - DNA, 103 bp, Artificial Sequence
  Synthetic Polynucleotide
taatacgactcactatagggaatgctacaatattgagctttttccccttaaacagaggagataagggatgaaagctcaaaacctggcggcagcgcaaaagatg

SEQ ID NO: 57752 - DNA, 103 bp, Artificial Sequence
  Synthetic Polynucleotide
taatacgactcactatagggagcgtaatgctacaatattgagctttttccaacagaggagaggaaaaatgtcaatattgaacctggcggcagcgcaaaagatg

SEQ ID NO: 57753 - DNA, 103 bp, Artificial Sequence
  Synthetic Polynucleotide
taatacgactcactatagggcagagagcgtaatgctacaatattgagcttaacagaggagaaagctcatgattgtagcaaacctggcggcagcgcaaaagatg

SEQ ID NO: 57754 - DNA, 103 bp, Artificial Sequence
  Synthetic Polynucleotide
taatacgactcactatagggtcctccagagagcgtaatgctacaatattgaacagaggagacaatatatgagcattacgaacctggcggcagcgcaaaagatg

SEQ ID NO: 57755 - DNA, 103 bp, Artificial Sequence
  Synthetic Polynucleotide
taatacgactcactatagggtacaatcctccagagagcgtaatgctacaaaacagaggagattgtagatgtacgctctcaacctggcggcagcgcaaaagatg

SEQ ID NO: 57756 - DNA, 103 bp, Artificial Sequence
  Synthetic Polynucleotide
taatacgactcactatagggatttatacaatcctccagagagcgtaatgcaacagaggagagcattaatgtctctggagaacctggcggcagcgcaaaagatg

SEQ ID NO: 57757 - DNA, 103 bp, Artificial Sequence
  Synthetic Polynucleotide
taatacgactcactatagggacgtaatttatacaatcctccagagagcgtaacagaggagaacgctcatgggaggattgaacctggcggcagcgcaaaagatg

SEQ ID NO: 57758 - DNA, 103 bp, Artificial Sequence
  Synthetic Polynucleotide
taatacgactcactatagggtagtcacgtaatttatacaatcctccagagaacagaggagactctggatgattgtataaaacctggcggcagcgcaaaagatg

SEQ ID NO: 57759 - DNA, 103 bp, Artificial Sequence
  Synthetic Polynucleotide
taatacgactcactatagggaaaaaatgggacctatatatgctaaatgtaaacagaggagatacattatgcatatatagaacctggcggcagcgcaaaagatg

SEQ ID NO: 57760 - DNA, 103 bp, Artificial Sequence
  Synthetic Polynucleotide
taatacgactcactatagggggatttagtcacgtaatttatacaatcctcaacagaggagagaggatatgataaattacaacctggcggcagcgcaaaagatg

SEQ ID NO: 57761 - DNA, 103 bp, Artificial Sequence
  Synthetic Polynucleotide
taatacgactcactatagggttctcggatttagtcacgtaatttatacaaaacagaggagattgtatatgttacgtgacaacctggcggcagcgcaaaagatg

SEQ ID NO: 57762 - DNA, 103 bp, Artificial Sequence
  Synthetic Polynucleotide
taatacgactcactatagggtcatattctcggatttagtcacgtaatttaaacagaggagataaattatgtgactaaataacctggcggcagcgcaaaagatg

SEQ ID NO: 57763 - DNA, 103 bp, Artificial Sequence
  Synthetic Polynucleotide
taatacgactcactatagggttctatcatattctcggatttagtcacgtaaacagaggagatacgtgatgaaatccgagaacctggcggcagcgcaaaagatg

SEQ ID NO: 57764 - DNA, 103 bp, Artificial Sequence
  Synthetic Polynucleotide
taatacgactcactatagggatcatttctatcatattctcggatttagtcaacagaggagagactaaatgcgagaatataacctggcggcagcgcaaaagatg

SEQ ID NO: 57765 - DNA, 103 bp, Artificial Sequence
  Synthetic Polynucleotide
taatacgactcactatagggccttcatcatttctatcatattctcggattaacagaggagaaatccgatgatatgatagaacctggcggcagcgcaaaagatg

SEQ ID NO: 57766 - DNA, 103 bp, Artificial Sequence
  Synthetic Polynucleotide
taatacgactcactatagggtctttccttcatcatttctatcatattctcaacagaggagagagaatatgatagaaatgaacctggcggcagcgcaaaagatg

SEQ ID NO: 57767 - DNA, 103 bp, Artificial Sequence
  Synthetic Polynucleotide
taatacgactcactataggggtcgatctttccttcatcatttctatcataaacagaggagatatgatatgaatgatgaaaacctggcggcagcgcaaaagatg

SEQ ID NO: 57768 - DNA, 103 bp, Artificial Sequence
  Synthetic Polynucleotide
taatacgactcactatagggaaatagtcgatctttccttcatcatttctaaacagaggagatagaaaatgtgaaggaaaaacctggcggcagcgcaaaagatg

SEQ ID NO: 57769 - DNA, 103 bp, Artificial Sequence
  Synthetic Polynucleotide
taatacgactcactatagggatttaaaatagtcgatctttccttcatcataacagaggagaatgatgatggaaagatcgaacctggcggcagcgcaaaagatg

SEQ ID NO: 57770 - DNA, 103 bp, Artificial Sequence
  Synthetic Polynucleotide
taatacgactcactatagggaaagcaaaaaatgggacctatatatgctaaaacagaggagattagcaatgataggtcccaacctggcggcagcgcaaaagatg

SEQ ID NO: 57771 - DNA, 103 bp, Artificial Sequence
  Synthetic Polynucleotide
taatacgactcactatagggatgctatttaaaatagtcgatctttccttcaacagaggagagaaggaatgatcgactataacctggcggcagcgcaaaagatg

SEQ ID NO: 57772 - DNA, 103 bp, Artificial Sequence
  Synthetic Polynucleotide
taatacgactcactatagggtatctatgctatttaaaatagtcgatctttaacagaggagaaaagatatgctattttaaaacctggcggcagcgcaaaagatg

SEQ ID NO: 57773 - DNA, 103 bp, Artificial Sequence
  Synthetic Polynucleotide
taatacgactcactatagggttctatatctatgctatttaaaatagtcgaaacagaggagatcgactatgttaaatagcaacctggcggcagcgcaaaagatg

SEQ ID NO: 57774 - DNA, 103 bp, Artificial Sequence
  Synthetic Polynucleotide
taatacgactcactatagggtccgtttctatatctatgctatttaaaataaacagaggagatattttatgtagcatagaaacctggcggcagcgcaaaagatg

SEQ ID NO: 57775 - DNA, 103 bp, Artificial Sequence
  Synthetic Polynucleotide
taatacgactcactatagggccgattccgtttctatatctatgctatttaaacagaggagataaataatgtagatatagaacctggcggcagcgcaaaagatg

SEQ ID NO: 57776 - DNA, 103 bp, Artificial Sequence
  Synthetic Polynucleotide
taatacgactcactatagggatctaccgattccgtttctatatctatgctaacagaggagaagcataatgatagaaacgaacctggcggcagcgcaaaagatg

SEQ ID NO: 57777 - DNA, 103 bp, Artificial Sequence
  Synthetic Polynucleotide
taatacgactcactatagggagacgatctaccgattccgtttctatatctaacagaggagaagatatatgaacggaatcaacctggcggcagcgcaaaagatg

SEQ ID NO: 57778 - DNA, 103 bp, Artificial Sequence
  Synthetic Polynucleotide
taatacgactcactatagggcttttagacgatctaccgattccgtttctaaacagaggagatagaaaatgaatcggtagaacctggcggcagcgcaaaagatg

SEQ ID NO: 57779 - DNA, 103 bp, Artificial Sequence
  Synthetic Polynucleotide
taatacgactcactatagggcaaatcttttagacgatctaccgattccgtaacagaggagaacggaaatggtagatcgtaacctggcggcagcgcaaaagatg

SEQ ID NO: 57780 - DNA, 103 bp, Artificial Sequence
  Synthetic Polynucleotide
taatacgactcactatagggagaagcaaatcttttagacgatctaccgataacagaggagaatcggtatgtcgtctaaaaacctggcggcagcgcaaaagatg

SEQ ID NO: 57781 - DNA, 103 bp, Artificial Sequence
  Synthetic Polynucleotide
taatacgactcactatagggtacagaaagcaaaaaatgggacctatatataacagaggagaatatatatgtcccattttaacctggcggcagcgcaaaagatg

SEQ ID NO: 57782 - DNA, 103 bp, Artificial Sequence
  Synthetic Polynucleotide
taatacgactcactatagggattttagaagcaaatcttttagacgatctaaacagaggagatagatcatgtaaaagattaacctggcggcagcgcaaaagatg

SEQ ID NO: 57783 - DNA, 103 bp, Artificial Sequence
  Synthetic Polynucleotide
taatacgactcactatagggttttcattttagaagcaaatcttttagacgaacagaggagacgtctaatggatttgcttaacctggcggcagcgcaaaagatg

SEQ ID NO: 57784 - DNA, 103 bp, Artificial Sequence
  Synthetic Polynucleotide
taatacgactcactataggggttttttttcattttagaagcaaatcttttaacagaggagaaaaagaatggcttctaaaaacctggcggcagcgcaaaagatg

SEQ ID NO: 57785 - DNA, 103 bp, Artificial Sequence
  Synthetic Polynucleotide
taatacgactcactatagggtcagtgttttttttcattttagaagcaaataacagaggagaatttgcatgtaaaatgaaaacctggcggcagcgcaaaagatg

SEQ ID NO: 57786 - DNA, 103 bp, Artificial Sequence
  Synthetic Polynucleotide
taatacgactcactatagggctgaatcagtgttttttttcattttagaagaacagaggagacttctaatgtgaaaaaaaaacctggcggcagcgcaaaagatg

SEQ ID NO: 57787 - DNA, 103 bp, Artificial Sequence
  Synthetic Polynucleotide
taatacgactcactatagggcatttctgaatcagtgttttttttcattttaacagaggagaaaaatgatgaaaaacactaacctggcggcagcgcaaaagatg

SEQ ID NO: 57788 - DNA, 103 bp, Artificial Sequence
  Synthetic Polynucleotide
taatacgactcactatagggtgatccatttctgaatcagtgttttttttcaacagaggagagaaaaaatgcactgattcaacctggcggcagcgcaaaagatg

SEQ ID NO: 57789 - DNA, 103 bp, Artificial Sequence
  Synthetic Polynucleotide
taatacgactcactataggggtcgttgatccatttctgaatcagtgttttaacagaggagaaaaacaatgattcagaaaaacctggcggcagcgcaaaagatg

SEQ ID NO: 57790 - DNA, 103 bp, Artificial Sequence
  Synthetic Polynucleotide
taatacgactcactatagggcccgagtcgttgatccatttctgaatcagtaacagaggagaactgatatggaaatggataacctggcggcagcgcaaaagatg

SEQ ID NO: 57791 - DNA, 103 bp, Artificial Sequence
  Synthetic Polynucleotide
taatacgactcactatagggttatacccgagtcgttgatccatttctgaaaacagaggagattcagaatgggatcaacgaacctggcggcagcgcaaaagatg

SEQ ID NO: 57792 - DNA, 103 bp, Artificial Sequence
  Synthetic Polynucleotide
taatacgactcactataggggatagaacagaactacacaaacacaataataacagaggagaattattatgtttgtgtagaacctggcggcagcgcaaaagatg

SEQ ID NO: 57793 - DNA, 103 bp, Artificial Sequence
  Synthetic Polynucleotide
taatacgactcactatagggctggatacagaaagcaaaaaatgggacctaaacagaggagataggtcatgttttttgctaacctggcggcagcgcaaaagatg

SEQ ID NO: 57794 - DNA, 103 bp, Artificial Sequence
  Synthetic Polynucleotide
taatacgactcactatagggaaaacttatacccgagtcgttgatccatttaacagaggagaaaatggatgaacgactcgaacctggcggcagcgcaaaagatg

SEQ ID NO: 57795 - DNA, 103 bp, Artificial Sequence
  Synthetic Polynucleotide
taatacgactcactatagggtaccaaaaacttatacccgagtcgttgatcaacagaggagagatcaaatgctcgggtataacctggcggcagcgcaaaagatg

SEQ ID NO: 57796 - DNA, 103 bp, Artificial Sequence
  Synthetic Polynucleotide
taatacgactcactatagggtcaggtaccaaaaacttatacccgagtcgtaacagaggagaacgactatggtataagttaacctggcggcagcgcaaaagatg

SEQ ID NO: 57797 - DNA, 103 bp, Artificial Sequence
  Synthetic Polynucleotide
taatacgactcactatagggtaggatcaggtaccaaaaacttatacccgaaacagaggagatcgggtatgagtttttggaacctggcggcagcgcaaaagatg

SEQ ID NO: 57798 - DNA, 103 bp, Artificial Sequence
  Synthetic Polynucleotide
taatacgactcactatagggggctttaggatcaggtaccaaaaacttataaacagaggagatataagatgttggtacctaacctggcggcagcgcaaaagatg

SEQ ID NO: 57799 - DNA, 103 bp, Artificial Sequence
  Synthetic Polynucleotide
taatacgactcactatagggactccggctttaggatcaggtaccaaaaacaacagaggagagtttttatgacctgatccaacctggcggcagcgcaaaagatg

SEQ ID NO: 57800 - DNA, 103 bp, Artificial Sequence
  Synthetic Polynucleotide
taatacgactcactatagggaaaaaactccggctttaggatcaggtaccaaacagaggagatggtacatgatcctaaagaacctggcggcagcgcaaaagatg

SEQ ID NO: 57801 - DNA, 103 bp, Artificial Sequence
  Synthetic Polynucleotide
taatacgactcactatagggtctataaaaaactccggctttaggatcaggaacagaggagacctgatatgaaagccggaaacctggcggcagcgcaaaagatg

SEQ ID NO: 57802 - DNA, 103 bp, Artificial Sequence
  Synthetic Polynucleotide
taatacgactcactatagggaacggtctataaaaaactccggctttaggaaacagaggagatcctaaatgcggagttttaacctggcggcagcgcaaaagatg

SEQ ID NO: 57803 - DNA, 103 bp, Artificial Sequence
  Synthetic Polynucleotide
taatacgactcactatagggaatgtaacggtctataaaaaactccggcttaacagaggagaaagccgatgttttttataaacctggcggcagcgcaaaagatg

SEQ ID NO: 57804 - DNA, 103 bp, Artificial Sequence
  Synthetic Polynucleotide
taatacgactcactatagggtctacctggatacagaaagcaaaaaatgggaacagaggagacccattatgtgctttctgaacctggcggcagcgcaaaagatg

SEQ ID NO: 57805 - DNA, 103 bp, Artificial Sequence
  Synthetic Polynucleotide
taatacgactcactatagggttggaaatgtaacggtctataaaaaactccaacagaggagaggagttatgtatagaccgaacctggcggcagcgcaaaagatg

SEQ ID NO: 57806 - DNA, 103 bp, Artificial Sequence
  Synthetic Polynucleotide
taatacgactcactatagggacatattggaaatgtaacggtctataaaaaaacagaggagatttttaatgaccgttacaaacctggcggcagcgcaaaagatg

SEQ ID NO: 57807 - DNA, 103 bp, Artificial Sequence
  Synthetic Polynucleotide
taatacgactcactatagggacgatacatattggaaatgtaacggtctataacagaggagaatagacatgtacatttccaacctggcggcagcgcaaaagatg

SEQ ID NO: 57808 - DNA, 103 bp, Artificial Sequence
  Synthetic Polynucleotide
taatacgactcactatagggagaatacgatacatattggaaatgtaacggaacagaggagaccgttaatgttccaatataacctggcggcagcgcaaaagatg

SEQ ID NO: 57809 - DNA, 103 bp, Artificial Sequence
  Synthetic Polynucleotide
taatacgactcactatagggaaattagaatacgatacatattggaaatgtaacagaggagaacatttatgatatgtatcaacctggcggcagcgcaaaagatg

SEQ ID NO: 57810 - DNA, 103 bp, Artificial Sequence
  Synthetic Polynucleotide
taatacgactcactatagggatataaaattagaatacgatacatattggaaacagaggagatccaatatgtatcgtattaacctggcggcagcgcaaaagatg

SEQ ID NO: 57811 - DNA, 103 bp, Artificial Sequence
  Synthetic Polynucleotide
taatacgactcactatagggatgcaatataaaattagaatacgatacataaacagaggagatatgtaatgtattctaataacctggcggcagcgcaaaagatg

SEQ ID NO: 57812 - DNA, 103 bp, Artificial Sequence
  Synthetic Polynucleotide
taatacgactcactatagggaatcgatgcaatataaaattagaatacgataacagaggagaatcgtaatgtaattttataacctggcggcagcgcaaaagatg

SEQ ID NO: 57813 - DNA, 103 bp, Artificial Sequence
  Synthetic Polynucleotide
taatacgactcactatagggcatgcaatcgatgcaatataaaattagaataacagaggagaattctaatgttatattgcaacctggcggcagcgcaaaagatg

SEQ ID NO: 57814 - DNA, 103 bp, Artificial Sequence
  Synthetic Polynucleotide
taatacgactcactataggggattccatgcaatcgatgcaatataaaattaacagaggagaaattttatgttgcatcgaaacctggcggcagcgcaaaagatg

SEQ ID NO: 57815 - DNA, 103 bp, Artificial Sequence
  Synthetic Polynucleotide
taatacgactcactatagggctatgtctacctggatacagaaagcaaaaaaacagaggagatttttgatgtctgtatccaacctggcggcagcgcaaaagatg

SEQ ID NO: 57816 - DNA, 103 bp, Artificial Sequence
  Synthetic Polynucleotide
taatacgactcactataggggtcaagattccatgcaatcgatgcaatataaacagaggagatatattatgtcgattgcaaacctggcggcagcgcaaaagatg

SEQ ID NO: 57817 - DNA, 103 bp, Artificial Sequence
  Synthetic Polynucleotide
taatacgactcactatagggtgacggtcaagattccatgcaatcgatgcaaacagaggagatgcatcatgtgcatggaaaacctggcggcagcgcaaaagatg

SEQ ID NO: 57818 - DNA, 103 bp, Artificial Sequence
  Synthetic Polynucleotide
taatacgactcactatagggccgcttgacggtcaagattccatgcaatcgaacagaggagacgattgatgggaatcttgaacctggcggcagcgcaaaagatg

SEQ ID NO: 57819 - DNA, 103 bp, Artificial Sequence
  Synthetic Polynucleotide
taatacgactcactatagggagtggccgcttgacggtcaagattccatgcaacagaggagagcatggatgcttgaccgtaacctggcggcagcgcaaaagatg

SEQ ID NO: 57820 - DNA, 103 bp, Artificial Sequence
  Synthetic Polynucleotide
taatacgactcactatagggataaaagtggccgcttgacggtcaagattcaacagaggagagaatctatgccgtcaagcaacctggcggcagcgcaaaagatg

SEQ ID NO: 57821 - DNA, 103 bp, Artificial Sequence
  Synthetic Polynucleotide
taatacgactcactatagggaaacgataaaagtggccgcttgacggtcaaaacagaggagattgaccatgaagcggccaaacctggcggcagcgcaaaagatg

SEQ ID NO: 57822 - DNA, 103 bp, Artificial Sequence
  Synthetic Polynucleotide
taatacgactcactatagggttcttaaacgataaaagtggccgcttgacgaacagaggagacgtcaaatggccacttttaacctggcggcagcgcaaaagatg

SEQ ID NO: 57823 - DNA, 103 bp, Artificial Sequence
  Synthetic Polynucleotide
taatacgactcactatagggtattattcttaaacgataaaagtggccgctaacagaggagaagcggcatgttttatcgtaacctggcggcagcgcaaaagatg

SEQ ID NO: 57824 - DNA, 103 bp, Artificial Sequence
  Synthetic Polynucleotide
taatacgactcactatagggttctgtattattcttaaacgataaaagtggaacagaggagaccacttatgtcgtttaagaacctggcggcagcgcaaaagatg

SEQ ID NO: 57825 - DNA, 103 bp, Artificial Sequence
  Synthetic Polynucleotide
taatacgactcactatagggattcgttctgtattattcttaaacgataaaaacagaggagatttatcatgtaagaataaaacctggcggcagcgcaaaagatg

SEQ ID NO: 57826 - DNA, 103 bp, Artificial Sequence
  Synthetic Polynucleotide
taatacgactcactatagggaatatctatgtctacctggatacagaaagcaacagaggagagctttcatgatccaggtaaacctggcggcagcgcaaaagatg

SEQ ID NO: 57827 - DNA, 103 bp, Artificial Sequence
  Synthetic Polynucleotide
taatacgactcactatagggtcataattcgttctgtattattcttaaacgaacagaggagacgtttaatgataatacagaacctggcggcagcgcaaaagatg

SEQ ID NO: 57828 - DNA, 103 bp, Artificial Sequence
  Synthetic Polynucleotide
taatacgactcactatagggttctatcataattcgttctgtattattcttaacagaggagaaagaatatgacagaacgaaacctggcggcagcgcaaaagatg

SEQ ID NO: 57829 - DNA, 103 bp, Artificial Sequence
  Synthetic Polynucleotide
taatacgactcactatagggctaatttctatcataattcgttctgtattaaacagaggagataatacatgacgaattataacctggcggcagcgcaaaagatg

SEQ ID NO: 57830 - DNA, 103 bp, Artificial Sequence
  Synthetic Polynucleotide
taatacgactcactatagggcattgctaatttctatcataattcgttctgaacagaggagacagaacatgttatgatagaacctggcggcagcgcaaaagatg

SEQ ID NO: 57831 - DNA, 103 bp, Artificial Sequence
  Synthetic Polynucleotide
taatacgactcactatagggtttaacattgctaatttctatcataattcgaacagaggagacgaattatgatagaaattaacctggcggcagcgcaaaagatg

SEQ ID NO: 57832 - DNA, 103 bp, Artificial Sequence
  Synthetic Polynucleotide
taatacgactcactataggggtcactttaacattgctaatttctatcataaacagaggagatatgatatgaattagcaaaacctggcggcagcgcaaaagatg

SEQ ID NO: 57833 - DNA, 103 bp, Artificial Sequence
  Synthetic Polynucleotide
taatacgactcactataggggaggagtcactttaacattgctaatttctaaacagaggagatagaaaatggcaatgttaaacctggcggcagcgcaaaagatg

SEQ ID NO: 57834 - DNA, 103 bp, Artificial Sequence
  Synthetic Polynucleotide
taatacgactcactatagggatctggaggagtcactttaacattgctaataacagaggagaattagcatggttaaagtgaacctggcggcagcgcaaaagatg

SEQ ID NO: 57835 - DNA, 103 bp, Artificial Sequence
  Synthetic Polynucleotide
taatacgactcactataggggagtaatctggaggagtcactttaacattgaacagaggagacaatgtatgagtgactccaacctggcggcagcgcaaaagatg

SEQ ID NO: 57836 - DNA, 103 bp, Artificial Sequence
  Synthetic Polynucleotide
taatacgactcactatagggtaggtgagtaatctggaggagtcactttaaaacagaggagattaaagatgctcctccagaacctggcggcagcgcaaaagatg

SEQ ID NO: 57837 - DNA, 103 bp, Artificial Sequence
  Synthetic Polynucleotide
taatacgactcactatagggtatagaatatctatgtctacctggatacagaacagaggagactgtatatgggtagacataacctggcggcagcgcaaaagatg

SEQ ID NO: 57838 - DNA, 103 bp, Artificial Sequence
  Synthetic Polynucleotide
taatacgactcactataggggattataggtgagtaatctggaggagtcacaacagaggagagtgactatgccagattacaacctggcggcagcgcaaaagatg

SEQ ID NO: 57839 - DNA, 103 bp, Artificial Sequence
  Synthetic Polynucleotide
taatacgactcactatagggctcgcgattataggtgagtaatctggaggaaacagaggagatcctccatgttactcaccaacctggcggcagcgcaaaagatg

SEQ ID NO: 57840 - DNA, 103 bp, Artificial Sequence
  Synthetic Polynucleotide
taatacgactcactatagggtaatactcgcgattataggtgagtaatctgaacagaggagacagattatgcacctataaaacctggcggcagcgcaaaagatg

SEQ ID NO: 57841 - DNA, 103 bp, Artificial Sequence
  Synthetic Polynucleotide
taatacgactcactatagggacctttaatactcgcgattataggtgagtaaacagaggagatactcaatgataatcgcgaacctggcggcagcgcaaaagatg

SEQ ID NO: 57842 - DNA, 103 bp, Artificial Sequence
  Synthetic Polynucleotide
taatacgactcactatagggctcttacctttaatactcgcgattataggtaacagaggagaacctatatgcgcgagtataacctggcggcagcgcaaaagatg

SEQ ID NO: 57843 - DNA, 103 bp, Artificial Sequence
  Synthetic Polynucleotide
taatacgactcactatagggcataactcttacctttaatactcgcgattaaacagaggagataatcgatggtattaaagaacctggcggcagcgcaaaagatg

SEQ ID NO: 57844 - DNA, 103 bp, Artificial Sequence
  Synthetic Polynucleotide
taatacgactcactatagggtgcgtcataactcttacctttaatactcgcaacagaggagagcgagtatgaaaggtaagaacctggcggcagcgcaaaagatg

SEQ ID NO: 57845 - DNA, 103 bp, Artificial Sequence
  Synthetic Polynucleotide
taatacgactcactataggggctaatgcgtcataactcttacctttaataaacagaggagatattaaatgtaagagttaaacctggcggcagcgcaaaagatg

SEQ ID NO: 57846 - DNA, 103 bp, Artificial Sequence
  Synthetic Polynucleotide
taatacgactcactatagggacgtggctaatgcgtcataactcttaccttaacagaggagaaaggtaatggttatgacgaacctggcggcagcgcaaaagatg

SEQ ID NO: 57847 - DNA, 103 bp, Artificial Sequence
  Synthetic Polynucleotide
taatacgactcactatagggagtgaacgtggctaatgcgtcataactcttaacagaggagaaagagtatggacgcattaaacctggcggcagcgcaaaagatg

SEQ ID NO: 57848 - DNA, 103 bp, Artificial Sequence
  Synthetic Polynucleotide
taatacgactcactataggggacactatagaatatctatgtctacctggaaacagaggagatccaggatgacatagataaacctggcggcagcgcaaaagatg

SEQ ID NO: 57849 - DNA, 103 bp, Artificial Sequence
  Synthetic Polynucleotide
taatacgactcactatagggtttacagtgaacgtggctaatgcgtcataaaacagaggagattatgaatgattagccacaacctggcggcagcgcaaaagatg

SEQ ID NO: 57850 - DNA, 103 bp, Artificial Sequence
  Synthetic Polynucleotide
taatacgactcactatagggagatatttacagtgaacgtggctaatgcgtaacagaggagaacgcatatgccacgttcaaacctggcggcagcgcaaaagatg

SEQ ID NO: 57851 - DNA, 103 bp, Artificial Sequence
  Synthetic Polynucleotide
taatacgactcactatagggtttaaagatatttacagtgaacgtggctaaaacagaggagattagccatgttcactgtaaacctggcggcagcgcaaaagatg

SEQ ID NO: 57852 - DNA, 103 bp, Artificial Sequence
  Synthetic Polynucleotide
taatacgactcactatagggacctctttaaagatatttacagtgaacgtgaacagaggagacacgttatgtgtaaatataacctggcggcagcgcaaaagatg

SEQ ID NO: 57853 - DNA, 103 bp, Artificial Sequence
  Synthetic Polynucleotide
taatacgactcactatagggccattacctctttaaagatatttacagtgaaacagaggagatcactgatgatatctttaaacctggcggcagcgcaaaagatg

SEQ ID NO: 57854 - DNA, 103 bp, Artificial Sequence
  Synthetic Polynucleotide
taatacgactcactatagggtttggccattacctctttaaagatatttacaacagaggagagtaaatatgtttaaagagaacctggcggcagcgcaaaagatg

SEQ ID NO: 57855 - DNA, 103 bp, Artificial Sequence
  Synthetic Polynucleotide
taatacgactcactatagggccctctttggccattacctctttaaagataaacagaggagatatcttatgagaggtaataacctggcggcagcgcaaaagatg

SEQ ID NO: 57856 - DNA, 103 bp, Artificial Sequence
  Synthetic Polynucleotide
taatacgactcactatagggatataccctctttggccattacctctttaaaacagaggagattaaagatgtaatggccaaacctggcggcagcgcaaaagatg

SEQ ID NO: 57857 - DNA, 103 bp, Artificial Sequence
  Synthetic Polynucleotide
taatacgactcactataggggatggatataccctctttggccattacctcaacagaggagagaggtaatggccaaagagaacctggcggcagcgcaaaagatg

SEQ ID NO: 57858 - DNA, 103 bp, Artificial Sequence
  Synthetic Polynucleotide
taatacgactcactatagggttagtgatggatataccctctttggccattaacagaggagaaatggcatgagagggtataacctggcggcagcgcaaaagatg

SEQ ID NO: 57859 - DNA, 103 bp, Artificial Sequence
  Synthetic Polynucleotide
taatacgactcactatagggtaggagacactatagaatatctatgtctacaacagaggagagtagacatggatattctaaacctggcggcagcgcaaaagatg

SEQ ID NO: 57860 - DNA, 103 bp, Artificial Sequence
  Synthetic Polynucleotide
taatacgactcactatagggttattttagtgatggatataccctctttggaacagaggagaccaaagatggtatatccaaacctggcggcagcgcaaaagatg

SEQ ID NO: 57861 - DNA, 103 bp, Artificial Sequence
  Synthetic Polynucleotide
taatacgactcactataggggctacttattttagtgatggatataccctcaacagaggagagagggtatgtccatcactaacctggcggcagcgcaaaagatg

SEQ ID NO: 57862 - DNA, 103 bp, Artificial Sequence
  Synthetic Polynucleotide
taatacgactcactatagggtcatagctacttattttagtgatggatataaacagaggagatatatcatgcactaaaataacctggcggcagcgcaaaagatg

SEQ ID NO: 57863 - DNA, 103 bp, Artificial Sequence
  Synthetic Polynucleotide
taatacgactcactatagggttccctcatagctacttattttagtgatggaacagaggagaccatcaatgaaataagtaaacctggcggcagcgcaaaagatg

SEQ ID NO: 57864 - DNA, 103 bp, Artificial Sequence
  Synthetic Polynucleotide
taatacgactcactatagggatcttttccctcatagctacttattttagtaacagaggagaactaaaatgagtagctataacctggcggcagcgcaaaagatg

SEQ ID NO: 57865 - DNA, 103 bp, Artificial Sequence
  Synthetic Polynucleotide
taatacgactcactatagggtgagaatcttttccctcatagctacttattaacagaggagaaataagatgctatgagggaacctggcggcagcgcaaaagatg

SEQ ID NO: 57866 - DNA, 103 bp, Artificial Sequence
  Synthetic Polynucleotide
taatacgactcactatagggtcaaatgagaatcttttccctcatagctacaacagaggagagtagctatgagggaaaagaacctggcggcagcgcaaaagatg

SEQ ID NO: 57867 - DNA, 103 bp, Artificial Sequence
  Synthetic Polynucleotide
taatacgactcactatagggttttatcaaatgagaatcttttccctcataaacagaggagatatgagatgaaagattctaacctggcggcagcgcaaaagatg

SEQ ID NO: 57868 - DNA, 103 bp, Artificial Sequence
  Synthetic Polynucleotide
taatacgactcactatagggggaatttttatcaaatgagaatcttttcccaacagaggagagggaaaatgttctcatttaacctggcggcagcgcaaaagatg

SEQ ID NO: 57869 - DNA, 103 bp, Artificial Sequence
  Synthetic Polynucleotide
taatacgactcactataggggtagcggaatttttatcaaatgagaatcttaacagaggagaaagattatgatttgataaaacctggcggcagcgcaaaagatg

SEQ ID NO: 57870 - DNA, 103 bp, Artificial Sequence
  Synthetic Polynucleotide
taatacgactcactatagggcaacataggagacactatagaatatctatgaacagaggagacatagaatgtctatagtgaacctggcggcagcgcaaaagatg

SEQ ID NO: 57871 - DNA, 103 bp, Artificial Sequence
  Synthetic Polynucleotide
taatacgactcactatagggtattagtagcggaatttttatcaaatgagaaacagaggagatctcatatgataaaaattaacctggcggcagcgcaaaagatg

SEQ ID NO: 57872 - DNA, 103 bp, Artificial Sequence
  Synthetic Polynucleotide
taatacgactcactatagggtatcctattagtagcggaatttttatcaaaaacagaggagatttgatatgaattccgctaacctggcggcagcgcaaaagatg

SEQ ID NO: 57873 - DNA, 103 bp, Artificial Sequence
  Synthetic Polynucleotide
taatacgactcactatagggtcccgtatcctattagtagcggaatttttaaacagaggagataaaaaatgcgctactaaaacctggcggcagcgcaaaagatg

SEQ ID NO: 57874 - DNA, 103 bp, Artificial Sequence
  Synthetic Polynucleotide
taatacgactcactatagggtttattcccgtatcctattagtagcggaataacagaggagaattccgatgctaataggaaacctggcggcagcgcaaaagatg

SEQ ID NO: 57875 - DNA, 103 bp, Artificial Sequence
  Synthetic Polynucleotide
taatacgactcactatagggggatttttattcccgtatcctattagtagcaacagaggagagctactatgaggatacggaacctggcggcagcgcaaaagatg

SEQ ID NO: 57876 - DNA, 103 bp, Artificial Sequence
  Synthetic Polynucleotide
taatacgactcactatagggcaagtggatttttattcccgtatcctattaaacagaggagataatagatgacgggaataaacctggcggcagcgcaaaagatg

SEQ ID NO: 57877 - DNA, 103 bp, Artificial Sequence
  Synthetic Polynucleotide
taatacgactcactatagggtgtatcaagtggatttttattcccgtatccaacagaggagaggatacatgaataaaaataacctggcggcagcgcaaaagatg

SEQ ID NO: 57878 - DNA, 103 bp, Artificial Sequence
  Synthetic Polynucleotide
taatacgactcactatagggttggctgtatcaagtggatttttattcccgaacagaggagacgggaaatgaaatccactaacctggcggcagcgcaaaagatg

SEQ ID NO: 57879 - DNA, 103 bp, Artificial Sequence
  Synthetic Polynucleotide
taatacgactcactataggggatacttggctgtatcaagtggatttttataacagaggagaataaaaatgcacttgataaacctggcggcagcgcaaaagatg

SEQ ID NO: 57880 - DNA, 103 bp, Artificial Sequence
  Synthetic Polynucleotide
taatacgactcactataggggacaagatacttggctgtatcaagtggattaacagaggagaaatccaatggatacagccaacctggcggcagcgcaaaagatg

SEQ ID NO: 57881 - DNA, 103 bp, Artificial Sequence
  Synthetic Polynucleotide
taatacgactcactatagggaattacaacataggagacactatagaatataacagaggagaatattcatgagtgtctccaacctggcggcagcgcaaaagatg

SEQ ID NO: 57882 - DNA, 103 bp, Artificial Sequence
  Synthetic Polynucleotide
taatacgactcactatagggttagggacaagatacttggctgtatcaagtaacagaggagaacttgaatgagccaagtaaacctggcggcagcgcaaaagatg

SEQ ID NO: 57883 - DNA, 103 bp, Artificial Sequence
  Synthetic Polynucleotide
taatacgactcactatagggtgacgttagggacaagatacttggctgtataacagaggagaatacagatgagtatcttgaacctggcggcagcgcaaaagatg

SEQ ID NO: 57884 - DNA, 103 bp, Artificial Sequence
  Synthetic Polynucleotide
taatacgactcactatagggacctatgacgttagggacaagatacttggcaacagaggagagccaagatgcttgtccctaacctggcggcagcgcaaaagatg

SEQ ID NO: 57885 - DNA, 103 bp, Artificial Sequence
  Synthetic Polynucleotide
taatacgactcactatagggaccccacctatgacgttagggacaagatacaacagaggagagtatctatgccctaacgtaacctggcggcagcgcaaaagatg

SEQ ID NO: 57886 - DNA, 103 bp, Artificial Sequence
  Synthetic Polynucleotide
taatacgactcactatagggtaaataccccacctatgacgttagggacaaaacagaggagattgtccatgacgtcatagaacctggcggcagcgcaaaagatg

SEQ ID NO: 57887 - DNA, 103 bp, Artificial Sequence
  Synthetic Polynucleotide
taatacgactcactatagggattgataaataccccacctatgacgttaggaacagaggagacctaacatgataggtgggaacctggcggcagcgcaaaagatg

SEQ ID NO: 57888 - DNA, 103 bp, Artificial Sequence
  Synthetic Polynucleotide
taatacgactcactatagggtgtttattgataaataccccacctatgacgaacagaggagacgtcatatgtggggtattaacctggcggcagcgcaaaagatg

SEQ ID NO: 57889 - DNA, 103 bp, Artificial Sequence
  Synthetic Polynucleotide
taatacgactcactatagggcagattgtttattgataaataccccacctaaacagaggagataggtgatgtatttatcaaacctggcggcagcgcaaaagatg

SEQ ID NO: 57890 - DNA, 103 bp, Artificial Sequence
  Synthetic Polynucleotide
taatacgactcactatagggttcgacagattgtttattgataaataccccaacagaggagaggggtaatgatcaataaaaacctggcggcagcgcaaaagatg

SEQ ID NO: 57891 - DNA, 103 bp, Artificial Sequence
  Synthetic Polynucleotide
taatacgactcactatagggactttttcgacagattgtttattgataaataacagaggagaatttatatgtaaacaatcaacctggcggcagcgcaaaagatg

SEQ ID NO: 57892 - DNA, 103 bp, Artificial Sequence
  Synthetic Polynucleotide
taatacgactcactatagggatgctaattacaacataggagacactatagaacagaggagactatagatgctcctatgtaacctggcggcagcgcaaaagatg

SEQ ID NO: 57893 - DNA, 103 bp, Artificial Sequence
  Synthetic Polynucleotide
taatacgactcactatagggttcctactttttcgacagattgtttattgaaacagaggagatcaataatgaatctgtcgaacctggcggcagcgcaaaagatg

SEQ ID NO: 57894 - DNA, 103 bp, Artificial Sequence
  Synthetic Polynucleotide
taatacgactcactatagggattaattcctactttttcgacagattgtttaacagaggagaaaacaaatggtcgaaaaaaacctggcggcagcgcaaaagatg

SEQ ID NO: 57895 - DNA, 103 bp, Artificial Sequence
  Synthetic Polynucleotide
taatacgactcactatagggactagattaattcctactttttcgacagataacagaggagaatctgtatgaaaagtaggaacctggcggcagcgcaaaagatg

SEQ ID NO: 57896 - DNA, 103 bp, Artificial Sequence
  Synthetic Polynucleotide
taatacgactcactatagggtttctactagattaattcctactttttcgaaacagaggagatcgaaaatgtaggaattaaacctggcggcagcgcaaaagatg

SEQ ID NO: 57897 - DNA, 103 bp, Artificial Sequence
  Synthetic Polynucleotide
taatacgactcactatagggaatcttttctactagattaattcctactttaacagaggagaaaagtaatgattaatctaaacctggcggcagcgcaaaagatg

SEQ ID NO: 57898 - DNA, 103 bp, Artificial Sequence
  Synthetic Polynucleotide
taatacgactcactataggggttgtaatcttttctactagattaattcctaacagaggagaaggaatatgtctagtagaaacctggcggcagcgcaaaagatg

SEQ ID NO: 57899 - DNA, 103 bp, Artificial Sequence
  Synthetic Polynucleotide
taatacgactcactataggggccatgttgtaatcttttctactagattaaaacagaggagattaatcatgtagaaaagaaacctggcggcagcgcaaaagatg

SEQ ID NO: 57900 - DNA, 103 bp, Artificial Sequence
  Synthetic Polynucleotide
taatacgactcactatagggttttggccatgttgtaatcttttctactagaacagaggagactagtaatgaagattacaaacctggcggcagcgcaaaagatg

SEQ ID NO: 57901 - DNA, 103 bp, Artificial Sequence
  Synthetic Polynucleotide
taatacgactcactatagggctaaattttggccatgttgtaatcttttctaacagaggagaagaaaaatgtacaacatgaacctggcggcagcgcaaaagatg

SEQ ID NO: 57902 - DNA, 103 bp, Artificial Sequence
  Synthetic Polynucleotide
taatacgactcactatagggcaaccctaaattttggccatgttgtaatctaacagaggagaagattaatgcatggccaaaacctggcggcagcgcaaaagatg

SEQ ID NO: 57903 - DNA, 103 bp, Artificial Sequence
  Synthetic Polynucleotide
taatacgactcactatagggtagatgatagaacagaactacacaaacacaaacagaggagatgtgttatggtagttctgaacctggcggcagcgcaaaagatg

SEQ ID NO: 57904 - DNA, 103 bp, Artificial Sequence
  Synthetic Polynucleotide
taatacgactcactatagggtgctaatgctaattacaacataggagacacaacagaggagagtgtctatgatgttgtaaaacctggcggcagcgcaaaagatg

SEQ ID NO: 57905 - DNA, 103 bp, Artificial Sequence
  Synthetic Polynucleotide
taatacgactcactatagggcttaacaaccctaaattttggccatgttgtaacagaggagaacaacaatgccaaaatttaacctggcggcagcgcaaaagatg

SEQ ID NO: 57906 - DNA, 103 bp, Artificial Sequence
  Synthetic Polynucleotide
taatacgactcactatagggtttggcttaacaaccctaaattttggccataacagaggagaatggccatgatttagggtaacctggcggcagcgcaaaagatg

SEQ ID NO: 57907 - DNA, 103 bp, Artificial Sequence
  Synthetic Polynucleotide
taatacgactcactatagggatgagtttggcttaacaaccctaaattttgaacagaggagacaaaatatggggttgttaaacctggcggcagcgcaaaagatg

SEQ ID NO: 57908 - DNA, 103 bp, Artificial Sequence
  Synthetic Polynucleotide
taatacgactcactatagggcgtgaatgagtttggcttaacaaccctaaaaacagaggagatttaggatggttaagccaaacctggcggcagcgcaaaagatg

SEQ ID NO: 57909 - DNA, 103 bp, Artificial Sequence
  Synthetic Polynucleotide
taatacgactcactataggggagaacgtgaatgagtttggcttaacaaccaacagaggagaggttgtatggccaaactcaacctggcggcagcgcaaaagatg

SEQ ID NO: 57910 - DNA, 103 bp, Artificial Sequence
  Synthetic Polynucleotide
taatacgactcactatagggaaaacgagaacgtgaatgagtttggcttaaaacagaggagattaagcatgactcattcaaacctggcggcagcgcaaaagatg

SEQ ID NO: 57911 - DNA, 103 bp, Artificial Sequence
  Synthetic Polynucleotide
taatacgactcactatagggggaggaaaacgagaacgtgaatgagtttggaacagaggagaccaaacatgttcacgttcaacctggcggcagcgcaaaagatg

SEQ ID NO: 57912 - DNA, 103 bp, Artificial Sequence
  Synthetic Polynucleotide
taatacgactcactataggggatacggaggaaaacgagaacgtgaatgagaacagaggagactcattatggttctcgttaacctggcggcagcgcaaaagatg

SEQ ID NO: 57913 - DNA, 103 bp, Artificial Sequence
  Synthetic Polynucleotide
taatacgactcactataggggaggggatacggaggaaaacgagaacgtgaaacagaggagatcacgtatgcgttttcctaacctggcggcagcgcaaaagatg

SEQ ID NO: 57914 - DNA, 103 bp, Artificial Sequence
  Synthetic Polynucleotide
taatacgactcactatagggattaggaggggatacggaggaaaacgagaaaacagaggagattctcgatgtcctccgtaaacctggcggcagcgcaaaagatg

SEQ ID NO: 57915 - DNA, 103 bp, Artificial Sequence
  Synthetic Polynucleotide
taatacgactcactatagggactgatgctaatgctaattacaacataggaaacagaggagatcctatatggtaattagcaacctggcggcagcgcaaaagatg

SEQ ID NO: 57916 - DNA, 103 bp, Artificial Sequence
  Synthetic Polynucleotide
taatacgactcactatagggaatatattaggaggggatacggaggaaaacaacagaggagagttttcatgcgtatccccaacctggcggcagcgcaaaagatg

SEQ ID NO: 57917 - DNA, 103 bp, Artificial Sequence
  Synthetic Polynucleotide
taatacgactcactatagggtcggtaatatattaggaggggatacggaggaacagaggagacctccgatgcccctcctaaacctggcggcagcgcaaaagatg

SEQ ID NO: 57918 - DNA, 103 bp, Artificial Sequence
  Synthetic Polynucleotide
taatacgactcactatagggtcttgtcggtaatatattaggaggggatacaacagaggagagtatccatgcctaatataaacctggcggcagcgcaaaagatg

SEQ ID NO: 57919 - DNA, 103 bp, Artificial Sequence
  Synthetic Polynucleotide
taatacgactcactatagggcgatatcttgtcggtaatatattaggagggaacagaggagaccctccatgtatattaccaacctggcggcagcgcaaaagatg

SEQ ID NO: 57920 - DNA, 103 bp, Artificial Sequence
  Synthetic Polynucleotide
taatacgactcactatagggaatggcgatatcttgtcggtaatatattagaacagaggagactaataatgtaccgacaaaacctggcggcagcgcaaaagatg

SEQ ID NO: 57921 - DNA, 103 bp, Artificial Sequence
  Synthetic Polynucleotide
taatacgactcactatagggcttgtaatggcgatatcttgtcggtaatataacagaggagaatattaatgacaagatataacctggcggcagcgcaaaagatg

SEQ ID NO: 57922 - DNA, 103 bp, Artificial Sequence
  Synthetic Polynucleotide
taatacgactcactataggggatatcttgtaatggcgatatcttgtcggtaacagaggagaaccgacatgatatcgccaaacctggcggcagcgcaaaagatg

SEQ ID NO: 57923 - DNA, 103 bp, Artificial Sequence
  Synthetic Polynucleotide
taatacgactcactatagggccagagatatcttgtaatggcgatatcttgaacagaggagacaagatatggccattacaaacctggcggcagcgcaaaagatg

SEQ ID NO: 57924 - DNA, 103 bp, Artificial Sequence
  Synthetic Polynucleotide
taatacgactcactatagggtatatccagagatatcttgtaatggcgataaacagaggagatatcgcatgtacaagataaacctggcggcagcgcaaaagatg

SEQ ID NO: 57925 - DNA, 103 bp, Artificial Sequence
  Synthetic Polynucleotide
taatacgactcactatagggtgtgatatatccagagatatcttgtaatggaacagaggagaccattaatggatatctctaacctggcggcagcgcaaaagatg

SEQ ID NO: 57926 - DNA, 103 bp, Artificial Sequence
  Synthetic Polynucleotide
taatacgactcactatagggtggagactgatgctaatgctaattacaacaaacagaggagatgttgtatgtagcattagaacctggcggcagcgcaaaagatg

SEQ ID NO: 57927 - DNA, 103 bp, Artificial Sequence
  Synthetic Polynucleotide
taatacgactcactatagggccaattgtgatatatccagagatatcttgtaacagaggagaacaagaatgctctggataaacctggcggcagcgcaaaagatg

SEQ ID NO: 57928 - DNA, 103 bp, Artificial Sequence
  Synthetic Polynucleotide
taatacgactcactatagggcgcttccaattgtgatatatccagagatataacagaggagaatatctatggatatatcaaacctggcggcagcgcaaaagatg

SEQ ID NO: 57929 - DNA, 103 bp, Artificial Sequence
  Synthetic Polynucleotide
taatacgactcactatagggttcgacgcttccaattgtgatatatccagaaacagaggagatctggaatgatcacaattaacctggcggcagcgcaaaagatg

SEQ ID NO: 57930 - DNA, 103 bp, Artificial Sequence
  Synthetic Polynucleotide
taatacgactcactatagggatatattcgacgcttccaattgtgatatataacagaggagaatatatatgaattggaagaacctggcggcagcgcaaaagatg

SEQ ID NO: 57931 - DNA, 103 bp, Artificial Sequence
  Synthetic Polynucleotide
taatacgactcactatagggcgatgatatattcgacgcttccaattgtgaaacagaggagatcacaaatggaagcgtcgaacctggcggcagcgcaaaagatg

SEQ ID NO: 57932 - DNA, 103 bp, Artificial Sequence
  Synthetic Polynucleotide
taatacgactcactatagggtttgtcgatgatatattcgacgcttccaataacagaggagaattggaatggtcgaatataacctggcggcagcgcaaaagatg

SEQ ID NO: 57933 - DNA, 103 bp, Artificial Sequence
  Synthetic Polynucleotide
taatacgactcactatagggatgtctttgtcgatgatatattcgacgcttaacagaggagaaagcgtatgatatatcataacctggcggcagcgcaaaagatg

SEQ ID NO: 57934 - DNA, 103 bp, Artificial Sequence
  Synthetic Polynucleotide
taatacgactcactatagggtataaatgtctttgtcgatgatatattcgaaacagaggagatcgaatatgtcatcgacaaacctggcggcagcgcaaaagatg

SEQ ID NO: 57935 - DNA, 103 bp, Artificial Sequence
  Synthetic Polynucleotide
taatacgactcactatagggaccgttataaatgtctttgtcgatgatataaacagaggagatatatcatggacaaagacaacctggcggcagcgcaaaagatg

SEQ ID NO: 57936 - DNA, 103 bp, Artificial Sequence
  Synthetic Polynucleotide
taatacgactcactatagggtattgaccgttataaatgtctttgtcgatgaacagaggagacatcgaatgagacatttaaacctggcggcagcgcaaaagatg

SEQ ID NO: 57937 - DNA, 103 bp, Artificial Sequence
  Synthetic Polynucleotide
taatacgactcactatagggtagtgtggagactgatgctaatgctaattaaacagaggagataattaatgttagcatcaaacctggcggcagcgcaaaagatg

SEQ ID NO: 57938 - DNA, 103 bp, Artificial Sequence
  Synthetic Polynucleotide
taatacgactcactatagggaacaatattgaccgttataaatgtctttgtaacagaggagaacaaagatgtttataacgaacctggcggcagcgcaaaagatg

SEQ ID NO: 57939 - DNA, 103 bp, Artificial Sequence
  Synthetic Polynucleotide
taatacgactcactatagggagtaaaacaatattgaccgttataaatgtcaacagaggagagacattatgaacggtcaaaacctggcggcagcgcaaaagatg

SEQ ID NO: 57940 - DNA, 103 bp, Artificial Sequence
  Synthetic Polynucleotide
taatacgactcactataggggagacagtaaaacaatattgaccgttataaaacagaggagattataaatgtcaatattgaacctggcggcagcgcaaaagatg

SEQ ID NO: 57941 - DNA, 103 bp, Artificial Sequence
  Synthetic Polynucleotide
taatacgactcactatagggatattgagacagtaaaacaatattgaccgtaacagaggagaacggtcatgattgttttaaacctggcggcagcgcaaaagatg

SEQ ID NO: 57942 - DNA, 103 bp, Artificial Sequence
  Synthetic Polynucleotide
taatacgactcactataggggataaatattgagacagtaaaacaatattgaacagaggagacaatatatgtttactgtcaacctggcggcagcgcaaaagatg

SEQ ID NO: 57943 - DNA, 103 bp, Artificial Sequence
  Synthetic Polynucleotide
taatacgactcactatagggctctagataaatattgagacagtaaaacaaaacagaggagattgtttatgtgtctcaataacctggcggcagcgcaaaagatg

SEQ ID NO: 57944 - DNA, 103 bp, Artificial Sequence
  Synthetic Polynucleotide
taatacgactcactatagggactcactctagataaatattgagacagtaaaacagaggagattactgatgcaatatttaaacctggcggcagcgcaaaagatg

SEQ ID NO: 57945 - DNA, 103 bp, Artificial Sequence
  Synthetic Polynucleotide
taatacgactcactatagggcctaaactcactctagataaatattgagacaacagaggagagtctcaatgtttatctagaacctggcggcagcgcaaaagatg

SEQ ID NO: 57946 - DNA, 103 bp, Artificial Sequence
  Synthetic Polynucleotide
taatacgactcactatagggtgaatcctaaactcactctagataaatattaacagaggagaaatattatgctagagtgaaacctggcggcagcgcaaaagatg

SEQ ID NO: 57947 - DNA, 103 bp, Artificial Sequence
  Synthetic Polynucleotide
taatacgactcactatagggtctaatgaatcctaaactcactctagataaaacagaggagattatctatggtgagtttaaacctggcggcagcgcaaaagatg

SEQ ID NO: 57948 - DNA, 103 bp, Artificial Sequence
  Synthetic Polynucleotide
taatacgactcactatagggaagaatagtgtggagactgatgctaatgctaacagaggagaagcattatgatcagtctcaacctggcggcagcgcaaaagatg

SEQ ID NO: 57949 - DNA, 103 bp, Artificial Sequence
  Synthetic Polynucleotide
taatacgactcactatagggctacgtctaatgaatcctaaactcactctaaacagaggagatagagtatgtttaggattaacctggcggcagcgcaaaagatg

SEQ ID NO: 57950 - DNA, 103 bp, Artificial Sequence
  Synthetic Polynucleotide
taatacgactcactatagggataaactacgtctaatgaatcctaaactcaaacagaggagatgagttatggattcattaaacctggcggcagcgcaaaagatg

SEQ ID NO: 57951 - DNA, 103 bp, Artificial Sequence
  Synthetic Polynucleotide
taatacgactcactataggggtatgataaactacgtctaatgaatcctaaaacagaggagattaggaatgattagacgtaacctggcggcagcgcaaaagatg

SEQ ID NO: 57952 - DNA, 103 bp, Artificial Sequence
  Synthetic Polynucleotide
taatacgactcactatagggatatcgtatgataaactacgtctaatgaataacagaggagaattcatatgacgtagtttaacctggcggcagcgcaaaagatg

SEQ ID NO: 57953 - DNA, 103 bp, Artificial Sequence
  Synthetic Polynucleotide
taatacgactcactataggggaggcatatcgtatgataaactacgtctaaaacagaggagattagacatggtttatcataacctggcggcagcgcaaaagatg

SEQ ID NO: 57954 - DNA, 103 bp, Artificial Sequence
  Synthetic Polynucleotide
taatacgactcactatagggttctggaggcatatcgtatgataaactacgaacagaggagacgtagtatgtcatacgataacctggcggcagcgcaaaagatg

SEQ ID NO: 57955 - DNA, 103 bp, Artificial Sequence
  Synthetic Polynucleotide
taatacgactcactatagggacaacttctggaggcatatcgtatgataaaaacagaggagatttatcatgcgatatgccaacctggcggcagcgcaaaagatg

SEQ ID NO: 57956 - DNA, 103 bp, Artificial Sequence
  Synthetic Polynucleotide
taatacgactcactatagggaatagacaacttctggaggcatatcgtatgaacagaggagacatacgatgtgcctccagaacctggcggcagcgcaaaagatg

SEQ ID NO: 57957 - DNA, 103 bp, Artificial Sequence
  Synthetic Polynucleotide
taatacgactcactatagggtactaaatagacaacttctggaggcatatcaacagaggagagatatgatgccagaagttaacctggcggcagcgcaaaagatg

SEQ ID NO: 57958 - DNA, 103 bp, Artificial Sequence
  Synthetic Polynucleotide
taatacgactcactataggggcgtttactaaatagacaacttctggaggcaacagaggagagcctccatgagttgtctaaacctggcggcagcgcaaaagatg

SEQ ID NO: 57959 - DNA, 103 bp, Artificial Sequence
  Synthetic Polynucleotide
taatacgactcactatagggcatttaagaatagtgtggagactgatgctaaacagaggagatagcatatgtctccacacaacctggcggcagcgcaaaagatg

SEQ ID NO: 57960 - DNA, 103 bp, Artificial Sequence
  Synthetic Polynucleotide
taatacgactcactatagggttatcgcgtttactaaatagacaacttctgaacagaggagacagaagatgtctatttagaacctggcggcagcgcaaaagatg

SEQ ID NO: 57961 - DNA, 103 bp, Artificial Sequence
  Synthetic Polynucleotide
taatacgactcactatagggatctattatcgcgtttactaaatagacaacaacagaggagagttgtcatgttagtaaacaacctggcggcagcgcaaaagatg

SEQ ID NO: 57962 - DNA, 103 bp, Artificial Sequence
  Synthetic Polynucleotide
taatacgactcactataggggcactatctattatcgcgtttactaaatagaacagaggagactatttatgaaacgcgataacctggcggcagcgcaaaagatg

SEQ ID NO: 57963 - DNA, 103 bp, Artificial Sequence
  Synthetic Polynucleotide
taatacgactcactataggggtttagcactatctattatcgcgtttactaaacagaggagatagtaaatgcgataatagaacctggcggcagcgcaaaagatg

SEQ ID NO: 57964 - DNA, 103 bp, Artificial Sequence
  Synthetic Polynucleotide
taatacgactcactatagggaagtcgtttagcactatctattatcgcgttaacagaggagaaacgcgatgatagatagtaacctggcggcagcgcaaaagatg

SEQ ID NO: 57965 - DNA, 103 bp, Artificial Sequence
  Synthetic Polynucleotide
taatacgactcactatagggtcggtaagtcgtttagcactatctattatcaacagaggagagataatatgtagtgctaaaacctggcggcagcgcaaaagatg

SEQ ID NO: 57966 - DNA, 103 bp, Artificial Sequence
  Synthetic Polynucleotide
taatacgactcactatagggtagattcggtaagtcgtttagcactatctaaacagaggagatagataatgctaaacgacaacctggcggcagcgcaaaagatg

SEQ ID NO: 57967 - DNA, 103 bp, Artificial Sequence
  Synthetic Polynucleotide
taatacgactcactatagggagtaatagattcggtaagtcgtttagcactaacagaggagaagtgctatgcgacttaccaacctggcggcagcgcaaaagatg

SEQ ID NO: 57968 - DNA, 103 bp, Artificial Sequence
  Synthetic Polynucleotide
taatacgactcactatagggaagtcagtaatagattcggtaagtcgtttaaacagaggagataaacgatgtaccgaatcaacctggcggcagcgcaaaagatg

SEQ ID NO: 57969 - DNA, 103 bp, Artificial Sequence
  Synthetic Polynucleotide
taatacgactcactatagggtattaaagtcagtaatagattcggtaagtcaacagaggagagacttaatgaatctattaaacctggcggcagcgcaaaagatg

SEQ ID NO: 57970 - DNA, 103 bp, Artificial Sequence
  Synthetic Polynucleotide
taatacgactcactatagggtatgacatttaagaatagtgtggagactgaaacagaggagatcagtcatgacactattcaacctggcggcagcgcaaaagatg

SEQ ID NO: 57971 - DNA, 103 bp, Artificial Sequence
  Synthetic Polynucleotide
taatacgactcactatagggatcaatattaaagtcagtaatagattcggtaacagaggagaaccgaaatgattactgacaacctggcggcagcgcaaaagatg

SEQ ID NO: 57972 - DNA, 103 bp, Artificial Sequence
  Synthetic Polynucleotide
taatacgactcactatagggtacgtatcaatattaaagtcagtaatagataacagaggagaatctatatgtgactttaaaacctggcggcagcgcaaaagatg

SEQ ID NO: 57973 - DNA, 103 bp, Artificial Sequence
  Synthetic Polynucleotide
taatacgactcactatagggtaatatacgtatcaatattaaagtcagtaaaacagaggagattactgatgttaatattgaacctggcggcagcgcaaaagatg

SEQ ID NO: 57974 - DNA, 103 bp, Artificial Sequence
  Synthetic Polynucleotide
taatacgactcactataggggtcattaatatacgtatcaatattaaagtcaacagaggagagactttatgattgatacgaacctggcggcagcgcaaaagatg

SEQ ID NO: 57975 - DNA, 103 bp, Artificial Sequence
  Synthetic Polynucleotide
taatacgactcactatagggaccaggtcattaatatacgtatcaatattaaacagaggagataatatatgtacgtatataacctggcggcagcgcaaaagatg

SEQ ID NO: 57976 - DNA, 103 bp, Artificial Sequence
  Synthetic Polynucleotide
taatacgactcactatagggcttccaccaggtcattaatatacgtatcaaaacagaggagattgataatgatattaatgaacctggcggcagcgcaaaagatg

SEQ ID NO: 57977 - DNA, 103 bp, Artificial Sequence
  Synthetic Polynucleotide
taatacgactcactatagggttcagcttccaccaggtcattaatatacgtaacagaggagaacgtatatgaatgacctgaacctggcggcagcgcaaaagatg

SEQ ID NO: 57978 - DNA, 103 bp, Artificial Sequence
  Synthetic Polynucleotide
taatacgactcactatagggacgtgttcagcttccaccaggtcattaataaacagaggagatattaaatgcctggtggaaacctggcggcagcgcaaaagatg

SEQ ID NO: 57979 - DNA, 103 bp, Artificial Sequence
  Synthetic Polynucleotide
taatacgactcactataggggtttaacgtgttcagcttccaccaggtcataacagaggagaatgaccatgtggaagctgaacctggcggcagcgcaaaagatg

SEQ ID NO: 57980 - DNA, 103 bp, Artificial Sequence
  Synthetic Polynucleotide
taatacgactcactatagggtttttgtttaacgtgttcagcttccaccagaacagaggagactggtgatggctgaacacaacctggcggcagcgcaaaagatg

SEQ ID NO: 57981 - DNA, 103 bp, Artificial Sequence
  Synthetic Polynucleotide
taatacgactcactatagggattaatatgacatttaagaatagtgtggagaacagaggagactccacatgattcttaaaaacctggcggcagcgcaaaagatg

SEQ ID NO: 57982 - DNA, 103 bp, Artificial Sequence
  Synthetic Polynucleotide
taatacgactcactatagggtgagatttttgtttaacgtgttcagcttccaacagaggagaggaagcatgacacgttaaaacctggcggcagcgcaaaagatg

SEQ ID NO: 57983 - DNA, 103 bp, Artificial Sequence
  Synthetic Polynucleotide
taatacgactcactatagggttaactgagatttttgtttaacgtgttcagaacagaggagactgaacatgttaaacaaaaacctggcggcagcgcaaaagatg

SEQ ID NO: 57984 - DNA, 103 bp, Artificial Sequence
  Synthetic Polynucleotide
taatacgactcactatagggaatcgttaactgagatttttgtttaacgtgaacagaggagacacgttatgcaaaaatctaacctggcggcagcgcaaaagatg

SEQ ID NO: 57985 - DNA, 103 bp, Artificial Sequence
  Synthetic Polynucleotide
taatacgactcactatagggtcgttaatcgttaactgagatttttgtttaaacagaggagataaacaatgatctcagttaacctggcggcagcgcaaaagatg

SEQ ID NO: 57986 - DNA, 103 bp, Artificial Sequence
  Synthetic Polynucleotide
taatacgactcactatagggtgaactcgttaatcgttaactgagatttttaacagaggagaaaaaatatgagttaacgaaacctggcggcagcgcaaaagatg

SEQ ID NO: 57987 - DNA, 103 bp, Artificial Sequence
  Synthetic Polynucleotide
taatacgactcactatagggatatttgaactcgttaatcgttaactgagaaacagaggagatctcagatgacgattaacaacctggcggcagcgcaaaagatg

SEQ ID NO: 57988 - DNA, 103 bp, Artificial Sequence
  Synthetic Polynucleotide
taatacgactcactatagggatttcatatttgaactcgttaatcgttaacaacagaggagagttaacatgtaacgagttaacctggcggcagcgcaaaagatg

SEQ ID NO: 57989 - DNA, 103 bp, Artificial Sequence
  Synthetic Polynucleotide
taatacgactcactataggggtagcatttcatatttgaactcgttaatcgaacagaggagacgattaatgagttcaaataacctggcggcagcgcaaaagatg

SEQ ID NO: 57990 - DNA, 103 bp, Artificial Sequence
  Synthetic Polynucleotide
taatacgactcactataggggttatgtagcatttcatatttgaactcgttaacagaggagaaacgagatgaaatatgaaaacctggcggcagcgcaaaagatg

SEQ ID NO: 57991 - DNA, 103 bp, Artificial Sequence
  Synthetic Polynucleotide
taatacgactcactatagggaaaaagttatgtagcatttcatatttgaacaacagaggagagttcaaatgtgaaatgctaacctggcggcagcgcaaaagatg

SEQ ID NO: 57992 - DNA, 103 bp, Artificial Sequence
  Synthetic Polynucleotide
taatacgactcactataggggacccattaatatgacatttaagaatagtgaacagaggagacactatatgtaaatgtcaaacctggcggcagcgcaaaagatg

SEQ ID NO: 57993 - DNA, 103 bp, Artificial Sequence
  Synthetic Polynucleotide
taatacgactcactataggggaggtaaaaagttatgtagcatttcatattaacagaggagaaatatgatgtgctacataaacctggcggcagcgcaaaagatg

SEQ ID NO: 57994 - DNA, 103 bp, Artificial Sequence
  Synthetic Polynucleotide
taatacgactcactatagggcatatgaggtaaaaagttatgtagcatttcaacagaggagagaaatgatgcataactttaacctggcggcagcgcaaaagatg

SEQ ID NO: 57995 - DNA, 103 bp, Artificial Sequence
  Synthetic Polynucleotide
taatacgactcactatagggtagttcatatgaggtaaaaagttatgtagcaacagaggagagctacaatgctttttaccaacctggcggcagcgcaaaagatg

SEQ ID NO: 57996 - DNA, 103 bp, Artificial Sequence
  Synthetic Polynucleotide
taatacgactcactataggggtgtatagttcatatgaggtaaaaagttataacagaggagaataactatgtacctcataaacctggcggcagcgcaaaagatg

SEQ ID NO: 57997 - DNA, 103 bp, Artificial Sequence
  Synthetic Polynucleotide
taatacgactcactatagggatcgggtgtatagttcatatgaggtaaaaaaacagaggagatttttaatgcatatgaacaacctggcggcagcgcaaaagatg

SEQ ID NO: 57998 - DNA, 103 bp, Artificial Sequence
  Synthetic Polynucleotide
taatacgactcactatagggagttgatcgggtgtatagttcatatgaggtaacagaggagaacctcaatggaactatacaacctggcggcagcgcaaaagatg

SEQ ID NO: 57999 - DNA, 103 bp, Artificial Sequence
  Synthetic Polynucleotide
taatacgactcactatagggcctttagttgatcgggtgtatagttcatataacagaggagaatatgaatgatacacccgaacctggcggcagcgcaaaagatg

SEQ ID NO: 58000 - DNA, 103 bp, Artificial Sequence
  Synthetic Polynucleotide
taatacgactcactatagggaaatccctttagttgatcgggtgtatagttaacagaggagaaactatatgcccgatcaaaacctggcggcagcgcaaaagatg

SEQ ID NO: 58001 - DNA, 103 bp, Artificial Sequence
  Synthetic Polynucleotide
taatacgactcactatagggatataaaatccctttagttgatcgggtgtaaacagaggagatacaccatgtcaactaaaaacctggcggcagcgcaaaagatg

SEQ ID NO: 58002 - DNA, 103 bp, Artificial Sequence
  Synthetic Polynucleotide
taatacgactcactatagggatatcatataaaatccctttagttgatcggaacagaggagaccgatcatgtaaagggataacctggcggcagcgcaaaagatg

SEQ ID NO: 58003 - DNA, 103 bp, Artificial Sequence
  Synthetic Polynucleotide
taatacgactcactataggggtcacgacccattaatatgacatttaagaaaacagaggagattcttaatggtcatattaaacctggcggcagcgcaaaagatg

SEQ ID NO: 58004 - DNA, 103 bp, Artificial Sequence
  Synthetic Polynucleotide
taatacgactcactatagggtaaagatatcatataaaatccctttagttgaacagaggagacaactaatgggattttataacctggcggcagcgcaaaagatg

SEQ ID NO: 58005 - DNA, 103 bp, Artificial Sequence
  Synthetic Polynucleotide
taatacgactcactatagggcttagtaaagatatcatataaaatccctttaacagaggagaaaagggatgttatatgataacctggcggcagcgcaaaagatg

SEQ ID NO: 58006 - DNA, 103 bp, Artificial Sequence
  Synthetic Polynucleotide
taatacgactcactatagggactttcttagtaaagatatcatataaaatcaacagaggagagattttatgtgatatcttaacctggcggcagcgcaaaagatg

SEQ ID NO: 58007 - DNA, 103 bp, Artificial Sequence
  Synthetic Polynucleotide
taatacgactcactatagggaagaaactttcttagtaaagatatcatataaacagaggagatatatgatgtctttactaaacctggcggcagcgcaaaagatg

SEQ ID NO: 58008 - DNA, 103 bp, Artificial Sequence
  Synthetic Polynucleotide
taatacgactcactatagggcagtaaagaaactttcttagtaaagatatcaacagaggagagatatcatgactaagaaaaacctggcggcagcgcaaaagatg

SEQ ID NO: 58009 - DNA, 103 bp, Artificial Sequence
  Synthetic Polynucleotide
taatacgactcactatagggagatacagtaaagaaactttcttagtaaagaacagaggagactttacatggaaagtttcaacctggcggcagcgcaaaagatg

SEQ ID NO: 58010 - DNA, 103 bp, Artificial Sequence
  Synthetic Polynucleotide
taatacgactcactataggggtagtagatacagtaaagaaactttcttagaacagaggagactaagaatgtttctttacaacctggcggcagcgcaaaagatg

SEQ ID NO: 58011 - DNA, 103 bp, Artificial Sequence
  Synthetic Polynucleotide
taatacgactcactataggggaagtgtagtagatacagtaaagaaactttaacagaggagaaaagttatgttactgtataacctggcggcagcgcaaaagatg

SEQ ID NO: 58012 - DNA, 103 bp, Artificial Sequence
  Synthetic Polynucleotide
taatacgactcactatagggatctagaagtgtagtagatacagtaaagaaaacagaggagattctttatggtatctactaacctggcggcagcgcaaaagatg

SEQ ID NO: 58013 - DNA, 103 bp, Artificial Sequence
  Synthetic Polynucleotide
taatacgactcactatagggtggatatctagaagtgtagtagatacagtaaacagaggagatactgtatgtactacactaacctggcggcagcgcaaaagatg

SEQ ID NO: 58014 - DNA, 103 bp, Artificial Sequence
  Synthetic Polynucleotide
taatacgactcactatagggtgatgtagatgatagaacagaactacacaaaacagaggagattgtgtatgtctgttctaaacctggcggcagcgcaaaagatg

SEQ ID NO: 58015 - DNA, 103 bp, Artificial Sequence
  Synthetic Polynucleotide
taatacgactcactatagggattccgtcacgacccattaatatgacatttaacagaggagaaaatgtatgattaatgggaacctggcggcagcgcaaaagatg

SEQ ID NO: 58016 - DNA, 103 bp, Artificial Sequence
  Synthetic Polynucleotide
taatacgactcactatagggctatctggatatctagaagtgtagtagataaacagaggagatatctaatgcacttctagaacctggcggcagcgcaaaagatg

SEQ ID NO: 58017 - DNA, 103 bp, Artificial Sequence
  Synthetic Polynucleotide
taatacgactcactatagggaatctctatctggatatctagaagtgtagtaacagaggagaactacaatgctagatatcaacctggcggcagcgcaaaagatg

SEQ ID NO: 58018 - DNA, 103 bp, Artificial Sequence
  Synthetic Polynucleotide
taatacgactcactatagggcattgaatctctatctggatatctagaagtaacagaggagaacttctatgtatccagataacctggcggcagcgcaaaagatg

SEQ ID NO: 58019 - DNA, 103 bp, Artificial Sequence
  Synthetic Polynucleotide
taatacgactcactatagggcaaaccattgaatctctatctggatatctaaacagaggagatagataatgagatagagaaacctggcggcagcgcaaaagatg

SEQ ID NO: 58020 - DNA, 103 bp, Artificial Sequence
  Synthetic Polynucleotide
taatacgactcactataggggatgacaaaccattgaatctctatctggataacagaggagaatccagatggagattcaaaacctggcggcagcgcaaaagatg

SEQ ID NO: 58021 - DNA, 103 bp, Artificial Sequence
  Synthetic Polynucleotide
taatacgactcactataggggatgcgatgacaaaccattgaatctctatcaacagaggagagatagaatgtcaatggttaacctggcggcagcgcaaaagatg

SEQ ID NO: 58022 - DNA, 103 bp, Artificial Sequence
  Synthetic Polynucleotide
taatacgactcactataggggttaggatgcgatgacaaaccattgaatctaacagaggagaagattcatgggtttgtcaaacctggcggcagcgcaaaagatg

SEQ ID NO: 58023 - DNA, 103 bp, Artificial Sequence
  Synthetic Polynucleotide
taatacgactcactatagggcgtatgttaggatgcgatgacaaaccattgaacagaggagacaatggatggtcatcgcaaacctggcggcagcgcaaaagatg

SEQ ID NO: 58024 - DNA, 103 bp, Artificial Sequence
  Synthetic Polynucleotide
taatacgactcactatagggtttgccgtatgttaggatgcgatgacaaacaacagaggagagtttgtatgcgcatcctaaacctggcggcagcgcaaaagatg

SEQ ID NO: 58025 - DNA, 103 bp, Artificial Sequence
  Synthetic Polynucleotide
taatacgactcactatagggaaatatttgccgtatgttaggatgcgatgaaacagaggagatcatcgatgcctaacataaacctggcggcagcgcaaaagatg

SEQ ID NO: 58026 - DNA, 103 bp, Artificial Sequence
  Synthetic Polynucleotide
taatacgactcactataggggtactattccgtcacgacccattaatatgaaacagaggagatcatatatgtgggtcgtgaacctggcggcagcgcaaaagatg

SEQ ID NO: 58027 - DNA, 103 bp, Artificial Sequence
  Synthetic Polynucleotide
taatacgactcactatagggtctcaaaatatttgccgtatgttaggatgcaacagaggagagcatccatgcatacggcaaacctggcggcagcgcaaaagatg

SEQ ID NO: 58028 - DNA, 103 bp, Artificial Sequence
  Synthetic Polynucleotide
taatacgactcactatagggcaacgtctcaaaatatttgccgtatgttagaacagaggagactaacaatgggcaaatataacctggcggcagcgcaaaagatg

SEQ ID NO: 58029 - DNA, 103 bp, Artificial Sequence
  Synthetic Polynucleotide
taatacgactcactatagggtgtgccaacgtctcaaaatatttgccgtataacagaggagaatacggatgatattttgaaacctggcggcagcgcaaaagatg

SEQ ID NO: 58030 - DNA, 103 bp, Artificial Sequence
  Synthetic Polynucleotide
taatacgactcactatagggcatcatgtgccaacgtctcaaaatatttgcaacagaggagagcaaatatgttgagacgtaacctggcggcagcgcaaaagatg

SEQ ID NO: 58031 - DNA, 103 bp, Artificial Sequence
  Synthetic Polynucleotide
taatacgactcactatagggtaattcatcatgtgccaacgtctcaaaataaacagaggagatattttatgacgttggcaaacctggcggcagcgcaaaagatg

SEQ ID NO: 58032 - DNA, 103 bp, Artificial Sequence
  Synthetic Polynucleotide
taatacgactcactatagggttctctaattcatcatgtgccaacgtctcaaacagaggagatgagacatgggcacatgaaacctggcggcagcgcaaaagatg

SEQ ID NO: 58033 - DNA, 103 bp, Artificial Sequence
  Synthetic Polynucleotide
taatacgactcactatagggtgtaattctctaattcatcatgtgccaacgaacagaggagacgttggatgatgatgaataacctggcggcagcgcaaaagatg

SEQ ID NO: 58034 - DNA, 103 bp, Artificial Sequence
  Synthetic Polynucleotide
taatacgactcactataggggcctatgtaattctctaattcatcatgtgcaacagaggagagcacatatggaattagagaacctggcggcagcgcaaaagatg

SEQ ID NO: 58035 - DNA, 103 bp, Artificial Sequence
  Synthetic Polynucleotide
taatacgactcactatagggatgttgcctatgtaattctctaattcatcaaacagaggagatgatgaatgagagaattaaacctggcggcagcgcaaaagatg

SEQ ID NO: 58036 - DNA, 103 bp, Artificial Sequence
  Synthetic Polynucleotide
taatacgactcactatagggttctgatgttgcctatgtaattctctaattaacagaggagaaattagatgattacatagaacctggcggcagcgcaaaagatg

SEQ ID NO: 58037 - DNA, 103 bp, Artificial Sequence
  Synthetic Polynucleotide
taatacgactcactatagggatgctgtactattccgtcacgacccattaaaacagaggagattaatgatgcgtgacggaaacctggcggcagcgcaaaagatg

SEQ ID NO: 58038 - DNA, 103 bp, Artificial Sequence
  Synthetic Polynucleotide
taatacgactcactataggggtcgtttctgatgttgcctatgtaattctcaacagaggagagagaatatgataggcaacaacctggcggcagcgcaaaagatg

SEQ ID NO: 58039 - DNA, 103 bp, Artificial Sequence
  Synthetic Polynucleotide
taatacgactcactatagggatgatgtcgtttctgatgttgcctatgtaaaacagaggagattacatatgcaacatcagaacctggcggcagcgcaaaagatg

SEQ ID NO: 58040 - DNA, 103 bp, Artificial Sequence
  Synthetic Polynucleotide
taatacgactcactatagggtgttcatgatgtcgtttctgatgttgcctaaacagaggagataggcaatgtcagaaacgaacctggcggcagcgcaaaagatg

SEQ ID NO: 58041 - DNA, 103 bp, Artificial Sequence
  Synthetic Polynucleotide
taatacgactcactataggggtgattgttcatgatgtcgtttctgatgttaacagaggagaaacatcatgaacgacatcaacctggcggcagcgcaaaagatg

SEQ ID NO: 58042 - DNA, 103 bp, Artificial Sequence
  Synthetic Polynucleotide
taatacgactcactatagggttcttgtgattgttcatgatgtcgtttctgaacagaggagacagaaaatgcatcatgaaaacctggcggcagcgcaaaagatg

SEQ ID NO: 58043 - DNA, 103 bp, Artificial Sequence
  Synthetic Polynucleotide
taatacgactcactatagggctctattcttgtgattgttcatgatgtcgtaacagaggagaacgacaatgtgaacaatcaacctggcggcagcgcaaaagatg

SEQ ID NO: 58044 - DNA, 103 bp, Artificial Sequence
  Synthetic Polynucleotide
taatacgactcactatagggagtgcctctattcttgtgattgttcatgataacagaggagaatcatgatgaatcacaagaacctggcggcagcgcaaaagatg

SEQ ID NO: 58045 - DNA, 103 bp, Artificial Sequence
  Synthetic Polynucleotide
taatacgactcactataggggcgtaagtgcctctattcttgtgattgttcaacagaggagagaacaaatgcaagaatagaacctggcggcagcgcaaaagatg

SEQ ID NO: 58046 - DNA, 103 bp, Artificial Sequence
  Synthetic Polynucleotide
taatacgactcactatagggttaccgcgtaagtgcctctattcttgtgataacagaggagaatcacaatgatagaggcaaacctggcggcagcgcaaaagatg

SEQ ID NO: 58047 - DNA, 103 bp, Artificial Sequence
  Synthetic Polynucleotide
taatacgactcactatagggaatgtttaccgcgtaagtgcctctattcttaacagaggagaaagaatatgggcacttacaacctggcggcagcgcaaaagatg

SEQ ID NO: 58048 - DNA, 103 bp, Artificial Sequence
  Synthetic Polynucleotide
taatacgactcactatagggctatcatgctgtactattccgtcacgacccaacagaggagagggtcgatgcggaatagtaacctggcggcagcgcaaaagatg

SEQ ID NO: 58049 - DNA, 103 bp, Artificial Sequence
  Synthetic Polynucleotide
taatacgactcactatagggacatgaatgtttaccgcgtaagtgcctctaaacagaggagatagaggatgttacgcggtaacctggcggcagcgcaaaagatg

SEQ ID NO: 58050 - DNA, 103 bp, Artificial Sequence
  Synthetic Polynucleotide
taatacgactcactatagggttagtacatgaatgtttaccgcgtaagtgcaacagaggagagcacttatgcggtaaacaaacctggcggcagcgcaaaagatg

SEQ ID NO: 58051 - DNA, 103 bp, Artificial Sequence
  Synthetic Polynucleotide
taatacgactcactatagggagttgttagtacatgaatgtttaccgcgtaaacagaggagatacgcgatgaacattcataacctggcggcagcgcaaaagatg

SEQ ID NO: 58052 - DNA, 103 bp, Artificial Sequence
  Synthetic Polynucleotide
taatacgactcactatagggccgggagttgttagtacatgaatgtttaccaacagaggagaggtaaaatgtcatgtactaacctggcggcagcgcaaaagatg

SEQ ID NO: 58053 - DNA, 103 bp, Artificial Sequence
  Synthetic Polynucleotide
taatacgactcactatagggtaagtccgggagttgttagtacatgaatgtaacagaggagaacattcatgtactaacaaaacctggcggcagcgcaaaagatg

SEQ ID NO: 58054 - DNA, 103 bp, Artificial Sequence
  Synthetic Polynucleotide
taatacgactcactataggggtgattaagtccgggagttgttagtacatgaacagaggagacatgtaatgacaactcccaacctggcggcagcgcaaaagatg

SEQ ID NO: 58055 - DNA, 103 bp, Artificial Sequence
  Synthetic Polynucleotide
taatacgactcactatagggaacgcgtgattaagtccgggagttgttagtaacagaggagaactaacatgtcccggactaacctggcggcagcgcaaaagatg

SEQ ID NO: 58056 - DNA, 103 bp, Artificial Sequence
  Synthetic Polynucleotide
taatacgactcactatagggtagaaaacgcgtgattaagtccgggagttgaacagaggagacaactcatggacttaatcaacctggcggcagcgcaaaagatg

SEQ ID NO: 58057 - DNA, 103 bp, Artificial Sequence
  Synthetic Polynucleotide
taatacgactcactatagggtaagctagaaaacgcgtgattaagtccgggaacagaggagacccggaatgaatcacgcgaacctggcggcagcgcaaaagatg

SEQ ID NO: 58058 - DNA, 103 bp, Artificial Sequence
  Synthetic Polynucleotide
taatacgactcactatagggctcaataagctagaaaacgcgtgattaagtaacagaggagaacttaaatgcgcgttttcaacctggcggcagcgcaaaagatg

SEQ ID NO: 58059 - DNA, 103 bp, Artificial Sequence
  Synthetic Polynucleotide
taatacgactcactataggggcgttctatcatgctgtactattccgtcacaacagaggagagtgacgatgtagtacagcaacctggcggcagcgcaaaagatg

SEQ ID NO: 58060 - DNA, 103 bp, Artificial Sequence
  Synthetic Polynucleotide
taatacgactcactatagggttccactcaataagctagaaaacgcgtgataacagaggagaatcacgatgtttctagctaacctggcggcagcgcaaaagatg

SEQ ID NO: 58061 - DNA, 103 bp, Artificial Sequence
  Synthetic Polynucleotide
taatacgactcactataggggaactttccactcaataagctagaaaacgcaacagaggagagcgtttatgagcttattgaacctggcggcagcgcaaaagatg

SEQ ID NO: 58062 - DNA, 103 bp, Artificial Sequence
  Synthetic Polynucleotide
taatacgactcactatagggtttttgaactttccactcaataagctagaaaacagaggagattctagatgattgagtggaacctggcggcagcgcaaaagatg

SEQ ID NO: 58063 - DNA, 103 bp, Artificial Sequence
  Synthetic Polynucleotide
taatacgactcactatagggctgactttttgaactttccactcaataagcaacagaggagagcttatatggtggaaagtaacctggcggcagcgcaaaagatg

SEQ ID NO: 58064 - DNA, 103 bp, Artificial Sequence
  Synthetic Polynucleotide
taatacgactcactatagggaccgtctgactttttgaactttccactcaaaacagaggagattgagtatgaagttcaaaaacctggcggcagcgcaaaagatg

SEQ ID NO: 58065 - DNA, 103 bp, Artificial Sequence
  Synthetic Polynucleotide
taatacgactcactatagggtaactaccgtctgactttttgaactttccaaacagaggagatggaaaatgcaaaaagtcaacctggcggcagcgcaaaagatg

SEQ ID NO: 58066 - DNA, 103 bp, Artificial Sequence
  Synthetic Polynucleotide
taatacgactcactatagggttcgataactaccgtctgactttttgaactaacagaggagaagttcaatgagtcagacgaacctggcggcagcgcaaaagatg

SEQ ID NO: 58067 - DNA, 103 bp, Artificial Sequence
  Synthetic Polynucleotide
taatacgactcactatagggatgtgttcgataactaccgtctgactttttaacagaggagaaaaaagatggacggtagtaacctggcggcagcgcaaaagatg

SEQ ID NO: 58068 - DNA, 103 bp, Artificial Sequence
  Synthetic Polynucleotide
taatacgactcactatagggtgaggatgtgttcgataactaccgtctgacaacagaggagagtcagaatgtagttatcgaacctggcggcagcgcaaaagatg

SEQ ID NO: 58069 - DNA, 103 bp, Artificial Sequence
  Synthetic Polynucleotide
taatacgactcactatagggaatagtgaggatgtgttcgataactaccgtaacagaggagaacggtaatgatcgaacacaacctggcggcagcgcaaaagatg

SEQ ID NO: 58070 - DNA, 103 bp, Artificial Sequence
  Synthetic Polynucleotide
taatacgactcactatagggaggatgcgttctatcatgctgtactattccaacagaggagaggaataatgcagcatgataacctggcggcagcgcaaaagatg

SEQ ID NO: 58071 - DNA, 103 bp, Artificial Sequence
  Synthetic Polynucleotide
taatacgactcactatagggccatgaatagtgaggatgtgttcgataactaacagaggagaagttatatgacacatcctaacctggcggcagcgcaaaagatg

SEQ ID NO: 58072 - DNA, 103 bp, Artificial Sequence
  Synthetic Polynucleotide
taatacgactcactatagggtgcatccatgaatagtgaggatgtgttcgaaacagaggagatcgaacatgtcctcactaaacctggcggcagcgcaaaagatg

SEQ ID NO: 58073 - DNA, 103 bp, Artificial Sequence
  Synthetic Polynucleotide
taatacgactcactatagggtattctgcatccatgaatagtgaggatgtgaacagaggagacacatcatgactattcataacctggcggcagcgcaaaagatg

SEQ ID NO: 58074 - DNA, 103 bp, Artificial Sequence
  Synthetic Polynucleotide
taatacgactcactatagggagaaatattctgcatccatgaatagtgaggaacagaggagacctcacatgtcatggatgaacctggcggcagcgcaaaagatg

SEQ ID NO: 58075 - DNA, 103 bp, Artificial Sequence
  Synthetic Polynucleotide
taatacgactcactatagggggaatagaaatattctgcatccatgaatagaacagaggagactattcatggatgcagaaaacctggcggcagcgcaaaagatg

SEQ ID NO: 58076 - DNA, 103 bp, Artificial Sequence
  Synthetic Polynucleotide
taatacgactcactatagggttctaggaatagaaatattctgcatccatgaacagaggagacatggaatgagaatatttaacctggcggcagcgcaaaagatg

SEQ ID NO: 58077 - DNA, 103 bp, Artificial Sequence
  Synthetic Polynucleotide
taatacgactcactatagggaacacttctaggaatagaaatattctgcataacagaggagaatgcagatgatttctattaacctggcggcagcgcaaaagatg

SEQ ID NO: 58078 - DNA, 103 bp, Artificial Sequence
  Synthetic Polynucleotide
taatacgactcactatagggaacccaacacttctaggaatagaaatattcaacagaggagagaatatatgtattcctagaacctggcggcagcgcaaaagatg

SEQ ID NO: 58079 - DNA, 103 bp, Artificial Sequence
  Synthetic Polynucleotide
taatacgactcactataggggataaaacccaacacttctaggaatagaaaaacagaggagatttctaatgctagaagtgaacctggcggcagcgcaaaagatg

SEQ ID NO: 58080 - DNA, 103 bp, Artificial Sequence
  Synthetic Polynucleotide
taatacgactcactatagggatccggataaaacccaacacttctaggaataacagaggagaattcctatgagtgttgggaacctggcggcagcgcaaaagatg

SEQ ID NO: 58081 - DNA, 103 bp, Artificial Sequence
  Synthetic Polynucleotide
taatacgactcactatagggggaataggatgcgttctatcatgctgtactaacagaggagaagtacaatgtgatagaacaacctggcggcagcgcaaaagatg

SEQ ID NO: 58082 - DNA, 103 bp, Artificial Sequence
  Synthetic Polynucleotide
taatacgactcactatagggacttgatccggataaaacccaacacttctaaacagaggagatagaagatgtgggttttaaacctggcggcagcgcaaaagatg

SEQ ID NO: 58083 - DNA, 103 bp, Artificial Sequence
  Synthetic Polynucleotide
taatacgactcactatagggtctttacttgatccggataaaacccaacacaacagaggagagtgttgatgtttatccggaacctggcggcagcgcaaaagatg

SEQ ID NO: 58084 - DNA, 103 bp, Artificial Sequence
  Synthetic Polynucleotide
taatacgactcactatagggtgaaatctttacttgatccggataaaacccaacagaggagagggtttatgccggatcaaaacctggcggcagcgcaaaagatg

SEQ ID NO: 58085 - DNA, 103 bp, Artificial Sequence
  Synthetic Polynucleotide
taatacgactcactatagggatctttgaaatctttacttgatccggataaaacagaggagattatccatgtcaagtaaaaacctggcggcagcgcaaaagatg

SEQ ID NO: 58086 - DNA, 103 bp, Artificial Sequence
  Synthetic Polynucleotide
taatacgactcactatagggaaaacatctttgaaatctttacttgatccgaacagaggagacggatcatgtaaagatttaacctggcggcagcgcaaaagatg

SEQ ID NO: 58087 - DNA, 103 bp, Artificial Sequence
  Synthetic Polynucleotide
taatacgactcactataggggacagaaaacatctttgaaatctttacttgaacagaggagacaagtaatgatttcaaagaacctggcggcagcgcaaaagatg

SEQ ID NO: 58088 - DNA, 103 bp, Artificial Sequence
  Synthetic Polynucleotide
taatacgactcactatagggtttctgacagaaaacatctttgaaatctttaacagaggagaaaagatatgaaagatgttaacctggcggcagcgcaaaagatg

SEQ ID NO: 58089 - DNA, 103 bp, Artificial Sequence
  Synthetic Polynucleotide
taatacgactcactatagggggtattttctgacagaaaacatctttgaaaaacagaggagatttcaaatgtgttttctgaacctggcggcagcgcaaaagatg

SEQ ID NO: 58090 - DNA, 103 bp, Artificial Sequence
  Synthetic Polynucleotide
taatacgactcactatagggtggatggtattttctgacagaaaacatcttaacagaggagaaagatgatgtctgtcagaaacctggcggcagcgcaaaagatg

SEQ ID NO: 58091 - DNA, 103 bp, Artificial Sequence
  Synthetic Polynucleotide
taatacgactcactatagggtgacttggatggtattttctgacagaaaacaacagaggagagttttcatgcagaaaataaacctggcggcagcgcaaaagatg

SEQ ID NO: 58092 - DNA, 103 bp, Artificial Sequence
  Synthetic Polynucleotide
taatacgactcactatagggtgttgggaataggatgcgttctatcatgctaacagaggagaagcatgatggaacgcatcaacctggcggcagcgcaaaagatg

SEQ ID NO: 58093 - DNA, 103 bp, Artificial Sequence
  Synthetic Polynucleotide
taatacgactcactataggggatattgacttggatggtattttctgacagaacagaggagactgtcaatgaataccatcaacctggcggcagcgcaaaagatg

SEQ ID NO: 58094 - DNA, 103 bp, Artificial Sequence
  Synthetic Polynucleotide
taatacgactcactataggggtaaagatattgacttggatggtattttctaacagaggagaagaaaaatgcatccaagtaacctggcggcagcgcaaaagatg

SEQ ID NO: 58095 - DNA, 103 bp, Artificial Sequence
  Synthetic Polynucleotide
taatacgactcactatagggcaaaagtaaagatattgacttggatggtataacagaggagaataccaatgaagtcaataaacctggcggcagcgcaaaagatg

SEQ ID NO: 58096 - DNA, 103 bp, Artificial Sequence
  Synthetic Polynucleotide
taatacgactcactatagggatgaacaaaagtaaagatattgacttggataacagaggagaatccaaatgaatatctttaacctggcggcagcgcaaaagatg

SEQ ID NO: 58097 - DNA, 103 bp, Artificial Sequence
  Synthetic Polynucleotide
taatacgactcactatagggatctgatgaacaaaagtaaagatattgactaacagaggagaagtcaaatgctttactttaacctggcggcagcgcaaaagatg

SEQ ID NO: 58098 - DNA, 103 bp, Artificial Sequence
  Synthetic Polynucleotide
taatacgactcactatagggggaacatctgatgaacaaaagtaaagatataacagaggagaatatctatgcttttgttcaacctggcggcagcgcaaaagatg

SEQ ID NO: 58099 - DNA, 103 bp, Artificial Sequence
  Synthetic Polynucleotide
taatacgactcactatagggtttccggaacatctgatgaacaaaagtaaaaacagaggagatttactatggttcatcagaacctggcggcagcgcaaaagatg

SEQ ID NO: 58100 - DNA, 103 bp, Artificial Sequence
  Synthetic Polynucleotide
taatacgactcactatagggacctctttccggaacatctgatgaacaaaaaacagaggagattttgtatgtcagatgttaacctggcggcagcgcaaaagatg

SEQ ID NO: 58101 - DNA, 103 bp, Artificial Sequence
  Synthetic Polynucleotide
taatacgactcactatagggtgaggacctctttccggaacatctgatgaaaacagaggagattcatcatgtgttccggaaacctggcggcagcgcaaaagatg

SEQ ID NO: 58102 - DNA, 103 bp, Artificial Sequence
  Synthetic Polynucleotide
taatacgactcactatagggctacctgaggacctctttccggaacatctgaacagaggagacagatgatgcggaaagagaacctggcggcagcgcaaaagatg

SEQ ID NO: 58103 - DNA, 103 bp, Artificial Sequence
  Synthetic Polynucleotide
taatacgactcactataggggacattgttgggaataggatgcgttctatcaacagaggagagatagaatgcatcctattaacctggcggcagcgcaaaagatg

SEQ ID NO: 58104 - DNA, 103 bp, Artificial Sequence
  Synthetic Polynucleotide
taatacgactcactatagggtaaacctacctgaggacctctttccggaacaacagaggagagttccgatgagaggtcctaacctggcggcagcgcaaaagatg

SEQ ID NO: 58105 - DNA, 103 bp, Artificial Sequence
  Synthetic Polynucleotide
taatacgactcactataggggatactaaacctacctgaggacctctttccaacagaggagaggaaagatgtcctcaggtaacctggcggcagcgcaaaagatg

SEQ ID NO: 58106 - DNA, 103 bp, Artificial Sequence
  Synthetic Polynucleotide
taatacgactcactatagggattgagatactaaacctacctgaggacctcaacagaggagagaggtcatgaggtaggttaacctggcggcagcgcaaaagatg

SEQ ID NO: 58107 - DNA, 103 bp, Artificial Sequence
  Synthetic Polynucleotide
taatacgactcactatagggagacaattgagatactaaacctacctgaggaacagaggagacctcagatgggtttagtaaacctggcggcagcgcaaaagatg

SEQ ID NO: 58108 - DNA, 103 bp, Artificial Sequence
  Synthetic Polynucleotide
taatacgactcactatagggaagacagacaattgagatactaaacctaccaacagaggagaggtaggatgagtatctcaaacctggcggcagcgcaaaagatg

SEQ ID NO: 58109 - DNA, 103 bp, Artificial Sequence
  Synthetic Polynucleotide
taatacgactcactatagggaacttaagacagacaattgagatactaaacaacagaggagagtttagatgctcaattgtaacctggcggcagcgcaaaagatg

SEQ ID NO: 58110 - DNA, 103 bp, Artificial Sequence
  Synthetic Polynucleotide
taatacgactcactatagggaatggaacttaagacagacaattgagatacaacagaggagagtatctatgttgtctgtcaacctggcggcagcgcaaaagatg

SEQ ID NO: 58111 - DNA, 103 bp, Artificial Sequence
  Synthetic Polynucleotide
taatacgactcactatagggtttgtaatggaacttaagacagacaattgaaacagaggagatcaattatgtgtcttaagaacctggcggcagcgcaaaagatg

SEQ ID NO: 58112 - DNA, 103 bp, Artificial Sequence
  Synthetic Polynucleotide
taatacgactcactataggggtatatttgtaatggaacttaagacagacaaacagaggagatgtctgatgtaagttccaaacctggcggcagcgcaaaagatg

SEQ ID NO: 58113 - DNA, 103 bp, Artificial Sequence
  Synthetic Polynucleotide
taatacgactcactatagggcgttagtatatttgtaatggaacttaagacaacagaggagagtcttaatgtccattacaaacctggcggcagcgcaaaagatg

SEQ ID NO: 58114 - DNA, 103 bp, Artificial Sequence
  Synthetic Polynucleotide
taatacgactcactatagggttcctgacattgttgggaataggatgcgttaacagaggagaaacgcaatgtattcccaaaacctggcggcagcgcaaaagatg

SEQ ID NO: 58115 - DNA, 103 bp, Artificial Sequence
  Synthetic Polynucleotide
taatacgactcactatagggtcagacgttagtatatttgtaatggaacttaacagaggagaaagttcatgtacaaatataacctggcggcagcgcaaaagatg

SEQ ID NO: 58116 - DNA, 103 bp, Artificial Sequence
  Synthetic Polynucleotide
taatacgactcactatagggaatactcagacgttagtatatttgtaatggaacagaggagaccattaatgatatactaaaacctggcggcagcgcaaaagatg

SEQ ID NO: 58117 - DNA, 103 bp, Artificial Sequence
  Synthetic Polynucleotide
taatacgactcactatagggatccaaatactcagacgttagtatatttgtaacagaggagaacaaatatgctaacgtctaacctggcggcagcgcaaaagatg

SEQ ID NO: 58118 - DNA, 103 bp, Artificial Sequence
  Synthetic Polynucleotide
taatacgactcactatagggtccaaatccaaatactcagacgttagtataaacagaggagatatactatggtctgagtaaacctggcggcagcgcaaaagatg

SEQ ID NO: 58119 - DNA, 103 bp, Artificial Sequence
  Synthetic Polynucleotide
taatacgactcactatagggtcttttccaaatccaaatactcagacgttaaacagaggagataacgtatgagtatttggaacctggcggcagcgcaaaagatg

SEQ ID NO: 58120 - DNA, 103 bp, Artificial Sequence
  Synthetic Polynucleotide
taatacgactcactatagggaattttcttttccaaatccaaatactcagaaacagaggagatctgagatgttggatttgaacctggcggcagcgcaaaagatg

SEQ ID NO: 58121 - DNA, 103 bp, Artificial Sequence
  Synthetic Polynucleotide
taatacgactcactatagggtcacaaattttcttttccaaatccaaatacaacagaggagagtatttatgtttggaaaaaacctggcggcagcgcaaaagatg

SEQ ID NO: 58122 - DNA, 103 bp, Artificial Sequence
  Synthetic Polynucleotide
taatacgactcactatagggtatactcacaaattttcttttccaaatccaaacagaggagatggattatgaaaagaaaaaacctggcggcagcgcaaaagatg

SEQ ID NO: 58123 - DNA, 103 bp, Artificial Sequence
  Synthetic Polynucleotide
taatacgactcactatagggtctgatatactcacaaattttcttttccaaaacagaggagattggaaatgaaaatttgtaacctggcggcagcgcaaaagatg

SEQ ID NO: 58124 - DNA, 103 bp, Artificial Sequence
  Synthetic Polynucleotide
taatacgactcactatagggtatgatctgatatactcacaaattttctttaacagaggagaaaagaaatgttgtgagtaaacctggcggcagcgcaaaagatg

SEQ ID NO: 58125 - DNA, 103 bp, Artificial Sequence
  Synthetic Polynucleotide
taatacgactcactataggggacagtgatgtagatgatagaacagaactaaacagaggagatagttcatgtctatcatcaacctggcggcagcgcaaaagatg

SEQ ID NO: 58126 - DNA, 103 bp, Artificial Sequence
  Synthetic Polynucleotide
taatacgactcactatagggtgacgttcctgacattgttgggaataggataacagaggagaatcctaatgccaacaatgaacctggcggcagcgcaaaagatg

SEQ ID NO: 58127 - DNA, 103 bp, Artificial Sequence
  Synthetic Polynucleotide
taatacgactcactatagggtataatatgatctgatatactcacaaatttaacagaggagaaaatttatgagtatatcaaacctggcggcagcgcaaaagatg

SEQ ID NO: 58128 - DNA, 103 bp, Artificial Sequence
  Synthetic Polynucleotide
taatacgactcactatagggatctttataatatgatctgatatactcacaaacagaggagatgtgagatgatcagatcaaacctggcggcagcgcaaaagatg

SEQ ID NO: 58129 - DNA, 103 bp, Artificial Sequence
  Synthetic Polynucleotide
taatacgactcactatagggatatcatctttataatatgatctgatatacaacagaggagagtatatatgatcatattaaacctggcggcagcgcaaaagatg

SEQ ID NO: 58130 - DNA, 103 bp, Artificial Sequence
  Synthetic Polynucleotide
taatacgactcactatagggaacttatatcatctttataatatgatctgaaacagaggagatcagatatgattataaagaacctggcggcagcgcaaaagatg

SEQ ID NO: 58131 - DNA, 103 bp, Artificial Sequence
  Synthetic Polynucleotide
taatacgactcactatagggaaagtaacttatatcatctttataatatgaaacagaggagatcatatatgaaagatgataacctggcggcagcgcaaaagatg

SEQ ID NO: 58132 - DNA, 103 bp, Artificial Sequence
  Synthetic Polynucleotide
taatacgactcactataggggtttcaaagtaacttatatcatctttataaaacagaggagattataaatgtgatataagaacctggcggcagcgcaaaagatg

SEQ ID NO: 58133 - DNA, 103 bp, Artificial Sequence
  Synthetic Polynucleotide
taatacgactcactatagggatcctgtttcaaagtaacttatatcatcttaacagaggagaaagatgatgtaagttactaacctggcggcagcgcaaaagatg

SEQ ID NO: 58134 - DNA, 103 bp, Artificial Sequence
  Synthetic Polynucleotide
taatacgactcactatagggtggaaatcctgtttcaaagtaacttatatcaacagaggagagatataatgtactttgaaaacctggcggcagcgcaaaagatg

SEQ ID NO: 58135 - DNA, 103 bp, Artificial Sequence
  Synthetic Polynucleotide
taatacgactcactataggggtgattggaaatcctgtttcaaagtaacttaacagaggagaaagttaatgtgaaacaggaacctggcggcagcgcaaaagatg

SEQ ID NO: 58136 - DNA, 103 bp, Artificial Sequence
  Synthetic Polynucleotide
taatacgactcactatagggctatagtgattggaaatcctgtttcaaagtaacagaggagaactttgatgcaggatttcaacctggcggcagcgcaaaagatg

SEQ ID NO: 58137 - DNA, 103 bp, Artificial Sequence
  Synthetic Polynucleotide
taatacgactcactataggggagagtgacgttcctgacattgttgggaataacagaggagaattcccatgaatgtcaggaacctggcggcagcgcaaaagatg

SEQ ID NO: 58138 - DNA, 103 bp, Artificial Sequence
  Synthetic Polynucleotide
taatacgactcactatagggattttctatagtgattggaaatcctgtttcaacagaggagagaaacaatgtttccaatcaacctggcggcagcgcaaaagatg

SEQ ID NO: 58139 - DNA, 103 bp, Artificial Sequence
  Synthetic Polynucleotide
taatacgactcactatagggagagcattttctatagtgattggaaatcctaacagaggagaaggattatgaatcactataacctggcggcagcgcaaaagatg

SEQ ID NO: 58140 - DNA, 103 bp, Artificial Sequence
  Synthetic Polynucleotide
taatacgactcactatagggcgactagagcattttctatagtgattggaaaacagaggagattccaaatgctatagaaaaacctggcggcagcgcaaaagatg

SEQ ID NO: 58141 - DNA, 103 bp, Artificial Sequence
  Synthetic Polynucleotide
taatacgactcactatagggagatgcgactagagcattttctatagtgataacagaggagaatcactatggaaaatgctaacctggcggcagcgcaaaagatg

SEQ ID NO: 58142 - DNA, 103 bp, Artificial Sequence
  Synthetic Polynucleotide
taatacgactcactatagggttaagagatgcgactagagcattttctataaacagaggagatatagaatgtgctctagtaacctggcggcagcgcaaaagatg

SEQ ID NO: 58143 - DNA, 103 bp, Artificial Sequence
  Synthetic Polynucleotide
taatacgactcactatagggttggattaagagatgcgactagagcattttaacagaggagaaaaatgatgtagtcgcataacctggcggcagcgcaaaagatg

SEQ ID NO: 58144 - DNA, 103 bp, Artificial Sequence
  Synthetic Polynucleotide
taatacgactcactatagggcatatttggattaagagatgcgactagagcaacagaggagagctctaatggcatctcttaacctggcggcagcgcaaaagatg

SEQ ID NO: 58145 - DNA, 103 bp, Artificial Sequence
  Synthetic Polynucleotide
taatacgactcactatagggcatatcatatttggattaagagatgcgactaacagaggagaagtcgcatgtcttaatccaacctggcggcagcgcaaaagatg

SEQ ID NO: 58146 - DNA, 103 bp, Artificial Sequence
  Synthetic Polynucleotide
taatacgactcactatagggaatcacatatcatatttggattaagagatgaacagaggagacatctcatgatccaaataaacctggcggcagcgcaaaagatg

SEQ ID NO: 58147 - DNA, 103 bp, Artificial Sequence
  Synthetic Polynucleotide
taatacgactcactatagggtacaaaatcacatatcatatttggattaagaacagaggagacttaatatgaatatgataaacctggcggcagcgcaaaagatg

SEQ ID NO: 58148 - DNA, 103 bp, Artificial Sequence
  Synthetic Polynucleotide
taatacgactcactataggggtggagagagtgacgttcctgacattgttgaacagaggagacaacaaatgcaggaacgtaacctggcggcagcgcaaaagatg

SEQ ID NO: 58149 - DNA, 103 bp, Artificial Sequence
  Synthetic Polynucleotide
taatacgactcactatagggtcagttacaaaatcacatatcatatttggaaacagaggagatccaaaatggatatgtgaaacctggcggcagcgcaaaagatg

SEQ ID NO: 58150 - DNA, 103 bp, Artificial Sequence
  Synthetic Polynucleotide
taatacgactcactatagggtaaagtcagttacaaaatcacatatcatataacagaggagaatatgaatggtgattttgaacctggcggcagcgcaaaagatg

SEQ ID NO: 58151 - DNA, 103 bp, Artificial Sequence
  Synthetic Polynucleotide
taatacgactcactatagggacgtctaaagtcagttacaaaatcacatataacagaggagaatatgtatgtttgtaactaacctggcggcagcgcaaaagatg

SEQ ID NO: 58152 - DNA, 103 bp, Artificial Sequence
  Synthetic Polynucleotide
taatacgactcactatagggtttctacgtctaaagtcagttacaaaatcaaacagaggagatgatttatgaactgacttaacctggcggcagcgcaaaagatg

SEQ ID NO: 58153 - DNA, 103 bp, Artificial Sequence
  Synthetic Polynucleotide
taatacgactcactatagggtccgttttctacgtctaaagtcagttacaaaacagaggagattgtaaatgactttagacaacctggcggcagcgcaaaagatg

SEQ ID NO: 58154 - DNA, 103 bp, Artificial Sequence
  Synthetic Polynucleotide
taatacgactcactatagggtcccatccgttttctacgtctaaagtcagtaacagaggagaactgacatgagacgtagaaacctggcggcagcgcaaaagatg

SEQ ID NO: 58155 - DNA, 103 bp, Artificial Sequence
  Synthetic Polynucleotide
taatacgactcactatagggaagaatcccatccgttttctacgtctaaagaacagaggagactttagatgtagaaaacgaacctggcggcagcgcaaaagatg

SEQ ID NO: 58156 - DNA, 103 bp, Artificial Sequence
  Synthetic Polynucleotide
taatacgactcactatagggtaccgaagaatcccatccgttttctacgtcaacagaggagagacgtaatgaacggatggaacctggcggcagcgcaaaagatg

SEQ ID NO: 58157 - DNA, 103 bp, Artificial Sequence
  Synthetic Polynucleotide
taatacgactcactatagggcaagttaccgaagaatcccatccgttttctaacagaggagaagaaaaatgatgggattcaacctggcggcagcgcaaaagatg

SEQ ID NO: 58158 - DNA, 103 bp, Artificial Sequence
  Synthetic Polynucleotide
taatacgactcactatagggacctccaagttaccgaagaatcccatccgtaacagaggagaacggatatgattcttcggaacctggcggcagcgcaaaagatg

SEQ ID NO: 58159 - DNA, 103 bp, Artificial Sequence
  Synthetic Polynucleotide
taatacgactcactatagggtgaaggtggagagagtgacgttcctgacataacagaggagaatgtcaatgacgtcactcaacctggcggcagcgcaaaagatg

SEQ ID NO: 58160 - DNA, 103 bp, Artificial Sequence
  Synthetic Polynucleotide
taatacgactcactatagggtacctacctccaagttaccgaagaatcccaaacagaggagatgggatatgtcggtaactaacctggcggcagcgcaaaagatg

SEQ ID NO: 58161 - DNA, 103 bp, Artificial Sequence
  Synthetic Polynucleotide
taatacgactcactatagggagtaatacctacctccaagttaccgaagaaaacagaggagattcttcatgaacttggagaacctggcggcagcgcaaaagatg

SEQ ID NO: 58162 - DNA, 103 bp, Artificial Sequence
  Synthetic Polynucleotide
taatacgactcactatagggactaaagtaatacctacctccaagttaccgaacagaggagacggtaaatgggaggtaggaacctggcggcagcgcaaaagatg

SEQ ID NO: 58163 - DNA, 103 bp, Artificial Sequence
  Synthetic Polynucleotide
taatacgactcactatagggccctaactaaagtaatacctacctccaagtaacagaggagaacttggatgtaggtattaaacctggcggcagcgcaaaagatg

SEQ ID NO: 58164 - DNA, 103 bp, Artificial Sequence
  Synthetic Polynucleotide
taatacgactcactataggggtgatccctaactaaagtaatacctacctcaacagaggagagaggtaatgattactttaaacctggcggcagcgcaaaagatg

SEQ ID NO: 58165 - DNA, 103 bp, Artificial Sequence
  Synthetic Polynucleotide
taatacgactcactatagggttcatgtgatccctaactaaagtaatacctaacagaggagaaggtatatgtttagttagaacctggcggcagcgcaaaagatg

SEQ ID NO: 58166 - DNA, 103 bp, Artificial Sequence
  Synthetic Polynucleotide
taatacgactcactatagggtttcattcatgtgatccctaactaaagtaaaacagaggagattacttatgttagggatcaacctggcggcagcgcaaaagatg

SEQ ID NO: 58167 - DNA, 103 bp, Artificial Sequence
  Synthetic Polynucleotide
taatacgactcactatagggacgaatttcattcatgtgatccctaactaaaacagaggagattagttatggatcacatgaacctggcggcagcgcaaaagatg

SEQ ID NO: 58168 - DNA, 103 bp, Artificial Sequence
  Synthetic Polynucleotide
taatacgactcactatagggttaatacgaatttcattcatgtgatccctaaacagaggagatagggaatgcatgaatgaaacctggcggcagcgcaaaagatg

SEQ ID NO: 58169 - DNA, 103 bp, Artificial Sequence
  Synthetic Polynucleotide
taatacgactcactatagggcaatattaatacgaatttcattcatgtgataacagaggagaatcacaatgatgaaattcaacctggcggcagcgcaaaagatg

SEQ ID NO: 58170 - DNA, 103 bp, Artificial Sequence
  Synthetic Polynucleotide
taatacgactcactatagggaaatatgaaggtggagagagtgacgttcctaacagaggagaaggaacatgactctctccaacctggcggcagcgcaaaagatg

SEQ ID NO: 58171 - DNA, 103 bp, Artificial Sequence
  Synthetic Polynucleotide
taatacgactcactatagggtgctccaatattaatacgaatttcattcataacagaggagaatgaatatgattcgtattaacctggcggcagcgcaaaagatg

SEQ ID NO: 58172 - DNA, 103 bp, Artificial Sequence
  Synthetic Polynucleotide
taatacgactcactatagggcttcctgctccaatattaatacgaatttcaaacagaggagatgaaatatgtattaatataacctggcggcagcgcaaaagatg

SEQ ID NO: 58173 - DNA, 103 bp, Artificial Sequence
  Synthetic Polynucleotide
taatacgactcactatagggctaatcttcctgctccaatattaatacgaaaacagaggagattcgtaatgatattggagaacctggcggcagcgcaaaagatg

SEQ ID NO: 58174 - DNA, 103 bp, Artificial Sequence
  Synthetic Polynucleotide
taatacgactcactatagggtctgactaatcttcctgctccaatattaataacagaggagaattaatatgggagcaggaaacctggcggcagcgcaaaagatg

SEQ ID NO: 58175 - DNA, 103 bp, Artificial Sequence
  Synthetic Polynucleotide
taatacgactcactatagggaatggtctgactaatcttcctgctccaataaacagaggagatattggatgaggaagattaacctggcggcagcgcaaaagatg

SEQ ID NO: 58176 - DNA, 103 bp, Artificial Sequence
  Synthetic Polynucleotide
taatacgactcactatagggccaagaatggtctgactaatcttcctgctcaacagaggagagagcagatggattagtcaaacctggcggcagcgcaaaagatg

SEQ ID NO: 58177 - DNA, 103 bp, Artificial Sequence
  Synthetic Polynucleotide
taatacgactcactatagggcaccaccaagaatggtctgactaatcttccaacagaggagaggaagaatggtcagaccaaacctggcggcagcgcaaaagatg

SEQ ID NO: 58178 - DNA, 103 bp, Artificial Sequence
  Synthetic Polynucleotide
taatacgactcactatagggttatccaccaccaagaatggtctgactaataacagaggagaattagtatgaccattcttaacctggcggcagcgcaaaagatg

SEQ ID NO: 58179 - DNA, 103 bp, Artificial Sequence
  Synthetic Polynucleotide
taatacgactcactatagggctccgttatccaccaccaagaatggtctgaaacagaggagatcagacatgtcttggtggaacctggcggcagcgcaaaagatg

SEQ ID NO: 58180 - DNA, 103 bp, Artificial Sequence
  Synthetic Polynucleotide
taatacgactcactataggggagctctccgttatccaccaccaagaatggaacagaggagaccattcatggtggtggataacctggcggcagcgcaaaagatg

SEQ ID NO: 58181 - DNA, 103 bp, Artificial Sequence
  Synthetic Polynucleotide
taatacgactcactatagggtaaataaatatgaaggtggagagagtgacgaacagaggagacgtcacatgctccaccttaacctggcggcagcgcaaaagatg

SEQ ID NO: 58182 - DNA, 103 bp, Artificial Sequence
  Synthetic Polynucleotide
taatacgactcactatagggatcatgagctctccgttatccaccaccaagaacagaggagacttggtatgggataacggaacctggcggcagcgcaaaagatg

SEQ ID NO: 58183 - DNA, 103 bp, Artificial Sequence
  Synthetic Polynucleotide
taatacgactcactatagggcatccatcatgagctctccgttatccaccaaacagaggagatggtggatgacggagagcaacctggcggcagcgcaaaagatg

SEQ ID NO: 58184 - DNA, 103 bp, Artificial Sequence
  Synthetic Polynucleotide
taatacgactcactatagggacacacatccatcatgagctctccgttatcaacagaggagagataacatggagctcatgaacctggcggcagcgcaaaagatg

SEQ ID NO: 58185 - DNA, 103 bp, Artificial Sequence
  Synthetic Polynucleotide
taatacgactcactatagggtccggacacacatccatcatgagctctccgaacagaggagacggagaatgcatgatggaaacctggcggcagcgcaaaagatg

SEQ ID NO: 58186 - DNA, 103 bp, Artificial Sequence
  Synthetic Polynucleotide
taatacgactcactatagggctaactccggacacacatccatcatgagctaacagaggagaagctcaatgtggatgtgtaacctggcggcagcgcaaaagatg

SEQ ID NO: 58187 - DNA, 103 bp, Artificial Sequence
  Synthetic Polynucleotide
taatacgactcactataggggctttctaactccggacacacatccatcataacagaggagaatgatgatggtgtgtccgaacctggcggcagcgcaaaagatg

SEQ ID NO: 58188 - DNA, 103 bp, Artificial Sequence
  Synthetic Polynucleotide
taatacgactcactatagggaatctgctttctaactccggacacacatccaacagaggagaggatgtatgtccggagttaacctggcggcagcgcaaaagatg

SEQ ID NO: 58189 - DNA, 103 bp, Artificial Sequence
  Synthetic Polynucleotide
taatacgactcactatagggcatctaatctgctttctaactccggacacaaacagaggagatgtgtcatgagttagaaaaacctggcggcagcgcaaaagatg

SEQ ID NO: 58190 - DNA, 103 bp, Artificial Sequence
  Synthetic Polynucleotide
taatacgactcactatagggcatgtcatctaatctgctttctaactccggaacagaggagaccggagatggaaagcagaaacctggcggcagcgcaaaagatg

SEQ ID NO: 58191 - DNA, 103 bp, Artificial Sequence
  Synthetic Polynucleotide
taatacgactcactatagggaatgtcatgtcatctaatctgctttctaacaacagaggagagttagaatgcagattagaaacctggcggcagcgcaaaagatg

SEQ ID NO: 58192 - DNA, 103 bp, Artificial Sequence
  Synthetic Polynucleotide
taatacgactcactatagggacggataaataaatatgaaggtggagagagaacagaggagactctctatgccttcatataacctggcggcagcgcaaaagatg

SEQ ID NO: 58193 - DNA, 103 bp, Artificial Sequence
  Synthetic Polynucleotide
taatacgactcactatagggcagagaatgtcatgtcatctaatctgctttaacagaggagaaaagcaatgtagatgacaaacctggcggcagcgcaaaagatg

SEQ ID NO: 58194 - DNA, 103 bp, Artificial Sequence
  Synthetic Polynucleotide
taatacgactcactatagggaatgtcagagaatgtcatgtcatctaatctaacagaggagaagattaatggacatgacaaacctggcggcagcgcaaaagatg

SEQ ID NO: 58195 - DNA, 103 bp, Artificial Sequence
  Synthetic Polynucleotide
taatacgactcactatagggttctgaatgtcagagaatgtcatgtcatctaacagaggagaagatgaatggacattctcaacctggcggcagcgcaaaagatg

SEQ ID NO: 58196 - DNA, 103 bp, Artificial Sequence
  Synthetic Polynucleotide
taatacgactcactatagggactctttctgaatgtcagagaatgtcatgtaacagaggagaacatgaatgtctctgacaaacctggcggcagcgcaaaagatg

SEQ ID NO: 58197 - DNA, 103 bp, Artificial Sequence
  Synthetic Polynucleotide
taatacgactcactatagggtgggaactctttctgaatgtcagagaatgtaacagaggagaacattcatggacattcagaacctggcggcagcgcaaaagatg

SEQ ID NO: 58198 - DNA, 103 bp, Artificial Sequence
  Synthetic Polynucleotide
taatacgactcactatagggacatgtgggaactctttctgaatgtcagagaacagaggagactctgaatgtcagaaagaaacctggcggcagcgcaaaagatg

SEQ ID NO: 58199 - DNA, 103 bp, Artificial Sequence
  Synthetic Polynucleotide
taatacgactcactatagggcgatgacatgtgggaactctttctgaatgtaacagaggagaacattcatgaagagttccaacctggcggcagcgcaaaagatg

SEQ ID NO: 58200 - DNA, 103 bp, Artificial Sequence
  Synthetic Polynucleotide
taatacgactcactatagggcatttcgatgacatgtgggaactctttctgaacagaggagacagaaaatgttcccacataacctggcggcagcgcaaaagatg

SEQ ID NO: 58201 - DNA, 103 bp, Artificial Sequence
  Synthetic Polynucleotide
taatacgactcactatagggtctaccatttcgatgacatgtgggaactctaacagaggagaagagttatgacatgtcataacctggcggcagcgcaaaagatg

SEQ ID NO: 58202 - DNA, 103 bp, Artificial Sequence
  Synthetic Polynucleotide
taatacgactcactatagggctatatctaccatttcgatgacatgtgggaaacagaggagatcccacatgtcatcgaaaaacctggcggcagcgcaaaagatg

SEQ ID NO: 58203 - DNA, 103 bp, Artificial Sequence
  Synthetic Polynucleotide
taatacgactcactatagggtttttacggataaataaatatgaaggtggaaacagaggagatccaccatgatatttattaacctggcggcagcgcaaaagatg

SEQ ID NO: 58204 - DNA, 103 bp, Artificial Sequence
  Synthetic Polynucleotide
taatacgactcactatagggttgttctatatctaccatttcgatgacatgaacagaggagacatgtcatggaaatggtaaacctggcggcagcgcaaaagatg

SEQ ID NO: 58205 - DNA, 103 bp, Artificial Sequence
  Synthetic Polynucleotide
taatacgactcactataggggtaaattgttctatatctaccatttcgatgaacagaggagacatcgaatgggtagatataacctggcggcagcgcaaaagatg

SEQ ID NO: 58206 - DNA, 103 bp, Artificial Sequence
  Synthetic Polynucleotide
taatacgactcactatagggtaaaagtaaattgttctatatctaccatttaacagaggagaaaatggatgatatagaacaacctggcggcagcgcaaaagatg

SEQ ID NO: 58207 - DNA, 103 bp, Artificial Sequence
  Synthetic Polynucleotide
taatacgactcactataggggttactaaaagtaaattgttctatatctacaacagaggagagtagatatggaacaatttaacctggcggcagcgcaaaagatg

SEQ ID NO: 58208 - DNA, 103 bp, Artificial Sequence
  Synthetic Polynucleotide
taatacgactcactatagggcatacgttactaaaagtaaattgttctataaacagaggagatatagaatgatttactttaacctggcggcagcgcaaaagatg

SEQ ID NO: 58209 - DNA, 103 bp, Artificial Sequence
  Synthetic Polynucleotide
taatacgactcactatagggattcacatacgttactaaaagtaaattgttaacagaggagaaacaatatgcttttagtaaacctggcggcagcgcaaaagatg

SEQ ID NO: 58210 - DNA, 103 bp, Artificial Sequence
  Synthetic Polynucleotide
taatacgactcactatagggaacagattcacatacgttactaaaagtaaaaacagaggagatttactatgagtaacgtaaacctggcggcagcgcaaaagatg

SEQ ID NO: 58211 - DNA, 103 bp, Artificial Sequence
  Synthetic Polynucleotide
taatacgactcactatagggttttgaacagattcacatacgttactaaaaaacagaggagattttagatgcgtatgtgaaacctggcggcagcgcaaaagatg

SEQ ID NO: 58212 - DNA, 103 bp, Artificial Sequence
  Synthetic Polynucleotide
taatacgactcactatagggtaaatttttgaacagattcacatacgttacaacagaggagagtaacgatggtgaatctgaacctggcggcagcgcaaaagatg

SEQ ID NO: 58213 - DNA, 103 bp, Artificial Sequence
  Synthetic Polynucleotide
taatacgactcactatagggcattctaaatttttgaacagattcacatacaacagaggagagtatgtatgtctgttcaaaacctggcggcagcgcaaaagatg

SEQ ID NO: 58214 - DNA, 103 bp, Artificial Sequence
  Synthetic Polynucleotide
taatacgactcactatagggtaacatttttacggataaataaatatgaagaacagaggagacttcatatgtatttatccaacctggcggcagcgcaaaagatg

SEQ ID NO: 58215 - DNA, 103 bp, Artificial Sequence
  Synthetic Polynucleotide
taatacgactcactataggggacatcattctaaatttttgaacagattcaaacagaggagatgaatcatgtcaaaaattaacctggcggcagcgcaaaagatg

SEQ ID NO: 58216 - DNA, 103 bp, Artificial Sequence
  Synthetic Polynucleotide
taatacgactcactatagggcctttgacatcattctaaatttttgaacagaacagaggagactgttcatgaatttagaaaacctggcggcagcgcaaaagatg

SEQ ID NO: 58217 - DNA, 103 bp, Artificial Sequence
  Synthetic Polynucleotide
taatacgactcactatagggttcatcctttgacatcattctaaatttttgaacagaggagacaaaaaatgagaatgatgaacctggcggcagcgcaaaagatg

SEQ ID NO: 58218 - DNA, 103 bp, Artificial Sequence
  Synthetic Polynucleotide
taatacgactcactatagggtttctttcatcctttgacatcattctaaataacagaggagaatttagatggatgtcaaaaacctggcggcagcgcaaaagatg

SEQ ID NO: 58219 - DNA, 103 bp, Artificial Sequence
  Synthetic Polynucleotide
taatacgactcactatagggattgctttctttcatcctttgacatcattcaacagaggagagaatgaatgcaaaggatgaacctggcggcagcgcaaaagatg

SEQ ID NO: 58220 - DNA, 103 bp, Artificial Sequence
  Synthetic Polynucleotide
taatacgactcactatagggatcgtattgctttctttcatcctttgacataacagaggagaatgtcaatggatgaaagaaacctggcggcagcgcaaaagatg

SEQ ID NO: 58221 - DNA, 103 bp, Artificial Sequence
  Synthetic Polynucleotide
taatacgactcactatagggcataaatcgtattgctttctttcatcctttaacagaggagaaaaggaatgaagaaagcaaacctggcggcagcgcaaaagatg

SEQ ID NO: 58222 - DNA, 103 bp, Artificial Sequence
  Synthetic Polynucleotide
taatacgactcactatagggagtcacataaatcgtattgctttctttcataacagaggagaatgaaaatgagcaatacgaacctggcggcagcgcaaaagatg

SEQ ID NO: 58223 - DNA, 103 bp, Artificial Sequence
  Synthetic Polynucleotide
taatacgactcactatagggaggaaagtcacataaatcgtattgctttctaacagaggagaagaaagatgtacgatttaaacctggcggcagcgcaaaagatg

SEQ ID NO: 58224 - DNA, 103 bp, Artificial Sequence
  Synthetic Polynucleotide
taatacgactcactatagggtcggcaggaaagtcacataaatcgtattgcaacagaggagagcaataatgtttatgtgaaacctggcggcagcgcaaaagatg

SEQ ID NO: 58225 - DNA, 103 bp, Artificial Sequence
  Synthetic Polynucleotide
taatacgactcactatagggcaggataacatttttacggataaataaataaacagaggagatatttaatgatccgtaaaaacctggcggcagcgcaaaagatg

SEQ ID NO: 58226 - DNA, 103 bp, Artificial Sequence
  Synthetic Polynucleotide
taatacgactcactatagggtaaattcggcaggaaagtcacataaatcgtaacagaggagaacgattatggtgactttcaacctggcggcagcgcaaaagatg

SEQ ID NO: 58227 - DNA, 103 bp, Artificial Sequence
  Synthetic Polynucleotide
taatacgactcactatagggatctctaaattcggcaggaaagtcacataaaacagaggagattatgtatgtttcctgccaacctggcggcagcgcaaaagatg

SEQ ID NO: 58228 - DNA, 103 bp, Artificial Sequence
  Synthetic Polynucleotide
taatacgactcactatagggtatccatctctaaattcggcaggaaagtcaaacagaggagatgacttatgtgccgaattaacctggcggcagcgcaaaagatg

SEQ ID NO: 58229 - DNA, 103 bp, Artificial Sequence
  Synthetic Polynucleotide
taatacgactcactatagggctacatatccatctctaaattcggcaggaaaacagaggagattcctgatgaatttagagaacctggcggcagcgcaaaagatg

SEQ ID NO: 58230 - DNA, 103 bp, Artificial Sequence
  Synthetic Polynucleotide
taatacgactcactatagggagatgctacatatccatctctaaattcggcaacagaggagagccgaaatgagagatggaaacctggcggcagcgcaaaagatg

SEQ ID NO: 58231 - DNA, 103 bp, Artificial Sequence
  Synthetic Polynucleotide
taatacgactcactatagggagtgaagatgctacatatccatctctaaataacagaggagaatttagatgtggatatgtaacctggcggcagcgcaaaagatg

SEQ ID NO: 58232 - DNA, 103 bp, Artificial Sequence
  Synthetic Polynucleotide
taatacgactcactatagggccactagtgaagatgctacatatccatctcaacagaggagagagatgatgatgtagcataacctggcggcagcgcaaaagatg

SEQ ID NO: 58233 - DNA, 103 bp, Artificial Sequence
  Synthetic Polynucleotide
taatacgactcactataggggattcccactagtgaagatgctacatatccaacagaggagaggatatatggcatcttcaaacctggcggcagcgcaaaagatg

SEQ ID NO: 58234 - DNA, 103 bp, Artificial Sequence
  Synthetic Polynucleotide
taatacgactcactatagggtgattgattcccactagtgaagatgctacaaacagaggagatgtagcatgttcactagtaacctggcggcagcgcaaaagatg

SEQ ID NO: 58235 - DNA, 103 bp, Artificial Sequence
  Synthetic Polynucleotide
taatacgactcactatagggaattgtgattgattcccactagtgaagatgaacagaggagacatcttatgtagtgggaaaacctggcggcagcgcaaaagatg

SEQ ID NO: 58236 - DNA, 103 bp, Artificial Sequence
  Synthetic Polynucleotide
taatacgactcactatagggacagtgacagtgatgtagatgatagaacagaacagaggagactgttcatgcatctacataacctggcggcagcgcaaaagatg

SEQ ID NO: 58237 - DNA, 103 bp, Artificial Sequence
  Synthetic Polynucleotide
taatacgactcactatagggatgtccaggataacatttttacggataaataacagaggagaatttatatgtaaaaatgtaacctggcggcagcgcaaaagatg

SEQ ID NO: 58238 - DNA, 103 bp, Artificial Sequence
  Synthetic Polynucleotide
taatacgactcactatagggaccagaattgtgattgattcccactagtgaaacagaggagatcactaatgggaatcaataacctggcggcagcgcaaaagatg

SEQ ID NO: 58239 - DNA, 103 bp, Artificial Sequence
  Synthetic Polynucleotide
taatacgactcactatagggcttggaccagaattgtgattgattcccactaacagaggagaagtgggatgcaatcacaaaacctggcggcagcgcaaaagatg

SEQ ID NO: 58240 - DNA, 103 bp, Artificial Sequence
  Synthetic Polynucleotide
taatacgactcactatagggtagctcttggaccagaattgtgattgattcaacagaggagagaatcaatgacaattctgaacctggcggcagcgcaaaagatg

SEQ ID NO: 58241 - DNA, 103 bp, Artificial Sequence
  Synthetic Polynucleotide
taatacgactcactatagggaagaatagctcttggaccagaattgtgattaacagaggagaaatcacatgtctggtccaaacctggcggcagcgcaaaagatg

SEQ ID NO: 58242 - DNA, 103 bp, Artificial Sequence
  Synthetic Polynucleotide
taatacgactcactatagggcatccaagaatagctcttggaccagaattgaacagaggagacaattcatgtccaagagcaacctggcggcagcgcaaaagatg

SEQ ID NO: 58243 - DNA, 103 bp, Artificial Sequence
  Synthetic Polynucleotide
taatacgactcactataggggagcacatccaagaatagctcttggaccagaacagaggagactggtcatggagctattcaacctggcggcagcgcaaaagatg

SEQ ID NO: 58244 - DNA, 103 bp, Artificial Sequence
  Synthetic Polynucleotide
taatacgactcactatagggagcttgagcacatccaagaatagctcttggaacagaggagaccaagaatgattcttggaaacctggcggcagcgcaaaagatg

SEQ ID NO: 58245 - DNA, 103 bp, Artificial Sequence
  Synthetic Polynucleotide
taatacgactcactatagggtgtttagcttgagcacatccaagaatagctaacagaggagaagctatatgtggatgtgcaacctggcggcagcgcaaaagatg

SEQ ID NO: 58246 - DNA, 103 bp, Artificial Sequence
  Synthetic Polynucleotide
taatacgactcactatagggtagcttgtttagcttgagcacatccaagaaaacagaggagattcttgatggtgctcaagaacctggcggcagcgcaaaagatg

SEQ ID NO: 58247 - DNA, 103 bp, Artificial Sequence
  Synthetic Polynucleotide
taatacgactcactatagggagagatagcttgtttagcttgagcacatccaacagaggagaggatgtatgcaagctaaaaacctggcggcagcgcaaaagatg

SEQ ID NO: 58248 - DNA, 103 bp, Artificial Sequence
  Synthetic Polynucleotide
taatacgactcactataggggcacaatgtccaggataacatttttacggaaacagaggagatccgtaatgatgttatccaacctggcggcagcgcaaaagatg

SEQ ID NO: 58249 - DNA, 103 bp, Artificial Sequence
  Synthetic Polynucleotide
taatacgactcactatagggagacaagagatagcttgtttagcttgagcaaacagaggagatgctcaatgtaaacaagcaacctggcggcagcgcaaaagatg

SEQ ID NO: 58250 - DNA, 103 bp, Artificial Sequence
  Synthetic Polynucleotide
taatacgactcactatagggaactcagacaagagatagcttgtttagcttaacagaggagaaagctaatgaagctatctaacctggcggcagcgcaaaagatg

SEQ ID NO: 58251 - DNA, 103 bp, Artificial Sequence
  Synthetic Polynucleotide
taatacgactcactatagggatccgaactcagacaagagatagcttgtttaacagaggagaaaacaaatgatctcttgtaacctggcggcagcgcaaaagatg

SEQ ID NO: 58252 - DNA, 103 bp, Artificial Sequence
  Synthetic Polynucleotide
taatacgactcactatagggcgtatatccgaactcagacaagagatagctaacagaggagaagctatatgttgtctgagaacctggcggcagcgcaaaagatg

SEQ ID NO: 58253 - DNA, 103 bp, Artificial Sequence
  Synthetic Polynucleotide
taatacgactcactatagggtatttcgtatatccgaactcagacaagagaaacagaggagatctcttatgtgagttcggaacctggcggcagcgcaaaagatg

SEQ ID NO: 58254 - DNA, 103 bp, Artificial Sequence
  Synthetic Polynucleotide
taatacgactcactatagggtattttatttcgtatatccgaactcagacaaacagaggagatgtctgatgtcggatataaacctggcggcagcgcaaaagatg

SEQ ID NO: 58255 - DNA, 103 bp, Artificial Sequence
  Synthetic Polynucleotide
taatacgactcactatagggttgtctattttatttcgtatatccgaactcaacagaggagagagttcatgtatacgaaaaacctggcggcagcgcaaaagatg

SEQ ID NO: 58256 - DNA, 103 bp, Artificial Sequence
  Synthetic Polynucleotide
taatacgactcactatagggttccattgtctattttatttcgtatatccgaacagaggagacggataatggaaataaaaaacctggcggcagcgcaaaagatg

SEQ ID NO: 58257 - DNA, 103 bp, Artificial Sequence
  Synthetic Polynucleotide
taatacgactcactatagggatgaattccattgtctattttatttcgtataacagaggagaatacgaatgaaaatagacaacctggcggcagcgcaaaagatg

SEQ ID NO: 58258 - DNA, 103 bp, Artificial Sequence
  Synthetic Polynucleotide
taatacgactcactatagggatcaaatgaattccattgtctattttatttaacagaggagaaaataaatgagacaatggaacctggcggcagcgcaaaagatg

SEQ ID NO: 58259 - DNA, 103 bp, Artificial Sequence
  Synthetic Polynucleotide
taatacgactcactatagggtattggcacaatgtccaggataacatttttaacagaggagaaaaaatatgatcctggacaacctggcggcagcgcaaaagatg

SEQ ID NO: 58260 - DNA, 103 bp, Artificial Sequence
  Synthetic Polynucleotide
taatacgactcactataggggatacatcaaatgaattccattgtctatttaacagaggagaaaatagatgatggaattcaacctggcggcagcgcaaaagatg

SEQ ID NO: 58261 - DNA, 103 bp, Artificial Sequence
  Synthetic Polynucleotide
taatacgactcactatagggctctggatacatcaaatgaattccattgtcaacagaggagagacaatatgattcatttgaacctggcggcagcgcaaaagatg

SEQ ID NO: 58262 - DNA, 103 bp, Artificial Sequence
  Synthetic Polynucleotide
taatacgactcactatagggggcctctctggatacatcaaatgaattccaaacagaggagatggaatatgtttgatgtaaacctggcggcagcgcaaaagatg

SEQ ID NO: 58263 - DNA, 103 bp, Artificial Sequence
  Synthetic Polynucleotide
taatacgactcactatagggcaattggcctctctggatacatcaaatgaaaacagaggagattcattatgtgtatccagaacctggcggcagcgcaaaagatg

SEQ ID NO: 58264 - DNA, 103 bp, Artificial Sequence
  Synthetic Polynucleotide
taatacgactcactatagggaatgacaattggcctctctggatacatcaaaacagaggagattgatgatgccagagaggaacctggcggcagcgcaaaagatg

SEQ ID NO: 58265 - DNA, 103 bp, Artificial Sequence
  Synthetic Polynucleotide
taatacgactcactatagggttactaatgacaattggcctctctggatacaacagaggagagtatccatggaggccaataacctggcggcagcgcaaaagatg

SEQ ID NO: 58266 - DNA, 103 bp, Artificial Sequence
  Synthetic Polynucleotide
taatacgactcactatagggaagccttactaatgacaattggcctctctgaacagaggagacagagaatgcaattgtcaaacctggcggcagcgcaaaagatg

SEQ ID NO: 58267 - DNA, 103 bp, Artificial Sequence
  Synthetic Polynucleotide
taatacgactcactatagggttctaaagccttactaatgacaattggcctaacagaggagaaggccaatggtcattagtaacctggcggcagcgcaaaagatg

SEQ ID NO: 58268 - DNA, 103 bp, Artificial Sequence
  Synthetic Polynucleotide
taatacgactcactataggggaagtttctaaagccttactaatgacaattaacagaggagaaattgtatgtagtaaggcaacctggcggcagcgcaaaagatg

SEQ ID NO: 58269 - DNA, 103 bp, Artificial Sequence
  Synthetic Polynucleotide
taatacgactcactatagggtctttgaagtttctaaagccttactaatgaaacagaggagatcattaatgaggctttagaacctggcggcagcgcaaaagatg

SEQ ID NO: 58270 - DNA, 103 bp, Artificial Sequence
  Synthetic Polynucleotide
taatacgactcactatagggtttattattggcacaatgtccaggataacaaacagaggagatgttatatgggacattgtaacctggcggcagcgcaaaagatg

SEQ ID NO: 58271 - DNA, 103 bp, Artificial Sequence
  Synthetic Polynucleotide
taatacgactcactatagggcgcaatctttgaagtttctaaagccttactaacagaggagaagtaagatgttagaaactaacctggcggcagcgcaaaagatg

SEQ ID NO: 58272 - DNA, 103 bp, Artificial Sequence
  Synthetic Polynucleotide
taatacgactcactatagggttagccgcaatctttgaagtttctaaagccaacagaggagaggctttatgaacttcaaaaacctggcggcagcgcaaaagatg

SEQ ID NO: 58273 - DNA, 103 bp, Artificial Sequence
  Synthetic Polynucleotide
taatacgactcactatagggagcaattagccgcaatctttgaagtttctaaacagaggagatagaaaatgcaaagattgaacctggcggcagcgcaaaagatg

SEQ ID NO: 58274 - DNA, 103 bp, Artificial Sequence
  Synthetic Polynucleotide
taatacgactcactatagggtccgaagcaattagccgcaatctttgaagtaacagaggagaacttcaatgattgcggctaacctggcggcagcgcaaaagatg

SEQ ID NO: 58275 - DNA, 103 bp, Artificial Sequence
  Synthetic Polynucleotide
taatacgactcactatagggtgttgtccgaagcaattagccgcaatctttaacagaggagaaaagatatgggctaattgaacctggcggcagcgcaaaagatg

SEQ ID NO: 58276 - DNA, 103 bp, Artificial Sequence
  Synthetic Polynucleotide
taatacgactcactatagggtaacatgttgtccgaagcaattagccgcaaaacagaggagattgcggatgattgcttcgaacctggcggcagcgcaaaagatg

SEQ ID NO: 58277 - DNA, 103 bp, Artificial Sequence
  Synthetic Polynucleotide
taatacgactcactatagggtatagtaacatgttgtccgaagcaattagcaacagaggagagctaatatgttcggacaaaacctggcggcagcgcaaaagatg

SEQ ID NO: 58278 - DNA, 103 bp, Artificial Sequence
  Synthetic Polynucleotide
taatacgactcactatagggaatgctatagtaacatgttgtccgaagcaaaacagaggagattgcttatgacaacatgtaacctggcggcagcgcaaaagatg

SEQ ID NO: 58279 - DNA, 103 bp, Artificial Sequence
  Synthetic Polynucleotide
taatacgactcactatagggacattaatgctatagtaacatgttgtccgaaacagaggagatcggacatgatgttactaaacctggcggcagcgcaaaagatg

SEQ ID NO: 58280 - DNA, 103 bp, Artificial Sequence
  Synthetic Polynucleotide
taatacgactcactataggggtacgacattaatgctatagtaacatgttgaacagaggagacaacatatgactatagcaaacctggcggcagcgcaaaagatg

SEQ ID NO: 58281 - DNA, 103 bp, Artificial Sequence
  Synthetic Polynucleotide
taatacgactcactatagggggctttttattattggcacaatgtccaggaaacagaggagatcctggatgttgtgccaaaacctggcggcagcgcaaaagatg

SEQ ID NO: 58282 - DNA, 103 bp, Artificial Sequence
  Synthetic Polynucleotide
taatacgactcactatagggcctttgtacgacattaatgctatagtaacaaacagaggagatgttacatgagcattaataacctggcggcagcgcaaaagatg

SEQ ID NO: 58283 - DNA, 103 bp, Artificial Sequence
  Synthetic Polynucleotide
taatacgactcactatagggtgatacctttgtacgacattaatgctatagaacagaggagactatagatgtaatgtcgtaacctggcggcagcgcaaaagatg

SEQ ID NO: 58284 - DNA, 103 bp, Artificial Sequence
  Synthetic Polynucleotide
taatacgactcactatagggttgattgatacctttgtacgacattaatgcaacagaggagagcattaatgtcgtacaaaaacctggcggcagcgcaaaagatg

SEQ ID NO: 58285 - DNA, 103 bp, Artificial Sequence
  Synthetic Polynucleotide
taatacgactcactatagggtcctcttgattgatacctttgtacgacattaacagaggagaaatgtcatgcaaaggtataacctggcggcagcgcaaaagatg

SEQ ID NO: 58286 - DNA, 103 bp, Artificial Sequence
  Synthetic Polynucleotide
taatacgactcactatagggttccatcctcttgattgatacctttgtacgaacagaggagacgtacaatggtatcaatcaacctggcggcagcgcaaaagatg

SEQ ID NO: 58287 - DNA, 103 bp, Artificial Sequence
  Synthetic Polynucleotide
taatacgactcactataggggataattccatcctcttgattgatacctttaacagaggagaaaaggtatgaatcaagagaacctggcggcagcgcaaaagatg

SEQ ID NO: 58288 - DNA, 103 bp, Artificial Sequence
  Synthetic Polynucleotide
taatacgactcactatagggttgatgataattccatcctcttgattgataaacagaggagatatcaaatgagaggatggaacctggcggcagcgcaaaagatg

SEQ ID NO: 58289 - DNA, 103 bp, Artificial Sequence
  Synthetic Polynucleotide
taatacgactcactataggggttttttgatgataattccatcctcttgataacagaggagaatcaagatgatggaattaaacctggcggcagcgcaaaagatg

SEQ ID NO: 58290 - DNA, 103 bp, Artificial Sequence
  Synthetic Polynucleotide
taatacgactcactatagggaaattgttttttgatgataattccatcctcaacagaggagagaggatatgattatcatcaacctggcggcagcgcaaaagatg

SEQ ID NO: 58291 - DNA, 103 bp, Artificial Sequence
  Synthetic Polynucleotide
taatacgactcactatagggtgaataaattgttttttgatgataattccaaacagaggagatggaatatgcatcaaaaaaacctggcggcagcgcaaaagatg

SEQ ID NO: 58292 - DNA, 103 bp, Artificial Sequence
  Synthetic Polynucleotide
taatacgactcactatagggatatgggctttttattattggcacaatgtcaacagaggagagacattatgccaataataaacctggcggcagcgcaaaagatg

SEQ ID NO: 58293 - DNA, 103 bp, Artificial Sequence
  Synthetic Polynucleotide
taatacgactcactatagggctctctgaataaattgttttttgatgataaaacagaggagattatcaatgaaaaacaataacctggcggcagcgcaaaagatg

SEQ ID NO: 58294 - DNA, 103 bp, Artificial Sequence
  Synthetic Polynucleotide
taatacgactcactatagggaccgcctctctgaataaattgttttttgataacagaggagaatcaaaatgcaatttattaacctggcggcagcgcaaaagatg

SEQ ID NO: 58295 - DNA, 103 bp, Artificial Sequence
  Synthetic Polynucleotide
taatacgactcactatagggtcaagaccgcctctctgaataaattgttttaacagaggagaaaaacaatgtattcagagaacctggcggcagcgcaaaagatg

SEQ ID NO: 58296 - DNA, 103 bp, Artificial Sequence
  Synthetic Polynucleotide
taatacgactcactatagggcaatatcaagaccgcctctctgaataaattaacagaggagaaatttaatgagagaggcgaacctggcggcagcgcaaaagatg

SEQ ID NO: 58297 - DNA, 103 bp, Artificial Sequence
  Synthetic Polynucleotide
taatacgactcactatagggtgtaacaatatcaagaccgcctctctgaataacagaggagaattcagatgggcggtcttaacctggcggcagcgcaaaagatg

SEQ ID NO: 58298 - DNA, 103 bp, Artificial Sequence
  Synthetic Polynucleotide
taatacgactcactatagggttggctgtaacaatatcaagaccgcctctcaacagaggagagagaggatgtcttgatataacctggcggcagcgcaaaagatg

SEQ ID NO: 58299 - DNA, 103 bp, Artificial Sequence
  Synthetic Polynucleotide
taatacgactcactataggggtttcttggctgtaacaatatcaagaccgcaacagaggagagcggtcatgatattgttaaacctggcggcagcgcaaaagatg

SEQ ID NO: 58300 - DNA, 103 bp, Artificial Sequence
  Synthetic Polynucleotide
taatacgactcactatagggttggtgtttcttggctgtaacaatatcaagaacagaggagacttgatatggttacagccaacctggcggcagcgcaaaagatg

SEQ ID NO: 58301 - DNA, 103 bp, Artificial Sequence
  Synthetic Polynucleotide
taatacgactcactatagggtctacttggtgtttcttggctgtaacaataaacagaggagatattgtatgagccaagaaaacctggcggcagcgcaaaagatg

SEQ ID NO: 58302 - DNA, 103 bp, Artificial Sequence
  Synthetic Polynucleotide
taatacgactcactataggggaatttctacttggtgtttcttggctgtaaaacagaggagattacagatgagaaacaccaacctggcggcagcgcaaaagatg

SEQ ID NO: 58303 - DNA, 103 bp, Artificial Sequence
  Synthetic Polynucleotide
taatacgactcactatagggaacatatatgggctttttattattggcacaaacagaggagatgtgccatgaataaaaagaacctggcggcagcgcaaaagatg

SEQ ID NO: 58304 - DNA, 103 bp, Artificial Sequence
  Synthetic Polynucleotide
taatacgactcactatagggcaatggaatttctacttggtgtttcttggcaacagaggagagccaagatgcaccaagtaaacctggcggcagcgcaaaagatg

SEQ ID NO: 58305 - DNA, 103 bp, Artificial Sequence
  Synthetic Polynucleotide
taatacgactcactatagggttttccaatggaatttctacttggtgtttcaacagaggagagaaacaatgagtagaaataacctggcggcagcgcaaaagatg

SEQ ID NO: 58306 - DNA, 103 bp, Artificial Sequence
  Synthetic Polynucleotide
taatacgactcactatagggtaaagttttccaatggaatttctacttggtaacagaggagaaccaagatgaaattccataacctggcggcagcgcaaaagatg

SEQ ID NO: 58307 - DNA, 103 bp, Artificial Sequence
  Synthetic Polynucleotide
taatacgactcactataggggttattaaagttttccaatggaatttctacaacagaggagagtagaaatgccattggaaaacctggcggcagcgcaaaagatg

SEQ ID NO: 58308 - DNA, 103 bp, Artificial Sequence
  Synthetic Polynucleotide
taatacgactcactatagggtctttgttattaaagttttccaatggaattaacagaggagaaattccatgggaaaacttaacctggcggcagcgcaaaagatg

SEQ ID NO: 58309 - DNA, 103 bp, Artificial Sequence
  Synthetic Polynucleotide
taatacgactcactatagggctctttctttgttattaaagttttccaatgaacagaggagacattggatgactttaataaacctggcggcagcgcaaaagatg

SEQ ID NO: 58310 - DNA, 103 bp, Artificial Sequence
  Synthetic Polynucleotide
taatacgactcactatagggcctatctctttctttgttattaaagttttcaacagaggagagaaaacatgaataacaaaaacctggcggcagcgcaaaagatg

SEQ ID NO: 58311 - DNA, 103 bp, Artificial Sequence
  Synthetic Polynucleotide
taatacgactcactatagggttagacctatctctttctttgttattaaagaacagaggagactttaaatgcaaagaaagaacctggcggcagcgcaaaagatg

SEQ ID NO: 58312 - DNA, 103 bp, Artificial Sequence
  Synthetic Polynucleotide
taatacgactcactatagggaggcgttagacctatctctttctttgttataacagaggagaataacaatgaaagagataaacctggcggcagcgcaaaagatg

SEQ ID NO: 58313 - DNA, 103 bp, Artificial Sequence
  Synthetic Polynucleotide
taatacgactcactatagggcgaataggcgttagacctatctctttctttaacagaggagaaaagaaatggataggtctaacctggcggcagcgcaaaagatg

SEQ ID NO: 58314 - DNA, 103 bp, Artificial Sequence
  Synthetic Polynucleotide
taatacgactcactatagggtagcgaacatatatgggctttttattattgaacagaggagacaataaatgaaagcccataacctggcggcagcgcaaaagatg

SEQ ID NO: 58315 - DNA, 103 bp, Artificial Sequence
  Synthetic Polynucleotide
taatacgactcactatagggaatttcgaataggcgttagacctatctcttaacagaggagaaagagaatggtctaacgcaacctggcggcagcgcaaaagatg

SEQ ID NO: 58316 - DNA, 103 bp, Artificial Sequence
  Synthetic Polynucleotide
taatacgactcactatagggtttctaatttcgaataggcgttagacctataacagaggagaataggtatgacgcctattaacctggcggcagcgcaaaagatg

SEQ ID NO: 58317 - DNA, 103 bp, Artificial Sequence
  Synthetic Polynucleotide
taatacgactcactatagggattactttctaatttcgaataggcgttagaaacagaggagatctaacatgtattcgaaaaacctggcggcagcgcaaaagatg

SEQ ID NO: 58318 - DNA, 103 bp, Artificial Sequence
  Synthetic Polynucleotide
taatacgactcactatagggaatccattactttctaatttcgaataggcgaacagaggagacgcctaatggaaattagaaacctggcggcagcgcaaaagatg

SEQ ID NO: 58319 - DNA, 103 bp, Artificial Sequence
  Synthetic Polynucleotide
taatacgactcactatagggtaactaatccattactttctaatttcgaataacagaggagaattcgaatgtagaaagtaaacctggcggcagcgcaaaagatg

SEQ ID NO: 58320 - DNA, 103 bp, Artificial Sequence
  Synthetic Polynucleotide
taatacgactcactatagggcagtctaactaatccattactttctaatttaacagaggagaaaattaatgagtaatggaaacctggcggcagcgcaaaagatg

SEQ ID NO: 58321 - DNA, 103 bp, Artificial Sequence
  Synthetic Polynucleotide
taatacgactcactataggggcattcagtctaactaatccattactttctaacagaggagaagaaagatgtggattagtaacctggcggcagcgcaaaagatg

SEQ ID NO: 58322 - DNA, 103 bp, Artificial Sequence
  Synthetic Polynucleotide
taatacgactcactatagggagaaagcattcagtctaactaatccattacaacagaggagagtaatgatgtagttagacaacctggcggcagcgcaaaagatg

SEQ ID NO: 58323 - DNA, 103 bp, Artificial Sequence
  Synthetic Polynucleotide
taatacgactcactatagggttccaagaaagcattcagtctaactaatccaacagaggagaggattaatgagactgaataacctggcggcagcgcaaaagatg

SEQ ID NO: 58324 - DNA, 103 bp, Artificial Sequence
  Synthetic Polynucleotide
taatacgactcactatagggccggattccaagaaagcattcagtctaactaacagaggagaagttagatggaatgctttaacctggcggcagcgcaaaagatg

SEQ ID NO: 58325 - DNA, 103 bp, Artificial Sequence
  Synthetic Polynucleotide
taatacgactcactatagggtacaatagcgaacatatatgggctttttataacagaggagaataaaaatgccatatatgaacctggcggcagcgcaaaagatg

SEQ ID NO: 58326 - DNA, 103 bp, Artificial Sequence
  Synthetic Polynucleotide
taatacgactcactatagggcgtctccggattccaagaaagcattcagtcaacagaggagagactgaatgctttcttggaacctggcggcagcgcaaaagatg

SEQ ID NO: 58327 - DNA, 103 bp, Artificial Sequence
  Synthetic Polynucleotide
taatacgactcactatagggcatagcgtctccggattccaagaaagcattaacagaggagaaatgctatgttggaatccaacctggcggcagcgcaaaagatg

SEQ ID NO: 58328 - DNA, 103 bp, Artificial Sequence
  Synthetic Polynucleotide
taatacgactcactatagggcgtgccatagcgtctccggattccaagaaaaacagaggagatttcttatgatccggagaaacctggcggcagcgcaaaagatg

SEQ ID NO: 58329 - DNA, 103 bp, Artificial Sequence
  Synthetic Polynucleotide
taatacgactcactatagggtatttcgtgccatagcgtctccggattccaaacagaggagatggaatatggagacgctaaacctggcggcagcgcaaaagatg

SEQ ID NO: 58330 - DNA, 103 bp, Artificial Sequence
  Synthetic Polynucleotide
taatacgactcactatagggtgagatatttcgtgccatagcgtctccggaaacagaggagatccggaatggctatggcaaacctggcggcagcgcaaaagatg

SEQ ID NO: 58331 - DNA, 103 bp, Artificial Sequence
  Synthetic Polynucleotide
taatacgactcactatagggcttgatgagatatttcgtgccatagcgtctaacagaggagaagacgcatgggcacgaaaaacctggcggcagcgcaaaagatg

SEQ ID NO: 58332 - DNA, 103 bp, Artificial Sequence
  Synthetic Polynucleotide
taatacgactcactataggggagttcttgatgagatatttcgtgccatagaacagaggagactatggatggaaatatctaacctggcggcagcgcaaaagatg

SEQ ID NO: 58333 - DNA, 103 bp, Artificial Sequence
  Synthetic Polynucleotide
taatacgactcactatagggttcaagagttcttgatgagatatttcgtgcaacagaggagagcacgaatgatctcatcaaacctggcggcagcgcaaaagatg

SEQ ID NO: 58334 - DNA, 103 bp, Artificial Sequence
  Synthetic Polynucleotide
taatacgactcactatagggtcatcttcaagagttcttgatgagatatttaacagaggagaaaatatatgatcaagaacaacctggcggcagcgcaaaagatg

SEQ ID NO: 58335 - DNA, 103 bp, Artificial Sequence
  Synthetic Polynucleotide
taatacgactcactatagggcaaaatcatcttcaagagttcttgatgagaaacagaggagatctcatatggaactcttgaacctggcggcagcgcaaaagatg

SEQ ID NO: 58336 - DNA, 103 bp, Artificial Sequence
  Synthetic Polynucleotide
taatacgactcactatagggatttctacaatagcgaacatatatgggcttaacagaggagaaagcccatgtatgttcgcaacctggcggcagcgcaaaagatg

SEQ ID NO: 58337 - DNA, 103 bp, Artificial Sequence
  Synthetic Polynucleotide
taatacgactcactatagggtctagcaaaatcatcttcaagagttcttgaaacagaggagatcaagaatgcttgaagataacctggcggcagcgcaaaagatg

SEQ ID NO: 58338 - DNA, 103 bp, Artificial Sequence
  Synthetic Polynucleotide
taatacgactcactatagggttatctctagcaaaatcatcttcaagagttaacagaggagaaactctatgagatgatttaacctggcggcagcgcaaaagatg

SEQ ID NO: 58339 - DNA, 103 bp, Artificial Sequence
  Synthetic Polynucleotide
taatacgactcactatagggtctgattatctctagcaaaatcatcttcaaaacagaggagattgaagatgattttgctaaacctggcggcagcgcaaaagatg

SEQ ID NO: 58340 - DNA, 103 bp, Artificial Sequence
  Synthetic Polynucleotide
taatacgactcactataggggctaatctgattatctctagcaaaatcatcaacagaggagagatgatatggctagagataacctggcggcagcgcaaaagatg

SEQ ID NO: 58341 - DNA, 103 bp, Artificial Sequence
  Synthetic Polynucleotide
taatacgactcactatagggtcaaagctaatctgattatctctagcaaaaaacagaggagattttgcatgagataatcaaacctggcggcagcgcaaaagatg

SEQ ID NO: 58342 - DNA, 103 bp, Artificial Sequence
  Synthetic Polynucleotide
taatacgactcactatagggaaacatcaaagctaatctgattatctctagaacagaggagactagagatgatcagattaaacctggcggcagcgcaaaagatg

SEQ ID NO: 58343 - DNA, 103 bp, Artificial Sequence
  Synthetic Polynucleotide
taatacgactcactatagggctcggaaacatcaaagctaatctgattatcaacagaggagagataatatgattagctttaacctggcggcagcgcaaaagatg

SEQ ID NO: 58344 - DNA, 103 bp, Artificial Sequence
  Synthetic Polynucleotide
taatacgactcactatagggtatttctcggaaacatcaaagctaatctgaaacagaggagatcagatatgctttgatgtaacctggcggcagcgcaaaagatg

SEQ ID NO: 58345 - DNA, 103 bp, Artificial Sequence
  Synthetic Polynucleotide
taatacgactcactatagggcggtatatttctcggaaacatcaaagctaaaacagaggagattagctatgatgtttccgaacctggcggcagcgcaaaagatg

SEQ ID NO: 58346 - DNA, 103 bp, Artificial Sequence
  Synthetic Polynucleotide
taatacgactcactatagggcatatcggtatatttctcggaaacatcaaaaacagaggagatttgatatgtccgagaaaaacctggcggcagcgcaaaagatg

SEQ ID NO: 58347 - DNA, 103 bp, Artificial Sequence
  Synthetic Polynucleotide
taatacgactcactataggggagtgacagtgacagtgatgtagatgatagaacagaggagactatcaatgacatcactgaacctggcggcagcgcaaaagatg

SEQ ID NO: 58348 - DNA, 103 bp, Artificial Sequence
  Synthetic Polynucleotide
taatacgactcactatagggaaacaatttctacaatagcgaacatatatgaacagaggagacatataatgtcgctattgaacctggcggcagcgcaaaagatg

SEQ ID NO: 58349 - DNA, 103 bp, Artificial Sequence
  Synthetic Polynucleotide
taatacgactcactatagggttgtacatatcggtatatttctcggaaacaaacagaggagatgtttcatggaaatatacaacctggcggcagcgcaaaagatg

SEQ ID NO: 58350 - DNA, 103 bp, Artificial Sequence
  Synthetic Polynucleotide
taatacgactcactataggggagatttgtacatatcggtatatttctcggaacagaggagaccgagaatgataccgataaacctggcggcagcgcaaaagatg

SEQ ID NO: 58351 - DNA, 103 bp, Artificial Sequence
  Synthetic Polynucleotide
taatacgactcactatagggaacgcgagatttgtacatatcggtatatttaacagaggagaaaatatatggatatgtacaacctggcggcagcgcaaaagatg

SEQ ID NO: 58352 - DNA, 103 bp, Artificial Sequence
  Synthetic Polynucleotide
taatacgactcactatagggcgttcaacgcgagatttgtacatatcggtaaacagaggagataccgaatggtacaaatcaacctggcggcagcgcaaaagatg

SEQ ID NO: 58353 - DNA, 103 bp, Artificial Sequence
  Synthetic Polynucleotide
taatacgactcactataggggcactcgttcaacgcgagatttgtacatataacagaggagaatatgtatgaatctcgcgaacctggcggcagcgcaaaagatg

SEQ ID NO: 58354 - DNA, 103 bp, Artificial Sequence
  Synthetic Polynucleotide
taatacgactcactatagggtacttgcactcgttcaacgcgagatttgtaaacagaggagatacaaaatgcgcgttgaaaacctggcggcagcgcaaaagatg

SEQ ID NO: 58355 - DNA, 103 bp, Artificial Sequence
  Synthetic Polynucleotide
taatacgactcactatagggagttctacttgcactcgttcaacgcgagataacagaggagaatctcgatgtgaacgagtaacctggcggcagcgcaaaagatg

SEQ ID NO: 58356 - DNA, 103 bp, Artificial Sequence
  Synthetic Polynucleotide
taatacgactcactatagggcagtaagttctacttgcactcgttcaacgcaacagaggagagcgttgatggagtgcaagaacctggcggcagcgcaaaagatg

SEQ ID NO: 58357 - DNA, 103 bp, Artificial Sequence
  Synthetic Polynucleotide
taatacgactcactatagggtttgtcagtaagttctacttgcactcgttcaacagaggagagaacgaatgcaagtagaaaacctggcggcagcgcaaaagatg

SEQ ID NO: 58358 - DNA, 103 bp, Artificial Sequence
  Synthetic Polynucleotide
taatacgactcactatagggttaactttgtcagtaagttctacttgcactaacagaggagaagtgcaatgagaacttacaacctggcggcagcgcaaaagatg

SEQ ID NO: 58359 - DNA, 103 bp, Artificial Sequence
  Synthetic Polynucleotide
taatacgactcactatagggatgaaaaacaatttctacaatagcgaacataacagaggagaatgttcatgattgtagaaaacctggcggcagcgcaaaagatg

SEQ ID NO: 58360 - DNA, 103 bp, Artificial Sequence
  Synthetic Polynucleotide
taatacgactcactataggggcaccttaactttgtcagtaagttctacttaacagaggagaaagtagatgttactgacaaacctggcggcagcgcaaaagatg

SEQ ID NO: 58361 - DNA, 103 bp, Artificial Sequence
  Synthetic Polynucleotide
taatacgactcactatagggtactcgcaccttaactttgtcagtaagttcaacagaggagagaacttatggacaaagttaacctggcggcagcgcaaaagatg

SEQ ID NO: 58362 - DNA, 103 bp, Artificial Sequence
  Synthetic Polynucleotide
taatacgactcactataggggttaatactcgcaccttaactttgtcagtaaacagaggagatactgaatgagttaaggtaacctggcggcagcgcaaaagatg

SEQ ID NO: 58363 - DNA, 103 bp, Artificial Sequence
  Synthetic Polynucleotide
taatacgactcactatagggtcatggttaatactcgcaccttaactttgtaacagaggagaacaaagatgaggtgcgagaacctggcggcagcgcaaaagatg

SEQ ID NO: 58364 - DNA, 103 bp, Artificial Sequence
  Synthetic Polynucleotide
taatacgactcactatagggttctttcatggttaatactcgcaccttaacaacagaggagagttaagatgcgagtattaaacctggcggcagcgcaaaagatg

SEQ ID NO: 58365 - DNA, 103 bp, Artificial Sequence
  Synthetic Polynucleotide
taatacgactcactatagggcttctttctttcatggttaatactcgcaccaacagaggagaggtgcgatgattaaccataacctggcggcagcgcaaaagatg

SEQ ID NO: 58366 - DNA, 103 bp, Artificial Sequence
  Synthetic Polynucleotide
taatacgactcactatagggtgggtcttctttctttcatggttaatactcaacagaggagagagtatatgccatgaaagaacctggcggcagcgcaaaagatg

SEQ ID NO: 58367 - DNA, 103 bp, Artificial Sequence
  Synthetic Polynucleotide
taatacgactcactatagggtagaatgggtcttctttctttcatggttaaaacagaggagattaaccatgaaagaaagaaacctggcggcagcgcaaaagatg

SEQ ID NO: 58368 - DNA, 103 bp, Artificial Sequence
  Synthetic Polynucleotide
taatacgactcactatagggtctcctagaatgggtcttctttctttcatgaacagaggagacatgaaatgaagaagaccaacctggcggcagcgcaaaagatg

SEQ ID NO: 58369 - DNA, 103 bp, Artificial Sequence
  Synthetic Polynucleotide
taatacgactcactatagggatttatctcctagaatgggtcttctttcttaacagaggagaaagaaaatggacccattcaacctggcggcagcgcaaaagatg

SEQ ID NO: 58370 - DNA, 103 bp, Artificial Sequence
  Synthetic Polynucleotide
taatacgactcactatagggcaactatgaaaaacaatttctacaatagcgaacagaggagacgctatatgagaaattgtaacctggcggcagcgcaaaagatg

SEQ ID NO: 58371 - DNA, 103 bp, Artificial Sequence
  Synthetic Polynucleotide
taatacgactcactatagggggtaaatttatctcctagaatgggtcttctaacagaggagaagaagaatgattctaggaaacctggcggcagcgcaaaagatg

SEQ ID NO: 58372 - DNA, 103 bp, Artificial Sequence
  Synthetic Polynucleotide
taatacgactcactatagggctagtggtaaatttatctcctagaatgggtaacagaggagaacccatatgaggagataaaacctggcggcagcgcaaaagatg

SEQ ID NO: 58373 - DNA, 103 bp, Artificial Sequence
  Synthetic Polynucleotide
taatacgactcactatagggtcgttctagtggtaaatttatctcctagaaaacagaggagattctagatgataaatttaaacctggcggcagcgcaaaagatg

SEQ ID NO: 58374 - DNA, 103 bp, Artificial Sequence
  Synthetic Polynucleotide
taatacgactcactatagggttgactcgttctagtggtaaatttatctccaacagaggagaggagatatgtttaccactaacctggcggcagcgcaaaagatg

SEQ ID NO: 58375 - DNA, 103 bp, Artificial Sequence
  Synthetic Polynucleotide
taatacgactcactatagggcccttttgactcgttctagtggtaaatttaaacagaggagataaattatgcactagaacaacctggcggcagcgcaaaagatg

SEQ ID NO: 58376 - DNA, 103 bp, Artificial Sequence
  Synthetic Polynucleotide
taatacgactcactatagggctgttcccttttgactcgttctagtggtaaaacagaggagattaccaatggaacgagtcaacctggcggcagcgcaaaagatg

SEQ ID NO: 58377 - DNA, 103 bp, Artificial Sequence
  Synthetic Polynucleotide
taatacgactcactatagggcgcgactgttcccttttgactcgttctagtaacagaggagaactagaatgagtcaaaagaacctggcggcagcgcaaaagatg

SEQ ID NO: 58378 - DNA, 103 bp, Artificial Sequence
  Synthetic Polynucleotide
taatacgactcactatagggatatacgcgactgttcccttttgactcgttaacagaggagaaacgagatgaaagggaacaacctggcggcagcgcaaaagatg

SEQ ID NO: 58379 - DNA, 103 bp, Artificial Sequence
  Synthetic Polynucleotide
taatacgactcactatagggctgcgatatacgcgactgttcccttttgacaacagaggagagtcaaaatggaacagtcgaacctggcggcagcgcaaaagatg

SEQ ID NO: 58380 - DNA, 103 bp, Artificial Sequence
  Synthetic Polynucleotide
taatacgactcactatagggttcatctgcgatatacgcgactgttcccttaacagaggagaaagggaatggtcgcgtataacctggcggcagcgcaaaagatg

SEQ ID NO: 58381 - DNA, 103 bp, Artificial Sequence
  Synthetic Polynucleotide
taatacgactcactatagggttgagcaactatgaaaaacaatttctacaaaacagaggagattgtagatgttgtttttcaacctggcggcagcgcaaaagatg

SEQ ID NO: 58382 - DNA, 103 bp, Artificial Sequence
  Synthetic Polynucleotide
taatacgactcactatagggtccgtttcatctgcgatatacgcgactgttaacagaggagaaacagtatggtatatcgcaacctggcggcagcgcaaaagatg

SEQ ID NO: 58383 - DNA, 103 bp, Artificial Sequence
  Synthetic Polynucleotide
taatacgactcactataggggaagttccgtttcatctgcgatatacgcgaaacagaggagatcgcgtatgtcgcagatgaacctggcggcagcgcaaaagatg

SEQ ID NO: 58384 - DNA, 103 bp, Artificial Sequence
  Synthetic Polynucleotide
taatacgactcactataggggtatggaagttccgtttcatctgcgatataaacagaggagatatatcatggatgaaacgaacctggcggcagcgcaaaagatg

SEQ ID NO: 58385 - DNA, 103 bp, Artificial Sequence
  Synthetic Polynucleotide
taatacgactcactatagggtcgtcgtatggaagttccgtttcatctgcgaacagaggagacgcagaatgaacggaactaacctggcggcagcgcaaaagatg

SEQ ID NO: 58386 - DNA, 103 bp, Artificial Sequence
  Synthetic Polynucleotide
taatacgactcactatagggcattttcgtcgtatggaagttccgtttcataacagaggagaatgaaaatgaacttccataacctggcggcagcgcaaaagatg

SEQ ID NO: 58387 - DNA, 103 bp, Artificial Sequence
  Synthetic Polynucleotide
taatacgactcactataggggataccattttcgtcgtatggaagttccgtaacagaggagaacggaaatgccatacgacaacctggcggcagcgcaaaagatg

SEQ ID NO: 58388 - DNA, 103 bp, Artificial Sequence
  Synthetic Polynucleotide
taatacgactcactatagggggtgtgataccattttcgtcgtatggaagtaacagaggagaacttccatgcgacgaaaaaacctggcggcagcgcaaaagatg

SEQ ID NO: 58389 - DNA, 103 bp, Artificial Sequence
  Synthetic Polynucleotide
taatacgactcactatagggcatctggtgtgataccattttcgtcgtatgaacagaggagacatacgatgaaaatggtaaacctggcggcagcgcaaaagatg

SEQ ID NO: 58390 - DNA, 103 bp, Artificial Sequence
  Synthetic Polynucleotide
taatacgactcactatagggaatgacatctggtgtgataccattttcgtcaacagaggagagacgaaatgggtatcacaaacctggcggcagcgcaaaagatg

SEQ ID NO: 58391 - DNA, 103 bp, Artificial Sequence
  Synthetic Polynucleotide
taatacgactcactatagggttaataatgacatctggtgtgataccatttaacagaggagaaaatggatgcacaccagaaacctggcggcagcgcaaaagatg

SEQ ID NO: 58392 - DNA, 103 bp, Artificial Sequence
  Synthetic Polynucleotide
taatacgactcactatagggcgtttttgagcaactatgaaaaacaatttcaacagaggagagaaattatgtttcatagtaacctggcggcagcgcaaaagatg

SEQ ID NO: 58393 - DNA, 103 bp, Artificial Sequence
  Synthetic Polynucleotide
taatacgactcactatagggtagaattaataatgacatctggtgtgatacaacagaggagagtatcaatgcagatgtcaaacctggcggcagcgcaaaagatg

SEQ ID NO: 58394 - DNA, 103 bp, Artificial Sequence
  Synthetic Polynucleotide
taatacgactcactatagggggatgtagaattaataatgacatctggtgtaacagaggagaacaccaatggtcattattaacctggcggcagcgcaaaagatg

SEQ ID NO: 58395 - DNA, 103 bp, Artificial Sequence
  Synthetic Polynucleotide
taatacgactcactatagggaagatggatgtagaattaataatgacatctaacagaggagaagatgtatgtattaattcaacctggcggcagcgcaaaagatg

SEQ ID NO: 58396 - DNA, 103 bp, Artificial Sequence
  Synthetic Polynucleotide
taatacgactcactatagggtagagaagatggatgtagaattaataatgaaacagaggagatcattaatgattctacataacctggcggcagcgcaaaagatg

SEQ ID NO: 58397 - DNA, 103 bp, Artificial Sequence
  Synthetic Polynucleotide
taatacgactcactatagggttttctagagaagatggatgtagaattaataacagaggagaattaatatgacatccatcaacctggcggcagcgcaaaagatg

SEQ ID NO: 58398 - DNA, 103 bp, Artificial Sequence
  Synthetic Polynucleotide
taatacgactcactatagggatagtttttctagagaagatggatgtagaaaacagaggagattctacatgcatcttctcaacctggcggcagcgcaaaagatg

SEQ ID NO: 58399 - DNA, 103 bp, Artificial Sequence
  Synthetic Polynucleotide
taatacgactcactatagggtagatatagtttttctagagaagatggatgaacagaggagacatccaatgtctctagaaaacctggcggcagcgcaaaagatg

SEQ ID NO: 58400 - DNA, 103 bp, Artificial Sequence
  Synthetic Polynucleotide
taatacgactcactatagggcaacatagatatagtttttctagagaagataacagaggagaatcttcatgagaaaaactaacctggcggcagcgcaaaagatg

SEQ ID NO: 58401 - DNA, 103 bp, Artificial Sequence
  Synthetic Polynucleotide
taatacgactcactatagggtctatcaacatagatatagtttttctagagaacagaggagactctagatgaactatatcaacctggcggcagcgcaaaagatg

SEQ ID NO: 58402 - DNA, 103 bp, Artificial Sequence
  Synthetic Polynucleotide
taatacgactcactatagggtaacttctatcaacatagatatagtttttcaacagaggagagaaaaaatgtatctatgtaacctggcggcagcgcaaaagatg

SEQ ID NO: 58403 - DNA, 103 bp, Artificial Sequence
  Synthetic Polynucleotide
taatacgactcactataggggccatcgtttttgagcaactatgaaaaacaaacagaggagatgttttatgtagttgctcaacctggcggcagcgcaaaagatg

SEQ ID NO: 58404 - DNA, 103 bp, Artificial Sequence
  Synthetic Polynucleotide
taatacgactcactatagggtaaaataacttctatcaacatagatatagtaacagaggagaactataatgatgttgataaacctggcggcagcgcaaaagatg

SEQ ID NO: 58405 - DNA, 103 bp, Artificial Sequence
  Synthetic Polynucleotide
taatacgactcactataggggctgttaaaataacttctatcaacatagataacagaggagaatctatatggatagaagtaacctggcggcagcgcaaaagatg

SEQ ID NO: 58406 - DNA, 103 bp, Artificial Sequence
  Synthetic Polynucleotide
taatacgactcactatagggatgcggctgttaaaataacttctatcaacaaacagaggagatgttgaatgaagttatttaacctggcggcagcgcaaaagatg

SEQ ID NO: 58407 - DNA, 103 bp, Artificial Sequence
  Synthetic Polynucleotide
taatacgactcactatagggggaatatgcggctgttaaaataacttctataacagaggagaatagaaatgattttaacaaacctggcggcagcgcaaaagatg

SEQ ID NO: 58408 - DNA, 103 bp, Artificial Sequence
  Synthetic Polynucleotide
taatacgactcactatagggttagcggaatatgcggctgttaaaataactaacagaggagaagttatatgaacagccgcaacctggcggcagcgcaaaagatg

SEQ ID NO: 58409 - DNA, 103 bp, Artificial Sequence
  Synthetic Polynucleotide
taatacgactcactatagggacggcttagcggaatatgcggctgttaaaaaacagaggagattttaaatgccgcatattaacctggcggcagcgcaaaagatg

SEQ ID NO: 58410 - DNA, 103 bp, Artificial Sequence
  Synthetic Polynucleotide
taatacgactcactataggggttgtacggcttagcggaatatgcggctgtaacagaggagaacagccatgtattccgctaacctggcggcagcgcaaaagatg

SEQ ID NO: 58411 - DNA, 103 bp, Artificial Sequence
  Synthetic Polynucleotide
taatacgactcactatagggttattgttgtacggcttagcggaatatgcgaacagaggagacgcataatgcgctaagccaacctggcggcagcgcaaaagatg

SEQ ID NO: 58412 - DNA, 103 bp, Artificial Sequence
  Synthetic Polynucleotide
taatacgactcactatagggctcccttattgttgtacggcttagcggaataacagaggagaattccgatgagccgtacaaacctggcggcagcgcaaaagatg

SEQ ID NO: 58413 - DNA, 103 bp, Artificial Sequence
  Synthetic Polynucleotide
taatacgactcactataggggttttctcccttattgttgtacggcttagcaacagaggagagctaagatgtacaacaataacctggcggcagcgcaaaagatg

SEQ ID NO: 58414 - DNA, 103 bp, Artificial Sequence
  Synthetic Polynucleotide
taatacgactcactatagggtcaccgccatcgtttttgagcaactatgaaaacagaggagattcataatggctcaaaaaaacctggcggcagcgcaaaagatg

SEQ ID NO: 58415 - DNA, 103 bp, Artificial Sequence
  Synthetic Polynucleotide
taatacgactcactatagggggtcggttttctcccttattgttgtacggcaacagaggagagccgtaatgcaataagggaacctggcggcagcgcaaaagatg

SEQ ID NO: 58416 - DNA, 103 bp, Artificial Sequence
  Synthetic Polynucleotide
taatacgactcactatagggagacaggtcggttttctcccttattgttgtaacagaggagaacaacaatgagggagaaaaacctggcggcagcgcaaaagatg

SEQ ID NO: 58417 - DNA, 103 bp, Artificial Sequence
  Synthetic Polynucleotide
taatacgactcactatagggaaaacagacaggtcggttttctcccttattaacagaggagaaataagatggaaaaccgaaacctggcggcagcgcaaaagatg

SEQ ID NO: 58418 - DNA, 103 bp, Artificial Sequence
  Synthetic Polynucleotide
taatacgactcactatagggctaggaaaacagacaggtcggttttctcccaacagaggagagggagaatgccgacctgtaacctggcggcagcgcaaaagatg

SEQ ID NO: 58419 - DNA, 103 bp, Artificial Sequence
  Synthetic Polynucleotide
taatacgactcactatagggtactactaggaaaacagacaggtcggttttaacagaggagaaaaaccatgctgtctgttaacctggcggcagcgcaaaagatg

SEQ ID NO: 58420 - DNA, 103 bp, Artificial Sequence
  Synthetic Polynucleotide
taatacgactcactatagggttcgttactactaggaaaacagacaggtcgaacagaggagacgacctatgtgttttcctaacctggcggcagcgcaaaagatg

SEQ ID NO: 58421 - DNA, 103 bp, Artificial Sequence
  Synthetic Polynucleotide
taatacgactcactataggggatgtttcgttactactaggaaaacagacaaacagaggagatgtctgatgtcctagtagaacctggcggcagcgcaaaagatg

SEQ ID NO: 58422 - DNA, 103 bp, Artificial Sequence
  Synthetic Polynucleotide
taatacgactcactatagggcgatggatgtttcgttactactaggaaaacaacagaggagagttttcatggtagtaacgaacctggcggcagcgcaaaagatg

SEQ ID NO: 58423 - DNA, 103 bp, Artificial Sequence
  Synthetic Polynucleotide
taatacgactcactatagggtgtatcgatggatgtttcgttactactaggaacagaggagacctagtatgaacgaaacaaacctggcggcagcgcaaaagatg

SEQ ID NO: 58424 - DNA, 103 bp, Artificial Sequence
  Synthetic Polynucleotide
taatacgactcactatagggatatatgtatcgatggatgtttcgttactaaacagaggagatagtaaatgaacatccataacctggcggcagcgcaaaagatg

SEQ ID NO: 58425 - DNA, 103 bp, Artificial Sequence
  Synthetic Polynucleotide
taatacgactcactatagggataagtcaccgccatcgtttttgagcaactaacagaggagaagttgcatgaaaacgatgaacctggcggcagcgcaaaagatg

SEQ ID NO: 58426 - DNA, 103 bp, Artificial Sequence
  Synthetic Polynucleotide
taatacgactcactatagggattgcatatatgtatcgatggatgtttcgtaacagaggagaacgaaaatgccatcgataaacctggcggcagcgcaaaagatg

SEQ ID NO: 58427 - DNA, 103 bp, Artificial Sequence
  Synthetic Polynucleotide
taatacgactcactatagggagcgaattgcatatatgtatcgatggatgtaacagaggagaacatccatggatacatataacctggcggcagcgcaaaagatg

SEQ ID NO: 58428 - DNA, 103 bp, Artificial Sequence
  Synthetic Polynucleotide
taatacgactcactatagggtgtttagcgaattgcatatatgtatcgatgaacagaggagacatcgaatgatatatgcaaacctggcggcagcgcaaaagatg

SEQ ID NO: 58429 - DNA, 103 bp, Artificial Sequence
  Synthetic Polynucleotide
taatacgactcactatagggaacattgtttagcgaattgcatatatgtataacagaggagaatacatatgtgcaattcgaacctggcggcagcgcaaaagatg

SEQ ID NO: 58430 - DNA, 103 bp, Artificial Sequence
  Synthetic Polynucleotide
taatacgactcactatagggctcataacattgtttagcgaattgcatataaacagaggagatatatgatgttcgctaaaaacctggcggcagcgcaaaagatg

SEQ ID NO: 58431 - DNA, 103 bp, Artificial Sequence
  Synthetic Polynucleotide
taatacgactcactatagggaaatgctcataacattgtttagcgaattgcaacagaggagagcaattatgtaaacaatgaacctggcggcagcgcaaaagatg

SEQ ID NO: 58432 - DNA, 103 bp, Artificial Sequence
  Synthetic Polynucleotide
taatacgactcactataggggatttaaatgctcataacattgtttagcgaaacagaggagatcgctaatgaatgttatgaacctggcggcagcgcaaaagatg

SEQ ID NO: 58433 - DNA, 103 bp, Artificial Sequence
  Synthetic Polynucleotide
taatacgactcactatagggtttcggatttaaatgctcataacattgtttaacagaggagaaaacaaatgtatgagcataacctggcggcagcgcaaaagatg

SEQ ID NO: 58434 - DNA, 103 bp, Artificial Sequence
  Synthetic Polynucleotide
taatacgactcactataggggtcaatttcggatttaaatgctcataacataacagaggagaatgttaatggcatttaaaaacctggcggcagcgcaaaagatg

SEQ ID NO: 58435 - DNA, 103 bp, Artificial Sequence
  Synthetic Polynucleotide
taatacgactcactatagggtctcggtcaatttcggatttaaatgctcataacagaggagaatgagcatgtaaatccgaaacctggcggcagcgcaaaagatg

SEQ ID NO: 58436 - DNA, 103 bp, Artificial Sequence
  Synthetic Polynucleotide
taatacgactcactataggggactcataagtcaccgccatcgtttttgagaacagaggagactcaaaatggatggcggtaacctggcggcagcgcaaaagatg

SEQ ID NO: 58437 - DNA, 103 bp, Artificial Sequence
  Synthetic Polynucleotide
taatacgactcactatagggttctttctcggtcaatttcggatttaaatgaacagaggagacatttaatgccgaaattgaacctggcggcagcgcaaaagatg

SEQ ID NO: 58438 - DNA, 103 bp, Artificial Sequence
  Synthetic Polynucleotide
taatacgactcactataggggataattctttctcggtcaatttcggatttaacagaggagaaaatccatgattgaccgaaacctggcggcagcgcaaaagatg

SEQ ID NO: 58439 - DNA, 103 bp, Artificial Sequence
  Synthetic Polynucleotide
taatacgactcactatagggtatccgataattctttctcggtcaatttcgaacagaggagacgaaatatgccgagaaagaacctggcggcagcgcaaaagatg

SEQ ID NO: 58440 - DNA, 103 bp, Artificial Sequence
  Synthetic Polynucleotide
taatacgactcactataggggattttatccgataattctttctcggtcaaaacagaggagattgaccatgaaagaattaaacctggcggcagcgcaaaagatg

SEQ ID NO: 58441 - DNA, 103 bp, Artificial Sequence
  Synthetic Polynucleotide
taatacgactcactatagggcaaaagattttatccgataattctttctcgaacagaggagacgagaaatgattatcggaaacctggcggcagcgcaaaagatg

SEQ ID NO: 58442 - DNA, 103 bp, Artificial Sequence
  Synthetic Polynucleotide
taatacgactcactatagggtttcacaaaagattttatccgataattcttaacagaggagaaagaatatgcggataaaaaacctggcggcagcgcaaaagatg

SEQ ID NO: 58443 - DNA, 103 bp, Artificial Sequence
  Synthetic Polynucleotide
taatacgactcactatagggaatcttttcacaaaagattttatccgataaaacagaggagattatcgatgaaaatctttaacctggcggcagcgcaaaagatg

SEQ ID NO: 58444 - DNA, 103 bp, Artificial Sequence
  Synthetic Polynucleotide
taatacgactcactatagggtaaagaatcttttcacaaaagattttatccaacagaggagaggataaatgcttttgtgaaacctggcggcagcgcaaaagatg

SEQ ID NO: 58445 - DNA, 103 bp, Artificial Sequence
  Synthetic Polynucleotide
taatacgactcactataggggatcataaagaatcttttcacaaaagatttaacagaggagaaaatctatggtgaaaagaaacctggcggcagcgcaaaagatg

SEQ ID NO: 58446 - DNA, 103 bp, Artificial Sequence
  Synthetic Polynucleotide
taatacgactcactatagggttcaggatcataaagaatcttttcacaaaaaacagaggagattttgtatgaagattcttaacctggcggcagcgcaaaagatg

SEQ ID NO: 58447 - DNA, 103 bp, Artificial Sequence
  Synthetic Polynucleotide
taatacgactcactatagggaacgtgactcataagtcaccgccatcgtttaacagaggagaaaacgaatgcggtgacttaacctggcggcagcgcaaaagatg

SEQ ID NO: 58448 - DNA, 103 bp, Artificial Sequence
  Synthetic Polynucleotide
taatacgactcactatagggtccgtttcaggatcataaagaatcttttcaaacagaggagatgaaaaatgtctttatgaaacctggcggcagcgcaaaagatg

SEQ ID NO: 58449 - DNA, 103 bp, Artificial Sequence
  Synthetic Polynucleotide
taatacgactcactataggggcttatccgtttcaggatcataaagaatctaacagaggagaagattcatgatgatcctgaacctggcggcagcgcaaaagatg

SEQ ID NO: 58450 - DNA, 103 bp, Artificial Sequence
  Synthetic Polynucleotide
taatacgactcactatagggataaggcttatccgtttcaggatcataaagaacagaggagactttatatgcctgaaacgaacctggcggcagcgcaaaagatg

SEQ ID NO: 58451 - DNA, 103 bp, Artificial Sequence
  Synthetic Polynucleotide
taatacgactcactataggggatgcataaggcttatccgtttcaggatcaaacagaggagatgatccatgaacggataaaacctggcggcagcgcaaaagatg

SEQ ID NO: 58452 - DNA, 103 bp, Artificial Sequence
  Synthetic Polynucleotide
taatacgactcactatagggctttggatgcataaggcttatccgtttcagaacagaggagactgaaaatgataagccttaacctggcggcagcgcaaaagatg

SEQ ID NO: 58453 - DNA, 103 bp, Artificial Sequence
  Synthetic Polynucleotide
taatacgactcactatagggaaatactttggatgcataaggcttatccgtaacagaggagaacggatatgccttatgcaaacctggcggcagcgcaaaagatg

SEQ ID NO: 58454 - DNA, 103 bp, Artificial Sequence
  Synthetic Polynucleotide
taatacgactcactatagggccaaaaaatactttggatgcataaggcttaaacagaggagataagccatgtgcatccaaaacctggcggcagcgcaaaagatg

SEQ ID NO: 58455 - DNA, 103 bp, Artificial Sequence
  Synthetic Polynucleotide
taatacgactcactatagggttggtccaaaaaatactttggatgcataagaacagaggagacttatgatgccaaagtataacctggcggcagcgcaaaagatg

SEQ ID NO: 58456 - DNA, 103 bp, Artificial Sequence
  Synthetic Polynucleotide
taatacgactcactatagggataaattggtccaaaaaatactttggatgcaacagaggagagcatccatggtattttttaacctggcggcagcgcaaaagatg

SEQ ID NO: 58457 - DNA, 103 bp, Artificial Sequence
  Synthetic Polynucleotide
taatacgactcactatagggaagtaataaattggtccaaaaaatactttgaacagaggagacaaagtatgttttggaccaacctggcggcagcgcaaaagatg

SEQ ID NO: 58458 - DNA, 103 bp, Artificial Sequence
  Synthetic Polynucleotide
taatacgactcactatagggactagagattgaaacgtgttataacttatcaacagaggagagataagatgtaacacgttaacctggcggcagcgcaaaagatg

SEQ ID NO: 58459 - DNA, 103 bp, Artificial Sequence
  Synthetic Polynucleotide
taatacgactcactatagggagggagagtgacagtgacagtgatgtagataacagaggagaatctacatgactgtcactaacctggcggcagcgcaaaagatg

SEQ ID NO: 58460 - DNA, 103 bp, Artificial Sequence
  Synthetic Polynucleotide
taatacgactcactatagggagtgtaacgtgactcataagtcaccgccataacagaggagaatggcgatgacttatgagaacctggcggcagcgcaaaagatg

SEQ ID NO: 58461 - DNA, 103 bp, Artificial Sequence
  Synthetic Polynucleotide
taatacgactcactataggggacgcaagtaataaattggtccaaaaaataaacagaggagatattttatggaccaatttaacctggcggcagcgcaaaagatg

SEQ ID NO: 58462 - DNA, 103 bp, Artificial Sequence
  Synthetic Polynucleotide
taatacgactcactatagggtctcagacgcaagtaataaattggtccaaaaacagaggagatttggaatgatttattacaacctggcggcagcgcaaaagatg

SEQ ID NO: 58463 - DNA, 103 bp, Artificial Sequence
  Synthetic Polynucleotide
taatacgactcactatagggaaatgtctcagacgcaagtaataaattggtaacagaggagaaccaatatgttacttgcgaacctggcggcagcgcaaaagatg

SEQ ID NO: 58464 - DNA, 103 bp, Artificial Sequence
  Synthetic Polynucleotide
taatacgactcactataggggagttaaatgtctcagacgcaagtaataaaaacagaggagatttattatgtgcgtctgaaacctggcggcagcgcaaaagatg

SEQ ID NO: 58465 - DNA, 103 bp, Artificial Sequence
  Synthetic Polynucleotide
taatacgactcactataggggtcctgagttaaatgtctcagacgcaagtaaacagaggagatacttgatgctgagacataacctggcggcagcgcaaaagatg

SEQ ID NO: 58466 - DNA, 103 bp, Artificial Sequence
  Synthetic Polynucleotide
taatacgactcactataggggccttgtcctgagttaaatgtctcagacgcaacagaggagagcgtctatgacatttaacaacctggcggcagcgcaaaagatg

SEQ ID NO: 58467 - DNA, 103 bp, Artificial Sequence
  Synthetic Polynucleotide
taatacgactcactatagggcggttgccttgtcctgagttaaatgtctcaaacagaggagatgagacatgtaactcaggaacctggcggcagcgcaaaagatg

SEQ ID NO: 58468 - DNA, 103 bp, Artificial Sequence
  Synthetic Polynucleotide
taatacgactcactatagggtctaacggttgccttgtcctgagttaaatgaacagaggagacatttaatgcaggacaagaacctggcggcagcgcaaaagatg

SEQ ID NO: 58469 - DNA, 103 bp, Artificial Sequence
  Synthetic Polynucleotide
taatacgactcactatagggctacatctaacggttgccttgtcctgagttaacagaggagaaactcaatgcaaggcaacaacctggcggcagcgcaaaagatg

SEQ ID NO: 58470 - DNA, 103 bp, Artificial Sequence
  Synthetic Polynucleotide
taatacgactcactatagggtacctctacatctaacggttgccttgtcctaacagaggagaaggacaatgcaaccgttaaacctggcggcagcgcaaaagatg

SEQ ID NO: 58471 - DNA, 103 bp, Artificial Sequence
  Synthetic Polynucleotide
taatacgactcactatagggtccaaagtgtaacgtgactcataagtcaccaacagaggagaggtgacatgtgagtcacgaacctggcggcagcgcaaaagatg

SEQ ID NO: 58472 - DNA, 103 bp, Artificial Sequence
  Synthetic Polynucleotide
taatacgactcactatagggctttttacctctacatctaacggttgccttaacagaggagaaaggcaatggttagatgtaacctggcggcagcgcaaaagatg

SEQ ID NO: 58473 - DNA, 103 bp, Artificial Sequence
  Synthetic Polynucleotide
taatacgactcactatagggttcgtctttttacctctacatctaacggttaacagaggagaaaccgtatgatgtagaggaacctggcggcagcgcaaaagatg

SEQ ID NO: 58474 - DNA, 103 bp, Artificial Sequence
  Synthetic Polynucleotide
taatacgactcactatagggttagcttcgtctttttacctctacatctaaaacagaggagattagatatggaggtaaaaaacctggcggcagcgcaaaagatg

SEQ ID NO: 58475 - DNA, 103 bp, Artificial Sequence
  Synthetic Polynucleotide
taatacgactcactatagggtctaattagcttcgtctttttacctctacaaacagaggagatgtagaatgaaaaagacgaacctggcggcagcgcaaaagatg

SEQ ID NO: 58476 - DNA, 103 bp, Artificial Sequence
  Synthetic Polynucleotide
taatacgactcactataggggcttgtctaattagcttcgtctttttacctaacagaggagaaggtaaatggacgaagctaacctggcggcagcgcaaaagatg

SEQ ID NO: 58477 - DNA, 103 bp, Artificial Sequence
  Synthetic Polynucleotide
taatacgactcactatagggcattcgcttgtctaattagcttcgtcttttaacagaggagaaaaagaatgagctaattaaacctggcggcagcgcaaaagatg

SEQ ID NO: 58478 - DNA, 103 bp, Artificial Sequence
  Synthetic Polynucleotide
taatacgactcactatagggtccctcattcgcttgtctaattagcttcgtaacagaggagaacgaagatgattagacaaaacctggcggcagcgcaaaagatg

SEQ ID NO: 58479 - DNA, 103 bp, Artificial Sequence
  Synthetic Polynucleotide
taatacgactcactatagggtttcgtccctcattcgcttgtctaattagcaacagaggagagctaatatgacaagcgaaaacctggcggcagcgcaaaagatg

SEQ ID NO: 58480 - DNA, 103 bp, Artificial Sequence
  Synthetic Polynucleotide
taatacgactcactatagggcacgttttcgtccctcattcgcttgtctaaaacagaggagattagacatgcgaatgaggaacctggcggcagcgcaaaagatg

SEQ ID NO: 58481 - DNA, 103 bp, Artificial Sequence
  Synthetic Polynucleotide
taatacgactcactatagggtcctccacgttttcgtccctcattcgcttgaacagaggagacaagcgatggagggacgaaacctggcggcagcgcaaaagatg

SEQ ID NO: 58482 - DNA, 103 bp, Artificial Sequence
  Synthetic Polynucleotide
taatacgactcactataggggagactccaaagtgtaacgtgactcataagaacagaggagacttatgatgcacgttacaaacctggcggcagcgcaaaagatg

SEQ ID NO: 58483 - DNA, 103 bp, Artificial Sequence
  Synthetic Polynucleotide
taatacgactcactatagggatacctcctccacgttttcgtccctcattcaacagaggagagaatgaatgacgaaaacgaacctggcggcagcgcaaaagatg

SEQ ID NO: 58484 - DNA, 103 bp, Artificial Sequence
  Synthetic Polynucleotide
taatacgactcactatagggacttgatacctcctccacgttttcgtccctaacagaggagaagggacatgaacgtggagaacctggcggcagcgcaaaagatg

SEQ ID NO: 58485 - DNA, 103 bp, Artificial Sequence
  Synthetic Polynucleotide
taatacgactcactatagggtccaaacttgatacctcctccacgttttcgaacagaggagacgaaaaatgggaggaggtaacctggcggcagcgcaaaagatg

SEQ ID NO: 58486 - DNA, 103 bp, Artificial Sequence
  Synthetic Polynucleotide
taatacgactcactatagggatttctccaaacttgatacctcctccacgtaacagaggagaacgtggatgaggtatcaaaacctggcggcagcgcaaaagatg

SEQ ID NO: 58487 - DNA, 103 bp, Artificial Sequence
  Synthetic Polynucleotide
taatacgactcactatagggtctccatttctccaaacttgatacctcctcaacagaggagagaggagatgtcaagtttgaacctggcggcagcgcaaaagatg

SEQ ID NO: 58488 - DNA, 103 bp, Artificial Sequence
  Synthetic Polynucleotide
taatacgactcactataggggtctctctccatttctccaaacttgataccaacagaggagaggtatcatgtttggagaaaacctggcggcagcgcaaaagatg

SEQ ID NO: 58489 - DNA, 103 bp, Artificial Sequence
  Synthetic Polynucleotide
taatacgactcactatagggaaacagtctctctccatttctccaaacttgaacagaggagacaagttatgagaaatggaaacctggcggcagcgcaaaagatg

SEQ ID NO: 58490 - DNA, 103 bp, Artificial Sequence
  Synthetic Polynucleotide
taatacgactcactatagggctattaaacagtctctctccatttctccaaaacagaggagattggagatgtggagagagaacctggcggcagcgcaaaagatg

SEQ ID NO: 58491 - DNA, 103 bp, Artificial Sequence
  Synthetic Polynucleotide
taatacgactcactatagggatgcgctattaaacagtctctctccatttcaacagaggagagaaatgatgagagactgtaacctggcggcagcgcaaaagatg

SEQ ID NO: 58492 - DNA, 103 bp, Artificial Sequence
  Synthetic Polynucleotide
taatacgactcactataggggcgccatgcgctattaaacagtctctctccaacagaggagaggagagatgctgtttaataacctggcggcagcgcaaaagatg

SEQ ID NO: 58493 - DNA, 103 bp, Artificial Sequence
  Synthetic Polynucleotide
taatacgactcactatagggaagatgagactccaaagtgtaacgtgactcaacagaggagagagtcaatgtacactttgaacctggcggcagcgcaaaagatg

SEQ ID NO: 58494 - DNA, 103 bp, Artificial Sequence
  Synthetic Polynucleotide
taatacgactcactatagggtggctgcgccatgcgctattaaacagtctcaacagaggagagagactatgtaatagcgcaacctggcggcagcgcaaaagatg

SEQ ID NO: 58495 - DNA, 103 bp, Artificial Sequence
  Synthetic Polynucleotide
taatacgactcactatagggagtattggctgcgccatgcgctattaaacaaacagaggagatgtttaatggcgcatggcaacctggcggcagcgcaaaagatg

SEQ ID NO: 58496 - DNA, 103 bp, Artificial Sequence
  Synthetic Polynucleotide
taatacgactcactataggggtaatagtattggctgcgccatgcgctattaacagaggagaaatagcatgtggcgcagcaacctggcggcagcgcaaaagatg

SEQ ID NO: 58497 - DNA, 103 bp, Artificial Sequence
  Synthetic Polynucleotide
taatacgactcactatagggcttctgtaatagtattggctgcgccatgcgaacagaggagacgcatgatgcagccaataaacctggcggcagcgcaaaagatg

SEQ ID NO: 58498 - DNA, 103 bp, Artificial Sequence
  Synthetic Polynucleotide
taatacgactcactatagggtaaaacttctgtaatagtattggctgcgccaacagaggagaggcgcaatgaatactattaacctggcggcagcgcaaaagatg

SEQ ID NO: 58499 - DNA, 103 bp, Artificial Sequence
  Synthetic Polynucleotide
taatacgactcactatagggtcttttaaaacttctgtaatagtattggctaacagaggagaagccaaatgtattacagaaacctggcggcagcgcaaaagatg

SEQ ID NO: 58500 - DNA, 103 bp, Artificial Sequence
  Synthetic Polynucleotide
taatacgactcactatagggctgagtcttttaaaacttctgtaatagtataacagaggagaatactaatgcagaagtttaacctggcggcagcgcaaaagatg

SEQ ID NO: 58501 - DNA, 103 bp, Artificial Sequence
  Synthetic Polynucleotide
taatacgactcactatagggctcttctgagtcttttaaaacttctgtaataacagaggagaattacaatggttttaaaaaacctggcggcagcgcaaaagatg

SEQ ID NO: 58502 - DNA, 103 bp, Artificial Sequence
  Synthetic Polynucleotide
taatacgactcactatagggtaatcctcttctgagtcttttaaaacttctaacagaggagaagaagtatgaaaagactcaacctggcggcagcgcaaaagatg

SEQ ID NO: 58503 - DNA, 103 bp, Artificial Sequence
  Synthetic Polynucleotide
taatacgactcactatagggcttgataatcctcttctgagtcttttaaaaaacagaggagattttaaatgactcagaagaacctggcggcagcgcaaaagatg

SEQ ID NO: 58504 - DNA, 103 bp, Artificial Sequence
  Synthetic Polynucleotide
taatacgactcactatagggtactaaagatgagactccaaagtgtaacgtaacagaggagaacgttaatgtttggagtcaacctggcggcagcgcaaaagatg

SEQ ID NO: 58505 - DNA, 103 bp, Artificial Sequence
  Synthetic Polynucleotide
taatacgactcactatagggcacatcttgataatcctcttctgagtctttaacagaggagaaaagacatggaagaggataacctggcggcagcgcaaaagatg

SEQ ID NO: 58506 - DNA, 103 bp, Artificial Sequence
  Synthetic Polynucleotide
taatacgactcactatagggatatacacatcttgataatcctcttctgagaacagaggagactcagaatgggattatcaaacctggcggcagcgcaaaagatg

SEQ ID NO: 58507 - DNA, 103 bp, Artificial Sequence
  Synthetic Polynucleotide
taatacgactcactatagggcacaaatatacacatcttgataatcctcttaacagaggagaaagaggatgatcaagatgaacctggcggcagcgcaaaagatg

SEQ ID NO: 58508 - DNA, 103 bp, Artificial Sequence
  Synthetic Polynucleotide
taatacgactcactatagggattttcacaaatatacacatcttgataatcaacagaggagagattatatggatgtgtataacctggcggcagcgcaaaagatg

SEQ ID NO: 58509 - DNA, 103 bp, Artificial Sequence
  Synthetic Polynucleotide
taatacgactcactatagggccacaattttcacaaatatacacatcttgaaacagaggagatcaagaatggtatatttgaacctggcggcagcgcaaaagatg

SEQ ID NO: 58510 - DNA, 103 bp, Artificial Sequence
  Synthetic Polynucleotide
taatacgactcactatagggtgtctccacaattttcacaaatatacacataacagaggagaatgtgtatgtttgtgaaaaacctggcggcagcgcaaaagatg

SEQ ID NO: 58511 - DNA, 103 bp, Artificial Sequence
  Synthetic Polynucleotide
taatacgactcactatagggtgctatgtctccacaattttcacaaatataaacagaggagatatattatggaaaattgtaacctggcggcagcgcaaaagatg

SEQ ID NO: 58512 - DNA, 103 bp, Artificial Sequence
  Synthetic Polynucleotide
taatacgactcactatagggtgtgctgctatgtctccacaattttcacaaaacagaggagattgtgaatgttgtggagaaacctggcggcagcgcaaaagatg

SEQ ID NO: 58513 - DNA, 103 bp, Artificial Sequence
  Synthetic Polynucleotide
taatacgactcactatagggtgatttgtgctgctatgtctccacaattttaacagaggagaaaaattatggagacatagaacctggcggcagcgcaaaagatg

SEQ ID NO: 58514 - DNA, 103 bp, Artificial Sequence
  Synthetic Polynucleotide
taatacgactcactatagggacttttgatttgtgctgctatgtctccacaaacagaggagatgtggaatgatagcagcaaacctggcggcagcgcaaaagatg

SEQ ID NO: 58515 - DNA, 103 bp, Artificial Sequence
  Synthetic Polynucleotide
taatacgactcactatagggatgtttactaaagatgagactccaaagtgtaacagaggagaacacttatgagtctcatcaacctggcggcagcgcaaaagatg

SEQ ID NO: 58516 - DNA, 103 bp, Artificial Sequence
  Synthetic Polynucleotide
taatacgactcactatagggttaatacttttgatttgtgctgctatgtctaacagaggagaagacatatgagcacaaataacctggcggcagcgcaaaagatg

SEQ ID NO: 58517 - DNA, 103 bp, Artificial Sequence
  Synthetic Polynucleotide
taatacgactcactatagggatgtattaatacttttgatttgtgctgctaaacagaggagatagcagatgaaatcaaaaaacctggcggcagcgcaaaagatg

SEQ ID NO: 58518 - DNA, 103 bp, Artificial Sequence
  Synthetic Polynucleotide
taatacgactcactatagggaagacatgtattaatacttttgatttgtgcaacagaggagagcacaaatgaaaagtattaacctggcggcagcgcaaaagatg

SEQ ID NO: 58519 - DNA, 103 bp, Artificial Sequence
  Synthetic Polynucleotide
taatacgactcactatagggcatctaagacatgtattaatacttttgattaacagaggagaaatcaaatgtattaatacaacctggcggcagcgcaaaagatg

SEQ ID NO: 58520 - DNA, 103 bp, Artificial Sequence
  Synthetic Polynucleotide
taatacgactcactatagggttgaacatctaagacatgtattaatactttaacagaggagaaaagtaatgatacatgtcaacctggcggcagcgcaaaagatg

SEQ ID NO: 58521 - DNA, 103 bp, Artificial Sequence
  Synthetic Polynucleotide
taatacgactcactatagggaagttttgaacatctaagacatgtattaataacagaggagaattaatatgtgtcttagaaacctggcggcagcgcaaaagatg

SEQ ID NO: 58522 - DNA, 103 bp, Artificial Sequence
  Synthetic Polynucleotide
taatacgactcactatagggagattaagttttgaacatctaagacatgtaaacagaggagatacatgatgtagatgttcaacctggcggcagcgcaaaagatg

SEQ ID NO: 58523 - DNA, 103 bp, Artificial Sequence
  Synthetic Polynucleotide
taatacgactcactataggggagagagattaagttttgaacatctaagacaacagaggagagtcttaatggttcaaaacaacctggcggcagcgcaaaagatg

SEQ ID NO: 58524 - DNA, 103 bp, Artificial Sequence
  Synthetic Polynucleotide
taatacgactcactataggggagaggagagagattaagttttgaacatctaacagaggagaagatgtatgaaacttaataacctggcggcagcgcaaaagatg

SEQ ID NO: 58525 - DNA, 103 bp, Artificial Sequence
  Synthetic Polynucleotide
taatacgactcactataggggttaagagaggagagagattaagttttgaaaacagaggagattcaaaatgtaatctctcaacctggcggcagcgcaaaagatg

SEQ ID NO: 58526 - DNA, 103 bp, Artificial Sequence
  Synthetic Polynucleotide
taatacgactcactatagggatgatatgtttactaaagatgagactccaaaacagaggagattggagatgcatctttagaacctggcggcagcgcaaaagatg

SEQ ID NO: 58527 - DNA, 103 bp, Artificial Sequence
  Synthetic Polynucleotide
taatacgactcactatagggtttttgttaagagaggagagagattaagttaacagaggagaaacttaatgtctctcctcaacctggcggcagcgcaaaagatg

SEQ ID NO: 58528 - DNA, 103 bp, Artificial Sequence
  Synthetic Polynucleotide
taatacgactcactatagggatcaatttttgttaagagaggagagagattaacagaggagaaatctcatgcctctcttaaacctggcggcagcgcaaaagatg

SEQ ID NO: 58529 - DNA, 103 bp, Artificial Sequence
  Synthetic Polynucleotide
taatacgactcactataggggtggtatcaatttttgttaagagaggagagaacagaggagactctccatgcttaacaaaaacctggcggcagcgcaaaagatg

SEQ ID NO: 58530 - DNA, 103 bp, Artificial Sequence
  Synthetic Polynucleotide
taatacgactcactatagggcgtgcgtggtatcaatttttgttaagagagaacagaggagactctctatgcaaaaattgaacctggcggcagcgcaaaagatg

SEQ ID NO: 58531 - DNA, 103 bp, Artificial Sequence
  Synthetic Polynucleotide
taatacgactcactatagggagatacgtgcgtggtatcaatttttgttaaaacagaggagattaacaatgattgataccaacctggcggcagcgcaaaagatg

SEQ ID NO: 58532 - DNA, 103 bp, Artificial Sequence
  Synthetic Polynucleotide
taatacgactcactatagggactttagatacgtgcgtggtatcaatttttaacagaggagaaaaaatatgtaccacgcaaacctggcggcagcgcaaaagatg

SEQ ID NO: 58533 - DNA, 103 bp, Artificial Sequence
  Synthetic Polynucleotide
taatacgactcactataggggaaatactttagatacgtgcgtggtatcaaaacagaggagattgataatgcgcacgtataacctggcggcagcgcaaaagatg

SEQ ID NO: 58534 - DNA, 103 bp, Artificial Sequence
  Synthetic Polynucleotide
taatacgactcactatagggagtaagaaatactttagatacgtgcgtggtaacagaggagaaccacgatggtatctaaaaacctggcggcagcgcaaaagatg

SEQ ID NO: 58535 - DNA, 103 bp, Artificial Sequence
  Synthetic Polynucleotide
taatacgactcactatagggatttgagtaagaaatactttagatacgtgcaacagaggagagcacgtatgtaaagtattaacctggcggcagcgcaaaagatg

SEQ ID NO: 58536 - DNA, 103 bp, Artificial Sequence
  Synthetic Polynucleotide
taatacgactcactatagggcgttcatttgagtaagaaatactttagataaacagaggagatatctaatgtatttcttaaacctggcggcagcgcaaaagatg

SEQ ID NO: 58537 - DNA, 103 bp, Artificial Sequence
  Synthetic Polynucleotide
taatacgactcactatagggatattatgatatgtttactaaagatgagacaacagaggagagtctcaatgttagtaaacaacctggcggcagcgcaaaagatg

SEQ ID NO: 58538 - DNA, 103 bp, Artificial Sequence
  Synthetic Polynucleotide
taatacgactcactatagggtctggcgttcatttgagtaagaaatactttaacagaggagaaaagtaatgcttactcaaaacctggcggcagcgcaaaagatg

SEQ ID NO: 58539 - DNA, 103 bp, Artificial Sequence
  Synthetic Polynucleotide
taatacgactcactatagggacgcctctggcgttcatttgagtaagaaataacagaggagaatttctatgtcaaatgaaaacctggcggcagcgcaaaagatg

SEQ ID NO: 58540 - DNA, 103 bp, Artificial Sequence
  Synthetic Polynucleotide
taatacgactcactatagggcttttacgcctctggcgttcatttgagtaaaacagaggagattactcatgtgaacgccaaacctggcggcagcgcaaaagatg

SEQ ID NO: 58541 - DNA, 103 bp, Artificial Sequence
  Synthetic Polynucleotide
taatacgactcactatagggtttgacttttacgcctctggcgttcatttgaacagaggagacaaatgatggccagaggcaacctggcggcagcgcaaaagatg

SEQ ID NO: 58542 - DNA, 103 bp, Artificial Sequence
  Synthetic Polynucleotide
taatacgactcactatagggtctaatttgacttttacgcctctggcgttcaacagaggagagaacgcatgaggcgtaaaaacctggcggcagcgcaaaagatg

SEQ ID NO: 58543 - DNA, 103 bp, Artificial Sequence
  Synthetic Polynucleotide
taatacgactcactatagggcgaaatctaatttgacttttacgcctctggaacagaggagaccagagatgtaaaagtcaaacctggcggcagcgcaaaagatg

SEQ ID NO: 58544 - DNA, 103 bp, Artificial Sequence
  Synthetic Polynucleotide
taatacgactcactatagggtcgttcgaaatctaatttgacttttacgccaacagaggagaggcgtaatggtcaaattaaacctggcggcagcgcaaaagatg

SEQ ID NO: 58545 - DNA, 103 bp, Artificial Sequence
  Synthetic Polynucleotide
taatacgactcactatagggggtcttcgttcgaaatctaatttgacttttaacagaggagaaaaagtatgattagatttaacctggcggcagcgcaaaagatg

SEQ ID NO: 58546 - DNA, 103 bp, Artificial Sequence
  Synthetic Polynucleotide
taatacgactcactatagggaaggaggtcttcgttcgaaatctaatttgaaacagaggagatcaaatatgatttcgaacaacctggcggcagcgcaaaagatg

SEQ ID NO: 58547 - DNA, 103 bp, Artificial Sequence
  Synthetic Polynucleotide
taatacgactcactatagggaaacgaaggaggtcttcgttcgaaatctaaaacagaggagattagatatggaacgaagaaacctggcggcagcgcaaaagatg

SEQ ID NO: 58548 - DNA, 103 bp, Artificial Sequence
  Synthetic Polynucleotide
taatacgactcactatagggatcgaatattatgatatgtttactaaagataacagaggagaatctttatgaaacatatcaacctggcggcagcgcaaaagatg

SEQ ID NO: 58549 - DNA, 103 bp, Artificial Sequence
  Synthetic Polynucleotide
taatacgactcactatagggttataaaacgaaggaggtcttcgttcgaaaaacagaggagatttcgaatgaagacctccaacctggcggcagcgcaaaagatg

SEQ ID NO: 58550 - DNA, 103 bp, Artificial Sequence
  Synthetic Polynucleotide
taatacgactcactatagggatggtttataaaacgaaggaggtcttcgttaacagaggagaaacgaaatgctccttcgtaacctggcggcagcgcaaaagatg

SEQ ID NO: 58551 - DNA, 103 bp, Artificial Sequence
  Synthetic Polynucleotide
taatacgactcactatagggatctaatggtttataaaacgaaggaggtctaacagaggagaagacctatgtcgttttataacctggcggcagcgcaaaagatg

SEQ ID NO: 58552 - DNA, 103 bp, Artificial Sequence
  Synthetic Polynucleotide
taatacgactcactatagggactttatctaatggtttataaaacgaaggaaacagaggagatccttcatgttataaaccaacctggcggcagcgcaaaagatg

SEQ ID NO: 58553 - DNA, 103 bp, Artificial Sequence
  Synthetic Polynucleotide
taatacgactcactataggggatcaactttatctaatggtttataaaacgaacagaggagacgttttatgaaccattagaacctggcggcagcgcaaaagatg

SEQ ID NO: 58554 - DNA, 103 bp, Artificial Sequence
  Synthetic Polynucleotide
taatacgactcactatagggcttgagatcaactttatctaatggtttataaacagaggagatataaaatgttagataaaaacctggcggcagcgcaaaagatg

SEQ ID NO: 58555 - DNA, 103 bp, Artificial Sequence
  Synthetic Polynucleotide
taatacgactcactataggggacggcttgagatcaactttatctaatggtaacagaggagaaccattatgtaaagttgaaacctggcggcagcgcaaaagatg

SEQ ID NO: 58556 - DNA, 103 bp, Artificial Sequence
  Synthetic Polynucleotide
taatacgactcactataggggaaaagacggcttgagatcaactttatctaaacagaggagatagataatgttgatctcaaacctggcggcagcgcaaaagatg

SEQ ID NO: 58557 - DNA, 103 bp, Artificial Sequence
  Synthetic Polynucleotide
taatacgactcactatagggcttcagaaaagacggcttgagatcaactttaacagaggagaaaagttatgctcaagccgaacctggcggcagcgcaaaagatg

SEQ ID NO: 58558 - DNA, 103 bp, Artificial Sequence
  Synthetic Polynucleotide
taatacgactcactatagggacctacttcagaaaagacggcttgagatcaaacagaggagatgatctatggccgtctttaacctggcggcagcgcaaaagatg

SEQ ID NO: 58559 - DNA, 103 bp, Artificial Sequence
  Synthetic Polynucleotide
taatacgactcactataggggtaatatcgaatattatgatatgtttactaaacagaggagatagtaaatgtatcataataacctggcggcagcgcaaaagatg

SEQ ID NO: 58560 - DNA, 103 bp, Artificial Sequence
  Synthetic Polynucleotide
taatacgactcactatagggaagaaacctacttcagaaaagacggcttgaaacagaggagatcaagcatgcttttctgaaacctggcggcagcgcaaaagatg

SEQ ID NO: 58561 - DNA, 103 bp, Artificial Sequence
  Synthetic Polynucleotide
taatacgactcactatagggtaaataagaaacctacttcagaaaagacggaacagaggagaccgtctatgctgaagtagaacctggcggcagcgcaaaagatg

SEQ ID NO: 58562 - DNA, 103 bp, Artificial Sequence
  Synthetic Polynucleotide
taatacgactcactatagggactactaaataagaaacctacttcagaaaaaacagaggagattttctatggtaggtttcaacctggcggcagcgcaaaagatg

SEQ ID NO: 58563 - DNA, 103 bp, Artificial Sequence
  Synthetic Polynucleotide
taatacgactcactatagggcaacaactactaaataagaaacctacttcaaacagaggagatgaagtatgtttcttattaacctggcggcagcgcaaaagatg

SEQ ID NO: 58564 - DNA, 103 bp, Artificial Sequence
  Synthetic Polynucleotide
taatacgactcactatagggatctacaacaactactaaataagaaacctaaacagaggagataggttatgtatttagtaaacctggcggcagcgcaaaagatg

SEQ ID NO: 58565 - DNA, 103 bp, Artificial Sequence
  Synthetic Polynucleotide
taatacgactcactatagggcgattatctacaacaactactaaataagaaaacagaggagattcttaatgagtagttgtaacctggcggcagcgcaaaagatg

SEQ ID NO: 58566 - DNA, 103 bp, Artificial Sequence
  Synthetic Polynucleotide
taatacgactcactatagggattaacgattatctacaacaactactaaataacagaggagaatttagatgttgttgtagaacctggcggcagcgcaaaagatg

SEQ ID NO: 58567 - DNA, 103 bp, Artificial Sequence
  Synthetic Polynucleotide
taatacgactcactatagggataatattaacgattatctacaacaactacaacagaggagagtagttatggtagataataacctggcggcagcgcaaaagatg

SEQ ID NO: 58568 - DNA, 103 bp, Artificial Sequence
  Synthetic Polynucleotide
taatacgactcactatagggtcttgataatattaacgattatctacaacaaacagaggagatgttgtatgtaatcgttaaacctggcggcagcgcaaaagatg

SEQ ID NO: 58569 - DNA, 103 bp, Artificial Sequence
  Synthetic Polynucleotide
taatacgactcactataggggattatcttgataatattaacgattatctaaacagaggagatagataatggttaatattaacctggcggcagcgcaaaagatg

SEQ ID NO: 58570 - DNA, 103 bp, Artificial Sequence
  Synthetic Polynucleotide
taatacgactcactataggggatatagggagagtgacagtgacagtgatgaacagaggagacatcacatgcactgtcacaacctggcggcagcgcaaaagatg

SEQ ID NO: 58571 - DNA, 103 bp, Artificial Sequence
  Synthetic Polynucleotide
taatacgactcactatagggaactcgtaatatcgaatattatgatatgttaacagaggagaaacataatgtaatattcgaacctggcggcagcgcaaaagatg

SEQ ID NO: 58572 - DNA, 103 bp, Artificial Sequence
  Synthetic Polynucleotide
taatacgactcactatagggatttggattatcttgataatattaacgattaacagaggagaaatcgtatgtattatcaaaacctggcggcagcgcaaaagatg

SEQ ID NO: 58573 - DNA, 103 bp, Artificial Sequence
  Synthetic Polynucleotide
taatacgactcactatagggattaaatttggattatcttgataatattaaaacagaggagattaataatgtcaagataaaacctggcggcagcgcaaaagatg

SEQ ID NO: 58574 - DNA, 103 bp, Artificial Sequence
  Synthetic Polynucleotide
taatacgactcactataggggaagaattaaatttggattatcttgataataacagaggagaattatcatgataatccaaaacctggcggcagcgcaaaagatg

SEQ ID NO: 58575 - DNA, 103 bp, Artificial Sequence
  Synthetic Polynucleotide
taatacgactcactatagggcatttgaagaattaaatttggattatcttgaacagaggagacaagatatgccaaatttaaacctggcggcagcgcaaaagatg

SEQ ID NO: 58576 - DNA, 103 bp, Artificial Sequence
  Synthetic Polynucleotide
taatacgactcactatagggtacttcatttgaagaattaaatttggattaaacagaggagataatccatgtttaattctaacctggcggcagcgcaaaagatg

SEQ ID NO: 58577 - DNA, 103 bp, Artificial Sequence
  Synthetic Polynucleotide
taatacgactcactataggggatcctacttcatttgaagaattaaatttgaacagaggagacaaattatgttcttcaaaaacctggcggcagcgcaaaagatg

SEQ ID NO: 58578 - DNA, 103 bp, Artificial Sequence
  Synthetic Polynucleotide
taatacgactcactatagggtagaagatcctacttcatttgaagaattaaaacagaggagattaattatgcaaatgaagaacctggcggcagcgcaaaagatg

SEQ ID NO: 58579 - DNA, 103 bp, Artificial Sequence
  Synthetic Polynucleotide
taatacgactcactatagggagttatagaagatcctacttcatttgaagaaacagaggagatcttcaatggaagtaggaaacctggcggcagcgcaaaagatg

SEQ ID NO: 58580 - DNA, 103 bp, Artificial Sequence
  Synthetic Polynucleotide
taatacgactcactatagggaaagtagttatagaagatcctacttcatttaacagaggagaaaatgaatgaggatcttcaacctggcggcagcgcaaaagatg

SEQ ID NO: 58581 - DNA, 103 bp, Artificial Sequence
  Synthetic Polynucleotide
taatacgactcactatagggatgataaagtagttatagaagatcctacttaacagaggagaaagtagatgcttctataaaacctggcggcagcgcaaaagatg

SEQ ID NO: 58582 - DNA, 103 bp, Artificial Sequence
  Synthetic Polynucleotide
taatacgactcactataggggtgtcaactcgtaatatcgaatattatgataacagaggagaatcataatgttcgatattaacctggcggcagcgcaaaagatg

SEQ ID NO: 58583 - DNA, 103 bp, Artificial Sequence
  Synthetic Polynucleotide
taatacgactcactatagggagactatgataaagtagttatagaagatccaacagaggagaggatctatgataactactaacctggcggcagcgcaaaagatg

SEQ ID NO: 58584 - DNA, 103 bp, Artificial Sequence
  Synthetic Polynucleotide
taatacgactcactatagggtctttagactatgataaagtagttatagaaaacagaggagattctatatgtactttatcaacctggcggcagcgcaaaagatg

SEQ ID NO: 58585 - DNA, 103 bp, Artificial Sequence
  Synthetic Polynucleotide
taatacgactcactatagggagtcatctttagactatgataaagtagttaaacagaggagataactaatgtatcatagtaacctggcggcagcgcaaaagatg

SEQ ID NO: 58586 - DNA, 103 bp, Artificial Sequence
  Synthetic Polynucleotide
taatacgactcactatagggatatcagtcatctttagactatgataaagtaacagaggagaactttaatgtagtctaaaaacctggcggcagcgcaaaagatg

SEQ ID NO: 58587 - DNA, 103 bp, Artificial Sequence
  Synthetic Polynucleotide
taatacgactcactatagggcctgaatatcagtcatctttagactatgataacagaggagaatcataatgtaaagatgaaacctggcggcagcgcaaaagatg

SEQ ID NO: 58588 - DNA, 103 bp, Artificial Sequence
  Synthetic Polynucleotide
taatacgactcactatagggcaaaacctgaatatcagtcatctttagactaacagaggagaagtctaatgatgactgataacctggcggcagcgcaaaagatg

SEQ ID NO: 58589 - DNA, 103 bp, Artificial Sequence
  Synthetic Polynucleotide
taatacgactcactataggggccaacaaaacctgaatatcagtcatctttaacagaggagaaaagatatgtgatattcaaacctggcggcagcgcaaaagatg

SEQ ID NO: 58590 - DNA, 103 bp, Artificial Sequence
  Synthetic Polynucleotide
taatacgactcactatagggcaaccgccaacaaaacctgaatatcagtcaaacagaggagatgactgatgttcaggtttaacctggcggcagcgcaaaagatg

SEQ ID NO: 58591 - DNA, 103 bp, Artificial Sequence
  Synthetic Polynucleotide
taatacgactcactatagggcacctcaaccgccaacaaaacctgaatatcaacagaggagagatattatggttttgttgaacctggcggcagcgcaaaagatg

SEQ ID NO: 58592 - DNA, 103 bp, Artificial Sequence
  Synthetic Polynucleotide
taatacgactcactatagggtgttacacctcaaccgccaacaaaacctgaaacagaggagatcaggtatggttggcggtaacctggcggcagcgcaaaagatg

SEQ ID NO: 58593 - DNA, 103 bp, Artificial Sequence
  Synthetic Polynucleotide
taatacgactcactatagggtcaatgtgtcaactcgtaatatcgaatattaacagaggagaaatattatgtattacgagaacctggcggcagcgcaaaagatg

SEQ ID NO: 58594 - DNA, 103 bp, Artificial Sequence
  Synthetic Polynucleotide
taatacgactcactataggggtagctgttacacctcaaccgccaacaaaaaacagaggagattttgtatgcggttgaggaacctggcggcagcgcaaaagatg

SEQ ID NO: 58595 - DNA, 103 bp, Artificial Sequence
  Synthetic Polynucleotide
taatacgactcactatagggctcaagtagctgttacacctcaaccgccaaaacagaggagattggcgatggaggtgtaaaacctggcggcagcgcaaaagatg

SEQ ID NO: 58596 - DNA, 103 bp, Artificial Sequence
  Synthetic Polynucleotide
taatacgactcactatagggggtatctcaagtagctgttacacctcaaccaacagaggagaggttgaatggtaacagctaacctggcggcagcgcaaaagatg

SEQ ID NO: 58597 - DNA, 103 bp, Artificial Sequence
  Synthetic Polynucleotide
taatacgactcactatagggactttggtatctcaagtagctgttacacctaacagaggagaaggtgtatgagctacttgaacctggcggcagcgcaaaagatg

SEQ ID NO: 58598 - DNA, 103 bp, Artificial Sequence
  Synthetic Polynucleotide
taatacgactcactatagggatcagactttggtatctcaagtagctgttaaacagaggagataacagatgcttgagataaacctggcggcagcgcaaaagatg

SEQ ID NO: 58599 - DNA, 103 bp, Artificial Sequence
  Synthetic Polynucleotide
taatacgactcactatagggtgaatatcagactttggtatctcaagtagcaacagaggagagctactatggataccaaaaacctggcggcagcgcaaaagatg

SEQ ID NO: 58600 - DNA, 103 bp, Artificial Sequence
  Synthetic Polynucleotide
taatacgactcactatagggctttctgaatatcagactttggtatctcaaaacagaggagattgagaatgcaaagtctgaacctggcggcagcgcaaaagatg

SEQ ID NO: 58601 - DNA, 103 bp, Artificial Sequence
  Synthetic Polynucleotide
taatacgactcactatagggcacagctttctgaatatcagactttggtataacagaggagaataccaatgtctgatattaacctggcggcagcgcaaaagatg

SEQ ID NO: 58602 - DNA, 103 bp, Artificial Sequence
  Synthetic Polynucleotide
taatacgactcactatagggacatccacagctttctgaatatcagactttaacagaggagaaaagtcatgtattcagaaaacctggcggcagcgcaaaagatg

SEQ ID NO: 58603 - DNA, 103 bp, Artificial Sequence
  Synthetic Polynucleotide
taatacgactcactatagggcccaaacatccacagctttctgaatatcagaacagaggagactgataatgagaaagctgaacctggcggcagcgcaaaagatg

SEQ ID NO: 58604 - DNA, 103 bp, Artificial Sequence
  Synthetic Polynucleotide
taatacgactcactatagggtttgttcaatgtgtcaactcgtaatatcgaaacagaggagatcgataatgcgagttgacaacctggcggcagcgcaaaagatg

SEQ ID NO: 58605 - DNA, 103 bp, Artificial Sequence
  Synthetic Polynucleotide
taatacgactcactatagggttgaacccaaacatccacagctttctgaataacagaggagaattcagatggctgtggataacctggcggcagcgcaaaagatg

SEQ ID NO: 58606 - DNA, 103 bp, Artificial Sequence
  Synthetic Polynucleotide
taatacgactcactatagggggatgttgaacccaaacatccacagctttcaacagaggagagaaagcatgggatgtttgaacctggcggcagcgcaaaagatg

SEQ ID NO: 58607 - DNA, 103 bp, Artificial Sequence
  Synthetic Polynucleotide
taatacgactcactatagggtcagtggatgttgaacccaaacatccacagaacagaggagactgtggatgtttgggttcaacctggcggcagcgcaaaagatg

SEQ ID NO: 58608 - DNA, 103 bp, Artificial Sequence
  Synthetic Polynucleotide
taatacgactcactatagggcaccatcagtggatgttgaacccaaacatcaacagaggagagatgttatggttcaacataacctggcggcagcgcaaaagatg

SEQ ID NO: 58609 - DNA, 103 bp, Artificial Sequence
  Synthetic Polynucleotide
taatacgactcactatagggtgtaacaccatcagtggatgttgaacccaaaacagaggagattgggtatgacatccactaacctggcggcagcgcaaaagatg

SEQ ID NO: 58610 - DNA, 103 bp, Artificial Sequence
  Synthetic Polynucleotide
taatacgactcactatagggattggtgtaacaccatcagtggatgttgaaaacagaggagattcaacatgcactgatggaacctggcggcagcgcaaaagatg

SEQ ID NO: 58611 - DNA, 103 bp, Artificial Sequence
  Synthetic Polynucleotide
taatacgactcactatagggaaccgattggtgtaacaccatcagtggatgaacagaggagacatccaatgatggtgttaaacctggcggcagcgcaaaagatg

SEQ ID NO: 58612 - DNA, 103 bp, Artificial Sequence
  Synthetic Polynucleotide
taatacgactcactatagggcactgaaccgattggtgtaacaccatcagtaacagaggagaactgatatggttacaccaaacctggcggcagcgcaaaagatg

SEQ ID NO: 58613 - DNA, 103 bp, Artificial Sequence
  Synthetic Polynucleotide
taatacgactcactataggggacgtcactgaaccgattggtgtaacaccaaacagaggagatggtgtatgaccaatcggaacctggcggcagcgcaaaagatg

SEQ ID NO: 58614 - DNA, 103 bp, Artificial Sequence
  Synthetic Polynucleotide
taatacgactcactatagggccacagacgtcactgaaccgattggtgtaaaacagaggagattacacatgtcggttcagaacctggcggcagcgcaaaagatg

SEQ ID NO: 58615 - DNA, 103 bp, Artificial Sequence
  Synthetic Polynucleotide
taatacgactcactatagggttggatttgttcaatgtgtcaactcgtaataacagaggagaattacgatgtgacacattaacctggcggcagcgcaaaagatg

SEQ ID NO: 58616 - DNA, 103 bp, Artificial Sequence
  Synthetic Polynucleotide
taatacgactcactatagggtccatccacagacgtcactgaaccgattggaacagaggagaccaatcatgtcagtgacgaacctggcggcagcgcaaaagatg

SEQ ID NO: 58617 - DNA, 103 bp, Artificial Sequence
  Synthetic Polynucleotide
taatacgactcactataggggcacctccatccacagacgtcactgaaccgaacagaggagacggttcatggacgtctgtaacctggcggcagcgcaaaagatg

SEQ ID NO: 58618 - DNA, 103 bp, Artificial Sequence
  Synthetic Polynucleotide
taatacgactcactatagggaagtagcacctccatccacagacgtcactgaacagaggagacagtgaatgctgtggatgaacctggcggcagcgcaaaagatg

SEQ ID NO: 58619 - DNA, 103 bp, Artificial Sequence
  Synthetic Polynucleotide
taatacgactcactatagggtgtaaaagtagcacctccatccacagacgtaacagaggagaacgtctatggatggaggtaacctggcggcagcgcaaaagatg

SEQ ID NO: 58620 - DNA, 103 bp, Artificial Sequence
  Synthetic Polynucleotide
taatacgactcactatagggggttctgtaaaagtagcacctccatccacaaacagaggagatgtggaatgaggtgctacaacctggcggcagcgcaaaagatg

SEQ ID NO: 58621 - DNA, 103 bp, Artificial Sequence
  Synthetic Polynucleotide
taatacgactcactatagggctacaggttctgtaaaagtagcacctccataacagaggagaatggagatgctacttttaaacctggcggcagcgcaaaagatg

SEQ ID NO: 58622 - DNA, 103 bp, Artificial Sequence
  Synthetic Polynucleotide
taatacgactcactatagggtaaggctacaggttctgtaaaagtagcaccaacagaggagaggtgctatgtttacagaaaacctggcggcagcgcaaaagatg

SEQ ID NO: 58623 - DNA, 103 bp, Artificial Sequence
  Synthetic Polynucleotide
taatacgactcactatagggacaactaaggctacaggttctgtaaaagtaaacagaggagatactttatgagaacctgtaacctggcggcagcgcaaaagatg

SEQ ID NO: 58624 - DNA, 103 bp, Artificial Sequence
  Synthetic Polynucleotide
taatacgactcactatagggcgtcgacaactaaggctacaggttctgtaaaacagaggagattacagatgctgtagcctaacctggcggcagcgcaaaagatg

SEQ ID NO: 58625 - DNA, 103 bp, Artificial Sequence
  Synthetic Polynucleotide
taatacgactcactatagggatctccgtcgacaactaaggctacaggttcaacagaggagagaacctatggccttagttaacctggcggcagcgcaaaagatg

SEQ ID NO: 58626 - DNA, 103 bp, Artificial Sequence
  Synthetic Polynucleotide
taatacgactcactatagggaatacttggatttgttcaatgtgtcaactcaacagaggagagagttgatgcattgaacaaacctggcggcagcgcaaaagatg

SEQ ID NO: 58627 - DNA, 103 bp, Artificial Sequence
  Synthetic Polynucleotide
taatacgactcactataggggatgtatctccgtcgacaactaaggctacaaacagaggagatgtagcatgagttgtcgaaacctggcggcagcgcaaaagatg

SEQ ID NO: 58628 - DNA, 103 bp, Artificial Sequence
  Synthetic Polynucleotide
taatacgactcactatagggttgaagatgtatctccgtcgacaactaaggaacagaggagaccttagatgtcgacggagaacctggcggcagcgcaaaagatg

SEQ ID NO: 58629 - DNA, 103 bp, Artificial Sequence
  Synthetic Polynucleotide
taatacgactcactatagggtcgcattgaagatgtatctccgtcgacaacaacagaggagagttgtcatgggagatacaaacctggcggcagcgcaaaagatg

SEQ ID NO: 58630 - DNA, 103 bp, Artificial Sequence
  Synthetic Polynucleotide
taatacgactcactatagggtttcctcgcattgaagatgtatctccgtcgaacagaggagacgacggatgtacatcttcaacctggcggcagcgcaaaagatg

SEQ ID NO: 58631 - DNA, 103 bp, Artificial Sequence
  Synthetic Polynucleotide
taatacgactcactatagggatacatttcctcgcattgaagatgtatctcaacagaggagagagataatgcttcaatgcaacctggcggcagcgcaaaagatg

SEQ ID NO: 58632 - DNA, 103 bp, Artificial Sequence
  Synthetic Polynucleotide
taatacgactcactatagggaaattatacatttcctcgcattgaagatgtaacagaggagaacatctatgatgcgaggaaacctggcggcagcgcaaaagatg

SEQ ID NO: 58633 - DNA, 103 bp, Artificial Sequence
  Synthetic Polynucleotide
taatacgactcactatagggttaccaaattatacatttcctcgcattgaaaacagaggagattcaatatgaggaaatgtaacctggcggcagcgcaaaagatg

SEQ ID NO: 58634 - DNA, 103 bp, Artificial Sequence
  Synthetic Polynucleotide
taatacgactcactatagggaaacattaccaaattatacatttcctcgcaaacagaggagatgcgagatgatgtataataacctggcggcagcgcaaaagatg

SEQ ID NO: 58635 - DNA, 103 bp, Artificial Sequence
  Synthetic Polynucleotide
taatacgactcactatagggataagaaacattaccaaattatacatttccaacagaggagaggaaatatgtaatttggtaacctggcggcagcgcaaaagatg

SEQ ID NO: 58636 - DNA, 103 bp, Artificial Sequence
  Synthetic Polynucleotide
taatacgactcactatagggtccacataagaaacattaccaaattatacaaacagaggagatgtataatgtggtaatgtaacctggcggcagcgcaaaagatg

SEQ ID NO: 58637 - DNA, 103 bp, Artificial Sequence
  Synthetic Polynucleotide
taatacgactcactatagggaatcaaatacttggatttgttcaatgtgtcaacagaggagagacacaatgaacaaatccaacctggcggcagcgcaaaagatg

SEQ ID NO: 58638 - DNA, 103 bp, Artificial Sequence
  Synthetic Polynucleotide
taatacgactcactatagggtcagatccacataagaaacattaccaaattaacagaggagaaatttgatgatgtttcttaacctggcggcagcgcaaaagatg

SEQ ID NO: 58639 - DNA, 103 bp, Artificial Sequence
  Synthetic Polynucleotide
taatacgactcactatagggcttcttcagatccacataagaaacattaccaacagaggagaggtaatatgtcttatgtgaacctggcggcagcgcaaaagatg

SEQ ID NO: 58640 - DNA, 103 bp, Artificial Sequence
  Synthetic Polynucleotide
taatacgactcactatagggtacctcttcttcagatccacataagaaacaaacagaggagatgtttcatgtgtggatctaacctggcggcagcgcaaaagatg

SEQ ID NO: 58641 - DNA, 103 bp, Artificial Sequence
  Synthetic Polynucleotide
taatacgactcactatagggtatcttacctcttcttcagatccacataagaacagaggagacttatgatgatctgaagaaacctggcggcagcgcaaaagatg

SEQ ID NO: 58642 - DNA, 103 bp, Artificial Sequence
  Synthetic Polynucleotide
taatacgactcactataggggtagatatcttacctcttcttcagatccacaacagaggagagtggatatgaagaagaggaacctggcggcagcgcaaaagatg

SEQ ID NO: 58643 - DNA, 103 bp, Artificial Sequence
  Synthetic Polynucleotide
taatacgactcactatagggttctagtagatatcttacctcttcttcagaaacagaggagatctgaaatggaggtaagaaacctggcggcagcgcaaaagatg

SEQ ID NO: 58644 - DNA, 103 bp, Artificial Sequence
  Synthetic Polynucleotide
taatacgactcactatagggtatctttctagtagatatcttacctcttctaacagaggagaagaagaatgaagatatctaacctggcggcagcgcaaaagatg

SEQ ID NO: 58645 - DNA, 103 bp, Artificial Sequence
  Synthetic Polynucleotide
taatacgactcactatagggatcggtatctttctagtagatatcttacctaacagaggagaaggtaaatgatctactagaacctggcggcagcgcaaaagatg

SEQ ID NO: 58646 - DNA, 103 bp, Artificial Sequence
  Synthetic Polynucleotide
taatacgactcactatagggacgtgatcggtatctttctagtagatatctaacagaggagaagatatatgctagaaagaaacctggcggcagcgcaaaagatg

SEQ ID NO: 58647 - DNA, 103 bp, Artificial Sequence
  Synthetic Polynucleotide
taatacgactcactatagggctagaacgtgatcggtatctttctagtagaaacagaggagatctactatgaagataccgaacctggcggcagcgcaaaagatg

SEQ ID NO: 58648 - DNA, 103 bp, Artificial Sequence
  Synthetic Polynucleotide
taatacgactcactatagggtccaaaatcaaatacttggatttgttcaataacagaggagaattgaaatgatccaagtaaacctggcggcagcgcaaaagatg

SEQ ID NO: 58649 - DNA, 103 bp, Artificial Sequence
  Synthetic Polynucleotide
taatacgactcactataggggagaactagaacgtgatcggtatctttctaaacagaggagatagaaaatgaccgatcacaacctggcggcagcgcaaaagatg

SEQ ID NO: 58650 - DNA, 103 bp, Artificial Sequence
  Synthetic Polynucleotide
taatacgactcactatagggcaaaagagaactagaacgtgatcggtatctaacagaggagaagatacatgtcacgttctaacctggcggcagcgcaaaagatg

SEQ ID NO: 58651 - DNA, 103 bp, Artificial Sequence
  Synthetic Polynucleotide
taatacgactcactatagggttctacaaaagagaactagaacgtgatcggaacagaggagaccgatcatgttctagttcaacctggcggcagcgcaaaagatg

SEQ ID NO: 58652 - DNA, 103 bp, Artificial Sequence
  Synthetic Polynucleotide
taatacgactcactatagggttaagttctacaaaagagaactagaacgtgaacagaggagacacgttatggttctctttaacctggcggcagcgcaaaagatg

SEQ ID NO: 58653 - DNA, 103 bp, Artificial Sequence
  Synthetic Polynucleotide
taatacgactcactatagggaaaagttaagttctacaaaagagaactagaaacagaggagatctagtatgcttttgtagaacctggcggcagcgcaaaagatg

SEQ ID NO: 58654 - DNA, 103 bp, Artificial Sequence
  Synthetic Polynucleotide
taatacgactcactatagggaaagaaaaagttaagttctacaaaagagaaaacagaggagattctctatggtagaacttaacctggcggcagcgcaaaagatg

SEQ ID NO: 58655 - DNA, 103 bp, Artificial Sequence
  Synthetic Polynucleotide
taatacgactcactatagggctgagaaagaaaaagttaagttctacaaaaaacagaggagattttgtatgacttaacttaacctggcggcagcgcaaaagatg

SEQ ID NO: 58656 - DNA, 103 bp, Artificial Sequence
  Synthetic Polynucleotide
taatacgactcactatagggagatgctgagaaagaaaaagttaagttctaaacagaggagatagaacatgactttttctaacctggcggcagcgcaaaagatg

SEQ ID NO: 58657 - DNA, 103 bp, Artificial Sequence
  Synthetic Polynucleotide
taatacgactcactatagggcaactagatgctgagaaagaaaaagttaagaacagaggagacttaacatgttctttctcaacctggcggcagcgcaaaagatg

SEQ ID NO: 58658 - DNA, 103 bp, Artificial Sequence
  Synthetic Polynucleotide
taatacgactcactatagggaatatcaactagatgctgagaaagaaaaagaacagaggagactttttatgtctcagcataacctggcggcagcgcaaaagatg

SEQ ID NO: 58659 - DNA, 103 bp, Artificial Sequence
  Synthetic Polynucleotide
taatacgactcactatagggtattatccaaaatcaaatacttggatttgtaacagaggagaacaaatatgagtatttgaaacctggcggcagcgcaaaagatg

SEQ ID NO: 58660 - DNA, 103 bp, Artificial Sequence
  Synthetic Polynucleotide
taatacgactcactataggggttggaatatcaactagatgctgagaaagaaacagaggagatctttcatggcatctagtaacctggcggcagcgcaaaagatg

SEQ ID NO: 58661 - DNA, 103 bp, Artificial Sequence
  Synthetic Polynucleotide
taatacgactcactatagggaagaggttggaatatcaactagatgctgagaacagaggagactcagcatgtagttgataaacctggcggcagcgcaaaagatg

SEQ ID NO: 58662 - DNA, 103 bp, Artificial Sequence
  Synthetic Polynucleotide
taatacgactcactatagggacgtgaagaggttggaatatcaactagatgaacagaggagacatctaatggatattccaaacctggcggcagcgcaaaagatg

SEQ ID NO: 58663 - DNA, 103 bp, Artificial Sequence
  Synthetic Polynucleotide
taatacgactcactatagggtagtaacgtgaagaggttggaatatcaactaacagaggagaagttgaatgtccaacctcaacctggcggcagcgcaaaagatg

SEQ ID NO: 58664 - DNA, 103 bp, Artificial Sequence
  Synthetic Polynucleotide
taatacgactcactataggggaacgtagtaacgtgaagaggttggaatataacagaggagaatattcatgcctcttcacaacctggcggcagcgcaaaagatg

SEQ ID NO: 58665 - DNA, 103 bp, Artificial Sequence
  Synthetic Polynucleotide
taatacgactcactatagggaatatgaacgtagtaacgtgaagaggttggaacagaggagaccaaccatgtcacgttacaacctggcggcagcgcaaaagatg

SEQ ID NO: 58666 - DNA, 103 bp, Artificial Sequence
  Synthetic Polynucleotide
taatacgactcactatagggattggaatatgaacgtagtaacgtgaagagaacagaggagactcttcatgttactacgtaacctggcggcagcgcaaaagatg

SEQ ID NO: 58667 - DNA, 103 bp, Artificial Sequence
  Synthetic Polynucleotide
taatacgactcactatagggcgtgaattggaatatgaacgtagtaacgtgaacagaggagacacgttatgacgttcataaacctggcggcagcgcaaaagatg

SEQ ID NO: 58668 - DNA, 103 bp, Artificial Sequence
  Synthetic Polynucleotide
taatacgactcactataggggcgaacgtgaattggaatatgaacgtagtaaacagaggagatactacatgcatattccaaacctggcggcagcgcaaaagatg

SEQ ID NO: 58669 - DNA, 103 bp, Artificial Sequence
  Synthetic Polynucleotide
taatacgactcactatagggcccatgcgaacgtgaattggaatatgaacgaacagaggagacgttcaatgtccaattcaaacctggcggcagcgcaaaagatg

SEQ ID NO: 58670 - DNA, 103 bp, Artificial Sequence
  Synthetic Polynucleotide
taatacgactcactatagggacgaatattatccaaaatcaaatacttggaaacagaggagatccaagatgttgattttgaacctggcggcagcgcaaaagatg

SEQ ID NO: 58671 - DNA, 103 bp, Artificial Sequence
  Synthetic Polynucleotide
taatacgactcactatagggggtaacccatgcgaacgtgaattggaatataacagaggagaatattcatgttcacgttcaacctggcggcagcgcaaaagatg

SEQ ID NO: 58672 - DNA, 103 bp, Artificial Sequence
  Synthetic Polynucleotide
taatacgactcactataggggcgaaggtaacccatgcgaacgtgaattggaacagaggagaccaattatggttcgcatgaacctggcggcagcgcaaaagatg

SEQ ID NO: 58673 - DNA, 103 bp, Artificial Sequence
  Synthetic Polynucleotide
taatacgactcactatagggaaactgcgaaggtaacccatgcgaacgtgaaacagaggagatcacgtatgcatgggttaaacctggcggcagcgcaaaagatg

SEQ ID NO: 58674 - DNA, 103 bp, Artificial Sequence
  Synthetic Polynucleotide
taatacgactcactatagggcgtaaaaactgcgaaggtaacccatgcgaaaacagaggagattcgcaatggttaccttcaacctggcggcagcgcaaaagatg

SEQ ID NO: 58675 - DNA, 103 bp, Artificial Sequence
  Synthetic Polynucleotide
taatacgactcactatagggtcgctcgtaaaaactgcgaaggtaacccataacagaggagaatgggtatgcttcgcagtaacctggcggcagcgcaaaagatg

SEQ ID NO: 58676 - DNA, 103 bp, Artificial Sequence
  Synthetic Polynucleotide
taatacgactcactatagggtgaaatcgctcgtaaaaactgcgaaggtaaaacagaggagattacctatgcagtttttaaacctggcggcagcgcaaaagatg

SEQ ID NO: 58677 - DNA, 103 bp, Artificial Sequence
  Synthetic Polynucleotide
taatacgactcactataggggaacgtgaaatcgctcgtaaaaactgcgaaaacagaggagattcgcaatgtttacgagcaacctggcggcagcgcaaaagatg

SEQ ID NO: 58678 - DNA, 103 bp, Artificial Sequence
  Synthetic Polynucleotide
taatacgactcactatagggatctggaacgtgaaatcgctcgtaaaaactaacagaggagaagttttatggagcgatttaacctggcggcagcgcaaaagatg

SEQ ID NO: 58679 - DNA, 103 bp, Artificial Sequence
  Synthetic Polynucleotide
taatacgactcactatagggacgtaatctggaacgtgaaatcgctcgtaaaacagaggagattacgaatgatttcacgtaacctggcggcagcgcaaaagatg

SEQ ID NO: 58680 - DNA, 103 bp, Artificial Sequence
  Synthetic Polynucleotide
taatacgactcactataggggctaaacgtaatctggaacgtgaaatcgctaacagaggagaagcgatatgacgttccagaacctggcggcagcgcaaaagatg

SEQ ID NO: 58681 - DNA, 103 bp, Artificial Sequence
  Synthetic Polynucleotide
taatacgactcactatagggtagaagatatagggagagtgacagtgacagaacagaggagactgtcaatgtcactctccaacctggcggcagcgcaaaagatg

SEQ ID NO: 58682 - DNA, 103 bp, Artificial Sequence
  Synthetic Polynucleotide
taatacgactcactatagggaaaatacgaatattatccaaaatcaaatacaacagaggagagtatttatgtttggataaaacctggcggcagcgcaaaagatg

SEQ ID NO: 58683 - DNA, 103 bp, Artificial Sequence
  Synthetic Polynucleotide
taatacgactcactatagggtgaaggctaaacgtaatctggaacgtgaaaaacagaggagatttcacatgccagattacaacctggcggcagcgcaaaagatg

SEQ ID NO: 58684 - DNA, 103 bp, Artificial Sequence
  Synthetic Polynucleotide
taatacgactcactatagggacacatgaaggctaaacgtaatctggaacgaacagaggagacgttccatgttacgtttaaacctggcggcagcgcaaaagatg

SEQ ID NO: 58685 - DNA, 103 bp, Artificial Sequence
  Synthetic Polynucleotide
taatacgactcactataggggagagacacatgaaggctaaacgtaatctgaacagaggagacagattatgtttagccttaacctggcggcagcgcaaaagatg

SEQ ID NO: 58686 - DNA, 103 bp, Artificial Sequence
  Synthetic Polynucleotide
taatacgactcactatagggagagtgagagacacatgaaggctaaacgtaaacagaggagatacgttatgccttcatgtaacctggcggcagcgcaaaagatg

SEQ ID NO: 58687 - DNA, 103 bp, Artificial Sequence
  Synthetic Polynucleotide
taatacgactcactatagggtagagagagtgagagacacatgaaggctaaaacagaggagattagccatgatgtgtctcaacctggcggcagcgcaaaagatg

SEQ ID NO: 58688 - DNA, 103 bp, Artificial Sequence
  Synthetic Polynucleotide
taatacgactcactatagggctcgatagagagagtgagagacacatgaagaacagaggagacttcatatgtctctcactaacctggcggcagcgcaaaagatg

SEQ ID NO: 58689 - DNA, 103 bp, Artificial Sequence
  Synthetic Polynucleotide
taatacgactcactatagggataaactcgatagagagagtgagagacacaaacagaggagatgtgtcatgcactctctcaacctggcggcagcgcaaaagatg

SEQ ID NO: 58690 - DNA, 103 bp, Artificial Sequence
  Synthetic Polynucleotide
taatacgactcactatagggctctgataaactcgatagagagagtgagagaacagaggagactctcaatgtctctatcgaacctggcggcagcgcaaaagatg

SEQ ID NO: 58691 - DNA, 103 bp, Artificial Sequence
  Synthetic Polynucleotide
taatacgactcactataggggactgctctgataaactcgatagagagagtaacagaggagaactctcatgatcgagtttaacctggcggcagcgcaaaagatg

SEQ ID NO: 58692 - DNA, 103 bp, Artificial Sequence
  Synthetic Polynucleotide
taatacgactcactatagggagaaagactgctctgataaactcgatagagaacagaggagactctatatggtttatcagaacctggcggcagcgcaaaagatg

SEQ ID NO: 58693 - DNA, 103 bp, Artificial Sequence
  Synthetic Polynucleotide
taatacgactcactataggggatgcaaaatacgaatattatccaaaatcaaacagaggagatgatttatgataatattcaacctggcggcagcgcaaaagatg

SEQ ID NO: 58694 - DNA, 103 bp, Artificial Sequence
  Synthetic Polynucleotide
taatacgactcactatagggcctttagaaagactgctctgataaactcgaaacagaggagatcgagtatgtcagagcagaacctggcggcagcgcaaaagatg

SEQ ID NO: 58695 - DNA, 103 bp, Artificial Sequence
  Synthetic Polynucleotide
taatacgactcactataggggatcgcctttagaaagactgctctgataaaaacagaggagatttatcatggcagtctttaacctggcggcagcgcaaaagatg

SEQ ID NO: 58696 - DNA, 103 bp, Artificial Sequence
  Synthetic Polynucleotide
taatacgactcactatagggagttcgatcgcctttagaaagactgctctgaacagaggagacagagcatgctttctaaaaacctggcggcagcgcaaaagatg

SEQ ID NO: 58697 - DNA, 103 bp, Artificial Sequence
  Synthetic Polynucleotide
taatacgactcactatagggtatggagttcgatcgcctttagaaagactgaacagaggagacagtctatgtaaaggcgaaacctggcggcagcgcaaaagatg

SEQ ID NO: 58698 - DNA, 103 bp, Artificial Sequence
  Synthetic Polynucleotide
taatacgactcactatagggaaatttatggagttcgatcgcctttagaaaaacagaggagatttctaatggcgatcgaaaacctggcggcagcgcaaaagatg

SEQ ID NO: 58699 - DNA, 103 bp, Artificial Sequence
  Synthetic Polynucleotide
taatacgactcactatagggtggagaaatttatggagttcgatcgcctttaacagaggagaaaaggcatgcgaactccaaacctggcggcagcgcaaaagatg

SEQ ID NO: 58700 - DNA, 103 bp, Artificial Sequence
  Synthetic Polynucleotide
taatacgactcactatagggatcgttggagaaatttatggagttcgatcgaacagaggagacgatcgatgtccataaataacctggcggcagcgcaaaagatg

SEQ ID NO: 58701 - DNA, 103 bp, Artificial Sequence
  Synthetic Polynucleotide
taatacgactcactatagggatcaaatcgttggagaaatttatggagttcaacagaggagagaactcatgaaatttctcaacctggcggcagcgcaaaagatg

SEQ ID NO: 58702 - DNA, 103 bp, Artificial Sequence
  Synthetic Polynucleotide
taatacgactcactatagggaaacaatcaaatcgttggagaaatttatggaacagaggagaccataaatgtctccaacgaacctggcggcagcgcaaaagatg

SEQ ID NO: 58703 - DNA, 103 bp, Artificial Sequence
  Synthetic Polynucleotide
taatacgactcactatagggtatggaaacaatcaaatcgttggagaaattaacagaggagaaatttcatgaacgatttgaacctggcggcagcgcaaaagatg

SEQ ID NO: 58704 - DNA, 103 bp, Artificial Sequence
  Synthetic Polynucleotide
taatacgactcactatagggtagcagatgcaaaatacgaatattatccaaaacagaggagattggatatgattcgtattaacctggcggcagcgcaaaagatg

SEQ ID NO: 58705 - DNA, 103 bp, Artificial Sequence
  Synthetic Polynucleotide
taatacgactcactatagggaaatctatggaaacaatcaaatcgttggagaacagaggagactccaaatgtttgattgtaacctggcggcagcgcaaaagatg

SEQ ID NO: 58706 - DNA, 103 bp, Artificial Sequence
  Synthetic Polynucleotide
taatacgactcactatagggttcggaaatctatggaaacaatcaaatcgtaacagaggagaacgattatgttgtttccaaacctggcggcagcgcaaaagatg

SEQ ID NO: 58707 - DNA, 103 bp, Artificial Sequence
  Synthetic Polynucleotide
taatacgactcactatagggtgaacttcggaaatctatggaaacaatcaaaacagaggagattgattatgtccatagataacctggcggcagcgcaaaagatg

SEQ ID NO: 58708 - DNA, 103 bp, Artificial Sequence
  Synthetic Polynucleotide
taatacgactcactataggggaagctgaacttcggaaatctatggaaacaaacagaggagatgtttcatgagatttccgaacctggcggcagcgcaaaagatg

SEQ ID NO: 58709 - DNA, 103 bp, Artificial Sequence
  Synthetic Polynucleotide
taatacgactcactatagggtcctagaagctgaacttcggaaatctatggaacagaggagaccatagatgtccgaagttaacctggcggcagcgcaaaagatg

SEQ ID NO: 58710 - DNA, 103 bp, Artificial Sequence
  Synthetic Polynucleotide
taatacgactcactatagggcgccgtcctagaagctgaacttcggaaatcaacagaggagagatttcatgagttcagctaacctggcggcagcgcaaaagatg

SEQ ID NO: 58711 - DNA, 103 bp, Artificial Sequence
  Synthetic Polynucleotide
taatacgactcactatagggagaatcgccgtcctagaagctgaacttcggaacagaggagaccgaagatgagcttctagaacctggcggcagcgcaaaagatg

SEQ ID NO: 58712 - DNA, 103 bp, Artificial Sequence
  Synthetic Polynucleotide
taatacgactcactataggggaaaaagaatcgccgtcctagaagctgaacaacagaggagagttcagatgctaggacggaacctggcggcagcgcaaaagatg

SEQ ID NO: 58713 - DNA, 103 bp, Artificial Sequence
  Synthetic Polynucleotide
taatacgactcactatagggcgaaagaaaaagaatcgccgtcctagaagcaacagaggagagcttctatgacggcgattaacctggcggcagcgcaaaagatg

SEQ ID NO: 58714 - DNA, 103 bp, Artificial Sequence
  Synthetic Polynucleotide
taatacgactcactataggggaattcgaaagaaaaagaatcgccgtcctaaacagaggagataggacatggattcttttaacctggcggcagcgcaaaagatg

SEQ ID NO: 58715 - DNA, 103 bp, Artificial Sequence
  Synthetic Polynucleotide
taatacgactcactatagggaattatagcagatgcaaaatacgaatattaaacagaggagataatatatgtattttgcaaacctggcggcagcgcaaaagatg

SEQ ID NO: 58716 - DNA, 103 bp, Artificial Sequence
  Synthetic Polynucleotide
taatacgactcactataggggctgtgaattcgaaagaaaaagaatcgccgaacagaggagacggcgaatgtttttctttaacctggcggcagcgcaaaagatg

SEQ ID NO: 58717 - DNA, 103 bp, Artificial Sequence
  Synthetic Polynucleotide
taatacgactcactatagggatccagctgtgaattcgaaagaaaaagaataacagaggagaattcttatgctttcgaataacctggcggcagcgcaaaagatg

SEQ ID NO: 58718 - DNA, 103 bp, Artificial Sequence
  Synthetic Polynucleotide
taatacgactcactatagggtgtacatccagctgtgaattcgaaagaaaaaacagaggagattttctatggaattcacaaacctggcggcagcgcaaaagatg

SEQ ID NO: 58719 - DNA, 103 bp, Artificial Sequence
  Synthetic Polynucleotide
taatacgactcactatagggacggttgtacatccagctgtgaattcgaaaaacagaggagatttcgaatgcacagctggaacctggcggcagcgcaaaagatg

SEQ ID NO: 58720 - DNA, 103 bp, Artificial Sequence
  Synthetic Polynucleotide
taatacgactcactatagggaggaaacggttgtacatccagctgtgaattaacagaggagaaattcaatgctggatgtaaacctggcggcagcgcaaaagatg

SEQ ID NO: 58721 - DNA, 103 bp, Artificial Sequence
  Synthetic Polynucleotide
taatacgactcactatagggaacggaggaaacggttgtacatccagctgtaacagaggagaacagctatgtgtacaaccaacctggcggcagcgcaaaagatg

SEQ ID NO: 58722 - DNA, 103 bp, Artificial Sequence
  Synthetic Polynucleotide
taatacgactcactatagggatggaaacggaggaaacggttgtacatccaaacagaggagatggatgatgaaccgtttcaacctggcggcagcgcaaaagatg

SEQ ID NO: 58723 - DNA, 103 bp, Artificial Sequence
  Synthetic Polynucleotide
taatacgactcactatagggtggtaatggaaacggaggaaacggttgtacaacagaggagagtacaaatgtttcctccgaacctggcggcagcgcaaaagatg

SEQ ID NO: 58724 - DNA, 103 bp, Artificial Sequence
  Synthetic Polynucleotide
taatacgactcactatagggagagatggtaatggaaacggaggaaacggtaacagaggagaaccgttatgtccgtttccaacctggcggcagcgcaaaagatg

SEQ ID NO: 58725 - DNA, 103 bp, Artificial Sequence
  Synthetic Polynucleotide
taatacgactcactatagggaacttagagatggtaatggaaacggaggaaaacagaggagattcctcatgttccattacaacctggcggcagcgcaaaagatg

SEQ ID NO: 58726 - DNA, 103 bp, Artificial Sequence
  Synthetic Polynucleotide
taatacgactcactatagggatcttaattatagcagatgcaaaatacgaaaacagaggagattcgtaatgtgcatctgcaacctggcggcagcgcaaaagatg

SEQ ID NO: 58727 - DNA, 103 bp, Artificial Sequence
  Synthetic Polynucleotide
taatacgactcactatagggaaagaaacttagagatggtaatggaaacggaacagaggagaccgtttatgttaccatctaacctggcggcagcgcaaaagatg

SEQ ID NO: 58728 - DNA, 103 bp, Artificial Sequence
  Synthetic Polynucleotide
taatacgactcactatagggctaggaaagaaacttagagatggtaatggaaacagaggagatccattatgatctctaagaacctggcggcagcgcaaaagatg

SEQ ID NO: 58729 - DNA, 103 bp, Artificial Sequence
  Synthetic Polynucleotide
taatacgactcactatagggccgatctaggaaagaaacttagagatggtaaacagaggagataccatatgtaagtttctaacctggcggcagcgcaaaagatg

SEQ ID NO: 58730 - DNA, 103 bp, Artificial Sequence
  Synthetic Polynucleotide
taatacgactcactataggggattgccgatctaggaaagaaacttagagaaacagaggagatctctaatgttctttcctaacctggcggcagcgcaaaagatg

SEQ ID NO: 58731 - DNA, 103 bp, Artificial Sequence
  Synthetic Polynucleotide
taatacgactcactatagggagaaagattgccgatctaggaaagaaacttaacagaggagaaagtttatgtcctagatcaacctggcggcagcgcaaaagatg

SEQ ID NO: 58732 - DNA, 103 bp, Artificial Sequence
  Synthetic Polynucleotide
taatacgactcactatagggtgttgagaaagattgccgatctaggaaagaaacagaggagatctttcatggatcggcaaaacctggcggcagcgcaaaagatg

SEQ ID NO: 58733 - DNA, 103 bp, Artificial Sequence
  Synthetic Polynucleotide
taatacgactcactatagggtgaaatgttgagaaagattgccgatctaggaacagaggagacctagaatggcaatctttaacctggcggcagcgcaaaagatg

SEQ ID NO: 58734 - DNA, 103 bp, Artificial Sequence
  Synthetic Polynucleotide
taatacgactcactatagggggggatgaaatgttgagaaagattgccgataacagaggagaatcggcatgctttctcaaaacctggcggcagcgcaaaagatg

SEQ ID NO: 58735 - DNA, 103 bp, Artificial Sequence
  Synthetic Polynucleotide
taatacgactcactatagggtgtatggggatgaaatgttgagaaagattgaacagaggagacaatctatgtcaacatttaacctggcggcagcgcaaaagatg

SEQ ID NO: 58736 - DNA, 103 bp, Artificial Sequence
  Synthetic Polynucleotide
taatacgactcactatagggtaaaatgtatggggatgaaatgttgagaaaaacagaggagatttctcatgatttcatccaacctggcggcagcgcaaaagatg

SEQ ID NO: 58737 - DNA, 103 bp, Artificial Sequence
  Synthetic Polynucleotide
taatacgactcactatagggattatatcttaattatagcagatgcaaaataacagaggagaattttgatgctgctataaaacctggcggcagcgcaaaagatg

SEQ ID NO: 58738 - DNA, 103 bp, Artificial Sequence
  Synthetic Polynucleotide
taatacgactcactataggggaatgtaaaatgtatggggatgaaatgttgaacagaggagacaacatatgatccccataaacctggcggcagcgcaaaagatg

SEQ ID NO: 58739 - DNA, 103 bp, Artificial Sequence
  Synthetic Polynucleotide
taatacgactcactatagggtcgaggaatgtaaaatgtatggggatgaaaaacagaggagatttcatatgcatacatttaacctggcggcagcgcaaaagatg

SEQ ID NO: 58740 - DNA, 103 bp, Artificial Sequence
  Synthetic Polynucleotide
taatacgactcactatagggtagactcgaggaatgtaaaatgtatggggaaacagaggagatccccaatgattttacataacctggcggcagcgcaaaagatg

SEQ ID NO: 58741 - DNA, 103 bp, Artificial Sequence
  Synthetic Polynucleotide
taatacgactcactataggggacggtagactcgaggaatgtaaaatgtataacagaggagaatacatatgacattcctcaacctggcggcagcgcaaaagatg

SEQ ID NO: 58742 - DNA, 103 bp, Artificial Sequence
  Synthetic Polynucleotide
taatacgactcactatagggtcgacgacggtagactcgaggaatgtaaaaaacagaggagattttacatgcctcgagtcaacctggcggcagcgcaaaagatg

SEQ ID NO: 58743 - DNA, 103 bp, Artificial Sequence
  Synthetic Polynucleotide
taatacgactcactatagggatatttcgacgacggtagactcgaggaatgaacagaggagacattccatgagtctaccgaacctggcggcagcgcaaaagatg

SEQ ID NO: 58744 - DNA, 103 bp, Artificial Sequence
  Synthetic Polynucleotide
taatacgactcactataggggaaagatatttcgacgacggtagactcgagaacagaggagactcgagatgaccgtcgtcaacctggcggcagcgcaaaagatg

SEQ ID NO: 58745 - DNA, 103 bp, Artificial Sequence
  Synthetic Polynucleotide
taatacgactcactatagggagttggaaagatatttcgacgacggtagacaacagaggagagtctacatgcgtcgaaataacctggcggcagcgcaaaagatg

SEQ ID NO: 58746 - DNA, 103 bp, Artificial Sequence
  Synthetic Polynucleotide
taatacgactcactatagggaaaggagttggaaagatatttcgacgacggaacagaggagaccgtcgatgaaatatcttaacctggcggcagcgcaaaagatg

SEQ ID NO: 58747 - DNA, 103 bp, Artificial Sequence
  Synthetic Polynucleotide
taatacgactcactataggggtcgaaaaggagttggaaagatatttcgacaacagaggagagtcgaaatgtctttccaaaacctggcggcagcgcaaaagatg

SEQ ID NO: 58748 - DNA, 103 bp, Artificial Sequence
  Synthetic Polynucleotide
taatacgactcactatagggtggcgattatatcttaattatagcagatgcaacagaggagagcatctatgataattaagaacctggcggcagcgcaaaagatg

SEQ ID NO: 58749 - DNA, 103 bp, Artificial Sequence
  Synthetic Polynucleotide
taatacgactcactatagggttgaggtcgaaaaggagttggaaagatattaacagaggagaaatatcatgccaactcctaacctggcggcagcgcaaaagatg

SEQ ID NO: 58750 - DNA, 103 bp, Artificial Sequence
  Synthetic Polynucleotide
taatacgactcactatagggagttattgaggtcgaaaaggagttggaaagaacagaggagactttccatgtccttttcgaacctggcggcagcgcaaaagatg

SEQ ID NO: 58751 - DNA, 103 bp, Artificial Sequence
  Synthetic Polynucleotide
taatacgactcactataggggttaaagttattgaggtcgaaaaggagttgaacagaggagacaactcatgttcgacctcaacctggcggcagcgcaaaagatg

SEQ ID NO: 58752 - DNA, 103 bp, Artificial Sequence
  Synthetic Polynucleotide
taatacgactcactatagggaacgtgttaaagttattgaggtcgaaaaggaacagaggagaccttttatgcctcaataaaacctggcggcagcgcaaaagatg

SEQ ID NO: 58753 - DNA, 103 bp, Artificial Sequence
  Synthetic Polynucleotide
taatacgactcactatagggaagacaacgtgttaaagttattgaggtcgaaacagaggagatcgaccatgataactttaaacctggcggcagcgcaaaagatg

SEQ ID NO: 58754 - DNA, 103 bp, Artificial Sequence
  Synthetic Polynucleotide
taatacgactcactatagggcttgaaagacaacgtgttaaagttattgagaacagaggagactcaatatgtttaacacgaacctggcggcagcgcaaaagatg

SEQ ID NO: 58755 - DNA, 103 bp, Artificial Sequence
  Synthetic Polynucleotide
taatacgactcactataggggagagcttgaaagacaacgtgttaaagttaaacagaggagataacttatgcacgttgtcaacctggcggcagcgcaaaagatg

SEQ ID NO: 58756 - DNA, 103 bp, Artificial Sequence
  Synthetic Polynucleotide
taatacgactcactatagggcaaacgagagcttgaaagacaacgtgttaaaacagaggagattaacaatgtgtctttcaaacctggcggcagcgcaaaagatg

SEQ ID NO: 58757 - DNA, 103 bp, Artificial Sequence
  Synthetic Polynucleotide
taatacgactcactatagggtgctacaaacgagagcttgaaagacaacgtaacagaggagaacgttgatgttcaagctcaacctggcggcagcgcaaaagatg

SEQ ID NO: 58758 - DNA, 103 bp, Artificial Sequence
  Synthetic Polynucleotide
taatacgactcactatagggatagttgctacaaacgagagcttgaaagacaacagaggagagtctttatggctctcgttaacctggcggcagcgcaaaagatg

SEQ ID NO: 58759 - DNA, 103 bp, Artificial Sequence
  Synthetic Polynucleotide
taatacgactcactatagggttttgtggcgattatatcttaattatagcaaacagaggagatgctatatgtaagatataaacctggcggcagcgcaaaagatg

SEQ ID NO: 58760 - DNA, 103 bp, Artificial Sequence
  Synthetic Polynucleotide
taatacgactcactatagggaaatgatagttgctacaaacgagagcttgaaacagaggagatcaagcatgcgtttgtagaacctggcggcagcgcaaaagatg

SEQ ID NO: 58761 - DNA, 103 bp, Artificial Sequence
  Synthetic Polynucleotide
taatacgactcactatagggagataaaatgatagttgctacaaacgagagaacagaggagactctcgatggtagcaactaacctggcggcagcgcaaaagatg

SEQ ID NO: 58762 - DNA, 103 bp, Artificial Sequence
  Synthetic Polynucleotide
taatacgactcactataggggaatcagataaaatgatagttgctacaaacaacagaggagagtttgtatgaactatcataacctggcggcagcgcaaaagatg

SEQ ID NO: 58763 - DNA, 103 bp, Artificial Sequence
  Synthetic Polynucleotide
taatacgactcactatagggccagggaatcagataaaatgatagttgctaaacagaggagatagcaaatgtcattttataacctggcggcagcgcaaaagatg

SEQ ID NO: 58764 - DNA, 103 bp, Artificial Sequence
  Synthetic Polynucleotide
taatacgactcactatagggacgcgccagggaatcagataaaatgatagtaacagaggagaactatcatgttatctgataacctggcggcagcgcaaaagatg

SEQ ID NO: 58765 - DNA, 103 bp, Artificial Sequence
  Synthetic Polynucleotide
taatacgactcactatagggcttaaacgcgccagggaatcagataaaatgaacagaggagacattttatgtgattccctaacctggcggcagcgcaaaagatg

SEQ ID NO: 58766 - DNA, 103 bp, Artificial Sequence
  Synthetic Polynucleotide
taatacgactcactatagggaagatcttaaacgcgccagggaatcagataaacagaggagatatctgatgccctggcgcaacctggcggcagcgcaaaagatg

SEQ ID NO: 58767 - DNA, 103 bp, Artificial Sequence
  Synthetic Polynucleotide
taatacgactcactataggggcatgaagatcttaaacgcgccagggaatcaacagaggagagattccatggcgcgtttaaacctggcggcagcgcaaaagatg

SEQ ID NO: 58768 - DNA, 103 bp, Artificial Sequence
  Synthetic Polynucleotide
taatacgactcactatagggcaattgcatgaagatcttaaacgcgccaggaacagaggagacctggcatgtttaagatcaacctggcggcagcgcaaaagatg

SEQ ID NO: 58769 - DNA, 103 bp, Artificial Sequence
  Synthetic Polynucleotide
taatacgactcactatagggtgactcaattgcatgaagatcttaaacgcgaacagaggagacgcgttatggatcttcataacctggcggcagcgcaaaagatg

SEQ ID NO: 58770 - DNA, 103 bp, Artificial Sequence
  Synthetic Polynucleotide
taatacgactcactatagggcgtgtttttgtggcgattatatcttaattaaacagaggagataattaatgtataatcgcaacctggcggcagcgcaaaagatg

SEQ ID NO: 58771 - DNA, 103 bp, Artificial Sequence
  Synthetic Polynucleotide
taatacgactcactatagggagagctgactcaattgcatgaagatcttaaaacagaggagattaagaatgtcatgcaataacctggcggcagcgcaaaagatg

SEQ ID NO: 58772 - DNA, 103 bp, Artificial Sequence
  Synthetic Polynucleotide
taatacgactcactatagggcgttaagagctgactcaattgcatgaagataacagaggagaatcttcatgcaattgagtaacctggcggcagcgcaaaagatg

SEQ ID NO: 58773 - DNA, 103 bp, Artificial Sequence
  Synthetic Polynucleotide
taatacgactcactataggggattgcgttaagagctgactcaattgcatgaacagaggagacatgcaatggagtcagctaacctggcggcagcgcaaaagatg

SEQ ID NO: 58774 - DNA, 103 bp, Artificial Sequence
  Synthetic Polynucleotide
taatacgactcactatagggcaagagattgcgttaagagctgactcaattaacagaggagaaattgaatgagctcttaaaacctggcggcagcgcaaaagatg

SEQ ID NO: 58775 - DNA, 103 bp, Artificial Sequence
  Synthetic Polynucleotide
taatacgactcactatagggagaagcaagagattgcgttaagagctgactaacagaggagaagtcagatgttaacgcaaaacctggcggcagcgcaaaagatg

SEQ ID NO: 58776 - DNA, 103 bp, Artificial Sequence
  Synthetic Polynucleotide
taatacgactcactataggggacgaagaagcaagagattgcgttaagagcaacagaggagagctcttatggcaatctctaacctggcggcagcgcaaaagatg

SEQ ID NO: 58777 - DNA, 103 bp, Artificial Sequence
  Synthetic Polynucleotide
taatacgactcactatagggactatgacgaagaagcaagagattgcgttaaacagaggagataacgcatgctcttgcttaacctggcggcagcgcaaaagatg

SEQ ID NO: 58778 - DNA, 103 bp, Artificial Sequence
  Synthetic Polynucleotide
taatacgactcactatagggtgagtactatgacgaagaagcaagagattgaacagaggagacaatctatggcttcttcgaacctggcggcagcgcaaaagatg

SEQ ID NO: 58779 - DNA, 103 bp, Artificial Sequence
  Synthetic Polynucleotide
taatacgactcactataggggattgtgagtactatgacgaagaagcaagaaacagaggagatcttgcatgttcgtcataaacctggcggcagcgcaaaagatg

SEQ ID NO: 58780 - DNA, 103 bp, Artificial Sequence
  Synthetic Polynucleotide
taatacgactcactatagggacagtgattgtgagtactatgacgaagaagaacagaggagacttcttatgcatagtactaacctggcggcagcgcaaaagatg

SEQ ID NO: 58781 - DNA, 103 bp, Artificial Sequence
  Synthetic Polynucleotide
taatacgactcactataggggttcgcgtgtttttgtggcgattatatcttaacagaggagaaagataatgtcgccacaaaacctggcggcagcgcaaaagatg

SEQ ID NO: 58782 - DNA, 103 bp, Artificial Sequence
  Synthetic Polynucleotide
taatacgactcactatagggatctcacagtgattgtgagtactatgacgaaacagaggagatcgtcaatgtactcacaaaacctggcggcagcgcaaaagatg

SEQ ID NO: 58783 - DNA, 103 bp, Artificial Sequence
  Synthetic Polynucleotide
taatacgactcactatagggaatggatctcacagtgattgtgagtactataacagaggagaatagtaatgacaatcactaacctggcggcagcgcaaaagatg

SEQ ID NO: 58784 - DNA, 103 bp, Artificial Sequence
  Synthetic Polynucleotide
taatacgactcactataggggtagcaatggatctcacagtgattgtgagtaacagaggagaactcacatgcactgtgagaacctggcggcagcgcaaaagatg

SEQ ID NO: 58785 - DNA, 103 bp, Artificial Sequence
  Synthetic Polynucleotide
taatacgactcactatagggacgtggtagcaatggatctcacagtgattgaacagaggagacaatcaatgtgagatccaaacctggcggcagcgcaaaagatg

SEQ ID NO: 58786 - DNA, 103 bp, Artificial Sequence
  Synthetic Polynucleotide
taatacgactcactatagggtgtagacgtggtagcaatggatctcacagtaacagaggagaactgtgatgtccattgctaacctggcggcagcgcaaaagatg

SEQ ID NO: 58787 - DNA, 103 bp, Artificial Sequence
  Synthetic Polynucleotide
taatacgactcactatagggccaagtgtagacgtggtagcaatggatctcaacagaggagagagatcatgtgctaccacaacctggcggcagcgcaaaagatg

SEQ ID NO: 58788 - DNA, 103 bp, Artificial Sequence
  Synthetic Polynucleotide
taatacgactcactataggggctcaccaagtgtagacgtggtagcaatggaacagaggagaccattgatgccacgtctaaacctggcggcagcgcaaaagatg

SEQ ID NO: 58789 - DNA, 103 bp, Artificial Sequence
  Synthetic Polynucleotide
taatacgactcactatagggcgcgagctcaccaagtgtagacgtggtagcaacagaggagagctaccatgtctacacttaacctggcggcagcgcaaaagatg

SEQ ID NO: 58790 - DNA, 103 bp, Artificial Sequence
  Synthetic Polynucleotide
taatacgactcactatagggttaaacgcgagctcaccaagtgtagacgtgaacagaggagacacgtcatgacttggtgaaacctggcggcagcgcaaaagatg

SEQ ID NO: 58791 - DNA, 103 bp, Artificial Sequence
  Synthetic Polynucleotide
taatacgactcactatagggatctcttaaacgcgagctcaccaagtgtagaacagaggagactacacatggtgagctcgaacctggcggcagcgcaaaagatg

SEQ ID NO: 58792 - DNA, 103 bp, Artificial Sequence
  Synthetic Polynucleotide
taatacgactcactatagggaattttagaagatatagggagagtgacagtaacagaggagaactgtcatgctccctataaacctggcggcagcgcaaaagatg

SEQ ID NO: 58793 - DNA, 103 bp, Artificial Sequence
  Synthetic Polynucleotide
taatacgactcactatagggaagatgttcgcgtgtttttgtggcgattataacagaggagaataatcatgacaaaaacaaacctggcggcagcgcaaaagatg

SEQ ID NO: 58794 - DNA, 103 bp, Artificial Sequence
  Synthetic Polynucleotide
taatacgactcactatagggattgaatctcttaaacgcgagctcaccaagaacagaggagacttggtatgctcgcgtttaacctggcggcagcgcaaaagatg

SEQ ID NO: 58795 - DNA, 103 bp, Artificial Sequence
  Synthetic Polynucleotide
taatacgactcactataggggggaaattgaatctcttaaacgcgagctcaaacagaggagatgagctatggtttaagagaacctggcggcagcgcaaaagatg

SEQ ID NO: 58796 - DNA, 103 bp, Artificial Sequence
  Synthetic Polynucleotide
taatacgactcactatagggcaaacgggaaattgaatctcttaaacgcgaaacagaggagatcgcgtatgagagattcaaacctggcggcagcgcaaaagatg

SEQ ID NO: 58797 - DNA, 103 bp, Artificial Sequence
  Synthetic Polynucleotide
taatacgactcactatagggcaatacaaacgggaaattgaatctcttaaaaacagaggagatttaagatgttcaatttcaacctggcggcagcgcaaaagatg

SEQ ID NO: 58798 - DNA, 103 bp, Artificial Sequence
  Synthetic Polynucleotide
taatacgactcactatagggtggaccaatacaaacgggaaattgaatctcaacagaggagagagattatgtttcccgttaacctggcggcagcgcaaaagatg

SEQ ID NO: 58799 - DNA, 103 bp, Artificial Sequence
  Synthetic Polynucleotide
taatacgactcactatagggagacatggaccaatacaaacgggaaattgaaacagaggagatcaattatgcgtttgtataacctggcggcagcgcaaaagatg

SEQ ID NO: 58800 - DNA, 103 bp, Artificial Sequence
  Synthetic Polynucleotide
taatacgactcactatagggaatggagacatggaccaatacaaacgggaaaacagaggagattcccgatggtattggtcaacctggcggcagcgcaaaagatg

SEQ ID NO: 58801 - DNA, 103 bp, Artificial Sequence
  Synthetic Polynucleotide
taatacgactcactataggggcggcaatggagacatggaccaatacaaacaacagaggagagtttgtatgggtccatgtaacctggcggcagcgcaaaagatg

SEQ ID NO: 58802 - DNA, 103 bp, Artificial Sequence
  Synthetic Polynucleotide
taatacgactcactatagggtggttgcggcaatggagacatggaccaataaacagaggagatattggatgatgtctccaaacctggcggcagcgcaaaagatg

SEQ ID NO: 58803 - DNA, 103 bp, Artificial Sequence
  Synthetic Polynucleotide
taatacgactcactatagggtctaatggttgcggcaatggagacatggacaacagaggagagtccatatgtccattgccaacctggcggcagcgcaaaagatg

SEQ ID NO: 58804 - DNA, 103 bp, Artificial Sequence
  Synthetic Polynucleotide
taatacgactcactatagggtaggaaagatgttcgcgtgtttttgtggcgaacagaggagacgccacatgaacacgcgaaacctggcggcagcgcaaaagatg

SEQ ID NO: 58805 - DNA, 103 bp, Artificial Sequence
  Synthetic Polynucleotide
taatacgactcactataggggtaaatctaatggttgcggcaatggagacaaacagaggagatgtctcatgtgccgcaacaacctggcggcagcgcaaaagatg

SEQ ID NO: 58806 - DNA, 103 bp, Artificial Sequence
  Synthetic Polynucleotide
taatacgactcactatagggagcctgtaaatctaatggttgcggcaatggaacagaggagaccattgatgcaaccattaaacctggcggcagcgcaaaagatg

SEQ ID NO: 58807 - DNA, 103 bp, Artificial Sequence
  Synthetic Polynucleotide
taatacgactcactatagggctaacagcctgtaaatctaatggttgcggcaacagaggagagccgcaatgattagatttaacctggcggcagcgcaaaagatg

SEQ ID NO: 58808 - DNA, 103 bp, Artificial Sequence
  Synthetic Polynucleotide
taatacgactcactataggggacagctaacagcctgtaaatctaatggttaacagaggagaaaccatatgatttacaggaacctggcggcagcgcaaaagatg

SEQ ID NO: 58809 - DNA, 103 bp, Artificial Sequence
  Synthetic Polynucleotide
taatacgactcactatagggtgaacgacagctaacagcctgtaaatctaaaacagaggagattagatatgcaggctgttaacctggcggcagcgcaaaagatg

SEQ ID NO: 58810 - DNA, 103 bp, Artificial Sequence
  Synthetic Polynucleotide
taatacgactcactataggggatcttgaacgacagctaacagcctgtaaaaacagaggagatttacaatgtgttagctgaacctggcggcagcgcaaaagatg

SEQ ID NO: 58811 - DNA, 103 bp, Artificial Sequence
  Synthetic Polynucleotide
taatacgactcactatagggtttctgatcttgaacgacagctaacagcctaacagaggagaaggctgatggctgtcgttaacctggcggcagcgcaaaagatg

SEQ ID NO: 58812 - DNA, 103 bp, Artificial Sequence
  Synthetic Polynucleotide
taatacgactcactatagggccgtatttctgatcttgaacgacagctaacaacagaggagagttagcatgcgttcaagaaacctggcggcagcgcaaaagatg

SEQ ID NO: 58813 - DNA, 103 bp, Artificial Sequence
  Synthetic Polynucleotide
taatacgactcactatagggaaaaaccgtatttctgatcttgaacgacagaacagaggagactgtcgatgaagatcagaaacctggcggcagcgcaaaagatg

SEQ ID NO: 58814 - DNA, 103 bp, Artificial Sequence
  Synthetic Polynucleotide
taatacgactcactatagggccaagaaaaaccgtatttctgatcttgaacaacagaggagagttcaaatgcagaaatacaacctggcggcagcgcaaaagatg

SEQ ID NO: 58815 - DNA, 103 bp, Artificial Sequence
  Synthetic Polynucleotide
taatacgactcactatagggccatgtaggaaagatgttcgcgtgtttttgaacagaggagacaaaaaatggcgaacatcaacctggcggcagcgcaaaagatg

SEQ ID NO: 58816 - DNA, 103 bp, Artificial Sequence
  Synthetic Polynucleotide
taatacgactcactatagggcaattccaagaaaaaccgtatttctgatctaacagaggagaagatcaatgatacggtttaacctggcggcagcgcaaaagatg

SEQ ID NO: 58817 - DNA, 103 bp, Artificial Sequence
  Synthetic Polynucleotide
taatacgactcactataggggaaatcaattccaagaaaaaccgtatttctaacagaggagaagaaatatggtttttcttaacctggcggcagcgcaaaagatg

SEQ ID NO: 58818 - DNA, 103 bp, Artificial Sequence
  Synthetic Polynucleotide
taatacgactcactatagggttgacgaaatcaattccaagaaaaaccgtaaacagaggagatacggtatgtcttggaataacctggcggcagcgcaaaagatg

SEQ ID NO: 58819 - DNA, 103 bp, Artificial Sequence
  Synthetic Polynucleotide
taatacgactcactataggggtacattgacgaaatcaattccaagaaaaaaacagaggagatttttcatggaattgattaacctggcggcagcgcaaaagatg

SEQ ID NO: 58820 - DNA, 103 bp, Artificial Sequence
  Synthetic Polynucleotide
taatacgactcactataggggttaagtacattgacgaaatcaattccaagaacagaggagacttggaatggatttcgtcaacctggcggcagcgcaaaagatg

SEQ ID NO: 58821 - DNA, 103 bp, Artificial Sequence
  Synthetic Polynucleotide
taatacgactcactatagggatcatgttaagtacattgacgaaatcaattaacagaggagaaattgaatgcgtcaatgtaacctggcggcagcgcaaaagatg

SEQ ID NO: 58822 - DNA, 103 bp, Artificial Sequence
  Synthetic Polynucleotide
taatacgactcactatagggtgttaatcatgttaagtacattgacgaaataacagaggagaatttcgatgatgtacttaaacctggcggcagcgcaaaagatg

SEQ ID NO: 58823 - DNA, 103 bp, Artificial Sequence
  Synthetic Polynucleotide
taatacgactcactatagggttcgatgttaatcatgttaagtacattgacaacagaggagagtcaatatgcttaacatgaacctggcggcagcgcaaaagatg

SEQ ID NO: 58824 - DNA, 103 bp, Artificial Sequence
  Synthetic Polynucleotide
taatacgactcactatagggagtgtttcgatgttaatcatgttaagtacaaacagaggagatgtactatgcatgattaaaacctggcggcagcgcaaaagatg

SEQ ID NO: 58825 - DNA, 103 bp, Artificial Sequence
  Synthetic Polynucleotide
taatacgactcactatagggtaataagtgtttcgatgttaatcatgttaaaacagaggagattaacaatgttaacatcgaacctggcggcagcgcaaaagatg

SEQ ID NO: 58826 - DNA, 103 bp, Artificial Sequence
  Synthetic Polynucleotide
taatacgactcactatagggtttaaccatgtaggaaagatgttcgcgtgtaacagaggagaacacgcatgcatctttccaacctggcggcagcgcaaaagatg

SEQ ID NO: 58827 - DNA, 103 bp, Artificial Sequence
  Synthetic Polynucleotide
taatacgactcactataggggaacttaataagtgtttcgatgttaatcataacagaggagaatgattatgatcgaaacaaacctggcggcagcgcaaaagatg

SEQ ID NO: 58828 - DNA, 103 bp, Artificial Sequence
  Synthetic Polynucleotide
taatacgactcactatagggaaaaagaacttaataagtgtttcgatgttaaacagaggagataacatatgaacacttataacctggcggcagcgcaaaagatg

SEQ ID NO: 58829 - DNA, 103 bp, Artificial Sequence
  Synthetic Polynucleotide
taatacgactcactatagggattggaaaaagaacttaataagtgtttcgaaacagaggagatcgaaaatgttattaagtaacctggcggcagcgcaaaagatg

SEQ ID NO: 58830 - DNA, 103 bp, Artificial Sequence
  Synthetic Polynucleotide
taatacgactcactataggggtagaattggaaaaagaacttaataagtgtaacagaggagaacacttatgaagttctttaacctggcggcagcgcaaaagatg

SEQ ID NO: 58831 - DNA, 103 bp, Artificial Sequence
  Synthetic Polynucleotide
taatacgactcactatagggaaatcgtagaattggaaaaagaacttaataaacagaggagatattaaatgctttttccaaacctggcggcagcgcaaaagatg

SEQ ID NO: 58832 - DNA, 103 bp, Artificial Sequence
  Synthetic Polynucleotide
taatacgactcactatagggaaataaaatcgtagaattggaaaaagaactaacagaggagaagttctatgtccaattctaacctggcggcagcgcaaaagatg

SEQ ID NO: 58833 - DNA, 103 bp, Artificial Sequence
  Synthetic Polynucleotide
taatacgactcactataggggaaagaaataaaatcgtagaattggaaaaaaacagaggagatttttcatgttctacgataacctggcggcagcgcaaaagatg

SEQ ID NO: 58834 - DNA, 103 bp, Artificial Sequence
  Synthetic Polynucleotide
taatacgactcactatagggctcgcgaaagaaataaaatcgtagaattggaacagaggagaccaattatgcgattttataacctggcggcagcgcaaaagatg

SEQ ID NO: 58835 - DNA, 103 bp, Artificial Sequence
  Synthetic Polynucleotide
taatacgactcactatagggattgactcgcgaaagaaataaaatcgtagaaacagaggagatctacgatgttatttcttaacctggcggcagcgcaaaagatg

SEQ ID NO: 58836 - DNA, 103 bp, Artificial Sequence
  Synthetic Polynucleotide
taatacgactcactatagggagggaattgactcgcgaaagaaataaaatcaacagaggagagattttatgtctttcgcgaacctggcggcagcgcaaaagatg

SEQ ID NO: 58837 - DNA, 103 bp, Artificial Sequence
  Synthetic Polynucleotide
taatacgactcactatagggtgtactttaaccatgtaggaaagatgttcgaacagaggagacgaacaatgttcctacataacctggcggcagcgcaaaagatg

SEQ ID NO: 58838 - DNA, 103 bp, Artificial Sequence
  Synthetic Polynucleotide
taatacgactcactatagggacaggagggaattgactcgcgaaagaaataaacagaggagatatttcatgcgcgagtcaaacctggcggcagcgcaaaagatg

SEQ ID NO: 58839 - DNA, 103 bp, Artificial Sequence
  Synthetic Polynucleotide
taatacgactcactatagggctactacaggagggaattgactcgcgaaagaacagaggagactttcgatggtcaattccaacctggcggcagcgcaaaagatg

SEQ ID NO: 58840 - DNA, 103 bp, Artificial Sequence
  Synthetic Polynucleotide
taatacgactcactataggggatagctactacaggagggaattgactcgcaacagaggagagcgagtatgttccctcctaacctggcggcagcgcaaaagatg

SEQ ID NO: 58841 - DNA, 103 bp, Artificial Sequence
  Synthetic Polynucleotide
taatacgactcactatagggaaaccgatagctactacaggagggaattgaaacagaggagatcaattatgtcctgtagtaacctggcggcagcgcaaaagatg

SEQ ID NO: 58842 - DNA, 103 bp, Artificial Sequence
  Synthetic Polynucleotide
taatacgactcactatagggtgacaaaaccgatagctactacaggagggaaacagaggagatccctcatgtagtagctaaacctggcggcagcgcaaaagatg

SEQ ID NO: 58843 - DNA, 103 bp, Artificial Sequence
  Synthetic Polynucleotide
taatacgactcactataggggaatctgacaaaaccgatagctactacaggaacagaggagacctgtaatggctatcggtaacctggcggcagcgcaaaagatg

SEQ ID NO: 58844 - DNA, 103 bp, Artificial Sequence
  Synthetic Polynucleotide
taatacgactcactatagggagcgtgaatctgacaaaaccgatagctactaacagaggagaagtagcatgcggttttgtaacctggcggcagcgcaaaagatg

SEQ ID NO: 58845 - DNA, 103 bp, Artificial Sequence
  Synthetic Polynucleotide
taatacgactcactatagggtagagagcgtgaatctgacaaaaccgatagaacagaggagactatcgatgttgtcagataacctggcggcagcgcaaaagatg

SEQ ID NO: 58846 - DNA, 103 bp, Artificial Sequence
  Synthetic Polynucleotide
taatacgactcactatagggctacgtagagagcgtgaatctgacaaaaccaacagaggagaggttttatgagattcacgaacctggcggcagcgcaaaagatg

SEQ ID NO: 58847 - DNA, 103 bp, Artificial Sequence
  Synthetic Polynucleotide
taatacgactcactatagggaaagtctacgtagagagcgtgaatctgacaaacagaggagatgtcagatgcacgctctcaacctggcggcagcgcaaaagatg

SEQ ID NO: 58848 - DNA, 103 bp, Artificial Sequence
  Synthetic Polynucleotide
taatacgactcactataggggtacatgtactttaaccatgtaggaaagataacagaggagaatctttatgacatggttaaacctggcggcagcgcaaaagatg

SEQ ID NO: 58849 - DNA, 103 bp, Artificial Sequence
  Synthetic Polynucleotide
taatacgactcactataggggcaagaaagtctacgtagagagcgtgaatcaacagaggagagattcaatgtctctacgtaacctggcggcagcgcaaaagatg

SEQ ID NO: 58850 - DNA, 103 bp, Artificial Sequence
  Synthetic Polynucleotide
taatacgactcactatagggaacttgcaagaaagtctacgtagagagcgtaacagaggagaacgctcatgacgtagactaacctggcggcagcgcaaaagatg

SEQ ID NO: 58851 - DNA, 103 bp, Artificial Sequence
  Synthetic Polynucleotide
taatacgactcactatagggttagtaacttgcaagaaagtctacgtagagaacagaggagactctacatggactttcttaacctggcggcagcgcaaaagatg

SEQ ID NO: 58852 - DNA, 103 bp, Artificial Sequence
  Synthetic Polynucleotide
taatacgactcactatagggacaaattagtaacttgcaagaaagtctacgaacagaggagacgtagaatgtcttgcaagaacctggcggcagcgcaaaagatg

SEQ ID NO: 58853 - DNA, 103 bp, Artificial Sequence
  Synthetic Polynucleotide
taatacgactcactatagggagggaacaaattagtaacttgcaagaaagtaacagaggagaactttcatgcaagttactaacctggcggcagcgcaaaagatg

SEQ ID NO: 58854 - DNA, 103 bp, Artificial Sequence
  Synthetic Polynucleotide
taatacgactcactataggggtgtcagggaacaaattagtaacttgcaagaacagaggagacttgcaatgtactaatttaacctggcggcagcgcaaaagatg

SEQ ID NO: 58855 - DNA, 103 bp, Artificial Sequence
  Synthetic Polynucleotide
taatacgactcactatagggtggacgtgtcagggaacaaattagtaacttaacagaggagaaagttaatgatttgttccaacctggcggcagcgcaaaagatg

SEQ ID NO: 58856 - DNA, 103 bp, Artificial Sequence
  Synthetic Polynucleotide
taatacgactcactataggggaacttggacgtgtcagggaacaaattagtaacagaggagaactaatatgttccctgacaacctggcggcagcgcaaaagatg

SEQ ID NO: 58857 - DNA, 103 bp, Artificial Sequence
  Synthetic Polynucleotide
taatacgactcactatagggaaactgaacttggacgtgtcagggaacaaaaacagaggagatttgttatgtgacacgtcaacctggcggcagcgcaaaagatg

SEQ ID NO: 58858 - DNA, 103 bp, Artificial Sequence
  Synthetic Polynucleotide
taatacgactcactatagggatataaaactgaacttggacgtgtcagggaaacagaggagatccctgatgcgtccaagtaacctggcggcagcgcaaaagatg

SEQ ID NO: 58859 - DNA, 103 bp, Artificial Sequence
  Synthetic Polynucleotide
taatacgactcactataggggaattgtacatgtactttaaccatgtaggaaacagaggagatcctacatggttaaagtaaacctggcggcagcgcaaaagatg

SEQ ID NO: 58860 - DNA, 103 bp, Artificial Sequence
  Synthetic Polynucleotide
taatacgactcactatagggtcggcatataaaactgaacttggacgtgtcaacagaggagagacacgatgaagttcagtaacctggcggcagcgcaaaagatg

SEQ ID NO: 58861 - DNA, 103 bp, Artificial Sequence
  Synthetic Polynucleotide
taatacgactcactatagggtctattcggcatataaaactgaacttggacaacagaggagagtccaaatgcagttttataacctggcggcagcgcaaaagatg

SEQ ID NO: 58862 - DNA, 103 bp, Artificial Sequence
  Synthetic Polynucleotide
taatacgactcactatagggagaactctattcggcatataaaactgaactaacagaggagaagttcaatgttatatgccaacctggcggcagcgcaaaagatg

SEQ ID NO: 58863 - DNA, 103 bp, Artificial Sequence
  Synthetic Polynucleotide
taatacgactcactatagggaaatcagaactctattcggcatataaaactaacagaggagaagttttatgtgccgaataaacctggcggcagcgcaaaagatg

SEQ ID NO: 58864 - DNA, 103 bp, Artificial Sequence
  Synthetic Polynucleotide
taatacgactcactatagggaggataaatcagaactctattcggcatataaacagaggagatatatgatgaatagagttaacctggcggcagcgcaaaagatg

SEQ ID NO: 58865 - DNA, 103 bp, Artificial Sequence
  Synthetic Polynucleotide
taatacgactcactatagggcttaaaggataaatcagaactctattcggcaacagaggagagccgaaatgagttctgataacctggcggcagcgcaaaagatg

SEQ ID NO: 58866 - DNA, 103 bp, Artificial Sequence
  Synthetic Polynucleotide
taatacgactcactatagggatctgcttaaaggataaatcagaactctataacagaggagaatagagatgtgatttatcaacctggcggcagcgcaaaagatg

SEQ ID NO: 58867 - DNA, 103 bp, Artificial Sequence
  Synthetic Polynucleotide
taatacgactcactatagggtagagatctgcttaaaggataaatcagaacaacagaggagagttctgatgtatcctttaaacctggcggcagcgcaaaagatg

SEQ ID NO: 58868 - DNA, 103 bp, Artificial Sequence
  Synthetic Polynucleotide
taatacgactcactatagggatcgctagagatctgcttaaaggataaatcaacagaggagagatttaatgtttaagcagaacctggcggcagcgcaaaagatg

SEQ ID NO: 58869 - DNA, 103 bp, Artificial Sequence
  Synthetic Polynucleotide
taatacgactcactatagggaaacaatcgctagagatctgcttaaaggataacagaggagaatccttatggcagatctcaacctggcggcagcgcaaaagatg

SEQ ID NO: 58870 - DNA, 103 bp, Artificial Sequence
  Synthetic Polynucleotide
taatacgactcactatagggggatagaattgtacatgtactttaaccatgaacagaggagacatggtatgagtacatgtaacctggcggcagcgcaaaagatg

SEQ ID NO: 58871 - DNA, 103 bp, Artificial Sequence
  Synthetic Polynucleotide
taatacgactcactatagggatcttaaacaatcgctagagatctgcttaaaacagaggagattaagcatgtctctagcgaacctggcggcagcgcaaaagatg

SEQ ID NO: 58872 - DNA, 103 bp, Artificial Sequence
  Synthetic Polynucleotide
taatacgactcactatagggtagtgatcttaaacaatcgctagagatctgaacagaggagacagatcatgagcgattgtaacctggcggcagcgcaaaagatg

SEQ ID NO: 58873 - DNA, 103 bp, Artificial Sequence
  Synthetic Polynucleotide
taatacgactcactatagggagaattagtgatcttaaacaatcgctagagaacagaggagactctagatgttgtttaagaacctggcggcagcgcaaaagatg

SEQ ID NO: 58874 - DNA, 103 bp, Artificial Sequence
  Synthetic Polynucleotide
taatacgactcactatagggagactagaattagtgatcttaaacaatcgcaacagaggagagcgattatgtaagatcacaacctggcggcagcgcaaaagatg

SEQ ID NO: 58875 - DNA, 103 bp, Artificial Sequence
  Synthetic Polynucleotide
taatacgactcactataggggctaaagactagaattagtgatcttaaacaaacagaggagatgtttaatgtcactaattaacctggcggcagcgcaaaagatg

SEQ ID NO: 58876 - DNA, 103 bp, Artificial Sequence
  Synthetic Polynucleotide
taatacgactcactatagggaataggctaaagactagaattagtgatcttaacagaggagaaagatcatgaattctagtaacctggcggcagcgcaaaagatg

SEQ ID NO: 58877 - DNA, 103 bp, Artificial Sequence
  Synthetic Polynucleotide
taatacgactcactatagggaggtaaataggctaaagactagaattagtgaacagaggagacactaaatgtagtctttaaacctggcggcagcgcaaaagatg

SEQ ID NO: 58878 - DNA, 103 bp, Artificial Sequence
  Synthetic Polynucleotide
taatacgactcactatagggtgaggaggtaaataggctaaagactagaataacagaggagaattctaatgtttagcctaaacctggcggcagcgcaaaagatg

SEQ ID NO: 58879 - DNA, 103 bp, Artificial Sequence
  Synthetic Polynucleotide
taatacgactcactatagggtcttctgaggaggtaaataggctaaagactaacagaggagaagtcttatgcctatttacaacctggcggcagcgcaaaagatg

SEQ ID NO: 58880 - DNA, 103 bp, Artificial Sequence
  Synthetic Polynucleotide
taatacgactcactataggggaacatcttctgaggaggtaaataggctaaaacagaggagattagccatgttacctcctaacctggcggcagcgcaaaagatg

SEQ ID NO: 58881 - DNA, 103 bp, Artificial Sequence
  Synthetic Polynucleotide
taatacgactcactatagggcaaatggatagaattgtacatgtactttaaaacagaggagattaaagatgatgtacaataacctggcggcagcgcaaaagatg

SEQ ID NO: 58882 - DNA, 103 bp, Artificial Sequence
  Synthetic Polynucleotide
taatacgactcactatagggtaacggaacatcttctgaggaggtaaatagaacagaggagactatttatgtcctcagaaaacctggcggcagcgcaaaagatg

SEQ ID NO: 58883 - DNA, 103 bp, Artificial Sequence
  Synthetic Polynucleotide
taatacgactcactatagggaacggtaacggaacatcttctgaggaggtaaacagaggagatacctcatgagaagatgtaacctggcggcagcgcaaaagatg

SEQ ID NO: 58884 - DNA, 103 bp, Artificial Sequence
  Synthetic Polynucleotide
taatacgactcactatagggaacgcaacggtaacggaacatcttctgaggaacagaggagacctcagatgatgttccgtaacctggcggcagcgcaaaagatg

SEQ ID NO: 58885 - DNA, 103 bp, Artificial Sequence
  Synthetic Polynucleotide
taatacgactcactataggggtgtaaacgcaacggtaacggaacatcttcaacagaggagagaagatatgccgttaccgaacctggcggcagcgcaaaagatg

SEQ ID NO: 58886 - DNA, 103 bp, Artificial Sequence
  Synthetic Polynucleotide
taatacgactcactatagggaacgagtgtaaacgcaacggtaacggaacaaacagaggagatgttccatgaccgttgcgaacctggcggcagcgcaaaagatg

SEQ ID NO: 58887 - DNA, 103 bp, Artificial Sequence
  Synthetic Polynucleotide
taatacgactcactatagggagcttaacgagtgtaaacgcaacggtaacgaacagaggagacgttacatgtgcgtttacaacctggcggcagcgcaaaagatg

SEQ ID NO: 58888 - DNA, 103 bp, Artificial Sequence
  Synthetic Polynucleotide
taatacgactcactatagggtagacagcttaacgagtgtaaacgcaacggaacagaggagaccgttgatgttacactcgaacctggcggcagcgcaaaagatg

SEQ ID NO: 58889 - DNA, 103 bp, Artificial Sequence
  Synthetic Polynucleotide
taatacgactcactatagggcttgatagacagcttaacgagtgtaaacgcaacagaggagagcgtttatgctcgttaagaacctggcggcagcgcaaaagatg

SEQ ID NO: 58890 - DNA, 103 bp, Artificial Sequence
  Synthetic Polynucleotide
taatacgactcactatagggtggatcttgatagacagcttaacgagtgtaaacagaggagatacactatgtaagctgtcaacctggcggcagcgcaaaagatg

SEQ ID NO: 58891 - DNA, 103 bp, Artificial Sequence
  Synthetic Polynucleotide
taatacgactcactatagggaatcatggatcttgatagacagcttaacgaaacagaggagatcgttaatgtgtctatcaaacctggcggcagcgcaaaagatg

SEQ ID NO: 58892 - DNA, 103 bp, Artificial Sequence
  Synthetic Polynucleotide
taatacgactcactataggggaagacaaatggatagaattgtacatgtacaacagaggagagtacatatgcaattctataacctggcggcagcgcaaaagatg

SEQ ID NO: 58893 - DNA, 103 bp, Artificial Sequence
  Synthetic Polynucleotide
taatacgactcactataggggatagaatcatggatcttgatagacagcttaacagaggagaaagctgatgatcaagatcaacctggcggcagcgcaaaagatg

SEQ ID NO: 58894 - DNA, 103 bp, Artificial Sequence
  Synthetic Polynucleotide
taatacgactcactatagggttagagatagaatcatggatcttgatagacaacagaggagagtctatatggatccatgaaacctggcggcagcgcaaaagatg

SEQ ID NO: 58895 - DNA, 103 bp, Artificial Sequence
  Synthetic Polynucleotide
taatacgactcactatagggacgtcttagagatagaatcatggatcttgaaacagaggagatcaagaatgatgattctaaacctggcggcagcgcaaaagatg

SEQ ID NO: 58896 - DNA, 103 bp, Artificial Sequence
  Synthetic Polynucleotide
taatacgactcactatagggatacaacgtcttagagatagaatcatggataacagaggagaatccatatgtctatctctaacctggcggcagcgcaaaagatg

SEQ ID NO: 58897 - DNA, 103 bp, Artificial Sequence
  Synthetic Polynucleotide
taatacgactcactatagggaagagatacaacgtcttagagatagaatcaaacagaggagatgattcatgctctaagacaacctggcggcagcgcaaaagatg

SEQ ID NO: 58898 - DNA, 103 bp, Artificial Sequence
  Synthetic Polynucleotide
taatacgactcactatagggggaaaaagagatacaacgtcttagagatagaacagaggagactatctatgagacgttgtaacctggcggcagcgcaaaagatg

SEQ ID NO: 58899 - DNA, 103 bp, Artificial Sequence
  Synthetic Polynucleotide
taatacgactcactataggggatatggaaaaagagatacaacgtcttagaaacagaggagatctaagatgttgtatctcaacctggcggcagcgcaaaagatg

SEQ ID NO: 58900 - DNA, 103 bp, Artificial Sequence
  Synthetic Polynucleotide
taatacgactcactatagggatgctgatatggaaaaagagatacaacgtcaacagaggagagacgttatgtctctttttaacctggcggcagcgcaaaagatg

SEQ ID NO: 58901 - DNA, 103 bp, Artificial Sequence
  Synthetic Polynucleotide
taatacgactcactatagggaagcaatgctgatatggaaaaagagatacaaacagaggagatgtatcatgttttccataaacctggcggcagcgcaaaagatg

SEQ ID NO: 58902 - DNA, 103 bp, Artificial Sequence
  Synthetic Polynucleotide
taatacgactcactatagggaatgaaagcaatgctgatatggaaaaagagaacagaggagactctttatgcatatcagcaacctggcggcagcgcaaaagatg

SEQ ID NO: 58903 - DNA, 103 bp, Artificial Sequence
  Synthetic Polynucleotide
taatacgactcactatagggtttgtaattttagaagatatagggagagtgaacagaggagacactctatgtatatcttcaacctggcggcagcgcaaaagatg

SEQ ID NO: 58904 - DNA, 103 bp, Artificial Sequence
  Synthetic Polynucleotide
taatacgactcactatagggttaaggaagacaaatggatagaattgtacaaacagaggagatgtacaatgctatccattaacctggcggcagcgcaaaagatg

SEQ ID NO: 58905 - DNA, 103 bp, Artificial Sequence
  Synthetic Polynucleotide
taatacgactcactataggggtaataatgaaagcaatgctgatatggaaaaacagaggagatttccaatgcagcattgcaacctggcggcagcgcaaaagatg

SEQ ID NO: 58906 - DNA, 103 bp, Artificial Sequence
  Synthetic Polynucleotide
taatacgactcactatagggcagacgtaataatgaaagcaatgctgatataacagaggagaatatcaatgttgctttcaaacctggcggcagcgcaaaagatg

SEQ ID NO: 58907 - DNA, 103 bp, Artificial Sequence
  Synthetic Polynucleotide
taatacgactcactataggggactacagacgtaataatgaaagcaatgctaacagaggagaagcattatgttcattattaacctggcggcagcgcaaaagatg

SEQ ID NO: 58908 - DNA, 103 bp, Artificial Sequence
  Synthetic Polynucleotide
taatacgactcactatagggtaagtgactacagacgtaataatgaaagcaaacagaggagatgctttatgtattacgtcaacctggcggcagcgcaaaagatg

SEQ ID NO: 58909 - DNA, 103 bp, Artificial Sequence
  Synthetic Polynucleotide
taatacgactcactatagggatagttaagtgactacagacgtaataatgaaacagaggagatcattaatgcgtctgtagaacctggcggcagcgcaaaagatg

SEQ ID NO: 58910 - DNA, 103 bp, Artificial Sequence
  Synthetic Polynucleotide
taatacgactcactataggggaaagatagttaagtgactacagacgtaataacagaggagaattacgatggtagtcactaacctggcggcagcgcaaaagatg

SEQ ID NO: 58911 - DNA, 103 bp, Artificial Sequence
  Synthetic Polynucleotide
taatacgactcactatagggatcttgaaagatagttaagtgactacagacaacagaggagagtctgtatgcacttaactaacctggcggcagcgcaaaagatg

SEQ ID NO: 58912 - DNA, 103 bp, Artificial Sequence
  Synthetic Polynucleotide
taatacgactcactatagggttcaaatcttgaaagatagttaagtgactaaacagaggagatagtcaatgaactatcttaacctggcggcagcgcaaaagatg

SEQ ID NO: 58913 - DNA, 103 bp, Artificial Sequence
  Synthetic Polynucleotide
taatacgactcactatagggagaatttcaaatcttgaaagatagttaagtaacagaggagaacttaaatgtctttcaagaacctggcggcagcgcaaaagatg

SEQ ID NO: 58914 - DNA, 103 bp, Artificial Sequence
  Synthetic Polynucleotide
taatacgactcactataggggagatagaatttcaaatcttgaaagatagtaacagaggagaactatcatgcaagatttgaacctggcggcagcgcaaaagatg

SEQ ID NO: 58915 - DNA, 103 bp, Artificial Sequence
  Synthetic Polynucleotide
taatacgactcactatagggtatagttaaggaagacaaatggatagaattaacagaggagaaattctatgcatttgtctaacctggcggcagcgcaaaagatg

SEQ ID NO: 58916 - DNA, 103 bp, Artificial Sequence
  Synthetic Polynucleotide
taatacgactcactatagggtcttagagatagaatttcaaatcttgaaagaacagaggagactttcaatgtttgaaattaacctggcggcagcgcaaaagatg

SEQ ID NO: 58917 - DNA, 103 bp, Artificial Sequence
  Synthetic Polynucleotide
taatacgactcactatagggagacgtcttagagatagaatttcaaatcttaacagaggagaaagattatgaattctatcaacctggcggcagcgcaaaagatg

SEQ ID NO: 58918 - DNA, 103 bp, Artificial Sequence
  Synthetic Polynucleotide
taatacgactcactatagggaaatgagacgtcttagagatagaatttcaaaacagaggagattgaaaatgtatctctaaaacctggcggcagcgcaaaagatg

SEQ ID NO: 58919 - DNA, 103 bp, Artificial Sequence
  Synthetic Polynucleotide
taatacgactcactataggggatagaaatgagacgtcttagagatagaataacagaggagaattctaatgctaagacgtaacctggcggcagcgcaaaagatg

SEQ ID NO: 58920 - DNA, 103 bp, Artificial Sequence
  Synthetic Polynucleotide
taatacgactcactatagggaaacagatagaaatgagacgtcttagagataacagaggagaatctctatgacgtctcataacctggcggcagcgcaaaagatg

SEQ ID NO: 58921 - DNA, 103 bp, Artificial Sequence
  Synthetic Polynucleotide
taatacgactcactatagggtaccgaaacagatagaaatgagacgtcttaaacagaggagataagacatgtcatttctaaacctggcggcagcgcaaaagatg

SEQ ID NO: 58922 - DNA, 103 bp, Artificial Sequence
  Synthetic Polynucleotide
taatacgactcactatagggaccaataccgaaacagatagaaatgagacgaacagaggagacgtctcatgtctatctgtaacctggcggcagcgcaaaagatg

SEQ ID NO: 58923 - DNA, 103 bp, Artificial Sequence
  Synthetic Polynucleotide
taatacgactcactatagggataagaccaataccgaaacagatagaaatgaacagaggagacatttcatgctgtttcggaacctggcggcagcgcaaaagatg

SEQ ID NO: 58924 - DNA, 103 bp, Artificial Sequence
  Synthetic Polynucleotide
taatacgactcactatagggtaataataagaccaataccgaaacagatagaacagaggagactatctatgtcggtattgaacctggcggcagcgcaaaagatg

SEQ ID NO: 58925 - DNA, 103 bp, Artificial Sequence
  Synthetic Polynucleotide
taatacgactcactatagggagacataataataagaccaataccgaaacaaacagaggagatgtttcatgattggtcttaacctggcggcagcgcaaaagatg

SEQ ID NO: 58926 - DNA, 103 bp, Artificial Sequence
  Synthetic Polynucleotide
taatacgactcactatagggaaatatatagttaaggaagacaaatggataaacagaggagatatccaatggtcttccttaacctggcggcagcgcaaaagatg

SEQ ID NO: 58927 - DNA, 103 bp, Artificial Sequence
  Synthetic Polynucleotide
taatacgactcactatagggactgtagacataataataagaccaataccgaacagaggagacggtatatgtcttattataacctggcggcagcgcaaaagatg

SEQ ID NO: 58928 - DNA, 103 bp, Artificial Sequence
  Synthetic Polynucleotide
taatacgactcactataggggaacgactgtagacataataataagaccaaaacagaggagattggtcatgttattatgtaacctggcggcagcgcaaaagatg

SEQ ID NO: 58929 - DNA, 103 bp, Artificial Sequence
  Synthetic Polynucleotide
taatacgactcactatagggcagttgaacgactgtagacataataataagaacagaggagacttattatgatgtctacaaacctggcggcagcgcaaaagatg

SEQ ID NO: 58930 - DNA, 103 bp, Artificial Sequence
  Synthetic Polynucleotide
taatacgactcactatagggaaagacagttgaacgactgtagacataataaacagaggagatattatatgtacagtcgtaacctggcggcagcgcaaaagatg

SEQ ID NO: 58931 - DNA, 103 bp, Artificial Sequence
  Synthetic Polynucleotide
taatacgactcactatagggtcttgaaagacagttgaacgactgtagacaaacagaggagatgtctaatgtcgttcaacaacctggcggcagcgcaaaagatg

SEQ ID NO: 58932 - DNA, 103 bp, Artificial Sequence
  Synthetic Polynucleotide
taatacgactcactatagggttagatcttgaaagacagttgaacgactgtaacagaggagaacagtcatgcaactgtctaacctggcggcagcgcaaaagatg

SEQ ID NO: 58933 - DNA, 103 bp, Artificial Sequence
  Synthetic Polynucleotide
taatacgactcactataggggaatattagatcttgaaagacagttgaacgaacagaggagacgttcaatggtctttcaaaacctggcggcagcgcaaaagatg

SEQ ID NO: 58934 - DNA, 103 bp, Artificial Sequence
  Synthetic Polynucleotide
taatacgactcactatagggatctagaatattagatcttgaaagacagttaacagaggagaaactgtatgtcaagatctaacctggcggcagcgcaaaagatg

SEQ ID NO: 58935 - DNA, 103 bp, Artificial Sequence
  Synthetic Polynucleotide
taatacgactcactatagggctccaatctagaatattagatcttgaaagaaacagaggagatctttcatgatctaatataacctggcggcagcgcaaaagatg

SEQ ID NO: 58936 - DNA, 103 bp, Artificial Sequence
  Synthetic Polynucleotide
taatacgactcactataggggtagactccaatctagaatattagatcttgaacagaggagacaagatatgatattctagaacctggcggcagcgcaaaagatg

SEQ ID NO: 58937 - DNA, 103 bp, Artificial Sequence
  Synthetic Polynucleotide
taatacgactcactatagggtatacaaatatatagttaaggaagacaaataacagaggagaatttgtatgccttaactaaacctggcggcagcgcaaaagatg

SEQ ID NO: 58938 - DNA, 103 bp, Artificial Sequence
  Synthetic Polynucleotide
taatacgactcactataggggattagtagactccaatctagaatattagaaacagaggagatctaatatgctagattggaacctggcggcagcgcaaaagatg

SEQ ID NO: 58939 - DNA, 103 bp, Artificial Sequence
  Synthetic Polynucleotide
taatacgactcactatagggacagagattagtagactccaatctagaataaacagaggagatattctatgttggagtctaacctggcggcagcgcaaaagatg

SEQ ID NO: 58940 - DNA, 103 bp, Artificial Sequence
  Synthetic Polynucleotide
taatacgactcactatagggatcttacagagattagtagactccaatctaaacagaggagatagattatggtctactaaaacctggcggcagcgcaaaagatg

SEQ ID NO: 58941 - DNA, 103 bp, Artificial Sequence
  Synthetic Polynucleotide
taatacgactcactatagggaggaaatcttacagagattagtagactccaaacagaggagatggagtatgctaatctctaacctggcggcagcgcaaaagatg

SEQ ID NO: 58942 - DNA, 103 bp, Artificial Sequence
  Synthetic Polynucleotide
taatacgactcactatagggggaggaggaaatcttacagagattagtagaaacagaggagatctactatgctctgtaagaacctggcggcagcgcaaaagatg

SEQ ID NO: 58943 - DNA, 103 bp, Artificial Sequence
  Synthetic Polynucleotide
taatacgactcactatagggagagcggaggaggaaatcttacagagattaaacagaggagataatctatgtaagatttcaacctggcggcagcgcaaaagatg

SEQ ID NO: 58944 - DNA, 103 bp, Artificial Sequence
  Synthetic Polynucleotide
taatacgactcactatagggcattgagagcggaggaggaaatcttacagaaacagaggagatctgtaatgtttcctcctaacctggcggcagcgcaaaagatg

SEQ ID NO: 58945 - DNA, 103 bp, Artificial Sequence
  Synthetic Polynucleotide
taatacgactcactataggggactgcattgagagcggaggaggaaatcttaacagaggagaaagattatgtcctccgctaacctggcggcagcgcaaaagatg

SEQ ID NO: 58946 - DNA, 103 bp, Artificial Sequence
  Synthetic Polynucleotide
taatacgactcactatagggtgaccgactgcattgagagcggaggaggaaaacagaggagattcctcatgcgctctcaaaacctggcggcagcgcaaaagatg

SEQ ID NO: 58947 - DNA, 103 bp, Artificial Sequence
  Synthetic Polynucleotide
taatacgactcactatagggtaagttgaccgactgcattgagagcggaggaacagaggagacctccgatgtcaatgcagaacctggcggcagcgcaaaagatg

SEQ ID NO: 58948 - DNA, 103 bp, Artificial Sequence
  Synthetic Polynucleotide
taatacgactcactatagggttatctatacaaatatatagttaaggaagaaacagaggagatcttccatgactatatataacctggcggcagcgcaaaagatg

SEQ ID NO: 58949 - DNA, 103 bp, Artificial Sequence
  Synthetic Polynucleotide
taatacgactcactataggggagaataagttgaccgactgcattgagagcaacagaggagagctctcatggcagtcggtaacctggcggcagcgcaaaagatg

SEQ ID NO: 58950 - DNA, 103 bp, Artificial Sequence
  Synthetic Polynucleotide
taatacgactcactatagggaactagagaataagttgaccgactgcattgaacagaggagacaatgcatgcggtcaactaacctggcggcagcgcaaaagatg

SEQ ID NO: 58951 - DNA, 103 bp, Artificial Sequence
  Synthetic Polynucleotide
taatacgactcactatagggtagcgaactagagaataagttgaccgactgaacagaggagacagtcgatgaacttattcaacctggcggcagcgcaaaagatg

SEQ ID NO: 58952 - DNA, 103 bp, Artificial Sequence
  Synthetic Polynucleotide
taatacgactcactatagggcgtattagcgaactagagaataagttgaccaacagaggagaggtcaaatgattctctagaacctggcggcagcgcaaaagatg

SEQ ID NO: 58953 - DNA, 103 bp, Artificial Sequence
  Synthetic Polynucleotide
taatacgactcactataggggttcgcgtattagcgaactagagaataagtaacagaggagaacttatatgctagttcgcaacctggcggcagcgcaaaagatg

SEQ ID NO: 58954 - DNA, 103 bp, Artificial Sequence
  Synthetic Polynucleotide
taatacgactcactatagggactgcgttcgcgtattagcgaactagagaaaacagaggagattctctatgtcgctaataaacctggcggcagcgcaaaagatg

SEQ ID NO: 58955 - DNA, 103 bp, Artificial Sequence
  Synthetic Polynucleotide
taatacgactcactataggggatgcactgcgttcgcgtattagcgaactaaacagaggagatagttcatgaatacgcgaaacctggcggcagcgcaaaagatg

SEQ ID NO: 58956 - DNA, 103 bp, Artificial Sequence
  Synthetic Polynucleotide
taatacgactcactatagggaagttgatgcactgcgttcgcgtattagcgaacagaggagacgctaaatggcgaacgcaaacctggcggcagcgcaaaagatg

SEQ ID NO: 58957 - DNA, 103 bp, Artificial Sequence
  Synthetic Polynucleotide
taatacgactcactataggggcaagaagttgatgcactgcgttcgcgtataacagaggagaatacgcatgcgcagtgcaaacctggcggcagcgcaaaagatg

SEQ ID NO: 58958 - DNA, 103 bp, Artificial Sequence
  Synthetic Polynucleotide
taatacgactcactataggggacacgcaagaagttgatgcactgcgttcgaacagaggagacgaacgatgtgcatcaacaacctggcggcagcgcaaaagatg

SEQ ID NO: 58959 - DNA, 103 bp, Artificial Sequence
  Synthetic Polynucleotide
taatacgactcactatagggcgtaattatctatacaaatatatagttaagaacagaggagacttaacatgatatttgtaaacctggcggcagcgcaaaagatg

SEQ ID NO: 58960 - DNA, 103 bp, Artificial Sequence
  Synthetic Polynucleotide
taatacgactcactatagggagaaagacacgcaagaagttgatgcactgcaacagaggagagcagtgatgcaacttcttaacctggcggcagcgcaaaagatg

SEQ ID NO: 58961 - DNA, 103 bp, Artificial Sequence
  Synthetic Polynucleotide
taatacgactcactatagggcaaccagaaagacacgcaagaagttgatgcaacagaggagagcatcaatgtcttgcgtgaacctggcggcagcgcaaaagatg

SEQ ID NO: 58962 - DNA, 103 bp, Artificial Sequence
  Synthetic Polynucleotide
taatacgactcactatagggacacacaaccagaaagacacgcaagaagttaacagaggagaaacttcatgcgtgtctttaacctggcggcagcgcaaaagatg

SEQ ID NO: 58963 - DNA, 103 bp, Artificial Sequence
  Synthetic Polynucleotide
taatacgactcactatagggaatgtacacacaaccagaaagacacgcaagaacagaggagacttgcgatgctttctggtaacctggcggcagcgcaaaagatg

SEQ ID NO: 58964 - DNA, 103 bp, Artificial Sequence
  Synthetic Polynucleotide
taatacgactcactatagggcgatgaatgtacacacaaccagaaagacacaacagaggagagtgtctatgtggttgtgtaacctggcggcagcgcaaaagatg

SEQ ID NO: 58965 - DNA, 103 bp, Artificial Sequence
  Synthetic Polynucleotide
taatacgactcactatagggagactcgatgaatgtacacacaaccagaaaaacagaggagatttctgatggtgtgtacaaacctggcggcagcgcaaaagatg

SEQ ID NO: 58966 - DNA, 103 bp, Artificial Sequence
  Synthetic Polynucleotide
taatacgactcactatagggaatctagactcgatgaatgtacacacaaccaacagaggagaggttgtatgtacattcataacctggcggcagcgcaaaagatg

SEQ ID NO: 58967 - DNA, 103 bp, Artificial Sequence
  Synthetic Polynucleotide
taatacgactcactatagggtctcgaatctagactcgatgaatgtacacaaacagaggagatgtgtaatgtcatcgagtaacctggcggcagcgcaaaagatg

SEQ ID NO: 58968 - DNA, 103 bp, Artificial Sequence
  Synthetic Polynucleotide
taatacgactcactatagggagagatctcgaatctagactcgatgaatgtaacagaggagaacattcatggagtctagaaacctggcggcagcgcaaaagatg

SEQ ID NO: 58969 - DNA, 103 bp, Artificial Sequence
  Synthetic Polynucleotide
taatacgactcactataggggcgttagagatctcgaatctagactcgatgaacagaggagacatcgaatgtagattcgaaacctggcggcagcgcaaaagatg

SEQ ID NO: 58970 - DNA, 103 bp, Artificial Sequence
  Synthetic Polynucleotide
taatacgactcactatagggagactcgtaattatctatacaaatatatagaacagaggagactatatatgtgtatagataacctggcggcagcgcaaaagatg

SEQ ID NO: 58971 - DNA, 103 bp, Artificial Sequence
  Synthetic Polynucleotide
taatacgactcactatagggacgacgcgttagagatctcgaatctagactaacagaggagaagtctaatgtcgagatctaacctggcggcagcgcaaaagatg

SEQ ID NO: 58972 - DNA, 103 bp, Artificial Sequence
  Synthetic Polynucleotide
taatacgactcactataggggaacgacgacgcgttagagatctcgaatctaacagaggagaagattcatgatctctaacaacctggcggcagcgcaaaagatg

SEQ ID NO: 58973 - DNA, 103 bp, Artificial Sequence
  Synthetic Polynucleotide
taatacgactcactatagggaggaagaacgacgacgcgttagagatctcgaacagaggagacgagatatgtaacgcgtcaacctggcggcagcgcaaaagatg

SEQ ID NO: 58974 - DNA, 103 bp, Artificial Sequence
  Synthetic Polynucleotide
taatacgactcactatagggacttgaggaagaacgacgacgcgttagagaaacagaggagatctctaatgcgtcgtcgtaacctggcggcagcgcaaaagatg

SEQ ID NO: 58975 - DNA, 103 bp, Artificial Sequence
  Synthetic Polynucleotide
taatacgactcactatagggggagaacttgaggaagaacgacgacgcgttaacagaggagaaacgcgatgtcgttcttcaacctggcggcagcgcaaaagatg

SEQ ID NO: 58976 - DNA, 103 bp, Artificial Sequence
  Synthetic Polynucleotide
taatacgactcactatagggtacgcggagaacttgaggaagaacgacgacaacagaggagagtcgtcatgcttcctcaaaacctggcggcagcgcaaaagatg

SEQ ID NO: 58977 - DNA, 103 bp, Artificial Sequence
  Synthetic Polynucleotide
taatacgactcactatagggtgcagtacgcggagaacttgaggaagaacgaacagaggagacgttctatgtcaagttctaacctggcggcagcgcaaaagatg

SEQ ID NO: 58978 - DNA, 103 bp, Artificial Sequence
  Synthetic Polynucleotide
taatacgactcactatagggctttctgcagtacgcggagaacttgaggaaaacagaggagattcctcatgttctccgcgaacctggcggcagcgcaaaagatg

SEQ ID NO: 58979 - DNA, 103 bp, Artificial Sequence
  Synthetic Polynucleotide
taatacgactcactatagggacacgctttctgcagtacgcggagaacttgaacagaggagacaagttatgcgcgtactgaacctggcggcagcgcaaaagatg

SEQ ID NO: 58980 - DNA, 103 bp, Artificial Sequence
  Synthetic Polynucleotide
taatacgactcactatagggtagggacacgctttctgcagtacgcggagaaacagaggagatctccgatgactgcagaaaacctggcggcagcgcaaaagatg

SEQ ID NO: 58981 - DNA, 103 bp, Artificial Sequence
  Synthetic Polynucleotide
taatacgactcactatagggacacgagactcgtaattatctatacaaataaacagaggagatatttgatgagataattaaacctggcggcagcgcaaaagatg

SEQ ID NO: 58982 - DNA, 103 bp, Artificial Sequence
  Synthetic Polynucleotide
taatacgactcactatagggcaagatagggacacgctttctgcagtacgcaacagaggagagcgtacatgagaaagcgtaacctggcggcagcgcaaaagatg

SEQ ID NO: 58983 - DNA, 103 bp, Artificial Sequence
  Synthetic Polynucleotide
taatacgactcactatagggatcaacaagatagggacacgctttctgcagaacagaggagactgcagatggcgtgtcccaacctggcggcagcgcaaaagatg

SEQ ID NO: 58984 - DNA, 103 bp, Artificial Sequence
  Synthetic Polynucleotide
taatacgactcactatagggtaaatatcaacaagatagggacacgctttcaacagaggagagaaagcatgtccctatctaacctggcggcagcgcaaaagatg

SEQ ID NO: 58985 - DNA, 103 bp, Artificial Sequence
  Synthetic Polynucleotide
taatacgactcactatagggattgctaaatatcaacaagatagggacacgaacagaggagacgtgtcatgatcttgttgaacctggcggcagcgcaaaagatg

SEQ ID NO: 58986 - DNA, 103 bp, Artificial Sequence
  Synthetic Polynucleotide
taatacgactcactatagggcagaaattgctaaatatcaacaagatagggaacagaggagaccctatatggttgatattaacctggcggcagcgcaaaagatg

SEQ ID NO: 58987 - DNA, 103 bp, Artificial Sequence
  Synthetic Polynucleotide
taatacgactcactatagggagaatcagaaattgctaaatatcaacaagaaacagaggagatcttgtatgtatttagcaaacctggcggcagcgcaaaagatg

SEQ ID NO: 58988 - DNA, 103 bp, Artificial Sequence
  Synthetic Polynucleotide
taatacgactcactatagggactctagaatcagaaattgctaaatatcaaaacagaggagattgataatgagcaatttcaacctggcggcagcgcaaaagatg

SEQ ID NO: 58989 - DNA, 103 bp, Artificial Sequence
  Synthetic Polynucleotide
taatacgactcactatagggtcagtactctagaatcagaaattgctaaataacagaggagaatttagatgtttctgattaacctggcggcagcgcaaaagatg

SEQ ID NO: 58990 - DNA, 103 bp, Artificial Sequence
  Synthetic Polynucleotide
taatacgactcactatagggcagaatcagtactctagaatcagaaattgcaacagaggagagcaattatggattctagaaacctggcggcagcgcaaaagatg

SEQ ID NO: 58991 - DNA, 103 bp, Artificial Sequence
  Synthetic Polynucleotide
taatacgactcactataggggtgagcagaatcagtactctagaatcagaaaacagaggagattctgaatgtagagtactaacctggcggcagcgcaaaagatg

SEQ ID NO: 58992 - DNA, 103 bp, Artificial Sequence
  Synthetic Polynucleotide
taatacgactcactatagggattacacacgagactcgtaattatctatacaacagaggagagtatagatgattacgagtaacctggcggcagcgcaaaagatg

SEQ ID NO: 58993 - DNA, 103 bp, Artificial Sequence
  Synthetic Polynucleotide
taatacgactcactatagggactacgtgagcagaatcagtactctagaataacagaggagaattctaatgtactgattcaacctggcggcagcgcaaaagatg

SEQ ID NO: 58994 - DNA, 103 bp, Artificial Sequence
  Synthetic Polynucleotide
taatacgactcactatagggtagtaactacgtgagcagaatcagtactctaacagaggagaagagtaatgattctgctcaacctggcggcagcgcaaaagatg

SEQ ID NO: 58995 - DNA, 103 bp, Artificial Sequence
  Synthetic Polynucleotide
taatacgactcactatagggactattagtaactacgtgagcagaatcagtaacagaggagaactgatatggctcacgtaaacctggcggcagcgcaaaagatg

SEQ ID NO: 58996 - DNA, 103 bp, Artificial Sequence
  Synthetic Polynucleotide
taatacgactcactatagggagacaactattagtaactacgtgagcagaaaacagaggagattctgcatgcgtagttacaacctggcggcagcgcaaaagatg

SEQ ID NO: 58997 - DNA, 103 bp, Artificial Sequence
  Synthetic Polynucleotide
taatacgactcactatagggggctaagacaactattagtaactacgtgagaacagaggagactcacgatgttactaataaacctggcggcagcgcaaaagatg

SEQ ID NO: 58998 - DNA, 103 bp, Artificial Sequence
  Synthetic Polynucleotide
taatacgactcactataggggataaggctaagacaactattagtaactacaacagaggagagtagttatgaatagttgtaacctggcggcagcgcaaaagatg

SEQ ID NO: 58999 - DNA, 103 bp, Artificial Sequence
  Synthetic Polynucleotide
taatacgactcactatagggaacttgataaggctaagacaactattagtaaacagaggagatactaaatgttgtcttagaacctggcggcagcgcaaaagatg

SEQ ID NO: 59000 - DNA, 103 bp, Artificial Sequence
  Synthetic Polynucleotide
taatacgactcactatagggggaggaacttgataaggctaagacaactataacagaggagaatagttatgttagccttaaacctggcggcagcgcaaaagatg

SEQ ID NO: 59001 - DNA, 103 bp, Artificial Sequence
  Synthetic Polynucleotide
taatacgactcactatagggtacaaggaggaacttgataaggctaagacaaacagaggagatgtcttatgcttatcaagaacctggcggcagcgcaaaagatg

SEQ ID NO: 59002 - DNA, 103 bp, Artificial Sequence
  Synthetic Polynucleotide
taatacgactcactatagggacaaatacaaggaggaacttgataaggctaaacagaggagatagcctatgcaagttcctaacctggcggcagcgcaaaagatg

SEQ ID NO: 59003 - DNA, 103 bp, Artificial Sequence
  Synthetic Polynucleotide
taatacgactcactatagggctggaattacacacgagactcgtaattatcaacagaggagagataatatggagtctcgtaacctggcggcagcgcaaaagatg

SEQ ID NO: 59004 - DNA, 103 bp, Artificial Sequence
  Synthetic Polynucleotide
taatacgactcactatagggatgcgacaaatacaaggaggaacttgataaaacagaggagattatcaatgtcctccttgaacctggcggcagcgcaaaagatg

SEQ ID NO: 59005 - DNA, 103 bp, Artificial Sequence
  Synthetic Polynucleotide
taatacgactcactatagggaaggaatgcgacaaatacaaggaggaacttaacagaggagaaagttcatgcttgtatttaacctggcggcagcgcaaaagatg

SEQ ID NO: 59006 - DNA, 103 bp, Artificial Sequence
  Synthetic Polynucleotide
taatacgactcactatagggatatcaaggaatgcgacaaatacaaggaggaacagaggagacctcctatgatttgtcgcaacctggcggcagcgcaaaagatg

SEQ ID NO: 59007 - DNA, 103 bp, Artificial Sequence
  Synthetic Polynucleotide
taatacgactcactatagggtagggatatcaaggaatgcgacaaatacaaaacagaggagattgtatatgtcgcattccaacctggcggcagcgcaaaagatg

SEQ ID NO: 59008 - DNA, 103 bp, Artificial Sequence
  Synthetic Polynucleotide
taatacgactcactatagggcttcgtagggatatcaaggaatgcgacaaaaacagaggagatttgtcatgttccttgataacctggcggcagcgcaaaagatg

SEQ ID NO: 59009 - DNA, 103 bp, Artificial Sequence
  Synthetic Polynucleotide
taatacgactcactatagggccaaacttcgtagggatatcaaggaatgcgaacagaggagacgcattatgtgatatcccaacctggcggcagcgcaaaagatg

SEQ ID NO: 59010 - DNA, 103 bp, Artificial Sequence
  Synthetic Polynucleotide
taatacgactcactatagggactgtccaaacttcgtagggatatcaaggaaacagaggagatccttgatgtccctacgaaacctggcggcagcgcaaaagatg

SEQ ID NO: 59011 - DNA, 103 bp, Artificial Sequence
  Synthetic Polynucleotide
taatacgactcactatagggtgggaactgtccaaacttcgtagggatatcaacagaggagagatatcatgacgaagtttaacctggcggcagcgcaaaagatg

SEQ ID NO: 59012 - DNA, 103 bp, Artificial Sequence
  Synthetic Polynucleotide
taatacgactcactatagggtcgaatgggaactgtccaaacttcgtagggaacagaggagaccctacatggtttggacaaacctggcggcagcgcaaaagatg

SEQ ID NO: 59013 - DNA, 103 bp, Artificial Sequence
  Synthetic Polynucleotide
taatacgactcactatagggtaatgtcgaatgggaactgtccaaacttcgaacagaggagacgaagtatggacagttccaacctggcggcagcgcaaaagatg

SEQ ID NO: 59014 - DNA, 103 bp, Artificial Sequence
  Synthetic Polynucleotide
taatacgactcactatagggagttgtttgtaattttagaagatatagggaaacagaggagatccctaatgcttctaaaaaacctggcggcagcgcaaaagatg

SEQ ID NO: 59015 - DNA, 103 bp, Artificial Sequence
  Synthetic Polynucleotide
taatacgactcactatagggaattactggaattacacacgagactcgtaaaacagaggagattacgaatgtcgtgtgtaaacctggcggcagcgcaaaagatg

SEQ ID NO: 59016 - DNA, 103 bp, Artificial Sequence
  Synthetic Polynucleotide
taatacgactcactatagggcgtcgtaatgtcgaatgggaactgtccaaaaacagaggagatttggaatgttcccattcaacctggcggcagcgcaaaagatg

SEQ ID NO: 59017 - DNA, 103 bp, Artificial Sequence
  Synthetic Polynucleotide
taatacgactcactatagggataaacgtcgtaatgtcgaatgggaactgtaacagaggagaacagttatgattcgacataacctggcggcagcgcaaaagatg

SEQ ID NO: 59018 - DNA, 103 bp, Artificial Sequence
  Synthetic Polynucleotide
taatacgactcactatagggaatcgataaacgtcgtaatgtcgaatgggaaacagaggagatcccatatgacattacgaaacctggcggcagcgcaaaagatg

SEQ ID NO: 59019 - DNA, 103 bp, Artificial Sequence
  Synthetic Polynucleotide
taatacgactcactataggggctgaaatcgataaacgtcgtaatgtcgaaaacagaggagattcgacatgacgacgtttaacctggcggcagcgcaaaagatg

SEQ ID NO: 59020 - DNA, 103 bp, Artificial Sequence
  Synthetic Polynucleotide
taatacgactcactatagggtccgagctgaaatcgataaacgtcgtaatgaacagaggagacattacatggtttatcgaaacctggcggcagcgcaaaagatg

SEQ ID NO: 59021 - DNA, 103 bp, Artificial Sequence
  Synthetic Polynucleotide
taatacgactcactatagggcgatctccgagctgaaatcgataaacgtcgaacagaggagacgacgtatgtcgatttcaaacctggcggcagcgcaaaagatg

SEQ ID NO: 59022 - DNA, 103 bp, Artificial Sequence
  Synthetic Polynucleotide
taatacgactcactataggggatgacgatctccgagctgaaatcgataaaaacagaggagatttatcatgttcagctcgaacctggcggcagcgcaaaagatg

SEQ ID NO: 59023 - DNA, 103 bp, Artificial Sequence
  Synthetic Polynucleotide
taatacgactcactatagggaacgcgatgacgatctccgagctgaaatcgaacagaggagacgatttatgctcggagataacctggcggcagcgcaaaagatg

SEQ ID NO: 59024 - DNA, 103 bp, Artificial Sequence
  Synthetic Polynucleotide
taatacgactcactatagggaaaacaacgcgatgacgatctccgagctgaaacagaggagatcagctatgagatcgtcaaacctggcggcagcgcaaaagatg

SEQ ID NO: 59025 - DNA, 103 bp, Artificial Sequence
  Synthetic Polynucleotide
taatacgactcactatagggtggctaaaacaacgcgatgacgatctccgaaacagaggagatcggagatggtcatcgcgaacctggcggcagcgcaaaagatg

SEQ ID NO: 59026 - DNA, 103 bp, Artificial Sequence
  Synthetic Polynucleotide
taatacgactcactatagggtatgcaattactggaattacacacgagactaacagaggagaagtctcatgtgtaattccaacctggcggcagcgcaaaagatg

SEQ ID NO: 59027 - DNA, 103 bp, Artificial Sequence
  Synthetic Polynucleotide
taatacgactcactataggggtatgtggctaaaacaacgcgatgacgatcaacagaggagagatcgtatgcgcgttgttaacctggcggcagcgcaaaagatg

SEQ ID NO: 59028 - DNA, 103 bp, Artificial Sequence
  Synthetic Polynucleotide
taatacgactcactatagggtagtcgtatgtggctaaaacaacgcgatgaaacagaggagatcatcgatgtgttttagcaacctggcggcagcgcaaaagatg

SEQ ID NO: 59029 - DNA, 103 bp, Artificial Sequence
  Synthetic Polynucleotide
taatacgactcactataggggaacttagtcgtatgtggctaaaacaacgcaacagaggagagcgttgatgtagccacataacctggcggcagcgcaaaagatg

SEQ ID NO: 59030 - DNA, 103 bp, Artificial Sequence
  Synthetic Polynucleotide
taatacgactcactataggggacttgaacttagtcgtatgtggctaaaacaacagaggagagttttaatgacatacgacaacctggcggcagcgcaaaagatg

SEQ ID NO: 59031 - DNA, 103 bp, Artificial Sequence
  Synthetic Polynucleotide
taatacgactcactatagggaggaagacttgaacttagtcgtatgtggctaacagaggagaagccacatgcgactaagtaacctggcggcagcgcaaaagatg

SEQ ID NO: 59032 - DNA, 103 bp, Artificial Sequence
  Synthetic Polynucleotide
taatacgactcactatagggtgtcaaggaagacttgaacttagtcgtatgaacagaggagacatacgatgaagttcaagaacctggcggcagcgcaaaagatg

SEQ ID NO: 59033 - DNA, 103 bp, Artificial Sequence
  Synthetic Polynucleotide
taatacgactcactataggggatcttgtcaaggaagacttgaacttagtcaacagaggagagactaaatgcaagtcttcaacctggcggcagcgcaaaagatg

SEQ ID NO: 59034 - DNA, 103 bp, Artificial Sequence
  Synthetic Polynucleotide
taatacgactcactatagggagatggatcttgtcaaggaagacttgaactaacagaggagaagttcaatgcttccttgaaacctggcggcagcgcaaaagatg

SEQ ID NO: 59035 - DNA, 103 bp, Artificial Sequence
  Synthetic Polynucleotide
taatacgactcactatagggaaagtagatggatcttgtcaaggaagacttaacagaggagaaagtctatgttgacaagaaacctggcggcagcgcaaaagatg

SEQ ID NO: 59036 - DNA, 103 bp, Artificial Sequence
  Synthetic Polynucleotide
taatacgactcactatagggatggaaaagtagatggatcttgtcaaggaaaacagaggagattccttatgaagatccataacctggcggcagcgcaaaagatg

SEQ ID NO: 59037 - DNA, 103 bp, Artificial Sequence
  Synthetic Polynucleotide
taatacgactcactatagggacatctatgcaattactggaattacacacgaacagaggagacgtgtgatgttccagtaaaacctggcggcagcgcaaaagatg

SEQ ID NO: 59038 - DNA, 103 bp, Artificial Sequence
  Synthetic Polynucleotide
taatacgactcactatagggtagggatggaaaagtagatggatcttgtcaaacagaggagatgacaaatgccatctactaacctggcggcagcgcaaaagatg

SEQ ID NO: 59039 - DNA, 103 bp, Artificial Sequence
  Synthetic Polynucleotide
taatacgactcactatagggactattagggatggaaaagtagatggatctaacagaggagaagatccatgtacttttccaacctggcggcagcgcaaaagatg

SEQ ID NO: 59040 - DNA, 103 bp, Artificial Sequence
  Synthetic Polynucleotide
taatacgactcactatagggtggatactattagggatggaaaagtagatgaacagaggagacatctaatgttccatcccaacctggcggcagcgcaaaagatg

SEQ ID NO: 59041 - DNA, 103 bp, Artificial Sequence
  Synthetic Polynucleotide
taatacgactcactatagggggaactggatactattagggatggaaaagtaacagaggagaacttttatgtccctaataaacctggcggcagcgcaaaagatg

SEQ ID NO: 59042 - DNA, 103 bp, Artificial Sequence
  Synthetic Polynucleotide
taatacgactcactataggggaaaaggaactggatactattagggatggaaacagaggagatccatcatgaatagtatcaacctggcggcagcgcaaaagatg

SEQ ID NO: 59043 - DNA, 103 bp, Artificial Sequence
  Synthetic Polynucleotide
taatacgactcactatagggaactagaaaaggaactggatactattagggaacagaggagaccctaaatgtatccagttaacctggcggcagcgcaaaagatg

SEQ ID NO: 59044 - DNA, 103 bp, Artificial Sequence
  Synthetic Polynucleotide
taatacgactcactatagggttcagaactagaaaaggaactggatactataacagaggagaatagtaatgagttcctttaacctggcggcagcgcaaaagatg

SEQ ID NO: 59045 - DNA, 103 bp, Artificial Sequence
  Synthetic Polynucleotide
taatacgactcactatagggatgcgttcagaactagaaaaggaactggataacagaggagaatccagatgcttttctagaacctggcggcagcgcaaaagatg

SEQ ID NO: 59046 - DNA, 103 bp, Artificial Sequence
  Synthetic Polynucleotide
taatacgactcactataggggagaaatgcgttcagaactagaaaaggaacaacagaggagagttcctatgctagttctgaacctggcggcagcgcaaaagatg

SEQ ID NO: 59047 - DNA, 103 bp, Artificial Sequence
  Synthetic Polynucleotide
taatacgactcactatagggggaacgagaaatgcgttcagaactagaaaaaacagaggagattttctatgtctgaacgcaacctggcggcagcgcaaaagatg

SEQ ID NO: 59048 - DNA, 103 bp, Artificial Sequence
  Synthetic Polynucleotide
taatacgactcactatagggtggtaacatctatgcaattactggaattacaacagaggagagtaattatggtaattgcaaacctggcggcagcgcaaaagatg

SEQ ID NO: 59049 - DNA, 103 bp, Artificial Sequence
  Synthetic Polynucleotide
taatacgactcactataggggatagggaacgagaaatgcgttcagaactaaacagaggagatagttcatgacgcatttcaacctggcggcagcgcaaaagatg

SEQ ID NO: 59050 - DNA, 103 bp, Artificial Sequence
  Synthetic Polynucleotide
taatacgactcactatagggcgcttgatagggaacgagaaatgcgttcagaacagaggagactgaacatgtttctcgttaacctggcggcagcgcaaaagatg

SEQ ID NO: 59051 - DNA, 103 bp, Artificial Sequence
  Synthetic Polynucleotide
taatacgactcactatagggagaatcgcttgatagggaacgagaaatgcgaacagaggagacgcattatgcgttccctaaacctggcggcagcgcaaaagatg

SEQ ID NO: 59052 - DNA, 103 bp, Artificial Sequence
  Synthetic Polynucleotide
taatacgactcactatagggttgaaagaatcgcttgatagggaacgagaaaacagaggagattctcgatgcctatcaagaacctggcggcagcgcaaaagatg

SEQ ID NO: 59053 - DNA, 103 bp, Artificial Sequence
  Synthetic Polynucleotide
taatacgactcactataggggagaattgaaagaatcgcttgatagggaacaacagaggagagttcccatgcaagcgattaacctggcggcagcgcaaaagatg

SEQ ID NO: 59054 - DNA, 103 bp, Artificial Sequence
  Synthetic Polynucleotide
taatacgactcactatagggtatccgagaattgaaagaatcgcttgatagaacagaggagactatcaatggattctttcaacctggcggcagcgcaaaagatg

SEQ ID NO: 59055 - DNA, 103 bp, Artificial Sequence
  Synthetic Polynucleotide
taatacgactcactatagggaagactatccgagaattgaaagaatcgcttaacagaggagaaagcgaatgtttcaattcaacctggcggcagcgcaaaagatg

SEQ ID NO: 59056 - DNA, 103 bp, Artificial Sequence
  Synthetic Polynucleotide
taatacgactcactatagggataagaagactatccgagaattgaaagaataacagaggagaattcttatgattctcggaaacctggcggcagcgcaaaagatg

SEQ ID NO: 59057 - DNA, 103 bp, Artificial Sequence
  Synthetic Polynucleotide
taatacgactcactatagggaattgataagaagactatccgagaattgaaaacagaggagattcaatatgcggatagtcaacctggcggcagcgcaaaagatg

SEQ ID NO: 59058 - DNA, 103 bp, Artificial Sequence
  Synthetic Polynucleotide
taatacgactcactatagggtcagaaattgataagaagactatccgagaaaacagaggagattctcgatgagtcttcttaacctggcggcagcgcaaaagatg

SEQ ID NO: 59059 - DNA, 103 bp, Artificial Sequence
  Synthetic Polynucleotide
taatacgactcactatagggtacgatggtaacatctatgcaattactggaaacagaggagatccagtatgtgcatagataacctggcggcagcgcaaaagatg

SEQ ID NO: 59060 - DNA, 103 bp, Artificial Sequence
  Synthetic Polynucleotide
taatacgactcactatagggattcatcagaaattgataagaagactatccaacagaggagaggatagatgtcttatcaaaacctggcggcagcgcaaaagatg

SEQ ID NO: 59061 - DNA, 103 bp, Artificial Sequence
  Synthetic Polynucleotide
taatacgactcactatagggttcagattcatcagaaattgataagaagacaacagaggagagtcttcatgtcaatttctaacctggcggcagcgcaaaagatg

SEQ ID NO: 59062 - DNA, 103 bp, Artificial Sequence
  Synthetic Polynucleotide
taatacgactcactataggggatggttcagattcatcagaaattgataagaacagaggagacttatcatgttctgatgaaacctggcggcagcgcaaaagatg

SEQ ID NO: 59063 - DNA, 103 bp, Artificial Sequence
  Synthetic Polynucleotide
taatacgactcactatagggcagatgatggttcagattcatcagaaattgaacagaggagacaatttatgatgaatctgaacctggcggcagcgcaaaagatg

SEQ ID NO: 59064 - DNA, 103 bp, Artificial Sequence
  Synthetic Polynucleotide
taatacgactcactatagggtgggacagatgatggttcagattcatcagaaacagaggagatctgatatgtctgaaccaaacctggcggcagcgcaaaagatg

SEQ ID NO: 59065 - DNA, 103 bp, Artificial Sequence
  Synthetic Polynucleotide
taatacgactcactatagggcaaaatgggacagatgatggttcagattcaaacagaggagatgaatcatgaccatcatcaacctggcggcagcgcaaaagatg

SEQ ID NO: 59066 - DNA, 103 bp, Artificial Sequence
  Synthetic Polynucleotide
taatacgactcactatagggatattcaaaatgggacagatgatggttcagaacagaggagactgaacatgcatctgtccaacctggcggcagcgcaaaagatg

SEQ ID NO: 59067 - DNA, 103 bp, Artificial Sequence
  Synthetic Polynucleotide
taatacgactcactatagggtagggatattcaaaatgggacagatgatggaacagaggagaccatcaatggtcccatttaacctggcggcagcgcaaaagatg

SEQ ID NO: 59068 - DNA, 103 bp, Artificial Sequence
  Synthetic Polynucleotide
taatacgactcactataggggaacttagggatattcaaaatgggacagataacagaggagaatctgtatgattttgaataacctggcggcagcgcaaaagatg

SEQ ID NO: 59069 - DNA, 103 bp, Artificial Sequence
  Synthetic Polynucleotide
taatacgactcactatagggtcaaagaacttagggatattcaaaatgggaaacagaggagatcccatatggaatatcccaacctggcggcagcgcaaaagatg

SEQ ID NO: 59070 - DNA, 103 bp, Artificial Sequence
  Synthetic Polynucleotide
taatacgactcactatagggtagagtacgatggtaacatctatgcaattaaacagaggagataattgatgagatgttacaacctggcggcagcgcaaaagatg

SEQ ID NO: 59071 - DNA, 103 bp, Artificial Sequence
  Synthetic Polynucleotide
taatacgactcactatagggagagatcaaagaacttagggatattcaaaaaacagaggagattttgaatgtccctaagtaacctggcggcagcgcaaaagatg

SEQ ID NO: 59072 - DNA, 103 bp, Artificial Sequence
  Synthetic Polynucleotide
taatacgactcactatagggacaaaagagatcaaagaacttagggatattaacagaggagaaatatcatgaagttctttaacctggcggcagcgcaaaagatg

SEQ ID NO: 59073 - DNA, 103 bp, Artificial Sequence
  Synthetic Polynucleotide
taatacgactcactataggggacttacaaaagagatcaaagaacttagggaacagaggagaccctaaatgctttgatctaacctggcggcagcgcaaaagatg

SEQ ID NO: 59074 - DNA, 103 bp, Artificial Sequence
  Synthetic Polynucleotide
taatacgactcactatagggcgaccgacttacaaaagagatcaaagaactaacagaggagaagttctatgatctcttttaacctggcggcagcgcaaaagatg

SEQ ID NO: 59075 - DNA, 103 bp, Artificial Sequence
  Synthetic Polynucleotide
taatacgactcactatagggagaatcgaccgacttacaaaagagatcaaaaacagaggagatttgatatgttttgtaagaacctggcggcagcgcaaaagatg

SEQ ID NO: 59076 - DNA, 103 bp, Artificial Sequence
  Synthetic Polynucleotide
taatacgactcactatagggccgaaagaatcgaccgacttacaaaagagaaacagaggagatctcttatgtaagtcggtaacctggcggcagcgcaaaagatg

SEQ ID NO: 59077 - DNA, 103 bp, Artificial Sequence
  Synthetic Polynucleotide
taatacgactcactatagggtaaaaccgaaagaatcgaccgacttacaaaaacagaggagatttgtaatgcggtcgattaacctggcggcagcgcaaaagatg

SEQ ID NO: 59078 - DNA, 103 bp, Artificial Sequence
  Synthetic Polynucleotide
taatacgactcactataggggtttataaaaccgaaagaatcgaccgacttaacagaggagaaagtcgatggattctttcaacctggcggcagcgcaaaagatg

SEQ ID NO: 59079 - DNA, 103 bp, Artificial Sequence
  Synthetic Polynucleotide
taatacgactcactatagggattctgtttataaaaccgaaagaatcgaccaacagaggagaggtcgaatgtttcggtttaacctggcggcagcgcaaaagatg

SEQ ID NO: 59080 - DNA, 103 bp, Artificial Sequence
  Synthetic Polynucleotide
taatacgactcactatagggaagggattctgtttataaaaccgaaagaataacagaggagaattcttatggttttataaaacctggcggcagcgcaaaagatg

SEQ ID NO: 59081 - DNA, 103 bp, Artificial Sequence
  Synthetic Polynucleotide
taatacgactcactatagggtgctgtagagtacgatggtaacatctatgcaacagaggagagcatagatgttaccatcgaacctggcggcagcgcaaaagatg

SEQ ID NO: 59082 - DNA, 103 bp, Artificial Sequence
  Synthetic Polynucleotide
taatacgactcactatagggttggaaagggattctgtttataaaaccgaaaacagaggagattcggtatgataaacagaaacctggcggcagcgcaaaagatg

SEQ ID NO: 59083 - DNA, 103 bp, Artificial Sequence
  Synthetic Polynucleotide
taatacgactcactatagggggactttggaaagggattctgtttataaaaaacagaggagattttatatgcagaatcccaacctggcggcagcgcaaaagatg

SEQ ID NO: 59084 - DNA, 103 bp, Artificial Sequence
  Synthetic Polynucleotide
taatacgactcactataggggattaggactttggaaagggattctgtttaaacagaggagataaacaatgtccctttccaacctggcggcagcgcaaaagatg

SEQ ID NO: 59085 - DNA, 103 bp, Artificial Sequence
  Synthetic Polynucleotide
taatacgactcactatagggagtaagattaggactttggaaagggattctaacagaggagaagaatcatgttccaaagtaacctggcggcagcgcaaaagatg

SEQ ID NO: 59086 - DNA, 103 bp, Artificial Sequence
  Synthetic Polynucleotide
taatacgactcactatagggaactcagtaagattaggactttggaaagggaacagaggagaccctttatgaagtcctaaaacctggcggcagcgcaaaagatg

SEQ ID NO: 59087 - DNA, 103 bp, Artificial Sequence
  Synthetic Polynucleotide
taatacgactcactatagggtgataaactcagtaagattaggactttggaaacagaggagatccaaaatgctaatcttaaacctggcggcagcgcaaaagatg

SEQ ID NO: 59088 - DNA, 103 bp, Artificial Sequence
  Synthetic Polynucleotide
taatacgactcactatagggcttagtgataaactcagtaagattaggactaacagaggagaagtcctatgcttactgagaacctggcggcagcgcaaaagatg

SEQ ID NO: 59089 - DNA, 103 bp, Artificial Sequence
  Synthetic Polynucleotide
taatacgactcactatagggcagaacttagtgataaactcagtaagattaaacagaggagataatctatgtgagtttataacctggcggcagcgcaaaagatg

SEQ ID NO: 59090 - DNA, 103 bp, Artificial Sequence
  Synthetic Polynucleotide
taatacgactcactataggggaatgcagaacttagtgataaactcagtaaaacagaggagattactgatgttatcactaaacctggcggcagcgcaaaagatg

SEQ ID NO: 59091 - DNA, 103 bp, Artificial Sequence
  Synthetic Polynucleotide
taatacgactcactataggggaattgaatgcagaacttagtgataaactcaacagaggagagagtttatgactaagttcaacctggcggcagcgcaaaagatg

SEQ ID NO: 59092 - DNA, 103 bp, Artificial Sequence
  Synthetic Polynucleotide
taatacgactcactataggggtttatgctgtagagtacgatggtaacatcaacagaggagagatgttatgatcgtactcaacctggcggcagcgcaaaagatg

SEQ ID NO: 59093 - DNA, 103 bp, Artificial Sequence
  Synthetic Polynucleotide
taatacgactcactatagggtcaccgaattgaatgcagaacttagtgataaacagaggagatatcacatggttctgcataacctggcggcagcgcaaaagatg

SEQ ID NO: 59094 - DNA, 103 bp, Artificial Sequence
  Synthetic Polynucleotide
taatacgactcactatagggaaaactcaccgaattgaatgcagaacttagaacagaggagactaagtatggcattcaataacctggcggcagcgcaaaagatg

SEQ ID NO: 59095 - DNA, 103 bp, Artificial Sequence
  Synthetic Polynucleotide
taatacgactcactatagggaagagaaaactcaccgaattgaatgcagaaaacagaggagattctgcatgcaattcggtaacctggcggcagcgcaaaagatg

SEQ ID NO: 59096 - DNA, 103 bp, Artificial Sequence
  Synthetic Polynucleotide
taatacgactcactatagggaagccaagagaaaactcaccgaattgaatgaacagaggagacattcaatgcggtgagttaacctggcggcagcgcaaaagatg

SEQ ID NO: 59097 - DNA, 103 bp, Artificial Sequence
  Synthetic Polynucleotide
taatacgactcactatagggggaagaagccaagagaaaactcaccgaattaacagaggagaaattcgatgagttttctcaacctggcggcagcgcaaaagatg

SEQ ID NO: 59098 - DNA, 103 bp, Artificial Sequence
  Synthetic Polynucleotide
taatacgactcactataggggagttggaagaagccaagagaaaactcaccaacagaggagaggtgagatgtctcttggcaacctggcggcagcgcaaaagatg

SEQ ID NO: 59099 - DNA, 103 bp, Artificial Sequence
  Synthetic Polynucleotide
taatacgactcactatagggaaacagagttggaagaagccaagagaaaacaacagaggagagttttcatgtggcttcttaacctggcggcagcgcaaaagatg

SEQ ID NO: 59100 - DNA, 103 bp, Artificial Sequence
  Synthetic Polynucleotide
taatacgactcactataggggtttaaaacagagttggaagaagccaagagaacagaggagactcttgatgtcttccaacaacctggcggcagcgcaaaagatg

SEQ ID NO: 59101 - DNA, 103 bp, Artificial Sequence
  Synthetic Polynucleotide
taatacgactcactatagggggagagtttaaaacagagttggaagaagccaacagaggagaggcttcatgcaactctgtaacctggcggcagcgcaaaagatg

SEQ ID NO: 59102 - DNA, 103 bp, Artificial Sequence
  Synthetic Polynucleotide
taatacgactcactatagggatggtggagagtttaaaacagagttggaagaacagaggagacttccaatgctgttttaaaacctggcggcagcgcaaaagatg

SEQ ID NO: 59103 - DNA, 103 bp, Artificial Sequence
  Synthetic Polynucleotide
taatacgactcactataggggtatagtttatgctgtagagtacgatggtaaacagaggagataccatatgactctacagaacctggcggcagcgcaaaagatg

SEQ ID NO: 59104 - DNA, 103 bp, Artificial Sequence
  Synthetic Polynucleotide
taatacgactcactatagggcggaaatggtggagagtttaaaacagagttaacagaggagaaactctatgttaaactctaacctggcggcagcgcaaaagatg

SEQ ID NO: 59105 - DNA, 103 bp, Artificial Sequence
  Synthetic Polynucleotide
taatacgactcactataggggaatgcggaaatggtggagagtttaaaacaaacagaggagatgttttatgctctccaccaacctggcggcagcgcaaaagatg

SEQ ID NO: 59106 - DNA, 103 bp, Artificial Sequence
  Synthetic Polynucleotide
taatacgactcactatagggaggaagaatgcggaaatggtggagagtttaaacagaggagataaactatgcaccatttcaacctggcggcagcgcaaaagatg

SEQ ID NO: 59107 - DNA, 103 bp, Artificial Sequence
  Synthetic Polynucleotide
taatacgactcactatagggatgcgaggaagaatgcggaaatggtggagaaacagaggagatctccaatgtttccgcataacctggcggcagcgcaaaagatg

SEQ ID NO: 59108 - DNA, 103 bp, Artificial Sequence
  Synthetic Polynucleotide
taatacgactcactataggggataaatgcgaggaagaatgcggaaatggtaacagaggagaaccattatggcattcttcaacctggcggcagcgcaaaagatg

SEQ ID NO: 59109 - DNA, 103 bp, Artificial Sequence
  Synthetic Polynucleotide
taatacgactcactatagggggttagataaatgcgaggaagaatgcggaaaacagaggagattccgcatgcttcctcgcaacctggcggcagcgcaaaagatg

SEQ ID NO: 59110 - DNA, 103 bp, Artificial Sequence
  Synthetic Polynucleotide
taatacgactcactatagggtgaatggttagataaatgcgaggaagaatgaacagaggagacattctatgtcgcatttaaacctggcggcagcgcaaaagatg

SEQ ID NO: 59111 - DNA, 103 bp, Artificial Sequence
  Synthetic Polynucleotide
taatacgactcactatagggctaattgaatggttagataaatgcgaggaaaacagaggagattcctcatgtttatctaaaacctggcggcagcgcaaaagatg

SEQ ID NO: 59112 - DNA, 103 bp, Artificial Sequence
  Synthetic Polynucleotide
taatacgactcactatagggataaactaattgaatggttagataaatgcgaacagaggagacgcattatgctaaccattaacctggcggcagcgcaaaagatg

SEQ ID NO: 59113 - DNA, 103 bp, Artificial Sequence
  Synthetic Polynucleotide
taatacgactcactatagggtattaataaactaattgaatggttagataaaacagaggagattatctatgcattcaattaacctggcggcagcgcaaaagatg

SEQ ID NO: 59114 - DNA, 103 bp, Artificial Sequence
  Synthetic Polynucleotide
taatacgactcactatagggtcatagtatagtttatgctgtagagtacgaaacagaggagatcgtacatgacagcataaaacctggcggcagcgcaaaagatg

SEQ ID NO: 59115 - DNA, 103 bp, Artificial Sequence
  Synthetic Polynucleotide
taatacgactcactatagggctagttattaataaactaattgaatggttaaacagaggagataaccaatgaattagtttaacctggcggcagcgcaaaagatg

SEQ ID NO: 59116 - DNA, 103 bp, Artificial Sequence
  Synthetic Polynucleotide
taatacgactcactatagggaccaactagttattaataaactaattgaataacagaggagaattcaaatggtttattaaaacctggcggcagcgcaaaagatg

SEQ ID NO: 59117 - DNA, 103 bp, Artificial Sequence
  Synthetic Polynucleotide
taatacgactcactatagggtgattaccaactagttattaataaactaataacagaggagaattagtatgttaataactaacctggcggcagcgcaaaagatg

SEQ ID NO: 59118 - DNA, 103 bp, Artificial Sequence
  Synthetic Polynucleotide
taatacgactcactatagggatcgctgattaccaactagttattaataaaaacagaggagatttattatgaactagttgaacctggcggcagcgcaaaagatg

SEQ ID NO: 59119 - DNA, 103 bp, Artificial Sequence
  Synthetic Polynucleotide
taatacgactcactatagggtaggaatcgctgattaccaactagttattaaacagaggagataataaatggttggtaataacctggcggcagcgcaaaagatg

SEQ ID NO: 59120 - DNA, 103 bp, Artificial Sequence
  Synthetic Polynucleotide
taatacgactcactatagggggctataggaatcgctgattaccaactagtaacagaggagaactagtatgtaatcagcgaacctggcggcagcgcaaaagatg

SEQ ID NO: 59121 - DNA, 103 bp, Artificial Sequence
  Synthetic Polynucleotide
taatacgactcactatagggagaacggctataggaatcgctgattaccaaaacagaggagattggtaatgagcgattccaacctggcggcagcgcaaaagatg

SEQ ID NO: 59122 - DNA, 103 bp, Artificial Sequence
  Synthetic Polynucleotide
taatacgactcactatagggttacaagaacggctataggaatcgctgattaacagaggagaaatcagatgttcctatagaacctggcggcagcgcaaaagatg

SEQ ID NO: 59123 - DNA, 103 bp, Artificial Sequence
  Synthetic Polynucleotide
taatacgactcactatagggcacaattacaagaacggctataggaatcgcaacagaggagagcgattatgatagccgttaacctggcggcagcgcaaaagatg

SEQ ID NO: 59124 - DNA, 103 bp, Artificial Sequence
  Synthetic Polynucleotide
taatacgactcactataggggttcccacaattacaagaacggctataggaaacagaggagatcctatatgcgttcttgtaacctggcggcagcgcaaaagatg

SEQ ID NO: 59125 - DNA, 103 bp, Artificial Sequence
  Synthetic Polynucleotide
taatacgactcactatagggtatccagttgtttgtaattttagaagatataacagaggagaatatctatgaaaattacaaacctggcggcagcgcaaaagatg

SEQ ID NO: 59126 - DNA, 103 bp, Artificial Sequence
  Synthetic Polynucleotide
taatacgactcactatagggagacatcatagtatagtttatgctgtagagaacagaggagactctacatgataaactataacctggcggcagcgcaaaagatg

SEQ ID NO: 59127 - DNA, 103 bp, Artificial Sequence
  Synthetic Polynucleotide
taatacgactcactatagggattatgttcccacaattacaagaacggctaaacagaggagatagccgatgttgtaattgaacctggcggcagcgcaaaagatg

SEQ ID NO: 59128 - DNA, 103 bp, Artificial Sequence
  Synthetic Polynucleotide
taatacgactcactatagggtcctaattatgttcccacaattacaagaacaacagaggagagttcttatgattgtgggaaacctggcggcagcgcaaaagatg

SEQ ID NO: 59129 - DNA, 103 bp, Artificial Sequence
  Synthetic Polynucleotide
taatacgactcactataggggaagatcctaattatgttcccacaattacaaacagaggagatgtaatatggggaacataaacctggcggcagcgcaaaagatg

SEQ ID NO: 59130 - DNA, 103 bp, Artificial Sequence
  Synthetic Polynucleotide
taatacgactcactatagggcattagaagatcctaattatgttcccacaaaacagaggagattgtggatgcataattagaacctggcggcagcgcaaaagatg

SEQ ID NO: 59131 - DNA, 103 bp, Artificial Sequence
  Synthetic Polynucleotide
taatacgactcactatagggcaatccattagaagatcctaattatgttccaacagaggagaggaacaatgttaggatctaacctggcggcagcgcaaaagatg

SEQ ID NO: 59132 - DNA, 103 bp, Artificial Sequence
  Synthetic Polynucleotide
taatacgactcactatagggtcatacaatccattagaagatcctaattataacagaggagaataattatgatcttctaaaacctggcggcagcgcaaaagatg

SEQ ID NO: 59133 - DNA, 103 bp, Artificial Sequence
  Synthetic Polynucleotide
taatacgactcactatagggttaagtcatacaatccattagaagatcctaaacagaggagataggatatgctaatggataacctggcggcagcgcaaaagatg

SEQ ID NO: 59134 - DNA, 103 bp, Artificial Sequence
  Synthetic Polynucleotide
taatacgactcactatagggtgctattaagtcatacaatccattagaagaaacagaggagatcttctatgggattgtataacctggcggcagcgcaaaagatg

SEQ ID NO: 59135 - DNA, 103 bp, Artificial Sequence
  Synthetic Polynucleotide
taatacgactcactataggggatgatgctattaagtcatacaatccattaaacagaggagataatggatggtatgacttaacctggcggcagcgcaaaagatg

SEQ ID NO: 59136 - DNA, 103 bp, Artificial Sequence
  Synthetic Polynucleotide
taatacgactcactatagggataaagatgatgctattaagtcatacaatcaacagaggagagattgtatgacttaatagaacctggcggcagcgcaaaagatg

SEQ ID NO: 59137 - DNA, 103 bp, Artificial Sequence
  Synthetic Polynucleotide
taatacgactcactatagggtgcctagacatcatagtatagtttatgctgaacagaggagacagcatatgctatactataacctggcggcagcgcaaaagatg

SEQ ID NO: 59138 - DNA, 103 bp, Artificial Sequence
  Synthetic Polynucleotide
taatacgactcactatagggtaatgataaagatgatgctattaagtcataaacagaggagatatgacatgatagcatcaaacctggcggcagcgcaaaagatg

SEQ ID NO: 59139 - DNA, 103 bp, Artificial Sequence
  Synthetic Polynucleotide
taatacgactcactatagggcctaataatgataaagatgatgctattaagaacagaggagacttaatatgatcatctttaacctggcggcagcgcaaaagatg

SEQ ID NO: 59140 - DNA, 103 bp, Artificial Sequence
  Synthetic Polynucleotide
taatacgactcactatagggatccccctaataatgataaagatgatgctaaacagaggagatagcatatgctttatcataacctggcggcagcgcaaaagatg

SEQ ID NO: 59141 - DNA, 103 bp, Artificial Sequence
  Synthetic Polynucleotide
taatacgactcactatagggtgtccatccccctaataatgataaagatgaaacagaggagatcatctatgtcattattaaacctggcggcagcgcaaaagatg

SEQ ID NO: 59142 - DNA, 103 bp, Artificial Sequence
  Synthetic Polynucleotide
taatacgactcactatagggaaggttgtccatccccctaataatgataaaaacagaggagatttatcatgattagggggaacctggcggcagcgcaaaagatg

SEQ ID NO: 59143 - DNA, 103 bp, Artificial Sequence
  Synthetic Polynucleotide
taatacgactcactatagggcaattaaggttgtccatccccctaataatgaacagaggagacattatatgggggatggaaacctggcggcagcgcaaaagatg

SEQ ID NO: 59144 - DNA, 103 bp, Artificial Sequence
  Synthetic Polynucleotide
taatacgactcactatagggccaaccaattaaggttgtccatccccctaaaacagaggagattagggatgtggacaaccaacctggcggcagcgcaaaagatg

SEQ ID NO: 59145 - DNA, 103 bp, Artificial Sequence
  Synthetic Polynucleotide
taatacgactcactataggggaggaccaaccaattaaggttgtccatcccaacagaggagagggatgatgaaccttaataacctggcggcagcgcaaaagatg

SEQ ID NO: 59146 - DNA, 103 bp, Artificial Sequence
  Synthetic Polynucleotide
taatacgactcactatagggataaggaggaccaaccaattaaggttgtccaacagaggagaggacaaatgtaattggttaacctggcggcagcgcaaaagatg

SEQ ID NO: 59147 - DNA, 103 bp, Artificial Sequence
  Synthetic Polynucleotide
taatacgactcactatagggaggagataaggaggaccaaccaattaaggtaacagaggagaaccttaatgggttggtccaacctggcggcagcgcaaaagatg

SEQ ID NO: 59148 - DNA, 103 bp, Artificial Sequence
  Synthetic Polynucleotide
taatacgactcactatagggtcccatgcctagacatcatagtatagtttaaacagaggagataaactatgctatgatgtaacctggcggcagcgcaaaagatg

SEQ ID NO: 59149 - DNA, 103 bp, Artificial Sequence
  Synthetic Polynucleotide
taatacgactcactatagggactggaggagataaggaggaccaaccaattaacagaggagaaattggatggtcctccttaacctggcggcagcgcaaaagatg

SEQ ID NO: 59150 - DNA, 103 bp, Artificial Sequence
  Synthetic Polynucleotide
taatacgactcactatagggatgctactggaggagataaggaggaccaacaacagaggagagttggtatgccttatctcaacctggcggcagcgcaaaagatg

SEQ ID NO: 59151 - DNA, 103 bp, Artificial Sequence
  Synthetic Polynucleotide
taatacgactcactatagggaccacatgctactggaggagataaggaggaaacagaggagatcctccatgtctcctccaaacctggcggcagcgcaaaagatg

SEQ ID NO: 59152 - DNA, 103 bp, Artificial Sequence
  Synthetic Polynucleotide
taatacgactcactataggggaagaaccacatgctactggaggagataagaacagaggagacttatcatgtccagtagcaacctggcggcagcgcaaaagatg

SEQ ID NO: 59153 - DNA, 103 bp, Artificial Sequence
  Synthetic Polynucleotide
taatacgactcactataggggtattgaagaaccacatgctactggaggagaacagaggagactcctcatgtagcatgtgaacctggcggcagcgcaaaagatg

SEQ ID NO: 59154 - DNA, 103 bp, Artificial Sequence
  Synthetic Polynucleotide
taatacgactcactatagggcactggtattgaagaaccacatgctactggaacagaggagaccagtaatgtgtggttctaacctggcggcagcgcaaaagatg

SEQ ID NO: 59155 - DNA, 103 bp, Artificial Sequence
  Synthetic Polynucleotide
taatacgactcactatagggactaacactggtattgaagaaccacatgctaacagaggagaagcatgatgttcttcaataacctggcggcagcgcaaaagatg

SEQ ID NO: 59156 - DNA, 103 bp, Artificial Sequence
  Synthetic Polynucleotide
taatacgactcactatagggctattactaacactggtattgaagaaccacaacagaggagagtggttatgcaataccagaacctggcggcagcgcaaaagatg

SEQ ID NO: 59157 - DNA, 103 bp, Artificial Sequence
  Synthetic Polynucleotide
taatacgactcactatagggtaagcctattactaacactggtattgaagaaacagaggagatcttcaatgccagtgttaaacctggcggcagcgcaaaagatg

SEQ ID NO: 59158 - DNA, 103 bp, Artificial Sequence
  Synthetic Polynucleotide
taatacgactcactatagggttgcctaagcctattactaacactggtattaacagaggagaaataccatggttagtaataacctggcggcagcgcaaaagatg

SEQ ID NO: 59159 - DNA, 103 bp, Artificial Sequence
  Synthetic Polynucleotide
taatacgactcactatagggaagtctcccatgcctagacatcatagtataaacagaggagatatactatgatgtctaggaacctggcggcagcgcaaaagatg

SEQ ID NO: 59160 - DNA, 103 bp, Artificial Sequence
  Synthetic Polynucleotide
taatacgactcactatagggagcatttgcctaagcctattactaacactgaacagaggagacagtgtatgtaataggctaacctggcggcagcgcaaaagatg

SEQ ID NO: 59161 - DNA, 103 bp, Artificial Sequence
  Synthetic Polynucleotide
taatacgactcactatagggcgacaagcatttgcctaagcctattactaaaacagaggagattagtaatgggcttaggcaacctggcggcagcgcaaaagatg

SEQ ID NO: 59162 - DNA, 103 bp, Artificial Sequence
  Synthetic Polynucleotide
taatacgactcactataggggcgtacgacaagcatttgcctaagcctattaacagaggagaaataggatgaggcaaatgaacctggcggcagcgcaaaagatg

SEQ ID NO: 59163 - DNA, 103 bp, Artificial Sequence
  Synthetic Polynucleotide
taatacgactcactatagggtgcccgcgtacgacaagcatttgcctaagcaacagaggagagcttagatgaatgcttgtaacctggcggcagcgcaaaagatg

SEQ ID NO: 59164 - DNA, 103 bp, Artificial Sequence
  Synthetic Polynucleotide
taatacgactcactatagggggaagtgcccgcgtacgacaagcatttgccaacagaggagaggcaaaatgttgtcgtacaacctggcggcagcgcaaaagatg

SEQ ID NO: 59165 - DNA, 103 bp, Artificial Sequence
  Synthetic Polynucleotide
taatacgactcactataggggatgaggaagtgcccgcgtacgacaagcataacagaggagaatgcttatggtacgcgggaacctggcggcagcgcaaaagatg

SEQ ID NO: 59166 - DNA, 103 bp, Artificial Sequence
  Synthetic Polynucleotide
taatacgactcactatagggtaatggatgaggaagtgcccgcgtacgacaaacagaggagatgtcgtatgcgggcacttaacctggcggcagcgcaaaagatg

SEQ ID NO: 59167 - DNA, 103 bp, Artificial Sequence
  Synthetic Polynucleotide
taatacgactcactatagggatacttaatggatgaggaagtgcccgcgtaaacagaggagatacgcgatgacttcctcaaacctggcggcagcgcaaaagatg

SEQ ID NO: 59168 - DNA, 103 bp, Artificial Sequence
  Synthetic Polynucleotide
taatacgactcactatagggtataaatacttaatggatgaggaagtgcccaacagaggagagggcacatgctcatccataacctggcggcagcgcaaaagatg

SEQ ID NO: 59169 - DNA, 103 bp, Artificial Sequence
  Synthetic Polynucleotide
taatacgactcactatagggccgattataaatacttaatggatgaggaagaacagaggagacttcctatgccattaagtaacctggcggcagcgcaaaagatg

SEQ ID NO: 59170 - DNA, 103 bp, Artificial Sequence
  Synthetic Polynucleotide
taatacgactcactatagggtaaaaaagtctcccatgcctagacatcataaacagaggagatatgatatgtaggcatggaacctggcggcagcgcaaaagatg

SEQ ID NO: 59171 - DNA, 103 bp, Artificial Sequence
  Synthetic Polynucleotide
taatacgactcactatagggagaacccgattataaatacttaatggatgaaacagaggagatcatccatgaagtatttaaacctggcggcagcgcaaaagatg

SEQ ID NO: 59172 - DNA, 103 bp, Artificial Sequence
  Synthetic Polynucleotide
taatacgactcactataggggaagcagaacccgattataaatacttaatgaacagaggagacattaaatgtttataatcaacctggcggcagcgcaaaagatg

SEQ ID NO: 59173 - DNA, 103 bp, Artificial Sequence
  Synthetic Polynucleotide
taatacgactcactatagggattctgaagcagaacccgattataaatactaacagaggagaagtattatgaatcgggttaacctggcggcagcgcaaaagatg

SEQ ID NO: 59174 - DNA, 103 bp, Artificial Sequence
  Synthetic Polynucleotide
taatacgactcactatagggagaatattctgaagcagaacccgattataaaacagaggagattataaatgggttctgctaacctggcggcagcgcaaaagatg

SEQ ID NO: 59175 - DNA, 103 bp, Artificial Sequence
  Synthetic Polynucleotide
taatacgactcactatagggagaaaagaatattctgaagcagaacccgataacagaggagaatcgggatgtgcttcagaaacctggcggcagcgcaaaagatg

SEQ ID NO: 59176 - DNA, 103 bp, Artificial Sequence
  Synthetic Polynucleotide
taatacgactcactatagggctcttagaaaagaatattctgaagcagaacaacagaggagagttctgatgcagaatattaacctggcggcagcgcaaaagatg

SEQ ID NO: 59177 - DNA, 103 bp, Artificial Sequence
  Synthetic Polynucleotide
taatacgactcactatagggcgcgtctcttagaaaagaatattctgaagcaacagaggagagcttcaatgtattcttttaacctggcggcagcgcaaaagatg

SEQ ID NO: 59178 - DNA, 103 bp, Artificial Sequence
  Synthetic Polynucleotide
taatacgactcactataggggaagtcgcgtctcttagaaaagaatattctaacagaggagaagaataatgttttctaagaacctggcggcagcgcaaaagatg

SEQ ID NO: 59179 - DNA, 103 bp, Artificial Sequence
  Synthetic Polynucleotide
taatacgactcactatagggctcctgaagtcgcgtctcttagaaaagaataacagaggagaattcttatgtaagagacgaacctggcggcagcgcaaaagatg

SEQ ID NO: 59180 - DNA, 103 bp, Artificial Sequence
  Synthetic Polynucleotide
taatacgactcactatagggactaactcctgaagtcgcgtctcttagaaaaacagaggagatttctaatggacgcgactaacctggcggcagcgcaaaagatg

SEQ ID NO: 59181 - DNA, 103 bp, Artificial Sequence
  Synthetic Polynucleotide
taatacgactcactatagggttggataaaaaagtctcccatgcctagacaaacagaggagatgtctaatgatgggagacaacctggcggcagcgcaaaagatg

SEQ ID NO: 59182 - DNA, 103 bp, Artificial Sequence
  Synthetic Polynucleotide
taatacgactcactatagggcttctactaactcctgaagtcgcgtctcttaacagaggagaaagagaatggacttcaggaacctggcggcagcgcaaaagatg

SEQ ID NO: 59183 - DNA, 103 bp, Artificial Sequence
  Synthetic Polynucleotide
taatacgactcactataggggagttcttctactaactcctgaagtcgcgtaacagaggagaacgcgaatgcaggagttaaacctggcggcagcgcaaaagatg

SEQ ID NO: 59184 - DNA, 103 bp, Artificial Sequence
  Synthetic Polynucleotide
taatacgactcactatagggaaacagagttcttctactaactcctgaagtaacagaggagaacttcaatggttagtagaaacctggcggcagcgcaaaagatg

SEQ ID NO: 59185 - DNA, 103 bp, Artificial Sequence
  Synthetic Polynucleotide
taatacgactcactatagggtacagaaacagagttcttctactaactcctaacagaggagaaggagtatgtagaagaacaacctggcggcagcgcaaaagatg

SEQ ID NO: 59186 - DNA, 103 bp, Artificial Sequence
  Synthetic Polynucleotide
taatacgactcactatagggatagatacagaaacagagttcttctactaaaacagaggagattagtaatggaactctgtaacctggcggcagcgcaaaagatg

SEQ ID NO: 59187 - DNA, 103 bp, Artificial Sequence
  Synthetic Polynucleotide
taatacgactcactatagggcgttgatagatacagaaacagagttcttctaacagaggagaagaagaatgctgtttctgaacctggcggcagcgcaaaagatg

SEQ ID NO: 59188 - DNA, 103 bp, Artificial Sequence
  Synthetic Polynucleotide
taatacgactcactatagggtccagcgttgatagatacagaaacagagttaacagaggagaaactctatgtctgtatctaacctggcggcagcgcaaaagatg

SEQ ID NO: 59189 - DNA, 103 bp, Artificial Sequence
  Synthetic Polynucleotide
taatacgactcactatagggttgattccagcgttgatagatacagaaacaaacagaggagatgtttcatgatctatcaaaacctggcggcagcgcaaaagatg

SEQ ID NO: 59190 - DNA, 103 bp, Artificial Sequence
  Synthetic Polynucleotide
taatacgactcactataggggagtattgattccagcgttgatagatacagaacagaggagactgtatatgtcaacgctgaacctggcggcagcgcaaaagatg

SEQ ID NO: 59191 - DNA, 103 bp, Artificial Sequence
  Synthetic Polynucleotide
taatacgactcactatagggaacttgagtattgattccagcgttgatagaaacagaggagatctatcatggctggaatcaacctggcggcagcgcaaaagatg

SEQ ID NO: 59192 - DNA, 103 bp, Artificial Sequence
  Synthetic Polynucleotide
taatacgactcactatagggaattgttggataaaaaagtctcccatgcctaacagaggagaaggcatatgagactttttaacctggcggcagcgcaaaagatg

SEQ ID NO: 59193 - DNA, 103 bp, Artificial Sequence
  Synthetic Polynucleotide
taatacgactcactatagggtccttaacttgagtattgattccagcgttgaacagaggagacaacgcatgaatcaatacaacctggcggcagcgcaaaagatg

SEQ ID NO: 59194 - DNA, 103 bp, Artificial Sequence
  Synthetic Polynucleotide
taatacgactcactatagggcgctatccttaacttgagtattgattccagaacagaggagactggaaatgatactcaagaacctggcggcagcgcaaaagatg

SEQ ID NO: 59195 - DNA, 103 bp, Artificial Sequence
  Synthetic Polynucleotide
taatacgactcactataggggtattcgctatccttaacttgagtattgataacagaggagaatcaatatgcaagttaagaacctggcggcagcgcaaaagatg

SEQ ID NO: 59196 - DNA, 103 bp, Artificial Sequence
  Synthetic Polynucleotide
taatacgactcactatagggatgaggtattcgctatccttaacttgagtaaacagaggagatactcaatgtaaggatagaacctggcggcagcgcaaaagatg

SEQ ID NO: 59197 - DNA, 103 bp, Artificial Sequence
  Synthetic Polynucleotide
taatacgactcactatagggtgacgatgaggtattcgctatccttaacttaacagaggagaaagttaatgatagcgaataacctggcggcagcgcaaaagatg

SEQ ID NO: 59198 - DNA, 103 bp, Artificial Sequence
  Synthetic Polynucleotide
taatacgactcactataggggatgatgacgatgaggtattcgctatccttaacagaggagaaaggatatggaatacctcaacctggcggcagcgcaaaagatg

SEQ ID NO: 59199 - DNA, 103 bp, Artificial Sequence
  Synthetic Polynucleotide
taatacgactcactatagggatacggatgatgacgatgaggtattcgctaaacagaggagatagcgaatgcctcatcgtaacctggcggcagcgcaaaagatg

SEQ ID NO: 59200 - DNA, 103 bp, Artificial Sequence
  Synthetic Polynucleotide
taatacgactcactatagggagaagatacggatgatgacgatgaggtattaacagaggagaaataccatgtcgtcatcaaacctggcggcagcgcaaaagatg

SEQ ID NO: 59201 - DNA, 103 bp, Artificial Sequence
  Synthetic Polynucleotide
taatacgactcactataggggtttcagaagatacggatgatgacgatgagaacagaggagactcatcatgatcatccgtaacctggcggcagcgcaaaagatg

SEQ ID NO: 59202 - DNA, 103 bp, Artificial Sequence
  Synthetic Polynucleotide
taatacgactcactatagggatggtgtttcagaagatacggatgatgacgaacagaggagacgtcatatgccgtatcttaacctggcggcagcgcaaaagatg

SEQ ID NO: 59203 - DNA, 103 bp, Artificial Sequence
  Synthetic Polynucleotide
taatacgactcactatagggctaaaaattgttggataaaaaagtctcccaaacagaggagatgggagatgtttttatccaacctggcggcagcgcaaaagatg

SEQ ID NO: 59204 - DNA, 103 bp, Artificial Sequence
  Synthetic Polynucleotide
taatacgactcactatagggatatgatggtgtttcagaagatacggatgaaacagaggagatcatccatgtcttctgaaaacctggcggcagcgcaaaagatg

SEQ ID NO: 59205 - DNA, 103 bp, Artificial Sequence
  Synthetic Polynucleotide
taatacgactcactatagggatgtcatatgatggtgtttcagaagatacgaacagaggagacgtatcatgtgaaacaccaacctggcggcagcgcaaaagatg

SEQ ID NO: 59206 - DNA, 103 bp, Artificial Sequence
  Synthetic Polynucleotide
taatacgactcactatagggatgaaatgtcatatgatggtgtttcagaagaacagaggagacttctgatgcaccatcataacctggcggcagcgcaaaagatg

SEQ ID NO: 59207 - DNA, 103 bp, Artificial Sequence
  Synthetic Polynucleotide
taatacgactcactatagggacttcatgaaatgtcatatgatggtgtttcaacagaggagagaaacaatgtcatatgacaacctggcggcagcgcaaaagatg

SEQ ID NO: 59208 - DNA, 103 bp, Artificial Sequence
  Synthetic Polynucleotide
taatacgactcactataggggttagacttcatgaaatgtcatatgatggtaacagaggagaaccatcatgtgacatttcaacctggcggcagcgcaaaagatg

SEQ ID NO: 59209 - DNA, 103 bp, Artificial Sequence
  Synthetic Polynucleotide
taatacgactcactatagggaatacgttagacttcatgaaatgtcatatgaacagaggagacatatgatgtttcatgaaaacctggcggcagcgcaaaagatg

SEQ ID NO: 59210 - DNA, 103 bp, Artificial Sequence
  Synthetic Polynucleotide
taatacgactcactatagggttatcaatacgttagacttcatgaaatgtcaacagaggagagacattatgtgaagtctaaacctggcggcagcgcaaaagatg

SEQ ID NO: 59211 - DNA, 103 bp, Artificial Sequence
  Synthetic Polynucleotide
taatacgactcactatagggtctatttatcaatacgttagacttcatgaaaacagaggagattcatgatgtctaacgtaaacctggcggcagcgcaaaagatg

SEQ ID NO: 59212 - DNA, 103 bp, Artificial Sequence
  Synthetic Polynucleotide
taatacgactcactatagggctgattctatttatcaatacgttagacttcaacagaggagagaagtcatgcgtattgataacctggcggcagcgcaaaagatg

SEQ ID NO: 59213 - DNA, 103 bp, Artificial Sequence
  Synthetic Polynucleotide
taatacgactcactatagggtaaatctgattctatttatcaatacgttagaacagaggagactaacgatgtgataaataaacctggcggcagcgcaaaagatg

SEQ ID NO: 59214 - DNA, 103 bp, Artificial Sequence
  Synthetic Polynucleotide
taatacgactcactatagggtttcactaaaaattgttggataaaaaagtcaacagaggagagactttatgatccaacaaaacctggcggcagcgcaaaagatg

SEQ ID NO: 59215 - DNA, 103 bp, Artificial Sequence
  Synthetic Polynucleotide
taatacgactcactatagggaatactaaatctgattctatttatcaatacaacagaggagagtattgatgaatagaatcaacctggcggcagcgcaaaagatg

SEQ ID NO: 59216 - DNA, 103 bp, Artificial Sequence
  Synthetic Polynucleotide
taatacgactcactatagggtgtttaatactaaatctgattctatttatcaacagaggagagataaaatgaatcagattaacctggcggcagcgcaaaagatg

SEQ ID NO: 59217 - DNA, 103 bp, Artificial Sequence
  Synthetic Polynucleotide
taatacgactcactatagggggatctgtttaatactaaatctgattctataacagaggagaatagaaatggatttagtaaacctggcggcagcgcaaaagatg

SEQ ID NO: 59218 - DNA, 103 bp, Artificial Sequence
  Synthetic Polynucleotide
taatacgactcactataggggttaaggatctgtttaatactaaatctgataacagaggagaatcagaatgagtattaaaaacctggcggcagcgcaaaagatg

SEQ ID NO: 59219 - DNA, 103 bp, Artificial Sequence
  Synthetic Polynucleotide
taatacgactcactatagggaaaaggttaaggatctgtttaatactaaataacagaggagaatttagatgtaaacagataacctggcggcagcgcaaaagatg

SEQ ID NO: 59220 - DNA, 103 bp, Artificial Sequence
  Synthetic Polynucleotide
taatacgactcactatagggtactaaaaaggttaaggatctgtttaatacaacagaggagagtattaatgagatccttaaacctggcggcagcgcaaaagatg

SEQ ID NO: 59221 - DNA, 103 bp, Artificial Sequence
  Synthetic Polynucleotide
taatacgactcactataggggcatttactaaaaaggttaaggatctgtttaacagaggagaaaacagatgcttaaccttaacctggcggcagcgcaaaagatg

SEQ ID NO: 59222 - DNA, 103 bp, Artificial Sequence
  Synthetic Polynucleotide
taatacgactcactatagggtatatgcatttactaaaaaggttaaggatcaacagaggagagatcctatgcctttttagaacctggcggcagcgcaaaagatg

SEQ ID NO: 59223 - DNA, 103 bp, Artificial Sequence
  Synthetic Polynucleotide
taatacgactcactatagggatatatatatgcatttactaaaaaggttaaaacagaggagattaaccatgttagtaaataacctggcggcagcgcaaaagatg

SEQ ID NO: 59224 - DNA, 103 bp, Artificial Sequence
  Synthetic Polynucleotide
taatacgactcactatagggctaatatatatatatgcatttactaaaaagaacagaggagactttttatgaaatgcataaacctggcggcagcgcaaaagatg

SEQ ID NO: 59225 - DNA, 103 bp, Artificial Sequence
  Synthetic Polynucleotide
taatacgactcactataggggaatgtttcactaaaaattgttggataaaaaacagaggagattttatatgacaatttttaacctggcggcagcgcaaaagatg

SEQ ID NO: 59226 - DNA, 103 bp, Artificial Sequence
  Synthetic Polynucleotide
taatacgactcactataggggagatctaatatatatatatgcatttactaaacagaggagatagtaaatgcatatatataacctggcggcagcgcaaaagatg

SEQ ID NO: 59227 - DNA, 103 bp, Artificial Sequence
  Synthetic Polynucleotide
taatacgactcactatagggatctggagatctaatatatatatatgcattaacagaggagaaatgcaatgatatatattaacctggcggcagcgcaaaagatg

SEQ ID NO: 59228 - DNA, 103 bp, Artificial Sequence
  Synthetic Polynucleotide
taatacgactcactatagggatgaaatctggagatctaatatatatatataacagaggagaatatatatgtattagatcaacctggcggcagcgcaaaagatg

SEQ ID NO: 59229 - DNA, 103 bp, Artificial Sequence
  Synthetic Polynucleotide
taatacgactcactatagggatattatgaaatctggagatctaatatataaacagaggagatatataatggatctccagaacctggcggcagcgcaaaagatg

SEQ ID NO: 59230 - DNA, 103 bp, Artificial Sequence
  Synthetic Polynucleotide
taatacgactcactatagggtgatcatattatgaaatctggagatctaataacagaggagaattagaatgccagatttcaacctggcggcagcgcaaaagatg

SEQ ID NO: 59231 - DNA, 103 bp, Artificial Sequence
  Synthetic Polynucleotide
taatacgactcactataggggcatgtgatcatattatgaaatctggagataacagaggagaatctccatgtttcataataacctggcggcagcgcaaaagatg

SEQ ID NO: 59232 - DNA, 103 bp, Artificial Sequence
  Synthetic Polynucleotide
taatacgactcactatagggttaaggcatgtgatcatattatgaaatctgaacagaggagacagattatgtaatatgataacctggcggcagcgcaaaagatg

SEQ ID NO: 59233 - DNA, 103 bp, Artificial Sequence
  Synthetic Polynucleotide
taatacgactcactataggggacatttaaggcatgtgatcatattatgaaaacagaggagattcataatgtgatcacataacctggcggcagcgcaaaagatg

SEQ ID NO: 59234 - DNA, 103 bp, Artificial Sequence
  Synthetic Polynucleotide
taatacgactcactataggggcactgacatttaaggcatgtgatcatattaacagaggagaaatatgatgacatgccttaacctggcggcagcgcaaaagatg

SEQ ID NO: 59235 - DNA, 103 bp, Artificial Sequence
  Synthetic Polynucleotide
taatacgactcactatagggtggaagcactgacatttaaggcatgtgatcaacagaggagagatcacatgccttaaatgaacctggcggcagcgcaaaagatg

SEQ ID NO: 59236 - DNA, 103 bp, Artificial Sequence
  Synthetic Polynucleotide
taatacgactcactatagggtcgaatatccagttgtttgtaattttagaaaacagaggagattctaaatgtacaaacaaaacctggcggcagcgcaaaagatg

SEQ ID NO: 59237 - DNA, 103 bp, Artificial Sequence
  Synthetic Polynucleotide
taatacgactcactatagggatgtggaatgtttcactaaaaattgttggaaacagaggagatccaacatgttttagtgaaacctggcggcagcgcaaaagatg

SEQ ID NO: 59238 - DNA, 103 bp, Artificial Sequence
  Synthetic Polynucleotide
taatacgactcactatagggtattatggaagcactgacatttaaggcatgaacagaggagacatgccatgaatgtcagtaacctggcggcagcgcaaaagatg

SEQ ID NO: 59239 - DNA, 103 bp, Artificial Sequence
  Synthetic Polynucleotide
taatacgactcactataggggactatattatggaagcactgacatttaagaacagaggagacttaaaatgcagtgcttcaacctggcggcagcgcaaaagatg

SEQ ID NO: 59240 - DNA, 103 bp, Artificial Sequence
  Synthetic Polynucleotide
taatacgactcactatagggttccagactatattatggaagcactgacataacagaggagaatgtcaatgcttccataaaacctggcggcagcgcaaaagatg

SEQ ID NO: 59241 - DNA, 103 bp, Artificial Sequence
  Synthetic Polynucleotide
taatacgactcactatagggtagtgttccagactatattatggaagcactaacagaggagaagtgctatgataatatagaacctggcggcagcgcaaaagatg

SEQ ID NO: 59242 - DNA, 103 bp, Artificial Sequence
  Synthetic Polynucleotide
taatacgactcactatagggcccattagtgttccagactatattatggaaaacagaggagattccatatgatagtctggaacctggcggcagcgcaaaagatg

SEQ ID NO: 59243 - DNA, 103 bp, Artificial Sequence
  Synthetic Polynucleotide
taatacgactcactatagggcgtcacccattagtgttccagactatattaaacagaggagataatatatgctggaacacaacctggcggcagcgcaaaagatg

SEQ ID NO: 59244 - DNA, 103 bp, Artificial Sequence
  Synthetic Polynucleotide
taatacgactcactatagggtttttcgtcacccattagtgttccagactaaacagaggagatagtctatgacactaatgaacctggcggcagcgcaaaagatg

SEQ ID NO: 59245 - DNA, 103 bp, Artificial Sequence
  Synthetic Polynucleotide
taatacgactcactataggggtatctttttcgtcacccattagtgttccaaacagaggagatggaacatgaatgggtgaaacctggcggcagcgcaaaagatg

SEQ ID NO: 59246 - DNA, 103 bp, Artificial Sequence
  Synthetic Polynucleotide
taatacgactcactataggggtgcggtatctttttcgtcacccattagtgaacagaggagacactaaatggtgacgaaaaacctggcggcagcgcaaaagatg

SEQ ID NO: 59247 - DNA, 103 bp, Artificial Sequence
  Synthetic Polynucleotide
taatacgactcactatagggatatggtgcggtatctttttcgtcacccataacagaggagaatgggtatggaaaaagataacctggcggcagcgcaaaagatg

SEQ ID NO: 59248 - DNA, 103 bp, Artificial Sequence
  Synthetic Polynucleotide
taatacgactcactatagggaaacgatgtggaatgtttcactaaaaattgaacagaggagacaatttatggtgaaacataacctggcggcagcgcaaaagatg

SEQ ID NO: 59249 - DNA, 103 bp, Artificial Sequence
  Synthetic Polynucleotide
taatacgactcactataggggtagcatatggtgcggtatctttttcgtcaaacagaggagatgacgaatgagataccgcaacctggcggcagcgcaaaagatg

SEQ ID NO: 59250 - DNA, 103 bp, Artificial Sequence
  Synthetic Polynucleotide
taatacgactcactatagggttaacgtagcatatggtgcggtatctttttaacagaggagaaaaaagatgccgcaccataacctggcggcagcgcaaaagatg

SEQ ID NO: 59251 - DNA, 103 bp, Artificial Sequence
  Synthetic Polynucleotide
taatacgactcactatagggatttattaacgtagcatatggtgcggtatcaacagaggagagataccatgccatatgctaacctggcggcagcgcaaaagatg

SEQ ID NO: 59252 - DNA, 103 bp, Artificial Sequence
  Synthetic Polynucleotide
taatacgactcactataggggatttatttattaacgtagcatatggtgcgaacagaggagacgcaccatgtgctacgttaacctggcggcagcgcaaaagatg

SEQ ID NO: 59253 - DNA, 103 bp, Artificial Sequence
  Synthetic Polynucleotide
taatacgactcactataggggttcagatttatttattaacgtagcatatgaacagaggagacatatgatgcgttaataaaacctggcggcagcgcaaaagatg

SEQ ID NO: 59254 - DNA, 103 bp, Artificial Sequence
  Synthetic Polynucleotide
taatacgactcactatagggtagtggttcagatttatttattaacgtagcaacagaggagagctacgatgataaataaaaacctggcggcagcgcaaaagatg

SEQ ID NO: 59255 - DNA, 103 bp, Artificial Sequence
  Synthetic Polynucleotide
taatacgactcactatagggctacttagtggttcagatttatttattaacaacagaggagagttaatatgtaaatctgaaacctggcggcagcgcaaaagatg

SEQ ID NO: 59256 - DNA, 103 bp, Artificial Sequence
  Synthetic Polynucleotide
taatacgactcactatagggattatctacttagtggttcagatttatttaaacagaggagataaataatgctgaaccacaacctggcggcagcgcaaaagatg

SEQ ID NO: 59257 - DNA, 103 bp, Artificial Sequence
  Synthetic Polynucleotide
taatacgactcactatagggtaatcattatctacttagtggttcagatttaacagaggagaaaatctatgccactaagtaacctggcggcagcgcaaaagatg

SEQ ID NO: 59258 - DNA, 103 bp, Artificial Sequence
  Synthetic Polynucleotide
taatacgactcactatagggaatattaatcattatctacttagtggttcaaacagaggagatgaaccatgaagtagataaacctggcggcagcgcaaaagatg

SEQ ID NO: 59259 - DNA, 103 bp, Artificial Sequence
  Synthetic Polynucleotide
taatacgactcactatagggatattaaacgatgtggaatgtttcactaaaaacagaggagatttagtatgacattccacaacctggcggcagcgcaaaagatg

SEQ ID NO: 59260 - DNA, 103 bp, Artificial Sequence
  Synthetic Polynucleotide
taatacgactcactatagggtccttaatattaatcattatctacttagtgaacagaggagacactaaatggataatgataacctggcggcagcgcaaaagatg

SEQ ID NO: 59261 - DNA, 103 bp, Artificial Sequence
  Synthetic Polynucleotide
taatacgactcactatagggcctcttccttaatattaatcattatctactaacagaggagaagtagaatgtgattaataaacctggcggcagcgcaaaagatg

SEQ ID NO: 59262 - DNA, 103 bp, Artificial Sequence
  Synthetic Polynucleotide
taatacgactcactatagggtatttcctcttccttaatattaatcattataacagaggagaataatgatgaatattaagaacctggcggcagcgcaaaagatg

SEQ ID NO: 59263 - DNA, 103 bp, Artificial Sequence
  Synthetic Polynucleotide
taatacgactcactatagggctgaatatttcctcttccttaatattaatcaacagaggagagattaaatgtaaggaagaaacctggcggcagcgcaaaagatg

SEQ ID NO: 59264 - DNA, 103 bp, Artificial Sequence
  Synthetic Polynucleotide
taatacgactcactatagggatatactgaatatttcctcttccttaatataacagaggagaatattaatgaagaggaaaaacctggcggcagcgcaaaagatg

SEQ ID NO: 59265 - DNA, 103 bp, Artificial Sequence
  Synthetic Polynucleotide
taatacgactcactatagggtatctatatactgaatatttcctcttccttaacagaggagaaaggaaatggaaatattcaacctggcggcagcgcaaaagatg

SEQ ID NO: 59266 - DNA, 103 bp, Artificial Sequence
  Synthetic Polynucleotide
taatacgactcactatagggaggcatatctatatactgaatatttcctctaacagaggagaagaggaatgattcagtataacctggcggcagcgcaaaagatg

SEQ ID NO: 59267 - DNA, 103 bp, Artificial Sequence
  Synthetic Polynucleotide
taatacgactcactatagggtgctaaggcatatctatatactgaatatttaacagaggagaaaatatatggtatatagaaacctggcggcagcgcaaaagatg

SEQ ID NO: 59268 - DNA, 103 bp, Artificial Sequence
  Synthetic Polynucleotide
taatacgactcactatagggtatgatgctaaggcatatctatatactgaaaacagaggagattcagtatgtagatatgcaacctggcggcagcgcaaaagatg

SEQ ID NO: 59269 - DNA, 103 bp, Artificial Sequence
  Synthetic Polynucleotide
taatacgactcactatagggcaagatatgatgctaaggcatatctatataaacagaggagatatataatgatgccttagaacctggcggcagcgcaaaagatg

SEQ ID NO: 59270 - DNA, 103 bp, Artificial Sequence
  Synthetic Polynucleotide
taatacgactcactatagggatgtaatattaaacgatgtggaatgtttcaaacagaggagatgaaacatgccacatcgtaacctggcggcagcgcaaaagatg

SEQ ID NO: 59271 - DNA, 103 bp, Artificial Sequence
  Synthetic Polynucleotide
taatacgactcactatagggtagtacaagatatgatgctaaggcatatctaacagaggagaagatatatgttagcatcaaacctggcggcagcgcaaaagatg

SEQ ID NO: 59272 - DNA, 103 bp, Artificial Sequence
  Synthetic Polynucleotide
taatacgactcactataggggtgtttagtacaagatatgatgctaaggcaaacagaggagatgccttatgatcatatctaacctggcggcagcgcaaaagatg

SEQ ID NO: 59273 - DNA, 103 bp, Artificial Sequence
  Synthetic Polynucleotide
taatacgactcactatagggttagtgtgtttagtacaagatatgatgctaaacagaggagatagcatatgatcttgtacaacctggcggcagcgcaaaagatg

SEQ ID NO: 59274 - DNA, 103 bp, Artificial Sequence
  Synthetic Polynucleotide
taatacgactcactatagggactgtttagtgtgtttagtacaagatatgaaacagaggagatcatatatggtactaaacaacctggcggcagcgcaaaagatg

SEQ ID NO: 59275 - DNA, 103 bp, Artificial Sequence
  Synthetic Polynucleotide
taatacgactcactatagggaataaactgtttagtgtgtttagtacaagaaacagaggagatcttgtatgaaacacactaacctggcggcagcgcaaaagatg

SEQ ID NO: 59276 - DNA, 103 bp, Artificial Sequence
  Synthetic Polynucleotide
taatacgactcactatagggacatcaataaactgtttagtgtgtttagtaaacagaggagatactaaatgcactaaacaaacctggcggcagcgcaaaagatg

SEQ ID NO: 59277 - DNA, 103 bp, Artificial Sequence
  Synthetic Polynucleotide
taatacgactcactatagggtgatcacatcaataaactgtttagtgtgttaacagaggagaaacacaatgaacagtttaaacctggcggcagcgcaaaagatg

SEQ ID NO: 59278 - DNA, 103 bp, Artificial Sequence
  Synthetic Polynucleotide
taatacgactcactataggggaaattgatcacatcaataaactgtttagtaacagaggagaactaaaatgtttattgataacctggcggcagcgcaaaagatg

SEQ ID NO: 59279 - DNA, 103 bp, Artificial Sequence
  Synthetic Polynucleotide
taatacgactcactatagggtgttggaaattgatcacatcaataaactgtaacagaggagaacagttatgtgatgtgataacctggcggcagcgcaaaagatg

SEQ ID NO: 59280 - DNA, 103 bp, Artificial Sequence
  Synthetic Polynucleotide
taatacgactcactatagggtgttttgttggaaattgatcacatcaataaaacagaggagattattgatgtgatcaattaacctggcggcagcgcaaaagatg

SEQ ID NO: 59281 - DNA, 103 bp, Artificial Sequence
  Synthetic Polynucleotide
taatacgactcactatagggaaaatatgtaatattaaacgatgtggaatgaacagaggagacattccatgtcgtttaataacctggcggcagcgcaaaagatg

SEQ ID NO: 59282 - DNA, 103 bp, Artificial Sequence
  Synthetic Polynucleotide
taatacgactcactatagggctaattgttttgttggaaattgatcacatcaacagaggagagatgtgatgaatttccaaaacctggcggcagcgcaaaagatg

SEQ ID NO: 59283 - DNA, 103 bp, Artificial Sequence
  Synthetic Polynucleotide
taatacgactcactatagggctgctctaattgttttgttggaaattgatcaacagaggagagatcaaatgccaacaaaaaacctggcggcagcgcaaaagatg

SEQ ID NO: 59284 - DNA, 103 bp, Artificial Sequence
  Synthetic Polynucleotide
taatacgactcactatagggtcctgctgctctaattgttttgttggaaataacagaggagaatttccatgaaaacaattaacctggcggcagcgcaaaagatg

SEQ ID NO: 59285 - DNA, 103 bp, Artificial Sequence
  Synthetic Polynucleotide
taatacgactcactatagggggtattcctgctgctctaattgttttgttgaacagaggagacaacaaatgaattagagcaacctggcggcagcgcaaaagatg

SEQ ID NO: 59286 - DNA, 103 bp, Artificial Sequence
  Synthetic Polynucleotide
taatacgactcactatagggttgttggtattcctgctgctctaattgtttaacagaggagaaaacaaatggagcagcagaacctggcggcagcgcaaaagatg

SEQ ID NO: 59287 - DNA, 103 bp, Artificial Sequence
  Synthetic Polynucleotide
taatacgactcactatagggtatgtttgttggtattcctgctgctctaataacagaggagaattagaatggcaggaataaacctggcggcagcgcaaaagatg

SEQ ID NO: 59288 - DNA, 103 bp, Artificial Sequence
  Synthetic Polynucleotide
taatacgactcactatagggggtaatatgtttgttggtattcctgctgctaacagaggagaagcagcatgaataccaacaacctggcggcagcgcaaaagatg

SEQ ID NO: 59289 - DNA, 103 bp, Artificial Sequence
  Synthetic Polynucleotide
taatacgactcactataggggctgtggtaatatgtttgttggtattcctgaacagaggagacaggaaatgcaacaaacaaacctggcggcagcgcaaaagatg

SEQ ID NO: 59290 - DNA, 103 bp, Artificial Sequence
  Synthetic Polynucleotide
taatacgactcactatagggatacggctgtggtaatatgtttgttggtataacagaggagaataccaatgaacatattaaacctggcggcagcgcaaaagatg

SEQ ID NO: 59291 - DNA, 103 bp, Artificial Sequence
  Synthetic Polynucleotide
taatacgactcactatagggaaaaaatacggctgtggtaatatgtttgttaacagaggagaaacaaaatgattaccacaaacctggcggcagcgcaaaagatg

SEQ ID NO: 59292 - DNA, 103 bp, Artificial Sequence
  Synthetic Polynucleotide
taatacgactcactatagggtatgaaaaatatgtaatattaaacgatgtgaacagaggagacacatcatgtaatattacaacctggcggcagcgcaaaagatg

SEQ ID NO: 59293 - DNA, 103 bp, Artificial Sequence
  Synthetic Polynucleotide
taatacgactcactatagggttcataaaaaatacggctgtggtaatatgtaacagaggagaacatatatgcacagccgtaacctggcggcagcgcaaaagatg

SEQ ID NO: 59294 - DNA, 103 bp, Artificial Sequence
  Synthetic Polynucleotide
taatacgactcactatagggtgatattcataaaaaatacggctgtggtaaaacagaggagattaccaatgccgtattttaacctggcggcagcgcaaaagatg

SEQ ID NO: 59295 - DNA, 103 bp, Artificial Sequence
  Synthetic Polynucleotide
taatacgactcactatagggatatgtgatattcataaaaaatacggctgtaacagaggagaacagccatgttttttatgaacctggcggcagcgcaaaagatg

SEQ ID NO: 59296 - DNA, 103 bp, Artificial Sequence
  Synthetic Polynucleotide
taatacgactcactatagggacatgatatgtgatattcataaaaaatacgaacagaggagacgtattatgtatgaatataacctggcggcagcgcaaaagatg

SEQ ID NO: 59297 - DNA, 103 bp, Artificial Sequence
  Synthetic Polynucleotide
taatacgactcactatagggttttaacatgatatgtgatattcataaaaaaacagaggagatttttaatgatatcacataacctggcggcagcgcaaaagatg

SEQ ID NO: 59298 - DNA, 103 bp, Artificial Sequence
  Synthetic Polynucleotide
taatacgactcactatagggagattttttaacatgatatgtgatattcataacagaggagaatgaatatgacatatcataacctggcggcagcgcaaaagatg

SEQ ID NO: 59299 - DNA, 103 bp, Artificial Sequence
  Synthetic Polynucleotide
taatacgactcactatagggtatcaagattttttaacatgatatgtgataaacagaggagatatcacatgtcatgttaaaacctggcggcagcgcaaaagatg

SEQ ID NO: 59300 - DNA, 103 bp, Artificial Sequence
  Synthetic Polynucleotide
taatacgactcactatagggtcttctatcaagattttttaacatgatatgaacagaggagacatatcatgttaaaaaataacctggcggcagcgcaaaagatg

SEQ ID NO: 59301 - DNA, 103 bp, Artificial Sequence
  Synthetic Polynucleotide
taatacgactcactatagggtttgctcttctatcaagattttttaacatgaacagaggagacatgttatgaaatcttgaaacctggcggcagcgcaaaagatg

SEQ ID NO: 59302 - DNA, 103 bp, Artificial Sequence
  Synthetic Polynucleotide
taatacgactcactatagggagatatttgctcttctatcaagattttttaaacagaggagataaaaaatgttgatagaaaacctggcggcagcgcaaaagatg

SEQ ID NO: 59303 - DNA, 103 bp, Artificial Sequence
  Synthetic Polynucleotide
taatacgactcactatagggccacgtatgaaaaatatgtaatattaaacgaacagaggagacgtttaatgttacatattaacctggcggcagcgcaaaagatg

SEQ ID NO: 59304 - DNA, 103 bp, Artificial Sequence
  Synthetic Polynucleotide
taatacgactcactatagggagatgagatatttgctcttctatcaagattaacagaggagaaatcttatgagaagagcaaacctggcggcagcgcaaaagatg

SEQ ID NO: 59305 - DNA, 103 bp, Artificial Sequence
  Synthetic Polynucleotide
taatacgactcactatagggaagtcagatgagatatttgctcttctatcaaacagaggagatgatagatgagcaaatataacctggcggcagcgcaaaagatg

SEQ ID NO: 59306 - DNA, 103 bp, Artificial Sequence
  Synthetic Polynucleotide
taatacgactcactatagggtcattaagtcagatgagatatttgctcttcaacagaggagagaagagatgatatctcataacctggcggcagcgcaaaagatg

SEQ ID NO: 59307 - DNA, 103 bp, Artificial Sequence
  Synthetic Polynucleotide
taatacgactcactatagggacgtctcattaagtcagatgagatatttgcaacagaggagagcaaatatgtcatctgacaacctggcggcagcgcaaaagatg

SEQ ID NO: 59308 - DNA, 103 bp, Artificial Sequence
  Synthetic Polynucleotide
taatacgactcactataggggaactacgtctcattaagtcagatgagataaacagaggagatatctcatgtgacttaataacctggcggcagcgcaaaagatg

SEQ ID NO: 59309 - DNA, 103 bp, Artificial Sequence
  Synthetic Polynucleotide
taatacgactcactatagggctgctgaactacgtctcattaagtcagatgaacagaggagacatctgatgtaatgagacaacctggcggcagcgcaaaagatg

SEQ ID NO: 59310 - DNA, 103 bp, Artificial Sequence
  Synthetic Polynucleotide
taatacgactcactatagggtgctgctgctgaactacgtctcattaagtcaacagaggagagacttaatgagacgtagtaacctggcggcagcgcaaaagatg

SEQ ID NO: 59311 - DNA, 103 bp, Artificial Sequence
  Synthetic Polynucleotide
taatacgactcactatagggacttatgctgctgctgaactacgtctcattaacagaggagaaatgagatgtagttcagcaacctggcggcagcgcaaaagatg

SEQ ID NO: 59312 - DNA, 103 bp, Artificial Sequence
  Synthetic Polynucleotide
taatacgactcactatagggttatgacttatgctgctgctgaactacgtcaacagaggagagacgtaatgcagcagcagaacctggcggcagcgcaaaagatg

SEQ ID NO: 59313 - DNA, 103 bp, Artificial Sequence
  Synthetic Polynucleotide
taatacgactcactatagggtacagttatgacttatgctgctgctgaactaacagaggagaagttcaatggcagcataaaacctggcggcagcgcaaaagatg

SEQ ID NO: 59314 - DNA, 103 bp, Artificial Sequence
  Synthetic Polynucleotide
taatacgactcactatagggttataccacgtatgaaaaatatgtaatattaacagaggagaaatattatgtatttttcaaacctggcggcagcgcaaaagatg

SEQ ID NO: 59315 - DNA, 103 bp, Artificial Sequence
  Synthetic Polynucleotide
taatacgactcactatagggctatttacagttatgacttatgctgctgctaacagaggagaagcagcatgataagtcataacctggcggcagcgcaaaagatg

SEQ ID NO: 59316 - DNA, 103 bp, Artificial Sequence
  Synthetic Polynucleotide
taatacgactcactatagggatgttctatttacagttatgacttatgctgaacagaggagacagcatatgtcataactgaacctggcggcagcgcaaaagatg

SEQ ID NO: 59317 - DNA, 103 bp, Artificial Sequence
  Synthetic Polynucleotide
taatacgactcactatagggaaagtatgttctatttacagttatgacttaaacagaggagataagtcatgactgtaaataacctggcggcagcgcaaaagatg

SEQ ID NO: 59318 - DNA, 103 bp, Artificial Sequence
  Synthetic Polynucleotide
taatacgactcactatagggacaggaaagtatgttctatttacagttatgaacagaggagacataacatgaaatagaacaacctggcggcagcgcaaaagatg

SEQ ID NO: 59319 - DNA, 103 bp, Artificial Sequence
  Synthetic Polynucleotide
taatacgactcactatagggatactacaggaaagtatgttctatttacagaacagaggagactgtaaatggaacatactaacctggcggcagcgcaaaagatg

SEQ ID NO: 59320 - DNA, 103 bp, Artificial Sequence
  Synthetic Polynucleotide
taatacgactcactatagggaatcaatactacaggaaagtatgttctattaacagaggagaaatagaatgtactttcctaacctggcggcagcgcaaaagatg

SEQ ID NO: 59321 - DNA, 103 bp, Artificial Sequence
  Synthetic Polynucleotide
taatacgactcactatagggtctagaatcaatactacaggaaagtatgttaacagaggagaaacataatgtcctgtagtaacctggcggcagcgcaaaagatg

SEQ ID NO: 59322 - DNA, 103 bp, Artificial Sequence
  Synthetic Polynucleotide
taatacgactcactatagggcggagtctagaatcaatactacaggaaagtaacagaggagaactttcatgtagtattgaaacctggcggcagcgcaaaagatg

SEQ ID NO: 59323 - DNA, 103 bp, Artificial Sequence
  Synthetic Polynucleotide
taatacgactcactatagggtgatgcggagtctagaatcaatactacaggaacagaggagacctgtaatgttgattctaaacctggcggcagcgcaaaagatg

SEQ ID NO: 59324 - DNA, 103 bp, Artificial Sequence
  Synthetic Polynucleotide
taatacgactcactatagggggtgttgatgcggagtctagaatcaatactaacagaggagaagtattatgtctagactcaacctggcggcagcgcaaaagatg

SEQ ID NO: 59325 - DNA, 103 bp, Artificial Sequence
  Synthetic Polynucleotide
taatacgactcactatagggggagtttataccacgtatgaaaaatatgtaaacagaggagatacataatgttcatacgtaacctggcggcagcgcaaaagatg

SEQ ID NO: 59326 - DNA, 103 bp, Artificial Sequence
  Synthetic Polynucleotide
taatacgactcactatagggataatggtgttgatgcggagtctagaatcaaacagaggagatgattcatgactccgcataacctggcggcagcgcaaaagatg

SEQ ID NO: 59327 - DNA, 103 bp, Artificial Sequence
  Synthetic Polynucleotide
taatacgactcactatagggttttaataatggtgttgatgcggagtctagaacagaggagactagacatggcatcaacaaacctggcggcagcgcaaaagatg

SEQ ID NO: 59328 - DNA, 103 bp, Artificial Sequence
  Synthetic Polynucleotide
taatacgactcactatagggactatttttaataatggtgttgatgcggagaacagaggagactccgcatgaacaccattaacctggcggcagcgcaaaagatg

SEQ ID NO: 59329 - DNA, 103 bp, Artificial Sequence
  Synthetic Polynucleotide
taatacgactcactatagggataaaactatttttaataatggtgttgatgaacagaggagacatcaaatgcattattaaaacctggcggcagcgcaaaagatg

SEQ ID NO: 59330 - DNA, 103 bp, Artificial Sequence
  Synthetic Polynucleotide
taatacgactcactatagggtgtatataaaactatttttaataatggtgtaacagaggagaacaccaatgttaaaaataaacctggcggcagcgcaaaagatg

SEQ ID NO: 59331 - DNA, 103 bp, Artificial Sequence
  Synthetic Polynucleotide
taatacgactcactatagggaaagatgtatataaaactatttttaataataacagaggagaattattatgaatagttttaacctggcggcagcgcaaaagatg

SEQ ID NO: 59332 - DNA, 103 bp, Artificial Sequence
  Synthetic Polynucleotide
taatacgactcactatagggagattaaagatgtatataaaactatttttaaacagaggagataaaaaatgttttatataaacctggcggcagcgcaaaagatg

SEQ ID NO: 59333 - DNA, 103 bp, Artificial Sequence
  Synthetic Polynucleotide
taatacgactcactatagggtgagcagattaaagatgtatataaaactataacagaggagaatagttatgtatacatctaacctggcggcagcgcaaaagatg

SEQ ID NO: 59334 - DNA, 103 bp, Artificial Sequence
  Synthetic Polynucleotide
taatacgactcactatagggaacggtgagcagattaaagatgtatataaaaacagaggagatttataatgatctttaataacctggcggcagcgcaaaagatg

SEQ ID NO: 59335 - DNA, 103 bp, Artificial Sequence
  Synthetic Polynucleotide
taatacgactcactatagggcgattaacggtgagcagattaaagatgtataacagaggagaatacatatgtaatctgctaacctggcggcagcgcaaaagatg

SEQ ID NO: 59336 - DNA, 103 bp, Artificial Sequence
  Synthetic Polynucleotide
taatacgactcactatagggtgggtggagtttataccacgtatgaaaaataacagaggagaatttttatgacgtggtataacctggcggcagcgcaaaagatg

SEQ ID NO: 59337 - DNA, 103 bp, Artificial Sequence
  Synthetic Polynucleotide
taatacgactcactatagggttcgacgattaacggtgagcagattaaagaaacagaggagatctttaatgtgctcaccgaacctggcggcagcgcaaaagatg

SEQ ID NO: 59338 - DNA, 103 bp, Artificial Sequence
  Synthetic Polynucleotide
taatacgactcactataggggaacgttcgacgattaacggtgagcagattaacagaggagaaatctgatgaccgttaataacctggcggcagcgcaaaagatg

SEQ ID NO: 59339 - DNA, 103 bp, Artificial Sequence
  Synthetic Polynucleotide
taatacgactcactatagggtactagaacgttcgacgattaacggtgagcaacagaggagagctcacatgtaatcgtcgaacctggcggcagcgcaaaagatg

SEQ ID NO: 59340 - DNA, 103 bp, Artificial Sequence
  Synthetic Polynucleotide
taatacgactcactatagggccgtatactagaacgttcgacgattaacggaacagaggagaccgttaatggtcgaacgtaacctggcggcagcgcaaaagatg

SEQ ID NO: 59341 - DNA, 103 bp, Artificial Sequence
  Synthetic Polynucleotide
taatacgactcactatagggtgtttccgtatactagaacgttcgacgattaacagaggagaaatcgtatgacgttctagaacctggcggcagcgcaaaagatg

SEQ ID NO: 59342 - DNA, 103 bp, Artificial Sequence
  Synthetic Polynucleotide
taatacgactcactatagggcaaagtgtttccgtatactagaacgttcgaaacagaggagatcgaacatgctagtatacaacctggcggcagcgcaaaagatg

SEQ ID NO: 59343 - DNA, 103 bp, Artificial Sequence
  Synthetic Polynucleotide
taatacgactcactataggggaaatcaaagtgtttccgtatactagaacgaacagaggagacgttctatgatacggaaaaacctggcggcagcgcaaaagatg

SEQ ID NO: 59344 - DNA, 103 bp, Artificial Sequence
  Synthetic Polynucleotide
taatacgactcactataggggataagaaatcaaagtgtttccgtatactaaacagaggagatagtatatggaaacacttaacctggcggcagcgcaaaagatg

SEQ ID NO: 59345 - DNA, 103 bp, Artificial Sequence
  Synthetic Polynucleotide
taatacgactcactatagggctacagataagaaatcaaagtgtttccgtaaacagaggagatacggaatgactttgattaacctggcggcagcgcaaaagatg

SEQ ID NO: 59346 - DNA, 103 bp, Artificial Sequence
  Synthetic Polynucleotide
taatacgactcactatagggattaactacagataagaaatcaaagtgtttaacagaggagaaaacacatggatttcttaaacctggcggcagcgcaaaagatg

SEQ ID NO: 59347 - DNA, 103 bp, Artificial Sequence
  Synthetic Polynucleotide
taatacgactcactatagggtgttatcgaatatccagttgtttgtaatttaacagaggagaaaattaatgacaactggaaacctggcggcagcgcaaaagatg

SEQ ID NO: 59348 - DNA, 103 bp, Artificial Sequence
  Synthetic Polynucleotide
taatacgactcactatagggtgtaatgggtggagtttataccacgtatgaaacagaggagatcatacatggtataaactaacctggcggcagcgcaaaagatg

SEQ ID NO: 59349 - DNA, 103 bp, Artificial Sequence
  Synthetic Polynucleotide
taatacgactcactatagggaagtcattaactacagataagaaatcaaagaacagaggagactttgaatgcttatctgtaacctggcggcagcgcaaaagatg

SEQ ID NO: 59350 - DNA, 103 bp, Artificial Sequence
  Synthetic Polynucleotide
taatacgactcactatagggtcactaagtcattaactacagataagaaataacagaggagaatttctatgctgtagttaaacctggcggcagcgcaaaagatg

SEQ ID NO: 59351 - DNA, 103 bp, Artificial Sequence
  Synthetic Polynucleotide
taatacgactcactatagggtgatatcactaagtcattaactacagataaaacagaggagattatctatggttaatgacaacctggcggcagcgcaaaagatg

SEQ ID NO: 59352 - DNA, 103 bp, Artificial Sequence
  Synthetic Polynucleotide
taatacgactcactatagggcttcgtgatatcactaagtcattaactacaaacagaggagatgtagtatgtgacttagtaacctggcggcagcgcaaaagatg

SEQ ID NO: 59353 - DNA, 103 bp, Artificial Sequence
  Synthetic Polynucleotide
taatacgactcactatagggatattcttcgtgatatcactaagtcattaaaacagaggagattaatgatgtagtgatataacctggcggcagcgcaaaagatg

SEQ ID NO: 59354 - DNA, 103 bp, Artificial Sequence
  Synthetic Polynucleotide
taatacgactcactatagggtcgtaatattcttcgtgatatcactaagtcaacagaggagagacttaatgatatcacgaaacctggcggcagcgcaaaagatg

SEQ ID NO: 59355 - DNA, 103 bp, Artificial Sequence
  Synthetic Polynucleotide
taatacgactcactataggggtaattcgtaatattcttcgtgatatcactaacagaggagaagtgatatgacgaagaataacctggcggcagcgcaaaagatg

SEQ ID NO: 59356 - DNA, 103 bp, Artificial Sequence
  Synthetic Polynucleotide
taatacgactcactataggggaaatgtaattcgtaatattcttcgtgataaacagaggagatatcacatggaatattacaacctggcggcagcgcaaaagatg

SEQ ID NO: 59357 - DNA, 103 bp, Artificial Sequence
  Synthetic Polynucleotide
taatacgactcactatagggaacaagaaatgtaattcgtaatattcttcgaacagaggagacgaagaatgttacgaattaacctggcggcagcgcaaaagatg

SEQ ID NO: 59358 - DNA, 103 bp, Artificial Sequence
  Synthetic Polynucleotide
taatacgactcactatagggagaaaaacaagaaatgtaattcgtaatattaacagaggagaaatattatgaattacattaacctggcggcagcgcaaaagatg

SEQ ID NO: 59359 - DNA, 103 bp, Artificial Sequence
  Synthetic Polynucleotide
taatacgactcactatagggatatatgtaatgggtggagtttataccacgaacagaggagacgtggtatgaactccaccaacctggcggcagcgcaaaagatg

SEQ ID NO: 59360 - DNA, 103 bp, Artificial Sequence
  Synthetic Polynucleotide
taatacgactcactatagggtctcaagaaaaacaagaaatgtaattcgtaaacagaggagatacgaaatgcatttcttgaacctggcggcagcgcaaaagatg

SEQ ID NO: 59361 - DNA, 103 bp, Artificial Sequence
  Synthetic Polynucleotide
taatacgactcactatagggatgtctctcaagaaaaacaagaaatgtaataacagaggagaattacaatgcttgtttttaacctggcggcagcgcaaaagatg

SEQ ID NO: 59362 - DNA, 103 bp, Artificial Sequence
  Synthetic Polynucleotide
taatacgactcactataggggaatcatgtctctcaagaaaaacaagaaataacagaggagaatttctatgttttcttgaaacctggcggcagcgcaaaagatg

SEQ ID NO: 59363 - DNA, 103 bp, Artificial Sequence
  Synthetic Polynucleotide
taatacgactcactataggggttctgaatcatgtctctcaagaaaaacaaaacagaggagattgtttatgttgagagacaacctggcggcagcgcaaaagatg

SEQ ID NO: 59364 - DNA, 103 bp, Artificial Sequence
  Synthetic Polynucleotide
taatacgactcactataggggttgagttctgaatcatgtctctcaagaaaaacagaggagatttcttatgagacatgataacctggcggcagcgcaaaagatg

SEQ ID NO: 59365 - DNA, 103 bp, Artificial Sequence
  Synthetic Polynucleotide
taatacgactcactataggggatgagttgagttctgaatcatgtctctcaaacagaggagatgagagatgtgattcagaaacctggcggcagcgcaaaagatg

SEQ ID NO: 59366 - DNA, 103 bp, Artificial Sequence
  Synthetic Polynucleotide
taatacgactcactatagggggaacgatgagttgagttctgaatcatgtcaacagaggagagacatgatgcagaactcaaacctggcggcagcgcaaaagatg

SEQ ID NO: 59367 - DNA, 103 bp, Artificial Sequence
  Synthetic Polynucleotide
taatacgactcactatagggactatggaacgatgagttgagttctgaatcaacagaggagagattcaatgctcaactcaaacctggcggcagcgcaaaagatg

SEQ ID NO: 59368 - DNA, 103 bp, Artificial Sequence
  Synthetic Polynucleotide
taatacgactcactataggggaaaaactatggaacgatgagttgagttctaacagaggagaagaactatgctcatcgttaacctggcggcagcgcaaaagatg

SEQ ID NO: 59369 - DNA, 103 bp, Artificial Sequence
  Synthetic Polynucleotide
taatacgactcactatagggaggtagaaaaactatggaacgatgagttgaaacagaggagatcaactatgcgttccataaacctggcggcagcgcaaaagatg

SEQ ID NO: 59370 - DNA, 103 bp, Artificial Sequence
  Synthetic Polynucleotide
taatacgactcactatagggatgatatatatgtaatgggtggagtttataaacagaggagatataaaatgcacccattaaacctggcggcagcgcaaaagatg

SEQ ID NO: 59371 - DNA, 103 bp, Artificial Sequence
  Synthetic Polynucleotide
taatacgactcactatagggcactgaggtagaaaaactatggaacgatgaaacagaggagatcatcgatgcatagttttaacctggcggcagcgcaaaagatg

SEQ ID NO: 59372 - DNA, 103 bp, Artificial Sequence
  Synthetic Polynucleotide
taatacgactcactatagggttcgccactgaggtagaaaaactatggaacaacagaggagagttccaatgtttttctacaacctggcggcagcgcaaaagatg

SEQ ID NO: 59373 - DNA, 103 bp, Artificial Sequence
  Synthetic Polynucleotide
taatacgactcactatagggaagatttcgccactgaggtagaaaaactataacagaggagaatagttatgctacctcagaacctggcggcagcgcaaaagatg

SEQ ID NO: 59374 - DNA, 103 bp, Artificial Sequence
  Synthetic Polynucleotide
taatacgactcactatagggctccaaagatttcgccactgaggtagaaaaaacagaggagattttctatgtcagtggcgaacctggcggcagcgcaaaagatg

SEQ ID NO: 59375 - DNA, 103 bp, Artificial Sequence
  Synthetic Polynucleotide
taatacgactcactatagggaagcactccaaagatttcgccactgaggtaaacagaggagatacctcatgggcgaaatcaacctggcggcagcgcaaaagatg

SEQ ID NO: 59376 - DNA, 103 bp, Artificial Sequence
  Synthetic Polynucleotide
taatacgactcactataggggtaccaagcactccaaagatttcgccactgaacagaggagacagtggatgaatctttggaacctggcggcagcgcaaaagatg

SEQ ID NO: 59377 - DNA, 103 bp, Artificial Sequence
  Synthetic Polynucleotide
taatacgactcactatagggaaaatgtaccaagcactccaaagatttcgcaacagaggagagcgaaaatgttggagtgcaacctggcggcagcgcaaaagatg

SEQ ID NO: 59378 - DNA, 103 bp, Artificial Sequence
  Synthetic Polynucleotide
taatacgactcactatagggattgaaaaatgtaccaagcactccaaagataacagaggagaatctttatggtgcttggtaacctggcggcagcgcaaaagatg

SEQ ID NO: 59379 - DNA, 103 bp, Artificial Sequence
  Synthetic Polynucleotide
taatacgactcactatagggaccttattgaaaaatgtaccaagcactccaaacagaggagatggagtatgtggtacattaacctggcggcagcgcaaaagatg

SEQ ID NO: 59380 - DNA, 103 bp, Artificial Sequence
  Synthetic Polynucleotide
taatacgactcactatagggcacgaaccttattgaaaaatgtaccaagcaaacagaggagatgcttgatgcatttttcaaacctggcggcagcgcaaaagatg

SEQ ID NO: 59381 - DNA, 103 bp, Artificial Sequence
  Synthetic Polynucleotide
taatacgactcactatagggaaatgatgatatatatgtaatgggtggagtaacagaggagaactccaatgattacatataacctggcggcagcgcaaaagatg

SEQ ID NO: 59382 - DNA, 103 bp, Artificial Sequence
  Synthetic Polynucleotide
taatacgactcactataggggaggtcacgaaccttattgaaaaatgtaccaacagaggagaggtacaatgttcaataagaacctggcggcagcgcaaaagatg

SEQ ID NO: 59383 - DNA, 103 bp, Artificial Sequence
  Synthetic Polynucleotide
taatacgactcactatagggaaatggaggtcacgaaccttattgaaaaataacagaggagaatttttatgtaaggttcgaacctggcggcagcgcaaaagatg

SEQ ID NO: 59384 - DNA, 103 bp, Artificial Sequence
  Synthetic Polynucleotide
taatacgactcactatagggataataaatggaggtcacgaaccttattgaaacagaggagatcaataatgttcgtgaccaacctggcggcagcgcaaaagatg

SEQ ID NO: 59385 - DNA, 103 bp, Artificial Sequence
  Synthetic Polynucleotide
taatacgactcactatagggtttttataataaatggaggtcacgaaccttaacagaggagaaaggttatggacctccataacctggcggcagcgcaaaagatg

SEQ ID NO: 59386 - DNA, 103 bp, Artificial Sequence
  Synthetic Polynucleotide
taatacgactcactatagggaaaattttttataataaatggaggtcacgaaacagaggagatcgtgaatgccatttattaacctggcggcagcgcaaaagatg

SEQ ID NO: 59387 - DNA, 103 bp, Artificial Sequence
  Synthetic Polynucleotide
taatacgactcactatagggtgaataaaattttttataataaatggaggtaacagaggagaacctccatgtattataaaaacctggcggcagcgcaaaagatg

SEQ ID NO: 59388 - DNA, 103 bp, Artificial Sequence
  Synthetic Polynucleotide
taatacgactcactatagggagttttgaataaaattttttataataaatgaacagaggagacatttaatgtaaaaaattaacctggcggcagcgcaaaagatg

SEQ ID NO: 59389 - DNA, 103 bp, Artificial Sequence
  Synthetic Polynucleotide
taatacgactcactatagggagttaagttttgaataaaattttttataataacagaggagaattataatgaattttattaacctggcggcagcgcaaaagatg

SEQ ID NO: 59390 - DNA, 103 bp, Artificial Sequence
  Synthetic Polynucleotide
taatacgactcactatagggattgtagttaagttttgaataaaattttttaacagaggagaaaaaaaatgtattcaaaaaacctggcggcagcgcaaaagatg

SEQ ID NO: 59391 - DNA, 103 bp, Artificial Sequence
  Synthetic Polynucleotide
taatacgactcactatagggacccgattgtagttaagttttgaataaaataacagaggagaattttaatgaaaacttaaaacctggcggcagcgcaaaagatg

SEQ ID NO: 59392 - DNA, 103 bp, Artificial Sequence
  Synthetic Polynucleotide
taatacgactcactatagggttcgtaaatgatgatatatatgtaatgggtaacagaggagaacccatatgatatatatcaacctggcggcagcgcaaaagatg

SEQ ID NO: 59393 - DNA, 103 bp, Artificial Sequence
  Synthetic Polynucleotide
taatacgactcactatagggtaattacccgattgtagttaagttttgaataacagaggagaattcaaatgttaactacaaacctggcggcagcgcaaaagatg

SEQ ID NO: 59394 - DNA, 103 bp, Artificial Sequence
  Synthetic Polynucleotide
taatacgactcactatagggtcttataattacccgattgtagttaagtttaacagaggagaaaacttatgtacaatcggaacctggcggcagcgcaaaagatg

SEQ ID NO: 59395 - DNA, 103 bp, Artificial Sequence
  Synthetic Polynucleotide
taatacgactcactatagggtacgatcttataattacccgattgtagttaaacagaggagataactaatgtcgggtaataacctggcggcagcgcaaaagatg

SEQ ID NO: 59396 - DNA, 103 bp, Artificial Sequence
  Synthetic Polynucleotide
taatacgactcactatagggagatctacgatcttataattacccgattgtaacagaggagaacaatcatgtaattataaaacctggcggcagcgcaaaagatg

SEQ ID NO: 59397 - DNA, 103 bp, Artificial Sequence
  Synthetic Polynucleotide
taatacgactcactatagggatgggagatctacgatcttataattacccgaacagaggagacgggtaatgataagatcgaacctggcggcagcgcaaaagatg

SEQ ID NO: 59398 - DNA, 103 bp, Artificial Sequence
  Synthetic Polynucleotide
taatacgactcactatagggaccacatgggagatctacgatcttataattaacagaggagaaattatatgatcgtagataacctggcggcagcgcaaaagatg

SEQ ID NO: 59399 - DNA, 103 bp, Artificial Sequence
  Synthetic Polynucleotide
taatacgactcactatagggattccaccacatgggagatctacgatcttaaacagaggagataagatatgagatctcccaacctggcggcagcgcaaaagatg

SEQ ID NO: 59400 - DNA, 103 bp, Artificial Sequence
  Synthetic Polynucleotide
taatacgactcactataggggtagtattccaccacatgggagatctacgaaacagaggagatcgtagatgtcccatgtgaacctggcggcagcgcaaaagatg

SEQ ID NO: 59401 - DNA, 103 bp, Artificial Sequence
  Synthetic Polynucleotide
taatacgactcactatagggagatggtagtattccaccacatgggagatcaacagaggagagatctcatgtgtggtggaaacctggcggcagcgcaaaagatg

SEQ ID NO: 59402 - DNA, 103 bp, Artificial Sequence
  Synthetic Polynucleotide
taatacgactcactataggggcgatagatggtagtattccaccacatgggaacagaggagacccatgatgtggaatactaacctggcggcagcgcaaaagatg

SEQ ID NO: 59403 - DNA, 103 bp, Artificial Sequence
  Synthetic Polynucleotide
taatacgactcactatagggcggtattcgtaaatgatgatatatatgtaaaacagaggagattacatatgtatcatcataacctggcggcagcgcaaaagatg

SEQ ID NO: 59404 - DNA, 103 bp, Artificial Sequence
  Synthetic Polynucleotide
taatacgactcactatagggcacatgcgatagatggtagtattccaccacaacagaggagagtggtgatgtactaccataacctggcggcagcgcaaaagatg

SEQ ID NO: 59405 - DNA, 103 bp, Artificial Sequence
  Synthetic Polynucleotide
taatacgactcactatagggccatccacatgcgatagatggtagtattccaacagaggagaggaataatgccatctatcaacctggcggcagcgcaaaagatg

SEQ ID NO: 59406 - DNA, 103 bp, Artificial Sequence
  Synthetic Polynucleotide
taatacgactcactatagggactgtccatccacatgcgatagatggtagtaacagaggagaactaccatgtatcgcatgaacctggcggcagcgcaaaagatg

SEQ ID NO: 59407 - DNA, 103 bp, Artificial Sequence
  Synthetic Polynucleotide
taatacgactcactatagggtacccactgtccatccacatgcgatagatgaacagaggagacatctaatgcatgtggataacctggcggcagcgcaaaagatg

SEQ ID NO: 59408 - DNA, 103 bp, Artificial Sequence
  Synthetic Polynucleotide
taatacgactcactataggggctattacccactgtccatccacatgcgataacagaggagaatcgcaatgggatggacaaacctggcggcagcgcaaaagatg

SEQ ID NO: 59409 - DNA, 103 bp, Artificial Sequence
  Synthetic Polynucleotide
taatacgactcactatagggccatggctattacccactgtccatccacataacagaggagaatgtggatggacagtgggaacctggcggcagcgcaaaagatg

SEQ ID NO: 59410 - DNA, 103 bp, Artificial Sequence
  Synthetic Polynucleotide
taatacgactcactatagggtgttcccatggctattacccactgtccatcaacagaggagagatggaatgtgggtaataaacctggcggcagcgcaaaagatg

SEQ ID NO: 59411 - DNA, 103 bp, Artificial Sequence
  Synthetic Polynucleotide
taatacgactcactatagggattactgttcccatggctattacccactgtaacagaggagaacagtgatgaatagccataacctggcggcagcgcaaaagatg

SEQ ID NO: 59412 - DNA, 103 bp, Artificial Sequence
  Synthetic Polynucleotide
taatacgactcactatagggcaatcattactgttcccatggctattacccaacagaggagagggtaaatgccatgggaaaacctggcggcagcgcaaaagatg

SEQ ID NO: 59413 - DNA, 103 bp, Artificial Sequence
  Synthetic Polynucleotide
taatacgactcactatagggatatgcaatcattactgttcccatggctataacagaggagaatagccatgggaacagtaaacctggcggcagcgcaaaagatg

SEQ ID NO: 59414 - DNA, 103 bp, Artificial Sequence
  Synthetic Polynucleotide
taatacgactcactatagggcgcgtcggtattcgtaaatgatgatatataaacagaggagatatataatgtcatttacgaacctggcggcagcgcaaaagatg

SEQ ID NO: 59415 - DNA, 103 bp, Artificial Sequence
  Synthetic Polynucleotide
taatacgactcactataggggataaatatgcaatcattactgttcccatgaacagaggagacatgggatgagtaatgataacctggcggcagcgcaaaagatg

SEQ ID NO: 59416 - DNA, 103 bp, Artificial Sequence
  Synthetic Polynucleotide
taatacgactcactatagggagaaagataaatatgcaatcattactgttcaacagaggagagaacagatgtgattgcataacctggcggcagcgcaaaagatg

SEQ ID NO: 59417 - DNA, 103 bp, Artificial Sequence
  Synthetic Polynucleotide
taatacgactcactatagggtagcaagaaagataaatatgcaatcattacaacagaggagagtaatgatggcatatttaaacctggcggcagcgcaaaagatg

SEQ ID NO: 59418 - DNA, 103 bp, Artificial Sequence
  Synthetic Polynucleotide
taatacgactcactatagggaatactagcaagaaagataaatatgcaatcaacagaggagagattgcatgtttatctttaacctggcggcagcgcaaaagatg

SEQ ID NO: 59419 - DNA, 103 bp, Artificial Sequence
  Synthetic Polynucleotide
taatacgactcactataggggcagtaatactagcaagaaagataaatatgaacagaggagacatattatgctttcttgcaacctggcggcagcgcaaaagatg

SEQ ID NO: 59420 - DNA, 103 bp, Artificial Sequence
  Synthetic Polynucleotide
taatacgactcactatagggaatatgcagtaatactagcaagaaagataaaacagaggagattatctatgttgctagtaaacctggcggcagcgcaaaagatg

SEQ ID NO: 59421 - DNA, 103 bp, Artificial Sequence
  Synthetic Polynucleotide
taatacgactcactataggggggacaatatgcagtaatactagcaagaaaaacagaggagatttcttatgagtattactaacctggcggcagcgcaaaagatg

SEQ ID NO: 59422 - DNA, 103 bp, Artificial Sequence
  Synthetic Polynucleotide
taatacgactcactatagggacattgggacaatatgcagtaatactagcaaacagaggagatgctagatgtactgcataaacctggcggcagcgcaaaagatg

SEQ ID NO: 59423 - DNA, 103 bp, Artificial Sequence
  Synthetic Polynucleotide
taatacgactcactatagggtcgaaacattgggacaatatgcagtaatacaacagaggagagtattaatgcatattgtcaacctggcggcagcgcaaaagatg

SEQ ID NO: 59424 - DNA, 103 bp, Artificial Sequence
  Synthetic Polynucleotide
taatacgactcactatagggccacatcgaaacattgggacaatatgcagtaacagaggagaactgcaatgtgtcccaataacctggcggcagcgcaaaagatg

SEQ ID NO: 59425 - DNA, 103 bp, Artificial Sequence
  Synthetic Polynucleotide
taatacgactcactatagggtcagacgcgtcggtattcgtaaatgatgataacagaggagaatcatcatgtacgaatacaacctggcggcagcgcaaaagatg

SEQ ID NO: 59426 - DNA, 103 bp, Artificial Sequence
  Synthetic Polynucleotide
taatacgactcactataggggaacaccacatcgaaacattgggacaatataacagaggagaatattgatgcaatgtttcaacctggcggcagcgcaaaagatg

SEQ ID NO: 59427 - DNA, 103 bp, Artificial Sequence
  Synthetic Polynucleotide
taatacgactcactatagggggttagaacaccacatcgaaacattgggacaacagaggagagtcccaatgtttcgatgtaacctggcggcagcgcaaaagatg

SEQ ID NO: 59428 - DNA, 103 bp, Artificial Sequence
  Synthetic Polynucleotide
taatacgactcactatagggtgataggttagaacaccacatcgaaacattaacagaggagaaatgttatgatgtggtgtaacctggcggcagcgcaaaagatg

SEQ ID NO: 59429 - DNA, 103 bp, Artificial Sequence
  Synthetic Polynucleotide
taatacgactcactataggggcagttgataggttagaacaccacatcgaaaacagaggagattcgatatggtgttctaaaacctggcggcagcgcaaaagatg

SEQ ID NO: 59430 - DNA, 103 bp, Artificial Sequence
  Synthetic Polynucleotide
taatacgactcactatagggcagcggcagttgataggttagaacaccacaaacagaggagatgtggtatgctaacctataacctggcggcagcgcaaaagatg

SEQ ID NO: 59431 - DNA, 103 bp, Artificial Sequence
  Synthetic Polynucleotide
taatacgactcactatagggtgatacagcggcagttgataggttagaacaaacagaggagatgttctatgctatcaactaacctggcggcagcgcaaaagatg

SEQ ID NO: 59432 - DNA, 103 bp, Artificial Sequence
  Synthetic Polynucleotide
taatacgactcactatagggtgttgtgatacagcggcagttgataggttaaacagaggagataacctatgaactgccgcaacctggcggcagcgcaaaagatg

SEQ ID NO: 59433 - DNA, 103 bp, Artificial Sequence
  Synthetic Polynucleotide
taatacgactcactatagggactattgttgtgatacagcggcagttgataaacagaggagatatcaaatgccgctgtataacctggcggcagcgcaaaagatg

SEQ ID NO: 59434 - DNA, 103 bp, Artificial Sequence
  Synthetic Polynucleotide
taatacgactcactatagggcggacactattgttgtgatacagcggcagtaacagaggagaactgccatggtatcacaaaacctggcggcagcgcaaaagatg

SEQ ID NO: 59435 - DNA, 103 bp, Artificial Sequence
  Synthetic Polynucleotide
taatacgactcactatagggtccatcggacactattgttgtgatacagcgaacagaggagacgctgtatgacaacaataaacctggcggcagcgcaaaagatg

SEQ ID NO: 59436 - DNA, 103 bp, Artificial Sequence
  Synthetic Polynucleotide
taatacgactcactataggggatattcagacgcgtcggtattcgtaaatgaacagaggagacatttaatgataccgacgaacctggcggcagcgcaaaagatg

SEQ ID NO: 59437 - DNA, 103 bp, Artificial Sequence
  Synthetic Polynucleotide
taatacgactcactatagggttaattccatcggacactattgttgtgataaacagaggagatatcacatgaatagtgtcaacctggcggcagcgcaaaagatg

SEQ ID NO: 59438 - DNA, 103 bp, Artificial Sequence
  Synthetic Polynucleotide
taatacgactcactatagggtaatcttaattccatcggacactattgttgaacagaggagacaacaaatgtgtccgatgaacctggcggcagcgcaaaagatg

SEQ ID NO: 59439 - DNA, 103 bp, Artificial Sequence
  Synthetic Polynucleotide
taatacgactcactataggggatcataatcttaattccatcggacactataacagaggagaatagtgatggatggaattaacctggcggcagcgcaaaagatg

SEQ ID NO: 59440 - DNA, 103 bp, Artificial Sequence
  Synthetic Polynucleotide
taatacgactcactatagggcattggatcataatcttaattccatcggacaacagaggagagtccgaatgaattaagataacctggcggcagcgcaaaagatg

SEQ ID NO: 59441 - DNA, 103 bp, Artificial Sequence
  Synthetic Polynucleotide
taatacgactcactatagggaaacacattggatcataatcttaattccataacagaggagaatggaaatgagattatgaaacctggcggcagcgcaaaagatg

SEQ ID NO: 59442 - DNA, 103 bp, Artificial Sequence
  Synthetic Polynucleotide
taatacgactcactatagggatattaaacacattggatcataatcttaataacagaggagaattaagatgatgatccaaaacctggcggcagcgcaaaagatg

SEQ ID NO: 59443 - DNA, 103 bp, Artificial Sequence
  Synthetic Polynucleotide
taatacgactcactatagggatcatatattaaacacattggatcataatcaacagaggagagattatatgccaatgtgtaacctggcggcagcgcaaaagatg

SEQ ID NO: 59444 - DNA, 103 bp, Artificial Sequence
  Synthetic Polynucleotide
taatacgactcactatagggtgataatcatatattaaacacattggatcaaacagaggagatgatccatggtgtttaataacctggcggcagcgcaaaagatg

SEQ ID NO: 59445 - DNA, 103 bp, Artificial Sequence
  Synthetic Polynucleotide
taatacgactcactatagggagacttgataatcatatattaaacacattgaacagaggagacaatgtatgtaatatatgaacctggcggcagcgcaaaagatg

SEQ ID NO: 59446 - DNA, 103 bp, Artificial Sequence
  Synthetic Polynucleotide
taatacgactcactataggggtataagacttgataatcatatattaaacaaacagaggagatgtttaatgtatgattataacctggcggcagcgcaaaagatg

SEQ ID NO: 59447 - DNA, 103 bp, Artificial Sequence
  Synthetic Polynucleotide
taatacgactcactatagggtcctagatattcagacgcgtcggtattcgtaacagaggagaacgaatatggacgcgtctaacctggcggcagcgcaaaagatg

SEQ ID NO: 59448 - DNA, 103 bp, Artificial Sequence
  Synthetic Polynucleotide
taatacgactcactatagggggatcgtataagacttgataatcatatattaacagaggagaaatataatgttatcaagtaacctggcggcagcgcaaaagatg

SEQ ID NO: 59449 - DNA, 103 bp, Artificial Sequence
  Synthetic Polynucleotide
taatacgactcactataggggacgcggatcgtataagacttgataatcataacagaggagaatgattatgaagtcttataacctggcggcagcgcaaaagatg

SEQ ID NO: 59450 - DNA, 103 bp, Artificial Sequence
  Synthetic Polynucleotide
taatacgactcactatagggaaaaagacgcggatcgtataagacttgataaacagaggagatatcaaatgttatacgataacctggcggcagcgcaaaagatg

SEQ ID NO: 59451 - DNA, 103 bp, Artificial Sequence
  Synthetic Polynucleotide
taatacgactcactatagggtgtcaaaaaagacgcggatcgtataagactaacagaggagaagtcttatgcgatccgcgaacctggcggcagcgcaaaagatg

SEQ ID NO: 59452 - DNA, 103 bp, Artificial Sequence
  Synthetic Polynucleotide
taatacgactcactataggggatcctgtcaaaaaagacgcggatcgtataaacagaggagatatacgatgcgcgtctttaacctggcggcagcgcaaaagatg

SEQ ID NO: 59453 - DNA, 103 bp, Artificial Sequence
  Synthetic Polynucleotide
taatacgactcactatagggaacctgatcctgtcaaaaaagacgcggatcaacagaggagagatccgatgcttttttgaaacctggcggcagcgcaaaagatg

SEQ ID NO: 59454 - DNA, 103 bp, Artificial Sequence
  Synthetic Polynucleotide
taatacgactcactatagggagaagaacctgatcctgtcaaaaaagacgcaacagaggagagcgtctatgttgacaggaaacctggcggcagcgcaaaagatg

SEQ ID NO: 59455 - DNA, 103 bp, Artificial Sequence
  Synthetic Polynucleotide
taatacgactcactatagggcatgtagaagaacctgatcctgtcaaaaaaaacagaggagattttttatgaggatcaggaacctggcggcagcgcaaaagatg

SEQ ID NO: 59456 - DNA, 103 bp, Artificial Sequence
  Synthetic Polynucleotide
taatacgactcactatagggttcttcatgtagaagaacctgatcctgtcaaacagaggagatgacagatgcaggttcttaacctggcggcagcgcaaaagatg

SEQ ID NO: 59457 - DNA, 103 bp, Artificial Sequence
  Synthetic Polynucleotide
taatacgactcactataggggaaacttcttcatgtagaagaacctgatccaacagaggagaggatcaatgtcttctacaaacctggcggcagcgcaaaagatg

SEQ ID NO: 59458 - DNA, 103 bp, Artificial Sequence
  Synthetic Polynucleotide
taatacgactcactatagggaatgctgttatcgaatatccagttgtttgtaacagaggagaacaaacatgtggatattcaacctggcggcagcgcaaaagatg

SEQ ID NO: 59459 - DNA, 103 bp, Artificial Sequence
  Synthetic Polynucleotide
taatacgactcactatagggattactcctagatattcagacgcgtcggtaaacagaggagataccgaatggtctgaataaacctggcggcagcgcaaaagatg

SEQ ID NO: 59460 - DNA, 103 bp, Artificial Sequence
  Synthetic Polynucleotide
taatacgactcactatagggaggccgaaacttcttcatgtagaagaacctaacagaggagaaggttcatgtacatgaagaacctggcggcagcgcaaaagatg

SEQ ID NO: 59461 - DNA, 103 bp, Artificial Sequence
  Synthetic Polynucleotide
taatacgactcactatagggataagaggccgaaacttcttcatgtagaagaacagaggagacttctaatggaagaagttaacctggcggcagcgcaaaagatg

SEQ ID NO: 59462 - DNA, 103 bp, Artificial Sequence
  Synthetic Polynucleotide
taatacgactcactatagggatattataagaggccgaaacttcttcatgtaacagaggagaacatgaatgagtttcggcaacctggcggcagcgcaaaagatg

SEQ ID NO: 59463 - DNA, 103 bp, Artificial Sequence
  Synthetic Polynucleotide
taatacgactcactatagggcatgaatattataagaggccgaaacttcttaacagaggagaaagaagatgcggcctcttaacctggcggcagcgcaaaagatg

SEQ ID NO: 59464 - DNA, 103 bp, Artificial Sequence
  Synthetic Polynucleotide
taatacgactcactatagggccagacatgaatattataagaggccgaaacaacagaggagagtttcgatgtcttataataacctggcggcagcgcaaaagatg

SEQ ID NO: 59465 - DNA, 103 bp, Artificial Sequence
  Synthetic Polynucleotide
taatacgactcactataggggtttcccagacatgaatattataagaggccaacagaggagaggcctcatgtaatattcaaacctggcggcagcgcaaaagatg

SEQ ID NO: 59466 - DNA, 103 bp, Artificial Sequence
  Synthetic Polynucleotide
taatacgactcactatagggccaccgtttcccagacatgaatattataagaacagaggagacttataatgttcatgtctaacctggcggcagcgcaaaagatg

SEQ ID NO: 59467 - DNA, 103 bp, Artificial Sequence
  Synthetic Polynucleotide
taatacgactcactatagggctagaccaccgtttcccagacatgaatattaacagaggagaaatattatggtctgggaaaacctggcggcagcgcaaaagatg

SEQ ID NO: 59468 - DNA, 103 bp, Artificial Sequence
  Synthetic Polynucleotide
taatacgactcactatagggttaccctagaccaccgtttcccagacatgaaacagaggagatcatgtatgggaaacggtaacctggcggcagcgcaaaagatg

SEQ ID NO: 59469 - DNA, 103 bp, Artificial Sequence
  Synthetic Polynucleotide
taatacgactcactataggggagccttaccctagaccaccgtttcccagaaacagaggagatctgggatgcggtggtctaacctggcggcagcgcaaaagatg

SEQ ID NO: 59470 - DNA, 103 bp, Artificial Sequence
  Synthetic Polynucleotide
taatacgactcactatagggacttaattactcctagatattcagacgcgtaacagaggagaacgcgtatgaatatctagaacctggcggcagcgcaaaagatg

SEQ ID NO: 59471 - DNA, 103 bp, Artificial Sequence
  Synthetic Polynucleotide
taatacgactcactatagggtaccggagccttaccctagaccaccgtttcaacagaggagagaaacgatggtctagggtaacctggcggcagcgcaaaagatg

SEQ ID NO: 59472 - DNA, 103 bp, Artificial Sequence
  Synthetic Polynucleotide
taatacgactcactatagggtccgataccggagccttaccctagaccaccaacagaggagaggtggtatggggtaaggcaacctggcggcagcgcaaaagatg

SEQ ID NO: 59473 - DNA, 103 bp, Artificial Sequence
  Synthetic Polynucleotide
taatacgactcactatagggcccactccgataccggagccttaccctagaaacagaggagatctaggatgaggctccggaacctggcggcagcgcaaaagatg

SEQ ID NO: 59474 - DNA, 103 bp, Artificial Sequence
  Synthetic Polynucleotide
taatacgactcactatagggcaaaacccactccgataccggagccttaccaacagaggagaggtaagatgccggtatcgaacctggcggcagcgcaaaagatg

SEQ ID NO: 59475 - DNA, 103 bp, Artificial Sequence
  Synthetic Polynucleotide
taatacgactcactatagggtaatccaaaacccactccgataccggagccaacagaggagaggctccatgatcggagtgaacctggcggcagcgcaaaagatg

SEQ ID NO: 59476 - DNA, 103 bp, Artificial Sequence
  Synthetic Polynucleotide
taatacgactcactataggggattataatccaaaacccactccgataccgaacagaggagacggtatatgagtgggtttaacctggcggcagcgcaaaagatg

SEQ ID NO: 59477 - DNA, 103 bp, Artificial Sequence
  Synthetic Polynucleotide
taatacgactcactatagggatgatgattataatccaaaacccactccgaaacagaggagatcggagatggttttggataacctggcggcagcgcaaaagatg

SEQ ID NO: 59478 - DNA, 103 bp, Artificial Sequence
  Synthetic Polynucleotide
taatacgactcactatagggagacgatgatgattataatccaaaacccacaacagaggagagtgggtatgggattataaaacctggcggcagcgcaaaagatg

SEQ ID NO: 59479 - DNA, 103 bp, Artificial Sequence
  Synthetic Polynucleotide
taatacgactcactataggggatgtagacgatgatgattataatccaaaaaacagaggagattttggatgataatcatcaacctggcggcagcgcaaaagatg

SEQ ID NO: 59480 - DNA, 103 bp, Artificial Sequence
  Synthetic Polynucleotide
taatacgactcactatagggatgatgatgtagacgatgatgattataatcaacagaggagagattatatgcatcatcgtaacctggcggcagcgcaaaagatg

SEQ ID NO: 59481 - DNA, 103 bp, Artificial Sequence
  Synthetic Polynucleotide
taatacgactcactatagggtccaaacttaattactcctagatattcagaaacagaggagatctgaaatgctaggagtaaacctggcggcagcgcaaaagatg

SEQ ID NO: 59482 - DNA, 103 bp, Artificial Sequence
  Synthetic Polynucleotide
taatacgactcactatagggcaaagatgatgatgtagacgatgatgattaaacagaggagataatcaatgtcgtctacaaacctggcggcagcgcaaaagatg

SEQ ID NO: 59483 - DNA, 103 bp, Artificial Sequence
  Synthetic Polynucleotide
taatacgactcactatagggaatatcaaagatgatgatgtagacgatgataacagaggagaatcatcatgtacatcatcaacctggcggcagcgcaaaagatg

SEQ ID NO: 59484 - DNA, 103 bp, Artificial Sequence
  Synthetic Polynucleotide
taatacgactcactatagggaaataaatatcaaagatgatgatgtagacgaacagaggagacgtctaatgcatcatcttaacctggcggcagcgcaaaagatg

SEQ ID NO: 59485 - DNA, 103 bp, Artificial Sequence
  Synthetic Polynucleotide
taatacgactcactatagggtagcaaaataaatatcaaagatgatgatgtaacagaggagaacatcaatgtctttgataaacctggcggcagcgcaaaagatg

SEQ ID NO: 59486 - DNA, 103 bp, Artificial Sequence
  Synthetic Polynucleotide
taatacgactcactatagggcaagatagcaaaataaatatcaaagatgataacagaggagaatcatcatggatatttataacctggcggcagcgcaaaagatg

SEQ ID NO: 59487 - DNA, 103 bp, Artificial Sequence
  Synthetic Polynucleotide
taatacgactcactatagggatcatcaagatagcaaaataaatatcaaagaacagaggagactttgaatgttattttgcaacctggcggcagcgcaaaagatg

SEQ ID NO: 59488 - DNA, 103 bp, Artificial Sequence
  Synthetic Polynucleotide
taatacgactcactatagggaggacatcatcaagatagcaaaataaatataacagaggagaatatttatgttgctatctaacctggcggcagcgcaaaagatg

SEQ ID NO: 59489 - DNA, 103 bp, Artificial Sequence
  Synthetic Polynucleotide
taatacgactcactataggggatacaggacatcatcaagatagcaaaataaacagaggagatattttatgatcttgatgaacctggcggcagcgcaaaagatg

SEQ ID NO: 59490 - DNA, 103 bp, Artificial Sequence
  Synthetic Polynucleotide
taatacgactcactatagggcaactgatacaggacatcatcaagatagcaaacagaggagatgctatatggatgatgtcaacctggcggcagcgcaaaagatg

SEQ ID NO: 59491 - DNA, 103 bp, Artificial Sequence
  Synthetic Polynucleotide
taatacgactcactatagggaaatgcaactgatacaggacatcatcaagaaacagaggagatcttgaatgtgtcctgtaaacctggcggcagcgcaaaagatg

SEQ ID NO: 59492 - DNA, 103 bp, Artificial Sequence
  Synthetic Polynucleotide
taatacgactcactatagggagacatccaaacttaattactcctagatataacagaggagaatatctatgagtaattaaaacctggcggcagcgcaaaagatg

SEQ ID NO: 59493 - DNA, 103 bp, Artificial Sequence
  Synthetic Polynucleotide
taatacgactcactataggggttgaaaatgcaactgatacaggacatcataacagaggagaatgatgatgtgtatcagtaacctggcggcagcgcaaaagatg

SEQ ID NO: 59494 - DNA, 103 bp, Artificial Sequence
  Synthetic Polynucleotide
taatacgactcactatagggcgagtgttgaaaatgcaactgatacaggacaacagaggagagtcctgatgcagttgcataacctggcggcagcgcaaaagatg

SEQ ID NO: 59495 - DNA, 103 bp, Artificial Sequence
  Synthetic Polynucleotide
taatacgactcactatagggtcagtcgagtgttgaaaatgcaactgatacaacagaggagagtatcaatggcattttcaaacctggcggcagcgcaaaagatg

SEQ ID NO: 59496 - DNA, 103 bp, Artificial Sequence
  Synthetic Polynucleotide
taatacgactcactatagggaatattcagtcgagtgttgaaaatgcaactaacagaggagaagttgcatgttcaacactaacctggcggcagcgcaaaagatg

SEQ ID NO: 59497 - DNA, 103 bp, Artificial Sequence
  Synthetic Polynucleotide
taatacgactcactataggggtgctaatattcagtcgagtgttgaaaatgaacagaggagacattttatgcactcgactaacctggcggcagcgcaaaagatg

SEQ ID NO: 59498 - DNA, 103 bp, Artificial Sequence
  Synthetic Polynucleotide
taatacgactcactatagggtgaatgtgctaatattcagtcgagtgttgaaacagaggagatcaacaatggactgaataaacctggcggcagcgcaaaagatg

SEQ ID NO: 59499 - DNA, 103 bp, Artificial Sequence
  Synthetic Polynucleotide
taatacgactcactataggggacaatgaatgtgctaatattcagtcgagtaacagaggagaactcgaatgaatattagcaacctggcggcagcgcaaaagatg

SEQ ID NO: 59500 - DNA, 103 bp, Artificial Sequence
  Synthetic Polynucleotide
taatacgactcactatagggtaatagacaatgaatgtgctaatattcagtaacagaggagaactgaaatgtagcacattaacctggcggcagcgcaaaagatg

SEQ ID NO: 59501 - DNA, 103 bp, Artificial Sequence
  Synthetic Polynucleotide
taatacgactcactatagggggtaataatagacaatgaatgtgctaatataacagaggagaatattaatgcattcattgaacctggcggcagcgcaaaagatg

SEQ ID NO: 59502 - DNA, 103 bp, Artificial Sequence
  Synthetic Polynucleotide
taatacgactcactatagggaatatggtaataatagacaatgaatgtgctaacagaggagaagcacaatgattgtctataacctggcggcagcgcaaaagatg

SEQ ID NO: 59503 - DNA, 103 bp, Artificial Sequence
  Synthetic Polynucleotide
taatacgactcactatagggggataagacatccaaacttaattactcctaaacagaggagataggagatgttaagtttgaacctggcggcagcgcaaaagatg

SEQ ID NO: 59504 - DNA, 103 bp, Artificial Sequence
  Synthetic Polynucleotide
taatacgactcactatagggttagaaatatggtaataatagacaatgaataacagaggagaattcatatgctattattaaacctggcggcagcgcaaaagatg

SEQ ID NO: 59505 - DNA, 103 bp, Artificial Sequence
  Synthetic Polynucleotide
taatacgactcactatagggtgggtttagaaatatggtaataatagacaaaacagaggagattgtctatgattaccataaacctggcggcagcgcaaaagatg

SEQ ID NO: 59506 - DNA, 103 bp, Artificial Sequence
  Synthetic Polynucleotide
taatacgactcactatagggcattttgggtttagaaatatggtaataataaacagaggagatattatatgcatatttctaacctggcggcagcgcaaaagatg

SEQ ID NO: 59507 - DNA, 103 bp, Artificial Sequence
  Synthetic Polynucleotide
taatacgactcactatagggacatacattttgggtttagaaatatggtaaaacagaggagattaccaatgttctaaaccaacctggcggcagcgcaaaagatg

SEQ ID NO: 59508 - DNA, 103 bp, Artificial Sequence
  Synthetic Polynucleotide
taatacgactcactatagggtcaacacatacattttgggtttagaaatataacagaggagaatatttatgaacccaaaaaacctggcggcagcgcaaaagatg

SEQ ID NO: 59509 - DNA, 103 bp, Artificial Sequence
  Synthetic Polynucleotide
taatacgactcactataggggatgttcaacacatacattttgggtttagaaacagaggagatctaaaatgaaaatgtataacctggcggcagcgcaaaagatg

SEQ ID NO: 59510 - DNA, 103 bp, Artificial Sequence
  Synthetic Polynucleotide
taatacgactcactataggggtactgatgttcaacacatacattttgggtaacagaggagaacccaaatggtatgtgttaacctggcggcagcgcaaaagatg

SEQ ID NO: 59511 - DNA, 103 bp, Artificial Sequence
  Synthetic Polynucleotide
taatacgactcactatagggcaatagtactgatgttcaacacatacatttaacagaggagaaaatgtatgtgttgaacaaacctggcggcagcgcaaaagatg

SEQ ID NO: 59512 - DNA, 103 bp, Artificial Sequence
  Synthetic Polynucleotide
taatacgactcactatagggatcaacaatagtactgatgttcaacacataaacagaggagatatgtgatgaacatcagtaacctggcggcagcgcaaaagatg

SEQ ID NO: 59513 - DNA, 103 bp, Artificial Sequence
  Synthetic Polynucleotide
taatacgactcactataggggactcatcaacaatagtactgatgttcaacaacagaggagagttgaaatgcagtactataacctggcggcagcgcaaaagatg

SEQ ID NO: 59514 - DNA, 103 bp, Artificial Sequence
  Synthetic Polynucleotide
taatacgactcactataggggaaatggataagacatccaaacttaattacaacagaggagagtaattatgtttggatgtaacctggcggcagcgcaaaagatg

SEQ ID NO: 59515 - DNA, 103 bp, Artificial Sequence
  Synthetic Polynucleotide
taatacgactcactatagggtataagactcatcaacaatagtactgatgtaacagaggagaacatcaatgctattgttgaacctggcggcagcgcaaaagatg

SEQ ID NO: 59516 - DNA, 103 bp, Artificial Sequence
  Synthetic Polynucleotide
taatacgactcactatagggcatgctataagactcatcaacaatagtactaacagaggagaagtactatggttgatgagaacctggcggcagcgcaaaagatg

SEQ ID NO: 59517 - DNA, 103 bp, Artificial Sequence
  Synthetic Polynucleotide
taatacgactcactataggggaattcatgctataagactcatcaacaataaacagaggagatattgtatgtgagtcttaaacctggcggcagcgcaaaagatg

SEQ ID NO: 59518 - DNA, 103 bp, Artificial Sequence
  Synthetic Polynucleotide
taatacgactcactatagggtaagcgaattcatgctataagactcatcaaaacagaggagattgatgatgcttatagcaaacctggcggcagcgcaaaagatg

SEQ ID NO: 59519 - DNA, 103 bp, Artificial Sequence
  Synthetic Polynucleotide
taatacgactcactatagggaacgataagcgaattcatgctataagactcaacagaggagagagtctatgagcatgaataacctggcggcagcgcaaaagatg

SEQ ID NO: 59520 - DNA, 103 bp, Artificial Sequence
  Synthetic Polynucleotide
taatacgactcactatagggccgataacgataagcgaattcatgctataaaacagaggagattatagatggaattcgctaacctggcggcagcgcaaaagatg

SEQ ID NO: 59521 - DNA, 103 bp, Artificial Sequence
  Synthetic Polynucleotide
taatacgactcactatagggtaaacccgataacgataagcgaattcatgcaacagaggagagcatgaatgcgcttatcgaacctggcggcagcgcaaaagatg

SEQ ID NO: 59522 - DNA, 103 bp, Artificial Sequence
  Synthetic Polynucleotide
taatacgactcactataggggaaactaaacccgataacgataagcgaattaacagaggagaaattcgatgatcgttatcaacctggcggcagcgcaaaagatg

SEQ ID NO: 59523 - DNA, 103 bp, Artificial Sequence
  Synthetic Polynucleotide
taatacgactcactatagggttacagaaactaaacccgataacgataagcaacagaggagagcttatatgtatcgggttaacctggcggcagcgcaaaagatg

SEQ ID NO: 59524 - DNA, 103 bp, Artificial Sequence
  Synthetic Polynucleotide
taatacgactcactatagggtaaggttacagaaactaaacccgataacgaaacagaggagatcgttaatgggtttagttaacctggcggcagcgcaaaagatg

SEQ ID NO: 59525 - DNA, 103 bp, Artificial Sequence
  Synthetic Polynucleotide
taatacgactcactatagggacttcgaaatggataagacatccaaacttaaacagaggagataagttatgatgtcttataacctggcggcagcgcaaaagatg

SEQ ID NO: 59526 - DNA, 103 bp, Artificial Sequence
  Synthetic Polynucleotide
taatacgactcactatagggattgttaaggttacagaaactaaacccgataacagaggagaatcgggatgagtttctgtaacctggcggcagcgcaaaagatg

SEQ ID NO: 59527 - DNA, 103 bp, Artificial Sequence
  Synthetic Polynucleotide
taatacgactcactatagggaaggaattgttaaggttacagaaactaaacaacagaggagagtttagatgctgtaacctaacctggcggcagcgcaaaagatg

SEQ ID NO: 59528 - DNA, 103 bp, Artificial Sequence
  Synthetic Polynucleotide
taatacgactcactatagggtaaaaaaggaattgttaaggttacagaaacaacagaggagagtttctatgaccttaacaaacctggcggcagcgcaaaagatg

SEQ ID NO: 59529 - DNA, 103 bp, Artificial Sequence
  Synthetic Polynucleotide
taatacgactcactatagggtttaataaaaaaggaattgttaaggttacaaacagaggagatgtaacatgaacaattccaacctggcggcagcgcaaaagatg

SEQ ID NO: 59530 - DNA, 103 bp, Artificial Sequence
  Synthetic Polynucleotide
taatacgactcactatagggtagagtttaataaaaaaggaattgttaaggaacagaggagaccttaaatgttcctttttaacctggcggcagcgcaaaagatg

SEQ ID NO: 59531 - DNA, 103 bp, Artificial Sequence
  Synthetic Polynucleotide
taatacgactcactatagggttatgtagagtttaataaaaaaggaattgtaacagaggagaacaattatgtttttattaaacctggcggcagcgcaaaagatg

SEQ ID NO: 59532 - DNA, 103 bp, Artificial Sequence
  Synthetic Polynucleotide
taatacgactcactatagggtatgattatgtagagtttaataaaaaaggaaacagaggagatcctttatgattaaactcaacctggcggcagcgcaaaagatg

SEQ ID NO: 59533 - DNA, 103 bp, Artificial Sequence
  Synthetic Polynucleotide
taatacgactcactatagggatggttatgattatgtagagtttaataaaaaacagaggagattttatatgactctacataacctggcggcagcgcaaaagatg

SEQ ID NO: 59534 - DNA, 103 bp, Artificial Sequence
  Synthetic Polynucleotide
taatacgactcactatagggtagaaatggttatgattatgtagagtttaaaacagaggagattaaacatgacataatcaaacctggcggcagcgcaaaagatg

SEQ ID NO: 59535 - DNA, 103 bp, Artificial Sequence
  Synthetic Polynucleotide
taatacgactcactatagggaacaatagaaatggttatgattatgtagagaacagaggagactctacatgatcataaccaacctggcggcagcgcaaaagatg

SEQ ID NO: 59536 - DNA, 103 bp, Artificial Sequence
  Synthetic Polynucleotide
taatacgactcactataggggctacacttcgaaatggataagacatccaaaacagaggagattggatatgttatccattaacctggcggcagcgcaaaagatg

SEQ ID NO: 59537 - DNA, 103 bp, Artificial Sequence
  Synthetic Polynucleotide
taatacgactcactatagggaaacaaacaatagaaatggttatgattatgaacagaggagacataatatgaaccatttcaacctggcggcagcgcaaaagatg

SEQ ID NO: 59538 - DNA, 103 bp, Artificial Sequence
  Synthetic Polynucleotide
taatacgactcactatagggtattaaaacaaacaatagaaatggttatgaaacagaggagatcataaatgtttctattgaacctggcggcagcgcaaaagatg

SEQ ID NO: 59539 - DNA, 103 bp, Artificial Sequence
  Synthetic Polynucleotide
taatacgactcactataggggtttatattaaaacaaacaatagaaatggtaacagaggagaaccattatgattgtttgtaacctggcggcagcgcaaaagatg

SEQ ID NO: 59540 - DNA, 103 bp, Artificial Sequence
  Synthetic Polynucleotide
taatacgactcactatagggtactcgtttatattaaaacaaacaatagaaaacagaggagattctatatgttgttttaaaacctggcggcagcgcaaaagatg

SEQ ID NO: 59541 - DNA, 103 bp, Artificial Sequence
  Synthetic Polynucleotide
taatacgactcactatagggtgctatactcgtttatattaaaacaaacaaaacagaggagattgtttatgttaatataaaacctggcggcagcgcaaaagatg

SEQ ID NO: 59542 - DNA, 103 bp, Artificial Sequence
  Synthetic Polynucleotide
taatacgactcactatagggaatgatgctatactcgtttatattaaaacaaacagaggagatgttttatgataaacgagaacctggcggcagcgcaaaagatg

SEQ ID NO: 59543 - DNA, 103 bp, Artificial Sequence
  Synthetic Polynucleotide
taatacgactcactatagggttagcaatgatgctatactcgtttatattaaacagaggagataatatatgcgagtatagaacctggcggcagcgcaaaagatg

SEQ ID NO: 59544 - DNA, 103 bp, Artificial Sequence
  Synthetic Polynucleotide
taatacgactcactatagggaaaatttagcaatgatgctatactcgtttaaacagaggagataaacgatgatagcatcaaacctggcggcagcgcaaaagatg

SEQ ID NO: 59545 - DNA, 103 bp, Artificial Sequence
  Synthetic Polynucleotide
taatacgactcactatagggattgaaaaatttagcaatgatgctatactcaacagaggagagagtatatgatcattgctaacctggcggcagcgcaaaagatg

SEQ ID NO: 59546 - DNA, 103 bp, Artificial Sequence
  Synthetic Polynucleotide
taatacgactcactatagggatactattgaaaaatttagcaatgatgctaaacagaggagatagcatatgtgctaaattaacctggcggcagcgcaaaagatg

SEQ ID NO: 59547 - DNA, 103 bp, Artificial Sequence
  Synthetic Polynucleotide
taatacgactcactatagggaaaacgctacacttcgaaatggataagacaaacagaggagatgtcttatgcatttcgaaaacctggcggcagcgcaaaagatg

SEQ ID NO: 59548 - DNA, 103 bp, Artificial Sequence
  Synthetic Polynucleotide
taatacgactcactatagggtttcgatactattgaaaaatttagcaatgaaacagaggagatcattgatgaatttttcaaacctggcggcagcgcaaaagatg

SEQ ID NO: 59549 - DNA, 103 bp, Artificial Sequence
  Synthetic Polynucleotide
taatacgactcactatagggtctgttttcgatactattgaaaaatttagcaacagaggagagctaaaatgttcaatagtaacctggcggcagcgcaaaagatg

SEQ ID NO: 59550 - DNA, 103 bp, Artificial Sequence
  Synthetic Polynucleotide
taatacgactcactataggggatattctgttttcgatactattgaaaaataacagaggagaatttttatgtagtatcgaaacctggcggcagcgcaaaagatg

SEQ ID NO: 59551 - DNA, 103 bp, Artificial Sequence
  Synthetic Polynucleotide
taatacgactcactatagggtttgggatattctgttttcgatactattgaaacagaggagatcaataatgtcgaaaacaaacctggcggcagcgcaaaagatg

SEQ ID NO: 59552 - DNA, 103 bp, Artificial Sequence
  Synthetic Polynucleotide
taatacgactcactatagggtatggtttgggatattctgttttcgatactaacagaggagaagtatcatgaacagaataaacctggcggcagcgcaaaagatg

SEQ ID NO: 59553 - DNA, 103 bp, Artificial Sequence
  Synthetic Polynucleotide
taatacgactcactatagggtattatatggtttgggatattctgttttcgaacagaggagacgaaaaatgaatatcccaaacctggcggcagcgcaaaagatg

SEQ ID NO: 59554 - DNA, 103 bp, Artificial Sequence
  Synthetic Polynucleotide
taatacgactcactatagggatatatattatatggtttgggatattctgtaacagaggagaacagaaatgcccaaaccaaacctggcggcagcgcaaaagatg

SEQ ID NO: 59555 - DNA, 103 bp, Artificial Sequence
  Synthetic Polynucleotide
taatacgactcactatagggcctgaatatatattatatggtttgggatataacagaggagaatatccatgaccatataaaacctggcggcagcgcaaaagatg

SEQ ID NO: 59556 - DNA, 103 bp, Artificial Sequence
  Synthetic Polynucleotide
taatacgactcactataggggtgtccctgaatatatattatatggtttggaacagaggagaccaaacatgataatatataacctggcggcagcgcaaaagatg

SEQ ID NO: 59557 - DNA, 103 bp, Artificial Sequence
  Synthetic Polynucleotide
taatacgactcactatagggtttgagtgtccctgaatatatattatatggaacagaggagaccatatatgatatattcaaacctggcggcagcgcaaaagatg

SEQ ID NO: 59558 - DNA, 103 bp, Artificial Sequence
  Synthetic Polynucleotide
taatacgactcactatagggtatttaaaacgctacacttcgaaatggataaacagaggagatatccaatgcgaagtgtaaacctggcggcagcgcaaaagatg

SEQ ID NO: 59559 - DNA, 103 bp, Artificial Sequence
  Synthetic Polynucleotide
taatacgactcactatagggtttagtttgagtgtccctgaatatatattaaacagaggagataatatatgttcagggacaacctggcggcagcgcaaaagatg

SEQ ID NO: 59560 - DNA, 103 bp, Artificial Sequence
  Synthetic Polynucleotide
taatacgactcactatagggggacatttagtttgagtgtccctgaatataaacagaggagatatattatgggacactcaaacctggcggcagcgcaaaagatg

SEQ ID NO: 59561 - DNA, 103 bp, Artificial Sequence
  Synthetic Polynucleotide
taatacgactcactatagggatcctggacatttagtttgagtgtccctgaaacagaggagatcagggatgctcaaactaaacctggcggcagcgcaaaagatg

SEQ ID NO: 59562 - DNA, 103 bp, Artificial Sequence
  Synthetic Polynucleotide
taatacgactcactatagggggagaatcctggacatttagtttgagtgtcaacagaggagagacactatgactaaatgtaacctggcggcagcgcaaaagatg

SEQ ID NO: 59563 - DNA, 103 bp, Artificial Sequence
  Synthetic Polynucleotide
taatacgactcactatagggatttaggagaatcctggacatttagtttgaaacagaggagatcaaacatgatgtccaggaacctggcggcagcgcaaaagatg

SEQ ID NO: 59564 - DNA, 103 bp, Artificial Sequence
  Synthetic Polynucleotide
taatacgactcactatagggtacgtatttaggagaatcctggacatttagaacagaggagactaaatatgcaggattctaacctggcggcagcgcaaaagatg

SEQ ID NO: 59565 - DNA, 103 bp, Artificial Sequence
  Synthetic Polynucleotide
taatacgactcactatagggaagtttacgtatttaggagaatcctggacaaacagaggagatgtccaatgttctcctaaaacctggcggcagcgcaaaagatg

SEQ ID NO: 59566 - DNA, 103 bp, Artificial Sequence
  Synthetic Polynucleotide
taatacgactcactatagggtattaaagtttacgtatttaggagaatcctaacagaggagaaggattatgctaaatacgaacctggcggcagcgcaaaagatg

SEQ ID NO: 59567 - DNA, 103 bp, Artificial Sequence
  Synthetic Polynucleotide
taatacgactcactatagggcgcactattaaagtttacgtatttaggagaaacagaggagatctcctatgtacgtaaacaacctggcggcagcgcaaaagatg

SEQ ID NO: 59568 - DNA, 103 bp, Artificial Sequence
  Synthetic Polynucleotide
taatacgactcactataggggatttcgcactattaaagtttacgtatttaaacagaggagataaataatgaaactttaaaacctggcggcagcgcaaaagatg

SEQ ID NO: 59569 - DNA, 103 bp, Artificial Sequence
  Synthetic Polynucleotide
taatacgactcactatagggataaaactagagattgaaacgtgttataacaacagaggagagttataatgcgtttcaataacctggcggcagcgcaaaagatg

SEQ ID NO: 59570 - DNA, 103 bp, Artificial Sequence
  Synthetic Polynucleotide
taatacgactcactatagggacacaaatgctgttatcgaatatccagttgaacagaggagacaactgatgattcgataaaacctggcggcagcgcaaaagatg

SEQ ID NO: 59571 - DNA, 103 bp, Artificial Sequence
  Synthetic Polynucleotide
taatacgactcactatagggcaaaatatttaaaacgctacacttcgaaataacagaggagaatttcgatgtgtagcgttaacctggcggcagcgcaaaagatg

SEQ ID NO: 59572 - DNA, 103 bp, Artificial Sequence
  Synthetic Polynucleotide
taatacgactcactatagggtgaatgatttcgcactattaaagtttacgtaacagaggagaacgtaaatgttaatagtgaacctggcggcagcgcaaaagatg

SEQ ID NO: 59573 - DNA, 103 bp, Artificial Sequence
  Synthetic Polynucleotide
taatacgactcactatagggatttttgaatgatttcgcactattaaagttaacagaggagaaactttatgagtgcgaaaaacctggcggcagcgcaaaagatg

SEQ ID NO: 59574 - DNA, 103 bp, Artificial Sequence
  Synthetic Polynucleotide
taatacgactcactataggggatagatttttgaatgatttcgcactattaaacagaggagataatagatggaaatcattaacctggcggcagcgcaaaagatg

SEQ ID NO: 59575 - DNA, 103 bp, Artificial Sequence
  Synthetic Polynucleotide
taatacgactcactatagggtaagtgatagatttttgaatgatttcgcacaacagaggagagtgcgaatgcattcaaaaaacctggcggcagcgcaaaagatg

SEQ ID NO: 59576 - DNA, 103 bp, Artificial Sequence
  Synthetic Polynucleotide
taatacgactcactatagggatctataagtgatagatttttgaatgatttaacagaggagaaaatcaatgaaaaatctaaacctggcggcagcgcaaaagatg

SEQ ID NO: 59577 - DNA, 103 bp, Artificial Sequence
  Synthetic Polynucleotide
taatacgactcactatagggtatctatctataagtgatagatttttgaataacagaggagaattcaaatgtctatcactaacctggcggcagcgcaaaagatg

SEQ ID NO: 59578 - DNA, 103 bp, Artificial Sequence
  Synthetic Polynucleotide
taatacgactcactatagggtgtactatctatctataagtgatagattttaacagaggagaaaaatcatgcacttatagaacctggcggcagcgcaaaagatg

SEQ ID NO: 59579 - DNA, 103 bp, Artificial Sequence
  Synthetic Polynucleotide
taatacgactcactatagggattcatgtactatctatctataagtgatagaacagaggagactatcaatgatagatagaaacctggcggcagcgcaaaagatg

SEQ ID NO: 59580 - DNA, 103 bp, Artificial Sequence
  Synthetic Polynucleotide
taatacgactcactatagggtacgcattcatgtactatctatctataagtaacagaggagaacttatatgtagatagtaaacctggcggcagcgcaaaagatg

SEQ ID NO: 59581 - DNA, 103 bp, Artificial Sequence
  Synthetic Polynucleotide
taatacgactcactatagggtactatacgcattcatgtactatctatctaaacagaggagatagataatgagtacatgaaacctggcggcagcgcaaaagatg

SEQ ID NO: 59582 - DNA, 103 bp, Artificial Sequence
  Synthetic Polynucleotide
taatacgactcactatagggtgtagcaaaatatttaaaacgctacacttcaacagaggagagaagtgatgcgttttaaaaacctggcggcagcgcaaaagatg

SEQ ID NO: 59583 - DNA, 103 bp, Artificial Sequence
  Synthetic Polynucleotide
taatacgactcactatagggtagactactatacgcattcatgtactatctaacagaggagaagatagatgatgaatgcgaacctggcggcagcgcaaaagatg

SEQ ID NO: 59584 - DNA, 103 bp, Artificial Sequence
  Synthetic Polynucleotide
taatacgactcactatagggatcggtagactactatacgcattcatgtacaacagaggagagtacatatgtgcgtatagaacctggcggcagcgcaaaagatg

SEQ ID NO: 59585 - DNA, 103 bp, Artificial Sequence
  Synthetic Polynucleotide
taatacgactcactatagggaagagatcggtagactactatacgcattcaaacagaggagatgaatgatgatagtagtcaacctggcggcagcgcaaaagatg

SEQ ID NO: 59586 - DNA, 103 bp, Artificial Sequence
  Synthetic Polynucleotide
taatacgactcactatagggtaataaagagatcggtagactactatacgcaacagaggagagcgtatatgagtctaccgaacctggcggcagcgcaaaagatg

SEQ ID NO: 59587 - DNA, 103 bp, Artificial Sequence
  Synthetic Polynucleotide
taatacgactcactatagggtttcataataaagagatcggtagactactaaacagaggagatagtagatgaccgatctcaacctggcggcagcgcaaaagatg

SEQ ID NO: 59588 - DNA, 103 bp, Artificial Sequence
  Synthetic Polynucleotide
taatacgactcactatagggtcggttttcataataaagagatcggtagacaacagaggagagtctacatgtctctttataacctggcggcagcgcaaaagatg

SEQ ID NO: 59589 - DNA, 103 bp, Artificial Sequence
  Synthetic Polynucleotide
taatacgactcactatagggtaatgtcggttttcataataaagagatcggaacagaggagaccgatcatgttattatgaaacctggcggcagcgcaaaagatg

SEQ ID NO: 59590 - DNA, 103 bp, Artificial Sequence
  Synthetic Polynucleotide
taatacgactcactataggggatggtaatgtcggttttcataataaagagaacagaggagactctttatgatgaaaaccaacctggcggcagcgcaaaagatg

SEQ ID NO: 59591 - DNA, 103 bp, Artificial Sequence
  Synthetic Polynucleotide
taatacgactcactatagggtatatgatggtaatgtcggttttcataataaacagaggagatattatatgaaccgacataacctggcggcagcgcaaaagatg

SEQ ID NO: 59592 - DNA, 103 bp, Artificial Sequence
  Synthetic Polynucleotide
taatacgactcactatagggcgaaatatatgatggtaatgtcggttttcaaacagaggagatgaaaaatgacattaccaaacctggcggcagcgcaaaagatg

SEQ ID NO: 59593 - DNA, 103 bp, Artificial Sequence
  Synthetic Polynucleotide
taatacgactcactatagggacaggtgtagcaaaatatttaaaacgctacaacagaggagagtagcgatgtaaatatttaacctggcggcagcgcaaaagatg

SEQ ID NO: 59594 - DNA, 103 bp, Artificial Sequence
  Synthetic Polynucleotide
taatacgactcactatagggtatcacgaaatatatgatggtaatgtcggtaacagaggagaaccgacatgaccatcataaacctggcggcagcgcaaaagatg

SEQ ID NO: 59595 - DNA, 103 bp, Artificial Sequence
  Synthetic Polynucleotide
taatacgactcactatagggatgtatatcacgaaatatatgatggtaatgaacagaggagacattacatgcatatatttaacctggcggcagcgcaaaagatg

SEQ ID NO: 59596 - DNA, 103 bp, Artificial Sequence
  Synthetic Polynucleotide
taatacgactcactatagggatcacatgtatatcacgaaatatatgatggaacagaggagaccatcaatgatttcgtgaaacctggcggcagcgcaaaagatg

SEQ ID NO: 59597 - DNA, 103 bp, Artificial Sequence
  Synthetic Polynucleotide
taatacgactcactatagggaacggatcacatgtatatcacgaaatatataacagaggagaatatatatggtgatatacaacctggcggcagcgcaaaagatg

SEQ ID NO: 59598 - DNA, 103 bp, Artificial Sequence
  Synthetic Polynucleotide
taatacgactcactatagggacgtaaacggatcacatgtatatcacgaaaaacagaggagatttcgtatgatacatgtgaacctggcggcagcgcaaaagatg

SEQ ID NO: 59599 - DNA, 103 bp, Artificial Sequence
  Synthetic Polynucleotide
taatacgactcactataggggtttaacgtaaacggatcacatgtatatcaaacagaggagatgatatatgtgtgatccgaacctggcggcagcgcaaaagatg

SEQ ID NO: 59600 - DNA, 103 bp, Artificial Sequence
  Synthetic Polynucleotide
taatacgactcactatagggttatggtttaacgtaaacggatcacatgtaaacagaggagatacatgatgtccgtttacaacctggcggcagcgcaaaagatg

SEQ ID NO: 59601 - DNA, 103 bp, Artificial Sequence
  Synthetic Polynucleotide
taatacgactcactatagggtgtatttatggtttaacgtaaacggatcacaacagaggagagtgatcatgttacgttaaaacctggcggcagcgcaaaagatg

SEQ ID NO: 59602 - DNA, 103 bp, Artificial Sequence
  Synthetic Polynucleotide
taatacgactcactatagggacccatgtatttatggtttaacgtaaacggaacagaggagaccgtttatgttaaaccataacctggcggcagcgcaaaagatg

SEQ ID NO: 59603 - DNA, 103 bp, Artificial Sequence
  Synthetic Polynucleotide
taatacgactcactataggggggtcacccatgtatttatggtttaacgtaaacagaggagatacgttatgccataaataaacctggcggcagcgcaaaagatg

SEQ ID NO: 59604 - DNA, 103 bp, Artificial Sequence
  Synthetic Polynucleotide
taatacgactcactatagggtttcaacaggtgtagcaaaatatttaaaacaacagaggagagttttaatgattttgctaaacctggcggcagcgcaaaagatg

SEQ ID NO: 59605 - DNA, 103 bp, Artificial Sequence
  Synthetic Polynucleotide
taatacgactcactatagggttatagggtcacccatgtatttatggtttaaacagaggagataaaccatgaatacatggaacctggcggcagcgcaaaagatg

SEQ ID NO: 59606 - DNA, 103 bp, Artificial Sequence
  Synthetic Polynucleotide
taatacgactcactatagggcatgtttatagggtcacccatgtatttatgaacagaggagacataaaatgatgggtgacaacctggcggcagcgcaaaagatg

SEQ ID NO: 59607 - DNA, 103 bp, Artificial Sequence
  Synthetic Polynucleotide
taatacgactcactatagggaaattcatgtttatagggtcacccatgtataacagaggagaatacatatgtgaccctataacctggcggcagcgcaaaagatg

SEQ ID NO: 59608 - DNA, 103 bp, Artificial Sequence
  Synthetic Polynucleotide
taatacgactcactataggggaaataaattcatgtttatagggtcacccaaacagaggagatgggtgatgctataaacaaacctggcggcagcgcaaaagatg

SEQ ID NO: 59609 - DNA, 103 bp, Artificial Sequence
  Synthetic Polynucleotide
taatacgactcactatagggaattagaaataaattcatgtttatagggtcaacagaggagagaccctatgaacatgaataacctggcggcagcgcaaaagatg

SEQ ID NO: 59610 - DNA, 103 bp, Artificial Sequence
  Synthetic Polynucleotide
taatacgactcactatagggctgagaattagaaataaattcatgtttataaacagaggagatataaaatggaatttattaacctggcggcagcgcaaaagatg

SEQ ID NO: 59611 - DNA, 103 bp, Artificial Sequence
  Synthetic Polynucleotide
taatacgactcactatagggtggctctgagaattagaaataaattcatgtaacagaggagaacatgaatgtatttctaaaacctggcggcagcgcaaaagatg

SEQ ID NO: 59612 - DNA, 103 bp, Artificial Sequence
  Synthetic Polynucleotide
taatacgactcactatagggaactatggctctgagaattagaaataaattaacagaggagaaatttaatgctaattctcaacctggcggcagcgcaaaagatg

SEQ ID NO: 59613 - DNA, 103 bp, Artificial Sequence
  Synthetic Polynucleotide
taatacgactcactatagggcaattaactatggctctgagaattagaaataacagaggagaatttctatgtctcagagcaacctggcggcagcgcaaaagatg

SEQ ID NO: 59614 - DNA, 103 bp, Artificial Sequence
  Synthetic Polynucleotide
taatacgactcactatagggacggtcaattaactatggctctgagaattaaacagaggagataattcatggagccatagaacctggcggcagcgcaaaagatg

SEQ ID NO: 59615 - DNA, 103 bp, Artificial Sequence
  Synthetic Polynucleotide
taatacgactcactatagggttctatttcaacaggtgtagcaaaatatttaacagaggagaaaatatatggctacacctaacctggcggcagcgcaaaagatg

SEQ ID NO: 59616 - DNA, 103 bp, Artificial Sequence
  Synthetic Polynucleotide
taatacgactcactatagggattacacggtcaattaactatggctctgagaacagaggagactcagaatgatagttaataacctggcggcagcgcaaaagatg

SEQ ID NO: 59617 - DNA, 103 bp, Artificial Sequence
  Synthetic Polynucleotide
taatacgactcactatagggcaaatattacacggtcaattaactatggctaacagaggagaagccatatgtaattgaccaacctggcggcagcgcaaaagatg

SEQ ID NO: 59618 - DNA, 103 bp, Artificial Sequence
  Synthetic Polynucleotide
taatacgactcactataggggtaagcaaatattacacggtcaattaactaaacagaggagatagttaatggaccgtgtaaacctggcggcagcgcaaaagatg

SEQ ID NO: 59619 - DNA, 103 bp, Artificial Sequence
  Synthetic Polynucleotide
taatacgactcactatagggtgcatgtaagcaaatattacacggtcaattaacagaggagaaattgaatgtgtaatattaacctggcggcagcgcaaaagatg

SEQ ID NO: 59620 - DNA, 103 bp, Artificial Sequence
  Synthetic Polynucleotide
taatacgactcactatagggaagtatgcatgtaagcaaatattacacggtaacagaggagaaccgtgatgtatttgcttaacctggcggcagcgcaaaagatg

SEQ ID NO: 59621 - DNA, 103 bp, Artificial Sequence
  Synthetic Polynucleotide
taatacgactcactataggggtatcaagtatgcatgtaagcaaatattacaacagaggagagtaataatggcttacatgaacctggcggcagcgcaaaagatg

SEQ ID NO: 59622 - DNA, 103 bp, Artificial Sequence
  Synthetic Polynucleotide
taatacgactcactatagggtgatcgtatcaagtatgcatgtaagcaaataacagaggagaatttgcatgcatgcatacaacctggcggcagcgcaaaagatg

SEQ ID NO: 59623 - DNA, 103 bp, Artificial Sequence
  Synthetic Polynucleotide
taatacgactcactatagggattaatgatcgtatcaagtatgcatgtaagaacagaggagacttacaatgatacttgataacctggcggcagcgcaaaagatg

SEQ ID NO: 59624 - DNA, 103 bp, Artificial Sequence
  Synthetic Polynucleotide
taatacgactcactatagggatcttattaatgatcgtatcaagtatgcataacagaggagaatgcatatgtgatacgataacctggcggcagcgcaaaagatg

SEQ ID NO: 59625 - DNA, 103 bp, Artificial Sequence
  Synthetic Polynucleotide
taatacgactcactatagggtaaaaatcttattaatgatcgtatcaagtaaacagaggagatacttgatgcgatcattaaacctggcggcagcgcaaaagatg

SEQ ID NO: 59626 - DNA, 103 bp, Artificial Sequence
  Synthetic Polynucleotide
taatacgactcactatagggaaattttctatttcaacaggtgtagcaaaaaacagaggagattttgcatgacctgttgaaacctggcggcagcgcaaaagatg

SEQ ID NO: 59627 - DNA, 103 bp, Artificial Sequence
  Synthetic Polynucleotide
taatacgactcactatagggaataataaaaatcttattaatgatcgtatcaacagaggagagatacgatgattaataagaacctggcggcagcgcaaaagatg

SEQ ID NO: 59628 - DNA, 103 bp, Artificial Sequence
  Synthetic Polynucleotide
taatacgactcactatagggcgagcaataataaaaatcttattaatgatcaacagaggagagatcatatgtaagattttaacctggcggcagcgcaaaagatg

SEQ ID NO: 59629 - DNA, 103 bp, Artificial Sequence
  Synthetic Polynucleotide
taatacgactcactatagggaataacgagcaataataaaaatcttattaaaacagaggagattaataatgtttttattaaacctggcggcagcgcaaaagatg

SEQ ID NO: 59630 - DNA, 103 bp, Artificial Sequence
  Synthetic Polynucleotide
taatacgactcactatagggtctgaaataacgagcaataataaaaatcttaacagaggagaaagattatgattattgctaacctggcggcagcgcaaaagatg

SEQ ID NO: 59631 - DNA, 103 bp, Artificial Sequence
  Synthetic Polynucleotide
taatacgactcactatagggacgattctgaaataacgagcaataataaaaaacagaggagattttatatgtgctcgttaaacctggcggcagcgcaaaagatg

SEQ ID NO: 59632 - DNA, 103 bp, Artificial Sequence
  Synthetic Polynucleotide
taatacgactcactatagggtatatacgattctgaaataacgagcaataaaacagaggagattattgatggttatttcaaacctggcggcagcgcaaaagatg

SEQ ID NO: 59633 - DNA, 103 bp, Artificial Sequence
  Synthetic Polynucleotide
taatacgactcactatagggccttatatatacgattctgaaataacgagcaacagaggagagctcgtatgttcagaatcaacctggcggcagcgcaaaagatg

SEQ ID NO: 59634 - DNA, 103 bp, Artificial Sequence
  Synthetic Polynucleotide
taatacgactcactataggggtactccttatatatacgattctgaaataaaacagaggagattatttatgaatcgtataaacctggcggcagcgcaaaagatg

SEQ ID NO: 59635 - DNA, 103 bp, Artificial Sequence
  Synthetic Polynucleotide
taatacgactcactatagggcaatggtactccttatatatacgattctgaaacagaggagatcagaaatgtatatataaaacctggcggcagcgcaaaagatg

SEQ ID NO: 59636 - DNA, 103 bp, Artificial Sequence
  Synthetic Polynucleotide
taatacgactcactatagggaatcacaatggtactccttatatatacgataacagaggagaatcgtaatgataaggagtaacctggcggcagcgcaaaagatg

SEQ ID NO: 59637 - DNA, 103 bp, Artificial Sequence
  Synthetic Polynucleotide
taatacgactcactatagggaattaaaattttctatttcaacaggtgtagaacagaggagactacacatgttgaaatagaacctggcggcagcgcaaaagatg

SEQ ID NO: 59638 - DNA, 103 bp, Artificial Sequence
  Synthetic Polynucleotide
taatacgactcactataggggtaagaatcacaatggtactccttatatataacagaggagaatatatatggagtaccataacctggcggcagcgcaaaagatg

SEQ ID NO: 59639 - DNA, 103 bp, Artificial Sequence
  Synthetic Polynucleotide
taatacgactcactatagggatctggtaagaatcacaatggtactccttaaacagaggagataaggaatgccattgtgaaacctggcggcagcgcaaaagatg

SEQ ID NO: 59640 - DNA, 103 bp, Artificial Sequence
  Synthetic Polynucleotide
taatacgactcactatagggataatatctggtaagaatcacaatggtactaacagaggagaagtaccatggtgattcttaacctggcggcagcgcaaaagatg

SEQ ID NO: 59641 - DNA, 103 bp, Artificial Sequence
  Synthetic Polynucleotide
taatacgactcactatagggtttgtataatatctggtaagaatcacaatgaacagaggagacattgtatgtcttaccagaacctggcggcagcgcaaaagatg

SEQ ID NO: 59642 - DNA, 103 bp, Artificial Sequence
  Synthetic Polynucleotide
taatacgactcactatagggagtattttgtataatatctggtaagaatcaaacagaggagatgattcatgccagatattaacctggcggcagcgcaaaagatg

SEQ ID NO: 59643 - DNA, 103 bp, Artificial Sequence
  Synthetic Polynucleotide
taatacgactcactatagggtatatagtattttgtataatatctggtaagaacagaggagacttaccatgtattatacaaacctggcggcagcgcaaaagatg

SEQ ID NO: 59644 - DNA, 103 bp, Artificial Sequence
  Synthetic Polynucleotide
taatacgactcactatagggttttatatatagtattttgtataatatctgaacagaggagacagataatgtacaaaataaacctggcggcagcgcaaaagatg

SEQ ID NO: 59645 - DNA, 103 bp, Artificial Sequence
  Synthetic Polynucleotide
taatacgactcactatagggatatattttatatatagtattttgtataataacagaggagaattataatgaatactataaacctggcggcagcgcaaaagatg

SEQ ID NO: 59646 - DNA, 103 bp, Artificial Sequence
  Synthetic Polynucleotide
taatacgactcactatagggggtcaatatattttatatatagtattttgtaacagaggagaacaaaaatgtatatataaaacctggcggcagcgcaaaagatg

SEQ ID NO: 59647 - DNA, 103 bp, Artificial Sequence
  Synthetic Polynucleotide
taatacgactcactatagggacgtgggtcaatatattttatatatagtataacagaggagaatactaatgataaaatataacctggcggcagcgcaaaagatg

SEQ ID NO: 59648 - DNA, 103 bp, Artificial Sequence
  Synthetic Polynucleotide
taatacgactcactatagggaggagaattaaaattttctatttcaacaggaacagaggagacctgttatgatagaaaataacctggcggcagcgcaaaagatg

SEQ ID NO: 59649 - DNA, 103 bp, Artificial Sequence
  Synthetic Polynucleotide
taatacgactcactatagggtactaacgtgggtcaatatattttatatataacagaggagaatatatatgatatattgaaacctggcggcagcgcaaaagatg

SEQ ID NO: 59650 - DNA, 103 bp, Artificial Sequence
  Synthetic Polynucleotide
taatacgactcactatagggatgattactaacgtgggtcaatatattttaaacagaggagataaaatatgttgacccacaacctggcggcagcgcaaaagatg

SEQ ID NO: 59651 - DNA, 103 bp, Artificial Sequence
  Synthetic Polynucleotide
taatacgactcactatagggtttacatgattactaacgtgggtcaatataaacagaggagatatattatgccacgttagaacctggcggcagcgcaaaagatg

SEQ ID NO: 59652 - DNA, 103 bp, Artificial Sequence
  Synthetic Polynucleotide
taatacgactcactatagggaaacatttacatgattactaacgtgggtcaaacagaggagatgacccatgttagtaatcaacctggcggcagcgcaaaagatg

SEQ ID NO: 59653 - DNA, 103 bp, Artificial Sequence
  Synthetic Polynucleotide
taatacgactcactatagggacattaaacatttacatgattactaacgtgaacagaggagacacgttatgaatcatgtaaacctggcggcagcgcaaaagatg

SEQ ID NO: 59654 - DNA, 103 bp, Artificial Sequence
  Synthetic Polynucleotide
taatacgactcactatagggttaaaacattaaacatttacatgattactaaacagaggagatagtaaatgtgtaaatgtaacctggcggcagcgcaaaagatg

SEQ ID NO: 59655 - DNA, 103 bp, Artificial Sequence
  Synthetic Polynucleotide
taatacgactcactatagggaaaatttaaaacattaaacatttacatgataacagaggagaatcatgatgatgtttaataacctggcggcagcgcaaaagatg

SEQ ID NO: 59656 - DNA, 103 bp, Artificial Sequence
  Synthetic Polynucleotide
taatacgactcactatagggaatacaaaatttaaaacattaaacatttacaacagaggagagtaaatatgtaatgttttaacctggcggcagcgcaaaagatg

SEQ ID NO: 59657 - DNA, 103 bp, Artificial Sequence
  Synthetic Polynucleotide
taatacgactcactatagggcattaaatacaaaatttaaaacattaaacaaacagaggagatgtttaatgttttaaattaacctggcggcagcgcaaaagatg

SEQ ID NO: 59658 - DNA, 103 bp, Artificial Sequence
  Synthetic Polynucleotide
taatacgactcactatagggtgaatcattaaatacaaaatttaaaacattaacagaggagaaatgttatgaattttgtaaacctggcggcagcgcaaaagatg

SEQ ID NO: 59659 - DNA, 103 bp, Artificial Sequence
  Synthetic Polynucleotide
taatacgactcactataggggtaataggagaattaaaattttctatttcaaacagaggagatgaaatatgaaattttaaaacctggcggcagcgcaaaagatg

SEQ ID NO: 59660 - DNA, 103 bp, Artificial Sequence
  Synthetic Polynucleotide
taatacgactcactataggggataatgaatcattaaatacaaaatttaaaaacagaggagatttaaaatgtgtatttaaaacctggcggcagcgcaaaagatg

SEQ ID NO: 59661 - DNA, 103 bp, Artificial Sequence
  Synthetic Polynucleotide
taatacgactcactatagggcgtatgataatgaatcattaaatacaaaataacagaggagaattttgatgttaatgattaacctggcggcagcgcaaaagatg

SEQ ID NO: 59662 - DNA, 103 bp, Artificial Sequence
  Synthetic Polynucleotide
taatacgactcactataggggctagcgtatgataatgaatcattaaatacaacagaggagagtatttatggattcattaaacctggcggcagcgcaaaagatg

SEQ ID NO: 59663 - DNA, 103 bp, Artificial Sequence
  Synthetic Polynucleotide
taatacgactcactatagggaccatgctagcgtatgataatgaatcattaaacagaggagataatgaatgattatcataaacctggcggcagcgcaaaagatg

SEQ ID NO: 59664 - DNA, 103 bp, Artificial Sequence
  Synthetic Polynucleotide
taatacgactcactatagggacaagaccatgctagcgtatgataatgaataacagaggagaattcatatgcatacgctaaacctggcggcagcgcaaaagatg

SEQ ID NO: 59665 - DNA, 103 bp, Artificial Sequence
  Synthetic Polynucleotide
taatacgactcactatagggatattacaagaccatgctagcgtatgataaaacagaggagattatcaatggctagcatgaacctggcggcagcgcaaaagatg

SEQ ID NO: 59666 - DNA, 103 bp, Artificial Sequence
  Synthetic Polynucleotide
taatacgactcactatagggaatgaatattacaagaccatgctagcgtataacagaggagaatacgcatgcatggtcttaacctggcggcagcgcaaaagatg

SEQ ID NO: 59667 - DNA, 103 bp, Artificial Sequence
  Synthetic Polynucleotide
taatacgactcactatagggtaaagaatgaatattacaagaccatgctagaacagaggagactagcaatgtcttgtaataacctggcggcagcgcaaaagatg

SEQ ID NO: 59668 - DNA, 103 bp, Artificial Sequence
  Synthetic Polynucleotide
taatacgactcactatagggtattttaaagaatgaatattacaagaccataacagaggagaatggtcatgtaatattcaaacctggcggcagcgcaaaagatg

SEQ ID NO: 59669 - DNA, 103 bp, Artificial Sequence
  Synthetic Polynucleotide
taatacgactcactatagggtattatattttaaagaatgaatattacaagaacagaggagacttgtaatgttcattcttaacctggcggcagcgcaaaagatg

SEQ ID NO: 59670 - DNA, 103 bp, Artificial Sequence
  Synthetic Polynucleotide
taatacgactcactatagggtatatgtaataggagaattaaaattttctaaacagaggagatagaaaatgttaattctcaacctggcggcagcgcaaaagatg

SEQ ID NO: 59671 - DNA, 103 bp, Artificial Sequence
  Synthetic Polynucleotide
taatacgactcactatagggcacaatattatattttaaagaatgaatattaacagaggagaaatattatgtctttaaaaaacctggcggcagcgcaaaagatg

SEQ ID NO: 59672 - DNA, 103 bp, Artificial Sequence
  Synthetic Polynucleotide
taatacgactcactataggggctaacacaatattatattttaaagaatgaaacagaggagatcattcatgaaaatataaaacctggcggcagcgcaaaagatg

SEQ ID NO: 59673 - DNA, 103 bp, Artificial Sequence
  Synthetic Polynucleotide
taatacgactcactatagggcaatggctaacacaatattatattttaaagaacagaggagactttaaatgataatattgaacctggcggcagcgcaaaagatg

SEQ ID NO: 59674 - DNA, 103 bp, Artificial Sequence
  Synthetic Polynucleotide
taatacgactcactatagggcaatgcaatggctaacacaatattatatttaacagaggagaaaatatatgattgtgttaaacctggcggcagcgcaaaagatg

SEQ ID NO: 59675 - DNA, 103 bp, Artificial Sequence
  Synthetic Polynucleotide
taatacgactcactatagggagctccaatgcaatggctaacacaatattaaacagaggagataatatatggttagccataacctggcggcagcgcaaaagatg

SEQ ID NO: 59676 - DNA, 103 bp, Artificial Sequence
  Synthetic Polynucleotide
taatacgactcactatagggttaggagctccaatgcaatggctaacacaaaacagaggagattgtgtatgccattgcataacctggcggcagcgcaaaagatg

SEQ ID NO: 59677 - DNA, 103 bp, Artificial Sequence
  Synthetic Polynucleotide
taatacgactcactatagggctccattaggagctccaatgcaatggctaaaacagaggagattagccatggcattggagaacctggcggcagcgcaaaagatg

SEQ ID NO: 59678 - DNA, 103 bp, Artificial Sequence
  Synthetic Polynucleotide
taatacgactcactatagggaaaatctccattaggagctccaatgcaatgaacagaggagacattgcatgggagctcctaacctggcggcagcgcaaaagatg

SEQ ID NO: 59679 - DNA, 103 bp, Artificial Sequence
  Synthetic Polynucleotide
taatacgactcactatagggaatagaaaatctccattaggagctccaatgaacagaggagacattggatgtcctaatggaacctggcggcagcgcaaaagatg

SEQ ID NO: 59680 - DNA, 103 bp, Artificial Sequence
  Synthetic Polynucleotide
taatacgactcactatagggacgagaatagaaaatctccattaggagctcaacagaggagagagctcatgatggagattaacctggcggcagcgcaaaagatg

SEQ ID NO: 59681 - DNA, 103 bp, Artificial Sequence
  Synthetic Polynucleotide
taatacgactcactatagggaaactacacaaatgctgttatcgaatatccaacagaggagaggatatatgataacagcaaacctggcggcagcgcaaaagatg

SEQ ID NO: 59682 - DNA, 103 bp, Artificial Sequence
  Synthetic Polynucleotide
taatacgactcactatagggaaagttatatgtaataggagaattaaaattaacagaggagaaattttatgtctcctattaacctggcggcagcgcaaaagatg

SEQ ID NO: 59683 - DNA, 103 bp, Artificial Sequence
  Synthetic Polynucleotide
taatacgactcactatagggaatggacgagaatagaaaatctccattaggaacagaggagacctaatatggattttctaaacctggcggcagcgcaaaagatg

SEQ ID NO: 59684 - DNA, 103 bp, Artificial Sequence
  Synthetic Polynucleotide
taatacgactcactatagggcctaaaatggacgagaatagaaaatctccaaacagaggagatggagaatgtctattctcaacctggcggcagcgcaaaagatg

SEQ ID NO: 59685 - DNA, 103 bp, Artificial Sequence
  Synthetic Polynucleotide
taatacgactcactatagggcatatcctaaaatggacgagaatagaaaataacagaggagaattttcatgtctcgtccaaacctggcggcagcgcaaaagatg

SEQ ID NO: 59686 - DNA, 103 bp, Artificial Sequence
  Synthetic Polynucleotide
taatacgactcactataggggaaagcatatcctaaaatggacgagaatagaacagaggagactattcatgtccattttaaacctggcggcagcgcaaaagatg

SEQ ID NO: 59687 - DNA, 103 bp, Artificial Sequence
  Synthetic Polynucleotide
taatacgactcactatagggtttatgaaagcatatcctaaaatggacgagaacagaggagactcgtcatgtttaggataaacctggcggcagcgcaaaagatg

SEQ ID NO: 59688 - DNA, 103 bp, Artificial Sequence
  Synthetic Polynucleotide
taatacgactcactataggggggactttatgaaagcatatcctaaaatggaacagaggagaccatttatggatatgcttaacctggcggcagcgcaaaagatg

SEQ ID NO: 59689 - DNA, 103 bp, Artificial Sequence
  Synthetic Polynucleotide
taatacgactcactatagggtattagggactttatgaaagcatatcctaaaacagaggagattaggaatggctttcataaacctggcggcagcgcaaaagatg

SEQ ID NO: 59690 - DNA, 103 bp, Artificial Sequence
  Synthetic Polynucleotide
taatacgactcactataggggaagttattagggactttatgaaagcatataacagaggagaatatgcatgcataaagtcaacctggcggcagcgcaaaagatg

SEQ ID NO: 59691 - DNA, 103 bp, Artificial Sequence
  Synthetic Polynucleotide
taatacgactcactatagggttcacgaagttattagggactttatgaaagaacagaggagactttcaatgagtccctaaaacctggcggcagcgcaaaagatg

SEQ ID NO: 59692 - DNA, 103 bp, Artificial Sequence
  Synthetic Polynucleotide
taatacgactcactatagggcattattcacgaagttattagggactttataacagaggagaataaagatgctaataactaacctggcggcagcgcaaaagatg

SEQ ID NO: 59693 - DNA, 103 bp, Artificial Sequence
  Synthetic Polynucleotide
taatacgactcactataggggatggaaagttatatgtaataggagaattaaacagaggagataattcatgtattacataaacctggcggcagcgcaaaagatg

SEQ ID NO: 59694 - DNA, 103 bp, Artificial Sequence
  Synthetic Polynucleotide
taatacgactcactatagggagaaacattattcacgaagttattagggacaacagaggagagtccctatgaacttcgtgaacctggcggcagcgcaaaagatg

SEQ ID NO: 59695 - DNA, 103 bp, Artificial Sequence
  Synthetic Polynucleotide
taatacgactcactatagggaacatagaaacattattcacgaagttattaaacagaggagataataaatgcgtgaataaaacctggcggcagcgcaaaagatg

SEQ ID NO: 59696 - DNA, 103 bp, Artificial Sequence
  Synthetic Polynucleotide
taatacgactcactatagggtagaaaacatagaaacattattcacgaagtaacagaggagaacttcgatgataatgtttaacctggcggcagcgcaaaagatg

SEQ ID NO: 59697 - DNA, 103 bp, Artificial Sequence
  Synthetic Polynucleotide
taatacgactcactatagggatcagtagaaaacatagaaacattattcacaacagaggagagtgaatatggtttctatgaacctggcggcagcgcaaaagatg

SEQ ID NO: 59698 - DNA, 103 bp, Artificial Sequence
  Synthetic Polynucleotide
taatacgactcactatagggcatgcatcagtagaaaacatagaaacattaaacagaggagataatgtatgtatgttttcaacctggcggcagcgcaaaagatg

SEQ ID NO: 59699 - DNA, 103 bp, Artificial Sequence
  Synthetic Polynucleotide
taatacgactcactatagggaaatacatgcatcagtagaaaacatagaaaaacagaggagatttctaatgtttctactgaacctggcggcagcgcaaaagatg

SEQ ID NO: 59700 - DNA, 103 bp, Artificial Sequence
  Synthetic Polynucleotide
taatacgactcactataggggaagcaaatacatgcatcagtagaaaacataacagaggagaatgtttatgactgatgcaaacctggcggcagcgcaaaagatg

SEQ ID NO: 59701 - DNA, 103 bp, Artificial Sequence
  Synthetic Polynucleotide
taatacgactcactatagggaaatcgaagcaaatacatgcatcagtagaaaacagaggagattctacatgtgcatgtataacctggcggcagcgcaaaagatg

SEQ ID NO: 59702 - DNA, 103 bp, Artificial Sequence
  Synthetic Polynucleotide
taatacgactcactatagggtaaaaaaatcgaagcaaatacatgcatcagaacagaggagactgatgatggtatttgctaacctggcggcagcgcaaaagatg

SEQ ID NO: 59703 - DNA, 103 bp, Artificial Sequence
  Synthetic Polynucleotide
taatacgactcactatagggtgggataaaaaaatcgaagcaaatacatgcaacagaggagagcatgtatgtgcttcgataacctggcggcagcgcaaaagatg

SEQ ID NO: 59704 - DNA, 103 bp, Artificial Sequence
  Synthetic Polynucleotide
taatacgactcactatagggttaatgatggaaagttatatgtaataggagaacagaggagactcctaatgcatataactaacctggcggcagcgcaaaagatg

SEQ ID NO: 59705 - DNA, 103 bp, Artificial Sequence
  Synthetic Polynucleotide
taatacgactcactatagggaaacatgggataaaaaaatcgaagcaaataaacagaggagatatttgatgcgattttttaacctggcggcagcgcaaaagatg

SEQ ID NO: 59706 - DNA, 103 bp, Artificial Sequence
  Synthetic Polynucleotide
taatacgactcactatagggagatgaaacatgggataaaaaaatcgaagcaacagaggagagcttcgatgtttttatccaacctggcggcagcgcaaaagatg

SEQ ID NO: 59707 - DNA, 103 bp, Artificial Sequence
  Synthetic Polynucleotide
taatacgactcactatagggatgatagatgaaacatgggataaaaaaatcaacagaggagagattttatgatcccatgtaacctggcggcagcgcaaaagatg

SEQ ID NO: 59708 - DNA, 103 bp, Artificial Sequence
  Synthetic Polynucleotide
taatacgactcactatagggaatctatgatagatgaaacatgggataaaaaacagaggagattttatatgatgtttcataacctggcggcagcgcaaaagatg

SEQ ID NO: 59709 - DNA, 103 bp, Artificial Sequence
  Synthetic Polynucleotide
taatacgactcactataggggtttaaatctatgatagatgaaacatgggaaacagaggagatcccatatgtcatctatcaacctggcggcagcgcaaaagatg

SEQ ID NO: 59710 - DNA, 103 bp, Artificial Sequence
  Synthetic Polynucleotide
taatacgactcactatagggactgcgtttaaatctatgatagatgaaacaaacagaggagatgtttcatgtatcatagaaacctggcggcagcgcaaaagatg

SEQ ID NO: 59711 - DNA, 103 bp, Artificial Sequence
  Synthetic Polynucleotide
taatacgactcactataggggcattactgcgtttaaatctatgatagatgaacagaggagacatctaatgtagatttaaaacctggcggcagcgcaaaagatg

SEQ ID NO: 59712 - DNA, 103 bp, Artificial Sequence
  Synthetic Polynucleotide
taatacgactcactatagggtgcaagcattactgcgtttaaatctatgataacagaggagaatcataatgttaaacgcaaacctggcggcagcgcaaaagatg

SEQ ID NO: 59713 - DNA, 103 bp, Artificial Sequence
  Synthetic Polynucleotide
taatacgactcactatagggaatgttgcaagcattactgcgtttaaatctaacagaggagaagatttatgcgcagtaataacctggcggcagcgcaaaagatg

SEQ ID NO: 59714 - DNA, 103 bp, Artificial Sequence
  Synthetic Polynucleotide
taatacgactcactatagggatgttaatgttgcaagcattactgcgtttaaacagaggagataaacgatgtaatgcttgaacctggcggcagcgcaaaagatg

SEQ ID NO: 59715 - DNA, 103 bp, Artificial Sequence
  Synthetic Polynucleotide
taatacgactcactataggggtgtgttaatgatggaaagttatatgtaataacagaggagaattacaatgaactttccaaacctggcggcagcgcaaaagatg

SEQ ID NO: 59716 - DNA, 103 bp, Artificial Sequence
  Synthetic Polynucleotide
taatacgactcactatagggtcaagatgttaatgttgcaagcattactgcaacagaggagagcagtaatgcttgcaacaaacctggcggcagcgcaaaagatg

SEQ ID NO: 59717 - DNA, 103 bp, Artificial Sequence
  Synthetic Polynucleotide
taatacgactcactatagggatggttcaagatgttaatgttgcaagcattaacagaggagaaatgctatgaacattaacaacctggcggcagcgcaaaagatg

SEQ ID NO: 59718 - DNA, 103 bp, Artificial Sequence
  Synthetic Polynucleotide
taatacgactcactatagggtaccaatggttcaagatgttaatgttgcaaaacagaggagattgcaaatgtaacatcttaacctggcggcagcgcaaaagatg

SEQ ID NO: 59719 - DNA, 103 bp, Artificial Sequence
  Synthetic Polynucleotide
taatacgactcactatagggaattgtaccaatggttcaagatgttaatgtaacagaggagaacattaatgtcttgaaccaacctggcggcagcgcaaaagatg

SEQ ID NO: 59720 - DNA, 103 bp, Artificial Sequence
  Synthetic Polynucleotide
taatacgactcactatagggaacggaattgtaccaatggttcaagatgttaacagaggagaaacatcatgaaccattggaacctggcggcagcgcaaaagatg

SEQ ID NO: 59721 - DNA, 103 bp, Artificial Sequence
  Synthetic Polynucleotide
taatacgactcactatagggtatggaacggaattgtaccaatggttcaagaacagaggagacttgaaatgttggtacaaaacctggcggcagcgcaaaagatg

SEQ ID NO: 59722 - DNA, 103 bp, Artificial Sequence
  Synthetic Polynucleotide
taatacgactcactatagggaaatttatggaacggaattgtaccaatggtaacagaggagaaccattatgacaattccgaacctggcggcagcgcaaaagatg

SEQ ID NO: 59723 - DNA, 103 bp, Artificial Sequence
  Synthetic Polynucleotide
taatacgactcactatagggattataaatttatggaacggaattgtaccaaacagaggagatggtacatgtccgttccaaacctggcggcagcgcaaaagatg

SEQ ID NO: 59724 - DNA, 103 bp, Artificial Sequence
  Synthetic Polynucleotide
taatacgactcactatagggtgaacattataaatttatggaacggaattgaacagaggagacaattcatgtccataaataacctggcggcagcgcaaaagatg

SEQ ID NO: 59725 - DNA, 103 bp, Artificial Sequence
  Synthetic Polynucleotide
taatacgactcactatagggaatggtgaacattataaatttatggaacggaacagaggagaccgttcatgaaatttataaacctggcggcagcgcaaaagatg

SEQ ID NO: 59726 - DNA, 103 bp, Artificial Sequence
  Synthetic Polynucleotide
taatacgactcactatagggagtacgtgtgttaatgatggaaagttatataacagaggagaatataaatgtccatcattaacctggcggcagcgcaaaagatg

SEQ ID NO: 59727 - DNA, 103 bp, Artificial Sequence
  Synthetic Polynucleotide
taatacgactcactatagggatataaatggtgaacattataaatttatggaacagaggagaccataaatgtataatgttaacctggcggcagcgcaaaagatg

SEQ ID NO: 59728 - DNA, 103 bp, Artificial Sequence
  Synthetic Polynucleotide
taatacgactcactataggggagttatataaatggtgaacattataaattaacagaggagaaatttaatgtgttcaccaaacctggcggcagcgcaaaagatg

SEQ ID NO: 59729 - DNA, 103 bp, Artificial Sequence
  Synthetic Polynucleotide
taatacgactcactatagggaaaatgagttatataaatggtgaacattataacagaggagaataatgatgaccatttataacctggcggcagcgcaaaagatg

SEQ ID NO: 59730 - DNA, 103 bp, Artificial Sequence
  Synthetic Polynucleotide
taatacgactcactatagggttcaaaaaatgagttatataaatggtgaacaacagaggagagttcacatgttatataacaacctggcggcagcgcaaaagatg

SEQ ID NO: 59731 - DNA, 103 bp, Artificial Sequence
  Synthetic Polynucleotide
taatacgactcactataggggtatattcaaaaaatgagttatataaatggaacagaggagaccatttatgtaactcattaacctggcggcagcgcaaaagatg

SEQ ID NO: 59732 - DNA, 103 bp, Artificial Sequence
  Synthetic Polynucleotide
taatacgactcactatagggtaaaagtatattcaaaaaatgagttatataaacagaggagatatataatgcattttttgaacctggcggcagcgcaaaagatg

SEQ ID NO: 59733 - DNA, 103 bp, Artificial Sequence
  Synthetic Polynucleotide
taatacgactcactatagggtcaattaaaagtatattcaaaaaatgagttaacagaggagaaactcaatgtttgaatataacctggcggcagcgcaaaagatg

SEQ ID NO: 59734 - DNA, 103 bp, Artificial Sequence
  Synthetic Polynucleotide
taatacgactcactatagggtttgttcaattaaaagtatattcaaaaaataacagaggagaatttttatgatatactttaacctggcggcagcgcaaaagatg

SEQ ID NO: 59735 - DNA, 103 bp, Artificial Sequence
  Synthetic Polynucleotide
taatacgactcactatagggactcttttgttcaattaaaagtatattcaaaacagaggagattgaatatgcttttaattaacctggcggcagcgcaaaagatg

SEQ ID NO: 59736 - DNA, 103 bp, Artificial Sequence
  Synthetic Polynucleotide
taatacgactcactatagggacttaactcttttgttcaattaaaagtataaacagaggagatatactatgaattgaacaaacctggcggcagcgcaaaagatg

SEQ ID NO: 59737 - DNA, 103 bp, Artificial Sequence
  Synthetic Polynucleotide
taatacgactcactatagggaagttagtacgtgtgttaatgatggaaagtaacagaggagaactttcatgcattaacacaacctggcggcagcgcaaaagatg

SEQ ID NO: 59738 - DNA, 103 bp, Artificial Sequence
  Synthetic Polynucleotide
taatacgactcactataggggagtaacttaactcttttgttcaattaaaaaacagaggagattttaaatgaacaaaagaaacctggcggcagcgcaaaagatg

SEQ ID NO: 59739 - DNA, 103 bp, Artificial Sequence
  Synthetic Polynucleotide
taatacgactcactatagggcatatgagtaacttaactcttttgttcaataacagaggagaattgaaatgaagagttaaaacctggcggcagcgcaaaagatg

SEQ ID NO: 59740 - DNA, 103 bp, Artificial Sequence
  Synthetic Polynucleotide
taatacgactcactataggggcgcccatatgagtaacttaactcttttgtaacagaggagaacaaaaatgttaagttacaacctggcggcagcgcaaaagatg

SEQ ID NO: 59741 - DNA, 103 bp, Artificial Sequence
  Synthetic Polynucleotide
taatacgactcactatagggggtcggcgcccatatgagtaacttaactctaacagaggagaagagttatgttactcataaacctggcggcagcgcaaaagatg

SEQ ID NO: 59742 - DNA, 103 bp, Artificial Sequence
  Synthetic Polynucleotide
taatacgactcactatagggagactggtcggcgcccatatgagtaacttaaacagaggagataagttatgcatatgggcaacctggcggcagcgcaaaagatg

SEQ ID NO: 59743 - DNA, 103 bp, Artificial Sequence
  Synthetic Polynucleotide
taatacgactcactatagggtgttcagactggtcggcgcccatatgagtaaacagaggagatactcaatggggcgccgaaacctggcggcagcgcaaaagatg

SEQ ID NO: 59744 - DNA, 103 bp, Artificial Sequence
  Synthetic Polynucleotide
taatacgactcactatagggattgatgttcagactggtcggcgcccatataacagaggagaatatggatgccgaccagtaacctggcggcagcgcaaaagatg

SEQ ID NO: 59745 - DNA, 103 bp, Artificial Sequence
  Synthetic Polynucleotide
taatacgactcactatagggaaaagattgatgttcagactggtcggcgccaacagaggagaggcgccatgcagtctgaaaacctggcggcagcgcaaaagatg

SEQ ID NO: 59746 - DNA, 103 bp, Artificial Sequence
  Synthetic Polynucleotide
taatacgactcactatagggggctaaaaagattgatgttcagactggtcgaacagaggagacgaccaatgtgaacatcaaacctggcggcagcgcaaaagatg

SEQ ID NO: 59747 - DNA, 103 bp, Artificial Sequence
  Synthetic Polynucleotide
taatacgactcactatagggtctctggctaaaaagattgatgttcagactaacagaggagaagtctgatgatcaatcttaacctggcggcagcgcaaaagatg

SEQ ID NO: 59748 - DNA, 103 bp, Artificial Sequence
  Synthetic Polynucleotide
taatacgactcactatagggatcaaaagttagtacgtgtgttaatgatggaacagaggagaccatcaatgacacacgtaaacctggcggcagcgcaaaagatg

SEQ ID NO: 59749 - DNA, 103 bp, Artificial Sequence
  Synthetic Polynucleotide
taatacgactcactatagggtgatatctctggctaaaaagattgatgttcaacagaggagagaacatatgtctttttagaacctggcggcagcgcaaaagatg

SEQ ID NO: 59750 - DNA, 103 bp, Artificial Sequence
  Synthetic Polynucleotide
taatacgactcactatagggggctatgatatctctggctaaaaagattgaaacagaggagatcaatcatgttagccagaaacctggcggcagcgcaaaagatg

SEQ ID NO: 59751 - DNA, 103 bp, Artificial Sequence
  Synthetic Polynucleotide
taatacgactcactatagggagagcggctatgatatctctggctaaaaagaacagaggagactttttatgcagagatataacctggcggcagcgcaaaagatg

SEQ ID NO: 59752 - DNA, 103 bp, Artificial Sequence
  Synthetic Polynucleotide
taatacgactcactatagggctctaagagcggctatgatatctctggctaaacagaggagatagccaatgatatcatagaacctggcggcagcgcaaaagatg

SEQ ID NO: 59753 - DNA, 103 bp, Artificial Sequence
  Synthetic Polynucleotide
taatacgactcactatagggtgaaactctaagagcggctatgatatctctaacagaggagaagagatatgatagccgctaacctggcggcagcgcaaaagatg

SEQ ID NO: 59754 - DNA, 103 bp, Artificial Sequence
  Synthetic Polynucleotide
taatacgactcactatagggcacgctgaaactctaagagcggctatgataaacagaggagatatcatatgcgctcttagaacctggcggcagcgcaaaagatg

SEQ ID NO: 59755 - DNA, 103 bp, Artificial Sequence
  Synthetic Polynucleotide
taatacgactcactatagggaaaatcacgctgaaactctaagagcggctaaacagaggagatagccgatgttagagtttaacctggcggcagcgcaaaagatg

SEQ ID NO: 59756 - DNA, 103 bp, Artificial Sequence
  Synthetic Polynucleotide
taatacgactcactataggggttggaaaatcacgctgaaactctaagagcaacagaggagagctcttatggtttcagcgaacctggcggcagcgcaaaagatg

SEQ ID NO: 59757 - DNA, 103 bp, Artificial Sequence
  Synthetic Polynucleotide
taatacgactcactatagggtttaggttggaaaatcacgctgaaactctaaacagaggagatagagtatgagcgtgattaacctggcggcagcgcaaaagatg

SEQ ID NO: 59758 - DNA, 103 bp, Artificial Sequence
  Synthetic Polynucleotide
taatacgactcactatagggttctatttaggttggaaaatcacgctgaaaaacagaggagatttcagatggattttccaaacctggcggcagcgcaaaagatg

SEQ ID NO: 59759 - DNA, 103 bp, Artificial Sequence
  Synthetic Polynucleotide
taatacgactcactatagggttaaaatcaaaagttagtacgtgtgttaataacagaggagaattaacatgcgtactaacaacctggcggcagcgcaaaagatg

SEQ ID NO: 59760 - DNA, 103 bp, Artificial Sequence
  Synthetic Polynucleotide
taatacgactcactatagggtgacgttctatttaggttggaaaatcacgcaacagaggagagcgtgaatgtccaacctaaacctggcggcagcgcaaaagatg

SEQ ID NO: 59761 - DNA, 103 bp, Artificial Sequence
  Synthetic Polynucleotide
taatacgactcactatagggaatgatgacgttctatttaggttggaaaataacagaggagaattttcatgcctaaatagaacctggcggcagcgcaaaagatg

SEQ ID NO: 59762 - DNA, 103 bp, Artificial Sequence
  Synthetic Polynucleotide
taatacgactcactatagggaacgcaatgatgacgttctatttaggttggaacagaggagaccaaccatgatagaacgtaacctggcggcagcgcaaaagatg

SEQ ID NO: 59763 - DNA, 103 bp, Artificial Sequence
  Synthetic Polynucleotide
taatacgactcactatagggttgtaaacgcaatgatgacgttctatttagaacagaggagactaaatatgacgtcatcaaacctggcggcagcgcaaaagatg

SEQ ID NO: 59764 - DNA, 103 bp, Artificial Sequence
  Synthetic Polynucleotide
taatacgactcactatagggaagtgttgtaaacgcaatgatgacgttctaaacagaggagatagaacatgatcattgcgaacctggcggcagcgcaaaagatg

SEQ ID NO: 59765 - DNA, 103 bp, Artificial Sequence
  Synthetic Polynucleotide
taatacgactcactatagggtagaaaagtgttgtaaacgcaatgatgacgaacagaggagacgtcatatgtgcgtttacaacctggcggcagcgcaaaagatg

SEQ ID NO: 59766 - DNA, 103 bp, Artificial Sequence
  Synthetic Polynucleotide
taatacgactcactatagggacaaatagaaaagtgttgtaaacgcaatgaaacagaggagatcattgatgttacaacacaacctggcggcagcgcaaaagatg

SEQ ID NO: 59767 - DNA, 103 bp, Artificial Sequence
  Synthetic Polynucleotide
taatacgactcactatagggtttgaacaaatagaaaagtgttgtaaacgcaacagaggagagcgtttatgacacttttcaacctggcggcagcgcaaaagatg

SEQ ID NO: 59768 - DNA, 103 bp, Artificial Sequence
  Synthetic Polynucleotide
taatacgactcactatagggcaaagtttgaacaaatagaaaagtgttgtaaacagaggagatacaacatgtttctatttaacctggcggcagcgcaaaagatg

SEQ ID NO: 59769 - DNA, 103 bp, Artificial Sequence
  Synthetic Polynucleotide
taatacgactcactatagggaacaacaaagtttgaacaaatagaaaagtgaacagaggagacactttatgatttgttcaaacctggcggcagcgcaaaagatg

SEQ ID NO: 59770 - DNA, 103 bp, Artificial Sequence
  Synthetic Polynucleotide
taatacgactcactatagggcgtcgttaaaatcaaaagttagtacgtgtgaacagaggagacacacgatgtaacttttgaacctggcggcagcgcaaaagatg

SEQ ID NO: 59771 - DNA, 103 bp, Artificial Sequence
  Synthetic Polynucleotide
taatacgactcactatagggaatgtaacaacaaagtttgaacaaatagaaaacagaggagattctatatgttcaaacttaacctggcggcagcgcaaaagatg

SEQ ID NO: 59772 - DNA, 103 bp, Artificial Sequence
  Synthetic Polynucleotide
taatacgactcactatagggttactaatgtaacaacaaagtttgaacaaaaacagaggagatttgttatgactttgttgaacctggcggcagcgcaaaagatg

SEQ ID NO: 59773 - DNA, 103 bp, Artificial Sequence
  Synthetic Polynucleotide
taatacgactcactatagggaaaaattactaatgtaacaacaaagtttgaaacagaggagatcaaacatggttgttacaaacctggcggcagcgcaaaagatg

SEQ ID NO: 59774 - DNA, 103 bp, Artificial Sequence
  Synthetic Polynucleotide
taatacgactcactataggggaaaaaaaaattactaatgtaacaacaaagaacagaggagactttgtatgtacattagtaacctggcggcagcgcaaaagatg

SEQ ID NO: 59775 - DNA, 103 bp, Artificial Sequence
  Synthetic Polynucleotide
taatacgactcactatagggatttggaaaaaaaaattactaatgtaacaaaacagaggagattgttaatgtagtaatttaacctggcggcagcgcaaaagatg

SEQ ID NO: 59776 - DNA, 103 bp, Artificial Sequence
  Synthetic Polynucleotide
taatacgactcactatagggaactaatttggaaaaaaaaattactaatgtaacagaggagaacattaatgattttttttaacctggcggcagcgcaaaagatg

SEQ ID NO: 59777 - DNA, 103 bp, Artificial Sequence
  Synthetic Polynucleotide
taatacgactcactatagggcggctaactaatttggaaaaaaaaattactaacagaggagaagtaatatgtttttccaaaacctggcggcagcgcaaaagatg

SEQ ID NO: 59778 - DNA, 103 bp, Artificial Sequence
  Synthetic Polynucleotide
taatacgactcactatagggaacaacggctaactaatttggaaaaaaaaaaacagaggagattttttatgccaaattagaacctggcggcagcgcaaaagatg

SEQ ID NO: 59779 - DNA, 103 bp, Artificial Sequence
  Synthetic Polynucleotide
taatacgactcactatagggtctcaaacaacggctaactaatttggaaaaaacagaggagattttccatgttagttagcaacctggcggcagcgcaaaagatg

SEQ ID NO: 59780 - DNA, 103 bp, Artificial Sequence
  Synthetic Polynucleotide
taatacgactcactataggggaaactctcaaacaacggctaactaatttgaacagaggagacaaattatgtagccgttgaacctggcggcagcgcaaaagatg

SEQ ID NO: 59781 - DNA, 103 bp, Artificial Sequence
  Synthetic Polynucleotide
taatacgactcactatagggtatgtcgtcgttaaaatcaaaagttagtacaacagaggagagtactaatgtttgattttaacctggcggcagcgcaaaagatg

SEQ ID NO: 59782 - DNA, 103 bp, Artificial Sequence
  Synthetic Polynucleotide
taatacgactcactatagggatgaggaaactctcaaacaacggctaactaaacagaggagatagttaatggttgtttgaaacctggcggcagcgcaaaagatg

SEQ ID NO: 59783 - DNA, 103 bp, Artificial Sequence
  Synthetic Polynucleotide
taatacgactcactatagggcaataatgaggaaactctcaaacaacggctaacagaggagaagccgtatgttgagagttaacctggcggcagcgcaaaagatg

SEQ ID NO: 59784 - DNA, 103 bp, Artificial Sequence
  Synthetic Polynucleotide
taatacgactcactatagggggagacaataatgaggaaactctcaaacaaaacagaggagattgtttatgagtttcctcaacctggcggcagcgcaaaagatg

SEQ ID NO: 59785 - DNA, 103 bp, Artificial Sequence
  Synthetic Polynucleotide
taatacgactcactatagggccgatggagacaataatgaggaaactctcaaacagaggagatgagagatgcctcattataacctggcggcagcgcaaaagatg

SEQ ID NO: 59786 - DNA, 103 bp, Artificial Sequence
  Synthetic Polynucleotide
taatacgactcactatagggtaaagccgatggagacaataatgaggaaacaacagaggagagtttccatgttattgtctaacctggcggcagcgcaaaagatg

SEQ ID NO: 59787 - DNA, 103 bp, Artificial Sequence
  Synthetic Polynucleotide
taatacgactcactatagggattgttaaagccgatggagacaataatgagaacagaggagactcattatggtctccatcaacctggcggcagcgcaaaagatg

SEQ ID NO: 59788 - DNA, 103 bp, Artificial Sequence
  Synthetic Polynucleotide
taatacgactcactatagggaagcaattgttaaagccgatggagacaataaacagaggagatattgtatgcatcggcttaacctggcggcagcgcaaaagatg

SEQ ID NO: 59789 - DNA, 103 bp, Artificial Sequence
  Synthetic Polynucleotide
taatacgactcactatagggacgcgaagcaattgttaaagccgatggagaaacagaggagatctccaatggctttaacaaacctggcggcagcgcaaaagatg

SEQ ID NO: 59790 - DNA, 103 bp, Artificial Sequence
  Synthetic Polynucleotide
taatacgactcactataggggctaaacgcgaagcaattgttaaagccgataacagaggagaatcggcatgaacaattgcaacctggcggcagcgcaaaagatg

SEQ ID NO: 59791 - DNA, 103 bp, Artificial Sequence
  Synthetic Polynucleotide
taatacgactcactatagggcagaggctaaacgcgaagcaattgttaaagaacagaggagactttaaatgttgcttcgcaacctggcggcagcgcaaaagatg

SEQ ID NO: 59792 - DNA, 103 bp, Artificial Sequence
  Synthetic Polynucleotide
taatacgactcactataggggacaaaaactacacaaatgctgttatcgaaaacagaggagattcgatatgagcatttgtaacctggcggcagcgcaaaagatg

SEQ ID NO: 59793 - DNA, 103 bp, Artificial Sequence
  Synthetic Polynucleotide
taatacgactcactatagggactaatatgtcgtcgttaaaatcaaaagttaacagaggagaaactttatgttttaacgaaacctggcggcagcgcaaaagatg

SEQ ID NO: 59794 - DNA, 103 bp, Artificial Sequence
  Synthetic Polynucleotide
taatacgactcactatagggaaagccagaggctaaacgcgaagcaattgtaacagaggagaacaattatgtcgcgtttaaacctggcggcagcgcaaaagatg

SEQ ID NO: 59795 - DNA, 103 bp, Artificial Sequence
  Synthetic Polynucleotide
taatacgactcactataggggctaaaaagccagaggctaaacgcgaagcaaacagaggagatgcttcatgtttagcctcaacctggcggcagcgcaaaagatg

SEQ ID NO: 59796 - DNA, 103 bp, Artificial Sequence
  Synthetic Polynucleotide
taatacgactcactatagggaggctgctaaaaagccagaggctaaacgcgaacagaggagacgcgttatgcctctggctaacctggcggcagcgcaaaagatg

SEQ ID NO: 59797 - DNA, 103 bp, Artificial Sequence
  Synthetic Polynucleotide
taatacgactcactatagggtacaaaggctgctaaaaagccagaggctaaaacagaggagattagccatgggctttttaaacctggcggcagcgcaaaagatg

SEQ ID NO: 59798 - DNA, 103 bp, Artificial Sequence
  Synthetic Polynucleotide
taatacgactcactatagggttctctacaaaggctgctaaaaagccagagaacagaggagactctggatgtttagcagcaacctggcggcagcgcaaaagatg

SEQ ID NO: 59799 - DNA, 103 bp, Artificial Sequence
  Synthetic Polynucleotide
taatacgactcactatagggaatttttctctacaaaggctgctaaaaagcaacagaggagagcttttatgcagcctttgaacctggcggcagcgcaaaagatg

SEQ ID NO: 59800 - DNA, 103 bp, Artificial Sequence
  Synthetic Polynucleotide
taatacgactcactatagggaactgaatttttctctacaaaggctgctaaaacagaggagattagcaatgtttgtagagaacctggcggcagcgcaaaagatg

SEQ ID NO: 59801 - DNA, 103 bp, Artificial Sequence
  Synthetic Polynucleotide
taatacgactcactatagggccagcaactgaatttttctctacaaaggctaacagaggagaagccttatgagagaaaaaaacctggcggcagcgcaaaagatg

SEQ ID NO: 59802 - DNA, 103 bp, Artificial Sequence
  Synthetic Polynucleotide
taatacgactcactatagggcaattccagcaactgaatttttctctacaaaacagaggagattgtagatgaaaattcagaacctggcggcagcgcaaaagatg

SEQ ID NO: 59803 - DNA, 103 bp, Artificial Sequence
  Synthetic Polynucleotide
taatacgactcactatagggtcttgcaattccagcaactgaatttttctcaacagaggagagagaaaatgtcagttgctaacctggcggcagcgcaaaagatg

SEQ ID NO: 59804 - DNA, 103 bp, Artificial Sequence
  Synthetic Polynucleotide
taatacgactcactatagggcagttactaatatgtcgtcgttaaaatcaaaacagaggagattgattatgacgacgacaaacctggcggcagcgcaaaagatg

SEQ ID NO: 59805 - DNA, 103 bp, Artificial Sequence
  Synthetic Polynucleotide
taatacgactcactataggggatgatcttgcaattccagcaactgaatttaacagaggagaaaattcatgtgctggaataacctggcggcagcgcaaaagatg

SEQ ID NO: 59806 - DNA, 103 bp, Artificial Sequence
  Synthetic Polynucleotide
taatacgactcactataggggagatgatgatcttgcaattccagcaactgaacagaggagacagttgatggaattgcaaaacctggcggcagcgcaaaagatg

SEQ ID NO: 59807 - DNA, 103 bp, Artificial Sequence
  Synthetic Polynucleotide
taatacgactcactatagggccctggagatgatgatcttgcaattccagcaacagaggagagctggaatggcaagatcaaacctggcggcagcgcaaaagatg

SEQ ID NO: 59808 - DNA, 103 bp, Artificial Sequence
  Synthetic Polynucleotide
taatacgactcactatagggcttttccctggagatgatgatcttgcaattaacagaggagaaattgcatgatcatcatcaacctggcggcagcgcaaaagatg

SEQ ID NO: 59809 - DNA, 103 bp, Artificial Sequence
  Synthetic Polynucleotide
taatacgactcactataggggaactcttttccctggagatgatgatcttgaacagaggagacaagatatgcatctccagaacctggcggcagcgcaaaagatg

SEQ ID NO: 59810 - DNA, 103 bp, Artificial Sequence
  Synthetic Polynucleotide
taatacgactcactatagggggacggaactcttttccctggagatgatgaaacagaggagatcatcaatgccagggaaaaacctggcggcagcgcaaaagatg

SEQ ID NO: 59811 - DNA, 103 bp, Artificial Sequence
  Synthetic Polynucleotide
taatacgactcactatagggtaaatggacggaactcttttccctggagataacagaggagaatctccatggaaaagagtaacctggcggcagcgcaaaagatg

SEQ ID NO: 59812 - DNA, 103 bp, Artificial Sequence
  Synthetic Polynucleotide
taatacgactcactatagggtactttaaatggacggaactcttttccctgaacagaggagacagggaatggagttccgtaacctggcggcagcgcaaaagatg

SEQ ID NO: 59813 - DNA, 103 bp, Artificial Sequence
  Synthetic Polynucleotide
taatacgactcactatagggatctgtactttaaatggacggaactcttttaacagaggagaaaaagaatgccgtccattaacctggcggcagcgcaaaagatg

SEQ ID NO: 59814 - DNA, 103 bp, Artificial Sequence
  Synthetic Polynucleotide
taatacgactcactatagggttaaaatctgtactttaaatggacggaactaacagaggagaagttccatgcatttaaagaacctggcggcagcgcaaaagatg

SEQ ID NO: 59815 - DNA, 103 bp, Artificial Sequence
  Synthetic Polynucleotide
taatacgactcactataggggaaaacagttactaatatgtcgtcgttaaaaacagaggagatttaacatggacatattaaacctggcggcagcgcaaaagatg

SEQ ID NO: 59816 - DNA, 103 bp, Artificial Sequence
  Synthetic Polynucleotide
taatacgactcactatagggagtttttaaaatctgtactttaaatggacgaacagaggagacgtccaatgaaagtacagaacctggcggcagcgcaaaagatg

SEQ ID NO: 59817 - DNA, 103 bp, Artificial Sequence
  Synthetic Polynucleotide
taatacgactcactataggggtgtcagtttttaaaatctgtactttaaataacagaggagaatttaaatgacagattttaacctggcggcagcgcaaaagatg

SEQ ID NO: 59818 - DNA, 103 bp, Artificial Sequence
  Synthetic Polynucleotide
taatacgactcactataggggtagagtgtcagtttttaaaatctgtacttaacagaggagaaagtacatgttttaaaaaaacctggcggcagcgcaaaagatg

SEQ ID NO: 59819 - DNA, 103 bp, Artificial Sequence
  Synthetic Polynucleotide
taatacgactcactatagggataacgtagagtgtcagtttttaaaatctgaacagaggagacagattatgaaaactgacaacctggcggcagcgcaaaagatg

SEQ ID NO: 59820 - DNA, 103 bp, Artificial Sequence
  Synthetic Polynucleotide
taatacgactcactatagggtataaataacgtagagtgtcagtttttaaaaacagaggagatttaaaatgtgacactctaacctggcggcagcgcaaaagatg

SEQ ID NO: 59821 - DNA, 103 bp, Artificial Sequence
  Synthetic Polynucleotide
taatacgactcactatagggccaaatataaataacgtagagtgtcagtttaacagaggagaaaactgatgctctacgttaacctggcggcagcgcaaaagatg

SEQ ID NO: 59822 - DNA, 103 bp, Artificial Sequence
  Synthetic Polynucleotide
taatacgactcactatagggttgcaccaaatataaataacgtagagtgtcaacagaggagagacactatgcgttatttaaacctggcggcagcgcaaaagatg

SEQ ID NO: 59823 - DNA, 103 bp, Artificial Sequence
  Synthetic Polynucleotide
taatacgactcactatagggatgtgttgcaccaaatataaataacgtagaaacagaggagatctacgatgtttatatttaacctggcggcagcgcaaaagatg

SEQ ID NO: 59824 - DNA, 103 bp, Artificial Sequence
  Synthetic Polynucleotide
taatacgactcactatagggaatccatgtgttgcaccaaatataaataacaacagaggagagttattatgatttggtgcaacctggcggcagcgcaaaagatg

SEQ ID NO: 59825 - DNA, 103 bp, Artificial Sequence
  Synthetic Polynucleotide
taatacgactcactatagggtttataatccatgtgttgcaccaaatataaaacagaggagattatatatggtgcaacacaacctggcggcagcgcaaaagatg

SEQ ID NO: 59826 - DNA, 103 bp, Artificial Sequence
  Synthetic Polynucleotide
taatacgactcactatagggaaatggaaaacagttactaatatgtcgtcgaacagaggagacgacgaatgattagtaacaacctggcggcagcgcaaaagatg

SEQ ID NO: 59827 - DNA, 103 bp, Artificial Sequence
  Synthetic Polynucleotide
taatacgactcactatagggcgatatttataatccatgtgttgcaccaaaaacagaggagatttggtatgacacatggaaacctggcggcagcgcaaaagatg

SEQ ID NO: 59828 - DNA, 103 bp, Artificial Sequence
  Synthetic Polynucleotide
taatacgactcactatagggaacatcgatatttataatccatgtgttgcaaacagaggagatgcaacatgtggattataaacctggcggcagcgcaaaagatg

SEQ ID NO: 59829 - DNA, 103 bp, Artificial Sequence
  Synthetic Polynucleotide
taatacgactcactatagggttattaacatcgatatttataatccatgtgaacagaggagacacatgatgtataaatataacctggcggcagcgcaaaagatg

SEQ ID NO: 59830 - DNA, 103 bp, Artificial Sequence
  Synthetic Polynucleotide
taatacgactcactatagggtgatgttattaacatcgatatttataatccaacagaggagaggattaatgatatcgatgaacctggcggcagcgcaaaagatg

SEQ ID NO: 59831 - DNA, 103 bp, Artificial Sequence
  Synthetic Polynucleotide
taatacgactcactatagggttttctgatgttattaacatcgatatttataacagaggagaataaatatggatgttaataacctggcggcagcgcaaaagatg

SEQ ID NO: 59832 - DNA, 103 bp, Artificial Sequence
  Synthetic Polynucleotide
taatacgactcactatagggttacattttctgatgttattaacatcgataaacagaggagatatcgaatgtaataacataacctggcggcagcgcaaaagatg

SEQ ID NO: 59833 - DNA, 103 bp, Artificial Sequence
  Synthetic Polynucleotide
taatacgactcactatagggagactttacattttctgatgttattaacataacagaggagaatgttaatgacatcagaaaacctggcggcagcgcaaaagatg

SEQ ID NO: 59834 - DNA, 103 bp, Artificial Sequence
  Synthetic Polynucleotide
taatacgactcactatagggtgtatagactttacattttctgatgttattaacagaggagaaataacatgagaaaatgtaacctggcggcagcgcaaaagatg

SEQ ID NO: 59835 - DNA, 103 bp, Artificial Sequence
  Synthetic Polynucleotide
taatacgactcactatagggcgcaatgtatagactttacattttctgatgaacagaggagacatcagatgatgtaaagtaacctggcggcagcgcaaaagatg

SEQ ID NO: 59836 - DNA, 103 bp, Artificial Sequence
  Synthetic Polynucleotide
taatacgactcactataggggatggcgcaatgtatagactttacattttcaacagaggagagaaaatatgaagtctataaacctggcggcagcgcaaaagatg

SEQ ID NO: 59837 - DNA, 103 bp, Artificial Sequence
  Synthetic Polynucleotide
taatacgactcactatagggaaaaaaaatggaaaacagttactaatatgtaacagaggagaacatatatgtaactgtttaacctggcggcagcgcaaaagatg

SEQ ID NO: 59838 - DNA, 103 bp, Artificial Sequence
  Synthetic Polynucleotide
taatacgactcactatagggaacacgatggcgcaatgtatagactttacaaacagaggagatgtaaaatgtatacattgaacctggcggcagcgcaaaagatg

SEQ ID NO: 59839 - DNA, 103 bp, Artificial Sequence
  Synthetic Polynucleotide
taatacgactcactatagggaatttaacacgatggcgcaatgtatagactaacagaggagaagtctaatgattgcgccaaacctggcggcagcgcaaaagatg

SEQ ID NO: 59840 - DNA, 103 bp, Artificial Sequence
  Synthetic Polynucleotide
taatacgactcactatagggtagaaaatttaacacgatggcgcaatgtataacagaggagaatacatatggccatcgtgaacctggcggcagcgcaaaagatg

SEQ ID NO: 59841 - DNA, 103 bp, Artificial Sequence
  Synthetic Polynucleotide
taatacgactcactatagggtccattagaaaatttaacacgatggcgcaaaacagaggagattgcgcatgcgtgttaaaaacctggcggcagcgcaaaagatg

SEQ ID NO: 59842 - DNA, 103 bp, Artificial Sequence
  Synthetic Polynucleotide
taatacgactcactatagggctagatccattagaaaatttaacacgatggaacagaggagaccatcgatgtaaattttcaacctggcggcagcgcaaaagatg

SEQ ID NO: 59843 - DNA, 103 bp, Artificial Sequence
  Synthetic Polynucleotide
taatacgactcactatagggtaatactagatccattagaaaatttaacacaacagaggagagtgttaatgtttctaatgaacctggcggcagcgcaaaagatg

SEQ ID NO: 59844 - DNA, 103 bp, Artificial Sequence
  Synthetic Polynucleotide
taatacgactcactatagggcccaataatactagatccattagaaaatttaacagaggagaaaatttatgaatggatctaacctggcggcagcgcaaaagatg

SEQ ID NO: 59845 - DNA, 103 bp, Artificial Sequence
  Synthetic Polynucleotide
taatacgactcactatagggttggacccaataatactagatccattagaaaacagaggagattctaaatgatctagtataacctggcggcagcgcaaaagatg

SEQ ID NO: 59846 - DNA, 103 bp, Artificial Sequence
  Synthetic Polynucleotide
taatacgactcactatagggtgaagttggacccaataatactagatccataacagaggagaatggatatggtattattgaacctggcggcagcgcaaaagatg

SEQ ID NO: 59847 - DNA, 103 bp, Artificial Sequence
  Synthetic Polynucleotide
taatacgactcactatagggcaggctgaagttggacccaataatactagaaacagaggagatctagtatgattgggtccaacctggcggcagcgcaaaagatg

SEQ ID NO: 59848 - DNA, 103 bp, Artificial Sequence
  Synthetic Polynucleotide
taatacgactcactatagggaaaaaaaaaaaaatggaaaacagttactaaaacagaggagattagtaatggttttccataacctggcggcagcgcaaaagatg

SEQ ID NO: 59849 - DNA, 103 bp, Artificial Sequence
  Synthetic Polynucleotide
taatacgactcactataggggatttcaggctgaagttggacccaataataaacagaggagatattatatggtccaacttaacctggcggcagcgcaaaagatg

SEQ ID NO: 59850 - DNA, 103 bp, Artificial Sequence
  Synthetic Polynucleotide
taatacgactcactatagggatttggatttcaggctgaagttggacccaaaacagaggagattgggtatgacttcagccaacctggcggcagcgcaaaagatg

SEQ ID NO: 59851 - DNA, 103 bp, Artificial Sequence
  Synthetic Polynucleotide
taatacgactcactatagggtccatatttggatttcaggctgaagttggaaacagaggagatccaacatgagcctgaaaaacctggcggcagcgcaaaagatg

SEQ ID NO: 59852 - DNA, 103 bp, Artificial Sequence
  Synthetic Polynucleotide
taatacgactcactatagggccgcttccatatttggatttcaggctgaagaacagaggagacttcagatggaaatccaaaacctggcggcagcgcaaaagatg

SEQ ID NO: 59853 - DNA, 103 bp, Artificial Sequence
  Synthetic Polynucleotide
taatacgactcactatagggtgtatccgcttccatatttggatttcaggcaacagaggagagcctgaatgccaaatatgaacctggcggcagcgcaaaagatg

SEQ ID NO: 59854 - DNA, 103 bp, Artificial Sequence
  Synthetic Polynucleotide
taatacgactcactatagggggttttgtatccgcttccatatttggatttaacagaggagaaaatccatgtatggaagcaacctggcggcagcgcaaaagatg

SEQ ID NO: 59855 - DNA, 103 bp, Artificial Sequence
  Synthetic Polynucleotide
taatacgactcactataggggaaacggttttgtatccgcttccatatttgaacagaggagacaaataatgaagcggataaacctggcggcagcgcaaaagatg

SEQ ID NO: 59856 - DNA, 103 bp, Artificial Sequence
  Synthetic Polynucleotide
taatacgactcactatagggtccaggaaacggttttgtatccgcttccataacagaggagaatggaaatggatacaaaaaacctggcggcagcgcaaaagatg

SEQ ID NO: 59857 - DNA, 103 bp, Artificial Sequence
  Synthetic Polynucleotide
taatacgactcactataggggcttatccaggaaacggttttgtatccgctaacagaggagaagcggaatgaaaaccgttaacctggcggcagcgcaaaagatg

SEQ ID NO: 59858 - DNA, 103 bp, Artificial Sequence
  Synthetic Polynucleotide
taatacgactcactataggggtgtggcttatccaggaaacggttttgtataacagaggagaatacaaatgcgtttcctgaacctggcggcagcgcaaaagatg

SEQ ID NO: 59859 - DNA, 103 bp, Artificial Sequence
  Synthetic Polynucleotide
taatacgactcactatagggaaaaaaaaaaaaaaaaaatggaaaacagttaacagaggagaaactgtatgccattttttaacctggcggcagcgcaaaagatg

SEQ ID NO: 59860 - DNA, 103 bp, Artificial Sequence
  Synthetic Polynucleotide
taatacgactcactataggggagatgtgtggcttatccaggaaacggtttaacagaggagaaaaccgatgcctggataaaacctggcggcagcgcaaaagatg

SEQ ID NO: 59861 - DNA, 103 bp, Artificial Sequence
  Synthetic Polynucleotide
taatacgactcactatagggaagtggagatgtgtggcttatccaggaaacaacagaggagagtttccatgataagccacaacctggcggcagcgcaaaagatg

SEQ ID NO: 59862 - DNA, 103 bp, Artificial Sequence
  Synthetic Polynucleotide
taatacgactcactatagggagcaaaagtggagatgtgtggcttatccagaacagaggagactggatatgccacacatcaacctggcggcagcgcaaaagatg

SEQ ID NO: 59863 - DNA, 103 bp, Artificial Sequence
  Synthetic Polynucleotide
taatacgactcactatagggtgtaaagcaaaagtggagatgtgtggcttaaacagaggagataagccatgcatctccacaacctggcggcagcgcaaaagatg

SEQ ID NO: 59864 - DNA, 103 bp, Artificial Sequence
  Synthetic Polynucleotide
taatacgactcactatagggtctgatgtaaagcaaaagtggagatgtgtgaacagaggagacacacaatgccacttttgaacctggcggcagcgcaaaagatg

SEQ ID NO: 59865 - DNA, 103 bp, Artificial Sequence
  Synthetic Polynucleotide
taatacgactcactatagggcaatttctgatgtaaagcaaaagtggagataacagaggagaatctccatgtttgctttaaacctggcggcagcgcaaaagatg

SEQ ID NO: 59866 - DNA, 103 bp, Artificial Sequence
  Synthetic Polynucleotide
taatacgactcactatagggtgacacaatttctgatgtaaagcaaaagtgaacagaggagacactttatgtttacatcaaacctggcggcagcgcaaaagatg

SEQ ID NO: 59867 - DNA, 103 bp, Artificial Sequence
  Synthetic Polynucleotide
taatacgactcactataggggtcaatgacacaatttctgatgtaaagcaaaacagaggagattgcttatgatcagaaataacctggcggcagcgcaaaagatg

SEQ ID NO: 59868 - DNA, 103 bp, Artificial Sequence
  Synthetic Polynucleotide
taatacgactcactatagggaagatgtcaatgacacaatttctgatgtaaaacagaggagattacatatgaaattgtgtaacctggcggcagcgcaaaagatg

SEQ ID NO: 59869 - DNA, 103 bp, Artificial Sequence
  Synthetic Polynucleotide
taatacgactcactatagggagttcaagatgtcaatgacacaatttctgaaacagaggagatcagaaatggtgtcattgaacctggcggcagcgcaaaagatg

SEQ ID NO: 59870 - DNA, 103 bp, Artificial Sequence
  Synthetic Polynucleotide
taatacgactcactatagggacaaaaaaaaaaaaaaaaaaaaatggaaaaaacagaggagattttccatgtttttttttaacctggcggcagcgcaaaagatg

SEQ ID NO: 59871 - DNA, 103 bp, Artificial Sequence
  Synthetic Polynucleotide
taatacgactcactatagggaggagagttcaagatgtcaatgacacaattaacagaggagaaattgtatgattgacatcaacctggcggcagcgcaaaagatg

SEQ ID NO: 59872 - DNA, 103 bp, Artificial Sequence
  Synthetic Polynucleotide
taatacgactcactatagggtagataggagagttcaagatgtcaatgacaaacagaggagatgtcatatgcatcttgaaaacctggcggcagcgcaaaagatg

SEQ ID NO: 59873 - DNA, 103 bp, Artificial Sequence
  Synthetic Polynucleotide
taatacgactcactatagggagcattagataggagagttcaagatgtcaaaacagaggagattgacaatgtgaactctcaacctggcggcagcgcaaaagatg

SEQ ID NO: 59874 - DNA, 103 bp, Artificial Sequence
  Synthetic Polynucleotide
taatacgactcactatagggacaccagcattagataggagagttcaagataacagaggagaatcttgatgtctcctatcaacctggcggcagcgcaaaagatg

SEQ ID NO: 59875 - DNA, 103 bp, Artificial Sequence
  Synthetic Polynucleotide
taatacgactcactataggggtggtacaccagcattagataggagagttcaacagaggagagaactcatgtatctaatgaacctggcggcagcgcaaaagatg

SEQ ID NO: 59876 - DNA, 103 bp, Artificial Sequence
  Synthetic Polynucleotide
taatacgactcactatagggtataggtggtacaccagcattagataggagaacagaggagactcctaatgaatgctggtaacctggcggcagcgcaaaagatg

SEQ ID NO: 59877 - DNA, 103 bp, Artificial Sequence
  Synthetic Polynucleotide
taatacgactcactatagggaaatctataggtggtacaccagcattagataacagaggagaatctaaatgtggtgtaccaacctggcggcagcgcaaaagatg

SEQ ID NO: 59878 - DNA, 103 bp, Artificial Sequence
  Synthetic Polynucleotide
taatacgactcactatagggattcaaaatctataggtggtacaccagcataacagaggagaatgctgatgtaccacctaaacctggcggcagcgcaaaagatg

SEQ ID NO: 59879 - DNA, 103 bp, Artificial Sequence
  Synthetic Polynucleotide
taatacgactcactatagggcgaatattcaaaatctataggtggtacaccaacagaggagaggtgtaatgcctatagataacctggcggcagcgcaaaagatg

SEQ ID NO: 59880 - DNA, 103 bp, Artificial Sequence
  Synthetic Polynucleotide
taatacgactcactataggggcattcgaatattcaaaatctataggtggtaacagaggagaaccaccatgagattttgaaacctggcggcagcgcaaaagatg

SEQ ID NO: 59881 - DNA, 103 bp, Artificial Sequence
  Synthetic Polynucleotide
taatacgactcactatagggttaaaacaaaaaaaaaaaaaaaaaaaaatgaacagaggagacattttatgtttttttttaacctggcggcagcgcaaaagatg

SEQ ID NO: 59882 - DNA, 103 bp, Artificial Sequence
  Synthetic Polynucleotide
taatacgactcactatagggatgcagcattcgaatattcaaaatctatagaacagaggagactatagatgttgaatattaacctggcggcagcgcaaaagatg

SEQ ID NO: 59883 - DNA, 103 bp, Artificial Sequence
  Synthetic Polynucleotide
taatacgactcactatagggtactcatgcagcattcgaatattcaaaatcaacagaggagagattttatgtattcgaataacctggcggcagcgcaaaagatg

SEQ ID NO: 59884 - DNA, 103 bp, Artificial Sequence
  Synthetic Polynucleotide
taatacgactcactatagggaatgctactcatgcagcattcgaatattcaaacagaggagatgaataatggaatgctgcaacctggcggcagcgcaaaagatg

SEQ ID NO: 59885 - DNA, 103 bp, Artificial Sequence
  Synthetic Polynucleotide
taatacgactcactatagggaatttaatgctactcatgcagcattcgaataacagaggagaattcgaatgctgcatgagaacctggcggcagcgcaaaagatg

SEQ ID NO: 59886 - DNA, 103 bp, Artificial Sequence
  Synthetic Polynucleotide
taatacgactcactatagggtaaggaatttaatgctactcatgcagcattaacagaggagaaatgctatgtgagtagcaaacctggcggcagcgcaaaagatg

SEQ ID NO: 59887 - DNA, 103 bp, Artificial Sequence
  Synthetic Polynucleotide
taatacgactcactatagggaatattaaggaatttaatgctactcatgcaaacagaggagatgcatgatgagcattaaaaacctggcggcagcgcaaaagatg

SEQ ID NO: 59888 - DNA, 103 bp, Artificial Sequence
  Synthetic Polynucleotide
taatacgactcactatagggatggcaatattaaggaatttaatgctactcaacagaggagagagtagatgtaaattcctaacctggcggcagcgcaaaagatg

SEQ ID NO: 59889 - DNA, 103 bp, Artificial Sequence
  Synthetic Polynucleotide
taatacgactcactataggggaattatggcaatattaaggaatttaatgcaacagaggagagcattaatgtccttaataaacctggcggcagcgcaaaagatg

SEQ ID NO: 59890 - DNA, 103 bp, Artificial Sequence
  Synthetic Polynucleotide
taatacgactcactatagggtatgagaattatggcaatattaaggaatttaacagaggagaaaattcatgaatattgccaacctggcggcagcgcaaaagatg

SEQ ID NO: 59891 - DNA, 103 bp, Artificial Sequence
  Synthetic Polynucleotide
taatacgactcactatagggcaatatatgagaattatggcaatattaaggaacagaggagaccttaaatgtgccataataacctggcggcagcgcaaaagatg

SEQ ID NO: 59892 - DNA, 103 bp, Artificial Sequence
  Synthetic Polynucleotide
taatacgactcactatagggagatcttaaaacaaaaaaaaaaaaaaaaaaaacagaggagattttttatgtttttttttaacctggcggcagcgcaaaagatg

SEQ ID NO: 59893 - DNA, 103 bp, Artificial Sequence
  Synthetic Polynucleotide
taatacgactcactatagggttactcaatatatgagaattatggcaatataacagaggagaatattgatgtaattctcaaacctggcggcagcgcaaaagatg

SEQ ID NO: 59894 - DNA, 103 bp, Artificial Sequence
  Synthetic Polynucleotide
taatacgactcactatagggcagggttactcaatatatgagaattatggcaacagaggagagccataatgctcatatataacctggcggcagcgcaaaagatg

SEQ ID NO: 59895 - DNA, 103 bp, Artificial Sequence
  Synthetic Polynucleotide
taatacgactcactatagggttatccagggttactcaatatatgagaattaacagaggagaaattctatgatattgagtaacctggcggcagcgcaaaagatg

SEQ ID NO: 59896 - DNA, 103 bp, Artificial Sequence
  Synthetic Polynucleotide
taatacgactcactatagggactttttatccagggttactcaatatatgaaacagaggagatcatatatggagtaacccaacctggcggcagcgcaaaagatg

SEQ ID NO: 59897 - DNA, 103 bp, Artificial Sequence
  Synthetic Polynucleotide
taatacgactcactatagggtgtttactttttatccagggttactcaataaacagaggagatattgaatgaccctggataacctggcggcagcgcaaaagatg

SEQ ID NO: 59898 - DNA, 103 bp, Artificial Sequence
  Synthetic Polynucleotide
taatacgactcactatagggcagtgtgtttactttttatccagggttactaacagaggagaagtaacatgggataaaaaaacctggcggcagcgcaaaagatg

SEQ ID NO: 59899 - DNA, 103 bp, Artificial Sequence
  Synthetic Polynucleotide
taatacgactcactatagggggctgcagtgtgtttactttttatccagggaacagaggagaccctggatgaaaagtaaaaacctggcggcagcgcaaaagatg

SEQ ID NO: 59900 - DNA, 103 bp, Artificial Sequence
  Synthetic Polynucleotide
taatacgactcactataggggcgacggctgcagtgtgtttactttttatcaacagaggagagataaaatgtaaacacacaacctggcggcagcgcaaaagatg

SEQ ID NO: 59901 - DNA, 103 bp, Artificial Sequence
  Synthetic Polynucleotide
taatacgactcactatagggtggtagcgacggctgcagtgtgtttactttaacagaggagaaaagtaatgacactgcagaacctggcggcagcgcaaaagatg

SEQ ID NO: 59902 - DNA, 103 bp, Artificial Sequence
  Synthetic Polynucleotide
taatacgactcactatagggtattgtggtagcgacggctgcagtgtgtttaacagaggagaaaacacatggcagccgtcaacctggcggcagcgcaaaagatg

SEQ ID NO: 59903 - DNA, 103 bp, Artificial Sequence
  Synthetic Polynucleotide
taatacgactcactatagggtaaaagacaaaaactacacaaatgctgttaaacagaggagataacagatgttgtgtagtaacctggcggcagcgcaaaagatg

SEQ ID NO: 59904 - DNA, 103 bp, Artificial Sequence
  Synthetic Polynucleotide
taatacgactcactatagggtgggtagatcttaaaacaaaaaaaaaaaaaaacagaggagattttttatgttttgttttaacctggcggcagcgcaaaagatg

SEQ ID NO: 59905 - DNA, 103 bp, Artificial Sequence
  Synthetic Polynucleotide
taatacgactcactatagggttttttattgtggtagcgacggctgcagtgaacagaggagacactgcatgcgtcgctacaacctggcggcagcgcaaaagatg

SEQ ID NO: 59906 - DNA, 103 bp, Artificial Sequence
  Synthetic Polynucleotide
taatacgactcactatagggcaattttttttattgtggtagcgacggctgaacagaggagacagccgatgctaccacaaaacctggcggcagcgcaaaagatg

SEQ ID NO: 59907 - DNA, 103 bp, Artificial Sequence
  Synthetic Polynucleotide
taatacgactcactatagggtctatcaattttttttattgtggtagcgacaacagaggagagtcgctatgacaataaaaaacctggcggcagcgcaaaagatg

SEQ ID NO: 59908 - DNA, 103 bp, Artificial Sequence
  Synthetic Polynucleotide
taatacgactcactatagggaactctctatcaattttttttattgtggtaaacagaggagataccacatgaaaaaaaataacctggcggcagcgcaaaagatg

SEQ ID NO: 59909 - DNA, 103 bp, Artificial Sequence
  Synthetic Polynucleotide
taatacgactcactatagggaaatgaactctctatcaattttttttattgaacagaggagacaataaatgaaattgataaacctggcggcagcgcaaaagatg

SEQ ID NO: 59910 - DNA, 103 bp, Artificial Sequence
  Synthetic Polynucleotide
taatacgactcactatagggattataaatgaactctctatcaatttttttaacagaggagaaaaaaaatggatagagagaacctggcggcagcgcaaaagatg

SEQ ID NO: 59911 - DNA, 103 bp, Artificial Sequence
  Synthetic Polynucleotide
taatacgactcactatagggaatagattataaatgaactctctatcaattaacagaggagaaattgaatgagagttcataacctggcggcagcgcaaaagatg

SEQ ID NO: 59912 - DNA, 103 bp, Artificial Sequence
  Synthetic Polynucleotide
taatacgactcactatagggcttctaatagattataaatgaactctctataacagaggagaatagagatgtcatttataaacctggcggcagcgcaaaagatg

SEQ ID NO: 59913 - DNA, 103 bp, Artificial Sequence
  Synthetic Polynucleotide
taatacgactcactataggggttagcttctaatagattataaatgaactcaacagaggagagagttcatgtataatctaaacctggcggcagcgcaaaagatg

SEQ ID NO: 59914 - DNA, 103 bp, Artificial Sequence
  Synthetic Polynucleotide
taatacgactcactatagggattttgttagcttctaatagattataaatgaacagaggagacatttaatgtctattagaaacctggcggcagcgcaaaagatg

SEQ ID NO: 59915 - DNA, 103 bp, Artificial Sequence
  Synthetic Polynucleotide
taatacgactcactatagggatccgtgggtagatcttaaaacaaaaaaaaaacagaggagattttttatgttttaagataacctggcggcagcgcaaaagatg

SEQ ID NO: 59916 - DNA, 103 bp, Artificial Sequence
  Synthetic Polynucleotide
taatacgactcactatagggaaaaaattttgttagcttctaatagattataacagaggagaataatcatgtagaagctaaacctggcggcagcgcaaaagatg

SEQ ID NO: 59917 - DNA, 103 bp, Artificial Sequence
  Synthetic Polynucleotide
taatacgactcactataggggtgtaaaaaaattttgttagcttctaatagaacagaggagactattaatggctaacaaaaacctggcggcagcgcaaaagatg

SEQ ID NO: 59918 - DNA, 103 bp, Artificial Sequence
  Synthetic Polynucleotide
taatacgactcactataggggatgcgtgtaaaaaaattttgttagcttctaacagaggagaagaagcatgcaaaattttaacctggcggcagcgcaaaagatg

SEQ ID NO: 59919 - DNA, 103 bp, Artificial Sequence
  Synthetic Polynucleotide
taatacgactcactatagggtgtctgatgcgtgtaaaaaaattttgttagaacagaggagactaacaatgtttttttacaacctggcggcagcgcaaaagatg

SEQ ID NO: 59920 - DNA, 103 bp, Artificial Sequence
  Synthetic Polynucleotide
taatacgactcactatagggagcattgtctgatgcgtgtaaaaaaattttaacagaggagaaaaattatgttacacgcaaacctggcggcagcgcaaaagatg

SEQ ID NO: 59921 - DNA, 103 bp, Artificial Sequence
  Synthetic Polynucleotide
taatacgactcactatagggattaaagcattgtctgatgcgtgtaaaaaaaacagaggagattttttatgcgcatcagaaacctggcggcagcgcaaaagatg

SEQ ID NO: 59922 - DNA, 103 bp, Artificial Sequence
  Synthetic Polynucleotide
taatacgactcactatagggtatttattaaagcattgtctgatgcgtgtaaacagaggagatacacgatgcagacaatgaacctggcggcagcgcaaaagatg

SEQ ID NO: 59923 - DNA, 103 bp, Artificial Sequence
  Synthetic Polynucleotide
taatacgactcactatagggtgaactatttattaaagcattgtctgatgcaacagaggagagcatcaatgaatgctttaaacctggcggcagcgcaaaagatg

SEQ ID NO: 59924 - DNA, 103 bp, Artificial Sequence
  Synthetic Polynucleotide
taatacgactcactataggggatgttgaactatttattaaagcattgtctaacagaggagaagacaaatgtttaataaaaacctggcggcagcgcaaaagatg

SEQ ID NO: 59925 - DNA, 103 bp, Artificial Sequence
  Synthetic Polynucleotide
taatacgactcactatagggaagtagatgttgaactatttattaaagcataacagaggagaatgcttatgtaaatagttaacctggcggcagcgcaaaagatg

SEQ ID NO: 59926 - DNA, 103 bp, Artificial Sequence
  Synthetic Polynucleotide
taatacgactcactatagggttcgtatccgtgggtagatcttaaaacaaaaacagaggagatttgttatgagatctaccaacctggcggcagcgcaaaagatg

SEQ ID NO: 59927 - DNA, 103 bp, Artificial Sequence
  Synthetic Polynucleotide
taatacgactcactatagggaacaaaagtagatgttgaactatttattaaaacagaggagattaataatgagttcaacaaacctggcggcagcgcaaaagatg

SEQ ID NO: 59928 - DNA, 103 bp, Artificial Sequence
  Synthetic Polynucleotide
taatacgactcactataggggatataacaaaagtagatgttgaactatttaacagaggagaaaatagatgaacatctacaacctggcggcagcgcaaaagatg

SEQ ID NO: 59929 - DNA, 103 bp, Artificial Sequence
  Synthetic Polynucleotide
taatacgactcactatagggggttcgatataacaaaagtagatgttgaacaacagaggagagttcaaatgctacttttgaacctggcggcagcgcaaaagatg

SEQ ID NO: 59930 - DNA, 103 bp, Artificial Sequence
  Synthetic Polynucleotide
taatacgactcactatagggtcatcggttcgatataacaaaagtagatgtaacagaggagaacatctatgtttgttataaacctggcggcagcgcaaaagatg

SEQ ID NO: 59931 - DNA, 103 bp, Artificial Sequence
  Synthetic Polynucleotide
taatacgactcactatagggtcatatcatcggttcgatataacaaaagtaaacagaggagatactttatgtatatcgaaaacctggcggcagcgcaaaagatg

SEQ ID NO: 59932 - DNA, 103 bp, Artificial Sequence
  Synthetic Polynucleotide
taatacgactcactatagggtagaatcatatcatcggttcgatataacaaaacagaggagattgttaatgcgaaccgataacctggcggcagcgcaaaagatg

SEQ ID NO: 59933 - DNA, 103 bp, Artificial Sequence
  Synthetic Polynucleotide
taatacgactcactatagggtaggttagaatcatatcatcggttcgatataacagaggagaatatcgatgcgatgatataacctggcggcagcgcaaaagatg

SEQ ID NO: 59934 - DNA, 103 bp, Artificial Sequence
  Synthetic Polynucleotide
taatacgactcactatagggaattctaggttagaatcatatcatcggttcaacagaggagagaaccgatgatatgattcaacctggcggcagcgcaaaagatg

SEQ ID NO: 59935 - DNA, 103 bp, Artificial Sequence
  Synthetic Polynucleotide
taatacgactcactataggggatgtaattctaggttagaatcatatcatcaacagaggagagatgatatgattctaaccaacctggcggcagcgcaaaagatg

SEQ ID NO: 59936 - DNA, 103 bp, Artificial Sequence
  Synthetic Polynucleotide
taatacgactcactatagggtttcggatgtaattctaggttagaatcataaacagaggagatatgatatgaacctagaaaacctggcggcagcgcaaaagatg

SEQ ID NO: 59937 - DNA, 103 bp, Artificial Sequence
  Synthetic Polynucleotide
taatacgactcactatagggtttatttcgtatccgtgggtagatcttaaaaacagaggagatttaagatgtacccacggaacctggcggcagcgcaaaagatg

SEQ ID NO: 59938 - DNA, 103 bp, Artificial Sequence
  Synthetic Polynucleotide
taatacgactcactatagggaactttttcggatgtaattctaggttagaaaacagaggagattctaaatgagaattacaaacctggcggcagcgcaaaagatg

SEQ ID NO: 59939 - DNA, 103 bp, Artificial Sequence
  Synthetic Polynucleotide
taatacgactcactatagggtagtcaactttttcggatgtaattctaggtaacagaggagaacctagatgtacatccgaaacctggcggcagcgcaaaagatg

SEQ ID NO: 59940 - DNA, 103 bp, Artificial Sequence
  Synthetic Polynucleotide
taatacgactcactataggggaacatagtcaactttttcggatgtaattcaacagaggagagaattaatgccgaaaaagaacctggcggcagcgcaaaagatg

SEQ ID NO: 59941 - DNA, 103 bp, Artificial Sequence
  Synthetic Polynucleotide
taatacgactcactatagggacaatgaacatagtcaactttttcggatgtaacagaggagaacatccatgaaagttgacaacctggcggcagcgcaaaagatg

SEQ ID NO: 59942 - DNA, 103 bp, Artificial Sequence
  Synthetic Polynucleotide
taatacgactcactatagggtaatgacaatgaacatagtcaactttttcgaacagaggagacgaaaaatgtgactatgtaacctggcggcagcgcaaaagatg

SEQ ID NO: 59943 - DNA, 103 bp, Artificial Sequence
  Synthetic Polynucleotide
taatacgactcactatagggtgacttaatgacaatgaacatagtcaacttaacagaggagaaagttgatgatgttcattaacctggcggcagcgcaaaagatg

SEQ ID NO: 59944 - DNA, 103 bp, Artificial Sequence
  Synthetic Polynucleotide
taatacgactcactataggggttaatgacttaatgacaatgaacatagtcaacagaggagagactatatgcattgtcataacctggcggcagcgcaaaagatg

SEQ ID NO: 59945 - DNA, 103 bp, Artificial Sequence
  Synthetic Polynucleotide
taatacgactcactatagggtgttcgttaatgacttaatgacaatgaacaaacagaggagatgttcaatgtcattaagtaacctggcggcagcgcaaaagatg

SEQ ID NO: 59946 - DNA, 103 bp, Artificial Sequence
  Synthetic Polynucleotide
taatacgactcactatagggcatattgttcgttaatgacttaatgacaataacagaggagaattgtcatgaagtcattaaacctggcggcagcgcaaaagatg

SEQ ID NO: 59947 - DNA, 103 bp, Artificial Sequence
  Synthetic Polynucleotide
taatacgactcactatagggtctggcatattgttcgttaatgacttaatgaacagaggagacattaaatgattaacgaaaacctggcggcagcgcaaaagatg

SEQ ID NO: 59948 - DNA, 103 bp, Artificial Sequence
  Synthetic Polynucleotide
taatacgactcactatagggacatgtttatttcgtatccgtgggtagatcaacagaggagagatctaatgacggatacgaacctggcggcagcgcaaaagatg

SEQ ID NO: 59949 - DNA, 103 bp, Artificial Sequence
  Synthetic Polynucleotide
taatacgactcactatagggcagagtctggcatattgttcgttaatgactaacagaggagaagtcatatgcgaacaataaacctggcggcagcgcaaaagatg

SEQ ID NO: 59950 - DNA, 103 bp, Artificial Sequence
  Synthetic Polynucleotide
taatacgactcactatagggtaatccagagtctggcatattgttcgttaaaacagaggagattaacgatgaatatgccaaacctggcggcagcgcaaaagatg

SEQ ID NO: 59951 - DNA, 103 bp, Artificial Sequence
  Synthetic Polynucleotide
taatacgactcactatagggtcttataatccagagtctggcatattgttcaacagaggagagaacaaatggccagactcaacctggcggcagcgcaaaagatg

SEQ ID NO: 59952 - DNA, 103 bp, Artificial Sequence
  Synthetic Polynucleotide
taatacgactcactatagggtatcgtcttataatccagagtctggcatataacagaggagaatatgcatgactctggataacctggcggcagcgcaaaagatg

SEQ ID NO: 59953 - DNA, 103 bp, Artificial Sequence
  Synthetic Polynucleotide
taatacgactcactatagggaacagtatcgtcttataatccagagtctggaacagaggagaccagacatgggattataaaacctggcggcagcgcaaaagatg

SEQ ID NO: 59954 - DNA, 103 bp, Artificial Sequence
  Synthetic Polynucleotide
taatacgactcactataggggatgaaacagtatcgtcttataatccagagaacagaggagactctggatgataagacgaaacctggcggcagcgcaaaagatg

SEQ ID NO: 59955 - DNA, 103 bp, Artificial Sequence
  Synthetic Polynucleotide
taatacgactcactatagggattgtgatgaaacagtatcgtcttataatcaacagaggagagattatatgacgatactgaacctggcggcagcgcaaaagatg

SEQ ID NO: 59956 - DNA, 103 bp, Artificial Sequence
  Synthetic Polynucleotide
taatacgactcactatagggaggtgattgtgatgaaacagtatcgtcttaaacagaggagataagacatgactgtttcaaacctggcggcagcgcaaaagatg

SEQ ID NO: 59957 - DNA, 103 bp, Artificial Sequence
  Synthetic Polynucleotide
taatacgactcactatagggaaggtaggtgattgtgatgaaacagtatcgaacagaggagacgatacatgttcatcacaaacctggcggcagcgcaaaagatg

SEQ ID NO: 59958 - DNA, 103 bp, Artificial Sequence
  Synthetic Polynucleotide
taatacgactcactatagggtgattaaggtaggtgattgtgatgaaacagaacagaggagactgtttatgcacaatcacaacctggcggcagcgcaaaagatg

SEQ ID NO: 59959 - DNA, 103 bp, Artificial Sequence
  Synthetic Polynucleotide
taatacgactcactatagggaatagacatgtttatttcgtatccgtgggtaacagaggagaacccacatgtacgaaataaacctggcggcagcgcaaaagatg

SEQ ID NO: 59960 - DNA, 103 bp, Artificial Sequence
  Synthetic Polynucleotide
taatacgactcactatagggtcacatgattaaggtaggtgattgtgatgaaacagaggagatcatcaatgtcacctaccaacctggcggcagcgcaaaagatg

SEQ ID NO: 59961 - DNA, 103 bp, Artificial Sequence
  Synthetic Polynucleotide
taatacgactcactatagggcataatcacatgattaaggtaggtgattgtaacagaggagaacaatcatgtaccttaataacctggcggcagcgcaaaagatg

SEQ ID NO: 59962 - DNA, 103 bp, Artificial Sequence
  Synthetic Polynucleotide
taatacgactcactatagggatattcataatcacatgattaaggtaggtgaacagaggagacacctaatgtaatcatgtaacctggcggcagcgcaaaagatg

SEQ ID NO: 59963 - DNA, 103 bp, Artificial Sequence
  Synthetic Polynucleotide
taatacgactcactatagggagccaatattcataatcacatgattaaggtaacagaggagaaccttaatgatgtgattaaacctggcggcagcgcaaaagatg

SEQ ID NO: 59964 - DNA, 103 bp, Artificial Sequence
  Synthetic Polynucleotide
taatacgactcactatagggctaatagccaatattcataatcacatgattaacagaggagaaatcatatgattatgaataacctggcggcagcgcaaaagatg

SEQ ID NO: 59965 - DNA, 103 bp, Artificial Sequence
  Synthetic Polynucleotide
taatacgactcactataggggtgctctaatagccaatattcataatcacaaacagaggagatgtgatatggaatattggaacctggcggcagcgcaaaagatg

SEQ ID NO: 59966 - DNA, 103 bp, Artificial Sequence
  Synthetic Polynucleotide
taatacgactcactatagggagaaggtgctctaatagccaatattcataaaacagaggagattatgaatgttggctattaacctggcggcagcgcaaaagatg

SEQ ID NO: 59967 - DNA, 103 bp, Artificial Sequence
  Synthetic Polynucleotide
taatacgactcactatagggttcttagaaggtgctctaatagccaatattaacagaggagaaatattatgtattagagcaacctggcggcagcgcaaaagatg

SEQ ID NO: 59968 - DNA, 103 bp, Artificial Sequence
  Synthetic Polynucleotide
taatacgactcactatagggtagatttcttagaaggtgctctaatagccaaacagaggagatggctaatggagcaccttaacctggcggcagcgcaaaagatg

SEQ ID NO: 59969 - DNA, 103 bp, Artificial Sequence
  Synthetic Polynucleotide
taatacgactcactatagggtattatagatttcttagaaggtgctctaataacagaggagaattagaatgccttctaagaacctggcggcagcgcaaaagatg

SEQ ID NO: 59970 - DNA, 103 bp, Artificial Sequence
  Synthetic Polynucleotide
taatacgactcactatagggttaacaatagacatgtttatttcgtatccgaacagaggagacggataatgaataaacataacctggcggcagcgcaaaagatg

SEQ ID NO: 59971 - DNA, 103 bp, Artificial Sequence
  Synthetic Polynucleotide
taatacgactcactatagggaaagatattatagatttcttagaaggtgctaacagaggagaagcaccatgtaagaaatcaacctggcggcagcgcaaaagatg

SEQ ID NO: 59972 - DNA, 103 bp, Artificial Sequence
  Synthetic Polynucleotide
taatacgactcactataggggtttcaaagatattatagatttcttagaagaacagaggagacttctaatgaatctataaaacctggcggcagcgcaaaagatg

SEQ ID NO: 59973 - DNA, 103 bp, Artificial Sequence
  Synthetic Polynucleotide
taatacgactcactatagggatcgtgtttcaaagatattatagatttcttaacagaggagaaagaaaatgataatatctaacctggcggcagcgcaaaagatg

SEQ ID NO: 59974 - DNA, 103 bp, Artificial Sequence
  Synthetic Polynucleotide
taatacgactcactatagggtttaaatcgtgtttcaaagatattatagataacagaggagaatctatatgatctttgaaaacctggcggcagcgcaaaagatg

SEQ ID NO: 59975 - DNA, 103 bp, Artificial Sequence
  Synthetic Polynucleotide
taatacgactcactatagggttgattttaaatcgtgtttcaaagatattaaacagaggagataatatatgtgaaacacgaacctggcggcagcgcaaaagatg

SEQ ID NO: 59976 - DNA, 103 bp, Artificial Sequence
  Synthetic Polynucleotide
taatacgactcactataggggtggtttgattttaaatcgtgtttcaaagaaacagaggagatctttgatgcacgatttaaacctggcggcagcgcaaaagatg

SEQ ID NO: 59977 - DNA, 103 bp, Artificial Sequence
  Synthetic Polynucleotide
taatacgactcactatagggtattcgtggtttgattttaaatcgtgtttcaacagaggagagaaacaatgtttaaaatcaacctggcggcagcgcaaaagatg

SEQ ID NO: 59978 - DNA, 103 bp, Artificial Sequence
  Synthetic Polynucleotide
taatacgactcactatagggaagtatattcgtggtttgattttaaatcgtaacagaggagaacgattatgaatcaaaccaacctggcggcagcgcaaaagatg

SEQ ID NO: 59979 - DNA, 103 bp, Artificial Sequence
  Synthetic Polynucleotide
taatacgactcactatagggcgtagaagtatattcgtggtttgattttaaaacagaggagattaaaaatgaaccacgaaaacctggcggcagcgcaaaagatg

SEQ ID NO: 59980 - DNA, 103 bp, Artificial Sequence
  Synthetic Polynucleotide
taatacgactcactatagggttcttcgtagaagtatattcgtggtttgataacagaggagaatcaaaatgcgaatatacaacctggcggcagcgcaaaagatg

SEQ ID NO: 59981 - DNA, 103 bp, Artificial Sequence
  Synthetic Polynucleotide
taatacgactcactatagggcatgattaacaatagacatgtttatttcgtaacagaggagaacgaaaatgacatgtctaaacctggcggcagcgcaaaagatg

SEQ ID NO: 59982 - DNA, 103 bp, Artificial Sequence
  Synthetic Polynucleotide
taatacgactcactatagggtaactttcttcgtagaagtatattcgtggtaacagaggagaaccacgatgatacttctaaacctggcggcagcgcaaaagatg

SEQ ID NO: 59983 - DNA, 103 bp, Artificial Sequence
  Synthetic Polynucleotide
taatacgactcactatagggtaaactaactttcttcgtagaagtatattcaacagaggagagaatatatgtctacgaagaacctggcggcagcgcaaaagatg

SEQ ID NO: 59984 - DNA, 103 bp, Artificial Sequence
  Synthetic Polynucleotide
taatacgactcactatagggatgggtaaactaactttcttcgtagaagtaaacagaggagatacttcatggaagaaagtaacctggcggcagcgcaaaagatg

SEQ ID NO: 59985 - DNA, 103 bp, Artificial Sequence
  Synthetic Polynucleotide
taatacgactcactatagggctcctatgggtaaactaactttcttcgtagaacagaggagactacgaatgaagttagttaacctggcggcagcgcaaaagatg

SEQ ID NO: 59986 - DNA, 103 bp, Artificial Sequence
  Synthetic Polynucleotide
taatacgactcactatagggtatctctcctatgggtaaactaactttcttaacagaggagaaagaaaatgagtttacccaacctggcggcagcgcaaaagatg

SEQ ID NO: 59987 - DNA, 103 bp, Artificial Sequence
  Synthetic Polynucleotide
taatacgactcactatagggatagttatctctcctatgggtaaactaactaacagaggagaagttagatgacccataggaacctggcggcagcgcaaaagatg

SEQ ID NO: 59988 - DNA, 103 bp, Artificial Sequence
  Synthetic Polynucleotide
taatacgactcactatagggcatttatagttatctctcctatgggtaaacaacagaggagagtttacatgtaggagagaaacctggcggcagcgcaaaagatg

SEQ ID NO: 59989 - DNA, 103 bp, Artificial Sequence
  Synthetic Polynucleotide
taatacgactcactatagggatctccatttatagttatctctcctatgggaacagaggagacccataatggagataactaacctggcggcagcgcaaaagatg

SEQ ID NO: 59990 - DNA, 103 bp, Artificial Sequence
  Synthetic Polynucleotide
taatacgactcactatagggtctagatctccatttatagttatctctcctaacagaggagaaggagaatgaactataaaaacctggcggcagcgcaaaagatg

SEQ ID NO: 59991 - DNA, 103 bp, Artificial Sequence
  Synthetic Polynucleotide
taatacgactcactatagggttgtatctagatctccatttatagttatctaacagaggagaagataaatgtaaatggagaacctggcggcagcgcaaaagatg

SEQ ID NO: 59992 - DNA, 103 bp, Artificial Sequence
  Synthetic Polynucleotide
taatacgactcactatagggggtggcatgattaacaatagacatgtttataacagaggagaataaacatgtctattgttaacctggcggcagcgcaaaagatg

SEQ ID NO: 59993 - DNA, 103 bp, Artificial Sequence
  Synthetic Polynucleotide
taatacgactcactatagggggattttgtatctagatctccatttatagtaacagaggagaactataatgggagatctaaacctggcggcagcgcaaaagatg

SEQ ID NO: 59994 - DNA, 103 bp, Artificial Sequence
  Synthetic Polynucleotide
taatacgactcactatagggaatccggattttgtatctagatctccatttaacagaggagaaaatggatgtctagatacaacctggcggcagcgcaaaagatg

SEQ ID NO: 59995 - DNA, 103 bp, Artificial Sequence
  Synthetic Polynucleotide
taatacgactcactatagggtcatgaatccggattttgtatctagatctcaacagaggagagagatcatgatacaaaataacctggcggcagcgcaaaagatg

SEQ ID NO: 59996 - DNA, 103 bp, Artificial Sequence
  Synthetic Polynucleotide
taatacgactcactatagggaactatcatgaatccggattttgtatctagaacagaggagactagatatgaaatccggaaacctggcggcagcgcaaaagatg

SEQ ID NO: 59997 - DNA, 103 bp, Artificial Sequence
  Synthetic Polynucleotide
taatacgactcactataggggttaaaactatcatgaatccggattttgtaaacagaggagatacaaaatgcggattcataacctggcggcagcgcaaaagatg

SEQ ID NO: 59998 - DNA, 103 bp, Artificial Sequence
  Synthetic Polynucleotide
taatacgactcactatagggataatgttaaaactatcatgaatccggattaacagaggagaaatccgatgtcatgatagaacctggcggcagcgcaaaagatg

SEQ ID NO: 59999 - DNA, 103 bp, Artificial Sequence
  Synthetic Polynucleotide
taatacgactcactatagggatataataatgttaaaactatcatgaatccaacagaggagaggattcatgatagttttaaacctggcggcagcgcaaaagatg

SEQ ID NO: 60000 - DNA, 103 bp, Artificial Sequence
  Synthetic Polynucleotide
taatacgactcactatagggagagaatataataatgttaaaactatcatgaacagaggagacatgatatgtttaacattaacctggcggcagcgcaaaagatg

SEQ ID NO: 60001 - DNA, 103 bp, Artificial Sequence
  Synthetic Polynucleotide
taatacgactcactatagggttaatagagaatataataatgttaaaactaaacagaggagatagtttatgcattattataacctggcggcagcgcaaaagatg

SEQ ID NO: 60002 - DNA, 103 bp, Artificial Sequence
  Synthetic Polynucleotide
taatacgactcactatagggggtatttaatagagaatataataatgttaaaacagaggagattaacaatgttatattctaacctggcggcagcgcaaaagatg

SEQ ID NO: 60003 - DNA, 103 bp, Artificial Sequence
  Synthetic Polynucleotide
taatacgactcactatagggttattggtggcatgattaacaatagacatgaacagaggagacatgtcatgtgttaatcaaacctggcggcagcgcaaaagatg

SEQ ID NO: 60004 - DNA, 103 bp, Artificial Sequence
  Synthetic Polynucleotide
taatacgactcactataggggtggaggtatttaatagagaatataataataacagaggagaattattatgttctctattaacctggcggcagcgcaaaagatg

SEQ ID NO: 60005 - DNA, 103 bp, Artificial Sequence
  Synthetic Polynucleotide
taatacgactcactatagggtagatgtggaggtatttaatagagaatataaacagaggagatatattatgtattaaataaacctggcggcagcgcaaaagatg

SEQ ID NO: 60006 - DNA, 103 bp, Artificial Sequence
  Synthetic Polynucleotide
taatacgactcactatagggatttttagatgtggaggtatttaatagagaaacagaggagatctctaatgaatacctccaacctggcggcagcgcaaaagatg

SEQ ID NO: 60007 - DNA, 103 bp, Artificial Sequence
  Synthetic Polynucleotide
taatacgactcactatagggttaacatttttagatgtggaggtatttaataacagaggagaattaaaatgctccacatcaacctggcggcagcgcaaaagatg

SEQ ID NO: 60008 - DNA, 103 bp, Artificial Sequence
  Synthetic Polynucleotide
taatacgactcactatagggcaaaattaacatttttagatgtggaggtataacagaggagaatacctatgcatctaaaaaacctggcggcagcgcaaaagatg

SEQ ID NO: 60009 - DNA, 103 bp, Artificial Sequence
  Synthetic Polynucleotide
taatacgactcactatagggagtttcaaaattaacatttttagatgtggaaacagaggagatccacaatgaaaaatgttaacctggcggcagcgcaaaagatg

SEQ ID NO: 60010 - DNA, 103 bp, Artificial Sequence
  Synthetic Polynucleotide
taatacgactcactataggggacatagtttcaaaattaacatttttagataacagaggagaatctaaatgtgttaatttaacctggcggcagcgcaaaagatg

SEQ ID NO: 60011 - DNA, 103 bp, Artificial Sequence
  Synthetic Polynucleotide
taatacgactcactatagggacgaagacatagtttcaaaattaacattttaacagaggagaaaaatgatgattttgaaaaacctggcggcagcgcaaaagatg

SEQ ID NO: 60012 - DNA, 103 bp, Artificial Sequence
  Synthetic Polynucleotide
taatacgactcactatagggaataaacgaagacatagtttcaaaattaacaacagaggagagttaatatggaaactatgaacctggcggcagcgcaaaagatg

SEQ ID NO: 60013 - DNA, 103 bp, Artificial Sequence
  Synthetic Polynucleotide
taatacgactcactatagggacggtaataaacgaagacatagtttcaaaaaacagaggagattttgaatgtatgtcttcaacctggcggcagcgcaaaagatg

SEQ ID NO: 60014 - DNA, 103 bp, Artificial Sequence
  Synthetic Polynucleotide
taatacgactcactatagggtactataaaagacaaaaactacacaaatgcaacagaggagagcatttatgtagtttttgaacctggcggcagcgcaaaagatg

SEQ ID NO: 60015 - DNA, 103 bp, Artificial Sequence
  Synthetic Polynucleotide
taatacgactcactatagggatacattattggtggcatgattaacaatagaacagaggagactattgatgatcatgccaaacctggcggcagcgcaaaagatg

SEQ ID NO: 60016 - DNA, 103 bp, Artificial Sequence
  Synthetic Polynucleotide
taatacgactcactatagggcaggtacggtaataaacgaagacatagtttaacagaggagaaaactaatgcttcgtttaaacctggcggcagcgcaaaagatg

SEQ ID NO: 60017 - DNA, 103 bp, Artificial Sequence
  Synthetic Polynucleotide
taatacgactcactatagggtagttcaggtacggtaataaacgaagacataacagaggagaatgtctatgtttattaccaacctggcggcagcgcaaaagatg

SEQ ID NO: 60018 - DNA, 103 bp, Artificial Sequence
  Synthetic Polynucleotide
taatacgactcactataggggcgtttagttcaggtacggtaataaacgaaaacagaggagattcgttatgtaccgtaccaacctggcggcagcgcaaaagatg

SEQ ID NO: 60019 - DNA, 103 bp, Artificial Sequence
  Synthetic Polynucleotide
taatacgactcactatagggttatagcgtttagttcaggtacggtaataaaacagaggagattattaatgtacctgaacaacctggcggcagcgcaaaagatg

SEQ ID NO: 60020 - DNA, 103 bp, Artificial Sequence
  Synthetic Polynucleotide
taatacgactcactatagggagagcttatagcgtttagttcaggtacggtaacagaggagaaccgtaatggaactaaacaacctggcggcagcgcaaaagatg

SEQ ID NO: 60021 - DNA, 103 bp, Artificial Sequence
  Synthetic Polynucleotide
taatacgactcactatagggacaatagagcttatagcgtttagttcaggtaacagaggagaacctgaatgaaacgctataacctggcggcagcgcaaaagatg

SEQ ID NO: 60022 - DNA, 103 bp, Artificial Sequence
  Synthetic Polynucleotide
taatacgactcactatagggcacaaacaatagagcttatagcgtttagttaacagaggagaaactaaatgctataagctaacctggcggcagcgcaaaagatg

SEQ ID NO: 60023 - DNA, 103 bp, Artificial Sequence
  Synthetic Polynucleotide
taatacgactcactataggggagttcacaaacaatagagcttatagcgttaacagaggagaaacgctatgagctctattaacctggcggcagcgcaaaagatg

SEQ ID NO: 60024 - DNA, 103 bp, Artificial Sequence
  Synthetic Polynucleotide
taatacgactcactatagggttaaagagttcacaaacaatagagcttataaacagaggagatataagatgtattgtttgaacctggcggcagcgcaaaagatg

SEQ ID NO: 60025 - DNA, 103 bp, Artificial Sequence
  Synthetic Polynucleotide
taatacgactcactatagggatcgtttaaagagttcacaaacaatagagcaacagaggagagctctaatgtttgtgaacaacctggcggcagcgcaaaagatg

SEQ ID NO: 60026 - DNA, 103 bp, Artificial Sequence
  Synthetic Polynucleotide
taatacgactcactatagggtgtctatacattattggtggcatgattaacaacagaggagagttaatatggccaccaataacctggcggcagcgcaaaagatg

SEQ ID NO: 60027 - DNA, 103 bp, Artificial Sequence
  Synthetic Polynucleotide
taatacgactcactatagggagaatatcgtttaaagagttcacaaacaataacagaggagaattgttatggaactctttaacctggcggcagcgcaaaagatg

SEQ ID NO: 60028 - DNA, 103 bp, Artificial Sequence
  Synthetic Polynucleotide
taatacgactcactatagggtttcaagaatatcgtttaaagagttcacaaaacagaggagattgtgaatgctttaaacgaacctggcggcagcgcaaaagatg

SEQ ID NO: 60029 - DNA, 103 bp, Artificial Sequence
  Synthetic Polynucleotide
taatacgactcactatagggatgtatttcaagaatatcgtttaaagagttaacagaggagaaactctatgaacgatattaacctggcggcagcgcaaaagatg

SEQ ID NO: 60030 - DNA, 103 bp, Artificial Sequence
  Synthetic Polynucleotide
taatacgactcactataggggttacatgtatttcaagaatatcgtttaaaaacagaggagatttaaaatgtattcttgaaacctggcggcagcgcaaaagatg

SEQ ID NO: 60031 - DNA, 103 bp, Artificial Sequence
  Synthetic Polynucleotide
taatacgactcactatagggactttgttacatgtatttcaagaatatcgtaacagaggagaacgataatgttgaaatacaacctggcggcagcgcaaaagatg

SEQ ID NO: 60032 - DNA, 103 bp, Artificial Sequence
  Synthetic Polynucleotide
taatacgactcactatagggaggaaactttgttacatgtatttcaagaataacagaggagaattcttatgatacatgtaaacctggcggcagcgcaaaagatg

SEQ ID NO: 60033 - DNA, 103 bp, Artificial Sequence
  Synthetic Polynucleotide
taatacgactcactataggggttaaaggaaactttgttacatgtatttcaaacagaggagatgaaatatgtgtaacaaaaacctggcggcagcgcaaaagatg

SEQ ID NO: 60034 - DNA, 103 bp, Artificial Sequence
  Synthetic Polynucleotide
taatacgactcactatagggaccgagttaaaggaaactttgttacatgtaaacagaggagatacatgatgcaaagtttcaacctggcggcagcgcaaaagatg

SEQ ID NO: 60035 - DNA, 103 bp, Artificial Sequence
  Synthetic Polynucleotide
taatacgactcactatagggaaccgaccgagttaaaggaaactttgttacaacagaggagagtaacaatgtttcctttaaacctggcggcagcgcaaaagatg

SEQ ID NO: 60036 - DNA, 103 bp, Artificial Sequence
  Synthetic Polynucleotide
taatacgactcactatagggagataaaccgaccgagttaaaggaaactttaacagaggagaaaagttatgtttaactcgaacctggcggcagcgcaaaagatg

SEQ ID NO: 60037 - DNA, 103 bp, Artificial Sequence
  Synthetic Polynucleotide
taatacgactcactatagggataattgtctatacattattggtggcatgaaacagaggagatcatgcatgcaataatgtaacctggcggcagcgcaaaagatg

SEQ ID NO: 60038 - DNA, 103 bp, Artificial Sequence
  Synthetic Polynucleotide
taatacgactcactatagggatggtagataaaccgaccgagttaaaggaaaacagaggagattccttatgctcggtcggaacctggcggcagcgcaaaagatg

SEQ ID NO: 60039 - DNA, 103 bp, Artificial Sequence
  Synthetic Polynucleotide
taatacgactcactatagggtaactatggtagataaaccgaccgagttaaaacagaggagattaactatgtcggtttataacctggcggcagcgcaaaagatg

SEQ ID NO: 60040 - DNA, 103 bp, Artificial Sequence
  Synthetic Polynucleotide
taatacgactcactatagggttctgtaactatggtagataaaccgaccgaaacagaggagatcggtcatgttatctaccaacctggcggcagcgcaaaagatg

SEQ ID NO: 60041 - DNA, 103 bp, Artificial Sequence
  Synthetic Polynucleotide
taatacgactcactatagggacaaattctgtaactatggtagataaaccgaacagaggagacggtttatgtaccatagtaacctggcggcagcgcaaaagatg

SEQ ID NO: 60042 - DNA, 103 bp, Artificial Sequence
  Synthetic Polynucleotide
taatacgactcactatagggaggatacaaattctgtaactatggtagataaacagaggagatatctaatgtagttacagaacctggcggcagcgcaaaagatg

SEQ ID NO: 60043 - DNA, 103 bp, Artificial Sequence
  Synthetic Polynucleotide
taatacgactcactatagggagataaggatacaaattctgtaactatggtaacagaggagaaccataatgacagaatttaacctggcggcagcgcaaaagatg

SEQ ID NO: 60044 - DNA, 103 bp, Artificial Sequence
  Synthetic Polynucleotide
taatacgactcactatagggattatagataaggatacaaattctgtaactaacagaggagaagttacatgatttgtatcaacctggcggcagcgcaaaagatg

SEQ ID NO: 60045 - DNA, 103 bp, Artificial Sequence
  Synthetic Polynucleotide
taatacgactcactatagggattatattatagataaggatacaaattctgaacagaggagacagaatatgtatccttataacctggcggcagcgcaaaagatg

SEQ ID NO: 60046 - DNA, 103 bp, Artificial Sequence
  Synthetic Polynucleotide
taatacgactcactatagggtgattattatattatagataaggatacaaaaacagaggagatttgtaatgttatctataaacctggcggcagcgcaaaagatg

SEQ ID NO: 60047 - DNA, 103 bp, Artificial Sequence
  Synthetic Polynucleotide
taatacgactcactataggggattttgattattatattatagataaggataacagaggagaatccttatgtataatataaacctggcggcagcgcaaaagatg

SEQ ID NO: 60048 - DNA, 103 bp, Artificial Sequence
  Synthetic Polynucleotide
taatacgactcactatagggtttatataattgtctatacattattggtggaacagaggagaccaccaatgatgtatagaaacctggcggcagcgcaaaagatg

SEQ ID NO: 60049 - DNA, 103 bp, Artificial Sequence
  Synthetic Polynucleotide
taatacgactcactatagggtatacgattttgattattatattatagataaacagaggagatatctaatgtataataataacctggcggcagcgcaaaagatg

SEQ ID NO: 60050 - DNA, 103 bp, Artificial Sequence
  Synthetic Polynucleotide
taatacgactcactatagggaactttatacgattttgattattatattataacagaggagaataataatgtaatcaaaaaacctggcggcagcgcaaaagatg

SEQ ID NO: 60051 - DNA, 103 bp, Artificial Sequence
  Synthetic Polynucleotide
taatacgactcactatagggtatataactttatacgattttgattattataacagaggagaataataatgaaaatcgtaaacctggcggcagcgcaaaagatg

SEQ ID NO: 60052 - DNA, 103 bp, Artificial Sequence
  Synthetic Polynucleotide
taatacgactcactatagggataattatataactttatacgattttgattaacagaggagaaatcaaatgcgtataaagaacctggcggcagcgcaaaagatg

SEQ ID NO: 60053 - DNA, 103 bp, Artificial Sequence
  Synthetic Polynucleotide
taatacgactcactatagggacgcgataattatataactttatacgatttaacagaggagaaaatcgatgaaagttataaacctggcggcagcgcaaaagatg

SEQ ID NO: 60054 - DNA, 103 bp, Artificial Sequence
  Synthetic Polynucleotide
taatacgactcactatagggtctgaacgcgataattatataactttatacaacagaggagagtataaatgtatataattaacctggcggcagcgcaaaagatg

SEQ ID NO: 60055 - DNA, 103 bp, Artificial Sequence
  Synthetic Polynucleotide
taatacgactcactatagggcacaatctgaacgcgataattatataacttaacagaggagaaagttaatgaattatcgcaacctggcggcagcgcaaaagatg

SEQ ID NO: 60056 - DNA, 103 bp, Artificial Sequence
  Synthetic Polynucleotide
taatacgactcactatagggaagatcacaatctgaacgcgataattatataacagaggagaatataaatgtcgcgttcaaacctggcggcagcgcaaaagatg

SEQ ID NO: 60057 - DNA, 103 bp, Artificial Sequence
  Synthetic Polynucleotide
taatacgactcactatagggttgaaaagatcacaatctgaacgcgataataacagaggagaattatcatgttcagattgaacctggcggcagcgcaaaagatg

SEQ ID NO: 60058 - DNA, 103 bp, Artificial Sequence
  Synthetic Polynucleotide
taatacgactcactatagggtctatttgaaaagatcacaatctgaacgcgaacagaggagacgcgttatgattgtgatcaacctggcggcagcgcaaaagatg

SEQ ID NO: 60059 - DNA, 103 bp, Artificial Sequence
  Synthetic Polynucleotide
taatacgactcactatagggaatgttttatataattgtctatacattattaacagaggagaaataatatgtagacaattaacctggcggcagcgcaaaagatg

SEQ ID NO: 60060 - DNA, 103 bp, Artificial Sequence
  Synthetic Polynucleotide
taatacgactcactatagggtttagtctatttgaaaagatcacaatctgaaacagaggagatcagatatggatcttttcaacctggcggcagcgcaaaagatg

SEQ ID NO: 60061 - DNA, 103 bp, Artificial Sequence
  Synthetic Polynucleotide
taatacgactcactataggggggtttttagtctatttgaaaagatcacaaaacagaggagattgtgaatgtttcaaataaacctggcggcagcgcaaaagatg

SEQ ID NO: 60062 - DNA, 103 bp, Artificial Sequence
  Synthetic Polynucleotide
taatacgactcactatagggaaatggggtttttagtctatttgaaaagataacagaggagaatctttatgaatagactaaacctggcggcagcgcaaaagatg

SEQ ID NO: 60063 - DNA, 103 bp, Artificial Sequence
  Synthetic Polynucleotide
taatacgactcactatagggtagagaaatggggtttttagtctatttgaaaacagaggagattcaaaatgactaaaaacaacctggcggcagcgcaaaagatg

SEQ ID NO: 60064 - DNA, 103 bp, Artificial Sequence
  Synthetic Polynucleotide
taatacgactcactatagggcttactagagaaatggggtttttagtctataacagaggagaatagacatgaaaccccataacctggcggcagcgcaaaagatg

SEQ ID NO: 60065 - DNA, 103 bp, Artificial Sequence
  Synthetic Polynucleotide
taatacgactcactatagggagatacttactagagaaatggggtttttagaacagaggagactaaaaatgccatttctcaacctggcggcagcgcaaaagatg

SEQ ID NO: 60066 - DNA, 103 bp, Artificial Sequence
  Synthetic Polynucleotide
taatacgactcactatagggacataagatacttactagagaaatggggttaacagaggagaaaccccatgtctctagtaaacctggcggcagcgcaaaagatg

SEQ ID NO: 60067 - DNA, 103 bp, Artificial Sequence
  Synthetic Polynucleotide
taatacgactcactatagggcatatacataagatacttactagagaaatgaacagaggagacatttcatgagtaagtataacctggcggcagcgcaaaagatg

SEQ ID NO: 60068 - DNA, 103 bp, Artificial Sequence
  Synthetic Polynucleotide
taatacgactcactatagggacaaacatatacataagatacttactagagaacagaggagactctagatggtatcttataacctggcggcagcgcaaaagatg

SEQ ID NO: 60069 - DNA, 103 bp, Artificial Sequence
  Synthetic Polynucleotide
taatacgactcactatagggattttacaaacatatacataagatacttacaacagaggagagtaagtatgttatgtataaacctggcggcagcgcaaaagatg

SEQ ID NO: 60070 - DNA, 103 bp, Artificial Sequence
  Synthetic Polynucleotide
taatacgactcactatagggatgcaaatgttttatataattgtctatacaaacagaggagatgtataatgaattatataaacctggcggcagcgcaaaagatg

SEQ ID NO: 60071 - DNA, 103 bp, Artificial Sequence
  Synthetic Polynucleotide
taatacgactcactatagggaagatattttacaaacatatacataagataaacagaggagatatcttatgtatatgtttaacctggcggcagcgcaaaagatg

SEQ ID NO: 60072 - DNA, 103 bp, Artificial Sequence
  Synthetic Polynucleotide
taatacgactcactatagggccatgaagatattttacaaacatatacataaacagaggagatatgtaatggtttgtaaaaacctggcggcagcgcaaaagatg

SEQ ID NO: 60073 - DNA, 103 bp, Artificial Sequence
  Synthetic Polynucleotide
taatacgactcactatagggtcccaccatgaagatattttacaaacatataacagaggagaatatgtatgtaaaatatcaacctggcggcagcgcaaaagatg

SEQ ID NO: 60074 - DNA, 103 bp, Artificial Sequence
  Synthetic Polynucleotide
taatacgactcactatagggcatattcccaccatgaagatattttacaaaaacagaggagatttgtaatgtatcttcataacctggcggcagcgcaaaagatg

SEQ ID NO: 60075 - DNA, 103 bp, Artificial Sequence
  Synthetic Polynucleotide
taatacgactcactatagggtagagcatattcccaccatgaagatattttaacagaggagaaaaataatgtcatggtggaacctggcggcagcgcaaaagatg

SEQ ID NO: 60076 - DNA, 103 bp, Artificial Sequence
  Synthetic Polynucleotide
taatacgactcactatagggtgtggtagagcatattcccaccatgaagataacagaggagaatcttcatggtgggaataaacctggcggcagcgcaaaagatg

SEQ ID NO: 60077 - DNA, 103 bp, Artificial Sequence
  Synthetic Polynucleotide
taatacgactcactatagggctaactgtggtagagcatattcccaccatgaacagaggagacatggtatgaatatgctcaacctggcggcagcgcaaaagatg

SEQ ID NO: 60078 - DNA, 103 bp, Artificial Sequence
  Synthetic Polynucleotide
taatacgactcactatagggaatggctaactgtggtagagcatattcccaaacagaggagatgggaaatggctctaccaaacctggcggcagcgcaaaagatg

SEQ ID NO: 60079 - DNA, 103 bp, Artificial Sequence
  Synthetic Polynucleotide
taatacgactcactatagggtgaggaatggctaactgtggtagagcatataacagaggagaatatgcatgaccacagttaacctggcggcagcgcaaaagatg

SEQ ID NO: 60080 - DNA, 103 bp, Artificial Sequence
  Synthetic Polynucleotide
taatacgactcactatagggatcaatgaggaatggctaactgtggtagagaacagaggagactctacatgagttagccaaacctggcggcagcgcaaaagatg

SEQ ID NO: 60081 - DNA, 103 bp, Artificial Sequence
  Synthetic Polynucleotide
taatacgactcactatagggctataatgcaaatgttttatataattgtctaacagaggagaagacaaatgtataaaacaaacctggcggcagcgcaaaagatg

SEQ ID NO: 60082 - DNA, 103 bp, Artificial Sequence
  Synthetic Polynucleotide
taatacgactcactatagggccgctatcaatgaggaatggctaactgtggaacagaggagaccacagatggccattcctaacctggcggcagcgcaaaagatg

SEQ ID NO: 60083 - DNA, 103 bp, Artificial Sequence
  Synthetic Polynucleotide
taatacgactcactatagggatctaccgctatcaatgaggaatggctaacaacagaggagagttagcatgtcctcattgaacctggcggcagcgcaaaagatg

SEQ ID NO: 60084 - DNA, 103 bp, Artificial Sequence
  Synthetic Polynucleotide
taatacgactcactatagggaatacatctaccgctatcaatgaggaatggaacagaggagaccattcatgattgatagcaacctggcggcagcgcaaaagatg

SEQ ID NO: 60085 - DNA, 103 bp, Artificial Sequence
  Synthetic Polynucleotide
taatacgactcactatagggtgtctaatacatctaccgctatcaatgaggaacagaggagacctcatatgtagcggtagaacctggcggcagcgcaaaagatg

SEQ ID NO: 60086 - DNA, 103 bp, Artificial Sequence
  Synthetic Polynucleotide
taatacgactcactatagggagttttgtctaatacatctaccgctatcaaaacagaggagattgataatggtagatgtaaacctggcggcagcgcaaaagatg

SEQ ID NO: 60087 - DNA, 103 bp, Artificial Sequence
  Synthetic Polynucleotide
taatacgactcactatagggggaatagttttgtctaatacatctaccgctaacagaggagaagcggtatgtgtattagaaacctggcggcagcgcaaaagatg

SEQ ID NO: 60088 - DNA, 103 bp, Artificial Sequence
  Synthetic Polynucleotide
taatacgactcactatagggacattggaatagttttgtctaatacatctaaacagaggagatagatgatgtagacaaaaaacctggcggcagcgcaaaagatg

SEQ ID NO: 60089 - DNA, 103 bp, Artificial Sequence
  Synthetic Polynucleotide
taatacgactcactataggggttaaacattggaatagttttgtctaatacaacagaggagagtattaatgaaaactattaacctggcggcagcgcaaaagatg

SEQ ID NO: 60090 - DNA, 103 bp, Artificial Sequence
  Synthetic Polynucleotide
taatacgactcactatagggcccttgttaaacattggaatagttttgtctaacagaggagaagacaaatgtattccaataacctggcggcagcgcaaaagatg

SEQ ID NO: 60091 - DNA, 103 bp, Artificial Sequence
  Synthetic Polynucleotide
taatacgactcactatagggaatggcccttgttaaacattggaatagtttaacagaggagaaaactaatgcaatgtttaaacctggcggcagcgcaaaagatg

SEQ ID NO: 60092 - DNA, 103 bp, Artificial Sequence
  Synthetic Polynucleotide
taatacgactcactatagggcaattctataatgcaaatgttttatataataacagaggagaattataatgaacatttgcaacctggcggcagcgcaaaagatg

SEQ ID NO: 60093 - DNA, 103 bp, Artificial Sequence
  Synthetic Polynucleotide
taatacgactcactatagggtgtaaaatggcccttgttaaacattggaataacagaggagaattccaatgtttaacaagaacctggcggcagcgcaaaagatg

SEQ ID NO: 60094 - DNA, 103 bp, Artificial Sequence
  Synthetic Polynucleotide
taatacgactcactatagggaatcttgtaaaatggcccttgttaaacattaacagaggagaaatgttatgcaagggccaaacctggcggcagcgcaaaagatg

SEQ ID NO: 60095 - DNA, 103 bp, Artificial Sequence
  Synthetic Polynucleotide
taatacgactcactatagggttaataatcttgtaaaatggcccttgttaaaacagaggagattaacaatggccattttaaacctggcggcagcgcaaaagatg

SEQ ID NO: 60096 - DNA, 103 bp, Artificial Sequence
  Synthetic Polynucleotide
taatacgactcactatagggaggatttaataatcttgtaaaatggcccttaacagaggagaaagggcatgtttacaagaaacctggcggcagcgcaaaagatg

SEQ ID NO: 60097 - DNA, 103 bp, Artificial Sequence
  Synthetic Polynucleotide
taatacgactcactatagggaaacaaggatttaataatcttgtaaaatggaacagaggagaccatttatgaagattattaacctggcggcagcgcaaaagatg

SEQ ID NO: 60098 - DNA, 103 bp, Artificial Sequence
  Synthetic Polynucleotide
taatacgactcactatagggttatcaaacaaggatttaataatcttgtaaaacagaggagattacaaatgtattaaatcaacctggcggcagcgcaaaagatg

SEQ ID NO: 60099 - DNA, 103 bp, Artificial Sequence
  Synthetic Polynucleotide
taatacgactcactatagggtacatttatcaaacaaggatttaataatctaacagaggagaagattaatgaatccttgtaacctggcggcagcgcaaaagatg

SEQ ID NO: 60100 - DNA, 103 bp, Artificial Sequence
  Synthetic Polynucleotide
taatacgactcactatagggttagctacatttatcaaacaaggatttaataacagaggagaattaaaatgttgtttgataacctggcggcagcgcaaaagatg

SEQ ID NO: 60101 - DNA, 103 bp, Artificial Sequence
  Synthetic Polynucleotide
taatacgactcactatagggcctcattagctacatttatcaaacaaggataacagaggagaatccttatgtgataaatgaacctggcggcagcgcaaaagatg

SEQ ID NO: 60102 - DNA, 103 bp, Artificial Sequence
  Synthetic Polynucleotide
taatacgactcactatagggcgaaccctcattagctacatttatcaaacaaacagaggagatgtttgatgaatgtagctaacctggcggcagcgcaaaagatg

SEQ ID NO: 60103 - DNA, 103 bp, Artificial Sequence
  Synthetic Polynucleotide
taatacgactcactatagggatagacaattctataatgcaaatgttttataacagaggagaataaaaatgttgcattataacctggcggcagcgcaaaagatg

SEQ ID NO: 60104 - DNA, 103 bp, Artificial Sequence
  Synthetic Polynucleotide
taatacgactcactataggggaactcgaaccctcattagctacatttatcaacagaggagagataaaatgagctaatgaaacctggcggcagcgcaaaagatg

SEQ ID NO: 60105 - DNA, 103 bp, Artificial Sequence
  Synthetic Polynucleotide
taatacgactcactatagggtcgttgaactcgaaccctcattagctacataacagaggagaatgtagatgatgagggttaacctggcggcagcgcaaaagatg

SEQ ID NO: 60106 - DNA, 103 bp, Artificial Sequence
  Synthetic Polynucleotide
taatacgactcactatagggaatcgtcgttgaactcgaaccctcattagcaacagaggagagctaatatgggttcgagtaacctggcggcagcgcaaaagatg

SEQ ID NO: 60107 - DNA, 103 bp, Artificial Sequence
  Synthetic Polynucleotide
taatacgactcactatagggaattcaatcgtcgttgaactcgaaccctcaaacagaggagatgagggatggagttcaacaacctggcggcagcgcaaaagatg

SEQ ID NO: 60108 - DNA, 103 bp, Artificial Sequence
  Synthetic Polynucleotide
taatacgactcactatagggaagagaattcaatcgtcgttgaactcgaacaacagaggagagttcgaatgcaacgacgaaacctggcggcagcgcaaaagatg

SEQ ID NO: 60109 - DNA, 103 bp, Artificial Sequence
  Synthetic Polynucleotide
taatacgactcactataggggcgggaagagaattcaatcgtcgttgaactaacagaggagaagttcaatgacgattgaaaacctggcggcagcgcaaaagatg

SEQ ID NO: 60110 - DNA, 103 bp, Artificial Sequence
  Synthetic Polynucleotide
taatacgactcactatagggcatccgcgggaagagaattcaatcgtcgttaacagaggagaaacgacatgtgaattctcaacctggcggcagcgcaaaagatg

SEQ ID NO: 60111 - DNA, 103 bp, Artificial Sequence
  Synthetic Polynucleotide
taatacgactcactatagggtgcggcatccgcgggaagagaattcaatcgaacagaggagacgattgatgtctcttcccaacctggcggcagcgcaaaagatg

SEQ ID NO: 60112 - DNA, 103 bp, Artificial Sequence
  Synthetic Polynucleotide
taatacgactcactatagggcatcatgcggcatccgcgggaagagaattcaacagaggagagaattcatgtcccgcggaaacctggcggcagcgcaaaagatg

SEQ ID NO: 60113 - DNA, 103 bp, Artificial Sequence
  Synthetic Polynucleotide
taatacgactcactatagggtcgttcatcatgcggcatccgcgggaagagaacagaggagactcttcatgcggatgccgaacctggcggcagcgcaaaagatg

SEQ ID NO: 60114 - DNA, 103 bp, Artificial Sequence
  Synthetic Polynucleotide
taatacgactcactataggggatagatagacaattctataatgcaaatgtaacagaggagaacatttatgttatagaataacctggcggcagcgcaaaagatg

SEQ ID NO: 60115 - DNA, 103 bp, Artificial Sequence
  Synthetic Polynucleotide
taatacgactcactatagggtccagtcgttcatcatgcggcatccgcgggaacagaggagacccgcgatggccgcatgaaacctggcggcagcgcaaaagatg

SEQ ID NO: 60116 - DNA, 103 bp, Artificial Sequence
  Synthetic Polynucleotide
taatacgactcactatagggcaacatccagtcgttcatcatgcggcatccaacagaggagaggatgcatgatgatgaacaacctggcggcagcgcaaaagatg

SEQ ID NO: 60117 - DNA, 103 bp, Artificial Sequence
  Synthetic Polynucleotide
taatacgactcactatagggtcgaacaacatccagtcgttcatcatgcggaacagaggagaccgcatatggaacgactgaacctggcggcagcgcaaaagatg

SEQ ID NO: 60118 - DNA, 103 bp, Artificial Sequence
  Synthetic Polynucleotide
taatacgactcactatagggatcaatcgaacaacatccagtcgttcatcaaacagaggagatgatgaatgactggatgtaacctggcggcagcgcaaaagatg

SEQ ID NO: 60119 - DNA, 103 bp, Artificial Sequence
  Synthetic Polynucleotide
taatacgactcactatagggtccaaatcaatcgaacaacatccagtcgttaacagaggagaaacgacatgatgttgttcaacctggcggcagcgcaaaagatg

SEQ ID NO: 60120 - DNA, 103 bp, Artificial Sequence
  Synthetic Polynucleotide
taatacgactcactatagggagaattccaaatcaatcgaacaacatccagaacagaggagactggatatggttcgattgaacctggcggcagcgcaaaagatg

SEQ ID NO: 60121 - DNA, 103 bp, Artificial Sequence
  Synthetic Polynucleotide
taatacgactcactataggggaaaaagaattccaaatcaatcgaacaacaaacagaggagatgttgtatgattgatttgaacctggcggcagcgcaaaagatg

SEQ ID NO: 60122 - DNA, 103 bp, Artificial Sequence
  Synthetic Polynucleotide
taatacgactcactatagggaagtcgaaaaagaattccaaatcaatcgaaaacagaggagattcgatatgtttggaattaacctggcggcagcgcaaaagatg

SEQ ID NO: 60123 - DNA, 103 bp, Artificial Sequence
  Synthetic Polynucleotide
taatacgactcactatagggacaaaaagtcgaaaaagaattccaaatcaaaacagaggagattgattatgaattcttttaacctggcggcagcgcaaaagatg

SEQ ID NO: 60124 - DNA, 103 bp, Artificial Sequence
  Synthetic Polynucleotide
taatacgactcactatagggtataaacaaaaagtcgaaaaagaattccaaaacagaggagattggaaatgtttttcgacaacctggcggcagcgcaaaagatg

SEQ ID NO: 60125 - DNA, 103 bp, Artificial Sequence
  Synthetic Polynucleotide
taatacgactcactataggggtatatactataaaagacaaaaactacacaaacagaggagatgtgtaatgtttgtctttaacctggcggcagcgcaaaagatg

SEQ ID NO: 60126 - DNA, 103 bp, Artificial Sequence
  Synthetic Polynucleotide
taatacgactcactatagggatacagatagatagacaattctataatgcaaacagaggagatgcattatggaattgtctaacctggcggcagcgcaaaagatg

SEQ ID NO: 60127 - DNA, 103 bp, Artificial Sequence
  Synthetic Polynucleotide
taatacgactcactatagggtttaatataaacaaaaagtcgaaaaagaataacagaggagaattcttatgcgactttttaacctggcggcagcgcaaaagatg

SEQ ID NO: 60128 - DNA, 103 bp, Artificial Sequence
  Synthetic Polynucleotide
taatacgactcactatagggaaatatttaatataaacaaaaagtcgaaaaaacagaggagattttcgatgttttgtttaaacctggcggcagcgcaaaagatg

SEQ ID NO: 60129 - DNA, 103 bp, Artificial Sequence
  Synthetic Polynucleotide
taatacgactcactatagggttttaaaatatttaatataaacaaaaagtcaacagaggagagactttatgtttatattaaacctggcggcagcgcaaaagatg

SEQ ID NO: 60130 - DNA, 103 bp, Artificial Sequence
  Synthetic Polynucleotide
taatacgactcactatagggataaattttaaaatatttaatataaacaaaaacagaggagatttgttatgattaaatataacctggcggcagcgcaaaagatg

SEQ ID NO: 60131 - DNA, 103 bp, Artificial Sequence
  Synthetic Polynucleotide
taatacgactcactatagggcagctataaattttaaaatatttaatataaaacagaggagattatatatgatattttaaaacctggcggcagcgcaaaagatg

SEQ ID NO: 60132 - DNA, 103 bp, Artificial Sequence
  Synthetic Polynucleotide
taatacgactcactataggggctatcagctataaattttaaaatatttaaaacagaggagattaaatatgttaaaatttaacctggcggcagcgcaaaagatg

SEQ ID NO: 60133 - DNA, 103 bp, Artificial Sequence
  Synthetic Polynucleotide
taatacgactcactataggggaattgctatcagctataaattttaaaataaacagaggagatattttatgatttatagcaacctggcggcagcgcaaaagatg

SEQ ID NO: 60134 - DNA, 103 bp, Artificial Sequence
  Synthetic Polynucleotide
taatacgactcactatagggtacatgaattgctatcagctataaattttaaacagaggagataaaatatgtagctgataaacctggcggcagcgcaaaagatg

SEQ ID NO: 60135 - DNA, 103 bp, Artificial Sequence
  Synthetic Polynucleotide
taatacgactcactatagggcgtagtacatgaattgctatcagctataaaaacagaggagatttataatggatagcaataacctggcggcagcgcaaaagatg

SEQ ID NO: 60136 - DNA, 103 bp, Artificial Sequence
  Synthetic Polynucleotide
taatacgactcactatagggttatccgtagtacatgaattgctatcagctaacagaggagaagctgaatgcaattcatgaacctggcggcagcgcaaaagatg

SEQ ID NO: 60137 - DNA, 103 bp, Artificial Sequence
  Synthetic Polynucleotide
taatacgactcactatagggcggtaatacagatagatagacaattctataaacagaggagatatagaatggtctatctaaacctggcggcagcgcaaaagatg

SEQ ID NO: 60138 - DNA, 103 bp, Artificial Sequence
  Synthetic Polynucleotide
taatacgactcactatagggctacattatccgtagtacatgaattgctataacagaggagaatagcaatgcatgtactaaacctggcggcagcgcaaaagatg

SEQ ID NO: 60139 - DNA, 103 bp, Artificial Sequence
  Synthetic Polynucleotide
taatacgactcactatagggcgcgtctacattatccgtagtacatgaattaacagaggagaaattcaatgactacggataacctggcggcagcgcaaaagatg

SEQ ID NO: 60140 - DNA, 103 bp, Artificial Sequence
  Synthetic Polynucleotide
taatacgactcactatagggcaatacgcgtctacattatccgtagtacataacagaggagaatgtacatgggataatgtaacctggcggcagcgcaaaagatg

SEQ ID NO: 60141 - DNA, 103 bp, Artificial Sequence
  Synthetic Polynucleotide
taatacgactcactatagggatgcacaatacgcgtctacattatccgtagaacagaggagactacggatgatgtagacgaacctggcggcagcgcaaaagatg

SEQ ID NO: 60142 - DNA, 103 bp, Artificial Sequence
  Synthetic Polynucleotide
taatacgactcactatagggtatcgatgcacaatacgcgtctacattatcaacagaggagagataatatggacgcgtataacctggcggcagcgcaaaagatg

SEQ ID NO: 60143 - DNA, 103 bp, Artificial Sequence
  Synthetic Polynucleotide
taatacgactcactatagggaaagatatcgatgcacaatacgcgtctacaaacagaggagatgtagaatggtattgtgcaacctggcggcagcgcaaaagatg

SEQ ID NO: 60144 - DNA, 103 bp, Artificial Sequence
  Synthetic Polynucleotide
taatacgactcactatagggataataaagatatcgatgcacaatacgcgtaacagaggagaacgcgtatggtgcatcgaaacctggcggcagcgcaaaagatg

SEQ ID NO: 60145 - DNA, 103 bp, Artificial Sequence
  Synthetic Polynucleotide
taatacgactcactatagggatctaataataaagatatcgatgcacaataaacagaggagatattgtatgtcgatatctaacctggcggcagcgcaaaagatg

SEQ ID NO: 60146 - DNA, 103 bp, Artificial Sequence
  Synthetic Polynucleotide
taatacgactcactatagggaatttatctaataataaagatatcgatgcaaacagaggagatgcatcatgatctttattaacctggcggcagcgcaaaagatg

SEQ ID NO: 60147 - DNA, 103 bp, Artificial Sequence
  Synthetic Polynucleotide
taatacgactcactatagggtgataaatttatctaataataaagatatcgaacagaggagacgatatatgtattattagaacctggcggcagcgcaaaagatg

SEQ ID NO: 60148 - DNA, 103 bp, Artificial Sequence
  Synthetic Polynucleotide
taatacgactcactatagggatcgtcggtaatacagatagatagacaattaacagaggagaaattgtatgtctatctgtaacctggcggcagcgcaaaagatg

SEQ ID NO: 60149 - DNA, 103 bp, Artificial Sequence
  Synthetic Polynucleotide
taatacgactcactatagggtttattgataaatttatctaataataaagaaacagaggagatctttaatgttagataaaaacctggcggcagcgcaaaagatg

SEQ ID NO: 60150 - DNA, 103 bp, Artificial Sequence
  Synthetic Polynucleotide
taatacgactcactatagggtcacatttattgataaatttatctaataataacagaggagaattattatgtaaatttataacctggcggcagcgcaaaagatg

SEQ ID NO: 60151 - DNA, 103 bp, Artificial Sequence
  Synthetic Polynucleotide
taatacgactcactatagggacttctcacatttattgataaatttatctaaacagaggagatagataatgttatcaataaacctggcggcagcgcaaaagatg

SEQ ID NO: 60152 - DNA, 103 bp, Artificial Sequence
  Synthetic Polynucleotide
taatacgactcactatagggggcaaacttctcacatttattgataaatttaacagaggagaaaatttatgaataaatgtaacctggcggcagcgcaaaagatg

SEQ ID NO: 60153 - DNA, 103 bp, Artificial Sequence
  Synthetic Polynucleotide
taatacgactcactatagggaacgaggcaaacttctcacatttattgataaacagaggagatatcaaatgatgtgagaaaacctggcggcagcgcaaaagatg

SEQ ID NO: 60154 - DNA, 103 bp, Artificial Sequence
  Synthetic Polynucleotide
taatacgactcactatagggaccttaacgaggcaaacttctcacatttataacagaggagaataaatatgagaagtttgaacctggcggcagcgcaaaagatg

SEQ ID NO: 60155 - DNA, 103 bp, Artificial Sequence
  Synthetic Polynucleotide
taatacgactcactatagggggaagaccttaacgaggcaaacttctcacaaacagaggagatgtgagatgtttgcctcgaacctggcggcagcgcaaaagatg

SEQ ID NO: 60156 - DNA, 103 bp, Artificial Sequence
  Synthetic Polynucleotide
taatacgactcactatagggtaaatggaagaccttaacgaggcaaacttcaacagaggagagaagttatgctcgttaagaacctggcggcagcgcaaaagatg

SEQ ID NO: 60157 - DNA, 103 bp, Artificial Sequence
  Synthetic Polynucleotide
taatacgactcactatagggatatttaaatggaagaccttaacgaggcaaaacagaggagattgcctatgtaaggtcttaacctggcggcagcgcaaaagatg

SEQ ID NO: 60158 - DNA, 103 bp, Artificial Sequence
  Synthetic Polynucleotide
taatacgactcactatagggatataatatttaaatggaagaccttaacgaaacagaggagatcgttaatgtcttccattaacctggcggcagcgcaaaagatg

SEQ ID NO: 60159 - DNA, 103 bp, Artificial Sequence
  Synthetic Polynucleotide
taatacgactcactatagggggacaatcgtcggtaatacagatagatagaaacagaggagatctatcatgctgtattacaacctggcggcagcgcaaaagatg

SEQ ID NO: 60160 - DNA, 103 bp, Artificial Sequence
  Synthetic Polynucleotide
taatacgactcactatagggtgtttatataatatttaaatggaagaccttaacagaggagaaaggtcatgcatttaaataacctggcggcagcgcaaaagatg

SEQ ID NO: 60161 - DNA, 103 bp, Artificial Sequence
  Synthetic Polynucleotide
taatacgactcactatagggacaaatgtttatataatatttaaatggaagaacagaggagacttccaatgaaatattataacctggcggcagcgcaaaagatg

SEQ ID NO: 60162 - DNA, 103 bp, Artificial Sequence
  Synthetic Polynucleotide
taatacgactcactatagggcaaacacaaatgtttatataatatttaaataacagaggagaatttaaatgttatataaaaacctggcggcagcgcaaaagatg

SEQ ID NO: 60163 - DNA, 103 bp, Artificial Sequence
  Synthetic Polynucleotide
taatacgactcactatagggagatacaaacacaaatgtttatataatattaacagaggagaaatattatgtaaacatttaacctggcggcagcgcaaaagatg

SEQ ID NO: 60164 - DNA, 103 bp, Artificial Sequence
  Synthetic Polynucleotide
taatacgactcactataggggaataagatacaaacacaaatgtttatataaacagaggagatatataatgatttgtgttaacctggcggcagcgcaaaagatg

SEQ ID NO: 60165 - DNA, 103 bp, Artificial Sequence
  Synthetic Polynucleotide
taatacgactcactatagggaagacgaataagatacaaacacaaatgtttaacagaggagaaaacatatgtgtttgtataacctggcggcagcgcaaaagatg

SEQ ID NO: 60166 - DNA, 103 bp, Artificial Sequence
  Synthetic Polynucleotide
taatacgactcactatagggcataaaagacgaataagatacaaacacaaaaacagaggagatttgtgatggtatcttataacctggcggcagcgcaaaagatg

SEQ ID NO: 60167 - DNA, 103 bp, Artificial Sequence
  Synthetic Polynucleotide
taatacgactcactatagggtattccataaaagacgaataagatacaaacaacagaggagagtttgtatgttattcgtcaacctggcggcagcgcaaaagatg

SEQ ID NO: 60168 - DNA, 103 bp, Artificial Sequence
  Synthetic Polynucleotide
taatacgactcactatagggaaaactattccataaaagacgaataagataaacagaggagatatcttatgcgtcttttaaacctggcggcagcgcaaaagatg

SEQ ID NO: 60169 - DNA, 103 bp, Artificial Sequence
  Synthetic Polynucleotide
taatacgactcactatagggagttaaaaactattccataaaagacgaataaacagaggagatattcgatgtttatggaaaacctggcggcagcgcaaaagatg

SEQ ID NO: 60170 - DNA, 103 bp, Artificial Sequence
  Synthetic Polynucleotide
taatacgactcactatagggatattggacaatcgtcggtaatacagatagaacagaggagactatctatgttaccgacgaacctggcggcagcgcaaaagatg

SEQ ID NO: 60171 - DNA, 103 bp, Artificial Sequence
  Synthetic Polynucleotide
taatacgactcactatagggttactagttaaaaactattccataaaagacaacagaggagagtctttatgggaatagttaacctggcggcagcgcaaaagatg

SEQ ID NO: 60172 - DNA, 103 bp, Artificial Sequence
  Synthetic Polynucleotide
taatacgactcactatagggcagctttactagttaaaaactattccataaaacagaggagattatggatgagtttttaaaacctggcggcagcgcaaaagatg

SEQ ID NO: 60173 - DNA, 103 bp, Artificial Sequence
  Synthetic Polynucleotide
taatacgactcactatagggaattacagctttactagttaaaaactattcaacagaggagagaatagatgttaactagtaacctggcggcagcgcaaaagatg

SEQ ID NO: 60174 - DNA, 103 bp, Artificial Sequence
  Synthetic Polynucleotide
taatacgactcactatagggtatgtaattacagctttactagttaaaaacaacagaggagagtttttatgtagtaaagcaacctggcggcagcgcaaaagatg

SEQ ID NO: 60175 - DNA, 103 bp, Artificial Sequence
  Synthetic Polynucleotide
taatacgactcactatagggcaaagtatgtaattacagctttactagttaaacagaggagataactaatgaagctgtaaaacctggcggcagcgcaaaagatg

SEQ ID NO: 60176 - DNA, 103 bp, Artificial Sequence
  Synthetic Polynucleotide
taatacgactcactatagggacggacaaagtatgtaattacagctttactaacagaggagaagtaaaatggtaattacaaacctggcggcagcgcaaaagatg

SEQ ID NO: 60177 - DNA, 103 bp, Artificial Sequence
  Synthetic Polynucleotide
taatacgactcactataggggttttacggacaaagtatgtaattacagctaacagaggagaagctgtatgtacatacttaacctggcggcagcgcaaaagatg

SEQ ID NO: 60178 - DNA, 103 bp, Artificial Sequence
  Synthetic Polynucleotide
taatacgactcactatagggtttatgttttacggacaaagtatgtaattaaacagaggagataattaatgactttgtccaacctggcggcagcgcaaaagatg

SEQ ID NO: 60179 - DNA, 103 bp, Artificial Sequence
  Synthetic Polynucleotide
taatacgactcactatagggttatatttatgttttacggacaaagtatgtaacagaggagaacatacatggtccgtaaaaacctggcggcagcgcaaaagatg

SEQ ID NO: 60180 - DNA, 103 bp, Artificial Sequence
  Synthetic Polynucleotide
taatacgactcactatagggggtgtttatatttatgttttacggacaaagaacagaggagactttgtatgtaaaacataaacctggcggcagcgcaaaagatg

SEQ ID NO: 60181 - DNA, 103 bp, Artificial Sequence
  Synthetic Polynucleotide
taatacgactcactatagggacagaatattggacaatcgtcggtaatacaaacagaggagatgtattatggacgattgtaacctggcggcagcgcaaaagatg

SEQ ID NO: 60182 - DNA, 103 bp, Artificial Sequence
  Synthetic Polynucleotide
taatacgactcactatagggaagcgggtgtttatatttatgttttacggaaacagaggagatccgtaatgcataaatataacctggcggcagcgcaaaagatg

SEQ ID NO: 60183 - DNA, 103 bp, Artificial Sequence
  Synthetic Polynucleotide
taatacgactcactataggggataaaagcgggtgtttatatttatgttttaacagaggagaaaaacaatgatataaacaaacctggcggcagcgcaaaagatg

SEQ ID NO: 60184 - DNA, 103 bp, Artificial Sequence
  Synthetic Polynucleotide
taatacgactcactatagggcgtttgataaaagcgggtgtttatatttataacagaggagaataaatatgaacacccgcaacctggcggcagcgcaaaagatg

SEQ ID NO: 60185 - DNA, 103 bp, Artificial Sequence
  Synthetic Polynucleotide
taatacgactcactatagggtggaacgtttgataaaagcgggtgtttataaacagaggagatataaaatgccgcttttaaacctggcggcagcgcaaaagatg

SEQ ID NO: 60186 - DNA, 103 bp, Artificial Sequence
  Synthetic Polynucleotide
taatacgactcactatagggctttttggaacgtttgataaaagcgggtgtaacagaggagaacacccatgtttatcaaaaacctggcggcagcgcaaaagatg

SEQ ID NO: 60187 - DNA, 103 bp, Artificial Sequence
  Synthetic Polynucleotide
taatacgactcactatagggaacgactttttggaacgtttgataaaagcgaacagaggagacgctttatgcaaacgttcaacctggcggcagcgcaaaagatg

SEQ ID NO: 60188 - DNA, 103 bp, Artificial Sequence
  Synthetic Polynucleotide
taatacgactcactatagggctactaacgactttttggaacgtttgataaaacagaggagattatcaatggttccaaaaaacctggcggcagcgcaaaagatg

SEQ ID NO: 60189 - DNA, 103 bp, Artificial Sequence
  Synthetic Polynucleotide
taatacgactcactatagggaatgtctactaacgactttttggaacgtttaacagaggagaaaacgtatgaaaaagtcgaacctggcggcagcgcaaaagatg

SEQ ID NO: 60190 - DNA, 103 bp, Artificial Sequence
  Synthetic Polynucleotide
taatacgactcactatagggttaaaaatgtctactaacgactttttggaaaacagaggagattccaaatggtcgttagtaacctggcggcagcgcaaaagatg

SEQ ID NO: 60191 - DNA, 103 bp, Artificial Sequence
  Synthetic Polynucleotide
taatacgactcactatagggccatgttaaaaatgtctactaacgacttttaacagaggagaaaaagtatgtagtagacaaacctggcggcagcgcaaaagatg

SEQ ID NO: 60192 - DNA, 103 bp, Artificial Sequence
  Synthetic Polynucleotide
taatacgactcactatagggctagaacagaatattggacaatcgtcggtaaacagaggagataccgaatgttgtccaataacctggcggcagcgcaaaagatg

SEQ ID NO: 60193 - DNA, 103 bp, Artificial Sequence
  Synthetic Polynucleotide
taatacgactcactatagggagataccatgttaaaaatgtctactaacgaaacagaggagatcgttaatggacatttttaacctggcggcagcgcaaaagatg

SEQ ID NO: 60194 - DNA, 103 bp, Artificial Sequence
  Synthetic Polynucleotide
taatacgactcactatagggaaaatagataccatgttaaaaatgtctactaacagaggagaagtagaatgttttaacataacctggcggcagcgcaaaagatg

SEQ ID NO: 60195 - DNA, 103 bp, Artificial Sequence
  Synthetic Polynucleotide
taatacgactcactatagggtatttaaaatagataccatgttaaaaatgtaacagaggagaacatttatgacatggtataacctggcggcagcgcaaaagatg

SEQ ID NO: 60196 - DNA, 103 bp, Artificial Sequence
  Synthetic Polynucleotide
taatacgactcactatagggaagtgtatttaaaatagataccatgttaaaaacagaggagatttaacatggtatctattaacctggcggcagcgcaaaagatg

SEQ ID NO: 60197 - DNA, 103 bp, Artificial Sequence
  Synthetic Polynucleotide
taatacgactcactatagggaacctaagtgtatttaaaatagataccatgaacagaggagacatggtatgtattttaaaaacctggcggcagcgcaaaagatg

SEQ ID NO: 60198 - DNA, 103 bp, Artificial Sequence
  Synthetic Polynucleotide
taatacgactcactatagggctaaaaacctaagtgtatttaaaatagataaacagaggagatatctaatgtaaatacacaacctggcggcagcgcaaaagatg

SEQ ID NO: 60199 - DNA, 103 bp, Artificial Sequence
  Synthetic Polynucleotide
taatacgactcactatagggtttttctaaaaacctaagtgtatttaaaataacagaggagaattttaatgacacttaggaacctggcggcagcgcaaaagatg

SEQ ID NO: 60200 - DNA, 103 bp, Artificial Sequence
  Synthetic Polynucleotide
taatacgactcactataggggatgttttttctaaaaacctaagtgtatttaacagaggagaaaatacatgtaggtttttaacctggcggcagcgcaaaagatg

SEQ ID NO: 60201 - DNA, 103 bp, Artificial Sequence
  Synthetic Polynucleotide
taatacgactcactatagggaaaatgatgttttttctaaaaacctaagtgaacagaggagacacttaatgttttagaaaaacctggcggcagcgcaaaagatg

SEQ ID NO: 60202 - DNA, 103 bp, Artificial Sequence
  Synthetic Polynucleotide
taatacgactcactatagggattataaaatgatgttttttctaaaaacctaacagaggagaaggtttatggaaaaaacaaacctggcggcagcgcaaaagatg

SEQ ID NO: 60203 - DNA, 103 bp, Artificial Sequence
  Synthetic Polynucleotide
taatacgactcactatagggctctcctagaacagaatattggacaatcgtaacagaggagaacgattatgcaatattctaacctggcggcagcgcaaaagatg

SEQ ID NO: 60204 - DNA, 103 bp, Artificial Sequence
  Synthetic Polynucleotide
taatacgactcactatagggttacaattataaaatgatgttttttctaaaaacagaggagatttagaatgaacatcattaacctggcggcagcgcaaaagatg

SEQ ID NO: 60205 - DNA, 103 bp, Artificial Sequence
  Synthetic Polynucleotide
taatacgactcactatagggaatcgttacaattataaaatgatgttttttaacagaggagaaaaaaaatgcattttataaacctggcggcagcgcaaaagatg

SEQ ID NO: 60206 - DNA, 103 bp, Artificial Sequence
  Synthetic Polynucleotide
taatacgactcactatagggtattgaatcgttacaattataaaatgatgtaacagaggagaacatcaatgtataattgtaacctggcggcagcgcaaaagatg

SEQ ID NO: 60207 - DNA, 103 bp, Artificial Sequence
  Synthetic Polynucleotide
taatacgactcactatagggttagttattgaatcgttacaattataaaataacagaggagaattttaatgttgtaacgaaacctggcggcagcgcaaaagatg

SEQ ID NO: 60208 - DNA, 103 bp, Artificial Sequence
  Synthetic Polynucleotide
taatacgactcactatagggtttctttagttattgaatcgttacaattataacagaggagaataattatgacgattcaaaacctggcggcagcgcaaaagatg

SEQ ID NO: 60209 - DNA, 103 bp, Artificial Sequence
  Synthetic Polynucleotide
taatacgactcactatagggaatcttttctttagttattgaatcgttacaaacagaggagatgtaacatgtcaataactaacctggcggcagcgcaaaagatg

SEQ ID NO: 60210 - DNA, 103 bp, Artificial Sequence
  Synthetic Polynucleotide
taatacgactcactatagggatcttaatcttttctttagttattgaatcgaacagaggagacgattcatgaactaaagaaacctggcggcagcgcaaaagatg

SEQ ID NO: 60211 - DNA, 103 bp, Artificial Sequence
  Synthetic Polynucleotide
taatacgactcactataggggtttaatcttaatcttttctttagttattgaacagaggagacaataaatgaagaaaagaaacctggcggcagcgcaaaagatg

SEQ ID NO: 60212 - DNA, 103 bp, Artificial Sequence
  Synthetic Polynucleotide
taatacgactcactatagggcttatgtttaatcttaatcttttctttagtaacagaggagaactaaaatgaagattaagaacctggcggcagcgcaaaagatg

SEQ ID NO: 60213 - DNA, 103 bp, Artificial Sequence
  Synthetic Polynucleotide
taatacgactcactatagggattcccttatgtttaatcttaatcttttctaacagaggagaagaaaaatgtaagattaaaacctggcggcagcgcaaaagatg

SEQ ID NO: 60214 - DNA, 103 bp, Artificial Sequence
  Synthetic Polynucleotide
taatacgactcactatagggcattactctcctagaacagaatattggacaaacagaggagatgtccaatgttctgttctaacctggcggcagcgcaaaagatg

SEQ ID NO: 60215 - DNA, 103 bp, Artificial Sequence
  Synthetic Polynucleotide
taatacgactcactatagggatgacattcccttatgtttaatcttaatctaacagaggagaagattaatgttaaacataaacctggcggcagcgcaaaagatg

SEQ ID NO: 60216 - DNA, 103 bp, Artificial Sequence
  Synthetic Polynucleotide
taatacgactcactatagggtacaaatgacattcccttatgtttaatcttaacagaggagaaagattatgcataagggaaacctggcggcagcgcaaaagatg

SEQ ID NO: 60217 - DNA, 103 bp, Artificial Sequence
  Synthetic Polynucleotide
taatacgactcactatagggtaaaatacaaatgacattcccttatgtttaaacagaggagataaacaatggggaatgtcaacctggcggcagcgcaaaagatg

SEQ ID NO: 60218 - DNA, 103 bp, Artificial Sequence
  Synthetic Polynucleotide
taatacgactcactataggggcttataaaatacaaatgacattcccttataacagaggagaataaggatgtgtcatttgaacctggcggcagcgcaaaagatg

SEQ ID NO: 60219 - DNA, 103 bp, Artificial Sequence
  Synthetic Polynucleotide
taatacgactcactatagggctttggcttataaaatacaaatgacattccaacagaggagaggaatgatgtttgtatttaacctggcggcagcgcaaaagatg

SEQ ID NO: 60220 - DNA, 103 bp, Artificial Sequence
  Synthetic Polynucleotide
taatacgactcactataggggaatgctttggcttataaaatacaaatgacaacagaggagagtcattatgattttataaaacctggcggcagcgcaaaagatg

SEQ ID NO: 60221 - DNA, 103 bp, Artificial Sequence
  Synthetic Polynucleotide
taatacgactcactatagggcggtagaatgctttggcttataaaatacaaaacagaggagattgtatatgataagccaaaacctggcggcagcgcaaaagatg

SEQ ID NO: 60222 - DNA, 103 bp, Artificial Sequence
  Synthetic Polynucleotide
taatacgactcactatagggaacaacggtagaatgctttggcttataaaaaacagaggagattttatatgccaaagcataacctggcggcagcgcaaaagatg

SEQ ID NO: 60223 - DNA, 103 bp, Artificial Sequence
  Synthetic Polynucleotide
taatacgactcactatagggtatttaacaacggtagaatgctttggcttaaacagaggagataagccatggcattctacaacctggcggcagcgcaaaagatg

SEQ ID NO: 60224 - DNA, 103 bp, Artificial Sequence
  Synthetic Polynucleotide
taatacgactcactatagggataagtatttaacaacggtagaatgctttgaacagaggagacaaagcatgctaccgttgaacctggcggcagcgcaaaagatg

SEQ ID NO: 60225 - DNA, 103 bp, Artificial Sequence
  Synthetic Polynucleotide
taatacgactcactatagggtaacccattactctcctagaacagaatattaacagaggagaaatattatgttctaggagaacctggcggcagcgcaaaagatg

SEQ ID NO: 60226 - DNA, 103 bp, Artificial Sequence
  Synthetic Polynucleotide
taatacgactcactatagggtccagataagtatttaacaacggtagaatgaacagaggagacattctatggttgttaaaaacctggcggcagcgcaaaagatg

SEQ ID NO: 60227 - DNA, 103 bp, Artificial Sequence
  Synthetic Polynucleotide
taatacgactcactatagggcatcctccagataagtatttaacaacggtaaacagaggagataccgtatgtaaatacttaacctggcggcagcgcaaaagatg

SEQ ID NO: 60228 - DNA, 103 bp, Artificial Sequence
  Synthetic Polynucleotide
taatacgactcactatagggatatacatcctccagataagtatttaacaaaacagaggagattgttaatgacttatctgaacctggcggcagcgcaaaagatg

SEQ ID NO: 60229 - DNA, 103 bp, Artificial Sequence
  Synthetic Polynucleotide
taatacgactcactatagggatgatatatacatcctccagataagtatttaacagaggagaaaatacatgtctggaggaaacctggcggcagcgcaaaagatg

SEQ ID NO: 60230 - DNA, 103 bp, Artificial Sequence
  Synthetic Polynucleotide
taatacgactcactatagggtcatcatgatatatacatcctccagataagaacagaggagacttatcatgaggatgtataacctggcggcagcgcaaaagatg

SEQ ID NO: 60231 - DNA, 103 bp, Artificial Sequence
  Synthetic Polynucleotide
taatacgactcactatagggccaaatcatcatgatatatacatcctccagaacagaggagactggagatggtatatatcaacctggcggcagcgcaaaagatg

SEQ ID NO: 60232 - DNA, 103 bp, Artificial Sequence
  Synthetic Polynucleotide
taatacgactcactatagggtacaaccaaatcatcatgatatatacatccaacagaggagaggatgtatgtatcatgataacctggcggcagcgcaaaagatg

SEQ ID NO: 60233 - DNA, 103 bp, Artificial Sequence
  Synthetic Polynucleotide
taatacgactcactatagggcccaatacaaccaaatcatcatgatatataaacagaggagatatataatgtgatgatttaacctggcggcagcgcaaaagatg

SEQ ID NO: 60234 - DNA, 103 bp, Artificial Sequence
  Synthetic Polynucleotide
taatacgactcactatagggccttccccaatacaaccaaatcatcatgataacagaggagaatcatgatgatttggttgaacctggcggcagcgcaaaagatg

SEQ ID NO: 60235 - DNA, 103 bp, Artificial Sequence
  Synthetic Polynucleotide
taatacgactcactatagggtgttaccttccccaatacaaccaaatcatcaacagaggagagatgatatggttgtattgaacctggcggcagcgcaaaagatg

SEQ ID NO: 60236 - DNA, 103 bp, Artificial Sequence
  Synthetic Polynucleotide
taatacgactcactatagggataacgtatatactataaaagacaaaaactaacagaggagaagttttatgcttttatagaacctggcggcagcgcaaaagatg

SEQ ID NO: 60237 - DNA, 103 bp, Artificial Sequence
  Synthetic Polynucleotide
taatacgactcactatagggcacaataacccattactctcctagaacagaaacagaggagatctgttatgggagagtaaaacctggcggcagcgcaaaagatg

SEQ ID NO: 60238 - DNA, 103 bp, Artificial Sequence
  Synthetic Polynucleotide
taatacgactcactatagggttaattgttaccttccccaatacaaccaaaaacagaggagatttggtatgattggggaaaacctggcggcagcgcaaaagatg

SEQ ID NO: 60239 - DNA, 103 bp, Artificial Sequence
  Synthetic Polynucleotide
taatacgactcactataggggatcattaattgttaccttccccaatacaaaacagaggagattgtatatgggaaggtaaaacctggcggcagcgcaaaagatg

SEQ ID NO: 60240 - DNA, 103 bp, Artificial Sequence
  Synthetic Polynucleotide
taatacgactcactatagggctttagatcattaattgttaccttccccaaaacagaggagattggggatggtaacaattaacctggcggcagcgcaaaagatg

SEQ ID NO: 60241 - DNA, 103 bp, Artificial Sequence
  Synthetic Polynucleotide
taatacgactcactatagggatcatctttagatcattaattgttaccttcaacagaggagagaaggtatgaattaatgaaacctggcggcagcgcaaaagatg

SEQ ID NO: 60242 - DNA, 103 bp, Artificial Sequence
  Synthetic Polynucleotide
taatacgactcactatagggatagcatcatctttagatcattaattgttaaacagaggagataacaaatgatgatctaaaacctggcggcagcgcaaaagatg

SEQ ID NO: 60243 - DNA, 103 bp, Artificial Sequence
  Synthetic Polynucleotide
taatacgactcactataggggtaaaatagcatcatctttagatcattaataacagaggagaattaatatgctaaagatgaacctggcggcagcgcaaaagatg

SEQ ID NO: 60244 - DNA, 103 bp, Artificial Sequence
  Synthetic Polynucleotide
taatacgactcactatagggtccatgtaaaatagcatcatctttagatcaaacagaggagatgatctatggatgatgctaacctggcggcagcgcaaaagatg

SEQ ID NO: 60245 - DNA, 103 bp, Artificial Sequence
  Synthetic Polynucleotide
taatacgactcactatagggataaatccatgtaaaatagcatcatctttaaacagaggagataaagaatgtgctattttaacctggcggcagcgcaaaagatg

SEQ ID NO: 60246 - DNA, 103 bp, Artificial Sequence
  Synthetic Polynucleotide
taatacgactcactatagggatatgataaatccatgtaaaatagcatcataacagaggagaatgatgatgttttacatgaacctggcggcagcgcaaaagatg

SEQ ID NO: 60247 - DNA, 103 bp, Artificial Sequence
  Synthetic Polynucleotide
taatacgactcactatagggccatgatatgataaatccatgtaaaatagcaacagaggagagctattatgcatggatttaacctggcggcagcgcaaaagatg

SEQ ID NO: 60248 - DNA, 103 bp, Artificial Sequence
  Synthetic Polynucleotide
taatacgactcactatagggatatccacaataacccattactctcctagaaacagaggagatctaggatggtaatgggtaacctggcggcagcgcaaaagatg

SEQ ID NO: 60249 - DNA, 103 bp, Artificial Sequence
  Synthetic Polynucleotide
taatacgactcactatagggtcactccatgatatgataaatccatgtaaaaacagaggagatttacaatgatttatcataacctggcggcagcgcaaaagatg

SEQ ID NO: 60250 - DNA, 103 bp, Artificial Sequence
  Synthetic Polynucleotide
taatacgactcactatagggacttgtcactccatgatatgataaatccataacagaggagaatggatatgtcatatcataacctggcggcagcgcaaaagatg

SEQ ID NO: 60251 - DNA, 103 bp, Artificial Sequence
  Synthetic Polynucleotide
taatacgactcactatagggccactacttgtcactccatgatatgataaaaacagaggagatttatcatgtcatggagtaacctggcggcagcgcaaaagatg

SEQ ID NO: 60252 - DNA, 103 bp, Artificial Sequence
  Synthetic Polynucleotide
taatacgactcactatagggttactccactacttgtcactccatgatatgaacagaggagacatatcatggagtgacaaaacctggcggcagcgcaaaagatg

SEQ ID NO: 60253 - DNA, 103 bp, Artificial Sequence
  Synthetic Polynucleotide
taatacgactcactataggggtaaattactccactacttgtcactccatgaacagaggagacatggaatgacaagtagtaacctggcggcagcgcaaaagatg

SEQ ID NO: 60254 - DNA, 103 bp, Artificial Sequence
  Synthetic Polynucleotide
taatacgactcactatagggaatttgtaaattactccactacttgtcactaacagaggagaagtgacatgtagtggagtaacctggcggcagcgcaaaagatg

SEQ ID NO: 60255 - DNA, 103 bp, Artificial Sequence
  Synthetic Polynucleotide
taatacgactcactatagggatcccaatttgtaaattactccactacttgaacagaggagacaagtaatggagtaatttaacctggcggcagcgcaaaagatg

SEQ ID NO: 60256 - DNA, 103 bp, Artificial Sequence
  Synthetic Polynucleotide
taatacgactcactatagggggatgatcccaatttgtaaattactccactaacagaggagaagtggaatgatttacaaaaacctggcggcagcgcaaaagatg

SEQ ID NO: 60257 - DNA, 103 bp, Artificial Sequence
  Synthetic Polynucleotide
taatacgactcactatagggtctatggatgatcccaatttgtaaattactaacagaggagaagtaatatgcaaattgggaacctggcggcagcgcaaaagatg

SEQ ID NO: 60258 - DNA, 103 bp, Artificial Sequence
  Synthetic Polynucleotide
taatacgactcactataggggtctatctatggatgatcccaatttgtaaaaacagaggagatttacaatgtgggatcataacctggcggcagcgcaaaagatg

SEQ ID NO: 60259 - DNA, 103 bp, Artificial Sequence
  Synthetic Polynucleotide
taatacgactcactatagggattatatatccacaataacccattactctcaacagaggagagagagtatggggttattgaacctggcggcagcgcaaaagatg

SEQ ID NO: 60260 - DNA, 103 bp, Artificial Sequence
  Synthetic Polynucleotide
taatacgactcactatagggagaaagtctatctatggatgatcccaatttaacagaggagaaaattgatgtcatccataaacctggcggcagcgcaaaagatg

SEQ ID NO: 60261 - DNA, 103 bp, Artificial Sequence
  Synthetic Polynucleotide
taatacgactcactatagggtttagagaaagtctatctatggatgatcccaacagaggagagggatcatgcatagatagaacctggcggcagcgcaaaagatg

SEQ ID NO: 60262 - DNA, 103 bp, Artificial Sequence
  Synthetic Polynucleotide
taatacgactcactatagggtcctatttagagaaagtctatctatggatgaacagaggagacatccaatgatagactttaacctggcggcagcgcaaaagatg

SEQ ID NO: 60263 - DNA, 103 bp, Artificial Sequence
  Synthetic Polynucleotide
taatacgactcactatagggaatagtcctatttagagaaagtctatctataacagaggagaatagatatgctttctctaaacctggcggcagcgcaaaagatg

SEQ ID NO: 60264 - DNA, 103 bp, Artificial Sequence
  Synthetic Polynucleotide
taatacgactcactataggggtaacaatagtcctatttagagaaagtctaaacagaggagatagactatgtctaaatagaacctggcggcagcgcaaaagatg

SEQ ID NO: 60265 - DNA, 103 bp, Artificial Sequence
  Synthetic Polynucleotide
taatacgactcactatagggcttttgtaacaatagtcctatttagagaaaaacagaggagatttctcatgataggactaaacctggcggcagcgcaaaagatg

SEQ ID NO: 60266 - DNA, 103 bp, Artificial Sequence
  Synthetic Polynucleotide
taatacgactcactatagggattaacttttgtaacaatagtcctatttagaacagaggagactaaatatgactattgttaacctggcggcagcgcaaaagatg

SEQ ID NO: 60267 - DNA, 103 bp, Artificial Sequence
  Synthetic Polynucleotide
taatacgactcactatagggttgttattaacttttgtaacaatagtcctaaacagaggagataggacatgtgttacaaaaacctggcggcagcgcaaaagatg

SEQ ID NO: 60268 - DNA, 103 bp, Artificial Sequence
  Synthetic Polynucleotide
taatacgactcactatagggtataattgttattaacttttgtaacaatagaacagaggagactattgatgcaaaagttaaacctggcggcagcgcaaaagatg

SEQ ID NO: 60269 - DNA, 103 bp, Artificial Sequence
  Synthetic Polynucleotide
taatacgactcactatagggattgttataattgttattaacttttgtaacaacagaggagagttacaatggttaataacaacctggcggcagcgcaaaagatg

SEQ ID NO: 60270 - DNA, 103 bp, Artificial Sequence
  Synthetic Polynucleotide
taatacgactcactatagggctctgattatatatccacaataacccattaaacagaggagataatggatgattgtggataacctggcggcagcgcaaaagatg

SEQ ID NO: 60271 - DNA, 103 bp, Artificial Sequence
  Synthetic Polynucleotide
taatacgactcactatagggttataattgttataattgttattaacttttaacagaggagaaaaagtatgtaacaattaaacctggcggcagcgcaaaagatg

SEQ ID NO: 60272 - DNA, 103 bp, Artificial Sequence
  Synthetic Polynucleotide
taatacgactcactatagggaattgttataattgttataattgttattaaaacagaggagattaataatgattataacaaacctggcggcagcgcaaaagatg

SEQ ID NO: 60273 - DNA, 103 bp, Artificial Sequence
  Synthetic Polynucleotide
taatacgactcactataggggttataattgttataattgttataattgttaacagaggagaaacaatatgaacaattataacctggcggcagcgcaaaagatg

SEQ ID NO: 60274 - DNA, 103 bp, Artificial Sequence
  Synthetic Polynucleotide
taatacgactcactatagggtaattgttataattgttataattgttataaaacagaggagattataaatgttataacaaaacctggcggcagcgcaaaagatg

SEQ ID NO: 60275 - DNA, 103 bp, Artificial Sequence
  Synthetic Polynucleotide
taatacgactcactatagggtataataattgttataattgttataattgtaacagaggagaacaattatgacaattataaacctggcggcagcgcaaaagatg

SEQ ID NO: 60276 - DNA, 103 bp, Artificial Sequence
  Synthetic Polynucleotide
taatacgactcactatagggacaattataataattgttataattgttataaacagaggagatataacatgtataacaataacctggcggcagcgcaaaagatg

SEQ ID NO: 60277 - DNA, 103 bp, Artificial Sequence
  Synthetic Polynucleotide
taatacgactcactatagggttataacaattataataattgttataattgaacagaggagacaattaatgcaattattaaacctggcggcagcgcaaaagatg

SEQ ID NO: 60278 - DNA, 103 bp, Artificial Sequence
  Synthetic Polynucleotide
taatacgactcactatagggcataattataacaattataataattgttataacagaggagaataacaatgattataattaacctggcggcagcgcaaaagatg

SEQ ID NO: 60279 - DNA, 103 bp, Artificial Sequence
  Synthetic Polynucleotide
taatacgactcactatagggatcatcataattataacaattataataattaacagaggagaaattatatgaattgttataacctggcggcagcgcaaaagatg

SEQ ID NO: 60280 - DNA, 103 bp, Artificial Sequence
  Synthetic Polynucleotide
taatacgactcactatagggaatgtatcatcataattataacaattataaaacagaggagattataaatgttataattaaacctggcggcagcgcaaaagatg

SEQ ID NO: 60281 - DNA, 103 bp, Artificial Sequence
  Synthetic Polynucleotide
taatacgactcactatagggaaaaactctgattatatatccacaataaccaacagaggagaggttatatgggatatataaacctggcggcagcgcaaaagatg

SEQ ID NO: 60282 - DNA, 103 bp, Artificial Sequence
  Synthetic Polynucleotide
taatacgactcactatagggcaaaaaatgtatcatcataattataacaataacagaggagaattgttatgattatgatgaacctggcggcagcgcaaaagatg

SEQ ID NO: 60283 - DNA, 103 bp, Artificial Sequence
  Synthetic Polynucleotide
taatacgactcactatagggatcgtcaaaaaatgtatcatcataattataaacagaggagatataatatggatgatacaaacctggcggcagcgcaaaagatg

SEQ ID NO: 60284 - DNA, 103 bp, Artificial Sequence
  Synthetic Polynucleotide
taatacgactcactatagggtcatcatcgtcaaaaaatgtatcatcataaaacagaggagattatgaatgtacatttttaacctggcggcagcgcaaaagatg

SEQ ID NO: 60285 - DNA, 103 bp, Artificial Sequence
  Synthetic Polynucleotide
taatacgactcactatagggatcaatcatcatcgtcaaaaaatgtatcataacagaggagaatgataatgtttttgacgaacctggcggcagcgcaaaagatg

SEQ ID NO: 60286 - DNA, 103 bp, Artificial Sequence
  Synthetic Polynucleotide
taatacgactcactatagggtagcgatcaatcatcatcgtcaaaaaatgtaacagaggagaacatttatggacgatgataacctggcggcagcgcaaaagatg

SEQ ID NO: 60287 - DNA, 103 bp, Artificial Sequence
  Synthetic Polynucleotide
taatacgactcactatagggtgtaatagcgatcaatcatcatcgtcaaaaaacagaggagattttgaatgtgatgattgaacctggcggcagcgcaaaagatg

SEQ ID NO: 60288 - DNA, 103 bp, Artificial Sequence
  Synthetic Polynucleotide
taatacgactcactatagggaattgtgtaatagcgatcaatcatcatcgtaacagaggagaacgatgatgattgatcgcaacctggcggcagcgcaaaagatg

SEQ ID NO: 60289 - DNA, 103 bp, Artificial Sequence
  Synthetic Polynucleotide
taatacgactcactatagggaacaaaattgtgtaatagcgatcaatcatcaacagaggagagatgatatgtcgctattaaacctggcggcagcgcaaaagatg

SEQ ID NO: 60290 - DNA, 103 bp, Artificial Sequence
  Synthetic Polynucleotide
taatacgactcactatagggacaaaaacaaaattgtgtaatagcgatcaaaacagaggagattgatcatgattacacaaaacctggcggcagcgcaaaagatg

SEQ ID NO: 60291 - DNA, 103 bp, Artificial Sequence
  Synthetic Polynucleotide
taatacgactcactatagggaaagtacaaaaacaaaattgtgtaatagcgaacagaggagacgctatatgacaattttgaacctggcggcagcgcaaaagatg

SEQ ID NO: 60292 - DNA, 103 bp, Artificial Sequence
  Synthetic Polynucleotide
taatacgactcactatagggtcattaaaaactctgattatatatccacaaaacagaggagattgtggatgtataatcagaacctggcggcagcgcaaaagatg

SEQ ID NO: 60293 - DNA, 103 bp, Artificial Sequence
  Synthetic Polynucleotide
taatacgactcactatagggattagaaagtacaaaaacaaaattgtgtaaaacagaggagattacacatgtttgtttttaacctggcggcagcgcaaaagatg

SEQ ID NO: 60294 - DNA, 103 bp, Artificial Sequence
  Synthetic Polynucleotide
taatacgactcactatagggactatattagaaagtacaaaaacaaaattgaacagaggagacaatttatgttttgtactaacctggcggcagcgcaaaagatg

SEQ ID NO: 60295 - DNA, 103 bp, Artificial Sequence
  Synthetic Polynucleotide
taatacgactcactatagggtaaacactatattagaaagtacaaaaacaaaacagaggagattgtttatgtactttctaaacctggcggcagcgcaaaagatg

SEQ ID NO: 60296 - DNA, 103 bp, Artificial Sequence
  Synthetic Polynucleotide
taatacgactcactataggggaacctaaacactatattagaaagtacaaaaacagaggagatttgtaatgtctaatataaacctggcggcagcgcaaaagatg

SEQ ID NO: 60297 - DNA, 103 bp, Artificial Sequence
  Synthetic Polynucleotide
taatacgactcactatagggaaaaagaacctaaacactatattagaaagtaacagaggagaactttcatgtatagtgttaacctggcggcagcgcaaaagatg

SEQ ID NO: 60298 - DNA, 103 bp, Artificial Sequence
  Synthetic Polynucleotide
taatacgactcactatagggatatgaaaaagaacctaaacactatattagaacagaggagactaataatgtgtttaggtaacctggcggcagcgcaaaagatg

SEQ ID NO: 60299 - DNA, 103 bp, Artificial Sequence
  Synthetic Polynucleotide
taatacgactcactatagggttctcatatgaaaaagaacctaaacactataacagaggagaatagtgatgaggttctttaacctggcggcagcgcaaaagatg

SEQ ID NO: 60300 - DNA, 103 bp, Artificial Sequence
  Synthetic Polynucleotide
taatacgactcactatagggcaatattctcatatgaaaaagaacctaaacaacagaggagagtttagatgctttttcataacctggcggcagcgcaaaagatg

SEQ ID NO: 60301 - DNA, 103 bp, Artificial Sequence
  Synthetic Polynucleotide
taatacgactcactatagggtaaatcaatattctcatatgaaaaagaaccaacagaggagaggttctatgtcatatgagaacctggcggcagcgcaaaagatg

SEQ ID NO: 60302 - DNA, 103 bp, Artificial Sequence
  Synthetic Polynucleotide
taatacgactcactatagggtttagtaaatcaatattctcatatgaaaaaaacagaggagatttttcatgtgagaatataacctggcggcagcgcaaaagatg

SEQ ID NO: 60303 - DNA, 103 bp, Artificial Sequence
  Synthetic Polynucleotide
taatacgactcactatagggagtagtcattaaaaactctgattatatatcaacagaggagagatataatgtcagagtttaacctggcggcagcgcaaaagatg

SEQ ID NO: 60304 - DNA, 103 bp, Artificial Sequence
  Synthetic Polynucleotide
taatacgactcactataggggatattttagtaaatcaatattctcatatgaacagaggagacatatgatgatattgattaacctggcggcagcgcaaaagatg

SEQ ID NO: 60305 - DNA, 103 bp, Artificial Sequence
  Synthetic Polynucleotide
taatacgactcactatagggacatagatattttagtaaatcaatattctcaacagaggagagagaatatggatttactaaacctggcggcagcgcaaaagatg

SEQ ID NO: 60306 - DNA, 103 bp, Artificial Sequence
  Synthetic Polynucleotide
taatacgactcactataggggttaaacatagatattttagtaaatcaataaacagaggagatattgaatgactaaaataaacctggcggcagcgcaaaagatg

SEQ ID NO: 60307 - DNA, 103 bp, Artificial Sequence
  Synthetic Polynucleotide
taatacgactcactatagggcaaaagttaaacatagatattttagtaaataacagaggagaatttacatgaatatctataacctggcggcagcgcaaaagatg

SEQ ID NO: 60308 - DNA, 103 bp, Artificial Sequence
  Synthetic Polynucleotide
taatacgactcactatagggtagaacaaaagttaaacatagatattttagaacagaggagactaaaaatgctatgtttaaacctggcggcagcgcaaaagatg

SEQ ID NO: 60309 - DNA, 103 bp, Artificial Sequence
  Synthetic Polynucleotide
taatacgactcactatagggcgttatagaacaaaagttaaacatagatataacagaggagaatatctatgtttaactttaacctggcggcagcgcaaaagatg

SEQ ID NO: 60310 - DNA, 103 bp, Artificial Sequence
  Synthetic Polynucleotide
taatacgactcactatagggaaggacgttatagaacaaaagttaaacataaacagaggagatatgttatgcttttgttcaacctggcggcagcgcaaaagatg

SEQ ID NO: 60311 - DNA, 103 bp, Artificial Sequence
  Synthetic Polynucleotide
taatacgactcactatagggccgataaggacgttatagaacaaaagttaaaacagaggagattaactatggttctataaaacctggcggcagcgcaaaagatg

SEQ ID NO: 60312 - DNA, 103 bp, Artificial Sequence
  Synthetic Polynucleotide
taatacgactcactatagggtaccgccgataaggacgttatagaacaaaaaacagaggagattttgtatgataacgtccaacctggcggcagcgcaaaagatg

SEQ ID NO: 60313 - DNA, 103 bp, Artificial Sequence
  Synthetic Polynucleotide
taatacgactcactatagggaccgataccgccgataaggacgttatagaaaacagaggagattctatatggtccttatcaacctggcggcagcgcaaaagatg

SEQ ID NO: 60314 - DNA, 103 bp, Artificial Sequence
  Synthetic Polynucleotide
taatacgactcactatagggaatatagtagtcattaaaaactctgattataacagaggagaataatcatggtttttaataacctggcggcagcgcaaaagatg

SEQ ID NO: 60315 - DNA, 103 bp, Artificial Sequence
  Synthetic Polynucleotide
taatacgactcactatagggtatgtaccgataccgccgataaggacgttaaacagaggagataacgtatgtatcggcggaacctggcggcagcgcaaaagatg

SEQ ID NO: 60316 - DNA, 103 bp, Artificial Sequence
  Synthetic Polynucleotide
taatacgactcactatagggacgtatatgtaccgataccgccgataaggaaacagaggagatccttaatggcggtatcgaacctggcggcagcgcaaaagatg

SEQ ID NO: 60317 - DNA, 103 bp, Artificial Sequence
  Synthetic Polynucleotide
taatacgactcactataggggaattacgtatatgtaccgataccgccgataacagaggagaatcggcatgatcggtacaaacctggcggcagcgcaaaagatg

SEQ ID NO: 60318 - DNA, 103 bp, Artificial Sequence
  Synthetic Polynucleotide
taatacgactcactatagggaaggtgaattacgtatatgtaccgataccgaacagaggagacggtatatgtacatatacaacctggcggcagcgcaaaagatg

SEQ ID NO: 60319 - DNA, 103 bp, Artificial Sequence
  Synthetic Polynucleotide
taatacgactcactatagggttgtgaaggtgaattacgtatatgtaccgaaacagaggagatcggtaatgatacgtaataacctggcggcagcgcaaaagatg

SEQ ID NO: 60320 - DNA, 103 bp, Artificial Sequence
  Synthetic Polynucleotide
taatacgactcactataggggtattttgtgaaggtgaattacgtatatgtaacagaggagaacatatatgtaattcaccaacctggcggcagcgcaaaagatg

SEQ ID NO: 60321 - DNA, 103 bp, Artificial Sequence
  Synthetic Polynucleotide
taatacgactcactatagggactccgtattttgtgaaggtgaattacgtaaacagaggagatacgtaatgcaccttcacaacctggcggcagcgcaaaagatg

SEQ ID NO: 60322 - DNA, 103 bp, Artificial Sequence
  Synthetic Polynucleotide
taatacgactcactatagggcgaagactccgtattttgtgaaggtgaattaacagaggagaaattcaatgtcacaaaataacctggcggcagcgcaaaagatg

SEQ ID NO: 60323 - DNA, 103 bp, Artificial Sequence
  Synthetic Polynucleotide
taatacgactcactatagggattatcgaagactccgtattttgtgaaggtaacagaggagaaccttcatgaaatacggaaacctggcggcagcgcaaaagatg

SEQ ID NO: 60324 - DNA, 103 bp, Artificial Sequence
  Synthetic Polynucleotide
taatacgactcactatagggctattattatcgaagactccgtattttgtgaacagaggagacacaaaatgcggagtcttaacctggcggcagcgcaaaagatg

SEQ ID NO: 60325 - DNA, 103 bp, Artificial Sequence
  Synthetic Polynucleotide
taatacgactcactatagggaacataatatagtagtcattaaaaactctgaacagaggagacagagtatgtaatgactaaacctggcggcagcgcaaaagatg

SEQ ID NO: 60326 - DNA, 103 bp, Artificial Sequence
  Synthetic Polynucleotide
taatacgactcactatagggattggctattattatcgaagactccgtattaacagaggagaaatacgatgtcttcgataaacctggcggcagcgcaaaagatg

SEQ ID NO: 60327 - DNA, 103 bp, Artificial Sequence
  Synthetic Polynucleotide
taatacgactcactatagggaatcgattggctattattatcgaagactccaacagaggagaggagtcatggataataataacctggcggcagcgcaaaagatg

SEQ ID NO: 60328 - DNA, 103 bp, Artificial Sequence
  Synthetic Polynucleotide
taatacgactcactatagggccaataatcgattggctattattatcgaagaacagaggagacttcgaatgtaatagccaaacctggcggcagcgcaaaagatg

SEQ ID NO: 60329 - DNA, 103 bp, Artificial Sequence
  Synthetic Polynucleotide
taatacgactcactatagggtagatccaataatcgattggctattattataacagaggagaataataatggccaatcgaaacctggcggcagcgcaaaagatg

SEQ ID NO: 60330 - DNA, 103 bp, Artificial Sequence
  Synthetic Polynucleotide
taatacgactcactatagggacggttagatccaataatcgattggctattaacagaggagaaatagcatgtcgattattaacctggcggcagcgcaaaagatg

SEQ ID NO: 60331 - DNA, 103 bp, Artificial Sequence
  Synthetic Polynucleotide
taatacgactcactatagggtacagacggttagatccaataatcgattggaacagaggagaccaatcatgtattggatcaacctggcggcagcgcaaaagatg

SEQ ID NO: 60332 - DNA, 103 bp, Artificial Sequence
  Synthetic Polynucleotide
taatacgactcactatagggtatgatacagacggttagatccaataatcgaacagaggagacgattaatggatctaaccaacctggcggcagcgcaaaagatg

SEQ ID NO: 60333 - DNA, 103 bp, Artificial Sequence
  Synthetic Polynucleotide
taatacgactcactatagggttgaatatgatacagacggttagatccaataacagaggagaattggaatgaaccgtctgaacctggcggcagcgcaaaagatg

SEQ ID NO: 60334 - DNA, 103 bp, Artificial Sequence
  Synthetic Polynucleotide
taatacgactcactatagggacatgttgaatatgatacagacggttagataacagaggagaatctaaatgtctgtatcaaacctggcggcagcgcaaaagatg

SEQ ID NO: 60335 - DNA, 103 bp, Artificial Sequence
  Synthetic Polynucleotide
taatacgactcactatagggattaaacatgttgaatatgatacagacggtaacagaggagaaccgtcatgatcatattcaacctggcggcagcgcaaaagatg

SEQ ID NO: 60336 - DNA, 103 bp, Artificial Sequence
  Synthetic Polynucleotide
taatacgactcactatagggtataaaacataatatagtagtcattaaaaaaacagaggagatttttaatgactactataaacctggcggcagcgcaaaagatg

SEQ ID NO: 60337 - DNA, 103 bp, Artificial Sequence
  Synthetic Polynucleotide
taatacgactcactataggggatatattaaacatgttgaatatgatacagaacagaggagactgtatatgattcaacataacctggcggcagcgcaaaagatg

SEQ ID NO: 60338 - DNA, 103 bp, Artificial Sequence
  Synthetic Polynucleotide
taatacgactcactataggggaaaggatatattaaacatgttgaatatgaaacagaggagatcatatatgacatgtttaaacctggcggcagcgcaaaagatg

SEQ ID NO: 60339 - DNA, 103 bp, Artificial Sequence
  Synthetic Polynucleotide
taatacgactcactatagggtaaacgaaaggatatattaaacatgttgaaaacagaggagattcaacatgtttaatataaacctggcggcagcgcaaaagatg

SEQ ID NO: 60340 - DNA, 103 bp, Artificial Sequence
  Synthetic Polynucleotide
taatacgactcactatagggaagggtaaacgaaaggatatattaaacatgaacagaggagacatgttatgtatatccttaacctggcggcagcgcaaaagatg

SEQ ID NO: 60341 - DNA, 103 bp, Artificial Sequence
  Synthetic Polynucleotide
taatacgactcactatagggctgtaaagggtaaacgaaaggatatattaaaacagaggagattaataatgcctttcgttaacctggcggcagcgcaaaagatg

SEQ ID NO: 60342 - DNA, 103 bp, Artificial Sequence
  Synthetic Polynucleotide
taatacgactcactataggggatgcctgtaaagggtaaacgaaaggatataacagaggagaatatccatgcgtttacccaacctggcggcagcgcaaaagatg

SEQ ID NO: 60343 - DNA, 103 bp, Artificial Sequence
  Synthetic Polynucleotide
taatacgactcactatagggcgatcgatgcctgtaaagggtaaacgaaagaacagaggagactttcgatgaccctttacaacctggcggcagcgcaaaagatg

SEQ ID NO: 60344 - DNA, 103 bp, Artificial Sequence
  Synthetic Polynucleotide
taatacgactcactatagggtgctacgatcgatgcctgtaaagggtaaacaacagaggagagtttacatgttacaggcaaacctggcggcagcgcaaaagatg

SEQ ID NO: 60345 - DNA, 103 bp, Artificial Sequence
  Synthetic Polynucleotide
taatacgactcactatagggaaatatgctacgatcgatgcctgtaaagggaacagaggagaccctttatgggcatcgataacctggcggcagcgcaaaagatg

SEQ ID NO: 60346 - DNA, 103 bp, Artificial Sequence
  Synthetic Polynucleotide
taatacgactcactataggggcggaaaatatgctacgatcgatgcctgtaaacagaggagatacaggatgcgatcgtagaacctggcggcagcgcaaaagatg

SEQ ID NO: 60347 - DNA, 103 bp, Artificial Sequence
  Synthetic Polynucleotide
taatacgactcactatagggtgacaataacgtatatactataaaagacaaaacagaggagattgtctatgatagtatataacctggcggcagcgcaaaagatg

SEQ ID NO: 60348 - DNA, 103 bp, Artificial Sequence
  Synthetic Polynucleotide
taatacgactcactatagggaatggtataaaacataatatagtagtcattaacagaggagaaatgacatgtatattatgaacctggcggcagcgcaaaagatg

SEQ ID NO: 60349 - DNA, 103 bp, Artificial Sequence
  Synthetic Polynucleotide
taatacgactcactatagggcagacgcggaaaatatgctacgatcgatgcaacagaggagagcatcgatggtagcatataacctggcggcagcgcaaaagatg

SEQ ID NO: 60350 - DNA, 103 bp, Artificial Sequence
  Synthetic Polynucleotide
taatacgactcactatagggcatctcagacgcggaaaatatgctacgatcaacagaggagagatcgtatgatattttccaacctggcggcagcgcaaaagatg

SEQ ID NO: 60351 - DNA, 103 bp, Artificial Sequence
  Synthetic Polynucleotide
taatacgactcactatagggatttccatctcagacgcggaaaatatgctaaacagaggagatagcatatgttccgcgtcaacctggcggcagcgcaaaagatg

SEQ ID NO: 60352 - DNA, 103 bp, Artificial Sequence
  Synthetic Polynucleotide
taatacgactcactatagggttaacatttccatctcagacgcggaaaataaacagaggagatattttatgcgtctgagaaacctggcggcagcgcaaaagatg

SEQ ID NO: 60353 - DNA, 103 bp, Artificial Sequence
  Synthetic Polynucleotide
taatacgactcactatagggtagttttaacatttccatctcagacgcggaaacagaggagatccgcgatggagatggaaaacctggcggcagcgcaaaagatg

SEQ ID NO: 60354 - DNA, 103 bp, Artificial Sequence
  Synthetic Polynucleotide
taatacgactcactatagggttttgtagttttaacatttccatctcagacaacagaggagagtctgaatgggaaatgttaacctggcggcagcgcaaaagatg

SEQ ID NO: 60355 - DNA, 103 bp, Artificial Sequence
  Synthetic Polynucleotide
taatacgactcactatagggcgcatttttgtagttttaacatttccatctaacagaggagaagatggatgtgttaaaacaacctggcggcagcgcaaaagatg

SEQ ID NO: 60356 - DNA, 103 bp, Artificial Sequence
  Synthetic Polynucleotide
taatacgactcactatagggcattacgcatttttgtagttttaacatttcaacagaggagagaaatgatgaaactacaaaacctggcggcagcgcaaaagatg

SEQ ID NO: 60357 - DNA, 103 bp, Artificial Sequence
  Synthetic Polynucleotide
taatacgactcactataggggctaacattacgcatttttgtagttttaacaacagaggagagttaaaatgacaaaaatgaacctggcggcagcgcaaaagatg

SEQ ID NO: 60358 - DNA, 103 bp, Artificial Sequence
  Synthetic Polynucleotide
taatacgactcactataggggacgggctaacattacgcatttttgtagttaacagaggagaaactacatgaatgcgtaaaacctggcggcagcgcaaaagatg

SEQ ID NO: 60359 - DNA, 103 bp, Artificial Sequence
  Synthetic Polynucleotide
taatacgactcactatagggcacgaaatggtataaaacataatatagtagaacagaggagactactaatgtatgttttaaacctggcggcagcgcaaaagatg

SEQ ID NO: 60360 - DNA, 103 bp, Artificial Sequence
  Synthetic Polynucleotide
taatacgactcactatagggattaggacgggctaacattacgcatttttgaacagaggagacaaaaaatggtaatgttaaacctggcggcagcgcaaaagatg

SEQ ID NO: 60361 - DNA, 103 bp, Artificial Sequence
  Synthetic Polynucleotide
taatacgactcactatagggccaatattaggacgggctaacattacgcataacagaggagaatgcgtatggttagcccgaacctggcggcagcgcaaaagatg

SEQ ID NO: 60362 - DNA, 103 bp, Artificial Sequence
  Synthetic Polynucleotide
taatacgactcactatagggatgtaccaatattaggacgggctaacattaaacagaggagataatgtatgcccgtcctaaacctggcggcagcgcaaaagatg

SEQ ID NO: 60363 - DNA, 103 bp, Artificial Sequence
  Synthetic Polynucleotide
taatacgactcactatagggtaggcatgtaccaatattaggacgggctaaaacagaggagattagccatgcctaatattaacctggcggcagcgcaaaagatg

SEQ ID NO: 60364 - DNA, 103 bp, Artificial Sequence
  Synthetic Polynucleotide
taatacgactcactatagggacttataggcatgtaccaatattaggacggaacagaggagaccgtccatgtattggtacaacctggcggcagcgcaaaagatg

SEQ ID NO: 60365 - DNA, 103 bp, Artificial Sequence
  Synthetic Polynucleotide
taatacgactcactataggggccaaacttataggcatgtaccaatattagaacagaggagactaataatggtacatgccaacctggcggcagcgcaaaagatg

SEQ ID NO: 60366 - DNA, 103 bp, Artificial Sequence
  Synthetic Polynucleotide
taatacgactcactatagggactatgccaaacttataggcatgtaccaataacagaggagaattggtatgtgcctataaaacctggcggcagcgcaaaagatg

SEQ ID NO: 60367 - DNA, 103 bp, Artificial Sequence
  Synthetic Polynucleotide
taatacgactcactatagggattctactatgccaaacttataggcatgtaaacagaggagatacatgatgataagtttgaacctggcggcagcgcaaaagatg

SEQ ID NO: 60368 - DNA, 103 bp, Artificial Sequence
  Synthetic Polynucleotide
taatacgactcactatagggctattattctactatgccaaacttataggcaacagaggagagcctatatgtttggcataaacctggcggcagcgcaaaagatg

SEQ ID NO: 60369 - DNA, 103 bp, Artificial Sequence
  Synthetic Polynucleotide
taatacgactcactatagggcacgtctattattctactatgccaaacttaaacagaggagataagttatgcatagtagaaacctggcggcagcgcaaaagatg

SEQ ID NO: 60370 - DNA, 103 bp, Artificial Sequence
  Synthetic Polynucleotide
taatacgactcactatagggtgtgacacgaaatggtataaaacataatataacagaggagaatattaatgtttataccaaacctggcggcagcgcaaaagatg

SEQ ID NO: 60371 - DNA, 103 bp, Artificial Sequence
  Synthetic Polynucleotide
taatacgactcactatagggttgaacacgtctattattctactatgccaaaacagaggagattggcaatgtagaataataacctggcggcagcgcaaaagatg

SEQ ID NO: 60372 - DNA, 103 bp, Artificial Sequence
  Synthetic Polynucleotide
taatacgactcactatagggggcatttgaacacgtctattattctactataacagaggagaatagtaatgtaatagacgaacctggcggcagcgcaaaagatg

SEQ ID NO: 60373 - DNA, 103 bp, Artificial Sequence
  Synthetic Polynucleotide
taatacgactcactatagggtggaaggcatttgaacacgtctattattctaacagaggagaagaataatggacgtgttcaacctggcggcagcgcaaaagatg

SEQ ID NO: 60374 - DNA, 103 bp, Artificial Sequence
  Synthetic Polynucleotide
taatacgactcactatagggaactttggaaggcatttgaacacgtctattaacagaggagaaatagaatggttcaaatgaacctggcggcagcgcaaaagatg

SEQ ID NO: 60375 - DNA, 103 bp, Artificial Sequence
  Synthetic Polynucleotide
taatacgactcactatagggtcttaaactttggaaggcatttgaacacgtaacagaggagaacgtgtatgaatgccttcaacctggcggcagcgcaaaagatg

SEQ ID NO: 60376 - DNA, 103 bp, Artificial Sequence
  Synthetic Polynucleotide
taatacgactcactatagggagaattcttaaactttggaaggcatttgaaaacagaggagattcaaaatgcttccaaagaacctggcggcagcgcaaaagatg

SEQ ID NO: 60377 - DNA, 103 bp, Artificial Sequence
  Synthetic Polynucleotide
taatacgactcactatagggctaatagaattcttaaactttggaaggcataacagaggagaatgcctatgaaagtttaaaacctggcggcagcgcaaaagatg

SEQ ID NO: 60378 - DNA, 103 bp, Artificial Sequence
  Synthetic Polynucleotide
taatacgactcactatagggatactctaatagaattcttaaactttggaaaacagaggagattccaaatgttaagaattaacctggcggcagcgcaaaagatg

SEQ ID NO: 60379 - DNA, 103 bp, Artificial Sequence
  Synthetic Polynucleotide
taatacgactcactatagggatgcaatactctaatagaattcttaaacttaacagaggagaaagtttatgaattctattaacctggcggcagcgcaaaagatg

SEQ ID NO: 60380 - DNA, 103 bp, Artificial Sequence
  Synthetic Polynucleotide
taatacgactcactatagggtcaaaatgcaatactctaatagaattcttaaacagaggagataagaaatgtattagagtaacctggcggcagcgcaaaagatg

SEQ ID NO: 60381 - DNA, 103 bp, Artificial Sequence
  Synthetic Polynucleotide
taatacgactcactatagggaagcctgtgacacgaaatggtataaaacataacagaggagaatgtttatgaccatttcgaacctggcggcagcgcaaaagatg

SEQ ID NO: 60382 - DNA, 103 bp, Artificial Sequence
  Synthetic Polynucleotide
taatacgactcactatagggaactatcaaaatgcaatactctaatagaataacagaggagaattctaatggagtattgcaacctggcggcagcgcaaaagatg

SEQ ID NO: 60383 - DNA, 103 bp, Artificial Sequence
  Synthetic Polynucleotide
taatacgactcactatagggtgataaactatcaaaatgcaatactctaataacagaggagaattagaatgttgcattttaacctggcggcagcgcaaaagatg

SEQ ID NO: 60384 - DNA, 103 bp, Artificial Sequence
  Synthetic Polynucleotide
taatacgactcactataggggtaggtgataaactatcaaaatgcaatactaacagaggagaagtattatgttttgatagaacctggcggcagcgcaaaagatg

SEQ ID NO: 60385 - DNA, 103 bp, Artificial Sequence
  Synthetic Polynucleotide
taatacgactcactatagggatgatgtaggtgataaactatcaaaatgcaaacagaggagatgcattatgatagtttataacctggcggcagcgcaaaagatg

SEQ ID NO: 60386 - DNA, 103 bp, Artificial Sequence
  Synthetic Polynucleotide
taatacgactcactatagggttttgatgatgtaggtgataaactatcaaaaacagaggagatttgatatgttatcacctaacctggcggcagcgcaaaagatg

SEQ ID NO: 60387 - DNA, 103 bp, Artificial Sequence
  Synthetic Polynucleotide
taatacgactcactatagggcttatttttgatgatgtaggtgataaactaaacagaggagatagtttatgacctacatcaacctggcggcagcgcaaaagatg

SEQ ID NO: 60388 - DNA, 103 bp, Artificial Sequence
  Synthetic Polynucleotide
taatacgactcactatagggttttacttatttttgatgatgtaggtgataaacagaggagatatcacatgcatcatcaaaacctggcggcagcgcaaaagatg

SEQ ID NO: 60389 - DNA, 103 bp, Artificial Sequence
  Synthetic Polynucleotide
taatacgactcactatagggacactttttacttatttttgatgatgtaggaacagaggagacctacaatgtcaaaaataaacctggcggcagcgcaaaagatg

SEQ ID NO: 60390 - DNA, 103 bp, Artificial Sequence
  Synthetic Polynucleotide
taatacgactcactatagggtcagcacactttttacttatttttgatgataacagaggagaatcatcatgaataagtaaaacctggcggcagcgcaaaagatg

SEQ ID NO: 60391 - DNA, 103 bp, Artificial Sequence
  Synthetic Polynucleotide
taatacgactcactatagggaaaaatcagcacactttttacttatttttgaacagaggagacaaaaaatggtaaaaagtaacctggcggcagcgcaaaagatg

SEQ ID NO: 60392 - DNA, 103 bp, Artificial Sequence
  Synthetic Polynucleotide
taatacgactcactatagggctacaaagcctgtgacacgaaatggtataaaacagaggagattatacatgttcgtgtcaaacctggcggcagcgcaaaagatg

SEQ ID NO: 60393 - DNA, 103 bp, Artificial Sequence
  Synthetic Polynucleotide
taatacgactcactatagggtcataaaaaatcagcacactttttacttataacagaggagaataagtatgaagtgtgctaacctggcggcagcgcaaaagatg

SEQ ID NO: 60394 - DNA, 103 bp, Artificial Sequence
  Synthetic Polynucleotide
taatacgactcactatagggcaaaatcataaaaaatcagcacactttttaaacagaggagataaaaaatgtgctgatttaacctggcggcagcgcaaaagatg

SEQ ID NO: 60395 - DNA, 103 bp, Artificial Sequence
  Synthetic Polynucleotide
taatacgactcactatagggtcgcacaaaatcataaaaaatcagcacactaacagaggagaagtgtgatgattttttataacctggcggcagcgcaaaagatg

SEQ ID NO: 60396 - DNA, 103 bp, Artificial Sequence
  Synthetic Polynucleotide
taatacgactcactatagggtactgtcgcacaaaatcataaaaaatcagcaacagaggagagctgatatgttatgatttaacctggcggcagcgcaaaagatg

SEQ ID NO: 60397 - DNA, 103 bp, Artificial Sequence
  Synthetic Polynucleotide
taatacgactcactatagggtgtattactgtcgcacaaaatcataaaaaaaacagaggagattttttatgattttgtgcaacctggcggcagcgcaaaagatg

SEQ ID NO: 60398 - DNA, 103 bp, Artificial Sequence
  Synthetic Polynucleotide
taatacgactcactatagggaaaaatgtattactgtcgcacaaaatcataaacagaggagatatgatatggtgcgacagaacctggcggcagcgcaaaagatg

SEQ ID NO: 60399 - DNA, 103 bp, Artificial Sequence
  Synthetic Polynucleotide
taatacgactcactatagggcatagaaaaatgtattactgtcgcacaaaaaacagaggagattttgtatgacagtaataaacctggcggcagcgcaaaagatg

SEQ ID NO: 60400 - DNA, 103 bp, Artificial Sequence
  Synthetic Polynucleotide
taatacgactcactatagggagtaacatagaaaaatgtattactgtcgcaaacagaggagatgcgacatgaatacatttaacctggcggcagcgcaaaagatg

SEQ ID NO: 60401 - DNA, 103 bp, Artificial Sequence
  Synthetic Polynucleotide
taatacgactcactatagggctaaaagtaacatagaaaaatgtattactgaacagaggagacagtaaatgatttttctaaacctggcggcagcgcaaaagatg

SEQ ID NO: 60402 - DNA, 103 bp, Artificial Sequence
  Synthetic Polynucleotide
taatacgactcactatagggacgaactaaaagtaacatagaaaaatgtataacagaggagaatacatatgtctatgttaaacctggcggcagcgcaaaagatg

SEQ ID NO: 60403 - DNA, 103 bp, Artificial Sequence
  Synthetic Polynucleotide
taatacgactcactatagggcaaatctacaaagcctgtgacacgaaatggaacagaggagaccatttatggtcacaggcaacctggcggcagcgcaaaagatg

SEQ ID NO: 60404 - DNA, 103 bp, Artificial Sequence
  Synthetic Polynucleotide
taatacgactcactatagggctaatacgaactaaaagtaacatagaaaaaaacagaggagatttttcatggttacttttaacctggcggcagcgcaaaagatg

SEQ ID NO: 60405 - DNA, 103 bp, Artificial Sequence
  Synthetic Polynucleotide
taatacgactcactatagggataatctaatacgaactaaaagtaacatagaacagaggagactatgtatgttttagttcaacctggcggcagcgcaaaagatg

SEQ ID NO: 60406 - DNA, 103 bp, Artificial Sequence
  Synthetic Polynucleotide
taatacgactcactatagggagaatataatctaatacgaactaaaagtaaaacagaggagattacttatggttcgtattaacctggcggcagcgcaaaagatg

SEQ ID NO: 60407 - DNA, 103 bp, Artificial Sequence
  Synthetic Polynucleotide
taatacgactcactatagggtctctagaatataatctaatacgaactaaaaacagaggagatttagtatgtattagattaacctggcggcagcgcaaaagatg

SEQ ID NO: 60408 - DNA, 103 bp, Artificial Sequence
  Synthetic Polynucleotide
taatacgactcactatagggaggaatctctagaatataatctaatacgaaaacagaggagattcgtaatggattatattaacctggcggcagcgcaaaagatg

SEQ ID NO: 60409 - DNA, 103 bp, Artificial Sequence
  Synthetic Polynucleotide
taatacgactcactatagggtagtcaggaatctctagaatataatctaataacagaggagaattagaatgtattctagaaacctggcggcagcgcaaaagatg

SEQ ID NO: 60410 - DNA, 103 bp, Artificial Sequence
  Synthetic Polynucleotide
taatacgactcactataggggttagtagtcaggaatctctagaatataataacagaggagaattataatgtagagattcaacctggcggcagcgcaaaagatg

SEQ ID NO: 60411 - DNA, 103 bp, Artificial Sequence
  Synthetic Polynucleotide
taatacgactcactatagggatttcgttagtagtcaggaatctctagaataacagaggagaattctaatgattcctgacaacctggcggcagcgcaaaagatg

SEQ ID NO: 60412 - DNA, 103 bp, Artificial Sequence
  Synthetic Polynucleotide
taatacgactcactatagggtattaatttcgttagtagtcaggaatctctaacagaggagaagagatatgtgactactaaacctggcggcagcgcaaaagatg

SEQ ID NO: 60413 - DNA, 103 bp, Artificial Sequence
  Synthetic Polynucleotide
taatacgactcactatagggaatcatattaatttcgttagtagtcaggaaaacagaggagattcctgatgactaacgaaaacctggcggcagcgcaaaagatg

SEQ ID NO: 60414 - DNA, 103 bp, Artificial Sequence
  Synthetic Polynucleotide
taatacgactcactatagggatatccaaatctacaaagcctgtgacacgaaacagaggagatcgtgtatgaggctttgtaacctggcggcagcgcaaaagatg

SEQ ID NO: 60415 - DNA, 103 bp, Artificial Sequence
  Synthetic Polynucleotide
taatacgactcactatagggggccaaatcatattaatttcgttagtagtcaacagaggagagactacatgcgaaattaaaacctggcggcagcgcaaaagatg

SEQ ID NO: 60416 - DNA, 103 bp, Artificial Sequence
  Synthetic Polynucleotide
taatacgactcactatagggcatttggccaaatcatattaatttcgttagaacagaggagactaacgatgttaatatgaaacctggcggcagcgcaaaagatg

SEQ ID NO: 60417 - DNA, 103 bp, Artificial Sequence
  Synthetic Polynucleotide
taatacgactcactataggggggtacatttggccaaatcatattaatttcaacagaggagagaaattatgatgatttggaacctggcggcagcgcaaaagatg

SEQ ID NO: 60418 - DNA, 103 bp, Artificial Sequence
  Synthetic Polynucleotide
taatacgactcactatagggatgatgggtacatttggccaaatcatattaaacagaggagataatatatgttggccaaaaacctggcggcagcgcaaaagatg

SEQ ID NO: 60419 - DNA, 103 bp, Artificial Sequence
  Synthetic Polynucleotide
taatacgactcactatagggagattatgatgggtacatttggccaaatcaaacagaggagatgatttatgcaaatgtacaacctggcggcagcgcaaaagatg

SEQ ID NO: 60420 - DNA, 103 bp, Artificial Sequence
  Synthetic Polynucleotide
taatacgactcactatagggaacccagattatgatgggtacatttggccaaacagaggagatggccaatggtacccatcaacctggcggcagcgcaaaagatg

SEQ ID NO: 60421 - DNA, 103 bp, Artificial Sequence
  Synthetic Polynucleotide
taatacgactcactatagggtttataacccagattatgatgggtacatttaacagaggagaaaatgtatgcatcataataacctggcggcagcgcaaaagatg

SEQ ID NO: 60422 - DNA, 103 bp, Artificial Sequence
  Synthetic Polynucleotide
taatacgactcactatagggacccgtttataacccagattatgatgggtaaacagaggagatacccaatgtaatctgggaacctggcggcagcgcaaaagatg

SEQ ID NO: 60423 - DNA, 103 bp, Artificial Sequence
  Synthetic Polynucleotide
taatacgactcactatagggtttacacccgtttataacccagattatgataacagaggagaatcataatgtgggttataaacctggcggcagcgcaaaagatg

SEQ ID NO: 60424 - DNA, 103 bp, Artificial Sequence
  Synthetic Polynucleotide
taatacgactcactatagggtcttgtttacacccgtttataacccagattaacagaggagaaatctgatgtataaacggaacctggcggcagcgcaaaagatg

SEQ ID NO: 60425 - DNA, 103 bp, Artificial Sequence
  Synthetic Polynucleotide
taatacgactcactatagggatgctatatccaaatctacaaagcctgtgaaacagaggagatcacagatgttgtagattaacctggcggcagcgcaaaagatg

SEQ ID NO: 60426 - DNA, 103 bp, Artificial Sequence
  Synthetic Polynucleotide
taatacgactcactatagggtatattcttgtttacacccgtttataacccaacagaggagagggttaatgacgggtgtaaacctggcggcagcgcaaaagatg

SEQ ID NO: 60427 - DNA, 103 bp, Artificial Sequence
  Synthetic Polynucleotide
taatacgactcactatagggaaacatatattcttgtttacacccgtttataacagaggagaataaacatgtgtaaacaaaacctggcggcagcgcaaaagatg

SEQ ID NO: 60428 - DNA, 103 bp, Artificial Sequence
  Synthetic Polynucleotide
taatacgactcactatagggaatataaacatatattcttgtttacacccgaacagaggagacgggtgatgacaagaataaacctggcggcagcgcaaaagatg

SEQ ID NO: 60429 - DNA, 103 bp, Artificial Sequence
  Synthetic Polynucleotide
taatacgactcactatagggtaaaaaatataaacatatattcttgtttacaacagaggagagtaaacatgaatatatgtaacctggcggcagcgcaaaagatg

SEQ ID NO: 60430 - DNA, 103 bp, Artificial Sequence
  Synthetic Polynucleotide
taatacgactcactatagggctagttaaaaaatataaacatatattcttgaacagaggagacaagaaatgatgtttataaacctggcggcagcgcaaaagatg

SEQ ID NO: 60431 - DNA, 103 bp, Artificial Sequence
  Synthetic Polynucleotide
taatacgactcactatagggctacactagttaaaaaatataaacatatataacagaggagaatatatatgtatatttttaacctggcggcagcgcaaaagatg

SEQ ID NO: 60432 - DNA, 103 bp, Artificial Sequence
  Synthetic Polynucleotide
taatacgactcactataggggttttctacactagttaaaaaatataaacaaacagaggagatgtttaatgtttttaactaacctggcggcagcgcaaaagatg

SEQ ID NO: 60433 - DNA, 103 bp, Artificial Sequence
  Synthetic Polynucleotide
taatacgactcactatagggtctctgttttctacactagttaaaaaatataacagaggagaatatttatgaactagtgtaacctggcggcagcgcaaaagatg

SEQ ID NO: 60434 - DNA, 103 bp, Artificial Sequence
  Synthetic Polynucleotide
taatacgactcactatagggtactatctctgttttctacactagttaaaaaacagaggagattttaaatggtgtagaaaaacctggcggcagcgcaaaagatg

SEQ ID NO: 60435 - DNA, 103 bp, Artificial Sequence
  Synthetic Polynucleotide
taatacgactcactatagggctatttactatctctgttttctacactagtaacagaggagaactagtatggaaaacagaaacctggcggcagcgcaaaagatg

SEQ ID NO: 60436 - DNA, 103 bp, Artificial Sequence
  Synthetic Polynucleotide
taatacgactcactataggggtgcaatgctatatccaaatctacaaagccaacagaggagaggctttatggatttggataacctggcggcagcgcaaaagatg

SEQ ID NO: 60437 - DNA, 103 bp, Artificial Sequence
  Synthetic Polynucleotide
taatacgactcactatagggactatctatttactatctctgttttctacaaacagaggagatgtagaatgcagagatagaacctggcggcagcgcaaaagatg

SEQ ID NO: 60438 - DNA, 103 bp, Artificial Sequence
  Synthetic Polynucleotide
taatacgactcactataggggaaaaactatctatttactatctctgttttaacagaggagaaaaacaatgatagtaaataacctggcggcagcgcaaaagatg

SEQ ID NO: 60439 - DNA, 103 bp, Artificial Sequence
  Synthetic Polynucleotide
taatacgactcactatagggatctggaaaaactatctatttactatctctaacagaggagaagagatatgaaatagataaacctggcggcagcgcaaaagatg

SEQ ID NO: 60440 - DNA, 103 bp, Artificial Sequence
  Synthetic Polynucleotide
taatacgactcactatagggtctggatctggaaaaactatctatttactaaacagaggagatagtaaatggatagttttaacctggcggcagcgcaaaagatg

SEQ ID NO: 60441 - DNA, 103 bp, Artificial Sequence
  Synthetic Polynucleotide
taatacgactcactataggggaggatctggatctggaaaaactatctattaacagaggagaaatagaatgtttttccagaacctggcggcagcgcaaaagatg

SEQ ID NO: 60442 - DNA, 103 bp, Artificial Sequence
  Synthetic Polynucleotide
taatacgactcactatagggaacgggaggatctggatctggaaaaactataacagaggagaatagttatgccagatccaaacctggcggcagcgcaaaagatg

SEQ ID NO: 60443 - DNA, 103 bp, Artificial Sequence
  Synthetic Polynucleotide
taatacgactcactataggggttttaacgggaggatctggatctggaaaaaacagaggagattttccatgtccagatccaacctggcggcagcgcaaaagatg

SEQ ID NO: 60444 - DNA, 103 bp, Artificial Sequence
  Synthetic Polynucleotide
taatacgactcactataggggaatggttttaacgggaggatctggatctgaacagaggagacagatcatgatcctcccgaacctggcggcagcgcaaaagatg

SEQ ID NO: 60445 - DNA, 103 bp, Artificial Sequence
  Synthetic Polynucleotide
taatacgactcactataggggtttagaatggttttaacgggaggatctggaacagaggagaccagatatgcccgttaaaaacctggcggcagcgcaaaagatg

SEQ ID NO: 60446 - DNA, 103 bp, Artificial Sequence
  Synthetic Polynucleotide
taatacgactcactatagggatgccgtttagaatggttttaacgggaggaaacagaggagatcctccatgtaaaaccataacctggcggcagcgcaaaagatg

SEQ ID NO: 60447 - DNA, 103 bp, Artificial Sequence
  Synthetic Polynucleotide
taatacgactcactatagggactatgtgcaatgctatatccaaatctacaaacagaggagatgtagaatgggatatagcaacctggcggcagcgcaaaagatg

SEQ ID NO: 60448 - DNA, 103 bp, Artificial Sequence
  Synthetic Polynucleotide
taatacgactcactatagggtaaaaatgccgtttagaatggttttaacggaacagaggagaccgttaatgccattctaaaacctggcggcagcgcaaaagatg

SEQ ID NO: 60449 - DNA, 103 bp, Artificial Sequence
  Synthetic Polynucleotide
taatacgactcactatagggtttattaaaaatgccgtttagaatggttttaacagaggagaaaaaccatgctaaacggcaacctggcggcagcgcaaaagatg

SEQ ID NO: 60450 - DNA, 103 bp, Artificial Sequence
  Synthetic Polynucleotide
taatacgactcactataggggaaaatttattaaaaatgccgtttagaatgaacagaggagacattctatgcggcattttaacctggcggcagcgcaaaagatg

SEQ ID NO: 60451 - DNA, 103 bp, Artificial Sequence
  Synthetic Polynucleotide
taatacgactcactatagggtaagagaaaatttattaaaaatgccgtttaaacagaggagataaacgatgtttttaataaacctggcggcagcgcaaaagatg

SEQ ID NO: 60452 - DNA, 103 bp, Artificial Sequence
  Synthetic Polynucleotide
taatacgactcactatagggatttttaagagaaaatttattaaaaatgccaacagaggagaggcattatgaataaatttaacctggcggcagcgcaaaagatg

SEQ ID NO: 60453 - DNA, 103 bp, Artificial Sequence
  Synthetic Polynucleotide
taatacgactcactatagggaaacaatttttaagagaaaatttattaaaaaacagaggagattttaaatgattttctctaacctggcggcagcgcaaaagatg

SEQ ID NO: 60454 - DNA, 103 bp, Artificial Sequence
  Synthetic Polynucleotide
taatacgactcactatagggaagaaaaacaatttttaagagaaaatttataacagaggagaataaatatgctcttaaaaaacctggcggcagcgcaaaagatg

SEQ ID NO: 60455 - DNA, 103 bp, Artificial Sequence
  Synthetic Polynucleotide
taatacgactcactatagggtttccaagaaaaacaatttttaagagaaaaaacagaggagattttctatgaaaaattgtaacctggcggcagcgcaaaagatg

SEQ ID NO: 60456 - DNA, 103 bp, Artificial Sequence
  Synthetic Polynucleotide
taatacgactcactatagggaattgtttccaagaaaaacaatttttaagaaacagaggagatcttaaatgttgtttttcaacctggcggcagcgcaaaagatg

SEQ ID NO: 60457 - DNA, 103 bp, Artificial Sequence
  Synthetic Polynucleotide
taatacgactcactatagggttatgaattgtttccaagaaaaacaattttaacagaggagaaaaattatgtttcttggaaacctggcggcagcgcaaaagatg

SEQ ID NO: 60458 - DNA, 103 bp, Artificial Sequence
  Synthetic Polynucleotide
taatacgactcactataggggattttgacaataacgtatatactataaaaaacagaggagattttatatgatatacgttaacctggcggcagcgcaaaagatg

SEQ ID NO: 60459 - DNA, 103 bp, Artificial Sequence
  Synthetic Polynucleotide
taatacgactcactatagggctaatactatgtgcaatgctatatccaaataacagaggagaatttggatgtagcattgcaacctggcggcagcgcaaaagatg

SEQ ID NO: 60460 - DNA, 103 bp, Artificial Sequence
  Synthetic Polynucleotide
taatacgactcactatagggtataattatgaattgtttccaagaaaaacaaacagaggagatgttttatgtggaaacaaaacctggcggcagcgcaaaagatg

SEQ ID NO: 60461 - DNA, 103 bp, Artificial Sequence
  Synthetic Polynucleotide
taatacgactcactataggggtaaatataattatgaattgtttccaagaaaacagaggagattcttgatgacaattcataacctggcggcagcgcaaaagatg

SEQ ID NO: 60462 - DNA, 103 bp, Artificial Sequence
  Synthetic Polynucleotide
taatacgactcactatagggtaactgtaaatataattatgaattgtttccaacagaggagaggaaacatgtcataattaaacctggcggcagcgcaaaagatg

SEQ ID NO: 60463 - DNA, 103 bp, Artificial Sequence
  Synthetic Polynucleotide
taatacgactcactatagggtttagtaactgtaaatataattatgaattgaacagaggagacaattcatgattatatttaacctggcggcagcgcaaaagatg

SEQ ID NO: 60464 - DNA, 103 bp, Artificial Sequence
  Synthetic Polynucleotide
taatacgactcactatagggattaatttagtaactgtaaatataattatgaacagaggagacataatatgatttacagtaacctggcggcagcgcaaaagatg

SEQ ID NO: 60465 - DNA, 103 bp, Artificial Sequence
  Synthetic Polynucleotide
taatacgactcactatagggatcaaattaatttagtaactgtaaatataaaacagaggagattatatatgcagttactaaacctggcggcagcgcaaaagatg

SEQ ID NO: 60466 - DNA, 103 bp, Artificial Sequence
  Synthetic Polynucleotide
taatacgactcactatagggttattatcaaattaatttagtaactgtaaaaacagaggagatttacaatgactaaattaaacctggcggcagcgcaaaagatg

SEQ ID NO: 60467 - DNA, 103 bp, Artificial Sequence
  Synthetic Polynucleotide
taatacgactcactatagggttgatttattatcaaattaatttagtaactaacagaggagaagttacatgattaatttgaacctggcggcagcgcaaaagatg

SEQ ID NO: 60468 - DNA, 103 bp, Artificial Sequence
  Synthetic Polynucleotide
taatacgactcactatagggatattttgatttattatcaaattaatttagaacagaggagactaaatatgtttgataataacctggcggcagcgcaaaagatg

SEQ ID NO: 60469 - DNA, 103 bp, Artificial Sequence
  Synthetic Polynucleotide
taatacgactcactatagggtttccatattttgatttattatcaaattaaaacagaggagattaattatgtaataaatcaacctggcggcagcgcaaaagatg

SEQ ID NO: 60470 - DNA, 103 bp, Artificial Sequence
  Synthetic Polynucleotide
taatacgactcactatagggtatgactaatactatgtgcaatgctatatcaacagaggagagatataatgttgcacataaacctggcggcagcgcaaaagatg

SEQ ID NO: 60471 - DNA, 103 bp, Artificial Sequence
  Synthetic Polynucleotide
taatacgactcactatagggttagttttccatattttgatttattatcaaaacagaggagattgataatgaatcaaaataacctggcggcagcgcaaaagatg

SEQ ID NO: 60472 - DNA, 103 bp, Artificial Sequence
  Synthetic Polynucleotide
taatacgactcactatagggcgaccttagttttccatattttgatttattaacagaggagaaataaaatgaaatatggaaacctggcggcagcgcaaaagatg

SEQ ID NO: 60473 - DNA, 103 bp, Artificial Sequence
  Synthetic Polynucleotide
taatacgactcactatagggactaacgaccttagttttccatattttgataacagaggagaatcaaaatgtggaaaactaacctggcggcagcgcaaaagatg

SEQ ID NO: 60474 - DNA, 103 bp, Artificial Sequence
  Synthetic Polynucleotide
taatacgactcactatagggtccctactaacgaccttagttttccatattaacagaggagaaatatgatgaactaaggtaacctggcggcagcgcaaaagatg

SEQ ID NO: 60475 - DNA, 103 bp, Artificial Sequence
  Synthetic Polynucleotide
taatacgactcactatagggtctcctccctactaacgaccttagttttccaacagaggagaggaaaaatgaggtcgttaaacctggcggcagcgcaaaagatg

SEQ ID NO: 60476 - DNA, 103 bp, Artificial Sequence
  Synthetic Polynucleotide
taatacgactcactatagggtttgttctcctccctactaacgaccttagtaacagaggagaactaagatggttagtaggaacctggcggcagcgcaaaagatg

SEQ ID NO: 60477 - DNA, 103 bp, Artificial Sequence
  Synthetic Polynucleotide
taatacgactcactatagggccttctttgttctcctccctactaacgaccaacagaggagaggtcgtatgtagggaggaaacctggcggcagcgcaaaagatg

SEQ ID NO: 60478 - DNA, 103 bp, Artificial Sequence
  Synthetic Polynucleotide
taatacgactcactatagggatgtgccttctttgttctcctccctactaaaacagaggagattagtaatgaggagaacaaacctggcggcagcgcaaaagatg

SEQ ID NO: 60479 - DNA, 103 bp, Artificial Sequence
  Synthetic Polynucleotide
taatacgactcactatagggtcacgatgtgccttctttgttctcctccctaacagaggagaagggagatgaacaaagaaaacctggcggcagcgcaaaagatg

SEQ ID NO: 60480 - DNA, 103 bp, Artificial Sequence
  Synthetic Polynucleotide
taatacgactcactatagggttatatcacgatgtgccttctttgttctccaacagaggagaggagaaatgagaaggcacaacctggcggcagcgcaaaagatg

SEQ ID NO: 60481 - DNA, 103 bp, Artificial Sequence
  Synthetic Polynucleotide
taatacgactcactatagggaagtttatgactaatactatgtgcaatgctaacagaggagaagcattatgcatagtattaacctggcggcagcgcaaaagatg

SEQ ID NO: 60482 - DNA, 103 bp, Artificial Sequence
  Synthetic Polynucleotide
taatacgactcactatagggattatttatatcacgatgtgccttctttgtaacagaggagaacaaagatggcacatcgtaacctggcggcagcgcaaaagatg

SEQ ID NO: 60483 - DNA, 103 bp, Artificial Sequence
  Synthetic Polynucleotide
taatacgactcactatagggcaaatattatttatatcacgatgtgccttcaacagaggagagaaggcatgtcgtgatataacctggcggcagcgcaaaagatg

SEQ ID NO: 60484 - DNA, 103 bp, Artificial Sequence
  Synthetic Polynucleotide
taatacgactcactataggggataacaaatattatttatatcacgatgtgaacagaggagacacatcatgatataaataaacctggcggcagcgcaaaagatg

SEQ ID NO: 60485 - DNA, 103 bp, Artificial Sequence
  Synthetic Polynucleotide
taatacgactcactatagggatcatgataacaaatattatttatatcacgaacagaggagacgtgatatgaataatattaacctggcggcagcgcaaaagatg

SEQ ID NO: 60486 - DNA, 103 bp, Artificial Sequence
  Synthetic Polynucleotide
taatacgactcactataggggtgtcatcatgataacaaatattatttataaacagaggagatataaaatgtatttgttaaacctggcggcagcgcaaaagatg

SEQ ID NO: 60487 - DNA, 103 bp, Artificial Sequence
  Synthetic Polynucleotide
taatacgactcactatagggttctggtgtcatcatgataacaaatattataacagaggagaataataatggttatcatgaacctggcggcagcgcaaaagatg

SEQ ID NO: 60488 - DNA, 103 bp, Artificial Sequence
  Synthetic Polynucleotide
taatacgactcactatagggtcgttttctggtgtcatcatgataacaaataacagaggagaatttgtatgcatgatgacaacctggcggcagcgcaaaagatg

SEQ ID NO: 60489 - DNA, 103 bp, Artificial Sequence
  Synthetic Polynucleotide
taatacgactcactatagggcttcgtcgttttctggtgtcatcatgataaaacagaggagattatcaatgtgacaccagaacctggcggcagcgcaaaagatg

SEQ ID NO: 60490 - DNA, 103 bp, Artificial Sequence
  Synthetic Polynucleotide
taatacgactcactatagggttgctcttcgtcgttttctggtgtcatcataacagaggagaatgatgatgccagaaaacaacctggcggcagcgcaaaagatg

SEQ ID NO: 60491 - DNA, 103 bp, Artificial Sequence
  Synthetic Polynucleotide
taatacgactcactataggggatgtttgctcttcgtcgttttctggtgtcaacagaggagagacaccatgaaacgacgaaacctggcggcagcgcaaaagatg

SEQ ID NO: 60492 - DNA, 103 bp, Artificial Sequence
  Synthetic Polynucleotide
taatacgactcactatagggatcccaagtttatgactaatactatgtgcaaacagaggagatgcacaatgtattagtcaaacctggcggcagcgcaaaagatg

SEQ ID NO: 60493 - DNA, 103 bp, Artificial Sequence
  Synthetic Polynucleotide
taatacgactcactatagggacacagatgtttgctcttcgtcgttttctgaacagaggagacagaaaatgacgaagagcaacctggcggcagcgcaaaagatg

SEQ ID NO: 60494 - DNA, 103 bp, Artificial Sequence
  Synthetic Polynucleotide
taatacgactcactatagggggagaacacagatgtttgctcttcgtcgttaacagaggagaaacgacatggagcaaacaaacctggcggcagcgcaaaagatg

SEQ ID NO: 60495 - DNA, 103 bp, Artificial Sequence
  Synthetic Polynucleotide
taatacgactcactataggggtggcggagaacacagatgtttgctcttcgaacagaggagacgaagaatgaacatctgtaacctggcggcagcgcaaaagatg

SEQ ID NO: 60496 - DNA, 103 bp, Artificial Sequence
  Synthetic Polynucleotide
taatacgactcactatagggaaacagtggcggagaacacagatgtttgctaacagaggagaagcaaaatgctgtgttctaacctggcggcagcgcaaaagatg

SEQ ID NO: 60497 - DNA, 103 bp, Artificial Sequence
  Synthetic Polynucleotide
taatacgactcactatagggtccgtaaacagtggcggagaacacagatgtaacagaggagaacatctatgttctccgccaacctggcggcagcgcaaaagatg

SEQ ID NO: 60498 - DNA, 103 bp, Artificial Sequence
  Synthetic Polynucleotide
taatacgactcactatagggttgtctccgtaaacagtggcggagaacacaaacagaggagatgtgttatgcgccactgtaacctggcggcagcgcaaaagatg

SEQ ID NO: 60499 - DNA, 103 bp, Artificial Sequence
  Synthetic Polynucleotide
taatacgactcactataggggaattttgtctccgtaaacagtggcggagaaacagaggagatctccgatgctgtttacgaacctggcggcagcgcaaaagatg

SEQ ID NO: 60500 - DNA, 103 bp, Artificial Sequence
  Synthetic Polynucleotide
taatacgactcactatagggtccctgaattttgtctccgtaaacagtggcaacagaggagagccactatgtacggagacaacctggcggcagcgcaaaagatg

SEQ ID NO: 60501 - DNA, 103 bp, Artificial Sequence
  Synthetic Polynucleotide
taatacgactcactatagggttttttccctgaattttgtctccgtaaacaaacagaggagatgtttaatgagacaaaataacctggcggcagcgcaaaagatg

SEQ ID NO: 60502 - DNA, 103 bp, Artificial Sequence
  Synthetic Polynucleotide
taatacgactcactataggggtttattttttccctgaattttgtctccgtaacagaggagaacggagatgaaattcaggaacctggcggcagcgcaaaagatg

SEQ ID NO: 60503 - DNA, 103 bp, Artificial Sequence
  Synthetic Polynucleotide
taatacgactcactatagggtttacatcccaagtttatgactaatactataacagaggagaatagtaatggtcataaacaacctggcggcagcgcaaaagatg

SEQ ID NO: 60504 - DNA, 103 bp, Artificial Sequence
  Synthetic Polynucleotide
taatacgactcactatagggtttgcgtttattttttccctgaattttgtcaacagaggagagacaaaatgcagggaaaaaacctggcggcagcgcaaaagatg

SEQ ID NO: 60505 - DNA, 103 bp, Artificial Sequence
  Synthetic Polynucleotide
taatacgactcactatagggacgcgtttgcgtttattttttccctgaattaacagaggagaaattcaatgaaaaaataaaacctggcggcagcgcaaaagatg

SEQ ID NO: 60506 - DNA, 103 bp, Artificial Sequence
  Synthetic Polynucleotide
taatacgactcactatagggcaattacgcgtttgcgtttattttttccctaacagaggagaagggaaatgataaacgcaaacctggcggcagcgcaaaagatg

SEQ ID NO: 60507 - DNA, 103 bp, Artificial Sequence
  Synthetic Polynucleotide
taatacgactcactatagggtataccaattacgcgtttgcgtttatttttaacagaggagaaaaaatatgcgcaaacgcaacctggcggcagcgcaaaagatg

SEQ ID NO: 60508 - DNA, 103 bp, Artificial Sequence
  Synthetic Polynucleotide
taatacgactcactatagggatacatataccaattacgcgtttgcgtttaaacagaggagataaacgatgacgcgtaataacctggcggcagcgcaaaagatg

SEQ ID NO: 60509 - DNA, 103 bp, Artificial Sequence
  Synthetic Polynucleotide
taatacgactcactatagggttctaatacatataccaattacgcgtttgcaacagaggagagcaaacatgtaattggtaaacctggcggcagcgcaaaagatg

SEQ ID NO: 60510 - DNA, 103 bp, Artificial Sequence
  Synthetic Polynucleotide
taatacgactcactatagggagatattctaatacatataccaattacgcgaacagaggagacgcgtaatgggtatatgtaacctggcggcagcgcaaaagatg

SEQ ID NO: 60511 - DNA, 103 bp, Artificial Sequence
  Synthetic Polynucleotide
taatacgactcactatagggaccatagatattctaatacatataccaattaacagaggagaaattggatgatgtattagaacctggcggcagcgcaaaagatg

SEQ ID NO: 60512 - DNA, 103 bp, Artificial Sequence
  Synthetic Polynucleotide
taatacgactcactatagggaaataaccatagatattctaatacatatacaacagaggagagtatatatgttagaatataacctggcggcagcgcaaaagatg

SEQ ID NO: 60513 - DNA, 103 bp, Artificial Sequence
  Synthetic Polynucleotide
taatacgactcactatagggtagtgaaataaccatagatattctaatacaaacagaggagatgtattatgatatctatgaacctggcggcagcgcaaaagatg

SEQ ID NO: 60514 - DNA, 103 bp, Artificial Sequence
  Synthetic Polynucleotide
taatacgactcactatagggaacagtttacatcccaagtttatgactaataacagaggagaattagtatgaaacttgggaacctggcggcagcgcaaaagatg

SEQ ID NO: 60515 - DNA, 103 bp, Artificial Sequence
  Synthetic Polynucleotide
taatacgactcactataggggatagtagtgaaataaccatagatattctaaacagaggagatagaatatgtatggttataacctggcggcagcgcaaaagatg

SEQ ID NO: 60516 - DNA, 103 bp, Artificial Sequence
  Synthetic Polynucleotide
taatacgactcactatagggtcatagatagtagtgaaataaccatagataaacagaggagatatctaatgttatttcacaacctggcggcagcgcaaaagatg

SEQ ID NO: 60517 - DNA, 103 bp, Artificial Sequence
  Synthetic Polynucleotide
taatacgactcactatagggggtaatcatagatagtagtgaaataaccataacagaggagaatggttatgtcactactaaacctggcggcagcgcaaaagatg

SEQ ID NO: 60518 - DNA, 103 bp, Artificial Sequence
  Synthetic Polynucleotide
taatacgactcactataggggacatggtaatcatagatagtagtgaaataaacagaggagatatttcatgactatctataacctggcggcagcgcaaaagatg

SEQ ID NO: 60519 - DNA, 103 bp, Artificial Sequence
  Synthetic Polynucleotide
taatacgactcactatagggacgcggacatggtaatcatagatagtagtgaacagaggagacactacatgctatgattaaacctggcggcagcgcaaaagatg

SEQ ID NO: 60520 - DNA, 103 bp, Artificial Sequence
  Synthetic Polynucleotide
taatacgactcactataggggagaaacgcggacatggtaatcatagatagaacagaggagactatctatgattaccatgaacctggcggcagcgcaaaagatg

SEQ ID NO: 60521 - DNA, 103 bp, Artificial Sequence
  Synthetic Polynucleotide
taatacgactcactatagggactatgagaaacgcggacatggtaatcataaacagaggagatatgatatgcatgtccgcaacctggcggcagcgcaaaagatg

SEQ ID NO: 60522 - DNA, 103 bp, Artificial Sequence
  Synthetic Polynucleotide
taatacgactcactataggggacgcactatgagaaacgcggacatggtaaaacagaggagattaccaatgccgcgtttcaacctggcggcagcgcaaaagatg

SEQ ID NO: 60523 - DNA, 103 bp, Artificial Sequence
  Synthetic Polynucleotide
taatacgactcactatagggatttagacgcactatgagaaacgcggacataacagaggagaatgtccatgtttctcataaacctggcggcagcgcaaaagatg

SEQ ID NO: 60524 - DNA, 103 bp, Artificial Sequence
  Synthetic Polynucleotide
taatacgactcactatagggcattgatttagacgcactatgagaaacgcgaacagaggagacgcgttatgcatagtgcgaacctggcggcagcgcaaaagatg

SEQ ID NO: 60525 - DNA, 103 bp, Artificial Sequence
  Synthetic Polynucleotide
taatacgactcactatagggtcatcaacagtttacatcccaagtttatgaaacagaggagatcataaatgtgggatgtaaacctggcggcagcgcaaaagatg

SEQ ID NO: 60526 - DNA, 103 bp, Artificial Sequence
  Synthetic Polynucleotide
taatacgactcactatagggacatgcattgatttagacgcactatgagaaaacagaggagattctcaatgtgcgtctaaaacctggcggcagcgcaaaagatg

SEQ ID NO: 60527 - DNA, 103 bp, Artificial Sequence
  Synthetic Polynucleotide
taatacgactcactatagggagcagacatgcattgatttagacgcactataacagaggagaatagtgatgctaaatcaaaacctggcggcagcgcaaaagatg

SEQ ID NO: 60528 - DNA, 103 bp, Artificial Sequence
  Synthetic Polynucleotide
taatacgactcactatagggtcgttagcagacatgcattgatttagacgcaacagaggagagcgtctatgtcaatgcataacctggcggcagcgcaaaagatg

SEQ ID NO: 60529 - DNA, 103 bp, Artificial Sequence
  Synthetic Polynucleotide
taatacgactcactatagggcagcctcgttagcagacatgcattgatttaaacagaggagataaatcatggcatgtctgaacctggcggcagcgcaaaagatg

SEQ ID NO: 60530 - DNA, 103 bp, Artificial Sequence
  Synthetic Polynucleotide
taatacgactcactatagggaatagcagcctcgttagcagacatgcattgaacagaggagacaatgcatgtctgctaacaacctggcggcagcgcaaaagatg

SEQ ID NO: 60531 - DNA, 103 bp, Artificial Sequence
  Synthetic Polynucleotide
taatacgactcactatagggtcagtaatagcagcctcgttagcagacatgaacagaggagacatgtcatgtaacgaggcaacctggcggcagcgcaaaagatg

SEQ ID NO: 60532 - DNA, 103 bp, Artificial Sequence
  Synthetic Polynucleotide
taatacgactcactatagggtggcgtcagtaatagcagcctcgttagcagaacagaggagactgctaatgaggctgctaaacctggcggcagcgcaaaagatg

SEQ ID NO: 60533 - DNA, 103 bp, Artificial Sequence
  Synthetic Polynucleotide
taatacgactcactatagggtgcagtggcgtcagtaatagcagcctcgttaacagaggagaaacgagatggctattactaacctggcggcagcgcaaaagatg

SEQ ID NO: 60534 - DNA, 103 bp, Artificial Sequence
  Synthetic Polynucleotide
taatacgactcactataggggcaactgcagtggcgtcagtaatagcagccaacagaggagaggctgcatgtactgacgcaacctggcggcagcgcaaaagatg

SEQ ID NO: 60535 - DNA, 103 bp, Artificial Sequence
  Synthetic Polynucleotide
taatacgactcactatagggcagcagcaactgcagtggcgtcagtaatagaacagaggagactattaatgacgccactgaacctggcggcagcgcaaaagatg

SEQ ID NO: 60536 - DNA, 103 bp, Artificial Sequence
  Synthetic Polynucleotide
taatacgactcactatagggagatatcatcaacagtttacatcccaagttaacagaggagaaacttgatgtgtaaactgaacctggcggcagcgcaaaagatg

SEQ ID NO: 60537 - DNA, 103 bp, Artificial Sequence
  Synthetic Polynucleotide
taatacgactcactatagggtaatgcagcagcaactgcagtggcgtcagtaacagaggagaactgacatgactgcagttaacctggcggcagcgcaaaagatg

SEQ ID NO: 60538 - DNA, 103 bp, Artificial Sequence
  Synthetic Polynucleotide
taatacgactcactataggggtagataatgcagcagcaactgcagtggcgaacagaggagacgccacatgagttgctgcaacctggcggcagcgcaaaagatg

SEQ ID NO: 60539 - DNA, 103 bp, Artificial Sequence
  Synthetic Polynucleotide
taatacgactcactatagggtatgagtagataatgcagcagcaactgcagaacagaggagactgcagatgctgctgcataacctggcggcagcgcaaaagatg

SEQ ID NO: 60540 - DNA, 103 bp, Artificial Sequence
  Synthetic Polynucleotide
taatacgactcactatagggctttctatgagtagataatgcagcagcaacaacagaggagagttgctatggcattatctaacctggcggcagcgcaaaagatg

SEQ ID NO: 60541 - DNA, 103 bp, Artificial Sequence
  Synthetic Polynucleotide
taatacgactcactataggggcaacctttctatgagtagataatgcagcaaacagaggagatgctgcatgatctactcaaacctggcggcagcgcaaaagatg

SEQ ID NO: 60542 - DNA, 103 bp, Artificial Sequence
  Synthetic Polynucleotide
taatacgactcactatagggtagacgcaacctttctatgagtagataatgaacagaggagacattatatgctcatagaaaacctggcggcagcgcaaaagatg

SEQ ID NO: 60543 - DNA, 103 bp, Artificial Sequence
  Synthetic Polynucleotide
taatacgactcactatagggagtgctagacgcaacctttctatgagtagaaacagaggagatctactatgagaaaggttaacctggcggcagcgcaaaagatg

SEQ ID NO: 60544 - DNA, 103 bp, Artificial Sequence
  Synthetic Polynucleotide
taatacgactcactatagggtgtgtagtgctagacgcaacctttctatgaaacagaggagatcatagatgggttgcgtcaacctggcggcagcgcaaaagatg

SEQ ID NO: 60545 - DNA, 103 bp, Artificial Sequence
  Synthetic Polynucleotide
taatacgactcactatagggtatattgtgtagtgctagacgcaacctttcaacagaggagagaaaggatgcgtctagcaaacctggcggcagcgcaaaagatg

SEQ ID NO: 60546 - DNA, 103 bp, Artificial Sequence
  Synthetic Polynucleotide
taatacgactcactataggggtgtttatattgtgtagtgctagacgcaacaacagaggagagttgcgatgagcactacaaacctggcggcagcgcaaaagatg

SEQ ID NO: 60547 - DNA, 103 bp, Artificial Sequence
  Synthetic Polynucleotide
taatacgactcactataggggatgtagatatcatcaacagtttacatcccaacagaggagagggatgatgactgttgataacctggcggcagcgcaaaagatg

SEQ ID NO: 60548 - DNA, 103 bp, Artificial Sequence
  Synthetic Polynucleotide
taatacgactcactatagggtcttggtgtttatattgtgtagtgctagacaacagaggagagtctagatgtacacaataaacctggcggcagcgcaaaagatg

SEQ ID NO: 60549 - DNA, 103 bp, Artificial Sequence
  Synthetic Polynucleotide
taatacgactcactatagggagctttcttggtgtttatattgtgtagtgcaacagaggagagcactaatgaatataaacaacctggcggcagcgcaaaagatg

SEQ ID NO: 60550 - DNA, 103 bp, Artificial Sequence
  Synthetic Polynucleotide
taatacgactcactatagggattacagctttcttggtgtttatattgtgtaacagaggagaacacaaatgaaacaccaaaacctggcggcagcgcaaaagatg

SEQ ID NO: 60551 - DNA, 103 bp, Artificial Sequence
  Synthetic Polynucleotide
taatacgactcactatagggaaaccattacagctttcttggtgtttatataacagaggagaatataaatgccaagaaagaacctggcggcagcgcaaaagatg

SEQ ID NO: 60552 - DNA, 103 bp, Artificial Sequence
  Synthetic Polynucleotide
taatacgactcactatagggaatataaaccattacagctttcttggtgttaacagaggagaaacaccatgaaagctgtaaacctggcggcagcgcaaaagatg

SEQ ID NO: 60553 - DNA, 103 bp, Artificial Sequence
  Synthetic Polynucleotide
taatacgactcactatagggctggtaatataaaccattacagctttcttgaacagaggagacaagaaatgtgtaatggtaacctggcggcagcgcaaaagatg

SEQ ID NO: 60554 - DNA, 103 bp, Artificial Sequence
  Synthetic Polynucleotide
taatacgactcactataggggaaccctggtaatataaaccattacagcttaacagaggagaaagctgatgtggtttataaacctggcggcagcgcaaaagatg

SEQ ID NO: 60555 - DNA, 103 bp, Artificial Sequence
  Synthetic Polynucleotide
taatacgactcactatagggaacaagaaccctggtaatataaaccattacaacagaggagagtaatgatgtatattaccaacctggcggcagcgcaaaagatg

SEQ ID NO: 60556 - DNA, 103 bp, Artificial Sequence
  Synthetic Polynucleotide
taatacgactcactatagggtatataacaagaaccctggtaatataaaccaacagaggagaggtttaatgtaccagggtaacctggcggcagcgcaaaagatg

SEQ ID NO: 60557 - DNA, 103 bp, Artificial Sequence
  Synthetic Polynucleotide
taatacgactcactatagggtggaatatataacaagaaccctggtaatataacagaggagaatattaatggggttcttgaacctggcggcagcgcaaaagatg

SEQ ID NO: 60558 - DNA, 103 bp, Artificial Sequence
  Synthetic Polynucleotide
taatacgactcactatagggcaaacgatgtagatatcatcaacagtttacaacagaggagagtaaacatgtgatgatataacctggcggcagcgcaaaagatg

SEQ ID NO: 60559 - DNA, 103 bp, Artificial Sequence
  Synthetic Polynucleotide
taatacgactcactatagggctgaatggaatatataacaagaaccctggtaacagaggagaaccaggatgcttgttataaacctggcggcagcgcaaaagatg

SEQ ID NO: 60560 - DNA, 103 bp, Artificial Sequence
  Synthetic Polynucleotide
taatacgactcactataggggtagtctgaatggaatatataacaagaaccaacagaggagaggttctatgtatatattcaacctggcggcagcgcaaaagatg

SEQ ID NO: 60561 - DNA, 103 bp, Artificial Sequence
  Synthetic Polynucleotide
taatacgactcactatagggaactggtagtctgaatggaatatataacaaaacagaggagattgttaatgattccattcaacctggcggcagcgcaaaagatg

SEQ ID NO: 60562 - DNA, 103 bp, Artificial Sequence
  Synthetic Polynucleotide
taatacgactcactatagggagaataactggtagtctgaatggaatatataacagaggagaatatatatgattcagactaacctggcggcagcgcaaaagatg

SEQ ID NO: 60563 - DNA, 103 bp, Artificial Sequence
  Synthetic Polynucleotide
taatacgactcactatagggatccgagaataactggtagtctgaatggaaaacagaggagattccatatggactaccagaacctggcggcagcgcaaaagatg

SEQ ID NO: 60564 - DNA, 103 bp, Artificial Sequence
  Synthetic Polynucleotide
taatacgactcactatagggttagcatccgagaataactggtagtctgaaaacagaggagattcagaatgccagttattaacctggcggcagcgcaaaagatg

SEQ ID NO: 60565 - DNA, 103 bp, Artificial Sequence
  Synthetic Polynucleotide
taatacgactcactatagggttgctttagcatccgagaataactggtagtaacagaggagaactaccatgtattctcggaacctggcggcagcgcaaaagatg

SEQ ID NO: 60566 - DNA, 103 bp, Artificial Sequence
  Synthetic Polynucleotide
taatacgactcactataggggcaatttgctttagcatccgagaataactgaacagaggagacagttaatgtcggatgctaacctggcggcagcgcaaaagatg

SEQ ID NO: 60567 - DNA, 103 bp, Artificial Sequence
  Synthetic Polynucleotide
taatacgactcactataggggtggcgcaatttgctttagcatccgagaataacagaggagaattctcatgtgctaaagcaacctggcggcagcgcaaaagatg

SEQ ID NO: 60568 - DNA, 103 bp, Artificial Sequence
  Synthetic Polynucleotide
taatacgactcactatagggattctgtggcgcaatttgctttagcatccgaacagaggagacggatgatgaagcaaattaacctggcggcagcgcaaaagatg

SEQ ID NO: 60569 - DNA, 103 bp, Artificial Sequence
  Synthetic Polynucleotide
taatacgactcactataggggtttagattttgacaataacgtatatactaaacagaggagatagtatatgcgttattgtaacctggcggcagcgcaaaagatg

SEQ ID NO: 60570 - DNA, 103 bp, Artificial Sequence
  Synthetic Polynucleotide
taatacgactcactatagggaaatccaaacgatgtagatatcatcaacagaacagaggagactgttgatgatatctacaaacctggcggcagcgcaaaagatg

SEQ ID NO: 60571 - DNA, 103 bp, Artificial Sequence
  Synthetic Polynucleotide
taatacgactcactatagggtgatgattctgtggcgcaatttgctttagcaacagaggagagctaaaatgaattgcgccaacctggcggcagcgcaaaagatg

SEQ ID NO: 60572 - DNA, 103 bp, Artificial Sequence
  Synthetic Polynucleotide
taatacgactcactatagggagtgttgatgattctgtggcgcaatttgctaacagaggagaagcaaaatgcgccacagaaacctggcggcagcgcaaaagatg

SEQ ID NO: 60573 - DNA, 103 bp, Artificial Sequence
  Synthetic Polynucleotide
taatacgactcactatagggtgggtagtgttgatgattctgtggcgcaataacagaggagaattgcgatgcagaatcataacctggcggcagcgcaaaagatg

SEQ ID NO: 60574 - DNA, 103 bp, Artificial Sequence
  Synthetic Polynucleotide
taatacgactcactatagggtttattgggtagtgttgatgattctgtggcaacagaggagagccacaatgtcatcaacaaacctggcggcagcgcaaaagatg

SEQ ID NO: 60575 - DNA, 103 bp, Artificial Sequence
  Synthetic Polynucleotide
taatacgactcactatagggtcagatttattgggtagtgttgatgattctaacagaggagaagaatcatgaacactaccaacctggcggcagcgcaaaagatg

SEQ ID NO: 60576 - DNA, 103 bp, Artificial Sequence
  Synthetic Polynucleotide
taatacgactcactatagggagacatcagatttattgggtagtgttgatgaacagaggagacatcaaatgtacccaataaacctggcggcagcgcaaaagatg

SEQ ID NO: 60577 - DNA, 103 bp, Artificial Sequence
  Synthetic Polynucleotide
taatacgactcactatagggagtcaagacatcagatttattgggtagtgtaacagaggagaacactaatgaataaatctaacctggcggcagcgcaaaagatg

SEQ ID NO: 60578 - DNA, 103 bp, Artificial Sequence
  Synthetic Polynucleotide
taatacgactcactatagggcaggtagtcaagacatcagatttattgggtaacagaggagaacccaaatgatctgatgtaacctggcggcagcgcaaaagatg

SEQ ID NO: 60579 - DNA, 103 bp, Artificial Sequence
  Synthetic Polynucleotide
taatacgactcactatagggtgagccaggtagtcaagacatcagatttataacagaggagaataaatatgatgtcttgaaacctggcggcagcgcaaaagatg

SEQ ID NO: 60580 - DNA, 103 bp, Artificial Sequence
  Synthetic Polynucleotide
taatacgactcactatagggatcaatgagccaggtagtcaagacatcagaaacagaggagatctgatatgttgactaccaacctggcggcagcgcaaaagatg

SEQ ID NO: 60581 - DNA, 103 bp, Artificial Sequence
  Synthetic Polynucleotide
taatacgactcactatagggcataaaaatccaaacgatgtagatatcatcaacagaggagagatgatatgtacatcgttaacctggcggcagcgcaaaagatg

SEQ ID NO: 60582 - DNA, 103 bp, Artificial Sequence
  Synthetic Polynucleotide
taatacgactcactatagggacataatcaatgagccaggtagtcaagacaaacagaggagatgtcttatgtacctggctaacctggcggcagcgcaaaagatg

SEQ ID NO: 60583 - DNA, 103 bp, Artificial Sequence
  Synthetic Polynucleotide
taatacgactcactatagggcctcaacataatcaatgagccaggtagtcaaacagaggagatgactaatgggctcattgaacctggcggcagcgcaaaagatg

SEQ ID NO: 60584 - DNA, 103 bp, Artificial Sequence
  Synthetic Polynucleotide
taatacgactcactatagggtgtatcctcaacataatcaatgagccaggtaacagaggagaacctggatgattgattataacctggcggcagcgcaaaagatg

SEQ ID NO: 60585 - DNA, 103 bp, Artificial Sequence
  Synthetic Polynucleotide
taatacgactcactatagggccccatgtatcctcaacataatcaatgagcaacagaggagagctcatatgttatgttgaaacctggcggcagcgcaaaagatg

SEQ ID NO: 60586 - DNA, 103 bp, Artificial Sequence
  Synthetic Polynucleotide
taatacgactcactatagggcagatccccatgtatcctcaacataatcaaaacagaggagattgattatgttgaggataaacctggcggcagcgcaaaagatg

SEQ ID NO: 60587 - DNA, 103 bp, Artificial Sequence
  Synthetic Polynucleotide
taatacgactcactatagggaccatcagatccccatgtatcctcaacataaacagaggagatatgttatggatacatggaacctggcggcagcgcaaaagatg

SEQ ID NO: 60588 - DNA, 103 bp, Artificial Sequence
  Synthetic Polynucleotide
taatacgactcactatagggggattaccatcagatccccatgtatcctcaaacagaggagatgaggaatgatggggatcaacctggcggcagcgcaaaagatg

SEQ ID NO: 60589 - DNA, 103 bp, Artificial Sequence
  Synthetic Polynucleotide
taatacgactcactatagggtaattggattaccatcagatccccatgtataacagaggagaatacatatggatctgatgaacctggcggcagcgcaaaagatg

SEQ ID NO: 60590 - DNA, 103 bp, Artificial Sequence
  Synthetic Polynucleotide
taatacgactcactatagggttttgtaattggattaccatcagatccccaaacagaggagatggggaatggatggtaataacctggcggcagcgcaaaagatg

SEQ ID NO: 60591 - DNA, 103 bp, Artificial Sequence
  Synthetic Polynucleotide
taatacgactcactataggggtagtttttgtaattggattaccatcagataacagaggagaatctgaatgtaatccaataacctggcggcagcgcaaaagatg

SEQ ID NO: 60592 - DNA, 103 bp, Artificial Sequence
  Synthetic Polynucleotide
taatacgactcactatagggggatacataaaaatccaaacgatgtagataaacagaggagatatctaatgcgtttggataacctggcggcagcgcaaaagatg

SEQ ID NO: 60593 - DNA, 103 bp, Artificial Sequence
  Synthetic Polynucleotide
taatacgactcactatagggcggttgtagtttttgtaattggattaccataacagaggagaatggtaatgcaattacaaaacctggcggcagcgcaaaagatg

SEQ ID NO: 60594 - DNA, 103 bp, Artificial Sequence
  Synthetic Polynucleotide
taatacgactcactatagggataatcggttgtagtttttgtaattggattaacagaggagaaatccaatgacaaaaactaacctggcggcagcgcaaaagatg

SEQ ID NO: 60595 - DNA, 103 bp, Artificial Sequence
  Synthetic Polynucleotide
taatacgactcactatagggtcttgataatcggttgtagtttttgtaattaacagaggagaaattacatgaactacaacaacctggcggcagcgcaaaagatg

SEQ ID NO: 60596 - DNA, 103 bp, Artificial Sequence
  Synthetic Polynucleotide
taatacgactcactatagggcggaatcttgataatcggttgtagtttttgaacagaggagacaaaaaatgcaaccgattaacctggcggcagcgcaaaagatg

SEQ ID NO: 60597 - DNA, 103 bp, Artificial Sequence
  Synthetic Polynucleotide
taatacgactcactatagggtacatcggaatcttgataatcggttgtagtaacagaggagaactacaatggattatcaaaacctggcggcagcgcaaaagatg

SEQ ID NO: 60598 - DNA, 103 bp, Artificial Sequence
  Synthetic Polynucleotide
taatacgactcactatagggtgtgatacatcggaatcttgataatcggttaacagaggagaaaccgaatgtcaagattcaacctggcggcagcgcaaaagatg

SEQ ID NO: 60599 - DNA, 103 bp, Artificial Sequence
  Synthetic Polynucleotide
taatacgactcactatagggcttcttgtgatacatcggaatcttgataataacagaggagaattatcatgattccgatgaacctggcggcagcgcaaaagatg

SEQ ID NO: 60600 - DNA, 103 bp, Artificial Sequence
  Synthetic Polynucleotide
taatacgactcactatagggtctaacttcttgtgatacatcggaatcttgaacagaggagacaagatatggatgtatcaaacctggcggcagcgcaaaagatg

SEQ ID NO: 60601 - DNA, 103 bp, Artificial Sequence
  Synthetic Polynucleotide
taatacgactcactatagggtactttctaacttcttgtgatacatcggaaaacagaggagattccgaatgatcacaagaaacctggcggcagcgcaaaagatg

SEQ ID NO: 60602 - DNA, 103 bp, Artificial Sequence
  Synthetic Polynucleotide
taatacgactcactatagggaaaaatactttctaacttcttgtgatacataacagaggagaatgtatatgaagaagttaaacctggcggcagcgcaaaagatg

SEQ ID NO: 60603 - DNA, 103 bp, Artificial Sequence
  Synthetic Polynucleotide
taatacgactcactatagggaaagtggatacataaaaatccaaacgatgtaacagaggagaacatcgatgggatttttaaacctggcggcagcgcaaaagatg

SEQ ID NO: 60604 - DNA, 103 bp, Artificial Sequence
  Synthetic Polynucleotide
taatacgactcactatagggaacacaaaaatactttctaacttcttgtgaaacagaggagatcacaaatggttagaaagaacctggcggcagcgcaaaagatg

SEQ ID NO: 60605 - DNA, 103 bp, Artificial Sequence
  Synthetic Polynucleotide
taatacgactcactataggggttttaacacaaaaatactttctaacttctaacagaggagaagaagtatgaaagtatttaacctggcggcagcgcaaaagatg

SEQ ID NO: 60606 - DNA, 103 bp, Artificial Sequence
  Synthetic Polynucleotide
taatacgactcactatagggtcattgttttaacacaaaaatactttctaaaacagaggagattagaaatgatttttgtgaacctggcggcagcgcaaaagatg

SEQ ID NO: 60607 - DNA, 103 bp, Artificial Sequence
  Synthetic Polynucleotide
taatacgactcactatagggttagttcattgttttaacacaaaaatacttaacagaggagaaagtatatgtgtgttaaaaacctggcggcagcgcaaaagatg

SEQ ID NO: 60608 - DNA, 103 bp, Artificial Sequence
  Synthetic Polynucleotide
taatacgactcactatagggaaatattagttcattgttttaacacaaaaaaacagaggagatttttgatgtaaaacaataacctggcggcagcgcaaaagatg

SEQ ID NO: 60609 - DNA, 103 bp, Artificial Sequence
  Synthetic Polynucleotide
taatacgactcactatagggaaaataaatattagttcattgttttaacacaacagaggagagtgttaatgcaatgaactaacctggcggcagcgcaaaagatg

SEQ ID NO: 60610 - DNA, 103 bp, Artificial Sequence
  Synthetic Polynucleotide
taatacgactcactataggggtacaaaaataaatattagttcattgttttaacagaggagaaaaacaatgaactaatataacctggcggcagcgcaaaagatg

SEQ ID NO: 60611 - DNA, 103 bp, Artificial Sequence
  Synthetic Polynucleotide
taatacgactcactatagggttaatgtacaaaaataaatattagttcattaacagaggagaaatgaaatgatatttattaacctggcggcagcgcaaaagatg

SEQ ID NO: 60612 - DNA, 103 bp, Artificial Sequence
  Synthetic Polynucleotide
taatacgactcactatagggatttattaatgtacaaaaataaatattagtaacagaggagaactaatatgtatttttgtaacctggcggcagcgcaaaagatg

SEQ ID NO: 60613 - DNA, 103 bp, Artificial Sequence
  Synthetic Polynucleotide
taatacgactcactatagggatttcatttattaatgtacaaaaataaataaacagaggagatatttaatgttgtacattaacctggcggcagcgcaaaagatg

SEQ ID NO: 60614 - DNA, 103 bp, Artificial Sequence
  Synthetic Polynucleotide
taatacgactcactatagggttattaaagtggatacataaaaatccaaacaacagaggagagtttggatgtttatgtataacctggcggcagcgcaaaagatg

SEQ ID NO: 60615 - DNA, 103 bp, Artificial Sequence
  Synthetic Polynucleotide
taatacgactcactatagggaagcgatttcatttattaatgtacaaaaataacagaggagaatttttatgcattaataaaacctggcggcagcgcaaaagatg

SEQ ID NO: 60616 - DNA, 103 bp, Artificial Sequence
  Synthetic Polynucleotide
taatacgactcactatagggctattaagcgatttcatttattaatgtacaaacagaggagatgtacaatgataaatgaaaacctggcggcagcgcaaaagatg

SEQ ID NO: 60617 - DNA, 103 bp, Artificial Sequence
  Synthetic Polynucleotide
taatacgactcactatagggtttgtctattaagcgatttcatttattaataacagaggagaattaatatgtgaaatcgcaacctggcggcagcgcaaaagatg

SEQ ID NO: 60618 - DNA, 103 bp, Artificial Sequence
  Synthetic Polynucleotide
taatacgactcactatagggtacagtttgtctattaagcgatttcatttaaacagaggagataaatgatgtcgcttaataacctggcggcagcgcaaaagatg

SEQ ID NO: 60619 - DNA, 103 bp, Artificial Sequence
  Synthetic Polynucleotide
taatacgactcactatagggctacttacagtttgtctattaagcgatttcaacagaggagagaaatcatgtaatagacaaacctggcggcagcgcaaaagatg

SEQ ID NO: 60620 - DNA, 103 bp, Artificial Sequence
  Synthetic Polynucleotide
taatacgactcactatagggtaaacctacttacagtttgtctattaagcgaacagaggagacgcttaatggacaaactgaacctggcggcagcgcaaaagatg

SEQ ID NO: 60621 - DNA, 103 bp, Artificial Sequence
  Synthetic Polynucleotide
taatacgactcactatagggcttcttaaacctacttacagtttgtctattaacagaggagaaatagaatgactgtaagtaacctggcggcagcgcaaaagatg

SEQ ID NO: 60622 - DNA, 103 bp, Artificial Sequence
  Synthetic Polynucleotide
taatacgactcactataggggacaacttcttaaacctacttacagtttgtaacagaggagaacaaacatgaagtaggttaacctggcggcagcgcaaaagatg

SEQ ID NO: 60623 - DNA, 103 bp, Artificial Sequence
  Synthetic Polynucleotide
taatacgactcactataggggcaccgacaacttcttaaacctacttacagaacagaggagactgtaaatgggtttaagaaacctggcggcagcgcaaaagatg

SEQ ID NO: 60624 - DNA, 103 bp, Artificial Sequence
  Synthetic Polynucleotide
taatacgactcactatagggggccggcaccgacaacttcttaaacctactaacagaggagaagtaggatgaagaagttgaacctggcggcagcgcaaaagatg

SEQ ID NO: 60625 - DNA, 103 bp, Artificial Sequence
  Synthetic Polynucleotide
taatacgactcactatagggtgatattattaaagtggatacataaaaatcaacagaggagagattttatggtatccactaacctggcggcagcgcaaaagatg

SEQ ID NO: 60626 - DNA, 103 bp, Artificial Sequence
  Synthetic Polynucleotide
taatacgactcactatagggatagcggccggcaccgacaacttcttaaacaacagaggagagtttaaatggttgtcggtaacctggcggcagcgcaaaagatg

SEQ ID NO: 60627 - DNA, 103 bp, Artificial Sequence
  Synthetic Polynucleotide
taatacgactcactatagggtcattatagcggccggcaccgacaacttctaacagaggagaagaagtatgcggtgccggaacctggcggcagcgcaaaagatg

SEQ ID NO: 60628 - DNA, 103 bp, Artificial Sequence
  Synthetic Polynucleotide
taatacgactcactatagggtatcatcattatagcggccggcaccgacaaaacagaggagattgtcgatgccggccgctaacctggcggcagcgcaaaagatg

SEQ ID NO: 60629 - DNA, 103 bp, Artificial Sequence
  Synthetic Polynucleotide
taatacgactcactataggggagagtatcatcattatagcggccggcaccaacagaggagaggtgccatgcgctataataacctggcggcagcgcaaaagatg

SEQ ID NO: 60630 - DNA, 103 bp, Artificial Sequence
  Synthetic Polynucleotide
taatacgactcactatagggtggttgagagtatcatcattatagcggccgaacagaggagacggccgatgtaatgatgaaacctggcggcagcgcaaaagatg

SEQ ID NO: 60631 - DNA, 103 bp, Artificial Sequence
  Synthetic Polynucleotide
taatacgactcactatagggaataatggttgagagtatcatcattatagcaacagaggagagctataatgatgatactcaacctggcggcagcgcaaaagatg

SEQ ID NO: 60632 - DNA, 103 bp, Artificial Sequence
  Synthetic Polynucleotide
taatacgactcactatagggccgctaataatggttgagagtatcatcattaacagaggagaaatgatatgactctcaacaacctggcggcagcgcaaaagatg

SEQ ID NO: 60633 - DNA, 103 bp, Artificial Sequence
  Synthetic Polynucleotide
taatacgactcactatagggctatgccgctaataatggttgagagtatcaaacagaggagatgatacatgcaaccattaaacctggcggcagcgcaaaagatg

SEQ ID NO: 60634 - DNA, 103 bp, Artificial Sequence
  Synthetic Polynucleotide
taatacgactcactatagggtgttcctatgccgctaataatggttgagagaacagaggagactctcaatgattattagcaacctggcggcagcgcaaaagatg

SEQ ID NO: 60635 - DNA, 103 bp, Artificial Sequence
  Synthetic Polynucleotide
taatacgactcactatagggagaaatgttcctatgccgctaataatggttaacagaggagaaaccatatgtagcggcataacctggcggcagcgcaaaagatg

SEQ ID NO: 60636 - DNA, 103 bp, Artificial Sequence
  Synthetic Polynucleotide
taatacgactcactatagggagctatgatattattaaagtggatacataaaacagaggagattatgtatgcactttaataacctggcggcagcgcaaaagatg

SEQ ID NO: 60637 - DNA, 103 bp, Artificial Sequence
  Synthetic Polynucleotide
taatacgactcactatagggaatgcagaaatgttcctatgccgctaataaaacagaggagattattaatggcataggaaaacctggcggcagcgcaaaagatg

SEQ ID NO: 60638 - DNA, 103 bp, Artificial Sequence
  Synthetic Polynucleotide
taatacgactcactatagggtttgtaatgcagaaatgttcctatgccgctaacagaggagaagcggcatgggaacatttaacctggcggcagcgcaaaagatg

SEQ ID NO: 60639 - DNA, 103 bp, Artificial Sequence
  Synthetic Polynucleotide
taatacgactcactatagggtcttctttgtaatgcagaaatgttcctatgaacagaggagacataggatgatttctgcaaacctggcggcagcgcaaaagatg

SEQ ID NO: 60640 - DNA, 103 bp, Artificial Sequence
  Synthetic Polynucleotide
taatacgactcactatagggtcagttcttctttgtaatgcagaaatgttcaacagaggagagaacatatgtgcattacaaacctggcggcagcgcaaaagatg

SEQ ID NO: 60641 - DNA, 103 bp, Artificial Sequence
  Synthetic Polynucleotide
taatacgactcactatagggaggcatcagttcttctttgtaatgcagaaaaacagaggagatttctgatgtacaaagaaaacctggcggcagcgcaaaagatg

SEQ ID NO: 60642 - DNA, 103 bp, Artificial Sequence
  Synthetic Polynucleotide
taatacgactcactataggggcactaggcatcagttcttctttgtaatgcaacagaggagagcattaatgagaagaactaacctggcggcagcgcaaaagatg

SEQ ID NO: 60643 - DNA, 103 bp, Artificial Sequence
  Synthetic Polynucleotide
taatacgactcactatagggcgcaagcactaggcatcagttcttctttgtaacagaggagaacaaagatgaactgatgcaacctggcggcagcgcaaaagatg

SEQ ID NO: 60644 - DNA, 103 bp, Artificial Sequence
  Synthetic Polynucleotide
taatacgactcactatagggattggcgcaagcactaggcatcagttcttcaacagaggagagaagaaatgatgcctagtaacctggcggcagcgcaaaagatg

SEQ ID NO: 60645 - DNA, 103 bp, Artificial Sequence
  Synthetic Polynucleotide
taatacgactcactatagggcatccattggcgcaagcactaggcatcagtaacagaggagaactgatatgtagtgcttgaacctggcggcagcgcaaaagatg

SEQ ID NO: 60646 - DNA, 103 bp, Artificial Sequence
  Synthetic Polynucleotide
taatacgactcactataggggtatccatccattggcgcaagcactaggcaaacagaggagatgcctaatgcttgcgccaaacctggcggcagcgcaaaagatg

SEQ ID NO: 60647 - DNA, 103 bp, Artificial Sequence
  Synthetic Polynucleotide
taatacgactcactataggggttacagctatgatattattaaagtggataaacagaggagatatccaatgtaataatataacctggcggcagcgcaaaagatg

SEQ ID NO: 60648 - DNA, 103 bp, Artificial Sequence
  Synthetic Polynucleotide
taatacgactcactataggggtattgtatccatccattggcgcaagcactaacagaggagaagtgctatggccaatggaaacctggcggcagcgcaaaagatg

SEQ ID NO: 60649 - DNA, 103 bp, Artificial Sequence
  Synthetic Polynucleotide
taatacgactcactatagggttatcgtattgtatccatccattggcgcaaaacagaggagattgcgcatgtggatggataacctggcggcagcgcaaaagatg

SEQ ID NO: 60650 - DNA, 103 bp, Artificial Sequence
  Synthetic Polynucleotide
taatacgactcactatagggaatgtttatcgtattgtatccatccattggaacagaggagaccaatgatgggatacaataacctggcggcagcgcaaaagatg

SEQ ID NO: 60651 - DNA, 103 bp, Artificial Sequence
  Synthetic Polynucleotide
taatacgactcactatagggataacaatgtttatcgtattgtatccatccaacagaggagaggatggatgcaatacgataacctggcggcagcgcaaaagatg

SEQ ID NO: 60652 - DNA, 103 bp, Artificial Sequence
  Synthetic Polynucleotide
taatacgactcactatagggtctaaataacaatgtttatcgtattgtatcaacagaggagagatacaatgcgataaacaaacctggcggcagcgcaaaagatg

SEQ ID NO: 60653 - DNA, 103 bp, Artificial Sequence
  Synthetic Polynucleotide
taatacgactcactatagggtagtatctaaataacaatgtttatcgtattaacagaggagaaatacgatgaacattgttaacctggcggcagcgcaaaagatg

SEQ ID NO: 60654 - DNA, 103 bp, Artificial Sequence
  Synthetic Polynucleotide
taatacgactcactatagggaatgttagtatctaaataacaatgtttatcaacagaggagagataaaatgtgttatttaaacctggcggcagcgcaaaagatg

SEQ ID NO: 60655 - DNA, 103 bp, Artificial Sequence
  Synthetic Polynucleotide
taatacgactcactatagggattttaatgttagtatctaaataacaatgtaacagaggagaacattgatgtttagatacaacctggcggcagcgcaaaagatg

SEQ ID NO: 60656 - DNA, 103 bp, Artificial Sequence
  Synthetic Polynucleotide
taatacgactcactatagggtagacattttaatgttagtatctaaataacaacagaggagagttattatgatactaacaaacctggcggcagcgcaaaagatg

SEQ ID NO: 60657 - DNA, 103 bp, Artificial Sequence
  Synthetic Polynucleotide
taatacgactcactatagggatctgtagacattttaatgttagtatctaaaacagaggagattagatatgaacattaaaaacctggcggcagcgcaaaagatg

SEQ ID NO: 60658 - DNA, 103 bp, Artificial Sequence
  Synthetic Polynucleotide
taatacgactcactatagggaggatgttacagctatgatattattaaagtaacagaggagaactttaatgatatcatagaacctggcggcagcgcaaaagatg

SEQ ID NO: 60659 - DNA, 103 bp, Artificial Sequence
  Synthetic Polynucleotide
taatacgactcactataggggtattatctgtagacattttaatgttagtaaacagaggagatactaaatgtaaaatgtcaacctggcggcagcgcaaaagatg

SEQ ID NO: 60660 - DNA, 103 bp, Artificial Sequence
  Synthetic Polynucleotide
taatacgactcactatagggaaaccgtattatctgtagacattttaatgtaacagaggagaacattaatgtgtctacagaacctggcggcagcgcaaaagatg

SEQ ID NO: 60661 - DNA, 103 bp, Artificial Sequence
  Synthetic Polynucleotide
taatacgactcactatagggctgataaaccgtattatctgtagacattttaacagaggagaaaaatgatgacagataataacctggcggcagcgcaaaagatg

SEQ ID NO: 60662 - DNA, 103 bp, Artificial Sequence
  Synthetic Polynucleotide
taatacgactcactatagggcgacactgataaaccgtattatctgtagacaacagaggagagtctacatgtaatacggtaacctggcggcagcgcaaaagatg

SEQ ID NO: 60663 - DNA, 103 bp, Artificial Sequence
  Synthetic Polynucleotide
taatacgactcactatagggatttacgacactgataaaccgtattatctgaacagaggagacagataatgcggtttatcaacctggcggcagcgcaaaagatg

SEQ ID NO: 60664 - DNA, 103 bp, Artificial Sequence
  Synthetic Polynucleotide
taatacgactcactatagggtcgtaatttacgacactgataaaccgtattaacagaggagaaatacgatgtatcagtgtaacctggcggcagcgcaaaagatg

SEQ ID NO: 60665 - DNA, 103 bp, Artificial Sequence
  Synthetic Polynucleotide
taatacgactcactatagggctggctcgtaatttacgacactgataaaccaacagaggagaggtttaatggtgtcgtaaaacctggcggcagcgcaaaagatg

SEQ ID NO: 60666 - DNA, 103 bp, Artificial Sequence
  Synthetic Polynucleotide
taatacgactcactataggggcaatctggctcgtaatttacgacactgataacagaggagaatcagtatggtaaattacaacctggcggcagcgcaaaagatg

SEQ ID NO: 60667 - DNA, 103 bp, Artificial Sequence
  Synthetic Polynucleotide
taatacgactcactatagggtctaggcaatctggctcgtaatttacgacaaacagaggagatgtcgtatgttacgagccaacctggcggcagcgcaaaagatg

SEQ ID NO: 60668 - DNA, 103 bp, Artificial Sequence
  Synthetic Polynucleotide
taatacgactcactatagggtccggtctaggcaatctggctcgtaatttaaacagaggagataaattatgagccagattaacctggcggcagcgcaaaagatg

SEQ ID NO: 60669 - DNA, 103 bp, Artificial Sequence
  Synthetic Polynucleotide
taatacgactcactatagggtcacgaggatgttacagctatgatattattaacagaggagaaataatatgatagctgtaaacctggcggcagcgcaaaagatg

SEQ ID NO: 60670 - DNA, 103 bp, Artificial Sequence
  Synthetic Polynucleotide
taatacgactcactatagggtagtatccggtctaggcaatctggctcgtaaacagaggagatacgagatggattgcctaaacctggcggcagcgcaaaagatg

SEQ ID NO: 60671 - DNA, 103 bp, Artificial Sequence
  Synthetic Polynucleotide
taatacgactcactatagggatgtctagtatccggtctaggcaatctggcaacagaggagagccagaatgcctagaccgaacctggcggcagcgcaaaagatg

SEQ ID NO: 60672 - DNA, 103 bp, Artificial Sequence
  Synthetic Polynucleotide
taatacgactcactatagggcttagatgtctagtatccggtctaggcaataacagaggagaattgccatgaccggatacaacctggcggcagcgcaaaagatg

SEQ ID NO: 60673 - DNA, 103 bp, Artificial Sequence
  Synthetic Polynucleotide
taatacgactcactatagggatactcttagatgtctagtatccggtctagaacagaggagactagacatgatactagacaacctggcggcagcgcaaaagatg

SEQ ID NO: 60674 - DNA, 103 bp, Artificial Sequence
  Synthetic Polynucleotide
taatacgactcactatagggaaacaatactcttagatgtctagtatccggaacagaggagaccggatatgagacatctaaacctggcggcagcgcaaaagatg

SEQ ID NO: 60675 - DNA, 103 bp, Artificial Sequence
  Synthetic Polynucleotide
taatacgactcactatagggatactaaacaatactcttagatgtctagtaaacagaggagatactagatgtctaagagtaacctggcggcagcgcaaaagatg

SEQ ID NO: 60676 - DNA, 103 bp, Artificial Sequence
  Synthetic Polynucleotide
taatacgactcactatagggaaaaaatactaaacaatactcttagatgtcaacagaggagagacatcatggagtattgtaacctggcggcagcgcaaaagatg

SEQ ID NO: 60677 - DNA, 103 bp, Artificial Sequence
  Synthetic Polynucleotide
taatacgactcactatagggtttataaaaaatactaaacaatactcttagaacagaggagactaagaatgttgtttagtaacctggcggcagcgcaaaagatg

SEQ ID NO: 60678 - DNA, 103 bp, Artificial Sequence
  Synthetic Polynucleotide
taatacgactcactatagggtaatctttataaaaaatactaaacaatactaacagaggagaagtattatgtagtattttaacctggcggcagcgcaaaagatg

SEQ ID NO: 60679 - DNA, 103 bp, Artificial Sequence
  Synthetic Polynucleotide
taatacgactcactatagggcccaataatctttataaaaaatactaaacaaacagaggagatgtttaatgttttttataaacctggcggcagcgcaaaagatg

SEQ ID NO: 60680 - DNA, 103 bp, Artificial Sequence
  Synthetic Polynucleotide
taatacgactcactatagggaaaaaataaaactagagattgaaacgtgttaacagaggagaaacacgatgcaatctctaaacctggcggcagcgcaaaagatg

SEQ ID NO: 60681 - DNA, 103 bp, Artificial Sequence
  Synthetic Polynucleotide
taatacgactcactatagggtatttgtttagattttgacaataacgtataaacagaggagatatacgatgttgtcaaaaaacctggcggcagcgcaaaagatg

SEQ ID NO: 60682 - DNA, 103 bp, Artificial Sequence
  Synthetic Polynucleotide
taatacgactcactataggggtaaatcacgaggatgttacagctatgataaacagaggagatatcatatgtgtaacatcaacctggcggcagcgcaaaagatg

SEQ ID NO: 60683 - DNA, 103 bp, Artificial Sequence
  Synthetic Polynucleotide
taatacgactcactatagggacttacccaataatctttataaaaaatactaacagaggagaagtattatgtataaagataacctggcggcagcgcaaaagatg

SEQ ID NO: 60684 - DNA, 103 bp, Artificial Sequence
  Synthetic Polynucleotide
taatacgactcactatagggtttaaacttacccaataatctttataaaaaaacagaggagatttttaatgagattattgaacctggcggcagcgcaaaagatg

SEQ ID NO: 60685 - DNA, 103 bp, Artificial Sequence
  Synthetic Polynucleotide
taatacgactcactatagggtcttttttaaacttacccaataatctttataacagaggagaataaagatgattgggtaaaacctggcggcagcgcaaaagatg

SEQ ID NO: 60686 - DNA, 103 bp, Artificial Sequence
  Synthetic Polynucleotide
taatacgactcactatagggattggtcttttttaaacttacccaataatcaacagaggagagattatatggtaagtttaaacctggcggcagcgcaaaagatg

SEQ ID NO: 60687 - DNA, 103 bp, Artificial Sequence
  Synthetic Polynucleotide
taatacgactcactatagggttattattggtcttttttaaacttacccaaaacagaggagattgggtatgtttaaaaaaaacctggcggcagcgcaaaagatg

SEQ ID NO: 60688 - DNA, 103 bp, Artificial Sequence
  Synthetic Polynucleotide
taatacgactcactatagggaccatttattattggtcttttttaaacttaaacagaggagataagttatgaaaagaccaaacctggcggcagcgcaaaagatg

SEQ ID NO: 60689 - DNA, 103 bp, Artificial Sequence
  Synthetic Polynucleotide
taatacgactcactatagggatctaaccatttattattggtcttttttaaaacagaggagattaaaaatgaccaataataacctggcggcagcgcaaaagatg

SEQ ID NO: 60690 - DNA, 103 bp, Artificial Sequence
  Synthetic Polynucleotide
taatacgactcactatagggttaatatctaaccatttattattggtctttaacagaggagaaaagacatgtaataaatgaacctggcggcagcgcaaaagatg

SEQ ID NO: 60691 - DNA, 103 bp, Artificial Sequence
  Synthetic Polynucleotide
taatacgactcactatagggcattattaatatctaaccatttattattggaacagaggagaccaataatgaatggttagaacctggcggcagcgcaaaagatg

SEQ ID NO: 60692 - DNA, 103 bp, Artificial Sequence
  Synthetic Polynucleotide
taatacgactcactatagggtttatcattattaatatctaaccatttattaacagaggagaaataaaatgttagatattaacctggcggcagcgcaaaagatg

SEQ ID NO: 60693 - DNA, 103 bp, Artificial Sequence
  Synthetic Polynucleotide
taatacgactcactatagggtcaacgtaaatcacgaggatgttacagctaaacagaggagatagctgatgcatcctcgtaacctggcggcagcgcaaaagatg

SEQ ID NO: 60694 - DNA, 103 bp, Artificial Sequence
  Synthetic Polynucleotide
taatacgactcactatagggatatctttatcattattaatatctaaccataacagaggagaatggttatgtattaataaaacctggcggcagcgcaaaagatg

SEQ ID NO: 60695 - DNA, 103 bp, Artificial Sequence
  Synthetic Polynucleotide
taatacgactcactatagggtatctatatctttatcattattaatatctaaacagaggagatagataatgataatgataaacctggcggcagcgcaaaagatg

SEQ ID NO: 60696 - DNA, 103 bp, Artificial Sequence
  Synthetic Polynucleotide
taatacgactcactatagggactaatatctatatctttatcattattaataacagaggagaattaatatggataaagataacctggcggcagcgcaaaagatg

SEQ ID NO: 60697 - DNA, 103 bp, Artificial Sequence
  Synthetic Polynucleotide
taatacgactcactatagggaatttactaatatctatatctttatcattaaacagaggagataatgaatgagatatagaaacctggcggcagcgcaaaagatg

SEQ ID NO: 60698 - DNA, 103 bp, Artificial Sequence
  Synthetic Polynucleotide
taatacgactcactatagggttgttaatttactaatatctatatctttataacagaggagaataaagatgtagatattaaacctggcggcagcgcaaaagatg

SEQ ID NO: 60699 - DNA, 103 bp, Artificial Sequence
  Synthetic Polynucleotide
taatacgactcactatagggaaaatttgttaatttactaatatctatatcaacagaggagagatataatgattagtaaaaacctggcggcagcgcaaaagatg

SEQ ID NO: 60700 - DNA, 103 bp, Artificial Sequence
  Synthetic Polynucleotide
taatacgactcactatagggtgtttaaaatttgttaatttactaatatctaacagaggagaagatatatgtaaattaacaacctggcggcagcgcaaaagatg

SEQ ID NO: 60701 - DNA, 103 bp, Artificial Sequence
  Synthetic Polynucleotide
taatacgactcactatagggttagttgtttaaaatttgttaatttactaaaacagaggagattagtaatgtaacaaattaacctggcggcagcgcaaaagatg

SEQ ID NO: 60702 - DNA, 103 bp, Artificial Sequence
  Synthetic Polynucleotide
taatacgactcactatagggactgtttagttgtttaaaatttgttaatttaacagaggagaaaattaatgaattttaaaaacctggcggcagcgcaaaagatg

SEQ ID NO: 60703 - DNA, 103 bp, Artificial Sequence
  Synthetic Polynucleotide
taatacgactcactataggggttgtactgtttagttgtttaaaatttgttaacagaggagaaacaaaatgtaaacaactaacctggcggcagcgcaaaagatg

SEQ ID NO: 60704 - DNA, 103 bp, Artificial Sequence
  Synthetic Polynucleotide
taatacgactcactatagggaaacgtcaacgtaaatcacgaggatgttacaacagaggagagtaacaatgtcgtgatttaacctggcggcagcgcaaaagatg

SEQ ID NO: 60705 - DNA, 103 bp, Artificial Sequence
  Synthetic Polynucleotide
taatacgactcactatagggcatccgttgtactgtttagttgtttaaaataacagaggagaattttaatgaactaaacaaacctggcggcagcgcaaaagatg

SEQ ID NO: 60706 - DNA, 103 bp, Artificial Sequence
  Synthetic Polynucleotide
taatacgactcactatagggttcagcatccgttgtactgtttagttgtttaacagaggagaaaacaaatgaacagtacaaacctggcggcagcgcaaaagatg

SEQ ID NO: 60707 - DNA, 103 bp, Artificial Sequence
  Synthetic Polynucleotide
taatacgactcactatagggcacgcttcagcatccgttgtactgtttagtaacagaggagaactaaaatgtacaacggaaacctggcggcagcgcaaaagatg

SEQ ID NO: 60708 - DNA, 103 bp, Artificial Sequence
  Synthetic Polynucleotide
taatacgactcactatagggtataacacgcttcagcatccgttgtactgtaacagaggagaacagtaatgcggatgctgaacctggcggcagcgcaaaagatg

SEQ ID NO: 60709 - DNA, 103 bp, Artificial Sequence
  Synthetic Polynucleotide
taatacgactcactataggggtatatataacacgcttcagcatccgttgtaacagaggagaacaacgatggctgaagcgaacctggcggcagcgcaaaagatg

SEQ ID NO: 60710 - DNA, 103 bp, Artificial Sequence
  Synthetic Polynucleotide
taatacgactcactataggggacttgtatatataacacgcttcagcatccaacagaggagaggatgcatgagcgtgttaaacctggcggcagcgcaaaagatg

SEQ ID NO: 60711 - DNA, 103 bp, Artificial Sequence
  Synthetic Polynucleotide
taatacgactcactatagggttccagacttgtatatataacacgcttcagaacagaggagactgaagatggttatatataacctggcggcagcgcaaaagatg

SEQ ID NO: 60712 - DNA, 103 bp, Artificial Sequence
  Synthetic Polynucleotide
taatacgactcactatagggcagttttccagacttgtatatataacacgcaacagaggagagcgtgtatgatatacaagaacctggcggcagcgcaaaagatg

SEQ ID NO: 60713 - DNA, 103 bp, Artificial Sequence
  Synthetic Polynucleotide
taatacgactcactatagggttaaccagttttccagacttgtatatataaaacagaggagattatatatgcaagtctggaacctggcggcagcgcaaaagatg

SEQ ID NO: 60714 - DNA, 103 bp, Artificial Sequence
  Synthetic Polynucleotide
taatacgactcactatagggctgttttaaccagttttccagacttgtataaacagaggagatatacaatgctggaaaacaacctggcggcagcgcaaaagatg

SEQ ID NO: 60715 - DNA, 103 bp, Artificial Sequence
  Synthetic Polynucleotide
taatacgactcactatagggcacgaaaacgtcaacgtaaatcacgaggataacagaggagaatcctcatgatttacgttaacctggcggcagcgcaaaagatg

SEQ ID NO: 60716 - DNA, 103 bp, Artificial Sequence
  Synthetic Polynucleotide
taatacgactcactatagggacatactgttttaaccagttttccagacttaacagaggagaaagtctatgaaactggttaacctggcggcagcgcaaaagatg

SEQ ID NO: 60717 - DNA, 103 bp, Artificial Sequence
  Synthetic Polynucleotide
taatacgactcactatagggcttttacatactgttttaaccagttttccaaacagaggagatggaaaatgggttaaaacaacctggcggcagcgcaaaagatg

SEQ ID NO: 60718 - DNA, 103 bp, Artificial Sequence
  Synthetic Polynucleotide
taatacgactcactataggggagtacttttacatactgttttaaccagttaacagaggagaaactggatgaaacagtataacctggcggcagcgcaaaagatg

SEQ ID NO: 60719 - DNA, 103 bp, Artificial Sequence
  Synthetic Polynucleotide
taatacgactcactatagggagattgagtacttttacatactgttttaacaacagaggagagttaaaatggtatgtaaaaacctggcggcagcgcaaaagatg

SEQ ID NO: 60720 - DNA, 103 bp, Artificial Sequence
  Synthetic Polynucleotide
taatacgactcactatagggagtacagattgagtacttttacatactgttaacagaggagaaacagtatgtaaaagtacaacctggcggcagcgcaaaagatg

SEQ ID NO: 60721 - DNA, 103 bp, Artificial Sequence
  Synthetic Polynucleotide
taatacgactcactatagggcacatagtacagattgagtacttttacataaacagaggagatatgtaatggtactcaataacctggcggcagcgcaaaagatg

SEQ ID NO: 60722 - DNA, 103 bp, Artificial Sequence
  Synthetic Polynucleotide
taatacgactcactatagggtttaacacatagtacagattgagtacttttaacagaggagaaaaagtatgcaatctgtaaacctggcggcagcgcaaaagatg

SEQ ID NO: 60723 - DNA, 103 bp, Artificial Sequence
  Synthetic Polynucleotide
taatacgactcactatagggaatcttttaacacatagtacagattgagtaaacagaggagatactcaatgtgtactatgaacctggcggcagcgcaaaagatg

SEQ ID NO: 60724 - DNA, 103 bp, Artificial Sequence
  Synthetic Polynucleotide
taatacgactcactatagggtgtagaatcttttaacacatagtacagattaacagaggagaaatctgatgtatgtgttaaacctggcggcagcgcaaaagatg

SEQ ID NO: 60725 - DNA, 103 bp, Artificial Sequence
  Synthetic Polynucleotide
taatacgactcactatagggttacttgtagaatcttttaacacatagtacaacagaggagagtactaatggttaaaagaaacctggcggcagcgcaaaagatg

SEQ ID NO: 60726 - DNA, 103 bp, Artificial Sequence
  Synthetic Polynucleotide
taatacgactcactatagggtatcccacgaaaacgtcaacgtaaatcacgaacagaggagacgtgatatgcgttgacgtaacctggcggcagcgcaaaagatg

SEQ ID NO: 60727 - DNA, 103 bp, Artificial Sequence
  Synthetic Polynucleotide
taatacgactcactatagggtgttgttacttgtagaatcttttaacacataacagaggagaatgtgtatgaagattctaaacctggcggcagcgcaaaagatg

SEQ ID NO: 60728 - DNA, 103 bp, Artificial Sequence
  Synthetic Polynucleotide
taatacgactcactatagggttttttgttgttacttgtagaatcttttaaaacagaggagattaaaaatgtctacaagtaacctggcggcagcgcaaaagatg

SEQ ID NO: 60729 - DNA, 103 bp, Artificial Sequence
  Synthetic Polynucleotide
taatacgactcactatagggttttattttttgttgttacttgtagaatctaacagaggagaagattcatgaagtaacaaaacctggcggcagcgcaaaagatg

SEQ ID NO: 60730 - DNA, 103 bp, Artificial Sequence
  Synthetic Polynucleotide
taatacgactcactatagggtattattttattttttgttgttacttgtagaacagaggagactacaaatgacaacaaaaaacctggcggcagcgcaaaagatg

SEQ ID NO: 60731 - DNA, 103 bp, Artificial Sequence
  Synthetic Polynucleotide
taatacgactcactatagggcttattattattttattttttgttgttactaacagaggagaagtaacatgaaaaaataaaacctggcggcagcgcaaaagatg

SEQ ID NO: 60732 - DNA, 103 bp, Artificial Sequence
  Synthetic Polynucleotide
taatacgactcactatagggaaggacttattattattttattttttgttgaacagaggagacaacaaatgataaaataaaacctggcggcagcgcaaaagatg

SEQ ID NO: 60733 - DNA, 103 bp, Artificial Sequence
  Synthetic Polynucleotide
taatacgactcactatagggtcgttaaggacttattattattttatttttaacagaggagaaaaaatatgataataataaacctggcggcagcgcaaaagatg

SEQ ID NO: 60734 - DNA, 103 bp, Artificial Sequence
  Synthetic Polynucleotide
taatacgactcactatagggaacgttcgttaaggacttattattattttaaacagaggagataaaatatgaataagtccaacctggcggcagcgcaaaagatg

SEQ ID NO: 60735 - DNA, 103 bp, Artificial Sequence
  Synthetic Polynucleotide
taatacgactcactatagggccatcaacgttcgttaaggacttattattaaacagaggagataataaatggtccttaacaacctggcggcagcgcaaaagatg

SEQ ID NO: 60736 - DNA, 103 bp, Artificial Sequence
  Synthetic Polynucleotide
taatacgactcactatagggggtgtccatcaacgttcgttaaggacttataacagaggagaataagtatgtaacgaacgaacctggcggcagcgcaaaagatg

SEQ ID NO: 60737 - DNA, 103 bp, Artificial Sequence
  Synthetic Polynucleotide
taatacgactcactatagggtatcttatcccacgaaaacgtcaacgtaaaaacagaggagatttacgatgacgttttcgaacctggcggcagcgcaaaagatg

SEQ ID NO: 60738 - DNA, 103 bp, Artificial Sequence
  Synthetic Polynucleotide
taatacgactcactatagggaacgtggtgtccatcaacgttcgttaaggaaacagaggagatccttaatgaacgttgataacctggcggcagcgcaaaagatg

SEQ ID NO: 60739 - DNA, 103 bp, Artificial Sequence
  Synthetic Polynucleotide
taatacgactcactatagggtaacaaacgtggtgtccatcaacgttcgttaacagaggagaaacgaaatgtgatggacaaacctggcggcagcgcaaaagatg

SEQ ID NO: 60740 - DNA, 103 bp, Artificial Sequence
  Synthetic Polynucleotide
taatacgactcactatagggagtaataacaaacgtggtgtccatcaacgtaacagaggagaacgttgatggacaccacgaacctggcggcagcgcaaaagatg

SEQ ID NO: 60741 - DNA, 103 bp, Artificial Sequence
  Synthetic Polynucleotide
taatacgactcactatagggattggagtaataacaaacgtggtgtccatcaacagaggagagatggaatgcacgtttgtaacctggcggcagcgcaaaagatg

SEQ ID NO: 60742 - DNA, 103 bp, Artificial Sequence
  Synthetic Polynucleotide
taatacgactcactatagggtacccattggagtaataacaaacgtggtgtaacagaggagaacaccaatgttgttattaaacctggcggcagcgcaaaagatg

SEQ ID NO: 60743 - DNA, 103 bp, Artificial Sequence
  Synthetic Polynucleotide
taatacgactcactatagggcagcatacccattggagtaataacaaacgtaacagaggagaacgtttatgattactccaaacctggcggcagcgcaaaagatg

SEQ ID NO: 60744 - DNA, 103 bp, Artificial Sequence
  Synthetic Polynucleotide
taatacgactcactatagggatagtcagcatacccattggagtaataacaaacagaggagatgttatatgtccaatgggaacctggcggcagcgcaaaagatg

SEQ ID NO: 60745 - DNA, 103 bp, Artificial Sequence
  Synthetic Polynucleotide
taatacgactcactatagggctgttatagtcagcatacccattggagtaaaacagaggagattactcatgtgggtatgcaacctggcggcagcgcaaaagatg

SEQ ID NO: 60746 - DNA, 103 bp, Artificial Sequence
  Synthetic Polynucleotide
taatacgactcactatagggtgtatctgttatagtcagcatacccattggaacagaggagaccaatgatgatgctgactaacctggcggcagcgcaaaagatg

SEQ ID NO: 60747 - DNA, 103 bp, Artificial Sequence
  Synthetic Polynucleotide
taatacgactcactatagggtataatgtatctgttatagtcagcatacccaacagaggagagggtatatggactataacaacctggcggcagcgcaaaagatg

SEQ ID NO: 60748 - DNA, 103 bp, Artificial Sequence
  Synthetic Polynucleotide
taatacgactcactatagggacaactatcttatcccacgaaaacgtcaacaacagaggagagttgacatgttcgtgggaaacctggcggcagcgcaaaagatg

SEQ ID NO: 60749 - DNA, 103 bp, Artificial Sequence
  Synthetic Polynucleotide
taatacgactcactatagggcatcatataatgtatctgttatagtcagcaaacagaggagatgctgaatgtaacagataaacctggcggcagcgcaaaagatg

SEQ ID NO: 60750 - DNA, 103 bp, Artificial Sequence
  Synthetic Polynucleotide
taatacgactcactataggggagatcatcatataatgtatctgttatagtaacagaggagaactataatggatacattaaacctggcggcagcgcaaaagatg

SEQ ID NO: 60751 - DNA, 103 bp, Artificial Sequence
  Synthetic Polynucleotide
taatacgactcactatagggatatcgagatcatcatataatgtatctgttaacagaggagaaacagaatgattatatgaaacctggcggcagcgcaaaagatg

SEQ ID NO: 60752 - DNA, 103 bp, Artificial Sequence
  Synthetic Polynucleotide
taatacgactcactatagggttgagatatcgagatcatcatataatgtataacagaggagaatacatatgatgatgatcaacctggcggcagcgcaaaagatg

SEQ ID NO: 60753 - DNA, 103 bp, Artificial Sequence
  Synthetic Polynucleotide
taatacgactcactatagggcattattgagatatcgagatcatcatataaaacagaggagattatatatggatctcgataacctggcggcagcgcaaaagatg

SEQ ID NO: 60754 - DNA, 103 bp, Artificial Sequence
  Synthetic Polynucleotide
taatacgactcactatagggaagtccattattgagatatcgagatcatcaaacagaggagatgatgaatgcgatatctcaacctggcggcagcgcaaaagatg

SEQ ID NO: 60755 - DNA, 103 bp, Artificial Sequence
  Synthetic Polynucleotide
taatacgactcactatagggctataaagtccattattgagatatcgagataacagaggagaatctcgatgtctcaataaaacctggcggcagcgcaaaagatg

SEQ ID NO: 60756 - DNA, 103 bp, Artificial Sequence
  Synthetic Polynucleotide
taatacgactcactatagggtggtcctataaagtccattattgagatatcaacagaggagagatatcatgataatggacaacctggcggcagcgcaaaagatg

SEQ ID NO: 60757 - DNA, 103 bp, Artificial Sequence
  Synthetic Polynucleotide
taatacgactcactatagggatgtatggtcctataaagtccattattgagaacagaggagactcaatatgggactttataacctggcggcagcgcaaaagatg

SEQ ID NO: 60758 - DNA, 103 bp, Artificial Sequence
  Synthetic Polynucleotide
taatacgactcactatagggctataatgtatggtcctataaagtccattaaacagaggagataatggatgttataggacaacctggcggcagcgcaaaagatg

SEQ ID NO: 60759 - DNA, 103 bp, Artificial Sequence
  Synthetic Polynucleotide
taatacgactcactataggggatgaacaactatcttatcccacgaaaacgaacagaggagacgttttatggggataagaaacctggcggcagcgcaaaagatg

SEQ ID NO: 60760 - DNA, 103 bp, Artificial Sequence
  Synthetic Polynucleotide
taatacgactcactataggggttacctataatgtatggtcctataaagtcaacagaggagagactttatgggaccatacaacctggcggcagcgcaaaagatg

SEQ ID NO: 60761 - DNA, 103 bp, Artificial Sequence
  Synthetic Polynucleotide
taatacgactcactatagggtttatgttacctataatgtatggtcctataaacagaggagatataggatgatacattataacctggcggcagcgcaaaagatg

SEQ ID NO: 60762 - DNA, 103 bp, Artificial Sequence
  Synthetic Polynucleotide
taatacgactcactatagggcagtttttatgttacctataatgtatggtcaacagaggagagaccatatgttataggtaaacctggcggcagcgcaaaagatg

SEQ ID NO: 60763 - DNA, 103 bp, Artificial Sequence
  Synthetic Polynucleotide
taatacgactcactatagggttggacagtttttatgttacctataatgtaaacagaggagatacattatgggtaacataaacctggcggcagcgcaaaagatg

SEQ ID NO: 60764 - DNA, 103 bp, Artificial Sequence
  Synthetic Polynucleotide
taatacgactcactatagggtctatttggacagtttttatgttacctataaacagaggagatataggatgcataaaaacaacctggcggcagcgcaaaagatg

SEQ ID NO: 60765 - DNA, 103 bp, Artificial Sequence
  Synthetic Polynucleotide
taatacgactcactataggggtacatctatttggacagtttttatgttacaacagaggagagtaacaatgaaactgtccaacctggcggcagcgcaaaagatg

SEQ ID NO: 60766 - DNA, 103 bp, Artificial Sequence
  Synthetic Polynucleotide
taatacgactcactatagggatcccgtacatctatttggacagtttttataacagaggagaataaaaatggtccaaataaacctggcggcagcgcaaaagatg

SEQ ID NO: 60767 - DNA, 103 bp, Artificial Sequence
  Synthetic Polynucleotide
taatacgactcactatagggtttatatcccgtacatctatttggacagttaacagaggagaaactgtatgaatagatgtaacctggcggcagcgcaaaagatg

SEQ ID NO: 60768 - DNA, 103 bp, Artificial Sequence
  Synthetic Polynucleotide
taatacgactcactatagggaatattttatatcccgtacatctatttggaaacagaggagatccaaaatgatgtacgggaacctggcggcagcgcaaaagatg

SEQ ID NO: 60769 - DNA, 103 bp, Artificial Sequence
  Synthetic Polynucleotide
taatacgactcactataggggtcggaatattttatatcccgtacatctataacagaggagaatagatatgcgggatataaacctggcggcagcgcaaaagatg

SEQ ID NO: 60770 - DNA, 103 bp, Artificial Sequence
  Synthetic Polynucleotide
taatacgactcactatagggcaaaggatgaacaactatcttatcccacgaaacagaggagatcgtggatgaagatagttaacctggcggcagcgcaaaagatg

SEQ ID NO: 60771 - DNA, 103 bp, Artificial Sequence
  Synthetic Polynucleotide
taatacgactcactatagggtgcatgtcggaatattttatatcccgtacaaacagaggagatgtacgatgtataaaataaacctggcggcagcgcaaaagatg

SEQ ID NO: 60772 - DNA, 103 bp, Artificial Sequence
  Synthetic Polynucleotide
taatacgactcactatagggatttttgcatgtcggaatattttatatcccaacagaggagagggataatgaatattccgaacctggcggcagcgcaaaagatg

SEQ ID NO: 60773 - DNA, 103 bp, Artificial Sequence
  Synthetic Polynucleotide
taatacgactcactataggggtagcatttttgcatgtcggaatattttataacagaggagaataaaaatgtccgacatgaacctggcggcagcgcaaaagatg

SEQ ID NO: 60774 - DNA, 103 bp, Artificial Sequence
  Synthetic Polynucleotide
taatacgactcactatagggctaaagtagcatttttgcatgtcggaatataacagaggagaatattcatgcatgcaaaaaacctggcggcagcgcaaaagatg

SEQ ID NO: 60775 - DNA, 103 bp, Artificial Sequence
  Synthetic Polynucleotide
taatacgactcactatagggcttagctaaagtagcatttttgcatgtcggaacagaggagaccgacaatgaaaaatgctaacctggcggcagcgcaaaagatg

SEQ ID NO: 60776 - DNA, 103 bp, Artificial Sequence
  Synthetic Polynucleotide
taatacgactcactatagggttacccttagctaaagtagcatttttgcataacagaggagaatgcaaatgtgctactttaacctggcggcagcgcaaaagatg

SEQ ID NO: 60777 - DNA, 103 bp, Artificial Sequence
  Synthetic Polynucleotide
taatacgactcactatagggctattttacccttagctaaagtagcattttaacagaggagaaaaatgatgctttagctaaacctggcggcagcgcaaaagatg

SEQ ID NO: 60778 - DNA, 103 bp, Artificial Sequence
  Synthetic Polynucleotide
taatacgactcactatagggaggaactattttacccttagctaaagtagcaacagaggagagctactatggctaagggtaacctggcggcagcgcaaaagatg

SEQ ID NO: 60779 - DNA, 103 bp, Artificial Sequence
  Synthetic Polynucleotide
taatacgactcactatagggtcctaaggaactattttacccttagctaaaaacagaggagatttagcatggggtaaaataacctggcggcagcgcaaaagatg

SEQ ID NO: 60780 - DNA, 103 bp, Artificial Sequence
  Synthetic Polynucleotide
taatacgactcactatagggtagaatcctaaggaactattttacccttagaacagaggagactaaggatgaaatagttcaacctggcggcagcgcaaaagatg

SEQ ID NO: 60781 - DNA, 103 bp, Artificial Sequence
  Synthetic Polynucleotide
taatacgactcactatagggattatcaaaggatgaacaactatcttatccaacagaggagaggataaatgagttgttcaaacctggcggcagcgcaaaagatg

SEQ ID NO: 60782 - DNA, 103 bp, Artificial Sequence
  Synthetic Polynucleotide
taatacgactcactatagggatcattagaatcctaaggaactattttaccaacagaggagaggtaaaatggttccttagaacctggcggcagcgcaaaagatg

SEQ ID NO: 60783 - DNA, 103 bp, Artificial Sequence
  Synthetic Polynucleotide
taatacgactcactatagggaccaaatcattagaatcctaaggaactattaacagaggagaaatagtatgttaggattcaacctggcggcagcgcaaaagatg

SEQ ID NO: 60784 - DNA, 103 bp, Artificial Sequence
  Synthetic Polynucleotide
taatacgactcactatagggatctaaccaaatcattagaatcctaaggaaaacagaggagattccttatgattctaatgaacctggcggcagcgcaaaagatg

SEQ ID NO: 60785 - DNA, 103 bp, Artificial Sequence
  Synthetic Polynucleotide
taatacgactcactataggggttgaatctaaccaaatcattagaatcctaaacagaggagataggatatgaatgatttgaacctggcggcagcgcaaaagatg

SEQ ID NO: 60786 - DNA, 103 bp, Artificial Sequence
  Synthetic Polynucleotide
taatacgactcactatagggtaaatgttgaatctaaccaaatcattagaaaacagaggagattctaaatgtttggttagaacctggcggcagcgcaaaagatg

SEQ ID NO: 60787 - DNA, 103 bp, Artificial Sequence
  Synthetic Polynucleotide
taatacgactcactatagggtgctataaatgttgaatctaaccaaatcataacagaggagaatgattatgttagattcaaacctggcggcagcgcaaaagatg

SEQ ID NO: 60788 - DNA, 103 bp, Artificial Sequence
  Synthetic Polynucleotide
taatacgactcactatagggacaaatgctataaatgttgaatctaaccaaaacagaggagattggttatgttcaacattaacctggcggcagcgcaaaagatg

SEQ ID NO: 60789 - DNA, 103 bp, Artificial Sequence
  Synthetic Polynucleotide
taatacgactcactataggggcggtacaaatgctataaatgttgaatctaaacagaggagatagattatgcatttatagaacctggcggcagcgcaaaagatg

SEQ ID NO: 60790 - DNA, 103 bp, Artificial Sequence
  Synthetic Polynucleotide
taatacgactcactatagggtgtatgcggtacaaatgctataaatgttgaaacagaggagatcaacaatgatagcatttaacctggcggcagcgcaaaagatg

SEQ ID NO: 60791 - DNA, 103 bp, Artificial Sequence
  Synthetic Polynucleotide
taatacgactcactatagggtgatctgtatgcggtacaaatgctataaataacagaggagaatttatatgatttgtaccaacctggcggcagcgcaaaagatg

SEQ ID NO: 60792 - DNA, 103 bp, Artificial Sequence
  Synthetic Polynucleotide
taatacgactcactataggggccaatatttgtttagattttgacaataacaacagaggagagttattatgaaaatctaaaacctggcggcagcgcaaaagatg

SEQ ID NO: 60793 - DNA, 103 bp, Artificial Sequence
  Synthetic Polynucleotide
taatacgactcactatagggggaaaattatcaaaggatgaacaactatctaacagaggagaagatagatgttcatccttaacctggcggcagcgcaaaagatg

SEQ ID NO: 60794 - DNA, 103 bp, Artificial Sequence
  Synthetic Polynucleotide
taatacgactcactatagggatttttgatctgtatgcggtacaaatgctaaacagaggagatagcatatgtaccgcataaacctggcggcagcgcaaaagatg

SEQ ID NO: 60795 - DNA, 103 bp, Artificial Sequence
  Synthetic Polynucleotide
taatacgactcactatagggatggtatttttgatctgtatgcggtacaaaaacagaggagatttgtaatgcatacagataacctggcggcagcgcaaaagatg

SEQ ID NO: 60796 - DNA, 103 bp, Artificial Sequence
  Synthetic Polynucleotide
taatacgactcactatagggtgatgatggtatttttgatctgtatgcggtaacagaggagaaccgcaatgagatcaaaaaacctggcggcagcgcaaaagatg

SEQ ID NO: 60797 - DNA, 103 bp, Artificial Sequence
  Synthetic Polynucleotide
taatacgactcactatagggtgctatgatgatggtatttttgatctgtataacagaggagaatacagatgaaaaataccaacctggcggcagcgcaaaagatg

SEQ ID NO: 60798 - DNA, 103 bp, Artificial Sequence
  Synthetic Polynucleotide
taatacgactcactatagggtcgcatgctatgatgatggtatttttgatcaacagaggagagatcaaatgtaccatcataacctggcggcagcgcaaaagatg

SEQ ID NO: 60799 - DNA, 103 bp, Artificial Sequence
  Synthetic Polynucleotide
taatacgactcactatagggcatagtcgcatgctatgatgatggtattttaacagaggagaaaaataatgtcatcatagaacctggcggcagcgcaaaagatg

SEQ ID NO: 60800 - DNA, 103 bp, Artificial Sequence
  Synthetic Polynucleotide
taatacgactcactatagggggtatcatagtcgcatgctatgatgatggtaacagaggagaaccatcatgatagcatgcaacctggcggcagcgcaaaagatg

SEQ ID NO: 60801 - DNA, 103 bp, Artificial Sequence
  Synthetic Polynucleotide
taatacgactcactatagggaacatggtatcatagtcgcatgctatgatgaacagaggagacatcatatgatgcgactaaacctggcggcagcgcaaaagatg

SEQ ID NO: 60802 - DNA, 103 bp, Artificial Sequence
  Synthetic Polynucleotide
taatacgactcactatagggtatctaacatggtatcatagtcgcatgctaaacagaggagatagcatatgactatgataaacctggcggcagcgcaaaagatg

SEQ ID NO: 60803 - DNA, 103 bp, Artificial Sequence
  Synthetic Polynucleotide
taatacgactcactatagggttctatatctaacatggtatcatagtcgcaaacagaggagatgcgacatggataccatgaacctggcggcagcgcaaaagatg

SEQ ID NO: 60804 - DNA, 103 bp, Artificial Sequence
  Synthetic Polynucleotide
taatacgactcactatagggaatttggaaaattatcaaaggatgaacaacaacagaggagagttgttatgcctttgataaacctggcggcagcgcaaaagatg

SEQ ID NO: 60805 - DNA, 103 bp, Artificial Sequence
  Synthetic Polynucleotide
taatacgactcactatagggttaccttctatatctaacatggtatcatagaacagaggagactatgaatgcatgttagaaacctggcggcagcgcaaaagatg

SEQ ID NO: 60806 - DNA, 103 bp, Artificial Sequence
  Synthetic Polynucleotide
taatacgactcactataggggatgtttaccttctatatctaacatggtataacagaggagaataccaatgtagatatagaacctggcggcagcgcaaaagatg

SEQ ID NO: 60807 - DNA, 103 bp, Artificial Sequence
  Synthetic Polynucleotide
taatacgactcactatagggtggctgatgtttaccttctatatctaacataacagaggagaatgttaatgatagaaggtaacctggcggcagcgcaaaagatg

SEQ ID NO: 60808 - DNA, 103 bp, Artificial Sequence
  Synthetic Polynucleotide
taatacgactcactatagggtaaaatggctgatgtttaccttctatatctaacagaggagaagatatatgaggtaaacaaacctggcggcagcgcaaaagatg

SEQ ID NO: 60809 - DNA, 103 bp, Artificial Sequence
  Synthetic Polynucleotide
taatacgactcactatagggatagataaaatggctgatgtttaccttctaaacagaggagatagaagatgaacatcagcaacctggcggcagcgcaaaagatg

SEQ ID NO: 60810 - DNA, 103 bp, Artificial Sequence
  Synthetic Polynucleotide
taatacgactcactatagggtgtaaatagataaaatggctgatgtttaccaacagaggagaggtaaaatgcagccatttaacctggcggcagcgcaaaagatg

SEQ ID NO: 60811 - DNA, 103 bp, Artificial Sequence
  Synthetic Polynucleotide
taatacgactcactatagggatagatgtaaatagataaaatggctgatgtaacagaggagaacatcaatgattttatctaacctggcggcagcgcaaaagatg

SEQ ID NO: 60812 - DNA, 103 bp, Artificial Sequence
  Synthetic Polynucleotide
taatacgactcactatagggcatcaatagatgtaaatagataaaatggctaacagaggagaagccatatgatctatttaaacctggcggcagcgcaaaagatg

SEQ ID NO: 60813 - DNA, 103 bp, Artificial Sequence
  Synthetic Polynucleotide
taatacgactcactatagggaaaaacatcaatagatgtaaatagataaaaaacagaggagattttatatgtttacatctaacctggcggcagcgcaaaagatg

SEQ ID NO: 60814 - DNA, 103 bp, Artificial Sequence
  Synthetic Polynucleotide
taatacgactcactataggggcgttaaaaacatcaatagatgtaaatagaaacagaggagatctattatgatctattgaaacctggcggcagcgcaaaagatg

SEQ ID NO: 60815 - DNA, 103 bp, Artificial Sequence
  Synthetic Polynucleotide
taatacgactcactatagggtccagaatttggaaaattatcaaaggatgaaacagaggagatcatccatggataattttaacctggcggcagcgcaaaagatg

SEQ ID NO: 60816 - DNA, 103 bp, Artificial Sequence
  Synthetic Polynucleotide
taatacgactcactatagggttgtagcgttaaaaacatcaatagatgtaaaacagaggagattacatatgttgatgtttaacctggcggcagcgcaaaagatg

SEQ ID NO: 60817 - DNA, 103 bp, Artificial Sequence
  Synthetic Polynucleotide
taatacgactcactatagggtatgattgtagcgttaaaaacatcaatagaaacagaggagatctattatggtttttaacaacctggcggcagcgcaaaagatg

SEQ ID NO: 60818 - DNA, 103 bp, Artificial Sequence
  Synthetic Polynucleotide
taatacgactcactataggggcttctatgattgtagcgttaaaaacatcaaacagaggagatgatgtatgtaacgctacaacctggcggcagcgcaaaagatg

SEQ ID NO: 60819 - DNA, 103 bp, Artificial Sequence
  Synthetic Polynucleotide
taatacgactcactatagggtatacgcttctatgattgtagcgttaaaaaaacagaggagatttttaatgctacaatcaaacctggcggcagcgcaaaagatg

SEQ ID NO: 60820 - DNA, 103 bp, Artificial Sequence
  Synthetic Polynucleotide
taatacgactcactatagggcaggttatacgcttctatgattgtagcgttaacagaggagaaacgctatgatcatagaaaacctggcggcagcgcaaaagatg

SEQ ID NO: 60821 - DNA, 103 bp, Artificial Sequence
  Synthetic Polynucleotide
taatacgactcactataggggtatacaggttatacgcttctatgattgtaaacagaggagatacaatatgagaagcgtaaacctggcggcagcgcaaaagatg

SEQ ID NO: 60822 - DNA, 103 bp, Artificial Sequence
  Synthetic Polynucleotide
taatacgactcactatagggcagctgtatacaggttatacgcttctatgaaacagaggagatcatagatgcgtataaccaacctggcggcagcgcaaaagatg

SEQ ID NO: 60823 - DNA, 103 bp, Artificial Sequence
  Synthetic Polynucleotide
taatacgactcactatagggatctccagctgtatacaggttatacgcttcaacagaggagagaagcgatgaacctgtataacctggcggcagcgcaaaagatg

SEQ ID NO: 60824 - DNA, 103 bp, Artificial Sequence
  Synthetic Polynucleotide
taatacgactcactatagggtgataatctccagctgtatacaggttatacaacagaggagagtataaatggtatacagcaacctggcggcagcgcaaaagatg

SEQ ID NO: 60825 - DNA, 103 bp, Artificial Sequence
  Synthetic Polynucleotide
taatacgactcactatagggtcagatgataatctccagctgtatacaggtaacagaggagaacctgtatgcagctggagaacctggcggcagcgcaaaagatg

SEQ ID NO: 60826 - DNA, 103 bp, Artificial Sequence
  Synthetic Polynucleotide
taatacgactcactatagggtccaatccagaatttggaaaattatcaaagaacagaggagactttgaatgttttccaaaaacctggcggcagcgcaaaagatg

SEQ ID NO: 60827 - DNA, 103 bp, Artificial Sequence
  Synthetic Polynucleotide
taatacgactcactataggggatgatcagatgataatctccagctgtataaacagaggagatatacaatgggagattataacctggcggcagcgcaaaagatg

SEQ ID NO: 60828 - DNA, 103 bp, Artificial Sequence
  Synthetic Polynucleotide
taatacgactcactatagggggattgatgatcagatgataatctccagctaacagaggagaagctggatgttatcatctaacctggcggcagcgcaaaagatg

SEQ ID NO: 60829 - DNA, 103 bp, Artificial Sequence
  Synthetic Polynucleotide
taatacgactcactatagggctgaaggattgatgatcagatgataatctcaacagaggagagagattatgatctgatcaaacctggcggcagcgcaaaagatg

SEQ ID NO: 60830 - DNA, 103 bp, Artificial Sequence
  Synthetic Polynucleotide
taatacgactcactatagggattatctgaaggattgatgatcagatgataaacagaggagatatcatatgatcatcaataacctggcggcagcgcaaaagatg

SEQ ID NO: 60831 - DNA, 103 bp, Artificial Sequence
  Synthetic Polynucleotide
taatacgactcactatagggttcagattatctgaaggattgatgatcagaaacagaggagatctgatatgcaatccttcaacctggcggcagcgcaaaagatg

SEQ ID NO: 60832 - DNA, 103 bp, Artificial Sequence
  Synthetic Polynucleotide
taatacgactcactatagggtcattttcagattatctgaaggattgatgaaacagaggagatcatcaatgcttcagataaacctggcggcagcgcaaaagatg

SEQ ID NO: 60833 - DNA, 103 bp, Artificial Sequence
  Synthetic Polynucleotide
taatacgactcactatagggcaatttcattttcagattatctgaaggattaacagaggagaaatcctatggataatctgaacctggcggcagcgcaaaagatg

SEQ ID NO: 60834 - DNA, 103 bp, Artificial Sequence
  Synthetic Polynucleotide
taatacgactcactatagggaactacaatttcattttcagattatctgaaaacagaggagattcagaatgtctgaaaataacctggcggcagcgcaaaagatg

SEQ ID NO: 60835 - DNA, 103 bp, Artificial Sequence
  Synthetic Polynucleotide
taatacgactcactatagggaattaaactacaatttcattttcagattataacagaggagaataatcatgaaatgaaataacctggcggcagcgcaaaagatg

SEQ ID NO: 60836 - DNA, 103 bp, Artificial Sequence
  Synthetic Polynucleotide
taatacgactcactatagggtgaagaattaaactacaatttcattttcagaacagaggagactgaaaatgaaattgtagaacctggcggcagcgcaaaagatg

SEQ ID NO: 60837 - DNA, 103 bp, Artificial Sequence
  Synthetic Polynucleotide
taatacgactcactatagggtgacatccaatccagaatttggaaaattataacagaggagaataattatgcaaattctgaacctggcggcagcgcaaaagatg

SEQ ID NO: 60838 - DNA, 103 bp, Artificial Sequence
  Synthetic Polynucleotide
taatacgactcactatagggcagaatgaagaattaaactacaatttcattaacagaggagaaatgaaatggtagtttaaaacctggcggcagcgcaaaagatg

SEQ ID NO: 60839 - DNA, 103 bp, Artificial Sequence
  Synthetic Polynucleotide
taatacgactcactatagggatatgcagaatgaagaattaaactacaattaacagaggagaaattgtatgttaattcttaacctggcggcagcgcaaaagatg

SEQ ID NO: 60840 - DNA, 103 bp, Artificial Sequence
  Synthetic Polynucleotide
taatacgactcactataggggtttgatatgcagaatgaagaattaaactaaacagaggagatagtttatgtcttcattcaacctggcggcagcgcaaaagatg

SEQ ID NO: 60841 - DNA, 103 bp, Artificial Sequence
  Synthetic Polynucleotide
taatacgactcactatagggttgccgtttgatatgcagaatgaagaattaaacagaggagataattcatgattctgcataacctggcggcagcgcaaaagatg

SEQ ID NO: 60842 - DNA, 103 bp, Artificial Sequence
  Synthetic Polynucleotide
taatacgactcactatagggatccattgccgtttgatatgcagaatgaagaacagaggagacttcatatggcatatcaaaacctggcggcagcgcaaaagatg

SEQ ID NO: 60843 - DNA, 103 bp, Artificial Sequence
  Synthetic Polynucleotide
taatacgactcactataggggatccatccattgccgtttgatatgcagaaaacagaggagattctgcatgtcaaacggcaacctggcggcagcgcaaaagatg

SEQ ID NO: 60844 - DNA, 103 bp, Artificial Sequence
  Synthetic Polynucleotide
taatacgactcactatagggattatgatccatccattgccgtttgatatgaacagaggagacatatcatgcggcaatggaacctggcggcagcgcaaaagatg

SEQ ID NO: 60845 - DNA, 103 bp, Artificial Sequence
  Synthetic Polynucleotide
taatacgactcactatagggcatcaattatgatccatccattgccgtttgaacagaggagacaaacgatgatggatggaaacctggcggcagcgcaaaagatg

SEQ ID NO: 60846 - DNA, 103 bp, Artificial Sequence
  Synthetic Polynucleotide
taatacgactcactatagggtttcccatcaattatgatccatccattgccaacagaggagaggcaatatgtggatcataaacctggcggcagcgcaaaagatg

SEQ ID NO: 60847 - DNA, 103 bp, Artificial Sequence
  Synthetic Polynucleotide
taatacgactcactatagggttgcatttcccatcaattatgatccatccaaacagaggagatggatgatgcataattgaaacctggcggcagcgcaaaagatg

SEQ ID NO: 60848 - DNA, 103 bp, Artificial Sequence
  Synthetic Polynucleotide
taatacgactcactatagggtgcagtgacatccaatccagaatttggaaaaacagaggagatttccaatgtctggattgaacctggcggcagcgcaaaagatg

SEQ ID NO: 60849 - DNA, 103 bp, Artificial Sequence
  Synthetic Polynucleotide
taatacgactcactatagggtactattgcatttcccatcaattatgatccaacagaggagaggatcaatgttgatgggaaacctggcggcagcgcaaaagatg

SEQ ID NO: 60850 - DNA, 103 bp, Artificial Sequence
  Synthetic Polynucleotide
taatacgactcactatagggaaaattactattgcatttcccatcaattataacagaggagaataattatggggaaatgcaacctggcggcagcgcaaaagatg

SEQ ID NO: 60851 - DNA, 103 bp, Artificial Sequence
  Synthetic Polynucleotide
taatacgactcactataggggataaaaaattactattgcatttcccatcaaacagaggagatgatggatgatgcaatagaacctggcggcagcgcaaaagatg

SEQ ID NO: 60852 - DNA, 103 bp, Artificial Sequence
  Synthetic Polynucleotide
taatacgactcactatagggtttatgataaaaaattactattgcatttccaacagaggagaggaaatatgatagtaattaacctggcggcagcgcaaaagatg

SEQ ID NO: 60853 - DNA, 103 bp, Artificial Sequence
  Synthetic Polynucleotide
taatacgactcactatagggcaacttttatgataaaaaattactattgcaaacagaggagatgcaatatgaattttttaaacctggcggcagcgcaaaagatg

SEQ ID NO: 60854 - DNA, 103 bp, Artificial Sequence
  Synthetic Polynucleotide
taatacgactcactatagggctttacaacttttatgataaaaaattactaaacagaggagatagtaaatgtttatcataaacctggcggcagcgcaaaagatg

SEQ ID NO: 60855 - DNA, 103 bp, Artificial Sequence
  Synthetic Polynucleotide
taatacgactcactatagggatttactttacaacttttatgataaaaaataacagaggagaatttttatgcataaaagtaacctggcggcagcgcaaaagatg

SEQ ID NO: 60856 - DNA, 103 bp, Artificial Sequence
  Synthetic Polynucleotide
taatacgactcactatagggttattatttactttacaacttttatgataaaacagaggagattatcaatgaagttgtaaaacctggcggcagcgcaaaagatg

SEQ ID NO: 60857 - DNA, 103 bp, Artificial Sequence
  Synthetic Polynucleotide
taatacgactcactatagggttgttttattatttactttacaacttttataacagaggagaataaaaatggtaaagtaaaacctggcggcagcgcaaaagatg

SEQ ID NO: 60858 - DNA, 103 bp, Artificial Sequence
  Synthetic Polynucleotide
taatacgactcactatagggatttattgttttattatttactttacaactaacagaggagaagttgtatggtaaataataacctggcggcagcgcaaaagatg

SEQ ID NO: 60859 - DNA, 103 bp, Artificial Sequence
  Synthetic Polynucleotide
taatacgactcactatagggattactgcagtgacatccaatccagaatttaacagaggagaaaattcatgattggatgtaacctggcggcagcgcaaaagatg

SEQ ID NO: 60860 - DNA, 103 bp, Artificial Sequence
  Synthetic Polynucleotide
taatacgactcactatagggtcaatatttattgttttattatttactttaaacagaggagataaagtatgtaataaaacaacctggcggcagcgcaaaagatg

SEQ ID NO: 60861 - DNA, 103 bp, Artificial Sequence
  Synthetic Polynucleotide
taatacgactcactatagggctagttcaatatttattgttttattatttaaacagaggagataaataatgaaacaataaaacctggcggcagcgcaaaagatg

SEQ ID NO: 60862 - DNA, 103 bp, Artificial Sequence
  Synthetic Polynucleotide
taatacgactcactatagggtactactagttcaatatttattgttttattaacagaggagaaataaaatgataaatattaacctggcggcagcgcaaaagatg

SEQ ID NO: 60863 - DNA, 103 bp, Artificial Sequence
  Synthetic Polynucleotide
taatacgactcactatagggatacgtactactagttcaatatttattgttaacagaggagaaacaatatgtattgaactaacctggcggcagcgcaaaagatg

SEQ ID NO: 60864 - DNA, 103 bp, Artificial Sequence
  Synthetic Polynucleotide
taatacgactcactatagggtcaatatacgtactactagttcaatatttaaacagaggagataaataatgaactagtagaacctggcggcagcgcaaaagatg

SEQ ID NO: 60865 - DNA, 103 bp, Artificial Sequence
  Synthetic Polynucleotide
taatacgactcactatagggattgctcaatatacgtactactagttcaataacagaggagaattgaaatggtagtacgtaacctggcggcagcgcaaaagatg

SEQ ID NO: 60866 - DNA, 103 bp, Artificial Sequence
  Synthetic Polynucleotide
taatacgactcactatagggttctgattgctcaatatacgtactactagtaacagaggagaactagtatgacgtatattaacctggcggcagcgcaaaagatg

SEQ ID NO: 60867 - DNA, 103 bp, Artificial Sequence
  Synthetic Polynucleotide
taatacgactcactatagggatcatttctgattgctcaatatacgtactaaacagaggagatagtacatgtattgagcaaacctggcggcagcgcaaaagatg

SEQ ID NO: 60868 - DNA, 103 bp, Artificial Sequence
  Synthetic Polynucleotide
taatacgactcactatagggccagtatcatttctgattgctcaatatacgaacagaggagacgtataatgagcaatcagaacctggcggcagcgcaaaagatg

SEQ ID NO: 60869 - DNA, 103 bp, Artificial Sequence
  Synthetic Polynucleotide
taatacgactcactatagggaggtaccagtatcatttctgattgctcaataacagaggagaattgagatgtcagaaatgaacctggcggcagcgcaaaagatg

SEQ ID NO: 60870 - DNA, 103 bp, Artificial Sequence
  Synthetic Polynucleotide
taatacgactcactatagggacaatattactgcagtgacatccaatccagaacagaggagactggatatgatgtcactgaacctggcggcagcgcaaaagatg

SEQ ID NO: 60871 - DNA, 103 bp, Artificial Sequence
  Synthetic Polynucleotide
taatacgactcactatagggataagaggtaccagtatcatttctgattgcaacagaggagagcaatcatgaatgatactaacctggcggcagcgcaaaagatg

SEQ ID NO: 60872 - DNA, 103 bp, Artificial Sequence
  Synthetic Polynucleotide
taatacgactcactatagggctgtgataagaggtaccagtatcatttctgaacagaggagacagaaaatgtactggtacaacctggcggcagcgcaaaagatg

SEQ ID NO: 60873 - DNA, 103 bp, Artificial Sequence
  Synthetic Polynucleotide
taatacgactcactatagggggtcactgtgataagaggtaccagtatcataacagaggagaatgataatggtacctcttaacctggcggcagcgcaaaagatg

SEQ ID NO: 60874 - DNA, 103 bp, Artificial Sequence
  Synthetic Polynucleotide
taatacgactcactatagggactacggtcactgtgataagaggtaccagtaacagaggagaactggtatgtcttatcacaacctggcggcagcgcaaaagatg

SEQ ID NO: 60875 - DNA, 103 bp, Artificial Sequence
  Synthetic Polynucleotide
taatacgactcactatagggccgcaactacggtcactgtgataagaggtaaacagaggagatacctcatgtcacagtgaaacctggcggcagcgcaaaagatg

SEQ ID NO: 60876 - DNA, 103 bp, Artificial Sequence
  Synthetic Polynucleotide
taatacgactcactatagggtgttcccgcaactacggtcactgtgataagaacagaggagacttatcatggtgaccgtaaacctggcggcagcgcaaaagatg

SEQ ID NO: 60877 - DNA, 103 bp, Artificial Sequence
  Synthetic Polynucleotide
taatacgactcactatagggaatattgttcccgcaactacggtcactgtgaacagaggagacacagtatgcgtagttgcaacctggcggcagcgcaaaagatg

SEQ ID NO: 60878 - DNA, 103 bp, Artificial Sequence
  Synthetic Polynucleotide
taatacgactcactatagggatactaatattgttcccgcaactacggtcaaacagaggagatgaccgatgttgcgggaaaacctggcggcagcgcaaaagatg

SEQ ID NO: 60879 - DNA, 103 bp, Artificial Sequence
  Synthetic Polynucleotide
taatacgactcactatagggataacatactaatattgttcccgcaactacaacagaggagagtagttatgggaacaataaacctggcggcagcgcaaaagatg

SEQ ID NO: 60880 - DNA, 103 bp, Artificial Sequence
  Synthetic Polynucleotide
taatacgactcactatagggaatatataacatactaatattgttcccgcaaacagaggagatgcgggatgaatattagtaacctggcggcagcgcaaaagatg

SEQ ID NO: 60881 - DNA, 103 bp, Artificial Sequence
  Synthetic Polynucleotide
taatacgactcactatagggaattaacaatattactgcagtgacatccaaaacagaggagattggatatgactgcagtaaacctggcggcagcgcaaaagatg

SEQ ID NO: 60882 - DNA, 103 bp, Artificial Sequence
  Synthetic Polynucleotide
taatacgactcactatagggtatataatatataacatactaatattgttcaacagaggagagaacaaatgtagtatgttaacctggcggcagcgcaaaagatg

SEQ ID NO: 60883 - DNA, 103 bp, Artificial Sequence
  Synthetic Polynucleotide
taatacgactcactatagggacaaatatataatatataacatactaatataacagaggagaatattaatgtgttatataaacctggcggcagcgcaaaagatg

SEQ ID NO: 60884 - DNA, 103 bp, Artificial Sequence
  Synthetic Polynucleotide
taatacgactcactatagggttcctacaaatatataatatataacatactaacagaggagaagtatgatgtatattataaacctggcggcagcgcaaaagatg

SEQ ID NO: 60885 - DNA, 103 bp, Artificial Sequence
  Synthetic Polynucleotide
taatacgactcactatagggtctttttcctacaaatatataatatataacaacagaggagagttataatgtatatatttaacctggcggcagcgcaaaagatg

SEQ ID NO: 60886 - DNA, 103 bp, Artificial Sequence
  Synthetic Polynucleotide
taatacgactcactatagggacgtatctttttcctacaaatatataatataacagaggagaatattaatgatttgtaggaacctggcggcagcgcaaaagatg

SEQ ID NO: 60887 - DNA, 103 bp, Artificial Sequence
  Synthetic Polynucleotide
taatacgactcactatagggacagtacgtatctttttcctacaaatatataacagaggagaatatatatgtaggaaaaaaacctggcggcagcgcaaaagatg

SEQ ID NO: 60888 - DNA, 103 bp, Artificial Sequence
  Synthetic Polynucleotide
taatacgactcactatagggtatagacagtacgtatctttttcctacaaaaacagaggagatttgtaatgaaaagatacaacctggcggcagcgcaaaagatg

SEQ ID NO: 60889 - DNA, 103 bp, Artificial Sequence
  Synthetic Polynucleotide
taatacgactcactataggggtcattatagacagtacgtatctttttcctaacagaggagaaggaaaatgatacgtactaacctggcggcagcgcaaaagatg

SEQ ID NO: 60890 - DNA, 103 bp, Artificial Sequence
  Synthetic Polynucleotide
taatacgactcactatagggttattgtcattatagacagtacgtatctttaacagaggagaaaagatatgtactgtctaaacctggcggcagcgcaaaagatg

SEQ ID NO: 60891 - DNA, 103 bp, Artificial Sequence
  Synthetic Polynucleotide
taatacgactcactatagggtaattttattgtcattatagacagtacgtaaacagaggagatacgtaatgtctataatgaacctggcggcagcgcaaaagatg

SEQ ID NO: 60892 - DNA, 103 bp, Artificial Sequence
  Synthetic Polynucleotide
taatacgactcactataggggaaataattaacaatattactgcagtgacaaacagaggagatgtcacatgagtaatattaacctggcggcagcgcaaaagatg

SEQ ID NO: 60893 - DNA, 103 bp, Artificial Sequence
  Synthetic Polynucleotide
taatacgactcactatagggcataataattttattgtcattatagacagtaacagaggagaactgtcatgaatgacaataacctggcggcagcgcaaaagatg

SEQ ID NO: 60894 - DNA, 103 bp, Artificial Sequence
  Synthetic Polynucleotide
taatacgactcactatagggtttgtcataataattttattgtcattatagaacagaggagactataaatgcaataaaataacctggcggcagcgcaaaagatg

SEQ ID NO: 60895 - DNA, 103 bp, Artificial Sequence
  Synthetic Polynucleotide
taatacgactcactatagggttaattttgtcataataattttattgtcataacagaggagaatgacaatgaaattattaaacctggcggcagcgcaaaagatg

SEQ ID NO: 60896 - DNA, 103 bp, Artificial Sequence
  Synthetic Polynucleotide
taatacgactcactatagggcttttttaattttgtcataataattttattaacagaggagaaataaaatgattatgacaaacctggcggcagcgcaaaagatg

SEQ ID NO: 60897 - DNA, 103 bp, Artificial Sequence
  Synthetic Polynucleotide
taatacgactcactatagggtttatcttttttaattttgtcataataattaacagaggagaaattatatggacaaaattaacctggcggcagcgcaaaagatg

SEQ ID NO: 60898 - DNA, 103 bp, Artificial Sequence
  Synthetic Polynucleotide
taatacgactcactatagggaactctttatcttttttaattttgtcataaaacagaggagattatgaatgaattaaaaaaacctggcggcagcgcaaaagatg

SEQ ID NO: 60899 - DNA, 103 bp, Artificial Sequence
  Synthetic Polynucleotide
taatacgactcactatagggattagaactctttatcttttttaattttgtaacagaggagaacaaaaatgaaaaagataaacctggcggcagcgcaaaagatg

SEQ ID NO: 60900 - DNA, 103 bp, Artificial Sequence
  Synthetic Polynucleotide
taatacgactcactatagggctggaattagaactctttatcttttttaataacagaggagaattaaaatggataaagagaacctggcggcagcgcaaaagatg

SEQ ID NO: 60901 - DNA, 103 bp, Artificial Sequence
  Synthetic Polynucleotide
taatacgactcactatagggatttgctggaattagaactctttatcttttaacagaggagaaaaagaatgagagttctaaacctggcggcagcgcaaaagatg

SEQ ID NO: 60902 - DNA, 103 bp, Artificial Sequence
  Synthetic Polynucleotide
taatacgactcactatagggactagatttgctggaattagaactctttataacagaggagaataaagatgtctaattccaacctggcggcagcgcaaaagatg

SEQ ID NO: 60903 - DNA, 103 bp, Artificial Sequence
  Synthetic Polynucleotide
taatacgactcactatagggattatgccaatatttgtttagattttgacaaacagaggagatgtcaaatgctaaacaaaaacctggcggcagcgcaaaagatg

SEQ ID NO: 60904 - DNA, 103 bp, Artificial Sequence
  Synthetic Polynucleotide
taatacgactcactatagggtgttagaaataattaacaatattactgcagaacagaggagactgcagatgtattgttaaaacctggcggcagcgcaaaagatg

SEQ ID NO: 60905 - DNA, 103 bp, Artificial Sequence
  Synthetic Polynucleotide
taatacgactcactataggggatttactagatttgctggaattagaactcaacagaggagagagttcatgttccagcaaaacctggcggcagcgcaaaagatg

SEQ ID NO: 60906 - DNA, 103 bp, Artificial Sequence
  Synthetic Polynucleotide
taatacgactcactatagggcagttgatttactagatttgctggaattagaacagaggagactaattatggcaaatctaaacctggcggcagcgcaaaagatg

SEQ ID NO: 60907 - DNA, 103 bp, Artificial Sequence
  Synthetic Polynucleotide
taatacgactcactataggggttatcagttgatttactagatttgctggaaacagaggagatccagcatgtctagtaaaaacctggcggcagcgcaaaagatg

SEQ ID NO: 60908 - DNA, 103 bp, Artificial Sequence
  Synthetic Polynucleotide
taatacgactcactataggggattcgttatcagttgatttactagatttgaacagaggagacaaatcatgtaaatcaacaacctggcggcagcgcaaaagatg

SEQ ID NO: 60909 - DNA, 103 bp, Artificial Sequence
  Synthetic Polynucleotide
taatacgactcactatagggagtctgattcgttatcagttgatttactagaacagaggagactagtaatgcaactgataaacctggcggcagcgcaaaagatg

SEQ ID NO: 60910 - DNA, 103 bp, Artificial Sequence
  Synthetic Polynucleotide
taatacgactcactatagggctcccagtctgattcgttatcagttgatttaacagaggagaaaatcaatggataacgaaaacctggcggcagcgcaaaagatg

SEQ ID NO: 60911 - DNA, 103 bp, Artificial Sequence
  Synthetic Polynucleotide
taatacgactcactatagggtgatcctcccagtctgattcgttatcagttaacagaggagaaactgaatgcgaatcagaaacctggcggcagcgcaaaagatg

SEQ ID NO: 60912 - DNA, 103 bp, Artificial Sequence
  Synthetic Polynucleotide
taatacgactcactatagggtacagtgatcctcccagtctgattcgttataacagaggagaataacgatgcagactgggaacctggcggcagcgcaaaagatg

SEQ ID NO: 60913 - DNA, 103 bp, Artificial Sequence
  Synthetic Polynucleotide
taatacgactcactatagggagcactacagtgatcctcccagtctgattcaacagaggagagaatcaatgtgggaggataacctggcggcagcgcaaaagatg

SEQ ID NO: 60914 - DNA, 103 bp, Artificial Sequence
  Synthetic Polynucleotide
taatacgactcactatagggtccatagcactacagtgatcctcccagtctaacagaggagaagactgatgggatcactgaacctggcggcagcgcaaaagatg

SEQ ID NO: 60915 - DNA, 103 bp, Artificial Sequence
  Synthetic Polynucleotide
taatacgactcactataggggtcaatgttagaaataattaacaatattacaacagaggagagtaataatgttaattattaacctggcggcagcgcaaaagatg

SEQ ID NO: 60916 - DNA, 103 bp, Artificial Sequence
  Synthetic Polynucleotide
taatacgactcactatagggtttgttccatagcactacagtgatcctcccaacagaggagagggaggatgactgtagtgaacctggcggcagcgcaaaagatg

SEQ ID NO: 60917 - DNA, 103 bp, Artificial Sequence
  Synthetic Polynucleotide
taatacgactcactatagggattattttgttccatagcactacagtgatcaacagaggagagatcacatgagtgctatgaacctggcggcagcgcaaaagatg

SEQ ID NO: 60918 - DNA, 103 bp, Artificial Sequence
  Synthetic Polynucleotide
taatacgactcactatagggacgtcattattttgttccatagcactacagaacagaggagactgtagatgtatggaacaaacctggcggcagcgcaaaagatg

SEQ ID NO: 60919 - DNA, 103 bp, Artificial Sequence
  Synthetic Polynucleotide
taatacgactcactatagggtatccacgtcattattttgttccatagcacaacagaggagagtgctaatgaacaaaataaacctggcggcagcgcaaaagatg

SEQ ID NO: 60920 - DNA, 103 bp, Artificial Sequence
  Synthetic Polynucleotide
taatacgactcactatagggaatattatccacgtcattattttgttccataacagaggagaatggaaatgaataatgacaacctggcggcagcgcaaaagatg

SEQ ID NO: 60921 - DNA, 103 bp, Artificial Sequence
  Synthetic Polynucleotide
taatacgactcactatagggctagaaatattatccacgtcattattttgtaacagaggagaacaaaaatgtgacgtggaaacctggcggcagcgcaaaagatg

SEQ ID NO: 60922 - DNA, 103 bp, Artificial Sequence
  Synthetic Polynucleotide
taatacgactcactatagggcattcctagaaatattatccacgtcattataacagaggagaataatgatgtggataataaacctggcggcagcgcaaaagatg

SEQ ID NO: 60923 - DNA, 103 bp, Artificial Sequence
  Synthetic Polynucleotide
taatacgactcactatagggtatctcattcctagaaatattatccacgtcaacagaggagagacgtgatgaatatttctaacctggcggcagcgcaaaagatg

SEQ ID NO: 60924 - DNA, 103 bp, Artificial Sequence
  Synthetic Polynucleotide
taatacgactcactatagggtccaatatctcattcctagaaatattatccaacagaggagaggataaatgttctaggaaaacctggcggcagcgcaaaagatg

SEQ ID NO: 60925 - DNA, 103 bp, Artificial Sequence
  Synthetic Polynucleotide
taatacgactcactatagggcatcatccaatatctcattcctagaaatataacagaggagaatatttatgggaatgagaaacctggcggcagcgcaaaagatg

SEQ ID NO: 60926 - DNA, 103 bp, Artificial Sequence
  Synthetic Polynucleotide
taatacgactcactatagggaatgcgtcaatgttagaaataattaacaataacagaggagaattgttatgtatttctaaaacctggcggcagcgcaaaagatg

SEQ ID NO: 60927 - DNA, 103 bp, Artificial Sequence
  Synthetic Polynucleotide
taatacgactcactataggggctatcatcatccaatatctcattcctagaaacagaggagatctaggatggagatattgaacctggcggcagcgcaaaagatg

SEQ ID NO: 60928 - DNA, 103 bp, Artificial Sequence
  Synthetic Polynucleotide
taatacgactcactataggggcgaagctatcatcatccaatatctcattcaacagaggagagaatgaatgattggatgaaacctggcggcagcgcaaaagatg

SEQ ID NO: 60929 - DNA, 103 bp, Artificial Sequence
  Synthetic Polynucleotide
taatacgactcactatagggtaccagcgaagctatcatcatccaatatctaacagaggagaagatatatgatgatgataaacctggcggcagcgcaaaagatg

SEQ ID NO: 60930 - DNA, 103 bp, Artificial Sequence
  Synthetic Polynucleotide
taatacgactcactatagggtaaactaccagcgaagctatcatcatccaaaacagaggagattggatatggatagcttcaacctggcggcagcgcaaaagatg

SEQ ID NO: 60931 - DNA, 103 bp, Artificial Sequence
  Synthetic Polynucleotide
taatacgactcactatagggcatattaaactaccagcgaagctatcatcaaacagaggagatgatgaatgcttcgctggaacctggcggcagcgcaaaagatg

SEQ ID NO: 60932 - DNA, 103 bp, Artificial Sequence
  Synthetic Polynucleotide
taatacgactcactatagggtatcccatattaaactaccagcgaagctataacagaggagaatagctatgctggtagttaacctggcggcagcgcaaaagatg

SEQ ID NO: 60933 - DNA, 103 bp, Artificial Sequence
  Synthetic Polynucleotide
taatacgactcactatagggttcgttatcccatattaaactaccagcgaaaacagaggagattcgctatgagtttaataaacctggcggcagcgcaaaagatg

SEQ ID NO: 60934 - DNA, 103 bp, Artificial Sequence
  Synthetic Polynucleotide
taatacgactcactatagggttggattcgttatcccatattaaactaccaaacagaggagatggtagatgaatatgggaaacctggcggcagcgcaaaagatg

SEQ ID NO: 60935 - DNA, 103 bp, Artificial Sequence
  Synthetic Polynucleotide
taatacgactcactatagggtgacattggattcgttatcccatattaaacaacagaggagagtttaaatggggataacgaacctggcggcagcgcaaaagatg

SEQ ID NO: 60936 - DNA, 103 bp, Artificial Sequence
  Synthetic Polynucleotide
taatacgactcactatagggcgctatgacattggattcgttatcccatataacagaggagaatatggatgaacgaatccaacctggcggcagcgcaaaagatg

SEQ ID NO: 60937 - DNA, 103 bp, Artificial Sequence
  Synthetic Polynucleotide
taatacgactcactatagggtatataatgcgtcaatgttagaaataattaaacagaggagataattaatgctaacattgaacctggcggcagcgcaaaagatg

SEQ ID NO: 60938 - DNA, 103 bp, Artificial Sequence
  Synthetic Polynucleotide
taatacgactcactatagggctaggcgctatgacattggattcgttatccaacagaggagaggataaatgatccaatgtaacctggcggcagcgcaaaagatg

SEQ ID NO: 60939 - DNA, 103 bp, Artificial Sequence
  Synthetic Polynucleotide
taatacgactcactatagggctgtgctaggcgctatgacattggattcgtaacagaggagaacgaatatgatgtcatagaacctggcggcagcgcaaaagatg

SEQ ID NO: 60940 - DNA, 103 bp, Artificial Sequence
  Synthetic Polynucleotide
taatacgactcactataggggtgttctgtgctaggcgctatgacattggaaacagaggagatccaatatgatagcgcctaacctggcggcagcgcaaaagatg

SEQ ID NO: 60941 - DNA, 103 bp, Artificial Sequence
  Synthetic Polynucleotide
taatacgactcactatagggtaaatgtgttctgtgctaggcgctatgacaaacagaggagatgtcatatggcctagcacaacctggcggcagcgcaaaagatg

SEQ ID NO: 60942 - DNA, 103 bp, Artificial Sequence
  Synthetic Polynucleotide
taatacgactcactatagggtatcgtaaatgtgttctgtgctaggcgctaaacagaggagatagcgcatggcacagaacaacctggcggcagcgcaaaagatg

SEQ ID NO: 60943 - DNA, 103 bp, Artificial Sequence
  Synthetic Polynucleotide
taatacgactcactatagggaacactatcgtaaatgtgttctgtgctaggaacagaggagacctagcatggaacacattaacctggcggcagcgcaaaagatg

SEQ ID NO: 60944 - DNA, 103 bp, Artificial Sequence
  Synthetic Polynucleotide
taatacgactcactatagggccagcaacactatcgtaaatgtgttctgtgaacagaggagacacagaatgcatttacgaaacctggcggcagcgcaaaagatg

SEQ ID NO: 60945 - DNA, 103 bp, Artificial Sequence
  Synthetic Polynucleotide
taatacgactcactatagggtgcttccagcaacactatcgtaaatgtgttaacagaggagaaacacaatgacgatagtgaacctggcggcagcgcaaaagatg

SEQ ID NO: 60946 - DNA, 103 bp, Artificial Sequence
  Synthetic Polynucleotide
taatacgactcactatagggccgcgtgcttccagcaacactatcgtaaataacagaggagaatttacatgagtgttgctaacctggcggcagcgcaaaagatg

SEQ ID NO: 60947 - DNA, 103 bp, Artificial Sequence
  Synthetic Polynucleotide
taatacgactcactatagggattagccgcgtgcttccagcaacactatcgaacagaggagacgatagatgtgctggaagaacctggcggcagcgcaaaagatg

SEQ ID NO: 60948 - DNA, 103 bp, Artificial Sequence
  Synthetic Polynucleotide
taatacgactcactatagggaaaactatataatgcgtcaatgttagaaataacagaggagaatttctatgattgacgcaaacctggcggcagcgcaaaagatg

SEQ ID NO: 60949 - DNA, 103 bp, Artificial Sequence
  Synthetic Polynucleotide
taatacgactcactatagggtatttattagccgcgtgcttccagcaacacaacagaggagagtgttgatggaagcacgcaacctggcggcagcgcaaaagatg

SEQ ID NO: 60950 - DNA, 103 bp, Artificial Sequence
  Synthetic Polynucleotide
taatacgactcactatagggatcattatttattagccgcgtgcttccagcaacagaggagagctggaatgacgcggctaaacctggcggcagcgcaaaagatg

SEQ ID NO: 60951 - DNA, 103 bp, Artificial Sequence
  Synthetic Polynucleotide
taatacgactcactatagggttacaatcattatttattagccgcgtgcttaacagaggagaaagcacatggctaataaaaacctggcggcagcgcaaaagatg

SEQ ID NO: 60952 - DNA, 103 bp, Artificial Sequence
  Synthetic Polynucleotide
taatacgactcactataggggttcattacaatcattatttattagccgcgaacagaggagacgcggcatgtaaataatgaacctggcggcagcgcaaaagatg

SEQ ID NO: 60953 - DNA, 103 bp, Artificial Sequence
  Synthetic Polynucleotide
taatacgactcactatagggagtttgttcattacaatcattatttattagaacagaggagactaataatgaatgattgtaacctggcggcagcgcaaaagatg

SEQ ID NO: 60954 - DNA, 103 bp, Artificial Sequence
  Synthetic Polynucleotide
taatacgactcactatagggtaaatagtttgttcattacaatcattatttaacagaggagaaaataaatgttgtaatgaaacctggcggcagcgcaaaagatg

SEQ ID NO: 60955 - DNA, 103 bp, Artificial Sequence
  Synthetic Polynucleotide
taatacgactcactatagggtctgataaatagtttgttcattacaatcataacagaggagaatgattatgatgaacaaaaacctggcggcagcgcaaaagatg

SEQ ID NO: 60956 - DNA, 103 bp, Artificial Sequence
  Synthetic Polynucleotide
taatacgactcactatagggagtgttctgataaatagtttgttcattacaaacagaggagatgtaatatgcaaactattaacctggcggcagcgcaaaagatg

SEQ ID NO: 60957 - DNA, 103 bp, Artificial Sequence
  Synthetic Polynucleotide
taatacgactcactatagggactgtagtgttctgataaatagtttgttcaaacagaggagatgaacaatgtatttatcaaacctggcggcagcgcaaaagatg

SEQ ID NO: 60958 - DNA, 103 bp, Artificial Sequence
  Synthetic Polynucleotide
taatacgactcactatagggtaattactgtagtgttctgataaatagtttaacagaggagaaaactaatgatcagaacaaacctggcggcagcgcaaaagatg

SEQ ID NO: 60959 - DNA, 103 bp, Artificial Sequence
  Synthetic Polynucleotide
taatacgactcactataggggtgtaaaaactatataatgcgtcaatgttaaacagaggagataacatatgcgcattataaacctggcggcagcgcaaaagatg

SEQ ID NO: 60960 - DNA, 103 bp, Artificial Sequence
  Synthetic Polynucleotide
taatacgactcactatagggctcattaattactgtagtgttctgataaataacagaggagaatttatatgaacactacaaacctggcggcagcgcaaaagatg

SEQ ID NO: 60961 - DNA, 103 bp, Artificial Sequence
  Synthetic Polynucleotide
taatacgactcactatagggtctgtctcattaattactgtagtgttctgaaacagaggagatcagaaatgtacagtaataacctggcggcagcgcaaaagatg

SEQ ID NO: 60962 - DNA, 103 bp, Artificial Sequence
  Synthetic Polynucleotide
taatacgactcactatagggtagtctctgtctcattaattactgtagtgtaacagaggagaacactaatgtaattaatgaacctggcggcagcgcaaaagatg

SEQ ID NO: 60963 - DNA, 103 bp, Artificial Sequence
  Synthetic Polynucleotide
taatacgactcactatagggttcaatagtctctgtctcattaattactgtaacagaggagaacagtaatgaatgagacaaacctggcggcagcgcaaaagatg

SEQ ID NO: 60964 - DNA, 103 bp, Artificial Sequence
  Synthetic Polynucleotide
taatacgactcactatagggagtacttcaatagtctctgtctcattaattaacagaggagaaattaaatggacagagacaacctggcggcagcgcaaaagatg

SEQ ID NO: 60965 - DNA, 103 bp, Artificial Sequence
  Synthetic Polynucleotide
taatacgactcactatagggcattaagtacttcaatagtctctgtctcataacagaggagaatgagaatgagactattgaacctggcggcagcgcaaaagatg

SEQ ID NO: 60966 - DNA, 103 bp, Artificial Sequence
  Synthetic Polynucleotide
taatacgactcactatagggatcttcattaagtacttcaatagtctctgtaacagaggagaacagagatgattgaagtaaacctggcggcagcgcaaaagatg

SEQ ID NO: 60967 - DNA, 103 bp, Artificial Sequence
  Synthetic Polynucleotide
taatacgactcactatagggttggtatcttcattaagtacttcaatagtcaacagaggagagactatatgagtacttaaaacctggcggcagcgcaaaagatg

SEQ ID NO: 60968 - DNA, 103 bp, Artificial Sequence
  Synthetic Polynucleotide
taatacgactcactatagggtctgtttggtatcttcattaagtacttcaaaacagaggagattgaagatgttaatgaagaacctggcggcagcgcaaaagatg

SEQ ID NO: 60969 - DNA, 103 bp, Artificial Sequence
  Synthetic Polynucleotide
taatacgactcactatagggaggattctgtttggtatcttcattaagtacaacagaggagagtacttatggaagataccaacctggcggcagcgcaaaagatg

SEQ ID NO: 60970 - DNA, 103 bp, Artificial Sequence
  Synthetic Polynucleotide
taatacgactcactatagggtctatgtgtaaaaactatataatgcgtcaaaacagaggagattgacgatgtatatagttaacctggcggcagcgcaaaagatg

SEQ ID NO: 60971 - DNA, 103 bp, Artificial Sequence
  Synthetic Polynucleotide
taatacgactcactatagggtagctaggattctgtttggtatcttcattaaacagaggagataatgaatgtaccaaacaaacctggcggcagcgcaaaagatg

SEQ ID NO: 60972 - DNA, 103 bp, Artificial Sequence
  Synthetic Polynucleotide
taatacgactcactatagggacgaatagctaggattctgtttggtatcttaacagaggagaaagataatgaacagaatcaacctggcggcagcgcaaaagatg

SEQ ID NO: 60973 - DNA, 103 bp, Artificial Sequence
  Synthetic Polynucleotide
taatacgactcactatagggattggacgaatagctaggattctgtttggtaacagaggagaaccaaaatgaatcctagcaacctggcggcagcgcaaaagatg

SEQ ID NO: 60974 - DNA, 103 bp, Artificial Sequence
  Synthetic Polynucleotide
taatacgactcactatagggaaaggattggacgaatagctaggattctgtaacagaggagaacagaaatgtagctattcaacctggcggcagcgcaaaagatg

SEQ ID NO: 60975 - DNA, 103 bp, Artificial Sequence
  Synthetic Polynucleotide
taatacgactcactatagggttacgaaaggattggacgaatagctaggataacagaggagaatcctaatgattcgtccaaacctggcggcagcgcaaaagatg

SEQ ID NO: 60976 - DNA, 103 bp, Artificial Sequence
  Synthetic Polynucleotide
taatacgactcactatagggataatttacgaaaggattggacgaatagctaacagaggagaagctatatgtccaatcctaacctggcggcagcgcaaaagatg

SEQ ID NO: 60977 - DNA, 103 bp, Artificial Sequence
  Synthetic Polynucleotide
taatacgactcactatagggttattataatttacgaaaggattggacgaaaacagaggagattcgtcatgtcctttcgtaacctggcggcagcgcaaaagatg

SEQ ID NO: 60978 - DNA, 103 bp, Artificial Sequence
  Synthetic Polynucleotide
taatacgactcactatagggtggttttattataatttacgaaaggattggaacagaggagaccaatcatgtcgtaaattaacctggcggcagcgcaaaagatg

SEQ ID NO: 60979 - DNA, 103 bp, Artificial Sequence
  Synthetic Polynucleotide
taatacgactcactatagggaatactggttttattataatttacgaaaggaacagaggagacctttcatgaattataataacctggcggcagcgcaaaagatg

SEQ ID NO: 60980 - DNA, 103 bp, Artificial Sequence
  Synthetic Polynucleotide
taatacgactcactatagggctacaaatactggttttattataatttacgaacagaggagacgtaaaatgtaataaaacaacctggcggcagcgcaaaagatg

SEQ ID NO: 60981 - DNA, 103 bp, Artificial Sequence
  Synthetic Polynucleotide
taatacgactcactataggggtagatctatgtgtaaaaactatataatgcaacagaggagagcattaatgagtttttacaacctggcggcagcgcaaaagatg

SEQ ID NO: 60982 - DNA, 103 bp, Artificial Sequence
  Synthetic Polynucleotide
taatacgactcactatagggacttgctacaaatactggttttattataataacagaggagaattataatgaaaccagtaaacctggcggcagcgcaaaagatg

SEQ ID NO: 60983 - DNA, 103 bp, Artificial Sequence
  Synthetic Polynucleotide
taatacgactcactatagggatttgacttgctacaaatactggttttattaacagaggagaaataaaatgagtatttgtaacctggcggcagcgcaaaagatg

SEQ ID NO: 60984 - DNA, 103 bp, Artificial Sequence
  Synthetic Polynucleotide
taatacgactcactatagggaacggatttgacttgctacaaatactggttaacagaggagaaaccagatgttgtagcaaaacctggcggcagcgcaaaagatg

SEQ ID NO: 60985 - DNA, 103 bp, Artificial Sequence
  Synthetic Polynucleotide
taatacgactcactatagggtaatgaacggatttgacttgctacaaatacaacagaggagagtatttatggcaagtcaaaacctggcggcagcgcaaaagatg

SEQ ID NO: 60986 - DNA, 103 bp, Artificial Sequence
  Synthetic Polynucleotide
taatacgactcactatagggttctgtaatgaacggatttgacttgctacaaacagaggagatgtagcatgtcaaatccgaacctggcggcagcgcaaaagatg

SEQ ID NO: 60987 - DNA, 103 bp, Artificial Sequence
  Synthetic Polynucleotide
taatacgactcactatagggttgagttctgtaatgaacggatttgacttgaacagaggagacaagtcatgtccgttcataacctggcggcagcgcaaaagatg

SEQ ID NO: 60988 - DNA, 103 bp, Artificial Sequence
  Synthetic Polynucleotide
taatacgactcactatagggtattgttgagttctgtaatgaacggatttgaacagaggagacaaatcatgtcattacagaacctggcggcagcgcaaaagatg

SEQ ID NO: 60989 - DNA, 103 bp, Artificial Sequence
  Synthetic Polynucleotide
taatacgactcactatagggaaatttattgttgagttctgtaatgaacggaacagaggagaccgttcatgacagaactcaacctggcggcagcgcaaaagatg

SEQ ID NO: 60990 - DNA, 103 bp, Artificial Sequence
  Synthetic Polynucleotide
taatacgactcactatagggtcactaaatttattgttgagttctgtaatgaacagaggagacattacatgactcaacaaaacctggcggcagcgcaaaagatg

SEQ ID NO: 60991 - DNA, 103 bp, Artificial Sequence
  Synthetic Polynucleotide
taatacgactcactatagggtattctcactaaatttattgttgagttctgaacagaggagacagaacatgacaataaataacctggcggcagcgcaaaagatg

SEQ ID NO: 60992 - DNA, 103 bp, Artificial Sequence
  Synthetic Polynucleotide
taatacgactcactatagggctgttgtagatctatgtgtaaaaactatataacagaggagaatatagatgttacacataaacctggcggcagcgcaaaagatg

SEQ ID NO: 60993 - DNA, 103 bp, Artificial Sequence
  Synthetic Polynucleotide
taatacgactcactatagggcggattattctcactaaatttattgttgagaacagaggagactcaacatgaaatttagtaacctggcggcagcgcaaaagatg

SEQ ID NO: 60994 - DNA, 103 bp, Artificial Sequence
  Synthetic Polynucleotide
taatacgactcactatagggctaaacggattattctcactaaatttattgaacagaggagacaataaatgtagtgagaaaacctggcggcagcgcaaaagatg

SEQ ID NO: 60995 - DNA, 103 bp, Artificial Sequence
  Synthetic Polynucleotide
taatacgactcactatagggctctcctaaacggattattctcactaaattaacagaggagaaatttaatgagaataatcaacctggcggcagcgcaaaagatg

SEQ ID NO: 60996 - DNA, 103 bp, Artificial Sequence
  Synthetic Polynucleotide
taatacgactcactatagggatgtgctctcctaaacggattattctcactaacagaggagaagtgagatgaatccgtttaacctggcggcagcgcaaaagatg

SEQ ID NO: 60997 - DNA, 103 bp, Artificial Sequence
  Synthetic Polynucleotide
taatacgactcactatagggtcgctatgtgctctcctaaacggattattcaacagaggagagaataaatggtttaggagaacctggcggcagcgcaaaagatg

SEQ ID NO: 60998 - DNA, 103 bp, Artificial Sequence
  Synthetic Polynucleotide
taatacgactcactatagggaatcatcgctatgtgctctcctaaacggataacagaggagaatccgtatgggagagcacaacctggcggcagcgcaaaagatg

SEQ ID NO: 60999 - DNA, 103 bp, Artificial Sequence
  Synthetic Polynucleotide
taatacgactcactatagggtaggtaatcatcgctatgtgctctcctaaaaacagaggagatttaggatggcacatagcaacctggcggcagcgcaaaagatg

SEQ ID NO: 61000 - DNA, 103 bp, Artificial Sequence
  Synthetic Polynucleotide
taatacgactcactatagggttatttaggtaatcatcgctatgtgctctcaacagaggagagagagcatgtagcgatgaaacctggcggcagcgcaaaagatg

SEQ ID NO: 61001 - DNA, 103 bp, Artificial Sequence
  Synthetic Polynucleotide
taatacgactcactatagggcttgcttatttaggtaatcatcgctatgtgaacagaggagacacataatgatgattaccaacctggcggcagcgcaaaagatg

SEQ ID NO: 61002 - DNA, 103 bp, Artificial Sequence
  Synthetic Polynucleotide
taatacgactcactatagggatgttcttgcttatttaggtaatcatcgctaacagaggagaagcgatatgtacctaaataacctggcggcagcgcaaaagatg

SEQ ID NO: 61003 - DNA, 103 bp, Artificial Sequence
  Synthetic Polynucleotide
taatacgactcactatagggtccacctgttgtagatctatgtgtaaaaacaacagaggagagtttttatgcatagatctaacctggcggcagcgcaaaagatg

SEQ ID NO: 61004 - DNA, 103 bp, Artificial Sequence
  Synthetic Polynucleotide
taatacgactcactatagggtcatcatgttcttgcttatttaggtaatcaaacagaggagatgattaatgaaataagcaaacctggcggcagcgcaaaagatg

SEQ ID NO: 61005 - DNA, 103 bp, Artificial Sequence
  Synthetic Polynucleotide
taatacgactcactatagggctatatcatcatgttcttgcttatttaggtaacagaggagaacctaaatgagcaagaacaacctggcggcagcgcaaaagatg

SEQ ID NO: 61006 - DNA, 103 bp, Artificial Sequence
  Synthetic Polynucleotide
taatacgactcactatagggtgattctatatcatcatgttcttgcttattaacagaggagaaataagatggaacatgataacctggcggcagcgcaaaagatg

SEQ ID NO: 61007 - DNA, 103 bp, Artificial Sequence
  Synthetic Polynucleotide
taatacgactcactatagggacagatgattctatatcatcatgttcttgcaacagaggagagcaagaatgtgatgatataacctggcggcagcgcaaaagatg

SEQ ID NO: 61008 - DNA, 103 bp, Artificial Sequence
  Synthetic Polynucleotide
taatacgactcactatagggatacaacagatgattctatatcatcatgttaacagaggagaaacatgatgatatagaataacctggcggcagcgcaaaagatg

SEQ ID NO: 61009 - DNA, 103 bp, Artificial Sequence
  Synthetic Polynucleotide
taatacgactcactatagggtaatgatacaacagatgattctatatcatcaacagaggagagatgatatggaatcatctaacctggcggcagcgcaaaagatg

SEQ ID NO: 61010 - DNA, 103 bp, Artificial Sequence
  Synthetic Polynucleotide
taatacgactcactatagggcagactaatgatacaacagatgattctataaacagaggagatatagaatgatctgttgtaacctggcggcagcgcaaaagatg

SEQ ID NO: 61011 - DNA, 103 bp, Artificial Sequence
  Synthetic Polynucleotide
taatacgactcactatagggctaatcagactaatgatacaacagatgattaacagaggagaaatcatatgttgtatcataacctggcggcagcgcaaaagatg

SEQ ID NO: 61012 - DNA, 103 bp, Artificial Sequence
  Synthetic Polynucleotide
taatacgactcactatagggggaaactaatcagactaatgatacaacagaaacagaggagatctgttatgtcattagtcaacctggcggcagcgcaaaagatg

SEQ ID NO: 61013 - DNA, 103 bp, Artificial Sequence
  Synthetic Polynucleotide
taatacgactcactatagggaaaaaggaaactaatcagactaatgatacaaacagaggagatgtatcatgagtctgattaacctggcggcagcgcaaaagatg

SEQ ID NO: 61014 - DNA, 103 bp, Artificial Sequence
  Synthetic Polynucleotide
taatacgactcactatagggtaggtattatgccaatatttgtttagatttaacagaggagaaaatctatgcaaatattgaacctggcggcagcgcaaaagatg

SEQ ID NO: 61015 - DNA, 103 bp, Artificial Sequence
  Synthetic Polynucleotide
taatacgactcactataggggatattccacctgttgtagatctatgtgtaaacagaggagatacacaatgatctacaacaacctggcggcagcgcaaaagatg

SEQ ID NO: 61016 - DNA, 103 bp, Artificial Sequence
  Synthetic Polynucleotide
taatacgactcactatagggtttataaaaaggaaactaatcagactaatgaacagaggagacattagatggattagtttaacctggcggcagcgcaaaagatg

SEQ ID NO: 61017 - DNA, 103 bp, Artificial Sequence
  Synthetic Polynucleotide
taatacgactcactatagggtcaattttataaaaaggaaactaatcagacaacagaggagagtctgaatggtttcctttaacctggcggcagcgcaaaagatg

SEQ ID NO: 61018 - DNA, 103 bp, Artificial Sequence
  Synthetic Polynucleotide
taatacgactcactatagggttacttcaattttataaaaaggaaactaataacagaggagaattagtatgctttttataaacctggcggcagcgcaaaagatg

SEQ ID NO: 61019 - DNA, 103 bp, Artificial Sequence
  Synthetic Polynucleotide
taatacgactcactatagggaaatattacttcaattttataaaaaggaaaaacagaggagatttcctatgtataaaattaacctggcggcagcgcaaaagatg

SEQ ID NO: 61020 - DNA, 103 bp, Artificial Sequence
  Synthetic Polynucleotide
taatacgactcactatagggatactaaatattacttcaattttataaaaaaacagaggagatttttaatgaattgaagtaacctggcggcagcgcaaaagatg

SEQ ID NO: 61021 - DNA, 103 bp, Artificial Sequence
  Synthetic Polynucleotide
taatacgactcactatagggaattaatactaaatattacttcaattttataacagaggagaataaaaatgaagtaatataacctggcggcagcgcaaaagatg

SEQ ID NO: 61022 - DNA, 103 bp, Artificial Sequence
  Synthetic Polynucleotide
taatacgactcactataggggtagcaattaatactaaatattacttcaataacagaggagaattgaaatgatatttagtaacctggcggcagcgcaaaagatg

SEQ ID NO: 61023 - DNA, 103 bp, Artificial Sequence
  Synthetic Polynucleotide
taatacgactcactatagggtaacggtagcaattaatactaaatattactaacagaggagaagtaatatgtagtattaaaacctggcggcagcgcaaaagatg

SEQ ID NO: 61024 - DNA, 103 bp, Artificial Sequence
  Synthetic Polynucleotide
taatacgactcactatagggcaatgtaacggtagcaattaatactaaataaacagaggagatatttaatgttaattgctaacctggcggcagcgcaaaagatg

SEQ ID NO: 61025 - DNA, 103 bp, Artificial Sequence
  Synthetic Polynucleotide
taatacgactcactatagggttgtacaatgtaacggtagcaattaatactaacagaggagaagtattatgtgctaccgtaacctggcggcagcgcaaaagatg

SEQ ID NO: 61026 - DNA, 103 bp, Artificial Sequence
  Synthetic Polynucleotide
taatacgactcactatagggtaattgatattccacctgttgtagatctataacagaggagaatagatatgcaacaggtgaacctggcggcagcgcaaaagatg

SEQ ID NO: 61027 - DNA, 103 bp, Artificial Sequence
  Synthetic Polynucleotide
taatacgactcactatagggtccatttgtacaatgtaacggtagcaattaaacagaggagataattgatgccgttacataacctggcggcagcgcaaaagatg

SEQ ID NO: 61028 - DNA, 103 bp, Artificial Sequence
  Synthetic Polynucleotide
taatacgactcactatagggatatctccatttgtacaatgtaacggtagcaacagaggagagctaccatgacattgtacaacctggcggcagcgcaaaagatg

SEQ ID NO: 61029 - DNA, 103 bp, Artificial Sequence
  Synthetic Polynucleotide
taatacgactcactatagggagggaatatctccatttgtacaatgtaacgaacagaggagacgttacatggtacaaatgaacctggcggcagcgcaaaagatg

SEQ ID NO: 61030 - DNA, 103 bp, Artificial Sequence
  Synthetic Polynucleotide
taatacgactcactatagggaatacagggaatatctccatttgtacaatgaacagaggagacattgtatgaatggagataacctggcggcagcgcaaaagatg

SEQ ID NO: 61031 - DNA, 103 bp, Artificial Sequence
  Synthetic Polynucleotide
taatacgactcactatagggtgccaaatacagggaatatctccatttgtaaacagaggagatacaaaatgagatattccaacctggcggcagcgcaaaagatg

SEQ ID NO: 61032 - DNA, 103 bp, Artificial Sequence
  Synthetic Polynucleotide
taatacgactcactatagggagaaatgccaaatacagggaatatctccataacagaggagaatggagatgttccctgtaaacctggcggcagcgcaaaagatg

SEQ ID NO: 61033 - DNA, 103 bp, Artificial Sequence
  Synthetic Polynucleotide
taatacgactcactatagggattttagaaatgccaaatacagggaatatcaacagaggagagatattatgtgtatttggaacctggcggcagcgcaaaagatg

SEQ ID NO: 61034 - DNA, 103 bp, Artificial Sequence
  Synthetic Polynucleotide
taatacgactcactatagggtgctaattttagaaatgccaaatacagggaaacagaggagatccctgatgttggcatttaacctggcggcagcgcaaaagatg

SEQ ID NO: 61035 - DNA, 103 bp, Artificial Sequence
  Synthetic Polynucleotide
taatacgactcactatagggaaaattgctaattttagaaatgccaaatacaacagaggagagtatttatgatttctaaaaacctggcggcagcgcaaaagatg

SEQ ID NO: 61036 - DNA, 103 bp, Artificial Sequence
  Synthetic Polynucleotide
taatacgactcactataggggcaataaaattgctaattttagaaatgccaaacagaggagatggcatatgtaaaattagaacctggcggcagcgcaaaagatg

SEQ ID NO: 61037 - DNA, 103 bp, Artificial Sequence
  Synthetic Polynucleotide
taatacgactcactatagggcgtattaattgatattccacctgttgtagaaacagaggagatctacaatgggtggaataaacctggcggcagcgcaaaagatg

SEQ ID NO: 61038 - DNA, 103 bp, Artificial Sequence
  Synthetic Polynucleotide
taatacgactcactatagggtattagcaataaaattgctaattttagaaaaacagaggagatttctaatgttagcaattaacctggcggcagcgcaaaagatg

SEQ ID NO: 61039 - DNA, 103 bp, Artificial Sequence
  Synthetic Polynucleotide
taatacgactcactataggggtcattattagcaataaaattgctaattttaacagaggagaaaaattatgaattttattaacctggcggcagcgcaaaagatg

SEQ ID NO: 61040 - DNA, 103 bp, Artificial Sequence
  Synthetic Polynucleotide
taatacgactcactatagggctacagtcattattagcaataaaattgctaaacagaggagatagcaaatgtattgctaaaacctggcggcagcgcaaaagatg

SEQ ID NO: 61041 - DNA, 103 bp, Artificial Sequence
  Synthetic Polynucleotide
taatacgactcactatagggaatatctacagtcattattagcaataaaataacagaggagaattttaatgctaataatgaacctggcggcagcgcaaaagatg

SEQ ID NO: 61042 - DNA, 103 bp, Artificial Sequence
  Synthetic Polynucleotide
taatacgactcactatagggtatataatatctacagtcattattagcaataacagaggagaattgctatgaatgactgtaacctggcggcagcgcaaaagatg

SEQ ID NO: 61043 - DNA, 103 bp, Artificial Sequence
  Synthetic Polynucleotide
taatacgactcactataggggtatctatataatatctacagtcattattaaacagaggagataataaatgctgtagataaacctggcggcagcgcaaaagatg

SEQ ID NO: 61044 - DNA, 103 bp, Artificial Sequence
  Synthetic Polynucleotide
taatacgactcactataggggttctgtatctatataatatctacagtcataacagaggagaatgactatggatattataaacctggcggcagcgcaaaagatg

SEQ ID NO: 61045 - DNA, 103 bp, Artificial Sequence
  Synthetic Polynucleotide
taatacgactcactatagggatgatgttctgtatctatataatatctacaaacagaggagatgtagaatgtatatagataacctggcggcagcgcaaaagatg

SEQ ID NO: 61046 - DNA, 103 bp, Artificial Sequence
  Synthetic Polynucleotide
taatacgactcactatagggttttaatgatgttctgtatctatataatataacagaggagaatattaatgagatacagaaacctggcggcagcgcaaaagatg

SEQ ID NO: 61047 - DNA, 103 bp, Artificial Sequence
  Synthetic Polynucleotide
taatacgactcactatagggtaattttttaatgatgttctgtatctatataacagaggagaatatagatgcagaacatcaacctggcggcagcgcaaaagatg

SEQ ID NO: 61048 - DNA, 103 bp, Artificial Sequence
  Synthetic Polynucleotide
taatacgactcactataggggctgccgtattaattgatattccacctgttaacagaggagaaacaggatgaatatcaataacctggcggcagcgcaaaagatg

SEQ ID NO: 61049 - DNA, 103 bp, Artificial Sequence
  Synthetic Polynucleotide
taatacgactcactatagggaggtataattttttaatgatgttctgtatcaacagaggagagatacaatgcatcattaaaacctggcggcagcgcaaaagatg

SEQ ID NO: 61050 - DNA, 103 bp, Artificial Sequence
  Synthetic Polynucleotide
taatacgactcactatagggtcattaggtataattttttaatgatgttctaacagaggagaagaacaatgttaaaaaataacctggcggcagcgcaaaagatg

SEQ ID NO: 61051 - DNA, 103 bp, Artificial Sequence
  Synthetic Polynucleotide
taatacgactcactatagggtgatctcattaggtataattttttaatgataacagaggagaatcattatgaaattatacaacctggcggcagcgcaaaagatg

SEQ ID NO: 61052 - DNA, 103 bp, Artificial Sequence
  Synthetic Polynucleotide
taatacgactcactatagggtctattgatctcattaggtataattttttaaacagaggagataaaaaatgatacctaataacctggcggcagcgcaaaagatg

SEQ ID NO: 61053 - DNA, 103 bp, Artificial Sequence
  Synthetic Polynucleotide
taatacgactcactatagggatctgtctattgatctcattaggtataattaacagaggagaaattatatgtaatgagataacctggcggcagcgcaaaagatg

SEQ ID NO: 61054 - DNA, 103 bp, Artificial Sequence
  Synthetic Polynucleotide
taatacgactcactatagggcatccatctgtctattgatctcattaggtaaacagaggagatacctaatgagatcaataaacctggcggcagcgcaaaagatg

SEQ ID NO: 61055 - DNA, 103 bp, Artificial Sequence
  Synthetic Polynucleotide
taatacgactcactatagggcatttcatccatctgtctattgatctcattaacagaggagaaatgagatgaatagacagaacctggcggcagcgcaaaagatg

SEQ ID NO: 61056 - DNA, 103 bp, Artificial Sequence
  Synthetic Polynucleotide
taatacgactcactatagggagtaccatttcatccatctgtctattgatcaacagaggagagatcaaatgacagatggaaacctggcggcagcgcaaaagatg

SEQ ID NO: 61057 - DNA, 103 bp, Artificial Sequence
  Synthetic Polynucleotide
taatacgactcactatagggtaagaagtaccatttcatccatctgtctataacagaggagaatagacatgtggatgaaaaacctggcggcagcgcaaaagatg

SEQ ID NO: 61058 - DNA, 103 bp, Artificial Sequence
  Synthetic Polynucleotide
taatacgactcactataggggttggtaagaagtaccatttcatccatctgaacagaggagacagatgatggaaatggtaaacctggcggcagcgcaaaagatg

SEQ ID NO: 61059 - DNA, 103 bp, Artificial Sequence
  Synthetic Polynucleotide
taatacgactcactatagggtagttgctgccgtattaattgatattccacaacagaggagagtggaaatgcaattaataaacctggcggcagcgcaaaagatg

SEQ ID NO: 61060 - DNA, 103 bp, Artificial Sequence
  Synthetic Polynucleotide
taatacgactcactatagggaagatgttggtaagaagtaccatttcatccaacagaggagaggatgaatgggtacttctaacctggcggcagcgcaaaagatg

SEQ ID NO: 61061 - DNA, 103 bp, Artificial Sequence
  Synthetic Polynucleotide
taatacgactcactatagggcgcttaagatgttggtaagaagtaccatttaacagaggagaaaatggatgttcttaccaaacctggcggcagcgcaaaagatg

SEQ ID NO: 61062 - DNA, 103 bp, Artificial Sequence
  Synthetic Polynucleotide
taatacgactcactatagggttctacgcttaagatgttggtaagaagtacaacagaggagagtacttatgaccaacatcaacctggcggcagcgcaaaagatg

SEQ ID NO: 61063 - DNA, 103 bp, Artificial Sequence
  Synthetic Polynucleotide
taatacgactcactatagggacaacttctacgcttaagatgttggtaagaaacagaggagatcttacatgcatcttaagaacctggcggcagcgcaaaagatg

SEQ ID NO: 61064 - DNA, 103 bp, Artificial Sequence
  Synthetic Polynucleotide
taatacgactcactatagggtatttacaacttctacgcttaagatgttggaacagaggagaccaacaatgtaagcgtagaacctggcggcagcgcaaaagatg

SEQ ID NO: 61065 - DNA, 103 bp, Artificial Sequence
  Synthetic Polynucleotide
taatacgactcactatagggattgttatttacaacttctacgcttaagataacagaggagaatcttaatggtagaagttaacctggcggcagcgcaaaagatg

SEQ ID NO: 61066 - DNA, 103 bp, Artificial Sequence
  Synthetic Polynucleotide
taatacgactcactatagggatctcattgttatttacaacttctacgcttaacagaggagaaagcgtatgagttgtaaaaacctggcggcagcgcaaaagatg

SEQ ID NO: 61067 - DNA, 103 bp, Artificial Sequence
  Synthetic Polynucleotide
taatacgactcactataggggatacatctcattgttatttacaacttctaaacagaggagatagaagatgtaaataacaaacctggcggcagcgcaaaagatg

SEQ ID NO: 61068 - DNA, 103 bp, Artificial Sequence
  Synthetic Polynucleotide
taatacgactcactatagggaagatgatacatctcattgttatttacaacaacagaggagagttgtaatgaacaatgagaacctggcggcagcgcaaaagatg

SEQ ID NO: 61069 - DNA, 103 bp, Artificial Sequence
  Synthetic Polynucleotide
taatacgactcactatagggggaataagatgatacatctcattgttatttaacagaggagaaaataaatgtgagatgtaaacctggcggcagcgcaaaagatg

SEQ ID NO: 61070 - DNA, 103 bp, Artificial Sequence
  Synthetic Polynucleotide
taatacgactcactataggggatactagttgctgccgtattaattgatataacagaggagaatatcaatgaatacggcaaacctggcggcagcgcaaaagatg

SEQ ID NO: 61071 - DNA, 103 bp, Artificial Sequence
  Synthetic Polynucleotide
taatacgactcactatagggtatggggaataagatgatacatctcattgtaacagaggagaacaatgatgtgtatcatcaacctggcggcagcgcaaaagatg

SEQ ID NO: 61072 - DNA, 103 bp, Artificial Sequence
  Synthetic Polynucleotide
taatacgactcactatagggtagtctatggggaataagatgatacatctcaacagaggagagagatgatgcatcttattaacctggcggcagcgcaaaagatg

SEQ ID NO: 61073 - DNA, 103 bp, Artificial Sequence
  Synthetic Polynucleotide
taatacgactcactatagggatcgatagtctatggggaataagatgatacaacagaggagagtatcaatgtattccccaaacctggcggcagcgcaaaagatg

SEQ ID NO: 61074 - DNA, 103 bp, Artificial Sequence
  Synthetic Polynucleotide
taatacgactcactatagggtaatcatcgatagtctatggggaataagataacagaggagaatcttaatgcccatagacaacctggcggcagcgcaaaagatg

SEQ ID NO: 61075 - DNA, 103 bp, Artificial Sequence
  Synthetic Polynucleotide
taatacgactcactataggggagtataatcatcgatagtctatggggaataacagaggagaattcccatgagactatcgaacctggcggcagcgcaaaagatg

SEQ ID NO: 61076 - DNA, 103 bp, Artificial Sequence
  Synthetic Polynucleotide
taatacgactcactatagggatacagagtataatcatcgatagtctatggaacagaggagaccatagatgatcgatgataacctggcggcagcgcaaaagatg

SEQ ID NO: 61077 - DNA, 103 bp, Artificial Sequence
  Synthetic Polynucleotide
taatacgactcactatagggaactaatacagagtataatcatcgatagtcaacagaggagagactatatgtgattatacaacctggcggcagcgcaaaagatg

SEQ ID NO: 61078 - DNA, 103 bp, Artificial Sequence
  Synthetic Polynucleotide
taatacgactcactatagggaatagaactaatacagagtataatcatcgaaacagaggagatcgatgatgatactctgtaacctggcggcagcgcaaaagatg

SEQ ID NO: 61079 - DNA, 103 bp, Artificial Sequence
  Synthetic Polynucleotide
taatacgactcactatagggcttccaatagaactaatacagagtataatcaacagaggagagattatatgctgtattagaacctggcggcagcgcaaaagatg

SEQ ID NO: 61080 - DNA, 103 bp, Artificial Sequence
  Synthetic Polynucleotide
taatacgactcactatagggcacatcttccaatagaactaatacagagtaaacagaggagatactctatgttagttctaaacctggcggcagcgcaaaagatg

SEQ ID NO: 61081 - DNA, 103 bp, Artificial Sequence
  Synthetic Polynucleotide
taatacgactcactataggggagatgatactagttgctgccgtattaattaacagaggagaaattaaatgggcagcaacaacctggcggcagcgcaaaagatg

SEQ ID NO: 61082 - DNA, 103 bp, Artificial Sequence
  Synthetic Polynucleotide
taatacgactcactataggggataacacatcttccaatagaactaatacaaacagaggagatgtattatgtctattggaaacctggcggcagcgcaaaagatg

SEQ ID NO: 61083 - DNA, 103 bp, Artificial Sequence
  Synthetic Polynucleotide
taatacgactcactatagggatagagataacacatcttccaatagaactaaacagaggagatagttcatgtggaagatgaacctggcggcagcgcaaaagatg

SEQ ID NO: 61084 - DNA, 103 bp, Artificial Sequence
  Synthetic Polynucleotide
taatacgactcactatagggtatctatagagataacacatcttccaatagaacagaggagactattgatggatgtgttaaacctggcggcagcgcaaaagatg

SEQ ID NO: 61085 - DNA, 103 bp, Artificial Sequence
  Synthetic Polynucleotide
taatacgactcactataggggtcattatctatagagataacacatcttccaacagaggagaggaagaatggttatctctaacctggcggcagcgcaaaagatg

SEQ ID NO: 61086 - DNA, 103 bp, Artificial Sequence
  Synthetic Polynucleotide
taatacgactcactatagggttaacgtcattatctatagagataacacataacagaggagaatgtgtatgctctatagaaacctggcggcagcgcaaaagatg

SEQ ID NO: 61087 - DNA, 103 bp, Artificial Sequence
  Synthetic Polynucleotide
taatacgactcactatagggtgttattaacgtcattatctatagagataaaacagaggagattatctatgtagataatgaacctggcggcagcgcaaaagatg

SEQ ID NO: 61088 - DNA, 103 bp, Artificial Sequence
  Synthetic Polynucleotide
taatacgactcactatagggatttttgttattaacgtcattatctatagaaacagaggagatctataatgaatgacgttaacctggcggcagcgcaaaagatg

SEQ ID NO: 61089 - DNA, 103 bp, Artificial Sequence
  Synthetic Polynucleotide
taatacgactcactatagggagaatatttttgttattaacgtcattatctaacagaggagaagataaatgcgttaataaaacctggcggcagcgcaaaagatg

SEQ ID NO: 61090 - DNA, 103 bp, Artificial Sequence
  Synthetic Polynucleotide
taatacgactcactatagggaggttagaatatttttgttattaacgtcataacagaggagaatgacgatgataacaaaaaacctggcggcagcgcaaaagatg

SEQ ID NO: 61091 - DNA, 103 bp, Artificial Sequence
  Synthetic Polynucleotide
taatacgactcactataggggggaaaggttagaatatttttgttattaacaacagaggagagttaatatgaaaaatattaacctggcggcagcgcaaaagatg

SEQ ID NO: 61092 - DNA, 103 bp, Artificial Sequence
  Synthetic Polynucleotide
taatacgactcactatagggatgtagagatgatactagttgctgccgtataacagaggagaatacggatgcaactagtaaacctggcggcagcgcaaaagatg

SEQ ID NO: 61093 - DNA, 103 bp, Artificial Sequence
  Synthetic Polynucleotide
taatacgactcactatagggtcaatgggaaaggttagaatatttttgttaaacagaggagataacaaatgtattctaacaacctggcggcagcgcaaaagatg

SEQ ID NO: 61094 - DNA, 103 bp, Artificial Sequence
  Synthetic Polynucleotide
taatacgactcactatagggcatgatcaatgggaaaggttagaatattttaacagaggagaaaaataatgtaacctttcaacctggcggcagcgcaaaagatg

SEQ ID NO: 61095 - DNA, 103 bp, Artificial Sequence
  Synthetic Polynucleotide
taatacgactcactatagggtacagcatgatcaatgggaaaggttagaataacagaggagaattctaatgtttcccattaacctggcggcagcgcaaaagatg

SEQ ID NO: 61096 - DNA, 103 bp, Artificial Sequence
  Synthetic Polynucleotide
taatacgactcactatagggatgattacagcatgatcaatgggaaaggttaacagaggagaaaccttatgcattgatcaaacctggcggcagcgcaaaagatg

SEQ ID NO: 61097 - DNA, 103 bp, Artificial Sequence
  Synthetic Polynucleotide
taatacgactcactataggggggatatgattacagcatgatcaatgggaaaacagaggagattcccaatgatcatgctgaacctggcggcagcgcaaaagatg

SEQ ID NO: 61098 - DNA, 103 bp, Artificial Sequence
  Synthetic Polynucleotide
taatacgactcactatagggttagtgggatatgattacagcatgatcaataacagaggagaattgatatggctgtaatcaacctggcggcagcgcaaaagatg

SEQ ID NO: 61099 - DNA, 103 bp, Artificial Sequence
  Synthetic Polynucleotide
taatacgactcactatagggtttacttagtgggatatgattacagcatgaaacagaggagatcatgcatgaatcatatcaacctggcggcagcgcaaaagatg

SEQ ID NO: 61100 - DNA, 103 bp, Artificial Sequence
  Synthetic Polynucleotide
taatacgactcactatagggacacatttacttagtgggatatgattacagaacagaggagactgtaaatgtatcccactaacctggcggcagcgcaaaagatg

SEQ ID NO: 61101 - DNA, 103 bp, Artificial Sequence
  Synthetic Polynucleotide
taatacgactcactatagggctacgacacatttacttagtgggatatgataacagaggagaatcataatgcactaagtaaacctggcggcagcgcaaaagatg

SEQ ID NO: 61102 - DNA, 103 bp, Artificial Sequence
  Synthetic Polynucleotide
taatacgactcactatagggactaactacgacacatttacttagtgggataacagaggagaatcccaatgagtaaatgtaacctggcggcagcgcaaaagatg

SEQ ID NO: 61103 - DNA, 103 bp, Artificial Sequence
  Synthetic Polynucleotide
taatacgactcactatagggaaacaatgtagagatgatactagttgctgcaacagaggagagcagcaatgagtatcatcaacctggcggcagcgcaaaagatg

SEQ ID NO: 61104 - DNA, 103 bp, Artificial Sequence
  Synthetic Polynucleotide
taatacgactcactatagggcccttactaactacgacacatttacttagtaacagaggagaactaagatgatgtgtcgtaacctggcggcagcgcaaaagatg

SEQ ID NO: 61105 - DNA, 103 bp, Artificial Sequence
  Synthetic Polynucleotide
taatacgactcactatagggtaggacccttactaactacgacacatttacaacagaggagagtaaatatgtcgtagttaaacctggcggcagcgcaaaagatg

SEQ ID NO: 61106 - DNA, 103 bp, Artificial Sequence
  Synthetic Polynucleotide
taatacgactcactatagggggttgtaggacccttactaactacgacacaaacagaggagatgtgtcatggttagtaagaacctggcggcagcgcaaaagatg

SEQ ID NO: 61107 - DNA, 103 bp, Artificial Sequence
  Synthetic Polynucleotide
taatacgactcactatagggaatatggttgtaggacccttactaactacgaacagaggagacgtagtatgtaagggtccaacctggcggcagcgcaaaagatg

SEQ ID NO: 61108 - DNA, 103 bp, Artificial Sequence
  Synthetic Polynucleotide
taatacgactcactatagggcaaccaatatggttgtaggacccttactaaaacagaggagattagtaatggtcctacaaaacctggcggcagcgcaaaagatg

SEQ ID NO: 61109 - DNA, 103 bp, Artificial Sequence
  Synthetic Polynucleotide
taatacgactcactatagggtttaacaaccaatatggttgtaggacccttaacagaggagaaagggtatgacaaccataaacctggcggcagcgcaaaagatg

SEQ ID NO: 61110 - DNA, 103 bp, Artificial Sequence
  Synthetic Polynucleotide
taatacgactcactatagggtccgctttaacaaccaatatggttgtaggaaacagaggagatcctacatgcatattggtaacctggcggcagcgcaaaagatg

SEQ ID NO: 61111 - DNA, 103 bp, Artificial Sequence
  Synthetic Polynucleotide
taatacgactcactataggggtatatccgctttaacaaccaatatggttgaacagaggagacaaccaatgtggttgttaaacctggcggcagcgcaaaagatg

SEQ ID NO: 61112 - DNA, 103 bp, Artificial Sequence
  Synthetic Polynucleotide
taatacgactcactataggggctgggtatatccgctttaacaaccaatataacagaggagaatattgatggttaaagcgaacctggcggcagcgcaaaagatg

SEQ ID NO: 61113 - DNA, 103 bp, Artificial Sequence
  Synthetic Polynucleotide
taatacgactcactatagggcgtttgctgggtatatccgctttaacaaccaacagaggagaggttgtatgagcggatataacctggcggcagcgcaaaagatg

SEQ ID NO: 61114 - DNA, 103 bp, Artificial Sequence
  Synthetic Polynucleotide
taatacgactcactatagggaccgtaaacaatgtagagatgatactagttaacagaggagaaactagatgcatctctacaacctggcggcagcgcaaaagatg

SEQ ID NO: 61115 - DNA, 103 bp, Artificial Sequence
  Synthetic Polynucleotide
taatacgactcactatagggtatgtcgtttgctgggtatatccgctttaaaacagaggagattaaagatgatatacccaaacctggcggcagcgcaaaagatg

SEQ ID NO: 61116 - DNA, 103 bp, Artificial Sequence
  Synthetic Polynucleotide
taatacgactcactatagggtatagtatgtcgtttgctgggtatatccgcaacagaggagagcggatatgcccagcaaaaacctggcggcagcgcaaaagatg

SEQ ID NO: 61117 - DNA, 103 bp, Artificial Sequence
  Synthetic Polynucleotide
taatacgactcactatagggttacatatagtatgtcgtttgctgggtataaacagaggagatataccatgcaaacgacaaacctggcggcagcgcaaaagatg

SEQ ID NO: 61118 - DNA, 103 bp, Artificial Sequence
  Synthetic Polynucleotide
taatacgactcactatagggattatttacatatagtatgtcgtttgctggaacagaggagaccagcaatggacatactaaacctggcggcagcgcaaaagatg

SEQ ID NO: 61119 - DNA, 103 bp, Artificial Sequence
  Synthetic Polynucleotide
taatacgactcactataggggacagattatttacatatagtatgtcgtttaacagaggagaaaacgaatgactatatgtaacctggcggcagcgcaaaagatg

SEQ ID NO: 61120 - DNA, 103 bp, Artificial Sequence
  Synthetic Polynucleotide
taatacgactcactatagggtcagtgacagattatttacatatagtatgtaacagaggagaacatacatgatgtaaataaacctggcggcagcgcaaaagatg

SEQ ID NO: 61121 - DNA, 103 bp, Artificial Sequence
  Synthetic Polynucleotide
taatacgactcactatagggattaatcagtgacagattatttacatatagaacagaggagactatatatgaataatctgaacctggcggcagcgcaaaagatg

SEQ ID NO: 61122 - DNA, 103 bp, Artificial Sequence
  Synthetic Polynucleotide
taatacgactcactatagggaaataattaatcagtgacagattatttacaaacagaggagatgtaaaatgtctgtcactaacctggcggcagcgcaaaagatg

SEQ ID NO: 61123 - DNA, 103 bp, Artificial Sequence
  Synthetic Polynucleotide
taatacgactcactatagggacggcaaataattaatcagtgacagattataacagaggagaataatcatgcactgattaaacctggcggcagcgcaaaagatg

SEQ ID NO: 61124 - DNA, 103 bp, Artificial Sequence
  Synthetic Polynucleotide
taatacgactcactatagggagacaacggcaaataattaatcagtgacagaacagaggagactgtcaatgattaattataacctggcggcagcgcaaaagatg

SEQ ID NO: 61125 - DNA, 103 bp, Artificial Sequence
  Synthetic Polynucleotide
taatacgactcactatagggatagataggtattatgccaatatttgtttaaacagaggagataaacaatgattggcataaacctggcggcagcgcaaaagatg

SEQ ID NO: 61126 - DNA, 103 bp, Artificial Sequence
  Synthetic Polynucleotide
taatacgactcactatagggacatcaccgtaaacaatgtagagatgatacaacagaggagagtatcaatgctacattgtaacctggcggcagcgcaaaagatg

SEQ ID NO: 61127 - DNA, 103 bp, Artificial Sequence
  Synthetic Polynucleotide
taatacgactcactatagggaatacagacaacggcaaataattaatcagtaacagaggagaactgatatgttatttgccaacctggcggcagcgcaaaagatg

SEQ ID NO: 61128 - DNA, 103 bp, Artificial Sequence
  Synthetic Polynucleotide
taatacgactcactatagggtaatgaatacagacaacggcaaataattaaaacagaggagattaattatgtgccgttgtaacctggcggcagcgcaaaagatg

SEQ ID NO: 61129 - DNA, 103 bp, Artificial Sequence
  Synthetic Polynucleotide
taatacgactcactatagggtctaataatgaatacagacaacggcaaataaacagaggagatatttgatgttgtctgtaaacctggcggcagcgcaaaagatg

SEQ ID NO: 61130 - DNA, 103 bp, Artificial Sequence
  Synthetic Polynucleotide
taatacgactcactatagggactcgtctaataatgaatacagacaacggcaacagaggagagccgttatgtgtattcataacctggcggcagcgcaaaagatg

SEQ ID NO: 61131 - DNA, 103 bp, Artificial Sequence
  Synthetic Polynucleotide
taatacgactcactatagggttgtaactcgtctaataatgaatacagacaaacagaggagatgtctgatgtcattattaaacctggcggcagcgcaaaagatg

SEQ ID NO: 61132 - DNA, 103 bp, Artificial Sequence
  Synthetic Polynucleotide
taatacgactcactatagggatagtttgtaactcgtctaataatgaatacaacagaggagagtattcatgattagacgaaacctggcggcagcgcaaaagatg

SEQ ID NO: 61133 - DNA, 103 bp, Artificial Sequence
  Synthetic Polynucleotide
taatacgactcactatagggtccaaatagtttgtaactcgtctaataatgaacagaggagacattatatgacgagttacaacctggcggcagcgcaaaagatg

SEQ ID NO: 61134 - DNA, 103 bp, Artificial Sequence
  Synthetic Polynucleotide
taatacgactcactataggggtctatccaaatagtttgtaactcgtctaaaacagaggagattagacatgttacaaactaacctggcggcagcgcaaaagatg

SEQ ID NO: 61135 - DNA, 103 bp, Artificial Sequence
  Synthetic Polynucleotide
taatacgactcactatagggtatgtgtctatccaaatagtttgtaactcgaacagaggagacgagttatgaactatttgaacctggcggcagcgcaaaagatg

SEQ ID NO: 61136 - DNA, 103 bp, Artificial Sequence
  Synthetic Polynucleotide
taatacgactcactatagggtcgcatatgtgtctatccaaatagtttgtaaacagaggagatacaaaatgtttggatagaacctggcggcagcgcaaaagatg

SEQ ID NO: 61137 - DNA, 103 bp, Artificial Sequence
  Synthetic Polynucleotide
taatacgactcactataggggataaacatcaccgtaaacaatgtagagataacagaggagaatctctatgttgtttacgaacctggcggcagcgcaaaagatg

SEQ ID NO: 61138 - DNA, 103 bp, Artificial Sequence
  Synthetic Polynucleotide
taatacgactcactatagggtctgatcgcatatgtgtctatccaaatagtaacagaggagaactattatgatagacacaaacctggcggcagcgcaaaagatg

SEQ ID NO: 61139 - DNA, 103 bp, Artificial Sequence
  Synthetic Polynucleotide
taatacgactcactatagggaaatatctgatcgcatatgtgtctatccaaaacagaggagattggatatgcacatatgcaacctggcggcagcgcaaaagatg

SEQ ID NO: 61140 - DNA, 103 bp, Artificial Sequence
  Synthetic Polynucleotide
taatacgactcactatagggttagcaaatatctgatcgcatatgtgtctaaacagaggagatagacaatgatgcgatcaaacctggcggcagcgcaaaagatg

SEQ ID NO: 61141 - DNA, 103 bp, Artificial Sequence
  Synthetic Polynucleotide
taatacgactcactatagggtattattagcaaatatctgatcgcatatgtaacagaggagaacatatatgatcagatataacctggcggcagcgcaaaagatg

SEQ ID NO: 61142 - DNA, 103 bp, Artificial Sequence
  Synthetic Polynucleotide
taatacgactcactatagggccacttattattagcaaatatctgatcgcaaacagaggagatgcgatatgatatttgctaacctggcggcagcgcaaaagatg

SEQ ID NO: 61143 - DNA, 103 bp, Artificial Sequence
  Synthetic Polynucleotide
taatacgactcactataggggaataccacttattattagcaaatatctgaaacagaggagatcagatatgtgctaataaaacctggcggcagcgcaaaagatg

SEQ ID NO: 61144 - DNA, 103 bp, Artificial Sequence
  Synthetic Polynucleotide
taatacgactcactatagggtaatggaataccacttattattagcaaataaacagaggagatatttgatgataataagtaacctggcggcagcgcaaaagatg

SEQ ID NO: 61145 - DNA, 103 bp, Artificial Sequence
  Synthetic Polynucleotide
taatacgactcactatagggggttataatggaataccacttattattagcaacagaggagagctaatatgaagtggtataacctggcggcagcgcaaaagatg

SEQ ID NO: 61146 - DNA, 103 bp, Artificial Sequence
  Synthetic Polynucleotide
taatacgactcactatagggtcgatggttataatggaataccacttattaaacagaggagataataaatggtattccataacctggcggcagcgcaaaagatg

SEQ ID NO: 61147 - DNA, 103 bp, Artificial Sequence
  Synthetic Polynucleotide
taatacgactcactatagggtatcgtcgatggttataatggaataccactaacagaggagaagtggtatgccattataaaacctggcggcagcgcaaaagatg

SEQ ID NO: 61148 - DNA, 103 bp, Artificial Sequence
  Synthetic Polynucleotide
taatacgactcactatagggaagaagataaacatcaccgtaaacaatgtaaacagaggagatacattatgtacggtgataacctggcggcagcgcaaaagatg

SEQ ID NO: 61149 - DNA, 103 bp, Artificial Sequence
  Synthetic Polynucleotide
taatacgactcactatagggctgcttatcgtcgatggttataatggaataaacagaggagatattccatgataaccatcaacctggcggcagcgcaaaagatg

SEQ ID NO: 61150 - DNA, 103 bp, Artificial Sequence
  Synthetic Polynucleotide
taatacgactcactatagggggaaactgcttatcgtcgatggttataatgaacagaggagacattatatgcatcgacgaaacctggcggcagcgcaaaagatg

SEQ ID NO: 61151 - DNA, 103 bp, Artificial Sequence
  Synthetic Polynucleotide
taatacgactcactataggggaataggaaactgcttatcgtcgatggttaaacagaggagataaccaatgacgataagcaacctggcggcagcgcaaaagatg

SEQ ID NO: 61152 - DNA, 103 bp, Artificial Sequence
  Synthetic Polynucleotide
taatacgactcactatagggtgatggaataggaaactgcttatcgtcgataacagaggagaatcgacatgaagcagtttaacctggcggcagcgcaaaagatg

SEQ ID NO: 61153 - DNA, 103 bp, Artificial Sequence
  Synthetic Polynucleotide
taatacgactcactatagggcagtttgatggaataggaaactgcttatcgaacagaggagacgataaatggtttcctataacctggcggcagcgcaaaagatg

SEQ ID NO: 61154 - DNA, 103 bp, Artificial Sequence
  Synthetic Polynucleotide
taatacgactcactatagggctatacagtttgatggaataggaaactgctaacagaggagaagcagtatgctattccataacctggcggcagcgcaaaagatg

SEQ ID NO: 61155 - DNA, 103 bp, Artificial Sequence
  Synthetic Polynucleotide
taatacgactcactatagggcatacctatacagtttgatggaataggaaaaacagaggagatttcctatgccatcaaacaacctggcggcagcgcaaaagatg

SEQ ID NO: 61156 - DNA, 103 bp, Artificial Sequence
  Synthetic Polynucleotide
taatacgactcactataggggaggacatacctatacagtttgatggaataaacagaggagatattccatgaaactgtataacctggcggcagcgcaaaagatg

SEQ ID NO: 61157 - DNA, 103 bp, Artificial Sequence
  Synthetic Polynucleotide
taatacgactcactatagggtggtagaggacatacctatacagtttgatgaacagaggagacatcaaatggtataggtaaacctggcggcagcgcaaaagatg

SEQ ID NO: 61158 - DNA, 103 bp, Artificial Sequence
  Synthetic Polynucleotide
taatacgactcactataggggtacttggtagaggacatacctatacagttaacagaggagaaactgtatgggtatgtccaacctggcggcagcgcaaaagatg

SEQ ID NO: 61159 - DNA, 103 bp, Artificial Sequence
  Synthetic Polynucleotide
taatacgactcactataggggctggaagaagataaacatcaccgtaaacaaacagaggagatgtttaatgtgatgtttaaacctggcggcagcgcaaaagatg

SEQ ID NO: 61160 - DNA, 103 bp, Artificial Sequence
  Synthetic Polynucleotide
taatacgactcactatagggtttatgtacttggtagaggacatacctataaacagaggagatataggatggtcctctacaacctggcggcagcgcaaaagatg

SEQ ID NO: 61161 - DNA, 103 bp, Artificial Sequence
  Synthetic Polynucleotide
taatacgactcactatagggtagaatttatgtacttggtagaggacatacaacagaggagagtatgtatgctaccaagtaacctggcggcagcgcaaaagatg

SEQ ID NO: 61162 - DNA, 103 bp, Artificial Sequence
  Synthetic Polynucleotide
taatacgactcactataggggatgctagaatttatgtacttggtagaggaaacagaggagatcctctatgaagtacataaacctggcggcagcgcaaaagatg

SEQ ID NO: 61163 - DNA, 103 bp, Artificial Sequence
  Synthetic Polynucleotide
taatacgactcactatagggtgctcgatgctagaatttatgtacttggtaaacagaggagataccaaatgcataaattcaacctggcggcagcgcaaaagatg

SEQ ID NO: 61164 - DNA, 103 bp, Artificial Sequence
  Synthetic Polynucleotide
taatacgactcactatagggtatcttgctcgatgctagaatttatgtactaacagaggagaagtacaatgattctagcaaacctggcggcagcgcaaaagatg

SEQ ID NO: 61165 - DNA, 103 bp, Artificial Sequence
  Synthetic Polynucleotide
taatacgactcactatagggtaaagtatcttgctcgatgctagaatttataacagaggagaataaatatgagcatcgagaacctggcggcagcgcaaaagatg

SEQ ID NO: 61166 - DNA, 103 bp, Artificial Sequence
  Synthetic Polynucleotide
taatacgactcactatagggtggattaaagtatcttgctcgatgctagaaaacagaggagattctagatgcgagcaagaaacctggcggcagcgcaaaagatg

SEQ ID NO: 61167 - DNA, 103 bp, Artificial Sequence
  Synthetic Polynucleotide
taatacgactcactatagggaaacatggattaaagtatcttgctcgatgcaacagaggagagcatcgatgaagatacttaacctggcggcagcgcaaaagatg

SEQ ID NO: 61168 - DNA, 103 bp, Artificial Sequence
  Synthetic Polynucleotide
taatacgactcactataggggttacaaacatggattaaagtatcttgctcaacagaggagagagcaaatgactttaatcaacctggcggcagcgcaaaagatg

SEQ ID NO: 61169 - DNA, 103 bp, Artificial Sequence
  Synthetic Polynucleotide
taatacgactcactatagggtcgaggttacaaacatggattaaagtatctaacagaggagaagatacatgaatccatgtaacctggcggcagcgcaaaagatg

SEQ ID NO: 61170 - DNA, 103 bp, Artificial Sequence
  Synthetic Polynucleotide
taatacgactcactatagggtatacgctggaagaagataaacatcaccgtaacagaggagaacggtgatgtttatcttcaacctggcggcagcgcaaaagatg

SEQ ID NO: 61171 - DNA, 103 bp, Artificial Sequence
  Synthetic Polynucleotide
taatacgactcactataggggatgctcgaggttacaaacatggattaaagaacagaggagactttaaatgatgtttgtaaacctggcggcagcgcaaaagatg

SEQ ID NO: 61172 - DNA, 103 bp, Artificial Sequence
  Synthetic Polynucleotide
taatacgactcactataggggaatggatgctcgaggttacaaacatggataacagaggagaatccatatgtgtaacctcaacctggcggcagcgcaaaagatg

SEQ ID NO: 61173 - DNA, 103 bp, Artificial Sequence
  Synthetic Polynucleotide
taatacgactcactataggggagtcgaatggatgctcgaggttacaaacaaacagaggagatgtttgatgcctcgagcaaacctggcggcagcgcaaaagatg

SEQ ID NO: 61174 - DNA, 103 bp, Artificial Sequence
  Synthetic Polynucleotide
taatacgactcactatagggatactgagtcgaatggatgctcgaggttacaacagaggagagtaaccatgagcatccataacctggcggcagcgcaaaagatg

SEQ ID NO: 61175 - DNA, 103 bp, Artificial Sequence
  Synthetic Polynucleotide
taatacgactcactatagggtttgtatactgagtcgaatggatgctcgagaacagaggagactcgagatgccattcgacaacctggcggcagcgcaaaagatg

SEQ ID NO: 61176 - DNA, 103 bp, Artificial Sequence
  Synthetic Polynucleotide
taatacgactcactataggggcatttttgtatactgagtcgaatggatgcaacagaggagagcatccatgcgactcagtaacctggcggcagcgcaaaagatg

SEQ ID NO: 61177 - DNA, 103 bp, Artificial Sequence
  Synthetic Polynucleotide
taatacgactcactatagggcgactgcatttttgtatactgagtcgaatgaacagaggagacattcgatgcagtatacaaacctggcggcagcgcaaaagatg

SEQ ID NO: 61178 - DNA, 103 bp, Artificial Sequence
  Synthetic Polynucleotide
taatacgactcactatagggttgtacgactgcatttttgtatactgagtcaacagaggagagactcaatgtacaaaaataacctggcggcagcgcaaaagatg

SEQ ID NO: 61179 - DNA, 103 bp, Artificial Sequence
  Synthetic Polynucleotide
taatacgactcactatagggagaatttgtacgactgcatttttgtatactaacagaggagaagtataatgaaatgcagtaacctggcggcagcgcaaaagatg

SEQ ID NO: 61180 - DNA, 103 bp, Artificial Sequence
  Synthetic Polynucleotide
taatacgactcactatagggggtacagaatttgtacgactgcatttttgtaacagaggagaacaaaaatgcagtcgtacaacctggcggcagcgcaaaagatg

SEQ ID NO: 61181 - DNA, 103 bp, Artificial Sequence
  Synthetic Polynucleotide
taatacgactcactataggggactatatacgctggaagaagataaacatcaacagaggagagatgttatgcttcttccaaacctggcggcagcgcaaaagatg

SEQ ID NO: 61182 - DNA, 103 bp, Artificial Sequence
  Synthetic Polynucleotide
taatacgactcactatagggtgataggtacagaatttgtacgactgcattaacagaggagaaatgcaatggtacaaattaacctggcggcagcgcaaaagatg

SEQ ID NO: 61183 - DNA, 103 bp, Artificial Sequence
  Synthetic Polynucleotide
taatacgactcactatagggttccttgataggtacagaatttgtacgactaacagaggagaagtcgtatgaattctgtaaacctggcggcagcgcaaaagatg

SEQ ID NO: 61184 - DNA, 103 bp, Artificial Sequence
  Synthetic Polynucleotide
taatacgactcactatagggatttgttccttgataggtacagaatttgtaaacagaggagatacaaaatgtgtacctataacctggcggcagcgcaaaagatg

SEQ ID NO: 61185 - DNA, 103 bp, Artificial Sequence
  Synthetic Polynucleotide
taatacgactcactatagggacaatatttgttccttgataggtacagaataacagaggagaattctgatgctatcaaggaacctggcggcagcgcaaaagatg

SEQ ID NO: 61186 - DNA, 103 bp, Artificial Sequence
  Synthetic Polynucleotide
taatacgactcactatagggaccgtacaatatttgttccttgataggtacaacagaggagagtacctatgaaggaacaaaacctggcggcagcgcaaaagatg

SEQ ID NO: 61187 - DNA, 103 bp, Artificial Sequence
  Synthetic Polynucleotide
taatacgactcactatagggattctaccgtacaatatttgttccttgataaacagaggagatatcaaatgacaaatattaacctggcggcagcgcaaaagatg

SEQ ID NO: 61188 - DNA, 103 bp, Artificial Sequence
  Synthetic Polynucleotide
taatacgactcactatagggtatcaattctaccgtacaatatttgttcctaacagaggagaaggaacatgtattgtacgaacctggcggcagcgcaaaagatg

SEQ ID NO: 61189 - DNA, 103 bp, Artificial Sequence
  Synthetic Polynucleotide
taatacgactcactatagggtatattatcaattctaccgtacaatatttgaacagaggagacaaataatgtacggtagaaacctggcggcagcgcaaaagatg

SEQ ID NO: 61190 - DNA, 103 bp, Artificial Sequence
  Synthetic Polynucleotide
taatacgactcactatagggatatttatattatcaattctaccgtacaataacagaggagaattgtaatgtagaattgaaacctggcggcagcgcaaaagatg

SEQ ID NO: 61191 - DNA, 103 bp, Artificial Sequence
  Synthetic Polynucleotide
taatacgactcactatagggtgctcatatttatattatcaattctaccgtaacagaggagaacggtaatgttgataataaacctggcggcagcgcaaaagatg

SEQ ID NO: 61192 - DNA, 103 bp, Artificial Sequence
  Synthetic Polynucleotide
taatacgactcactatagggtattagactatatacgctggaagaagataaaacagaggagattatctatgtccagcgtaaacctggcggcagcgcaaaagatg

SEQ ID NO: 61193 - DNA, 103 bp, Artificial Sequence
  Synthetic Polynucleotide
taatacgactcactatagggactaatgctcatatttatattatcaattctaacagaggagaagaattatgaatataaataacctggcggcagcgcaaaagatg

SEQ ID NO: 61194 - DNA, 103 bp, Artificial Sequence
  Synthetic Polynucleotide
taatacgactcactataggggaaatactaatgctcatatttatattatcaaacagaggagatgataaatgaaatatgagaacctggcggcagcgcaaaagatg

SEQ ID NO: 61195 - DNA, 103 bp, Artificial Sequence
  Synthetic Polynucleotide
taatacgactcactatagggccacagaaatactaatgctcatatttatataacagaggagaatataaatgtgagcattaaacctggcggcagcgcaaaagatg

SEQ ID NO: 61196 - DNA, 103 bp, Artificial Sequence
  Synthetic Polynucleotide
taatacgactcactatagggttaatccacagaaatactaatgctcatattaacagaggagaaatatgatgattagtattaacctggcggcagcgcaaaagatg

SEQ ID NO: 61197 - DNA, 103 bp, Artificial Sequence
  Synthetic Polynucleotide
taatacgactcactatagggatctattaatccacagaaatactaatgctcaacagaggagagagcatatgtatttctgtaacctggcggcagcgcaaaagatg

SEQ ID NO: 61198 - DNA, 103 bp, Artificial Sequence
  Synthetic Polynucleotide
taatacgactcactatagggtagaaatctattaatccacagaaatactaaaacagaggagattagtaatgctgtggattaacctggcggcagcgcaaaagatg

SEQ ID NO: 61199 - DNA, 103 bp, Artificial Sequence
  Synthetic Polynucleotide
taatacgactcactatagggcatactagaaatctattaatccacagaaataacagaggagaatttctatggattaatagaacctggcggcagcgcaaaagatg

SEQ ID NO: 61200 - DNA, 103 bp, Artificial Sequence
  Synthetic Polynucleotide
taatacgactcactataggggatcccatactagaaatctattaatccacaaacagaggagatgtggaatgatagatttcaacctggcggcagcgcaaaagatg

SEQ ID NO: 61201 - DNA, 103 bp, Artificial Sequence
  Synthetic Polynucleotide
taatacgactcactatagggttaatgatcccatactagaaatctattaataacagaggagaattaatatgtttctagtaaacctggcggcagcgcaaaagatg

SEQ ID NO: 61202 - DNA, 103 bp, Artificial Sequence
  Synthetic Polynucleotide
taatacgactcactatagggaatgattaatgatcccatactagaaatctaaacagaggagatagattatgagtatgggaaacctggcggcagcgcaaaagatg

SEQ ID NO: 61203 - DNA, 103 bp, Artificial Sequence
  Synthetic Polynucleotide
taatacgactcactatagggatcgctattagactatatacgctggaagaaaacagaggagattcttcatgcgtatatagaacctggcggcagcgcaaaagatg

SEQ ID NO: 61204 - DNA, 103 bp, Artificial Sequence
  Synthetic Polynucleotide
taatacgactcactatagggttagaaatgattaatgatcccatactagaaaacagaggagattctagatggggatcattaacctggcggcagcgcaaaagatg

SEQ ID NO: 61205 - DNA, 103 bp, Artificial Sequence
  Synthetic Polynucleotide
taatacgactcactatagggagagattagaaatgattaatgatcccatacaacagaggagagtatggatgcattaatcaaacctggcggcagcgcaaaagatg

SEQ ID NO: 61206 - DNA, 103 bp, Artificial Sequence
  Synthetic Polynucleotide
taatacgactcactatagggtatttagagattagaaatgattaatgatccaacagaggagaggatcaatgatcatttctaacctggcggcagcgcaaaagatg

SEQ ID NO: 61207 - DNA, 103 bp, Artificial Sequence
  Synthetic Polynucleotide
taatacgactcactatagggtgaggtatttagagattagaaatgattaataacagaggagaattaatatgttctaatctaacctggcggcagcgcaaaagatg

SEQ ID NO: 61208 - DNA, 103 bp, Artificial Sequence
  Synthetic Polynucleotide
taatacgactcactatagggttttatgaggtatttagagattagaaatgaaacagaggagatcatttatgatctctaaaaacctggcggcagcgcaaaagatg

SEQ ID NO: 61209 - DNA, 103 bp, Artificial Sequence
  Synthetic Polynucleotide
taatacgactcactatagggttttgttttatgaggtatttagagattagaaacagaggagatctaatatgtaaatacctaacctggcggcagcgcaaaagatg

SEQ ID NO: 61210 - DNA, 103 bp, Artificial Sequence
  Synthetic Polynucleotide
taatacgactcactatagggagcttttttgttttatgaggtatttagagaaacagaggagatctctaatgacctcataaaacctggcggcagcgcaaaagatg

SEQ ID NO: 61211 - DNA, 103 bp, Artificial Sequence
  Synthetic Polynucleotide
taatacgactcactatagggataatagcttttttgttttatgaggtatttaacagaggagaaaatacatgataaaacaaaacctggcggcagcgcaaaagatg

SEQ ID NO: 61212 - DNA, 103 bp, Artificial Sequence
  Synthetic Polynucleotide
taatacgactcactatagggatttgataatagcttttttgttttatgaggaacagaggagacctcatatgacaaaaaagaacctggcggcagcgcaaaagatg

SEQ ID NO: 61213 - DNA, 103 bp, Artificial Sequence
  Synthetic Polynucleotide
taatacgactcactatagggacagtatttgataatagcttttttgttttaaacagaggagataaaacatgaaagctattaacctggcggcagcgcaaaagatg

SEQ ID NO: 61214 - DNA, 103 bp, Artificial Sequence
  Synthetic Polynucleotide
taatacgactcactatagggtttgaatcgctattagactatatacgctggaacagaggagaccagcgatgatagtctaaaacctggcggcagcgcaaaagatg

SEQ ID NO: 61215 - DNA, 103 bp, Artificial Sequence
  Synthetic Polynucleotide
taatacgactcactatagggtccgtacagtatttgataatagcttttttgaacagaggagacaaaaaatgtattatcaaaacctggcggcagcgcaaaagatg

SEQ ID NO: 61216 - DNA, 103 bp, Artificial Sequence
  Synthetic Polynucleotide
taatacgactcactatagggtccattccgtacagtatttgataatagcttaacagaggagaaagctaatgtcaaatactaacctggcggcagcgcaaaagatg

SEQ ID NO: 61217 - DNA, 103 bp, Artificial Sequence
  Synthetic Polynucleotide
taatacgactcactatagggatgaatccattccgtacagtatttgataataacagaggagaattatcatgtactgtacgaacctggcggcagcgcaaaagatg

SEQ ID NO: 61218 - DNA, 103 bp, Artificial Sequence
  Synthetic Polynucleotide
taatacgactcactatagggagagaatgaatccattccgtacagtatttgaacagaggagacaaataatgtacggaatgaacctggcggcagcgcaaaagatg

SEQ ID NO: 61219 - DNA, 103 bp, Artificial Sequence
  Synthetic Polynucleotide
taatacgactcactatagggagagaagagaatgaatccattccgtacagtaacagaggagaactgtaatgaatggattcaacctggcggcagcgcaaaagatg

SEQ ID NO: 61220 - DNA, 103 bp, Artificial Sequence
  Synthetic Polynucleotide
taatacgactcactatagggtaaaaagagaagagaatgaatccattccgtaacagaggagaacggaaatgattcattctaacctggcggcagcgcaaaagatg

SEQ ID NO: 61221 - DNA, 103 bp, Artificial Sequence
  Synthetic Polynucleotide
taatacgactcactatagggtttcataaaaagagaagagaatgaatccataacagaggagaatggatatgttctcttctaacctggcggcagcgcaaaagatg

SEQ ID NO: 61222 - DNA, 103 bp, Artificial Sequence
  Synthetic Polynucleotide
taatacgactcactatagggcagagtttcataaaaagagaagagaatgaaaacagaggagattcattatgttctcttttaacctggcggcagcgcaaaagatg

SEQ ID NO: 61223 - DNA, 103 bp, Artificial Sequence
  Synthetic Polynucleotide
taatacgactcactatagggtacaacagagtttcataaaaagagaagagaaacagaggagatctcttatgtttttatgaaacctggcggcagcgcaaaagatg

SEQ ID NO: 61224 - DNA, 103 bp, Artificial Sequence
  Synthetic Polynucleotide
taatacgactcactatagggagatatacaacagagtttcataaaaagagaaacagaggagatctcttatgatgaaactcaacctggcggcagcgcaaaagatg

SEQ ID NO: 61225 - DNA, 103 bp, Artificial Sequence
  Synthetic Polynucleotide
taatacgactcactatagggacgcgtttgaatcgctattagactatatacaacagaggagagtatatatgctaatagcgaacctggcggcagcgcaaaagatg

SEQ ID NO: 61226 - DNA, 103 bp, Artificial Sequence
  Synthetic Polynucleotide
taatacgactcactatagggtcagtagatatacaacagagtttcataaaaaacagaggagattttatatgactctgttgaacctggcggcagcgcaaaagatg

SEQ ID NO: 61227 - DNA, 103 bp, Artificial Sequence
  Synthetic Polynucleotide
taatacgactcactatagggttttatcagtagatatacaacagagtttcaaacagaggagatgaaacatggttgtatataacctggcggcagcgcaaaagatg

SEQ ID NO: 61228 - DNA, 103 bp, Artificial Sequence
  Synthetic Polynucleotide
taatacgactcactatagggtccagttttatcagtagatatacaacagagaacagaggagactctgtatgatatctactaacctggcggcagcgcaaaagatg

SEQ ID NO: 61229 - DNA, 103 bp, Artificial Sequence
  Synthetic Polynucleotide
taatacgactcactatagggttgcttccagttttatcagtagatatacaaaacagaggagattgtatatgtactgataaaacctggcggcagcgcaaaagatg

SEQ ID NO: 61230 - DNA, 103 bp, Artificial Sequence
  Synthetic Polynucleotide
taatacgactcactatagggattttttgcttccagttttatcagtagataaacagaggagatatctaatgataaaactgaacctggcggcagcgcaaaagatg

SEQ ID NO: 61231 - DNA, 103 bp, Artificial Sequence
  Synthetic Polynucleotide
taatacgactcactatagggatcagattttttgcttccagttttatcagtaacagaggagaactgatatgactggaagcaacctggcggcagcgcaaaagatg

SEQ ID NO: 61232 - DNA, 103 bp, Artificial Sequence
  Synthetic Polynucleotide
taatacgactcactatagggtttctatcagattttttgcttccagttttaaacagaggagataaaacatgaagcaaaaaaacctggcggcagcgcaaaagatg

SEQ ID NO: 61233 - DNA, 103 bp, Artificial Sequence
  Synthetic Polynucleotide
taatacgactcactatagggtattctttctatcagattttttgcttccagaacagaggagactggaaatgaaaaatctgaacctggcggcagcgcaaaagatg

SEQ ID NO: 61234 - DNA, 103 bp, Artificial Sequence
  Synthetic Polynucleotide
taatacgactcactatagggattcttattctttctatcagattttttgctaacagaggagaagcaaaatgtctgatagaaacctggcggcagcgcaaaagatg

SEQ ID NO: 61235 - DNA, 103 bp, Artificial Sequence
  Synthetic Polynucleotide
taatacgactcactatagggatcttattcttattctttctatcagattttaacagaggagaaaaatcatgtagaaagaaaacctggcggcagcgcaaaagatg

SEQ ID NO: 61236 - DNA, 103 bp, Artificial Sequence
  Synthetic Polynucleotide
taatacgactcactatagggatcttatagataggtattatgccaatatttaacagaggagaaaatatatgcataataccaacctggcggcagcgcaaaagatg

SEQ ID NO: 61237 - DNA, 103 bp, Artificial Sequence
  Synthetic Polynucleotide
taatacgactcactatagggctatcacgcgtttgaatcgctattagactaaacagaggagatagtctatgagcgattcaaacctggcggcagcgcaaaagatg

SEQ ID NO: 61238 - DNA, 103 bp, Artificial Sequence
  Synthetic Polynucleotide
taatacgactcactatagggccttgatcttattcttattctttctatcagaacagaggagactgataatgagaataagaaacctggcggcagcgcaaaagatg

SEQ ID NO: 61239 - DNA, 103 bp, Artificial Sequence
  Synthetic Polynucleotide
taatacgactcactatagggataatccttgatcttattcttattctttctaacagaggagaagaaagatgaagaataagaacctggcggcagcgcaaaagatg

SEQ ID NO: 61240 - DNA, 103 bp, Artificial Sequence
  Synthetic Polynucleotide
taatacgactcactatagggtccatataatccttgatcttattcttattcaacagaggagagaataaatgtaagatcaaaacctggcggcagcgcaaaagatg

SEQ ID NO: 61241 - DNA, 103 bp, Artificial Sequence
  Synthetic Polynucleotide
taatacgactcactatagggcgtgttccatataatccttgatcttattctaacagaggagaagaataatgtcaaggattaacctggcggcagcgcaaaagatg

SEQ ID NO: 61242 - DNA, 103 bp, Artificial Sequence
  Synthetic Polynucleotide
taatacgactcactatagggataatcgtgttccatataatccttgatcttaacagaggagaaagatcatggattatatgaacctggcggcagcgcaaaagatg

SEQ ID NO: 61243 - DNA, 103 bp, Artificial Sequence
  Synthetic Polynucleotide
taatacgactcactatagggttataataatcgtgttccatataatccttgaacagaggagacaaggaatgtatggaacaaacctggcggcagcgcaaaagatg

SEQ ID NO: 61244 - DNA, 103 bp, Artificial Sequence
  Synthetic Polynucleotide
taatacgactcactatagggttattttataataatcgtgttccatataataacagaggagaattataatgaacacgattaacctggcggcagcgcaaaagatg

SEQ ID NO: 61245 - DNA, 103 bp, Artificial Sequence
  Synthetic Polynucleotide
taatacgactcactatagggtattgttattttataataatcgtgttccataacagaggagaatggaaatggattattataacctggcggcagcgcaaaagatg

SEQ ID NO: 61246 - DNA, 103 bp, Artificial Sequence
  Synthetic Polynucleotide
taatacgactcactatagggggaactattgttattttataataatcgtgtaacagaggagaacacgaatgttataaaataacctggcggcagcgcaaaagatg

SEQ ID NO: 61247 - DNA, 103 bp, Artificial Sequence
  Synthetic Polynucleotide
taatacgactcactatagggaaccaggaactattgttattttataataataacagaggagaattattatgaaataacaaaacctggcggcagcgcaaaagatg

SEQ ID NO: 61248 - DNA, 103 bp, Artificial Sequence
  Synthetic Polynucleotide
taatacgactcactatagggataaactatcacgcgtttgaatcgctattaaacagaggagataatagatgttcaaacgcaacctggcggcagcgcaaaagatg

SEQ ID NO: 61249 - DNA, 103 bp, Artificial Sequence
  Synthetic Polynucleotide
taatacgactcactatagggagaggaaccaggaactattgttattttataaacagaggagatataaaatgacaatagttaacctggcggcagcgcaaaagatg

SEQ ID NO: 61250 - DNA, 103 bp, Artificial Sequence
  Synthetic Polynucleotide
taatacgactcactataggggtggaagaggaaccaggaactattgttattaacagaggagaaataacatgagttcctggaacctggcggcagcgcaaaagatg

SEQ ID NO: 61251 - DNA, 103 bp, Artificial Sequence
  Synthetic Polynucleotide
taatacgactcactatagggtagacgtggaagaggaaccaggaactattgaacagaggagacaatagatgctggttcctaacctggcggcagcgcaaaagatg

SEQ ID NO: 61252 - DNA, 103 bp, Artificial Sequence
  Synthetic Polynucleotide
taatacgactcactataggggctagtagacgtggaagaggaaccaggaacaacagaggagagttcctatgtcctcttccaacctggcggcagcgcaaaagatg

SEQ ID NO: 61253 - DNA, 103 bp, Artificial Sequence
  Synthetic Polynucleotide
taatacgactcactatagggcacgagctagtagacgtggaagaggaaccaaacagaggagatggttcatgttccacgtcaacctggcggcagcgcaaaagatg

SEQ ID NO: 61254 - DNA, 103 bp, Artificial Sequence
  Synthetic Polynucleotide
taatacgactcactatagggaataccacgagctagtagacgtggaagaggaacagaggagacctcttatgcgtctactaaacctggcggcagcgcaaaagatg

SEQ ID NO: 61255 - DNA, 103 bp, Artificial Sequence
  Synthetic Polynucleotide
taatacgactcactatagggcgtataataccacgagctagtagacgtggaaacagaggagatccacgatgactagctcgaacctggcggcagcgcaaaagatg

SEQ ID NO: 61256 - DNA, 103 bp, Artificial Sequence
  Synthetic Polynucleotide
taatacgactcactataggggcatgcgtataataccacgagctagtagacaacagaggagagtctacatgctcgtggtaaacctggcggcagcgcaaaagatg

SEQ ID NO: 61257 - DNA, 103 bp, Artificial Sequence
  Synthetic Polynucleotide
taatacgactcactatagggactaggcatgcgtataataccacgagctagaacagaggagactagctatgggtattataaacctggcggcagcgcaaaagatg

SEQ ID NO: 61258 - DNA, 103 bp, Artificial Sequence
  Synthetic Polynucleotide
taatacgactcactatagggctattactaggcatgcgtataataccacgaaacagaggagatcgtggatgtatacgcataacctggcggcagcgcaaaagatg

SEQ ID NO: 61259 - DNA, 103 bp, Artificial Sequence
  Synthetic Polynucleotide
taatacgactcactatagggatggtataaactatcacgcgtttgaatcgcaacagaggagagcgattatgacgcgtgataacctggcggcagcgcaaaagatg

SEQ ID NO: 61260 - DNA, 103 bp, Artificial Sequence
  Synthetic Polynucleotide
taatacgactcactatagggagagactattactaggcatgcgtataatacaacagaggagagtattaatggcatgcctaaacctggcggcagcgcaaaagatg

SEQ ID NO: 61261 - DNA, 103 bp, Artificial Sequence
  Synthetic Polynucleotide
taatacgactcactatagggcgcaaagagactattactaggcatgcgtataacagaggagaatacgcatgcctagtaataacctggcggcagcgcaaaagatg

SEQ ID NO: 61262 - DNA, 103 bp, Artificial Sequence
  Synthetic Polynucleotide
taatacgactcactatagggatcaacgcaaagagactattactaggcatgaacagaggagacatgccatgtaatagtctaacctggcggcagcgcaaaagatg

SEQ ID NO: 61263 - DNA, 103 bp, Artificial Sequence
  Synthetic Polynucleotide
taatacgactcactatagggtttccatcaacgcaaagagactattactagaacagaggagactagtaatggtctctttgaacctggcggcagcgcaaaagatg

SEQ ID NO: 61264 - DNA, 103 bp, Artificial Sequence
  Synthetic Polynucleotide
taatacgactcactatagggtctgctttccatcaacgcaaagagactattaacagaggagaaatagtatgtttgcgttgaacctggcggcagcgcaaaagatg

SEQ ID NO: 61265 - DNA, 103 bp, Artificial Sequence
  Synthetic Polynucleotide
taatacgactcactatagggtctagtctgctttccatcaacgcaaagagaaacagaggagatctcttatggttgatggaaacctggcggcagcgcaaaagatg

SEQ ID NO: 61266 - DNA, 103 bp, Artificial Sequence
  Synthetic Polynucleotide
taatacgactcactatagggttatttctagtctgctttccatcaacgcaaaacagaggagattgcgtatgtggaaagcaaacctggcggcagcgcaaaagatg

SEQ ID NO: 61267 - DNA, 103 bp, Artificial Sequence
  Synthetic Polynucleotide
taatacgactcactataggggcctgttatttctagtctgctttccatcaaaacagaggagattgatgatgagcagactaaacctggcggcagcgcaaaagatg

SEQ ID NO: 61268 - DNA, 103 bp, Artificial Sequence
  Synthetic Polynucleotide
taatacgactcactatagggttttagcctgttatttctagtctgctttccaacagaggagaggaaagatgactagaaataacctggcggcagcgcaaaagatg

SEQ ID NO: 61269 - DNA, 103 bp, Artificial Sequence
  Synthetic Polynucleotide
taatacgactcactataggggaacattttagcctgttatttctagtctgcaacagaggagagcagacatgaaataacagaacctggcggcagcgcaaaagatg

SEQ ID NO: 61270 - DNA, 103 bp, Artificial Sequence
  Synthetic Polynucleotide
taatacgactcactatagggattgaatggtataaactatcacgcgtttgaaacagaggagatcaaacatgtgatagtttaacctggcggcagcgcaaaagatg

SEQ ID NO: 61271 - DNA, 103 bp, Artificial Sequence
  Synthetic Polynucleotide
taatacgactcactatagggtgtctgaacattttagcctgttatttctagaacagaggagactagaaatgacaggctaaaacctggcggcagcgcaaaagatg

SEQ ID NO: 61272 - DNA, 103 bp, Artificial Sequence
  Synthetic Polynucleotide
taatacgactcactatagggtatggtgtctgaacattttagcctgttattaacagaggagaaataacatgctaaaatgtaacctggcggcagcgcaaaagatg

SEQ ID NO: 61273 - DNA, 103 bp, Artificial Sequence
  Synthetic Polynucleotide
taatacgactcactatagggactattatggtgtctgaacattttagcctgaacagaggagacaggctatgatgttcagaaacctggcggcagcgcaaaagatg

SEQ ID NO: 61274 - DNA, 103 bp, Artificial Sequence
  Synthetic Polynucleotide
taatacgactcactatagggtgggaactattatggtgtctgaacattttaaacagaggagataaaatatgcagacaccaaacctggcggcagcgcaaaagatg

SEQ ID NO: 61275 - DNA, 103 bp, Artificial Sequence
  Synthetic Polynucleotide
taatacgactcactatagggtgggttgggaactattatggtgtctgaacaaacagaggagatgttcaatgaccataataaacctggcggcagcgcaaaagatg

SEQ ID NO: 61276 - DNA, 103 bp, Artificial Sequence
  Synthetic Polynucleotide
taatacgactcactatagggttatctgggttgggaactattatggtgtctaacagaggagaagacacatgaatagttccaacctggcggcagcgcaaaagatg

SEQ ID NO: 61277 - DNA, 103 bp, Artificial Sequence
  Synthetic Polynucleotide
taatacgactcactatagggtgttattatctgggttgggaactattatggaacagaggagaccataaatgttcccaaccaacctggcggcagcgcaaaagatg

SEQ ID NO: 61278 - DNA, 103 bp, Artificial Sequence
  Synthetic Polynucleotide
taatacgactcactatagggaactctgttattatctgggttgggaactataacagaggagaatagttatgaacccagataacctggcggcagcgcaaaagatg

SEQ ID NO: 61279 - DNA, 103 bp, Artificial Sequence
  Synthetic Polynucleotide
taatacgactcactataggggatggaactctgttattatctgggttgggaaacagaggagatcccaaatgagataataaaacctggcggcagcgcaaaagatg

SEQ ID NO: 61280 - DNA, 103 bp, Artificial Sequence
  Synthetic Polynucleotide
taatacgactcactataggggtgttgatggaactctgttattatctgggtaacagaggagaacccagatgataacagagaacctggcggcagcgcaaaagatg

SEQ ID NO: 61281 - DNA, 103 bp, Artificial Sequence
  Synthetic Polynucleotide
taatacgactcactatagggattatattgaatggtataaactatcacgcgaacagaggagacgcgtgatggtttataccaacctggcggcagcgcaaaagatg

SEQ ID NO: 61282 - DNA, 103 bp, Artificial Sequence
  Synthetic Polynucleotide
taatacgactcactatagggggaatgtgttgatggaactctgttattatcaacagaggagagataatatgagagttccaaacctggcggcagcgcaaaagatg

SEQ ID NO: 61283 - DNA, 103 bp, Artificial Sequence
  Synthetic Polynucleotide
taatacgactcactatagggctaaaggaatgtgttgatggaactctgttaaacagaggagataacagatgtccatcaacaacctggcggcagcgcaaaagatg

SEQ ID NO: 61284 - DNA, 103 bp, Artificial Sequence
  Synthetic Polynucleotide
taatacgactcactatagggtgagtctaaaggaatgtgttgatggaactcaacagaggagagagttcatgcaacacattaacctggcggcagcgcaaaagatg

SEQ ID NO: 61285 - DNA, 103 bp, Artificial Sequence
  Synthetic Polynucleotide
taatacgactcactataggggggattgagtctaaaggaatgtgttgatggaacagaggagaccatcaatgcattcctttaacctggcggcagcgcaaaagatg

SEQ ID NO: 61286 - DNA, 103 bp, Artificial Sequence
  Synthetic Polynucleotide
taatacgactcactatagggggattgggattgagtctaaaggaatgtgttaacagaggagaaacacaatgctttagactaacctggcggcagcgcaaaagatg

SEQ ID NO: 61287 - DNA, 103 bp, Artificial Sequence
  Synthetic Polynucleotide
taatacgactcactatagggttttgggattgggattgagtctaaaggaataacagaggagaattcctatggactcaatcaacctggcggcagcgcaaaagatg

SEQ ID NO: 61288 - DNA, 103 bp, Artificial Sequence
  Synthetic Polynucleotide
taatacgactcactatagggaacggttttgggattgggattgagtctaaaaacagaggagatttagaatgaatcccaataacctggcggcagcgcaaaagatg

SEQ ID NO: 61289 - DNA, 103 bp, Artificial Sequence
  Synthetic Polynucleotide
taatacgactcactatagggattttaacggttttgggattgggattgagtaacagaggagaactcaaatgcaatcccaaaacctggcggcagcgcaaaagatg

SEQ ID NO: 61290 - DNA, 103 bp, Artificial Sequence
  Synthetic Polynucleotide
taatacgactcactataggggatacattttaacggttttgggattgggataacagaggagaatcccaatgccaaaaccgaacctggcggcagcgcaaaagatg

SEQ ID NO: 61291 - DNA, 103 bp, Artificial Sequence
  Synthetic Polynucleotide
taatacgactcactatagggggccggatacattttaacggttttgggattaacagaggagaaatcccatgaccgttaaaaacctggcggcagcgcaaaagatg

SEQ ID NO: 61292 - DNA, 103 bp, Artificial Sequence
  Synthetic Polynucleotide
taatacgactcactatagggaagcgattatattgaatggtataaactatcaacagaggagagatagtatgtaccattcaaacctggcggcagcgcaaaagatg

SEQ ID NO: 61293 - DNA, 103 bp, Artificial Sequence
  Synthetic Polynucleotide
taatacgactcactatagggcaattggccggatacattttaacggttttgaacagaggagacaaaacatgtaaaatgtaaacctggcggcagcgcaaaagatg

SEQ ID NO: 61294 - DNA, 103 bp, Artificial Sequence
  Synthetic Polynucleotide
taatacgactcactatagggactatcaattggccggatacattttaacggaacagaggagaccgttaatgtgtatccggaacctggcggcagcgcaaaagatg

SEQ ID NO: 61295 - DNA, 103 bp, Artificial Sequence
  Synthetic Polynucleotide
taatacgactcactatagggtatttactatcaattggccggatacattttaacagaggagaaaaatgatgccggccaataacctggcggcagcgcaaaagatg

SEQ ID NO: 61296 - DNA, 103 bp, Artificial Sequence
  Synthetic Polynucleotide
taatacgactcactatagggctcattatttactatcaattggccggatacaacagaggagagtatccatgcaattgataaacctggcggcagcgcaaaagatg

SEQ ID NO: 61297 - DNA, 103 bp, Artificial Sequence
  Synthetic Polynucleotide
taatacgactcactatagggtacacctcattatttactatcaattggccgaacagaggagacggccaatggatagtaaaaacctggcggcagcgcaaaagatg

SEQ ID NO: 61298 - DNA, 103 bp, Artificial Sequence
  Synthetic Polynucleotide
taatacgactcactatagggtgctgtacacctcattatttactatcaattaacagaggagaaattgaatgtaaataatgaacctggcggcagcgcaaaagatg

SEQ ID NO: 61299 - DNA, 103 bp, Artificial Sequence
  Synthetic Polynucleotide
taatacgactcactatagggtcatgtgctgtacacctcattatttactataacagaggagaatagtaatgaatgaggtgaacctggcggcagcgcaaaagatg

SEQ ID NO: 61300 - DNA, 103 bp, Artificial Sequence
  Synthetic Polynucleotide
taatacgactcactatagggaattatcatgtgctgtacacctcattatttaacagaggagaaaataaatgggtgtacagaacctggcggcagcgcaaaagatg

SEQ ID NO: 61301 - DNA, 103 bp, Artificial Sequence
  Synthetic Polynucleotide
taatacgactcactataggggtgtaaattatcatgtgctgtacacctcataacagaggagaatgaggatgacagcacataacctggcggcagcgcaaaagatg

SEQ ID NO: 61302 - DNA, 103 bp, Artificial Sequence
  Synthetic Polynucleotide
taatacgactcactatagggttactgtgtaaattatcatgtgctgtacacaacagaggagagtgtacatgacatgataaaacctggcggcagcgcaaaagatg

SEQ ID NO: 61303 - DNA, 103 bp, Artificial Sequence
  Synthetic Polynucleotide
taatacgactcactatagggtgatgaagcgattatattgaatggtataaaaacagaggagatttataatgttcaatataaacctggcggcagcgcaaaagatg

SEQ ID NO: 61304 - DNA, 103 bp, Artificial Sequence
  Synthetic Polynucleotide
taatacgactcactatagggtttggttactgtgtaaattatcatgtgctgaacagaggagacagcacatgataatttacaacctggcggcagcgcaaaagatg

SEQ ID NO: 61305 - DNA, 103 bp, Artificial Sequence
  Synthetic Polynucleotide
taatacgactcactatagggttcattttggttactgtgtaaattatcatgaacagaggagacatgatatgttacacagtaacctggcggcagcgcaaaagatg

SEQ ID NO: 61306 - DNA, 103 bp, Artificial Sequence
  Synthetic Polynucleotide
taatacgactcactataggggtgttttcattttggttactgtgtaaattaaacagaggagataatttatgcagtaaccaaacctggcggcagcgcaaaagatg

SEQ ID NO: 61307 - DNA, 103 bp, Artificial Sequence
  Synthetic Polynucleotide
taatacgactcactatagggctaaagtgttttcattttggttactgtgtaaacagaggagatacacaatgaccaaaatgaacctggcggcagcgcaaaagatg

SEQ ID NO: 61308 - DNA, 103 bp, Artificial Sequence
  Synthetic Polynucleotide
taatacgactcactatagggaattactaaagtgttttcattttggttactaacagaggagaagtaacatgaatgaaaacaacctggcggcagcgcaaaagatg

SEQ ID NO: 61309 - DNA, 103 bp, Artificial Sequence
  Synthetic Polynucleotide
taatacgactcactatagggcttataattactaaagtgttttcattttggaacagaggagaccaaaaatgaaacactttaacctggcggcagcgcaaaagatg

SEQ ID NO: 61310 - DNA, 103 bp, Artificial Sequence
  Synthetic Polynucleotide
taatacgactcactatagggtatttcttataattactaaagtgttttcataacagaggagaatgaaaatgctttagtaaaacctggcggcagcgcaaaagatg

SEQ ID NO: 61311 - DNA, 103 bp, Artificial Sequence
  Synthetic Polynucleotide
taatacgactcactataggggtctatatttcttataattactaaagtgttaacagaggagaaacactatggtaattataaacctggcggcagcgcaaaagatg

SEQ ID NO: 61312 - DNA, 103 bp, Artificial Sequence
  Synthetic Polynucleotide
taatacgactcactatagggttaccgtctatatttcttataattactaaaaacagaggagatttagtatgtataagaaaaacctggcggcagcgcaaaagatg

SEQ ID NO: 61313 - DNA, 103 bp, Artificial Sequence
  Synthetic Polynucleotide
taatacgactcactatagggtgacattaccgtctatatttcttataattaaacagaggagataattaatggaaatatagaacctggcggcagcgcaaaagatg

SEQ ID NO: 61314 - DNA, 103 bp, Artificial Sequence
  Synthetic Polynucleotide
taatacgactcactatagggataaatgatgaagcgattatattgaatggtaacagaggagaaccattatgtataatcgcaacctggcggcagcgcaaaagatg

SEQ ID NO: 61315 - DNA, 103 bp, Artificial Sequence
  Synthetic Polynucleotide
taatacgactcactatagggaatgatgacattaccgtctatatttcttataacagaggagaataagaatgatagacggtaacctggcggcagcgcaaaagatg

SEQ ID NO: 61316 - DNA, 103 bp, Artificial Sequence
  Synthetic Polynucleotide
taatacgactcactatagggttgttaatgatgacattaccgtctatatttaacagaggagaaaatatatgcggtaatgtaacctggcggcagcgcaaaagatg

SEQ ID NO: 61317 - DNA, 103 bp, Artificial Sequence
  Synthetic Polynucleotide
taatacgactcactatagggttggattgttaatgatgacattaccgtctaaacagaggagatagacgatgatgtcatcaaacctggcggcagcgcaaaagatg

SEQ ID NO: 61318 - DNA, 103 bp, Artificial Sequence
  Synthetic Polynucleotide
taatacgactcactatagggtattattggattgttaatgatgacattaccaacagaggagaggtaatatgatcattaacaacctggcggcagcgcaaaagatg

SEQ ID NO: 61319 - DNA, 103 bp, Artificial Sequence
  Synthetic Polynucleotide
taatacgactcactatagggaggcatattattggattgttaatgatgacaaacagaggagatgtcatatgtaacaatccaacctggcggcagcgcaaaagatg

SEQ ID NO: 61320 - DNA, 103 bp, Artificial Sequence
  Synthetic Polynucleotide
taatacgactcactatagggctctcaggcatattattggattgttaatgaaacagaggagatcattaatgatccaataaaacctggcggcagcgcaaaagatg

SEQ ID NO: 61321 - DNA, 103 bp, Artificial Sequence
  Synthetic Polynucleotide
taatacgactcactataggggtttactctcaggcatattattggattgttaacagaggagaaacaatatgataatatgcaacctggcggcagcgcaaaagatg

SEQ ID NO: 61322 - DNA, 103 bp, Artificial Sequence
  Synthetic Polynucleotide
taatacgactcactatagggtcaatgtttactctcaggcatattattggaaacagaggagatccaatatgatgcctgagaacctggcggcagcgcaaaagatg

SEQ ID NO: 61323 - DNA, 103 bp, Artificial Sequence
  Synthetic Polynucleotide
taatacgactcactatagggatccgtcaatgtttactctcaggcatattaaacagaggagataatatatgtgagagtaaaacctggcggcagcgcaaaagatg

SEQ ID NO: 61324 - DNA, 103 bp, Artificial Sequence
  Synthetic Polynucleotide
taatacgactcactataggggttttatccgtcaatgtttactctcaggcaaacagaggagatgcctgatggtaaacattaacctggcggcagcgcaaaagatg

SEQ ID NO: 61325 - DNA, 103 bp, Artificial Sequence
  Synthetic Polynucleotide
taatacgactcactatagggaccatataaatgatgaagcgattatattgaaacagaggagatcaataatgtcgcttcataacctggcggcagcgcaaaagatg

SEQ ID NO: 61326 - DNA, 103 bp, Artificial Sequence
  Synthetic Polynucleotide
taatacgactcactatagggtttttgttttatccgtcaatgtttactctcaacagaggagagagagtatgcattgacggaacctggcggcagcgcaaaagatg

SEQ ID NO: 61327 - DNA, 103 bp, Artificial Sequence
  Synthetic Polynucleotide
taatacgactcactataggggggcatttttgttttatccgtcaatgtttaaacagaggagataaacaatgacggataaaaacctggcggcagcgcaaaagatg

SEQ ID NO: 61328 - DNA, 103 bp, Artificial Sequence
  Synthetic Polynucleotide
taatacgactcactatagggatgcggggcatttttgttttatccgtcaataacagaggagaattgacatgtaaaacaaaaacctggcggcagcgcaaaagatg

SEQ ID NO: 61329 - DNA, 103 bp, Artificial Sequence
  Synthetic Polynucleotide
taatacgactcactataggggagttatgcggggcatttttgttttatccgaacagaggagacggataatgcaaaaatgcaacctggcggcagcgcaaaagatg

SEQ ID NO: 61330 - DNA, 103 bp, Artificial Sequence
  Synthetic Polynucleotide
taatacgactcactatagggtgatagagttatgcggggcatttttgttttaacagaggagaaaaacaatgatgccccgcaacctggcggcagcgcaaaagatg

SEQ ID NO: 61331 - DNA, 103 bp, Artificial Sequence
  Synthetic Polynucleotide
taatacgactcactatagggtgccatgatagagttatgcggggcatttttaacagaggagaaaaaatatgccgcataacaacctggcggcagcgcaaaagatg

SEQ ID NO: 61332 - DNA, 103 bp, Artificial Sequence
  Synthetic Polynucleotide
taatacgactcactatagggattattgccatgatagagttatgcggggcaaacagaggagatgccccatgtaactctataacctggcggcagcgcaaaagatg

SEQ ID NO: 61333 - DNA, 103 bp, Artificial Sequence
  Synthetic Polynucleotide
taatacgactcactataggggttgtattattgccatgatagagttatgcgaacagaggagacgcataatgctatcatggaacctggcggcagcgcaaaagatg

SEQ ID NO: 61334 - DNA, 103 bp, Artificial Sequence
  Synthetic Polynucleotide
taatacgactcactataggggtttggttgtattattgccatgatagagttaacagaggagaaactctatgatggcaataaacctggcggcagcgcaaaagatg

SEQ ID NO: 61335 - DNA, 103 bp, Artificial Sequence
  Synthetic Polynucleotide
taatacgactcactatagggcaagtgtttggttgtattattgccatgataaacagaggagatatcatatgaataatacaaacctggcggcagcgcaaaagatg

SEQ ID NO: 61336 - DNA, 103 bp, Artificial Sequence
  Synthetic Polynucleotide
taatacgactcactataggggaaacaccatataaatgatgaagcgattataacagaggagaataatcatgtcatcatttaacctggcggcagcgcaaaagatg

SEQ ID NO: 61337 - DNA, 103 bp, Artificial Sequence
  Synthetic Polynucleotide
taatacgactcactatagggttttacaagtgtttggttgtattattgccaaacagaggagatggcaaatgtacaaccaaaacctggcggcagcgcaaaagatg

SEQ ID NO: 61338 - DNA, 103 bp, Artificial Sequence
  Synthetic Polynucleotide
taatacgactcactatagggaggaattttacaagtgtttggttgtattataacagaggagaataataatgccaaacactaacctggcggcagcgcaaaagatg

SEQ ID NO: 61339 - DNA, 103 bp, Artificial Sequence
  Synthetic Polynucleotide
taatacgactcactatagggaatttaggaattttacaagtgtttggttgtaacagaggagaacaaccatgcacttgtaaaacctggcggcagcgcaaaagatg

SEQ ID NO: 61340 - DNA, 103 bp, Artificial Sequence
  Synthetic Polynucleotide
taatacgactcactatagggctactaatttaggaattttacaagtgtttgaacagaggagacaaacaatggtaaaattcaacctggcggcagcgcaaaagatg

SEQ ID NO: 61341 - DNA, 103 bp, Artificial Sequence
  Synthetic Polynucleotide
taatacgactcactatagggattttctactaatttaggaattttacaagtaacagaggagaacttgtatgattcctaaaaacctggcggcagcgcaaaagatg

SEQ ID NO: 61342 - DNA, 103 bp, Artificial Sequence
  Synthetic Polynucleotide
taatacgactcactataggggttgtattttctactaatttaggaattttaaacagaggagataaaatatgtaaattagtaacctggcggcagcgcaaaagatg

SEQ ID NO: 61343 - DNA, 103 bp, Artificial Sequence
  Synthetic Polynucleotide
taatacgactcactatagggtatcagttgtattttctactaatttaggaaaacagaggagattcctaatgtagtagaaaaacctggcggcagcgcaaaagatg

SEQ ID NO: 61344 - DNA, 103 bp, Artificial Sequence
  Synthetic Polynucleotide
taatacgactcactatagggatcgatatcagttgtattttctactaatttaacagaggagaaaattaatggaaaatacaaacctggcggcagcgcaaaagatg

SEQ ID NO: 61345 - DNA, 103 bp, Artificial Sequence
  Synthetic Polynucleotide
taatacgactcactatagggtatacatcgatatcagttgtattttctactaacagaggagaagtagaatgtacaactgaaacctggcggcagcgcaaaagatg

SEQ ID NO: 61346 - DNA, 103 bp, Artificial Sequence
  Synthetic Polynucleotide
taatacgactcactatagggtcgcttatacatcgatatcagttgtattttaacagaggagaaaaataatgctgatatcgaacctggcggcagcgcaaaagatg

SEQ ID NO: 61347 - DNA, 103 bp, Artificial Sequence
  Synthetic Polynucleotide
taatacgactcactatagggtcctaatcttatagataggtattatgccaaaacagaggagattggcaatgtacctatctaacctggcggcagcgcaaaagatg

SEQ ID NO: 61348 - DNA, 103 bp, Artificial Sequence
  Synthetic Polynucleotide
taatacgactcactatagggatttagaaacaccatataaatgatgaagcgaacagaggagacgcttcatgatttatatgaacctggcggcagcgcaaaagatg

SEQ ID NO: 61349 - DNA, 103 bp, Artificial Sequence
  Synthetic Polynucleotide
taatacgactcactatagggcgaaatcgcttatacatcgatatcagttgtaacagaggagaacaactatgatcgatgtaaacctggcggcagcgcaaaagatg

SEQ ID NO: 61350 - DNA, 103 bp, Artificial Sequence
  Synthetic Polynucleotide
taatacgactcactatagggttcctcgaaatcgcttatacatcgatatcaaacagaggagatgatatatgtgtataagcaacctggcggcagcgcaaaagatg

SEQ ID NO: 61351 - DNA, 103 bp, Artificial Sequence
  Synthetic Polynucleotide
taatacgactcactatagggtattattcctcgaaatcgcttatacatcgaaacagaggagatcgatgatgaagcgatttaacctggcggcagcgcaaaagatg

SEQ ID NO: 61352 - DNA, 103 bp, Artificial Sequence
  Synthetic Polynucleotide
taatacgactcactataggggttcttattattcctcgaaatcgcttatacaacagaggagagtataaatgatttcgaggaacctggcggcagcgcaaaagatg

SEQ ID NO: 61353 - DNA, 103 bp, Artificial Sequence
  Synthetic Polynucleotide
taatacgactcactatagggactttgttcttattattcctcgaaatcgctaacagaggagaagcgatatggaggaataaaacctggcggcagcgcaaaagatg

SEQ ID NO: 61354 - DNA, 103 bp, Artificial Sequence
  Synthetic Polynucleotide
taatacgactcactataggggcattactttgttcttattattcctcgaaaaacagaggagatttcgaatgataataagaaacctggcggcagcgcaaaagatg

SEQ ID NO: 61355 - DNA, 103 bp, Artificial Sequence
  Synthetic Polynucleotide
taatacgactcactatagggtacaggcattactttgttcttattattcctaacagaggagaaggaatatgaagaacaaaaacctggcggcagcgcaaaagatg

SEQ ID NO: 61356 - DNA, 103 bp, Artificial Sequence
  Synthetic Polynucleotide
taatacgactcactatagggatttttacaggcattactttgttcttattaaacagaggagataataaatgcaaagtaataacctggcggcagcgcaaaagatg

SEQ ID NO: 61357 - DNA, 103 bp, Artificial Sequence
  Synthetic Polynucleotide
taatacgactcactatagggtgtttatttttacaggcattactttgttctaacagaggagaagaacaatgtaatgcctgaacctggcggcagcgcaaaagatg

SEQ ID NO: 61358 - DNA, 103 bp, Artificial Sequence
  Synthetic Polynucleotide
taatacgactcactataggggttgatgtttatttttacaggcattactttaacagaggagaaaagtaatgcctgtaaaaaacctggcggcagcgcaaaagatg

SEQ ID NO: 61359 - DNA, 103 bp, Artificial Sequence
  Synthetic Polynucleotide
taatacgactcactatagggaacgaatttagaaacaccatataaatgatgaacagaggagacatcatatgtatggtgttaacctggcggcagcgcaaaagatg

SEQ ID NO: 61360 - DNA, 103 bp, Artificial Sequence
  Synthetic Polynucleotide
taatacgactcactatagggacaatgttgatgtttatttttacaggcattaacagaggagaaatgccatgaaaaataaaaacctggcggcagcgcaaaagatg

SEQ ID NO: 61361 - DNA, 103 bp, Artificial Sequence
  Synthetic Polynucleotide
taatacgactcactatagggatcatacaatgttgatgtttatttttacagaacagaggagactgtaaatgtaaacatcaaacctggcggcagcgcaaaagatg

SEQ ID NO: 61362 - DNA, 103 bp, Artificial Sequence
  Synthetic Polynucleotide
taatacgactcactatagggtgaccatcatacaatgttgatgtttattttaacagaggagaaaaataatgatcaacattaacctggcggcagcgcaaaagatg

SEQ ID NO: 61363 - DNA, 103 bp, Artificial Sequence
  Synthetic Polynucleotide
taatacgactcactatagggtttaatgaccatcatacaatgttgatgtttaacagaggagaaaacatatgcattgtatgaacctggcggcagcgcaaaagatg

SEQ ID NO: 61364 - DNA, 103 bp, Artificial Sequence
  Synthetic Polynucleotide
taatacgactcactatagggattggtttaatgaccatcatacaatgttgaaacagaggagatcaacaatgtatgatggtaacctggcggcagcgcaaaagatg

SEQ ID NO: 61365 - DNA, 103 bp, Artificial Sequence
  Synthetic Polynucleotide
taatacgactcactatagggtactaattggtttaatgaccatcatacaataacagaggagaattgtaatgtggtcattaaacctggcggcagcgcaaaagatg

SEQ ID NO: 61366 - DNA, 103 bp, Artificial Sequence
  Synthetic Polynucleotide
taatacgactcactatagggcgtcatactaattggtttaatgaccatcataacagaggagaatgatgatgattaaaccaaacctggcggcagcgcaaaagatg

SEQ ID NO: 61367 - DNA, 103 bp, Artificial Sequence
  Synthetic Polynucleotide
taatacgactcactatagggttcaacgtcatactaattggtttaatgaccaacagaggagaggtcatatgaccaattagaacctggcggcagcgcaaaagatg

SEQ ID NO: 61368 - DNA, 103 bp, Artificial Sequence
  Synthetic Polynucleotide
taatacgactcactatagggattagttcaacgtcatactaattggtttaaaacagaggagattaaacatgttagtatgaaacctggcggcagcgcaaaagatg

SEQ ID NO: 61369 - DNA, 103 bp, Artificial Sequence
  Synthetic Polynucleotide
taatacgactcactataggggtgaaattagttcaacgtcatactaattggaacagaggagaccaattatgatgacgttgaacctggcggcagcgcaaaagatg

SEQ ID NO: 61370 - DNA, 103 bp, Artificial Sequence
  Synthetic Polynucleotide
taatacgactcactatagggttttaaacgaatttagaaacaccatataaaaacagaggagatttataatgtgtttctaaaacctggcggcagcgcaaaagatg

SEQ ID NO: 61371 - DNA, 103 bp, Artificial Sequence
  Synthetic Polynucleotide
taatacgactcactatagggctactgtgaaattagttcaacgtcatactaaacagaggagatagtatatggttgaactaaacctggcggcagcgcaaaagatg

SEQ ID NO: 61372 - DNA, 103 bp, Artificial Sequence
  Synthetic Polynucleotide
taatacgactcactatagggaaaatctactgtgaaattagttcaacgtcaaacagaggagatgacgtatgactaatttcaacctggcggcagcgcaaaagatg

SEQ ID NO: 61373 - DNA, 103 bp, Artificial Sequence
  Synthetic Polynucleotide
taatacgactcactatagggggaataaaatctactgtgaaattagttcaaaacagaggagattgaacatgtttcacagtaacctggcggcagcgcaaaagatg

SEQ ID NO: 61374 - DNA, 103 bp, Artificial Sequence
  Synthetic Polynucleotide
taatacgactcactatagggacaccggaataaaatctactgtgaaattagaacagaggagactaattatgcagtagattaacctggcggcagcgcaaaagatg

SEQ ID NO: 61375 - DNA, 103 bp, Artificial Sequence
  Synthetic Polynucleotide
taatacgactcactatagggggataacaccggaataaaatctactgtgaaaacagaggagattcacaatggattttattaacctggcggcagcgcaaaagatg

SEQ ID NO: 61376 - DNA, 103 bp, Artificial Sequence
  Synthetic Polynucleotide
taatacgactcactatagggtgcgaggataacaccggaataaaatctactaacagaggagaagtagaatgtattccggtaacctggcggcagcgcaaaagatg

SEQ ID NO: 61377 - DNA, 103 bp, Artificial Sequence
  Synthetic Polynucleotide
taatacgactcactatagggatacatgcgaggataacaccggaataaaataacagaggagaattttaatgcggtgttataacctggcggcagcgcaaaagatg

SEQ ID NO: 61378 - DNA, 103 bp, Artificial Sequence
  Synthetic Polynucleotide
taatacgactcactatagggtacttatacatgcgaggataacaccggaataacagaggagaattccgatgttatcctcgaacctggcggcagcgcaaaagatg

SEQ ID NO: 61379 - DNA, 103 bp, Artificial Sequence
  Synthetic Polynucleotide
taatacgactcactatagggcccggtacttatacatgcgaggataacaccaacagaggagaggtgttatgctcgcatgtaacctggcggcagcgcaaaagatg

SEQ ID NO: 61380 - DNA, 103 bp, Artificial Sequence
  Synthetic Polynucleotide
taatacgactcactatagggtattacccggtacttatacatgcgaggataaacagaggagatatcctatgatgtataagaacctggcggcagcgcaaaagatg

SEQ ID NO: 61381 - DNA, 103 bp, Artificial Sequence
  Synthetic Polynucleotide
taatacgactcactatagggtaattttttaaacgaatttagaaacaccataacagaggagaatggtgatgctaaattcgaacctggcggcagcgcaaaagatg

SEQ ID NO: 61382 - DNA, 103 bp, Artificial Sequence
  Synthetic Polynucleotide
taatacgactcactatagggagatatattacccggtacttatacatgcgaaacagaggagatcgcatatgtaagtaccgaacctggcggcagcgcaaaagatg

SEQ ID NO: 61383 - DNA, 103 bp, Artificial Sequence
  Synthetic Polynucleotide
taatacgactcactatagggtataaagatatattacccggtacttatacaaacagaggagatgtataatgaccgggtaaaacctggcggcagcgcaaaagatg

SEQ ID NO: 61384 - DNA, 103 bp, Artificial Sequence
  Synthetic Polynucleotide
taatacgactcactatagggtaaagtataaagatatattacccggtacttaacagaggagaaagtacatggtaatatataacctggcggcagcgcaaaagatg

SEQ ID NO: 61385 - DNA, 103 bp, Artificial Sequence
  Synthetic Polynucleotide
taatacgactcactatagggaattataaagtataaagatatattacccggaacagaggagaccgggtatgatatctttaaacctggcggcagcgcaaaagatg

SEQ ID NO: 61386 - DNA, 103 bp, Artificial Sequence
  Synthetic Polynucleotide
taatacgactcactatagggtcattaattataaagtataaagatatattaaacagaggagataatatatgtttatacttaacctggcggcagcgcaaaagatg

SEQ ID NO: 61387 - DNA, 103 bp, Artificial Sequence
  Synthetic Polynucleotide
taatacgactcactatagggatgtttcattaattataaagtataaagataaacagaggagatatcttatgactttataaaacctggcggcagcgcaaaagatg

SEQ ID NO: 61388 - DNA, 103 bp, Artificial Sequence
  Synthetic Polynucleotide
taatacgactcactatagggtaacgatgtttcattaattataaagtataaaacagaggagattatacatgataattaataacctggcggcagcgcaaaagatg

SEQ ID NO: 61389 - DNA, 103 bp, Artificial Sequence
  Synthetic Polynucleotide
taatacgactcactatagggtctgataacgatgtttcattaattataaagaacagaggagactttatatgtaatgaaacaacctggcggcagcgcaaaagatg

SEQ ID NO: 61390 - DNA, 103 bp, Artificial Sequence
  Synthetic Polynucleotide
taatacgactcactatagggcgttatctgataacgatgtttcattaattaaacagaggagataattaatgaaacatcgtaacctggcggcagcgcaaaagatg

SEQ ID NO: 61391 - DNA, 103 bp, Artificial Sequence
  Synthetic Polynucleotide
taatacgactcactatagggccattcgttatctgataacgatgtttcattaacagaggagaaatgaaatgtcgttatcaaacctggcggcagcgcaaaagatg

SEQ ID NO: 61392 - DNA, 103 bp, Artificial Sequence
  Synthetic Polynucleotide
taatacgactcactatagggccgtataattttttaaacgaatttagaaacaacagaggagagtttctatgttcgtttaaaacctggcggcagcgcaaaagatg

SEQ ID NO: 61393 - DNA, 103 bp, Artificial Sequence
  Synthetic Polynucleotide
taatacgactcactatagggaaactccattcgttatctgataacgatgttaacagaggagaaacatcatgatcagataaaacctggcggcagcgcaaaagatg

SEQ ID NO: 61394 - DNA, 103 bp, Artificial Sequence
  Synthetic Polynucleotide
taatacgactcactataggggtgccaaactccattcgttatctgataacgaacagaggagacgttatatgataacgaataacctggcggcagcgcaaaagatg

SEQ ID NO: 61395 - DNA, 103 bp, Artificial Sequence
  Synthetic Polynucleotide
taatacgactcactatagggtactagtgccaaactccattcgttatctgaaacagaggagatcagatatggaatggagtaacctggcggcagcgcaaaagatg

SEQ ID NO: 61396 - DNA, 103 bp, Artificial Sequence
  Synthetic Polynucleotide
taatacgactcactatagggtggcatactagtgccaaactccattcgttaaacagaggagataacgaatggagtttggcaacctggcggcagcgcaaaagatg

SEQ ID NO: 61397 - DNA, 103 bp, Artificial Sequence
  Synthetic Polynucleotide
taatacgactcactataggggtaaatggcatactagtgccaaactccattaacagaggagaaatggaatgtggcactagaacctggcggcagcgcaaaagatg

SEQ ID NO: 61398 - DNA, 103 bp, Artificial Sequence
  Synthetic Polynucleotide
taatacgactcactatagggattaagtaaatggcatactagtgccaaactaacagaggagaagtttgatgctagtatgcaacctggcggcagcgcaaaagatg

SEQ ID NO: 61399 - DNA, 103 bp, Artificial Sequence
  Synthetic Polynucleotide
taatacgactcactatagggatcatattaagtaaatggcatactagtgccaacagaggagaggcactatgatgccatttaacctggcggcagcgcaaaagatg

SEQ ID NO: 61400 - DNA, 103 bp, Artificial Sequence
  Synthetic Polynucleotide
taatacgactcactatagggagacgatcatattaagtaaatggcatactaaacagaggagatagtatatgatttacttaaacctggcggcagcgcaaaagatg

SEQ ID NO: 61401 - DNA, 103 bp, Artificial Sequence
  Synthetic Polynucleotide
taatacgactcactatagggttccaagacgatcatattaagtaaatggcaaacagaggagatgccatatgcttaatatgaacctggcggcagcgcaaaagatg

SEQ ID NO: 61402 - DNA, 103 bp, Artificial Sequence
  Synthetic Polynucleotide
taatacgactcactatagggaaaacttccaagacgatcatattaagtaaaaacagaggagatttactatgtatgatcgtaacctggcggcagcgcaaaagatg

SEQ ID NO: 61403 - DNA, 103 bp, Artificial Sequence
  Synthetic Polynucleotide
taatacgactcactatagggcgtctccgtataattttttaaacgaatttaaacagaggagataaattatgttaaaaaataacctggcggcagcgcaaaagatg

SEQ ID NO: 61404 - DNA, 103 bp, Artificial Sequence
  Synthetic Polynucleotide
taatacgactcactatagggataataaaacttccaagacgatcatattaaaacagaggagattaataatgtcgtcttggaacctggcggcagcgcaaaagatg

SEQ ID NO: 61405 - DNA, 103 bp, Artificial Sequence
  Synthetic Polynucleotide
taatacgactcactatagggaacttataataaaacttccaagacgatcataacagaggagaatgatcatgttggaagttaacctggcggcagcgcaaaagatg

SEQ ID NO: 61406 - DNA, 103 bp, Artificial Sequence
  Synthetic Polynucleotide
taatacgactcactatagggattttaacttataataaaacttccaagacgaacagaggagacgtcttatgagttttattaacctggcggcagcgcaaaagatg

SEQ ID NO: 61407 - DNA, 103 bp, Artificial Sequence
  Synthetic Polynucleotide
taatacgactcactatagggataatattttaacttataataaaacttccaaacagaggagatggaagatgtattataagaacctggcggcagcgcaaaagatg

SEQ ID NO: 61408 - DNA, 103 bp, Artificial Sequence
  Synthetic Polynucleotide
taatacgactcactatagggcaaccataatattttaacttataataaaacaacagaggagagttttaatgtaagttaaaaacctggcggcagcgcaaaagatg

SEQ ID NO: 61409 - DNA, 103 bp, Artificial Sequence
  Synthetic Polynucleotide
taatacgactcactatagggttggacaaccataatattttaacttataataacagaggagaattataatgtaaaatattaacctggcggcagcgcaaaagatg

SEQ ID NO: 61410 - DNA, 103 bp, Artificial Sequence
  Synthetic Polynucleotide
taatacgactcactatagggggaaattggacaaccataatattttaacttaacagaggagaaagttaatgtattatggtaacctggcggcagcgcaaaagatg

SEQ ID NO: 61411 - DNA, 103 bp, Artificial Sequence
  Synthetic Polynucleotide
taatacgactcactatagggtagatggaaattggacaaccataatattttaacagaggagaaaaataatgtggttgtccaacctggcggcagcgcaaaagatg

SEQ ID NO: 61412 - DNA, 103 bp, Artificial Sequence
  Synthetic Polynucleotide
taatacgactcactatagggtatattagatggaaattggacaaccataataacagaggagaattatgatggtccaatttaacctggcggcagcgcaaaagatg

SEQ ID NO: 61413 - DNA, 103 bp, Artificial Sequence
  Synthetic Polynucleotide
taatacgactcactatagggcaaagtatattagatggaaattggacaaccaacagaggagaggttgtatgatttccatcaacctggcggcagcgcaaaagatg

SEQ ID NO: 61414 - DNA, 103 bp, Artificial Sequence
  Synthetic Polynucleotide
taatacgactcactatagggtacggcgtctccgtataattttttaaacgaaacagaggagatcgtttatgaaattatacaacctggcggcagcgcaaaagatg

SEQ ID NO: 61415 - DNA, 103 bp, Artificial Sequence
  Synthetic Polynucleotide
taatacgactcactatagggtccaacaaagtatattagatggaaattggaaacagaggagatccaatatgcatctaataaacctggcggcagcgcaaaagatg

SEQ ID NO: 61416 - DNA, 103 bp, Artificial Sequence
  Synthetic Polynucleotide
taatacgactcactataggggataatccaacaaagtatattagatggaaaaacagaggagatttccaatgaatatacttaacctggcggcagcgcaaaagatg

SEQ ID NO: 61417 - DNA, 103 bp, Artificial Sequence
  Synthetic Polynucleotide
taatacgactcactatagggctatagataatccaacaaagtatattagataacagaggagaatctaaatgactttgttgaacctggcggcagcgcaaaagatg

SEQ ID NO: 61418 - DNA, 103 bp, Artificial Sequence
  Synthetic Polynucleotide
taatacgactcactataggggtgtactatagataatccaacaaagtatataacagaggagaatatacatggttggattaaacctggcggcagcgcaaaagatg

SEQ ID NO: 61419 - DNA, 103 bp, Artificial Sequence
  Synthetic Polynucleotide
taatacgactcactatagggattccgtgtactatagataatccaacaaagaacagaggagactttgtatgattatctataacctggcggcagcgcaaaagatg

SEQ ID NO: 61420 - DNA, 103 bp, Artificial Sequence
  Synthetic Polynucleotide
taatacgactcactatagggtcattattccgtgtactatagataatccaaaacagaggagattggatatgctatagtacaacctggcggcagcgcaaaagatg

SEQ ID NO: 61421 - DNA, 103 bp, Artificial Sequence
  Synthetic Polynucleotide
taatacgactcactatagggtaccatcattattccgtgtactatagataaaacagaggagattatctatggtacacggaaacctggcggcagcgcaaaagatg

SEQ ID NO: 61422 - DNA, 103 bp, Artificial Sequence
  Synthetic Polynucleotide
taatacgactcactatagggaatgataccatcattattccgtgtactataaacagaggagatatagtatgcggaataataacctggcggcagcgcaaaagatg

SEQ ID NO: 61423 - DNA, 103 bp, Artificial Sequence
  Synthetic Polynucleotide
taatacgactcactatagggcgtgcaatgataccatcattattccgtgtaaacagaggagatacacgatgtaatgatggaacctggcggcagcgcaaaagatg

SEQ ID NO: 61424 - DNA, 103 bp, Artificial Sequence
  Synthetic Polynucleotide
taatacgactcactatagggtacggcgtgcaatgataccatcattattccaacagaggagaggaataatgatggtatcaaacctggcggcagcgcaaaagatg

SEQ ID NO: 61425 - DNA, 103 bp, Artificial Sequence
  Synthetic Polynucleotide
taatacgactcactatagggattattacggcgtctccgtataattttttaaacagaggagataaaaaatgatacggagaaacctggcggcagcgcaaaagatg

SEQ ID NO: 61426 - DNA, 103 bp, Artificial Sequence
  Synthetic Polynucleotide
taatacgactcactataggggagtatacggcgtgcaatgataccatcattaacagaggagaaatgatatgatcattgcaaacctggcggcagcgcaaaagatg

SEQ ID NO: 61427 - DNA, 103 bp, Artificial Sequence
  Synthetic Polynucleotide
taatacgactcactatagggctatagagtatacggcgtgcaatgataccaaacagaggagatggtatatgtgcacgccgaacctggcggcagcgcaaaagatg

SEQ ID NO: 61428 - DNA, 103 bp, Artificial Sequence
  Synthetic Polynucleotide
taatacgactcactatagggaaagactatagagtatacggcgtgcaatgaaacagaggagatcattgatggccgtatacaacctggcggcagcgcaaaagatg

SEQ ID NO: 61429 - DNA, 103 bp, Artificial Sequence
  Synthetic Polynucleotide
taatacgactcactatagggtctacaaagactatagagtatacggcgtgcaacagaggagagcacgcatgatactctataacctggcggcagcgcaaaagatg

SEQ ID NO: 61430 - DNA, 103 bp, Artificial Sequence
  Synthetic Polynucleotide
taatacgactcactatagggtaacatctacaaagactatagagtatacggaacagaggagaccgtatatgctatagtctaacctggcggcagcgcaaaagatg

SEQ ID NO: 61431 - DNA, 103 bp, Artificial Sequence
  Synthetic Polynucleotide
taatacgactcactatagggggttataacatctacaaagactatagagtaaacagaggagatactctatggtctttgtaaacctggcggcagcgcaaaagatg

SEQ ID NO: 61432 - DNA, 103 bp, Artificial Sequence
  Synthetic Polynucleotide
taatacgactcactatagggtttgtggttataacatctacaaagactataaacagaggagatatagtatgtgtagatgtaacctggcggcagcgcaaaagatg

SEQ ID NO: 61433 - DNA, 103 bp, Artificial Sequence
  Synthetic Polynucleotide
taatacgactcactataggggcacttttgtggttataacatctacaaagaaacagaggagatctttgatgatgttataaaacctggcggcagcgcaaaagatg

SEQ ID NO: 61434 - DNA, 103 bp, Artificial Sequence
  Synthetic Polynucleotide
taatacgactcactatagggcctctgcacttttgtggttataacatctacaacagaggagagtagatatgataaccacaaacctggcggcagcgcaaaagatg

SEQ ID NO: 61435 - DNA, 103 bp, Artificial Sequence
  Synthetic Polynucleotide
taatacgactcactatagggatatacctctgcacttttgtggttataacaaacagaggagatgttatatgcacaaaagtaacctggcggcagcgcaaaagatg

SEQ ID NO: 61436 - DNA, 103 bp, Artificial Sequence
  Synthetic Polynucleotide
taatacgactcactataggggggaaattattacggcgtctccgtataattaacagaggagaaattatatggagacgccgaacctggcggcagcgcaaaagatg

SEQ ID NO: 61437 - DNA, 103 bp, Artificial Sequence
  Synthetic Polynucleotide
taatacgactcactatagggtgttgatatacctctgcacttttgtggttaaacagaggagataaccaatgaagtgcagaaacctggcggcagcgcaaaagatg

SEQ ID NO: 61438 - DNA, 103 bp, Artificial Sequence
  Synthetic Polynucleotide
taatacgactcactatagggaatattgttgatatacctctgcacttttgtaacagaggagaacaaaaatgcagaggtataacctggcggcagcgcaaaagatg

SEQ ID NO: 61439 - DNA, 103 bp, Artificial Sequence
  Synthetic Polynucleotide
taatacgactcactataggggttagaatattgttgatatacctctgcactaacagaggagaagtgcaatggtatatcaaaacctggcggcagcgcaaaagatg

SEQ ID NO: 61440 - DNA, 103 bp, Artificial Sequence
  Synthetic Polynucleotide
taatacgactcactatagggtaagagttagaatattgttgatatacctctaacagaggagaagaggtatgtcaacaataaacctggcggcagcgcaaaagatg

SEQ ID NO: 61441 - DNA, 103 bp, Artificial Sequence
  Synthetic Polynucleotide
taatacgactcactatagggaatgttaagagttagaatattgttgatataaacagaggagatatatcatgaatattctaaacctggcggcagcgcaaaagatg

SEQ ID NO: 61442 - DNA, 103 bp, Artificial Sequence
  Synthetic Polynucleotide
taatacgactcactatagggataaaaatgttaagagttagaatattgttgaacagaggagacaacaaatgtctaactctaacctggcggcagcgcaaaagatg

SEQ ID NO: 61443 - DNA, 103 bp, Artificial Sequence
  Synthetic Polynucleotide
taatacgactcactatagggaataaataaaaatgttaagagttagaatataacagaggagaatattcatgctcttaacaaacctggcggcagcgcaaaagatg

SEQ ID NO: 61444 - DNA, 103 bp, Artificial Sequence
  Synthetic Polynucleotide
taatacgactcactatagggttttaaataaataaaaatgttaagagttagaacagaggagactaactatgaacatttttaacctggcggcagcgcaaaagatg

SEQ ID NO: 61445 - DNA, 103 bp, Artificial Sequence
  Synthetic Polynucleotide
taatacgactcactatagggtatcattttaaataaataaaaatgttaagaaacagaggagatcttaaatgttttatttaaacctggcggcagcgcaaaagatg

SEQ ID NO: 61446 - DNA, 103 bp, Artificial Sequence
  Synthetic Polynucleotide
taatacgactcactatagggaaaggtatcattttaaataaataaaaatgtaacagaggagaacatttatgtttatttaaaacctggcggcagcgcaaaagatg

SEQ ID NO: 61447 - DNA, 103 bp, Artificial Sequence
  Synthetic Polynucleotide
taatacgactcactatagggcaatggggaaattattacggcgtctccgtaaacagaggagatacggaatggccgtaataaacctggcggcagcgcaaaagatg

SEQ ID NO: 61448 - DNA, 103 bp, Artificial Sequence
  Synthetic Polynucleotide
taatacgactcactatagggataacaaaggtatcattttaaataaataaaaacagaggagatttattatgttaaaatgaaacctggcggcagcgcaaaagatg

SEQ ID NO: 61449 - DNA, 103 bp, Artificial Sequence
  Synthetic Polynucleotide
taatacgactcactatagggaataaataacaaaggtatcattttaaataaaacagaggagattatttatgatgatacctaacctggcggcagcgcaaaagatg

SEQ ID NO: 61450 - DNA, 103 bp, Artificial Sequence
  Synthetic Polynucleotide
taatacgactcactatagggaataaaataaataacaaaggtatcattttaaacagaggagataaaatatgacctttgttaacctggcggcagcgcaaaagatg

SEQ ID NO: 61451 - DNA, 103 bp, Artificial Sequence
  Synthetic Polynucleotide
taatacgactcactatagggaatagaataaaataaataacaaaggtatcaaacagaggagatgatacatgtgttatttaaacctggcggcagcgcaaaagatg

SEQ ID NO: 61452 - DNA, 103 bp, Artificial Sequence
  Synthetic Polynucleotide
taatacgactcactatagggcgcaaaatagaataaaataaataacaaaggaacagaggagacctttgatgtttattttaaacctggcggcagcgcaaaagatg

SEQ ID NO: 61453 - DNA, 103 bp, Artificial Sequence
  Synthetic Polynucleotide
taatacgactcactatagggccgttcgcaaaatagaataaaataaataacaacagaggagagttattatgtttattctaaacctggcggcagcgcaaaagatg

SEQ ID NO: 61454 - DNA, 103 bp, Artificial Sequence
  Synthetic Polynucleotide
taatacgactcactatagggcgataccgttcgcaaaatagaataaaataaaacagaggagattatttatgtctattttgaacctggcggcagcgcaaaagatg

SEQ ID NO: 61455 - DNA, 103 bp, Artificial Sequence
  Synthetic Polynucleotide
taatacgactcactatagggccattcgataccgttcgcaaaatagaataaaacagaggagattattcatgtttgcgaacaacctggcggcagcgcaaaagatg

SEQ ID NO: 61456 - DNA, 103 bp, Artificial Sequence
  Synthetic Polynucleotide
taatacgactcactatagggttatgccattcgataccgttcgcaaaatagaacagaggagactatttatggaacggtataacctggcggcagcgcaaaagatg

SEQ ID NO: 61457 - DNA, 103 bp, Artificial Sequence
  Synthetic Polynucleotide
taatacgactcactatagggcaaacttatgccattcgataccgttcgcaaaacagaggagattgcgaatggtatcgaataacctggcggcagcgcaaaagatg

SEQ ID NO: 61458 - DNA, 103 bp, Artificial Sequence
  Synthetic Polynucleotide
taatacgactcactatagggatggatcctaatcttatagataggtattataacagaggagaataataatgatctataagaacctggcggcagcgcaaaagatg

SEQ ID NO: 61459 - DNA, 103 bp, Artificial Sequence
  Synthetic Polynucleotide
taatacgactcactatagggtctatcaatggggaaattattacggcgtctaacagaggagaagacgcatgaataatttcaacctggcggcagcgcaaaagatg

SEQ ID NO: 61460 - DNA, 103 bp, Artificial Sequence
  Synthetic Polynucleotide
taatacgactcactatagggcgtttcaaacttatgccattcgataccgttaacagaggagaaacggtatggaatggcataacctggcggcagcgcaaaagatg

SEQ ID NO: 61461 - DNA, 103 bp, Artificial Sequence
  Synthetic Polynucleotide
taatacgactcactatagggtcactcgtttcaaacttatgccattcgataaacagaggagatatcgaatggcataagttaacctggcggcagcgcaaaagatg

SEQ ID NO: 61462 - DNA, 103 bp, Artificial Sequence
  Synthetic Polynucleotide
taatacgactcactatagggttttttcactcgtttcaaacttatgccattaacagaggagaaatggcatgagtttgaaaaacctggcggcagcgcaaaagatg

SEQ ID NO: 61463 - DNA, 103 bp, Artificial Sequence
  Synthetic Polynucleotide
taatacgactcactatagggaattattttttcactcgtttcaaacttatgaacagaggagacataagatggaaacgagtaacctggcggcagcgcaaaagatg

SEQ ID NO: 61464 - DNA, 103 bp, Artificial Sequence
  Synthetic Polynucleotide
taatacgactcactataggggtagaaattattttttcactcgtttcaaacaacagaggagagtttgaatggagtgaaaaaacctggcggcagcgcaaaagatg

SEQ ID NO: 61465 - DNA, 103 bp, Artificial Sequence
  Synthetic Polynucleotide
taatacgactcactatagggagtaagtagaaattattttttcactcgtttaacagaggagaaaacgaatgaaaaaataaaacctggcggcagcgcaaaagatg

SEQ ID NO: 61466 - DNA, 103 bp, Artificial Sequence
  Synthetic Polynucleotide
taatacgactcactatagggtattaagtaagtagaaattattttttcactaacagaggagaagtgaaatgataatttctaacctggcggcagcgcaaaagatg

SEQ ID NO: 61467 - DNA, 103 bp, Artificial Sequence
  Synthetic Polynucleotide
taatacgactcactatagggtcatctattaagtaagtagaaattatttttaacagaggagaaaaaatatgttctacttaaacctggcggcagcgcaaaagatg

SEQ ID NO: 61468 - DNA, 103 bp, Artificial Sequence
  Synthetic Polynucleotide
taatacgactcactatagggatacgtcatctattaagtaagtagaaattaaacagaggagataatttatgcttacttaaaacctggcggcagcgcaaaagatg

SEQ ID NO: 61469 - DNA, 103 bp, Artificial Sequence
  Synthetic Polynucleotide
taatacgactcactataggggtataatacgtcatctattaagtaagtagaaacagaggagatctactatgttaatagataacctggcggcagcgcaaaagatg

SEQ ID NO: 61470 - DNA, 103 bp, Artificial Sequence
  Synthetic Polynucleotide
taatacgactcactatagggtattttctatcaatggggaaattattacggaacagaggagaccgtaaatgtttccccataacctggcggcagcgcaaaagatg

SEQ ID NO: 61471 - DNA, 103 bp, Artificial Sequence
  Synthetic Polynucleotide
taatacgactcactatagggcccgtgtataatacgtcatctattaagtaaaacagaggagattacttatgagatgacgtaacctggcggcagcgcaaaagatg

SEQ ID NO: 61472 - DNA, 103 bp, Artificial Sequence
  Synthetic Polynucleotide
taatacgactcactatagggtaacacccgtgtataatacgtcatctattaaacagaggagataatagatgacgtattataacctggcggcagcgcaaaagatg

SEQ ID NO: 61473 - DNA, 103 bp, Artificial Sequence
  Synthetic Polynucleotide
taatacgactcactatagggcccattaacacccgtgtataatacgtcatcaacagaggagagatgacatgttatacacgaacctggcggcagcgcaaaagatg

SEQ ID NO: 61474 - DNA, 103 bp, Artificial Sequence
  Synthetic Polynucleotide
taatacgactcactatagggactgccccattaacacccgtgtataatacgaacagaggagacgtattatgcacgggtgtaacctggcggcagcgcaaaagatg

SEQ ID NO: 61475 - DNA, 103 bp, Artificial Sequence
  Synthetic Polynucleotide
taatacgactcactatagggtatatactgccccattaacacccgtgtataaacagaggagatatacaatggtgttaatgaacctggcggcagcgcaaaagatg

SEQ ID NO: 61476 - DNA, 103 bp, Artificial Sequence
  Synthetic Polynucleotide
taatacgactcactatagggaaatgtatatactgccccattaacacccgtaacagaggagaacgggtatgaatggggcaaacctggcggcagcgcaaaagatg

SEQ ID NO: 61477 - DNA, 103 bp, Artificial Sequence
  Synthetic Polynucleotide
taatacgactcactatagggtttgaaaatgtatatactgccccattaacaaacagaggagatgttaaatgggcagtataaacctggcggcagcgcaaaagatg

SEQ ID NO: 61478 - DNA, 103 bp, Artificial Sequence
  Synthetic Polynucleotide
taatacgactcactatagggtattatttgaaaatgtatatactgccccataacagaggagaatggggatgtatatacataacctggcggcagcgcaaaagatg

SEQ ID NO: 61479 - DNA, 103 bp, Artificial Sequence
  Synthetic Polynucleotide
taatacgactcactatagggtagtttattatttgaaaatgtatatactgcaacagaggagagcagtaatgacattttcaaacctggcggcagcgcaaaagatg

SEQ ID NO: 61480 - DNA, 103 bp, Artificial Sequence
  Synthetic Polynucleotide
taatacgactcactatagggttgtttagtttattatttgaaaatgtatataacagaggagaatatacatgttcaaataaaacctggcggcagcgcaaaagatg

SEQ ID NO: 61481 - DNA, 103 bp, Artificial Sequence
  Synthetic Polynucleotide
taatacgactcactatagggcgtgatattttctatcaatggggaaattataacagaggagaataattatgccattgataaacctggcggcagcgcaaaagatg

SEQ ID NO: 61482 - DNA, 103 bp, Artificial Sequence
  Synthetic Polynucleotide
taatacgactcactatagggcagttttgtttagtttattatttgaaaatgaacagaggagacattttatgataataaacaacctggcggcagcgcaaaagatg

SEQ ID NO: 61483 - DNA, 103 bp, Artificial Sequence
  Synthetic Polynucleotide
taatacgactcactatagggtaaaccagttttgtttagtttattatttgaaacagaggagatcaaatatgaaactaaacaacctggcggcagcgcaaaagatg

SEQ ID NO: 61484 - DNA, 103 bp, Artificial Sequence
  Synthetic Polynucleotide
taatacgactcactatagggttagctaaaccagttttgtttagtttattaaacagaggagataataaatgaaacaaaacaacctggcggcagcgcaaaagatg

SEQ ID NO: 61485 - DNA, 103 bp, Artificial Sequence
  Synthetic Polynucleotide
taatacgactcactatagggtagtattagctaaaccagttttgtttagttaacagaggagaaactaaatgaaactggttaacctggcggcagcgcaaaagatg

SEQ ID NO: 61486 - DNA, 103 bp, Artificial Sequence
  Synthetic Polynucleotide
taatacgactcactatagggataattagtattagctaaaccagttttgttaacagaggagaaacaaaatgggtttagctaacctggcggcagcgcaaaagatg

SEQ ID NO: 61487 - DNA, 103 bp, Artificial Sequence
  Synthetic Polynucleotide
taatacgactcactataggggtgatataattagtattagctaaaccagttaacagaggagaaactggatgagctaatacaacctggcggcagcgcaaaagatg

SEQ ID NO: 61488 - DNA, 103 bp, Artificial Sequence
  Synthetic Polynucleotide
taatacgactcactatagggatgttgtgatataattagtattagctaaacaacagaggagagtttagatgatactaattaacctggcggcagcgcaaaagatg

SEQ ID NO: 61489 - DNA, 103 bp, Artificial Sequence
  Synthetic Polynucleotide
taatacgactcactatagggtatagatgttgtgatataattagtattagcaacagaggagagctaatatgaattatatcaacctggcggcagcgcaaaagatg

SEQ ID NO: 61490 - DNA, 103 bp, Artificial Sequence
  Synthetic Polynucleotide
taatacgactcactatagggacttttatagatgttgtgatataattagtaaacagaggagatactaaatgtatcacaacaacctggcggcagcgcaaaagatg

SEQ ID NO: 61491 - DNA, 103 bp, Artificial Sequence
  Synthetic Polynucleotide
taatacgactcactatagggcctctacttttatagatgttgtgatataataacagaggagaattataatgcaacatctaaacctggcggcagcgcaaaagatg

SEQ ID NO: 61492 - DNA, 103 bp, Artificial Sequence
  Synthetic Polynucleotide
taatacgactcactataggggaaagcgtgatattttctatcaatggggaaaacagaggagattccccatggatagaaaaaacctggcggcagcgcaaaagatg

SEQ ID NO: 61493 - DNA, 103 bp, Artificial Sequence
  Synthetic Polynucleotide
taatacgactcactatagggcacatcctctacttttatagatgttgtgataacagaggagaatcacaatgtctataaaaaacctggcggcagcgcaaaagatg

SEQ ID NO: 61494 - DNA, 103 bp, Artificial Sequence
  Synthetic Polynucleotide
taatacgactcactatagggtgtatcacatcctctacttttatagatgttaacagaggagaaacatcatgaaaagtagaaacctggcggcagcgcaaaagatg

SEQ ID NO: 61495 - DNA, 103 bp, Artificial Sequence
  Synthetic Polynucleotide
taatacgactcactatagggactaatgtatcacatcctctacttttatagaacagaggagactataaatgtagaggatgaacctggcggcagcgcaaaagatg

SEQ ID NO: 61496 - DNA, 103 bp, Artificial Sequence
  Synthetic Polynucleotide
taatacgactcactatagggcgcatactaatgtatcacatcctctactttaacagaggagaaaagtaatggatgtgataaacctggcggcagcgcaaaagatg

SEQ ID NO: 61497 - DNA, 103 bp, Artificial Sequence
  Synthetic Polynucleotide
taatacgactcactatagggggttccgcatactaatgtatcacatcctctaacagaggagaagaggaatggatacattaaacctggcggcagcgcaaaagatg

SEQ ID NO: 61498 - DNA, 103 bp, Artificial Sequence
  Synthetic Polynucleotide
taatacgactcactatagggttattggttccgcatactaatgtatcacataacagaggagaatgtgaatgattagtatgaacctggcggcagcgcaaaagatg

SEQ ID NO: 61499 - DNA, 103 bp, Artificial Sequence
  Synthetic Polynucleotide
taatacgactcactatagggttccgttattggttccgcatactaatgtataacagaggagaatacatatgtatgcggaaaacctggcggcagcgcaaaagatg

SEQ ID NO: 61500 - DNA, 103 bp, Artificial Sequence
  Synthetic Polynucleotide
taatacgactcactataggggggatttccgttattggttccgcatactaaaacagaggagattagtaatgggaaccaataacctggcggcagcgcaaaagatg

SEQ ID NO: 61501 - DNA, 103 bp, Artificial Sequence
  Synthetic Polynucleotide
taatacgactcactatagggcatttgggatttccgttattggttccgcataacagaggagaatgcggatgcaataacggaacctggcggcagcgcaaaagatg

SEQ ID NO: 61502 - DNA, 103 bp, Artificial Sequence
  Synthetic Polynucleotide
taatacgactcactatagggtccaacatttgggatttccgttattggttcaacagaggagagaaccaatgacggaaatcaacctggcggcagcgcaaaagatg

SEQ ID NO: 61503 - DNA, 103 bp, Artificial Sequence
  Synthetic Polynucleotide
taatacgactcactataggggaatggaaagcgtgatattttctatcaatgaacagaggagacattgaatgaaaatatcaaacctggcggcagcgcaaaagatg

SEQ ID NO: 61504 - DNA, 103 bp, Artificial Sequence
  Synthetic Polynucleotide
taatacgactcactatagggtattttccaacatttgggatttccgttattaacagaggagaaataacatgaatcccaaaaacctggcggcagcgcaaaagatg

SEQ ID NO: 61505 - DNA, 103 bp, Artificial Sequence
  Synthetic Polynucleotide
taatacgactcactatagggccgtctattttccaacatttgggatttccgaacagaggagacggaaaatgcaaatgttgaacctggcggcagcgcaaaagatg

SEQ ID NO: 61506 - DNA, 103 bp, Artificial Sequence
  Synthetic Polynucleotide
taatacgactcactatagggtggaaccgtctattttccaacatttgggataacagaggagaatcccaatggttggaaaaaacctggcggcagcgcaaaagatg

SEQ ID NO: 61507 - DNA, 103 bp, Artificial Sequence
  Synthetic Polynucleotide
taatacgactcactatagggatctttggaaccgtctattttccaacatttaacagaggagaaaatgtatgaaaatagacaacctggcggcagcgcaaaagatg

SEQ ID NO: 61508 - DNA, 103 bp, Artificial Sequence
  Synthetic Polynucleotide
taatacgactcactatagggtttggatctttggaaccgtctattttccaaaacagaggagattggaaatgagacggttcaacctggcggcagcgcaaaagatg

SEQ ID NO: 61509 - DNA, 103 bp, Artificial Sequence
  Synthetic Polynucleotide
taatacgactcactatagggtatgttttggatctttggaaccgtctatttaacagaggagaaaatagatggttccaaagaacctggcggcagcgcaaaagatg

SEQ ID NO: 61510 - DNA, 103 bp, Artificial Sequence
  Synthetic Polynucleotide
taatacgactcactatagggacctctatgttttggatctttggaaccgtcaacagaggagagacggtatgaaagatccaaacctggcggcagcgcaaaagatg

SEQ ID NO: 61511 - DNA, 103 bp, Artificial Sequence
  Synthetic Polynucleotide
taatacgactcactatagggcctctacctctatgttttggatctttggaaaacagaggagattccaaatgtccaaaacaaacctggcggcagcgcaaaagatg

SEQ ID NO: 61512 - DNA, 103 bp, Artificial Sequence
  Synthetic Polynucleotide
taatacgactcactatagggcgtatcctctacctctatgttttggatcttaacagaggagaaagatcatgaacatagagaacctggcggcagcgcaaaagatg

SEQ ID NO: 61513 - DNA, 103 bp, Artificial Sequence
  Synthetic Polynucleotide
taatacgactcactatagggaggagcgtatcctctacctctatgttttggaacagaggagaccaaaaatgagaggtagaaacctggcggcagcgcaaaagatg

SEQ ID NO: 61514 - DNA, 103 bp, Artificial Sequence
  Synthetic Polynucleotide
taatacgactcactatagggttcaagaatggaaagcgtgatattttctataacagaggagaatagaaatgatcacgcttaacctggcggcagcgcaaaagatg

SEQ ID NO: 61515 - DNA, 103 bp, Artificial Sequence
  Synthetic Polynucleotide
taatacgactcactatagggtgataaggagcgtatcctctacctctatgtaacagaggagaacatagatgtagaggataaacctggcggcagcgcaaaagatg

SEQ ID NO: 61516 - DNA, 103 bp, Artificial Sequence
  Synthetic Polynucleotide
taatacgactcactatagggtattttgataaggagcgtatcctctacctcaacagaggagagaggtaatggatacgctcaacctggcggcagcgcaaaagatg

SEQ ID NO: 61517 - DNA, 103 bp, Artificial Sequence
  Synthetic Polynucleotide
taatacgactcactatagggtttactattttgataaggagcgtatcctctaacagaggagaagaggaatggctccttataacctggcggcagcgcaaaagatg

SEQ ID NO: 61518 - DNA, 103 bp, Artificial Sequence
  Synthetic Polynucleotide
taatacgactcactataggggttactttactattttgataaggagcgtataacagaggagaatacgcatgttatcaaaaaacctggcggcagcgcaaaagatg

SEQ ID NO: 61519 - DNA, 103 bp, Artificial Sequence
  Synthetic Polynucleotide
taatacgactcactatagggttatcgttactttactattttgataaggagaacagaggagactccttatgaaaatagtaaacctggcggcagcgcaaaagatg

SEQ ID NO: 61520 - DNA, 103 bp, Artificial Sequence
  Synthetic Polynucleotide
taatacgactcactatagggactgattatcgttactttactattttgataaacagaggagatatcaaatgagtaaagtaaacctggcggcagcgcaaaagatg

SEQ ID NO: 61521 - DNA, 103 bp, Artificial Sequence
  Synthetic Polynucleotide
taatacgactcactatagggttatgactgattatcgttactttactatttaacagaggagaaaatagatgagtaacgataacctggcggcagcgcaaaagatg

SEQ ID NO: 61522 - DNA, 103 bp, Artificial Sequence
  Synthetic Polynucleotide
taatacgactcactatagggatttgttatgactgattatcgttactttacaacagaggagagtaaagatgcgataatcaaacctggcggcagcgcaaaagatg

SEQ ID NO: 61523 - DNA, 103 bp, Artificial Sequence
  Synthetic Polynucleotide
taatacgactcactatagggtatacatttgttatgactgattatcgttacaacagaggagagtaacgatgatcagtcataacctggcggcagcgcaaaagatg

SEQ ID NO: 61524 - DNA, 103 bp, Artificial Sequence
  Synthetic Polynucleotide
taatacgactcactataggggatagtatacatttgttatgactgattatcaacagaggagagataatatgtcataacaaaacctggcggcagcgcaaaagatg

SEQ ID NO: 61525 - DNA, 103 bp, Artificial Sequence
  Synthetic Polynucleotide
taatacgactcactatagggagtacttcaagaatggaaagcgtgatatttaacagaggagaaaatatatggctttccataacctggcggcagcgcaaaagatg

SEQ ID NO: 61526 - DNA, 103 bp, Artificial Sequence
  Synthetic Polynucleotide
taatacgactcactatagggtgttagatagtatacatttgttatgactgaaacagaggagatcagtcatgacaaatgtaaacctggcggcagcgcaaaagatg

SEQ ID NO: 61527 - DNA, 103 bp, Artificial Sequence
  Synthetic Polynucleotide
taatacgactcactataggggtttatgttagatagtatacatttgttatgaacagaggagacataacatgtgtatactaaacctggcggcagcgcaaaagatg

SEQ ID NO: 61528 - DNA, 103 bp, Artificial Sequence
  Synthetic Polynucleotide
taatacgactcactataggggatatgtttatgttagatagtatacatttgaacagaggagacaaatgatgactatctaaaacctggcggcagcgcaaaagatg

SEQ ID NO: 61529 - DNA, 103 bp, Artificial Sequence
  Synthetic Polynucleotide
taatacgactcactatagggcttttgatatgtttatgttagatagtatacaacagaggagagtatacatgctaacataaaacctggcggcagcgcaaaagatg

SEQ ID NO: 61530 - DNA, 103 bp, Artificial Sequence
  Synthetic Polynucleotide
taatacgactcactatagggtccttcttttgatatgtttatgttagatagaacagaggagactatctatgataaacataaacctggcggcagcgcaaaagatg

SEQ ID NO: 61531 - DNA, 103 bp, Artificial Sequence
  Synthetic Polynucleotide
taatacgactcactatagggttaattccttcttttgatatgtttatgttaaacagaggagataacatatgcatatcaaaaacctggcggcagcgcaaaagatg

SEQ ID NO: 61532 - DNA, 103 bp, Artificial Sequence
  Synthetic Polynucleotide
taatacgactcactatagggatcgtttaattccttcttttgatatgtttaaacagaggagataaacaatgcaaaagaagaacctggcggcagcgcaaaagatg

SEQ ID NO: 61533 - DNA, 103 bp, Artificial Sequence
  Synthetic Polynucleotide
taatacgactcactatagggtctccatcgtttaattccttcttttgatataacagaggagaatatcaatggaaggaattaacctggcggcagcgcaaaagatg

SEQ ID NO: 61534 - DNA, 103 bp, Artificial Sequence
  Synthetic Polynucleotide
taatacgactcactatagggaatcttctccatcgtttaattccttcttttaacagaggagaaaaagaatgaattaaacgaacctggcggcagcgcaaaagatg

SEQ ID NO: 61535 - DNA, 103 bp, Artificial Sequence
  Synthetic Polynucleotide
taatacgactcactatagggcgtcaaatcttctccatcgtttaattccttaacagaggagaaaggaaatgaacgatggaaacctggcggcagcgcaaaagatg

SEQ ID NO: 61536 - DNA, 103 bp, Artificial Sequence
  Synthetic Polynucleotide
taatacgactcactatagggcttatagtacttcaagaatggaaagcgtgaaacagaggagatcacgcatgccattcttgaacctggcggcagcgcaaaagatg

SEQ ID NO: 61537 - DNA, 103 bp, Artificial Sequence
  Synthetic Polynucleotide
taatacgactcactatagggtggtccgtcaaatcttctccatcgtttaataacagaggagaattaaaatgtggagaagaaacctggcggcagcgcaaaagatg

SEQ ID NO: 61538 - DNA, 103 bp, Artificial Sequence
  Synthetic Polynucleotide
taatacgactcactatagggccacatggtccgtcaaatcttctccatcgtaacagaggagaacgatgatgaagatttgaaacctggcggcagcgcaaaagatg

SEQ ID NO: 61539 - DNA, 103 bp, Artificial Sequence
  Synthetic Polynucleotide
taatacgactcactatagggcataaccacatggtccgtcaaatcttctccaacagaggagaggagaaatgttgacggacaacctggcggcagcgcaaaagatg

SEQ ID NO: 61540 - DNA, 103 bp, Artificial Sequence
  Synthetic Polynucleotide
taatacgactcactatagggtaaatcataaccacatggtccgtcaaatctaacagaggagaagatttatgggaccatgtaacctggcggcagcgcaaaagatg

SEQ ID NO: 61541 - DNA, 103 bp, Artificial Sequence
  Synthetic Polynucleotide
taatacgactcactatagggataaataaatcataaccacatggtccgtcaaacagaggagatgacggatgatgtggttaaacctggcggcagcgcaaaagatg

SEQ ID NO: 61542 - DNA, 103 bp, Artificial Sequence
  Synthetic Polynucleotide
taatacgactcactatagggcgtgtataaataaatcataaccacatggtcaacagaggagagaccatatggttatgattaacctggcggcagcgcaaaagatg

SEQ ID NO: 61543 - DNA, 103 bp, Artificial Sequence
  Synthetic Polynucleotide
taatacgactcactatagggtccgccgtgtataaataaatcataaccacaaacagaggagatgtggtatggatttatttaacctggcggcagcgcaaaagatg

SEQ ID NO: 61544 - DNA, 103 bp, Artificial Sequence
  Synthetic Polynucleotide
taatacgactcactatagggcgttatccgccgtgtataaataaatcataaaacagaggagattatgaatgatttatacaaacctggcggcagcgcaaaagatg

SEQ ID NO: 61545 - DNA, 103 bp, Artificial Sequence
  Synthetic Polynucleotide
taatacgactcactatagggaattacgttatccgccgtgtataaataaataacagaggagaatttatatgtacacggcgaacctggcggcagcgcaaaagatg

SEQ ID NO: 61546 - DNA, 103 bp, Artificial Sequence
  Synthetic Polynucleotide
taatacgactcactatagggtttggaattacgttatccgccgtgtataaaaacagaggagatttataatgggcggataaaacctggcggcagcgcaaaagatg

SEQ ID NO: 61547 - DNA, 103 bp, Artificial Sequence
  Synthetic Polynucleotide
taatacgactcactatagggaattacttatagtacttcaagaatggaaagaacagaggagactttccatgcttgaagtaaacctggcggcagcgcaaaagatg

SEQ ID NO: 61548 - DNA, 103 bp, Artificial Sequence
  Synthetic Polynucleotide
taatacgactcactatagggcatcttttggaattacgttatccgccgtgtaacagaggagaacacggatgataacgtaaaacctggcggcagcgcaaaagatg

SEQ ID NO: 61549 - DNA, 103 bp, Artificial Sequence
  Synthetic Polynucleotide
taatacgactcactatagggtaaaccatcttttggaattacgttatccgcaacagaggagagcggatatggtaattccaaacctggcggcagcgcaaaagatg

SEQ ID NO: 61550 - DNA, 103 bp, Artificial Sequence
  Synthetic Polynucleotide
taatacgactcactatagggccttgtaaaccatcttttggaattacgttaaacagaggagataacgtatgtccaaaagaaacctggcggcagcgcaaaagatg

SEQ ID NO: 61551 - DNA, 103 bp, Artificial Sequence
  Synthetic Polynucleotide
taatacgactcactatagggatgctccttgtaaaccatcttttggaattaaacagaggagataattcatgaagatggttaacctggcggcagcgcaaaagatg

SEQ ID NO: 61552 - DNA, 103 bp, Artificial Sequence
  Synthetic Polynucleotide
taatacgactcactataggggacaaatgctccttgtaaaccatcttttggaacagaggagaccaaaaatgggtttacaaaacctggcggcagcgcaaaagatg

SEQ ID NO: 61553 - DNA, 103 bp, Artificial Sequence
  Synthetic Polynucleotide
taatacgactcactatagggttatcgacaaatgctccttgtaaaccatctaacagaggagaagatggatgacaaggagcaacctggcggcagcgcaaaagatg

SEQ ID NO: 61554 - DNA, 103 bp, Artificial Sequence
  Synthetic Polynucleotide
taatacgactcactatagggcgtctttatcgacaaatgctccttgtaaacaacagaggagagtttacatggagcatttgaacctggcggcagcgcaaaagatg

SEQ ID NO: 61555 - DNA, 103 bp, Artificial Sequence
  Synthetic Polynucleotide
taatacgactcactatagggagtaccgtctttatcgacaaatgctccttgaacagaggagacaaggaatgtttgtcgataacctggcggcagcgcaaaagatg

SEQ ID NO: 61556 - DNA, 103 bp, Artificial Sequence
  Synthetic Polynucleotide
taatacgactcactatagggtcataagtaccgtctttatcgacaaatgctaacagaggagaagcattatgcgataaagaaacctggcggcagcgcaaaagatg

SEQ ID NO: 61557 - DNA, 103 bp, Artificial Sequence
  Synthetic Polynucleotide
taatacgactcactatagggctttgtcataagtaccgtctttatcgacaaaacagaggagattgtcgatgaagacggtaaacctggcggcagcgcaaaagatg

SEQ ID NO: 61558 - DNA, 103 bp, Artificial Sequence
  Synthetic Polynucleotide
taatacgactcactatagggactataattacttatagtacttcaagaatgaacagaggagacattctatgagtactataaacctggcggcagcgcaaaagatg

SEQ ID NO: 61559 - DNA, 103 bp, Artificial Sequence
  Synthetic Polynucleotide
taatacgactcactataggggtaaactttgtcataagtaccgtctttatcaacagaggagagataaaatgggtacttataacctggcggcagcgcaaaagatg

SEQ ID NO: 61560 - DNA, 103 bp, Artificial Sequence
  Synthetic Polynucleotide
taatacgactcactatagggagaatgtaaactttgtcataagtaccgtctaacagaggagaagacggatgttatgacaaaacctggcggcagcgcaaaagatg

SEQ ID NO: 61561 - DNA, 103 bp, Artificial Sequence
  Synthetic Polynucleotide
taatacgactcactatagggtgaaaagaatgtaaactttgtcataagtacaacagaggagagtacttatgacaaagtttaacctggcggcagcgcaaaagatg

SEQ ID NO: 61562 - DNA, 103 bp, Artificial Sequence
  Synthetic Polynucleotide
taatacgactcactatagggaacagtgaaaagaatgtaaactttgtcataaacagaggagatatgacatggtttacattaacctggcggcagcgcaaaagatg

SEQ ID NO: 61563 - DNA, 103 bp, Artificial Sequence
  Synthetic Polynucleotide
taatacgactcactatagggatagtaacagtgaaaagaatgtaaactttgaacagaggagacaaagtatgcattcttttaacctggcggcagcgcaaaagatg

SEQ ID NO: 61564 - DNA, 103 bp, Artificial Sequence
  Synthetic Polynucleotide
taatacgactcactatagggagccgatagtaacagtgaaaagaatgtaaaaacagaggagatttacaatgttttcactgaacctggcggcagcgcaaaagatg

SEQ ID NO: 61565 - DNA, 103 bp, Artificial Sequence
  Synthetic Polynucleotide
taatacgactcactatagggctttgagccgatagtaacagtgaaaagaataacagaggagaattcttatgactgttactaacctggcggcagcgcaaaagatg

SEQ ID NO: 61566 - DNA, 103 bp, Artificial Sequence
  Synthetic Polynucleotide
taatacgactcactatagggattctctttgagccgatagtaacagtgaaaaacagaggagatttcacatgtactatcggaacctggcggcagcgcaaaagatg

SEQ ID NO: 61567 - DNA, 103 bp, Artificial Sequence
  Synthetic Polynucleotide
taatacgactcactatagggtaacaattctctttgagccgatagtaacagaacagaggagactgttaatgtcggctcaaaacctggcggcagcgcaaaagatg

SEQ ID NO: 61568 - DNA, 103 bp, Artificial Sequence
  Synthetic Polynucleotide
taatacgactcactatagggaattttaacaattctctttgagccgatagtaacagaggagaactatcatgtcaaagagaaacctggcggcagcgcaaaagatg

SEQ ID NO: 61569 - DNA, 103 bp, Artificial Sequence
  Synthetic Polynucleotide
taatacgactcactatagggcgaacatggatcctaatcttatagataggtaacagaggagaacctatatgtaagattagaacctggcggcagcgcaaaagatg

SEQ ID NO: 61570 - DNA, 103 bp, Artificial Sequence
  Synthetic Polynucleotide
taatacgactcactatagggattatactataattacttatagtacttcaaaacagaggagattgaagatgtataagtaaaacctggcggcagcgcaaaagatg

SEQ ID NO: 61571 - DNA, 103 bp, Artificial Sequence
  Synthetic Polynucleotide
taatacgactcactatagggtacggaattttaacaattctctttgagccgaacagaggagacggctcatggagaattgtaacctggcggcagcgcaaaagatg

SEQ ID NO: 61572 - DNA, 103 bp, Artificial Sequence
  Synthetic Polynucleotide
taatacgactcactatagggctatatacggaattttaacaattctctttgaacagaggagacaaagaatgttgttaaaaaacctggcggcagcgcaaaagatg

SEQ ID NO: 61573 - DNA, 103 bp, Artificial Sequence
  Synthetic Polynucleotide
taatacgactcactatagggttgtgctatatacggaattttaacaattctaacagaggagaagaattatgaaaattccgaacctggcggcagcgcaaaagatg

SEQ ID NO: 61574 - DNA, 103 bp, Artificial Sequence
  Synthetic Polynucleotide
taatacgactcactatagggcacatttgtgctatatacggaattttaacaaacagaggagatgttaaatgtccgtatataacctggcggcagcgcaaaagatg

SEQ ID NO: 61575 - DNA, 103 bp, Artificial Sequence
  Synthetic Polynucleotide
taatacgactcactatagggttaagcacatttgtgctatatacggaatttaacagaggagaaaattcatgatatagcacaacctggcggcagcgcaaaagatg

SEQ ID NO: 61576 - DNA, 103 bp, Artificial Sequence
  Synthetic Polynucleotide
taatacgactcactataggggtcgtttaagcacatttgtgctatatacggaacagaggagaccgtatatggcacaaatgaacctggcggcagcgcaaaagatg

SEQ ID NO: 61577 - DNA, 103 bp, Artificial Sequence
  Synthetic Polynucleotide
taatacgactcactatagggcattcgtcgtttaagcacatttgtgctataaacagaggagatatagcatgaatgtgcttaacctggcggcagcgcaaaagatg

SEQ ID NO: 61578 - DNA, 103 bp, Artificial Sequence
  Synthetic Polynucleotide
taatacgactcactataggggaccacattcgtcgtttaagcacatttgtgaacagaggagacacaaaatggcttaaacgaacctggcggcagcgcaaaagatg

SEQ ID NO: 61579 - DNA, 103 bp, Artificial Sequence
  Synthetic Polynucleotide
taatacgactcactatagggtgatggaccacattcgtcgtttaagcacataacagaggagaatgtgcatgaacgacgaaaacctggcggcagcgcaaaagatg

SEQ ID NO: 61580 - DNA, 103 bp, Artificial Sequence
  Synthetic Polynucleotide
taatacgactcactatagggaatgatgatggaccacattcgtcgtttaagaacagaggagacttaaaatgcgaatgtggaacctggcggcagcgcaaaagatg

SEQ ID NO: 61581 - DNA, 103 bp, Artificial Sequence
  Synthetic Polynucleotide
taatacgactcactataggggttacattatactataattacttatagtacaacagaggagagtactaatggtaattataaacctggcggcagcgcaaaagatg

SEQ ID NO: 61582 - DNA, 103 bp, Artificial Sequence
  Synthetic Polynucleotide
taatacgactcactatagggtagacaatgatgatggaccacattcgtcgtaacagaggagaacgacgatggtggtccataacctggcggcagcgcaaaagatg

SEQ ID NO: 61583 - DNA, 103 bp, Artificial Sequence
  Synthetic Polynucleotide
taatacgactcactatagggatgactagacaatgatgatggaccacattcaacagaggagagaatgtatgccatcatcaaacctggcggcagcgcaaaagatg

SEQ ID NO: 61584 - DNA, 103 bp, Artificial Sequence
  Synthetic Polynucleotide
taatacgactcactatagggcatctatgactagacaatgatgatggaccaaacagaggagatggtccatgatcattgtcaacctggcggcagcgcaaaagatg

SEQ ID NO: 61585 - DNA, 103 bp, Artificial Sequence
  Synthetic Polynucleotide
taatacgactcactatagggtcgaccatctatgactagacaatgatgatgaacagaggagacatcatatgtgtctagtcaacctggcggcagcgcaaaagatg

SEQ ID NO: 61586 - DNA, 103 bp, Artificial Sequence
  Synthetic Polynucleotide
taatacgactcactatagggcaacgtcgaccatctatgactagacaatgaaacagaggagatcattgatgagtcatagaaacctggcggcagcgcaaaagatg

SEQ ID NO: 61587 - DNA, 103 bp, Artificial Sequence
  Synthetic Polynucleotide
taatacgactcactatagggttgagcaacgtcgaccatctatgactagacaacagaggagagtctagatgtagatggtcaacctggcggcagcgcaaaagatg

SEQ ID NO: 61588 - DNA, 103 bp, Artificial Sequence
  Synthetic Polynucleotide
taatacgactcactatagggcgactttgagcaacgtcgaccatctatgacaacagaggagagtcataatgggtcgacgtaacctggcggcagcgcaaaagatg

SEQ ID NO: 61589 - DNA, 103 bp, Artificial Sequence
  Synthetic Polynucleotide
taatacgactcactatagggtaattcgactttgagcaacgtcgaccatctaacagaggagaagatggatgacgttgctcaacctggcggcagcgcaaaagatg

SEQ ID NO: 61590 - DNA, 103 bp, Artificial Sequence
  Synthetic Polynucleotide
taatacgactcactatagggcattctaattcgactttgagcaacgtcgacaacagaggagagtcgacatggctcaaagtaacctggcggcagcgcaaaagatg

SEQ ID NO: 61591 - DNA, 103 bp, Artificial Sequence
  Synthetic Polynucleotide
taatacgactcactatagggtgtcacattctaattcgactttgagcaacgaacagaggagacgttgcatgaagtcgaataacctggcggcagcgcaaaagatg

SEQ ID NO: 61592 - DNA, 103 bp, Artificial Sequence
  Synthetic Polynucleotide
taatacgactcactatagggtaaacgttacattatactataattacttataacagaggagaataagtatgtatagtataaacctggcggcagcgcaaaagatg

SEQ ID NO: 61593 - DNA, 103 bp, Artificial Sequence
  Synthetic Polynucleotide
taatacgactcactataggggtcgatgtcacattctaattcgactttgagaacagaggagactcaaaatggaattagaaaacctggcggcagcgcaaaagatg

SEQ ID NO: 61594 - DNA, 103 bp, Artificial Sequence
  Synthetic Polynucleotide
taatacgactcactatagggcttccgtcgatgtcacattctaattcgactaacagaggagaagtcgaatgagaatgtgaaacctggcggcagcgcaaaagatg

SEQ ID NO: 61595 - DNA, 103 bp, Artificial Sequence
  Synthetic Polynucleotide
taatacgactcactatagggaacttcttccgtcgatgtcacattctaattaacagaggagaaattagatggtgacatcgaacctggcggcagcgcaaaagatg

SEQ ID NO: 61596 - DNA, 103 bp, Artificial Sequence
  Synthetic Polynucleotide
taatacgactcactatagggactataacttcttccgtcgatgtcacattcaacagaggagagaatgtatgatcgacggaaacctggcggcagcgcaaaagatg

SEQ ID NO: 61597 - DNA, 103 bp, Artificial Sequence
  Synthetic Polynucleotide
taatacgactcactatagggatttgactataacttcttccgtcgatgtcaaacagaggagatgacatatgcggaagaagaacctggcggcagcgcaaaagatg

SEQ ID NO: 61598 - DNA, 103 bp, Artificial Sequence
  Synthetic Polynucleotide
taatacgactcactataggggattaatttgactataacttcttccgtcgaaacagaggagatcgacgatggaagttataaacctggcggcagcgcaaaagatg

SEQ ID NO: 61599 - DNA, 103 bp, Artificial Sequence
  Synthetic Polynucleotide
taatacgactcactatagggagaatgattaatttgactataacttcttccaacagaggagaggaagaatgtatagtcaaaacctggcggcagcgcaaaagatg

SEQ ID NO: 61600 - DNA, 103 bp, Artificial Sequence
  Synthetic Polynucleotide
taatacgactcactataggggttttagaatgattaatttgactataacttaacagaggagaaagttaatgtcaaattaaaacctggcggcagcgcaaaagatg

SEQ ID NO: 61601 - DNA, 103 bp, Artificial Sequence
  Synthetic Polynucleotide
taatacgactcactatagggttatagttttagaatgattaatttgactataacagaggagaatagtcatgttaatcattaacctggcggcagcgcaaaagatg

SEQ ID NO: 61602 - DNA, 103 bp, Artificial Sequence
  Synthetic Polynucleotide
taatacgactcactatagggctgttttatagttttagaatgattaatttgaacagaggagacaaattatgcattctaaaaacctggcggcagcgcaaaagatg

SEQ ID NO: 61603 - DNA, 103 bp, Artificial Sequence
  Synthetic Polynucleotide
taatacgactcactatagggatatataaacgttacattatactataattaaacagaggagataattaatgtataatgtaaacctggcggcagcgcaaaagatg

SEQ ID NO: 61604 - DNA, 103 bp, Artificial Sequence
  Synthetic Polynucleotide
taatacgactcactatagggattatctgttttatagttttagaatgattaaacagaggagataatcaatgtaaaactataacctggcggcagcgcaaaagatg

SEQ ID NO: 61605 - DNA, 103 bp, Artificial Sequence
  Synthetic Polynucleotide
taatacgactcactataggggtatcattatctgttttatagttttagaataacagaggagaattctaatgctataaaacaacctggcggcagcgcaaaagatg

SEQ ID NO: 61606 - DNA, 103 bp, Artificial Sequence
  Synthetic Polynucleotide
taatacgactcactataggggtatcgtatcattatctgttttatagttttaacagaggagaaaaactatgaaacagataaacctggcggcagcgcaaaagatg

SEQ ID NO: 61607 - DNA, 103 bp, Artificial Sequence
  Synthetic Polynucleotide
taatacgactcactatagggatatagtatcgtatcattatctgttttataaacagaggagatataaaatggataatgataacctggcggcagcgcaaaagatg

SEQ ID NO: 61608 - DNA, 103 bp, Artificial Sequence
  Synthetic Polynucleotide
taatacgactcactatagggaatacatatagtatcgtatcattatctgttaacagaggagaaacagaatgtgatacgataacctggcggcagcgcaaaagatg

SEQ ID NO: 61609 - DNA, 103 bp, Artificial Sequence
  Synthetic Polynucleotide
taatacgactcactatagggcaaagaatacatatagtatcgtatcattataacagaggagaataatgatgcgatactataacctggcggcagcgcaaaagatg

SEQ ID NO: 61610 - DNA, 103 bp, Artificial Sequence
  Synthetic Polynucleotide
taatacgactcactatagggactatcaaagaatacatatagtatcgtatcaacagaggagagatacgatgctatatgtaaacctggcggcagcgcaaaagatg

SEQ ID NO: 61611 - DNA, 103 bp, Artificial Sequence
  Synthetic Polynucleotide
taatacgactcactatagggaaaggactatcaaagaatacatatagtatcaacagaggagagatactatgtgtattcttaacctggcggcagcgcaaaagatg

SEQ ID NO: 61612 - DNA, 103 bp, Artificial Sequence
  Synthetic Polynucleotide
taatacgactcactatagggttggaaaaggactatcaaagaatacatataaacagaggagatatatgatgtctttgataaacctggcggcagcgcaaaagatg

SEQ ID NO: 61613 - DNA, 103 bp, Artificial Sequence
  Synthetic Polynucleotide
taatacgactcactatagggcggacttggaaaaggactatcaaagaatacaacagaggagagtattcatggatagtcctaacctggcggcagcgcaaaagatg

SEQ ID NO: 61614 - DNA, 103 bp, Artificial Sequence
  Synthetic Polynucleotide
taatacgactcactatagggattgaatatataaacgttacattatactataacagaggagaatagtaatgtgtaacgttaacctggcggcagcgcaaaagatg

SEQ ID NO: 61615 - DNA, 103 bp, Artificial Sequence
  Synthetic Polynucleotide
taatacgactcactatagggtaatgcggacttggaaaaggactatcaaagaacagaggagactttgaatgtccttttccaacctggcggcagcgcaaaagatg

SEQ ID NO: 61616 - DNA, 103 bp, Artificial Sequence
  Synthetic Polynucleotide
taatacgactcactataggggtacataatgcggacttggaaaaggactataacagaggagaatagtcatgttccaagtcaacctggcggcagcgcaaaagatg

SEQ ID NO: 61617 - DNA, 103 bp, Artificial Sequence
  Synthetic Polynucleotide
taatacgactcactatagggaataggtacataatgcggacttggaaaaggaacagaggagaccttttatgagtccgcataacctggcggcagcgcaaaagatg

SEQ ID NO: 61618 - DNA, 103 bp, Artificial Sequence
  Synthetic Polynucleotide
taatacgactcactatagggcatagaataggtacataatgcggacttggaaacagaggagatccaagatggcattatgtaacctggcggcagcgcaaaagatg

SEQ ID NO: 61619 - DNA, 103 bp, Artificial Sequence
  Synthetic Polynucleotide
taatacgactcactataggggtattcatagaataggtacataatgcggacaacagaggagagtccgcatgatgtacctaaacctggcggcagcgcaaaagatg

SEQ ID NO: 61620 - DNA, 103 bp, Artificial Sequence
  Synthetic Polynucleotide
taatacgactcactatagggtaatggtattcatagaataggtacataatgaacagaggagacattatatgcctattctaaacctggcggcagcgcaaaagatg

SEQ ID NO: 61621 - DNA, 103 bp, Artificial Sequence
  Synthetic Polynucleotide
taatacgactcactatagggttgtttaatggtattcatagaataggtacaaacagaggagatgtaccatgtctatgaataacctggcggcagcgcaaaagatg

SEQ ID NO: 61622 - DNA, 103 bp, Artificial Sequence
  Synthetic Polynucleotide
taatacgactcactatagggaaagattgtttaatggtattcatagaatagaacagaggagactattcatggaataccataacctggcggcagcgcaaaagatg

SEQ ID NO: 61623 - DNA, 103 bp, Artificial Sequence
  Synthetic Polynucleotide
taatacgactcactatagggtagaaaaagattgtttaatggtattcatagaacagaggagactatgaatgccattaaacaacctggcggcagcgcaaaagatg

SEQ ID NO: 61624 - DNA, 103 bp, Artificial Sequence
  Synthetic Polynucleotide
taatacgactcactatagggtgacgtagaaaaagattgtttaatggtattaacagaggagaaataccatgaaacaatctaacctggcggcagcgcaaaagatg

SEQ ID NO: 61625 - DNA, 103 bp, Artificial Sequence
  Synthetic Polynucleotide
taatacgactcactatagggaaaatattgaatatataaacgttacattataacagaggagaataatgatgcgtttatataacctggcggcagcgcaaaagatg

SEQ ID NO: 61626 - DNA, 103 bp, Artificial Sequence
  Synthetic Polynucleotide
taatacgactcactatagggcaatttgacgtagaaaaagattgtttaatgaacagaggagacattaaatgatctttttcaacctggcggcagcgcaaaagatg

SEQ ID NO: 61627 - DNA, 103 bp, Artificial Sequence
  Synthetic Polynucleotide
taatacgactcactatagggcctcccaatttgacgtagaaaaagattgttaacagaggagaaacaatatgtttctacgtaacctggcggcagcgcaaaagatg

SEQ ID NO: 61628 - DNA, 103 bp, Artificial Sequence
  Synthetic Polynucleotide
taatacgactcactatagggtatatcctcccaatttgacgtagaaaaagaaacagaggagatcttttatgacgtcaaataacctggcggcagcgcaaaagatg

SEQ ID NO: 61629 - DNA, 103 bp, Artificial Sequence
  Synthetic Polynucleotide
taatacgactcactatagggctttgtatatcctcccaatttgacgtagaaaacagaggagattctacatgaaattgggaaacctggcggcagcgcaaaagatg

SEQ ID NO: 61630 - DNA, 103 bp, Artificial Sequence
  Synthetic Polynucleotide
taatacgactcactatagggaattgctttgtatatcctcccaatttgacgaacagaggagacgtcaaatggggaggataaacctggcggcagcgcaaaagatg

SEQ ID NO: 61631 - DNA, 103 bp, Artificial Sequence
  Synthetic Polynucleotide
taatacgactcactatagggacagtaattgctttgtatatcctcccaattaacagaggagaaattggatggatatacaaaacctggcggcagcgcaaaagatg

SEQ ID NO: 61632 - DNA, 103 bp, Artificial Sequence
  Synthetic Polynucleotide
taatacgactcactatagggtggagacagtaattgctttgtatatcctccaacagaggagaggaggaatgacaaagcaaaacctggcggcagcgcaaaagatg

SEQ ID NO: 61633 - DNA, 103 bp, Artificial Sequence
  Synthetic Polynucleotide
taatacgactcactatagggaaagctggagacagtaattgctttgtatataacagaggagaatatacatggcaattactaacctggcggcagcgcaaaagatg

SEQ ID NO: 61634 - DNA, 103 bp, Artificial Sequence
  Synthetic Polynucleotide
taatacgactcactatagggtaccaaaagctggagacagtaattgctttgaacagaggagacaaagcatgtactgtctcaacctggcggcagcgcaaaagatg

SEQ ID NO: 61635 - DNA, 103 bp, Artificial Sequence
  Synthetic Polynucleotide
taatacgactcactatagggacatataccaaaagctggagacagtaattgaacagaggagacaattaatgtctccagctaacctggcggcagcgcaaaagatg

SEQ ID NO: 61636 - DNA, 103 bp, Artificial Sequence
  Synthetic Polynucleotide
taatacgactcactatagggtataaaaaatattgaatatataaacgttacaacagaggagagtaacgatgatatattcaaacctggcggcagcgcaaaagatg

SEQ ID NO: 61637 - DNA, 103 bp, Artificial Sequence
  Synthetic Polynucleotide
taatacgactcactatagggggtagacatataccaaaagctggagacagtaacagaggagaactgtcatgagcttttggaacctggcggcagcgcaaaagatg

SEQ ID NO: 61638 - DNA, 103 bp, Artificial Sequence
  Synthetic Polynucleotide
taatacgactcactatagggcagctggtagacatataccaaaagctggagaacagaggagactccagatgttggtatataacctggcggcagcgcaaaagatg

SEQ ID NO: 61639 - DNA, 103 bp, Artificial Sequence
  Synthetic Polynucleotide
taatacgactcactatagggttttccagctggtagacatataccaaaagcaacagaggagagcttttatgatatgtctaaacctggcggcagcgcaaaagatg

SEQ ID NO: 61640 - DNA, 103 bp, Artificial Sequence
  Synthetic Polynucleotide
taatacgactcactatagggcaactttttccagctggtagacatataccaaacagaggagatggtatatgtctaccagcaacctggcggcagcgcaaaagatg

SEQ ID NO: 61641 - DNA, 103 bp, Artificial Sequence
  Synthetic Polynucleotide
taatacgactcactatagggtggaacaactttttccagctggtagacataaacagaggagatatgtcatgcagctggaaaacctggcggcagcgcaaaagatg

SEQ ID NO: 61642 - DNA, 103 bp, Artificial Sequence
  Synthetic Polynucleotide
taatacgactcactatagggttatgtggaacaactttttccagctggtagaacagaggagactaccaatgggaaaaagtaacctggcggcagcgcaaaagatg

SEQ ID NO: 61643 - DNA, 103 bp, Artificial Sequence
  Synthetic Polynucleotide
taatacgactcactatagggacgtgttatgtggaacaactttttccagctaacagaggagaagctggatgaagttgttcaacctggcggcagcgcaaaagatg

SEQ ID NO: 61644 - DNA, 103 bp, Artificial Sequence
  Synthetic Polynucleotide
taatacgactcactataggggtcaaacgtgttatgtggaacaactttttcaacagaggagagaaaaaatggttccacataacctggcggcagcgcaaaagatg

SEQ ID NO: 61645 - DNA, 103 bp, Artificial Sequence
  Synthetic Polynucleotide
taatacgactcactatagggataacgtcaaacgtgttatgtggaacaactaacagaggagaagttgtatgacataacacaacctggcggcagcgcaaaagatg

SEQ ID NO: 61646 - DNA, 103 bp, Artificial Sequence
  Synthetic Polynucleotide
taatacgactcactataggggttctataacgtcaaacgtgttatgtggaaaacagaggagattccacatgacacgtttgaacctggcggcagcgcaaaagatg

SEQ ID NO: 61647 - DNA, 103 bp, Artificial Sequence
  Synthetic Polynucleotide
taatacgactcactatagggttttttataaaaaatattgaatatataaacaacagaggagagtttatatgttcaatattaacctggcggcagcgcaaaagatg

SEQ ID NO: 61648 - DNA, 103 bp, Artificial Sequence
  Synthetic Polynucleotide
taatacgactcactatagggatattgttctataacgtcaaacgtgttatgaacagaggagacataacatgtttgacgttaacctggcggcagcgcaaaagatg

SEQ ID NO: 61649 - DNA, 103 bp, Artificial Sequence
  Synthetic Polynucleotide
taatacgactcactatagggacattatattgttctataacgtcaaacgtgaacagaggagacacgttatgcgttatagaaacctggcggcagcgcaaaagatg

SEQ ID NO: 61650 - DNA, 103 bp, Artificial Sequence
  Synthetic Polynucleotide
taatacgactcactatagggctagtacattatattgttctataacgtcaaaacagaggagattgacgatgtagaacaataacctggcggcagcgcaaaagatg

SEQ ID NO: 61651 - DNA, 103 bp, Artificial Sequence
  Synthetic Polynucleotide
taatacgactcactatagggattatctagtacattatattgttctataacaacagaggagagttataatgcaatataataacctggcggcagcgcaaaagatg

SEQ ID NO: 61652 - DNA, 103 bp, Artificial Sequence
  Synthetic Polynucleotide
taatacgactcactatagggataatattatctagtacattatattgttctaacagaggagaagaacaatgtaatgtactaacctggcggcagcgcaaaagatg

SEQ ID NO: 61653 - DNA, 103 bp, Artificial Sequence
  Synthetic Polynucleotide
taatacgactcactataggggctttataatattatctagtacattatattaacagaggagaaatataatgtactagataaacctggcggcagcgcaaaagatg

SEQ ID NO: 61654 - DNA, 103 bp, Artificial Sequence
  Synthetic Polynucleotide
taatacgactcactatagggtaaaggctttataatattatctagtacattaacagaggagaaatgtaatggataatattaacctggcggcagcgcaaaagatg

SEQ ID NO: 61655 - DNA, 103 bp, Artificial Sequence
  Synthetic Polynucleotide
taatacgactcactatagggttaaataaaggctttataatattatctagtaacagaggagaactagaatgtattataaaaacctggcggcagcgcaaaagatg

SEQ ID NO: 61656 - DNA, 103 bp, Artificial Sequence
  Synthetic Polynucleotide
taatacgactcactataggggttggttaaataaaggctttataatattataacagaggagaataataatgtaaagccttaacctggcggcagcgcaaaagatg

SEQ ID NO: 61657 - DNA, 103 bp, Artificial Sequence
  Synthetic Polynucleotide
taatacgactcactataggggataggttggttaaataaaggctttataataacagaggagaattataatgcctttatttaacctggcggcagcgcaaaagatg

SEQ ID NO: 61658 - DNA, 103 bp, Artificial Sequence
  Synthetic Polynucleotide
taatacgactcactatagggatgatttttttataaaaaatattgaatataaacagaggagatatattatgtattttttaaacctggcggcagcgcaaaagatg

SEQ ID NO: 61659 - DNA, 103 bp, Artificial Sequence
  Synthetic Polynucleotide
taatacgactcactatagggttgaagataggttggttaaataaaggctttaacagaggagaaaagccatgatttaaccaaacctggcggcagcgcaaaagatg

SEQ ID NO: 61660 - DNA, 103 bp, Artificial Sequence
  Synthetic Polynucleotide
taatacgactcactataggggtcctttgaagataggttggttaaataaagaacagaggagactttatatgaccaacctaaacctggcggcagcgcaaaagatg

SEQ ID NO: 61661 - DNA, 103 bp, Artificial Sequence
  Synthetic Polynucleotide
taatacgactcactatagggagacggtcctttgaagataggttggttaaaaacagaggagatttaacatgcctatcttcaacctggcggcagcgcaaaagatg

SEQ ID NO: 61662 - DNA, 103 bp, Artificial Sequence
  Synthetic Polynucleotide
taatacgactcactatagggacatcagacggtcctttgaagataggttggaacagaggagaccaaccatgcttcaaaggaacctggcggcagcgcaaaagatg

SEQ ID NO: 61663 - DNA, 103 bp, Artificial Sequence
  Synthetic Polynucleotide
taatacgactcactatagggatttaacatcagacggtcctttgaagatagaacagaggagactatctatgaaggaccgtaacctggcggcagcgcaaaagatg

SEQ ID NO: 61664 - DNA, 103 bp, Artificial Sequence
  Synthetic Polynucleotide
taatacgactcactataggggaaccatttaacatcagacggtcctttgaaaacagaggagattcaaaatgccgtctgataacctggcggcagcgcaaaagatg

SEQ ID NO: 61665 - DNA, 103 bp, Artificial Sequence
  Synthetic Polynucleotide
taatacgactcactatagggatatcgaaccatttaacatcagacggtcctaacagaggagaaggaccatgtgatgttaaaacctggcggcagcgcaaaagatg

SEQ ID NO: 61666 - DNA, 103 bp, Artificial Sequence
  Synthetic Polynucleotide
taatacgactcactatagggcctttatatcgaaccatttaacatcagacgaacagaggagacgtctgatgttaaatggtaacctggcggcagcgcaaaagatg

SEQ ID NO: 61667 - DNA, 103 bp, Artificial Sequence
  Synthetic Polynucleotide
taatacgactcactatagggcttctcctttatatcgaaccatttaacatcaacagaggagagatgttatgtggttcgataacctggcggcagcgcaaaagatg

SEQ ID NO: 61668 - DNA, 103 bp, Artificial Sequence
  Synthetic Polynucleotide
taatacgactcactatagggttttccttctcctttatatcgaaccatttaaacagaggagataaatgatgcgatataaaaacctggcggcagcgcaaaagatg

SEQ ID NO: 61669 - DNA, 103 bp, Artificial Sequence
  Synthetic Polynucleotide
taatacgactcactatagggtcgaaatgatttttttataaaaaatattgaaacagaggagatcaataatgtttataaaaaacctggcggcagcgcaaaagatg

SEQ ID NO: 61670 - DNA, 103 bp, Artificial Sequence
  Synthetic Polynucleotide
taatacgactcactataggggttcattttccttctcctttatatcgaaccaacagaggagaggttcgatgtaaaggagaaacctggcggcagcgcaaaagatg

SEQ ID NO: 61671 - DNA, 103 bp, Artificial Sequence
  Synthetic Polynucleotide
taatacgactcactatagggccgatgttcattttccttctcctttatatcaacagaggagagatataatggagaaggaaaacctggcggcagcgcaaaagatg

SEQ ID NO: 61672 - DNA, 103 bp, Artificial Sequence
  Synthetic Polynucleotide
taatacgactcactatagggtatttccgatgttcattttccttctcctttaacagaggagaaaaggaatgggaaaatgaaacctggcggcagcgcaaaagatg

SEQ ID NO: 61673 - DNA, 103 bp, Artificial Sequence
  Synthetic Polynucleotide
taatacgactcactatagggttctatatttccgatgttcattttccttctaacagaggagaagaaggatgatgaacatcaacctggcggcagcgcaaaagatg

SEQ ID NO: 61674 - DNA, 103 bp, Artificial Sequence
  Synthetic Polynucleotide
taatacgactcactataggggtatattctatatttccgatgttcattttcaacagaggagagaaaatatgcatcggaaaaacctggcggcagcgcaaaagatg

SEQ ID NO: 61675 - DNA, 103 bp, Artificial Sequence
  Synthetic Polynucleotide
taatacgactcactatagggatgaagtatattctatatttccgatgttcaaacagaggagatgaacaatggaaatatagaacctggcggcagcgcaaaagatg

SEQ ID NO: 61676 - DNA, 103 bp, Artificial Sequence
  Synthetic Polynucleotide
taatacgactcactatagggcttttatgaagtatattctatatttccgataacagaggagaatcggaatgatagaatataacctggcggcagcgcaaaagatg

SEQ ID NO: 61677 - DNA, 103 bp, Artificial Sequence
  Synthetic Polynucleotide
taatacgactcactatagggattttcttttatgaagtatattctatatttaacagaggagaaaatatatgatatacttcaacctggcggcagcgcaaaagatg

SEQ ID NO: 61678 - DNA, 103 bp, Artificial Sequence
  Synthetic Polynucleotide
taatacgactcactatagggatagtattttcttttatgaagtatattctaaacagaggagatagaatatgcttcataaaaacctggcggcagcgcaaaagatg

SEQ ID NO: 61679 - DNA, 103 bp, Artificial Sequence
  Synthetic Polynucleotide
taatacgactcactatagggaatatatagtattttcttttatgaagtataaacagaggagatatactatgtaaaagaaaaacctggcggcagcgcaaaagatg

SEQ ID NO: 61680 - DNA, 103 bp, Artificial Sequence
  Synthetic Polynucleotide
taatacgactcactatagggatgctcgaacatggatcctaatcttatagaaacagaggagatctataatgttaggatccaacctggcggcagcgcaaaagatg

SEQ ID NO: 61681 - DNA, 103 bp, Artificial Sequence
  Synthetic Polynucleotide
taatacgactcactatagggtaatgtcgaaatgatttttttataaaaaataacagaggagaatttttatgaaaaaaatcaacctggcggcagcgcaaaagatg

SEQ ID NO: 61682 - DNA, 103 bp, Artificial Sequence
  Synthetic Polynucleotide
taatacgactcactataggggaacgaatatatagtattttcttttatgaaaacagaggagattcataatggaaaatactaacctggcggcagcgcaaaagatg

SEQ ID NO: 61683 - DNA, 103 bp, Artificial Sequence
  Synthetic Polynucleotide
taatacgactcactataggggtattgaacgaatatatagtattttcttttaacagaggagaaaaagaatgtactatataaacctggcggcagcgcaaaagatg

SEQ ID NO: 61684 - DNA, 103 bp, Artificial Sequence
  Synthetic Polynucleotide
taatacgactcactatagggattttgtattgaacgaatatatagtattttaacagaggagaaaaataatgtatattcgtaacctggcggcagcgcaaaagatg

SEQ ID NO: 61685 - DNA, 103 bp, Artificial Sequence
  Synthetic Polynucleotide
taatacgactcactatagggtttagattttgtattgaacgaatatatagtaacagaggagaactataatgtcgttcaataacctggcggcagcgcaaaagatg

SEQ ID NO: 61686 - DNA, 103 bp, Artificial Sequence
  Synthetic Polynucleotide
taatacgactcactataggggtttgtttagattttgtattgaacgaatataacagaggagaatattcatgcaatacaaaaacctggcggcagcgcaaaagatg

SEQ ID NO: 61687 - DNA, 103 bp, Artificial Sequence
  Synthetic Polynucleotide
taatacgactcactatagggtacgagtttgtttagattttgtattgaacgaacagaggagacgttcaatgcaaaatctaaacctggcggcagcgcaaaagatg

SEQ ID NO: 61688 - DNA, 103 bp, Artificial Sequence
  Synthetic Polynucleotide
taatacgactcactatagggcgagctacgagtttgtttagattttgtattaacagaggagaaatacaatgtctaaacaaaacctggcggcagcgcaaaagatg

SEQ ID NO: 61689 - DNA, 103 bp, Artificial Sequence
  Synthetic Polynucleotide
taatacgactcactatagggacttgcgagctacgagtttgtttagattttaacagaggagaaaaatcatgacaaactcgaacctggcggcagcgcaaaagatg

SEQ ID NO: 61690 - DNA, 103 bp, Artificial Sequence
  Synthetic Polynucleotide
taatacgactcactatagggcatcgacttgcgagctacgagtttgtttagaacagaggagactaaacatgctcgtagctaacctggcggcagcgcaaaagatg

SEQ ID NO: 61691 - DNA, 103 bp, Artificial Sequence
  Synthetic Polynucleotide
taatacgactcactatagggttgcgcatcgacttgcgagctacgagtttgaacagaggagacaaactatgagctcgcaaaacctggcggcagcgcaaaagatg

SEQ ID NO: 61692 - DNA, 103 bp, Artificial Sequence
  Synthetic Polynucleotide
taatacgactcactatagggggaattaatgtcgaaatgatttttttataaaacagaggagattataaatgaatcatttcaacctggcggcagcgcaaaagatg

SEQ ID NO: 61693 - DNA, 103 bp, Artificial Sequence
  Synthetic Polynucleotide
taatacgactcactatagggaatagttgcgcatcgacttgcgagctacgaaacagaggagatcgtagatggcaagtcgaaacctggcggcagcgcaaaagatg

SEQ ID NO: 61694 - DNA, 103 bp, Artificial Sequence
  Synthetic Polynucleotide
taatacgactcactatagggctgaaaatagttgcgcatcgacttgcgagcaacagaggagagctcgcatgtcgatgcgcaacctggcggcagcgcaaaagatg

SEQ ID NO: 61695 - DNA, 103 bp, Artificial Sequence
  Synthetic Polynucleotide
taatacgactcactatagggcattactgaaaatagttgcgcatcgacttgaacagaggagacaagtcatggcgcaactaaacctggcggcagcgcaaaagatg

SEQ ID NO: 61696 - DNA, 103 bp, Artificial Sequence
  Synthetic Polynucleotide
taatacgactcactataggggttaccattactgaaaatagttgcgcatcgaacagaggagacgatgcatgactattttcaacctggcggcagcgcaaaagatg

SEQ ID NO: 61697 - DNA, 103 bp, Artificial Sequence
  Synthetic Polynucleotide
taatacgactcactatagggtcgaagttaccattactgaaaatagttgcgaacagaggagacgcaacatgtttcagtaaaacctggcggcagcgcaaaagatg

SEQ ID NO: 61698 - DNA, 103 bp, Artificial Sequence
  Synthetic Polynucleotide
taatacgactcactatagggcggtttcgaagttaccattactgaaaatagaacagaggagactatttatggtaatggtaaacctggcggcagcgcaaaagatg

SEQ ID NO: 61699 - DNA, 103 bp, Artificial Sequence
  Synthetic Polynucleotide
taatacgactcactatagggaataacggtttcgaagttaccattactgaaaacagaggagattcagtatgggtaacttcaacctggcggcagcgcaaaagatg

SEQ ID NO: 61700 - DNA, 103 bp, Artificial Sequence
  Synthetic Polynucleotide
taatacgactcactatagggctataaataacggtttcgaagttaccattaaacagaggagataatggatgcttcgaaacaacctggcggcagcgcaaaagatg

SEQ ID NO: 61701 - DNA, 103 bp, Artificial Sequence
  Synthetic Polynucleotide
taatacgactcactatagggatctgctataaataacggtttcgaagttacaacagaggagagtaactatgaaaccgttaaacctggcggcagcgcaaaagatg

SEQ ID NO: 61702 - DNA, 103 bp, Artificial Sequence
  Synthetic Polynucleotide
taatacgactcactatagggcctatatctgctataaataacggtttcgaaaacagaggagattcgaaatggttatttataacctggcggcagcgcaaaagatg

SEQ ID NO: 61703 - DNA, 103 bp, Artificial Sequence
  Synthetic Polynucleotide
taatacgactcactatagggaaaaaggaattaatgtcgaaatgattttttaacagaggagaaaaaaaatgtttcgacataacctggcggcagcgcaaaagatg

SEQ ID NO: 61704 - DNA, 103 bp, Artificial Sequence
  Synthetic Polynucleotide
taatacgactcactatagggctatccctatatctgctataaataacggttaacagaggagaaaccgtatgttatagcagaacctggcggcagcgcaaaagatg

SEQ ID NO: 61705 - DNA, 103 bp, Artificial Sequence
  Synthetic Polynucleotide
taatacgactcactatagggtacttctatccctatatctgctataaataaaacagaggagattatttatggcagatataaacctggcggcagcgcaaaagatg

SEQ ID NO: 61706 - DNA, 103 bp, Artificial Sequence
  Synthetic Polynucleotide
taatacgactcactatagggattcctacttctatccctatatctgctataaacagaggagatatagcatgtatagggataacctggcggcagcgcaaaagatg

SEQ ID NO: 61707 - DNA, 103 bp, Artificial Sequence
  Synthetic Polynucleotide
taatacgactcactataggggtggcattcctacttctatccctatatctgaacagaggagacagataatgggatagaagaacctggcggcagcgcaaaagatg

SEQ ID NO: 61708 - DNA, 103 bp, Artificial Sequence
  Synthetic Polynucleotide
taatacgactcactatagggtattcgtggcattcctacttctatccctataacagaggagaatagggatggaagtaggaaacctggcggcagcgcaaaagatg

SEQ ID NO: 61709 - DNA, 103 bp, Artificial Sequence
  Synthetic Polynucleotide
taatacgactcactatagggttttttattcgtggcattcctacttctatcaacagaggagagatagaatgaggaatgccaacctggcggcagcgcaaaagatg

SEQ ID NO: 61710 - DNA, 103 bp, Artificial Sequence
  Synthetic Polynucleotide
taatacgactcactatagggaagtattttttattcgtggcattcctacttaacagaggagaaagtagatgtgccacgaaaacctggcggcagcgcaaaagatg

SEQ ID NO: 61711 - DNA, 103 bp, Artificial Sequence
  Synthetic Polynucleotide
taatacgactcactatagggattttaagtattttttattcgtggcattccaacagaggagaggaatgatgcgaataaaaaacctggcggcagcgcaaaagatg

SEQ ID NO: 61712 - DNA, 103 bp, Artificial Sequence
  Synthetic Polynucleotide
taatacgactcactatagggattacattttaagtattttttattcgtggcaacagaggagagccacgatgaaaaaatacaacctggcggcagcgcaaaagatg

SEQ ID NO: 61713 - DNA, 103 bp, Artificial Sequence
  Synthetic Polynucleotide
taatacgactcactatagggttaagattacattttaagtattttttattcaacagaggagagaataaatgatacttaaaaacctggcggcagcgcaaaagatg

SEQ ID NO: 61714 - DNA, 103 bp, Artificial Sequence
  Synthetic Polynucleotide
taatacgactcactatagggaatttaaaaaggaattaatgtcgaaatgataacagaggagaatcattatgacattaattaacctggcggcagcgcaaaagatg

SEQ ID NO: 61715 - DNA, 103 bp, Artificial Sequence
  Synthetic Polynucleotide
taatacgactcactatagggctcgattaagattacattttaagtatttttaacagaggagaaaaaatatgtaaaatgtaaacctggcggcagcgcaaaagatg

SEQ ID NO: 61716 - DNA, 103 bp, Artificial Sequence
  Synthetic Polynucleotide
taatacgactcactataggggcgtactcgattaagattacattttaagtaaacagaggagatacttaatgtgtaatcttaacctggcggcagcgcaaaagatg

SEQ ID NO: 61717 - DNA, 103 bp, Artificial Sequence
  Synthetic Polynucleotide
taatacgactcactatagggatatggcgtactcgattaagattacattttaacagaggagaaaaatgatgtcttaatcgaacctggcggcagcgcaaaagatg

SEQ ID NO: 61718 - DNA, 103 bp, Artificial Sequence
  Synthetic Polynucleotide
taatacgactcactatagggttgtcatatggcgtactcgattaagattacaacagaggagagtaatcatgatcgagtacaacctggcggcagcgcaaaagatg

SEQ ID NO: 61719 - DNA, 103 bp, Artificial Sequence
  Synthetic Polynucleotide
taatacgactcactataggggttcattgtcatatggcgtactcgattaagaacagaggagacttaatatggtacgccataacctggcggcagcgcaaaagatg

SEQ ID NO: 61720 - DNA, 103 bp, Artificial Sequence
  Synthetic Polynucleotide
taatacgactcactatagggggtttgttcattgtcatatggcgtactcgaaacagaggagatcgagtatgccatatgacaacctggcggcagcgcaaaagatg

SEQ ID NO: 61721 - DNA, 103 bp, Artificial Sequence
  Synthetic Polynucleotide
taatacgactcactatagggtcttaggtttgttcattgtcatatggcgtaaacagaggagatacgccatgtgacaatgaaacctggcggcagcgcaaaagatg

SEQ ID NO: 61722 - DNA, 103 bp, Artificial Sequence
  Synthetic Polynucleotide
taatacgactcactatagggatttgtcttaggtttgttcattgtcatatgaacagaggagacatatgatgatgaacaaaaacctggcggcagcgcaaaagatg

SEQ ID NO: 61723 - DNA, 103 bp, Artificial Sequence
  Synthetic Polynucleotide
taatacgactcactataggggcataatttgtcttaggtttgttcattgtcaacagaggagagacaatatgcaaacctaaaacctggcggcagcgcaaaagatg

SEQ ID NO: 61724 - DNA, 103 bp, Artificial Sequence
  Synthetic Polynucleotide
taatacgactcactatagggaaccagcataatttgtcttaggtttgttcaaacagaggagatgaacaatgctaagacaaaacctggcggcagcgcaaaagatg

SEQ ID NO: 61725 - DNA, 103 bp, Artificial Sequence
  Synthetic Polynucleotide
taatacgactcactatagggacggaaatttaaaaaggaattaatgtcgaaaacagaggagattcgacatgaattcctttaacctggcggcagcgcaaaagatg

SEQ ID NO: 61726 - DNA, 103 bp, Artificial Sequence
  Synthetic Polynucleotide
taatacgactcactatagggagcataaccagcataatttgtcttaggtttaacagaggagaaaacctatgacaaattataacctggcggcagcgcaaaagatg

SEQ ID NO: 61727 - DNA, 103 bp, Artificial Sequence
  Synthetic Polynucleotide
taatacgactcactatagggcagcaagcataaccagcataatttgtcttaaacagaggagataagacatgttatgctggaacctggcggcagcgcaaaagatg

SEQ ID NO: 61728 - DNA, 103 bp, Artificial Sequence
  Synthetic Polynucleotide
taatacgactcactatagggttacgcagcaagcataaccagcataatttgaacagaggagacaaattatgctggttatgaacctggcggcagcgcaaaagatg

SEQ ID NO: 61729 - DNA, 103 bp, Artificial Sequence
  Synthetic Polynucleotide
taatacgactcactataggggcatattacgcagcaagcataaccagcataaacagaggagatatgctatgtatgcttgcaacctggcggcagcgcaaaagatg

SEQ ID NO: 61730 - DNA, 103 bp, Artificial Sequence
  Synthetic Polynucleotide
taatacgactcactatagggagaccgcatattacgcagcaagcataaccaaacagaggagatggttaatgttgctgcgtaacctggcggcagcgcaaaagatg

SEQ ID NO: 61731 - DNA, 103 bp, Artificial Sequence
  Synthetic Polynucleotide
taatacgactcactatagggcaattagaccgcatattacgcagcaagcataacagaggagaatgcttatggcgtaatataacctggcggcagcgcaaaagatg

SEQ ID NO: 61732 - DNA, 103 bp, Artificial Sequence
  Synthetic Polynucleotide
taatacgactcactatagggtccaacaattagaccgcatattacgcagcaaacagaggagatgctgcatgatatgcggtaacctggcggcagcgcaaaagatg

SEQ ID NO: 61733 - DNA, 103 bp, Artificial Sequence
  Synthetic Polynucleotide
taatacgactcactatagggataattccaacaattagaccgcatattacgaacagaggagacgtaatatgcggtctaataacctggcggcagcgcaaaagatg

SEQ ID NO: 61734 - DNA, 103 bp, Artificial Sequence
  Synthetic Polynucleotide
taatacgactcactatagggtaaaaataattccaacaattagaccgcataaacagaggagatatgcgatgtaattgttgaacctggcggcagcgcaaaagatg

SEQ ID NO: 61735 - DNA, 103 bp, Artificial Sequence
  Synthetic Polynucleotide
taatacgactcactatagggcgctgtaaaaataattccaacaattagaccaacagaggagaggtctaatggttggaattaacctggcggcagcgcaaaagatg

SEQ ID NO: 61736 - DNA, 103 bp, Artificial Sequence
  Synthetic Polynucleotide
taatacgactcactataggggatagacggaaatttaaaaaggaattaatgaacagaggagacattaaatgctttttaaaaacctggcggcagcgcaaaagatg

SEQ ID NO: 61737 - DNA, 103 bp, Artificial Sequence
  Synthetic Polynucleotide
taatacgactcactatagggagtgtcgctgtaaaaataattccaacaattaacagaggagaaattgtatgaattattttaacctggcggcagcgcaaaagatg

SEQ ID NO: 61738 - DNA, 103 bp, Artificial Sequence
  Synthetic Polynucleotide
taatacgactcactatagggttaatagtgtcgctgtaaaaataattccaaaacagaggagattggaaatgtttttacagaacctggcggcagcgcaaaagatg

SEQ ID NO: 61739 - DNA, 103 bp, Artificial Sequence
  Synthetic Polynucleotide
taatacgactcactatagggagcttttaatagtgtcgctgtaaaaataataacagaggagaattattatgacagcgacaaacctggcggcagcgcaaaagatg

SEQ ID NO: 61740 - DNA, 103 bp, Artificial Sequence
  Synthetic Polynucleotide
taatacgactcactatagggtctacagcttttaatagtgtcgctgtaaaaaacagaggagattttacatggacactattaacctggcggcagcgcaaaagatg

SEQ ID NO: 61741 - DNA, 103 bp, Artificial Sequence
  Synthetic Polynucleotide
taatacgactcactatagggtacgttctacagcttttaatagtgtcgctgaacagaggagacagcgaatgtattaaaagaacctggcggcagcgcaaaagatg

SEQ ID NO: 61742 - DNA, 103 bp, Artificial Sequence
  Synthetic Polynucleotide
taatacgactcactatagggtaatttacgttctacagcttttaatagtgtaacagaggagaacactaatgaaagctgtaaacctggcggcagcgcaaaagatg

SEQ ID NO: 61743 - DNA, 103 bp, Artificial Sequence
  Synthetic Polynucleotide
taatacgactcactatagggtgaattaatttacgttctacagcttttaataacagaggagaattaaaatgtgtagaacgaacctggcggcagcgcaaaagatg

SEQ ID NO: 61744 - DNA, 103 bp, Artificial Sequence
  Synthetic Polynucleotide
taatacgactcactataggggtgtatgaattaatttacgttctacagcttaacagaggagaaagctgatgaacgtaaataacctggcggcagcgcaaaagatg

SEQ ID NO: 61745 - DNA, 103 bp, Artificial Sequence
  Synthetic Polynucleotide
taatacgactcactatagggtaatggtgtatgaattaatttacgttctacaacagaggagagtagaaatgaaattaattaacctggcggcagcgcaaaagatg

SEQ ID NO: 61746 - DNA, 103 bp, Artificial Sequence
  Synthetic Polynucleotide
taatacgactcactatagggtctattaatggtgtatgaattaatttacgtaacagaggagaacgtaaatgaattcatacaacctggcggcagcgcaaaagatg

SEQ ID NO: 61747 - DNA, 103 bp, Artificial Sequence
  Synthetic Polynucleotide
taatacgactcactatagggtagatgatagacggaaatttaaaaaggaataacagaggagaattcctatgtaaatttccaacctggcggcagcgcaaaagatg

SEQ ID NO: 61748 - DNA, 103 bp, Artificial Sequence
  Synthetic Polynucleotide
taatacgactcactatagggttttatctattaatggtgtatgaattaattaacagaggagaaattaaatgatacaccataacctggcggcagcgcaaaagatg

SEQ ID NO: 61749 - DNA, 103 bp, Artificial Sequence
  Synthetic Polynucleotide
taatacgactcactatagggtatcgttttatctattaatggtgtatgaataacagaggagaattcatatgccattaataaacctggcggcagcgcaaaagatg

SEQ ID NO: 61750 - DNA, 103 bp, Artificial Sequence
  Synthetic Polynucleotide
taatacgactcactatagggtcttttatcgttttatctattaatggtgtaaacagaggagatacaccatgaatagataaaacctggcggcagcgcaaaagatg

SEQ ID NO: 61751 - DNA, 103 bp, Artificial Sequence
  Synthetic Polynucleotide
taatacgactcactatagggatgcatcttttatcgttttatctattaatgaacagaggagacattaaatgataaaacgaaacctggcggcagcgcaaaagatg

SEQ ID NO: 61752 - DNA, 103 bp, Artificial Sequence
  Synthetic Polynucleotide
taatacgactcactatagggaatatatgcatcttttatcgttttatctataacagaggagaatagatatgacgataaaaaacctggcggcagcgcaaaagatg

SEQ ID NO: 61753 - DNA, 103 bp, Artificial Sequence
  Synthetic Polynucleotide
taatacgactcactatagggtctctaatatatgcatcttttatcgttttaaacagaggagataaaacatgaaaagatgcaacctggcggcagcgcaaaagatg

SEQ ID NO: 61754 - DNA, 103 bp, Artificial Sequence
  Synthetic Polynucleotide
taatacgactcactatagggaatcttctctaatatatgcatcttttatcgaacagaggagacgataaatgatgcatataaacctggcggcagcgcaaaagatg

SEQ ID NO: 61755 - DNA, 103 bp, Artificial Sequence
  Synthetic Polynucleotide
taatacgactcactatagggaggacaatcttctctaatatatgcatctttaacagaggagaaaagatatgtatattagaaacctggcggcagcgcaaaagatg

SEQ ID NO: 61756 - DNA, 103 bp, Artificial Sequence
  Synthetic Polynucleotide
taatacgactcactatagggtcagtaggacaatcttctctaatatatgcaaacagaggagatgcataatgtagagaagaaacctggcggcagcgcaaaagatg

SEQ ID NO: 61757 - DNA, 103 bp, Artificial Sequence
  Synthetic Polynucleotide
taatacgactcactatagggttcagtcagtaggacaatcttctctaatataacagaggagaatattaatgaagattgtcaacctggcggcagcgcaaaagatg

SEQ ID NO: 61758 - DNA, 103 bp, Artificial Sequence
  Synthetic Polynucleotide
taatacgactcactatagggttctatagatgatagacggaaatttaaaaaaacagaggagatttttaatgttccgtctaaacctggcggcagcgcaaaagatg

SEQ ID NO: 61759 - DNA, 103 bp, Artificial Sequence
  Synthetic Polynucleotide
taatacgactcactataggggcttattcagtcagtaggacaatcttctctaacagaggagaagagaaatgtgtcctactaacctggcggcagcgcaaaagatg

SEQ ID NO: 61760 - DNA, 103 bp, Artificial Sequence
  Synthetic Polynucleotide
taatacgactcactatagggatatagcttattcagtcagtaggacaatctaacagaggagaagattgatgtactgactgaacctggcggcagcgcaaaagatg

SEQ ID NO: 61761 - DNA, 103 bp, Artificial Sequence
  Synthetic Polynucleotide
taatacgactcactatagggttattatatagcttattcagtcagtaggacaacagaggagagtcctaatgactgaataaaacctggcggcagcgcaaaagatg

SEQ ID NO: 61762 - DNA, 103 bp, Artificial Sequence
  Synthetic Polynucleotide
taatacgactcactatagggtacatttattatatagcttattcagtcagtaacagaggagaactgacatgataagctataacctggcggcagcgcaaaagatg

SEQ ID NO: 61763 - DNA, 103 bp, Artificial Sequence
  Synthetic Polynucleotide
taatacgactcactatagggatgtatacatttattatatagcttattcagaacagaggagactgaatatgctatataataacctggcggcagcgcaaaagatg

SEQ ID NO: 61764 - DNA, 103 bp, Artificial Sequence
  Synthetic Polynucleotide
taatacgactcactataggggataaatgtatacatttattatatagcttaaacagaggagataagctatgtaataaatgaacctggcggcagcgcaaaagatg

SEQ ID NO: 61765 - DNA, 103 bp, Artificial Sequence
  Synthetic Polynucleotide
taatacgactcactatagggtagtcgataaatgtatacatttattatataaacagaggagatatataatgaatgtatacaacctggcggcagcgcaaaagatg

SEQ ID NO: 61766 - DNA, 103 bp, Artificial Sequence
  Synthetic Polynucleotide
taatacgactcactatagggttgattagtcgataaatgtatacatttattaacagaggagaaataaaatgatacatttaaacctggcggcagcgcaaaagatg

SEQ ID NO: 61767 - DNA, 103 bp, Artificial Sequence
  Synthetic Polynucleotide
taatacgactcactataggggttttttgattagtcgataaatgtatacataacagaggagaatgtatatgtttatcgacaacctggcggcagcgcaaaagatg

SEQ ID NO: 61768 - DNA, 103 bp, Artificial Sequence
  Synthetic Polynucleotide
taatacgactcactatagggcccaggttttttgattagtcgataaatgtaaacagaggagatacattatgcgactaatcaacctggcggcagcgcaaaagatg

SEQ ID NO: 61769 - DNA, 103 bp, Artificial Sequence
  Synthetic Polynucleotide
taatacgactcactatagggtatgtttctatagatgatagacggaaatttaacagaggagaaaatttatgtctatcatcaacctggcggcagcgcaaaagatg

SEQ ID NO: 61770 - DNA, 103 bp, Artificial Sequence
  Synthetic Polynucleotide
taatacgactcactatagggttcctcccaggttttttgattagtcgataaaacagaggagattatcgatgaatcaaaaaaacctggcggcagcgcaaaagatg

SEQ ID NO: 61771 - DNA, 103 bp, Artificial Sequence
  Synthetic Polynucleotide
taatacgactcactatagggcgtccttcctcccaggttttttgattagtcaacagaggagagactaaatgaaaaacctgaacctggcggcagcgcaaaagatg

SEQ ID NO: 61772 - DNA, 103 bp, Artificial Sequence
  Synthetic Polynucleotide
taatacgactcactatagggcattacgtccttcctcccaggttttttgataacagaggagaatcaaaatgcctgggaggaacctggcggcagcgcaaaagatg

SEQ ID NO: 61773 - DNA, 103 bp, Artificial Sequence
  Synthetic Polynucleotide
taatacgactcactataggggcatgcattacgtccttcctcccaggttttaacagaggagaaaaaccatggaggaaggaaacctggcggcagcgcaaaagatg

SEQ ID NO: 61774 - DNA, 103 bp, Artificial Sequence
  Synthetic Polynucleotide
taatacgactcactataggggctttgcatgcattacgtccttcctcccagaacagaggagactgggaatgaggacgtaaaacctggcggcagcgcaaaagatg

SEQ ID NO: 61775 - DNA, 103 bp, Artificial Sequence
  Synthetic Polynucleotide
taatacgactcactatagggttagagctttgcatgcattacgtccttcctaacagaggagaaggaagatggtaatgcataacctggcggcagcgcaaaagatg

SEQ ID NO: 61776 - DNA, 103 bp, Artificial Sequence
  Synthetic Polynucleotide
taatacgactcactatagggtggatttagagctttgcatgcattacgtccaacagaggagaggacgtatggcatgcaaaaacctggcggcagcgcaaaagatg

SEQ ID NO: 61777 - DNA, 103 bp, Artificial Sequence
  Synthetic Polynucleotide
taatacgactcactataggggaatttggatttagagctttgcatgcattaaacagaggagataatgcatgcaaagctctaacctggcggcagcgcaaaagatg

SEQ ID NO: 61778 - DNA, 103 bp, Artificial Sequence
  Synthetic Polynucleotide
taatacgactcactataggggatccgaatttggatttagagctttgcatgaacagaggagacatgcaatgctctaaatcaacctggcggcagcgcaaaagatg

SEQ ID NO: 61779 - DNA, 103 bp, Artificial Sequence
  Synthetic Polynucleotide
taatacgactcactatagggaattagatccgaatttggatttagagctttaacagaggagaaaagctatgaatccaaataacctggcggcagcgcaaaagatg

SEQ ID NO: 61780 - DNA, 103 bp, Artificial Sequence
  Synthetic Polynucleotide
taatacgactcactatagggtagaatatgtttctatagatgatagacggaaacagaggagatccgtcatgcatctatagaacctggcggcagcgcaaaagatg

SEQ ID NO: 61781 - DNA, 103 bp, Artificial Sequence
  Synthetic Polynucleotide
taatacgactcactatagggatattaattagatccgaatttggatttagaaacagaggagatctaaaatgaaattcggaaacctggcggcagcgcaaaagatg

SEQ ID NO: 61782 - DNA, 103 bp, Artificial Sequence
  Synthetic Polynucleotide
taatacgactcactatagggtctctatattaattagatccgaatttggataacagaggagaatccaaatgcggatctaaaacctggcggcagcgcaaaagatg

SEQ ID NO: 61783 - DNA, 103 bp, Artificial Sequence
  Synthetic Polynucleotide
taatacgactcactatagggtagagtctctatattaattagatccgaattaacagaggagaaattcgatgctaattaataacctggcggcagcgcaaaagatg

SEQ ID NO: 61784 - DNA, 103 bp, Artificial Sequence
  Synthetic Polynucleotide
taatacgactcactatagggtcgtttagagtctctatattaattagatccaacagaggagaggatctatgtaatatagaaacctggcggcagcgcaaaagatg

SEQ ID NO: 61785 - DNA, 103 bp, Artificial Sequence
  Synthetic Polynucleotide
taatacgactcactatagggttaactcgtttagagtctctatattaattaaacagaggagataattaatgtagagactcaacctggcggcagcgcaaaagatg

SEQ ID NO: 61786 - DNA, 103 bp, Artificial Sequence
  Synthetic Polynucleotide
taatacgactcactatagggaaaacttaactcgtttagagtctctatattaacagaggagaaatataatgactctaaacaacctggcggcagcgcaaaagatg

SEQ ID NO: 61787 - DNA, 103 bp, Artificial Sequence
  Synthetic Polynucleotide
taatacgactcactatagggcttaaaaaacttaactcgtttagagtctctaacagaggagaagagacatgaaacgagttaacctggcggcagcgcaaaagatg

SEQ ID NO: 61788 - DNA, 103 bp, Artificial Sequence
  Synthetic Polynucleotide
taatacgactcactatagggggcttcttaaaaaacttaactcgtttagagaacagaggagactctaaatgagttaagttaacctggcggcagcgcaaaagatg

SEQ ID NO: 61789 - DNA, 103 bp, Artificial Sequence
  Synthetic Polynucleotide
taatacgactcactatagggtctaaggcttcttaaaaaacttaactcgttaacagaggagaaacgagatgagttttttaaacctggcggcagcgcaaaagatg

SEQ ID NO: 61790 - DNA, 103 bp, Artificial Sequence
  Synthetic Polynucleotide
taatacgactcactatagggcctcttctaaggcttcttaaaaaacttaacaacagaggagagttaagatgtttaagaagaacctggcggcagcgcaaaagatg

SEQ ID NO: 61791 - DNA, 103 bp, Artificial Sequence
  Synthetic Polynucleotide
taatacgactcactataggggtacaaaaaaataaaactagagattgaaacaacagaggagagtttcaatgtctagttttaacctggcggcagcgcaaaagatg

SEQ ID NO: 61792 - DNA, 103 bp, Artificial Sequence
  Synthetic Polynucleotide
taatacgactcactatagggctagtatgctcgaacatggatcctaatcttaacagaggagaaagattatgatccatgttaacctggcggcagcgcaaaagatg

SEQ ID NO: 61793 - DNA, 103 bp, Artificial Sequence
  Synthetic Polynucleotide
taatacgactcactatagggattcatagaatatgtttctatagatgatagaacagaggagactatcaatgatagaaacaaacctggcggcagcgcaaaagatg

SEQ ID NO: 61794 - DNA, 103 bp, Artificial Sequence
  Synthetic Polynucleotide
taatacgactcactatagggaatagcctcttctaaggcttcttaaaaaacaacagaggagagtttttatggaagccttaaacctggcggcagcgcaaaagatg

SEQ ID NO: 61795 - DNA, 103 bp, Artificial Sequence
  Synthetic Polynucleotide
taatacgactcactatagggtacccaatagcctcttctaaggcttcttaaaacagaggagattaagaatgcttagaagaaacctggcggcagcgcaaaagatg

SEQ ID NO: 61796 - DNA, 103 bp, Artificial Sequence
  Synthetic Polynucleotide
taatacgactcactatagggtctcctacccaatagcctcttctaaggcttaacagaggagaaagcctatgaagaggctaaacctggcggcagcgcaaaagatg

SEQ ID NO: 61797 - DNA, 103 bp, Artificial Sequence
  Synthetic Polynucleotide
taatacgactcactatagggtgaattctcctacccaatagcctcttctaaaacagaggagattagaaatggctattgggaacctggcggcagcgcaaaagatg

SEQ ID NO: 61798 - DNA, 103 bp, Artificial Sequence
  Synthetic Polynucleotide
taatacgactcactatagggtattttgaattctcctacccaatagcctctaacagaggagaagaggcatgtgggtaggaaacctggcggcagcgcaaaagatg

SEQ ID NO: 61799 - DNA, 103 bp, Artificial Sequence
  Synthetic Polynucleotide
taatacgactcactatagggtttaatattttgaattctcctacccaatagaacagaggagactattgatgaggagaattaacctggcggcagcgcaaaagatg

SEQ ID NO: 61800 - DNA, 103 bp, Artificial Sequence
  Synthetic Polynucleotide
taatacgactcactatagggtctggtttaatattttgaattctcctacccaacagaggagagggtagatgaattcaaaaaacctggcggcagcgcaaaagatg

SEQ ID NO: 61801 - DNA, 103 bp, Artificial Sequence
  Synthetic Polynucleotide
taatacgactcactatagggggttgtctggtttaatattttgaattctccaacagaggagaggagaaatgaaaatattaaacctggcggcagcgcaaaagatg

SEQ ID NO: 61802 - DNA, 103 bp, Artificial Sequence
  Synthetic Polynucleotide
taatacgactcactatagggtacgtggttgtctggtttaatattttgaataacagaggagaattcaaatgattaaaccaaacctggcggcagcgcaaaagatg

SEQ ID NO: 61803 - DNA, 103 bp, Artificial Sequence
  Synthetic Polynucleotide
taatacgactcactatagggaattatacgtggttgtctggtttaatatttaacagaggagaaaatatatgaccagacaaaacctggcggcagcgcaaaagatg

SEQ ID NO: 61804 - DNA, 103 bp, Artificial Sequence
  Synthetic Polynucleotide
taatacgactcactatagggtataaattcatagaatatgtttctatagataacagaggagaatctatatgaacatattcaacctggcggcagcgcaaaagatg

SEQ ID NO: 61805 - DNA, 103 bp, Artificial Sequence
  Synthetic Polynucleotide
taatacgactcactatagggtataaaattatacgtggttgtctggtttaaaacagaggagattaaacatgacaaccacgaacctggcggcagcgcaaaagatg

SEQ ID NO: 61806 - DNA, 103 bp, Artificial Sequence
  Synthetic Polynucleotide
taatacgactcactatagggttagctataaaattatacgtggttgtctggaacagaggagaccagacatgcacgtataaaacctggcggcagcgcaaaagatg

SEQ ID NO: 61807 - DNA, 103 bp, Artificial Sequence
  Synthetic Polynucleotide
taatacgactcactatagggcatttttagctataaaattatacgtggttgaacagaggagacaaccaatgataattttaaacctggcggcagcgcaaaagatg

SEQ ID NO: 61808 - DNA, 103 bp, Artificial Sequence
  Synthetic Polynucleotide
taatacgactcactatagggcgtgacatttttagctataaaattatacgtaacagaggagaacgtatatgtttatagctaacctggcggcagcgcaaaagatg

SEQ ID NO: 61809 - DNA, 103 bp, Artificial Sequence
  Synthetic Polynucleotide
taatacgactcactatagggttcttcgtgacatttttagctataaaattaaacagaggagataatttatgagctaaaaaaacctggcggcagcgcaaaagatg

SEQ ID NO: 61810 - DNA, 103 bp, Artificial Sequence
  Synthetic Polynucleotide
taatacgactcactatagggttccattcttcgtgacatttttagctataaaacagaggagattatagatgaaaatgtcaaacctggcggcagcgcaaaagatg

SEQ ID NO: 61811 - DNA, 103 bp, Artificial Sequence
  Synthetic Polynucleotide
taatacgactcactatagggtttagttccattcttcgtgacatttttagcaacagaggagagctaaaatggtcacgaagaacctggcggcagcgcaaaagatg

SEQ ID NO: 61812 - DNA, 103 bp, Artificial Sequence
  Synthetic Polynucleotide
taatacgactcactatagggcgttttttagttccattcttcgtgacatttaacagaggagaaaatgtatggaagaatggaacctggcggcagcgcaaaagatg

SEQ ID NO: 61813 - DNA, 103 bp, Artificial Sequence
  Synthetic Polynucleotide
taatacgactcactatagggtatttcgttttttagttccattcttcgtgaaacagaggagatcacgaatgatggaactaaacctggcggcagcgcaaaagatg

SEQ ID NO: 61814 - DNA, 103 bp, Artificial Sequence
  Synthetic Polynucleotide
taatacgactcactatagggaaatatatttcgttttttagttccattcttaacagaggagaaagaatatgactaaaaaaaacctggcggcagcgcaaaagatg

SEQ ID NO: 61815 - DNA, 103 bp, Artificial Sequence
  Synthetic Polynucleotide
taatacgactcactatagggcattttataaattcatagaatatgtttctaaacagaggagatagaaaatgattctatgaaacctggcggcagcgcaaaagatg

SEQ ID NO: 61816 - DNA, 103 bp, Artificial Sequence
  Synthetic Polynucleotide
taatacgactcactatagggactacaaatatatttcgttttttagttccaaacagaggagatggaacatgaaaacgaaaaacctggcggcagcgcaaaagatg

SEQ ID NO: 61817 - DNA, 103 bp, Artificial Sequence
  Synthetic Polynucleotide
taatacgactcactataggggttgtactacaaatatatttcgttttttagaacagaggagactaaaaatggaaatatataacctggcggcagcgcaaaagatg

SEQ ID NO: 61818 - DNA, 103 bp, Artificial Sequence
  Synthetic Polynucleotide
taatacgactcactatagggtattcgttgtactacaaatatatttcgtttaacagaggagaaaacgaatgatatttgtaaacctggcggcagcgcaaaagatg

SEQ ID NO: 61819 - DNA, 103 bp, Artificial Sequence
  Synthetic Polynucleotide
taatacgactcactataggggggagtattcgttgtactacaaatatatttaacagaggagaaaatatatgtgtagtacaaacctggcggcagcgcaaaagatg

SEQ ID NO: 61820 - DNA, 103 bp, Artificial Sequence
  Synthetic Polynucleotide
taatacgactcactatagggagtttgggagtattcgttgtactacaaataaacagaggagatatttgatgtacaacgaaaacctggcggcagcgcaaaagatg

SEQ ID NO: 61821 - DNA, 103 bp, Artificial Sequence
  Synthetic Polynucleotide
taatacgactcactatagggaatgcagtttgggagtattcgttgtactacaacagaggagagtagtaatgcgaatactcaacctggcggcagcgcaaaagatg

SEQ ID NO: 61822 - DNA, 103 bp, Artificial Sequence
  Synthetic Polynucleotide
taatacgactcactatagggacatgaatgcagtttgggagtattcgttgtaacagaggagaacaacgatgactcccaaaaacctggcggcagcgcaaaagatg

SEQ ID NO: 61823 - DNA, 103 bp, Artificial Sequence
  Synthetic Polynucleotide
taatacgactcactataggggtgtaacatgaatgcagtttgggagtattcaacagaggagagaatacatgcaaactgcaaacctggcggcagcgcaaaagatg

SEQ ID NO: 61824 - DNA, 103 bp, Artificial Sequence
  Synthetic Polynucleotide
taatacgactcactatagggatatagtgtaacatgaatgcagtttgggagaacagaggagactcccaatgtgcattcataacctggcggcagcgcaaaagatg

SEQ ID NO: 61825 - DNA, 103 bp, Artificial Sequence
  Synthetic Polynucleotide
taatacgactcactatagggttgttatatagtgtaacatgaatgcagtttaacagaggagaaaactgatgtcatgttacaacctggcggcagcgcaaaagatg

SEQ ID NO: 61826 - DNA, 103 bp, Artificial Sequence
  Synthetic Polynucleotide
taatacgactcactatagggaaaagcattttataaattcatagaatatgtaacagaggagaacatatatgatgaatttaaacctggcggcagcgcaaaagatg

SEQ ID NO: 61827 - DNA, 103 bp, Artificial Sequence
  Synthetic Polynucleotide
taatacgactcactatagggtgtaattgttatatagtgtaacatgaatgcaacagaggagagcattcatgttacactataacctggcggcagcgcaaaagatg

SEQ ID NO: 61828 - DNA, 103 bp, Artificial Sequence
  Synthetic Polynucleotide
taatacgactcactatagggtgtagtgtaattgttatatagtgtaacatgaacagaggagacatgttatgctatataacaacctggcggcagcgcaaaagatg

SEQ ID NO: 61829 - DNA, 103 bp, Artificial Sequence
  Synthetic Polynucleotide
taatacgactcactatagggaaaaatgtagtgtaattgttatatagtgtaaacagaggagatacactatgtaacaattaaacctggcggcagcgcaaaagatg

SEQ ID NO: 61830 - DNA, 103 bp, Artificial Sequence
  Synthetic Polynucleotide
taatacgactcactatagggatgataaaaatgtagtgtaattgttatataaacagaggagatatataatgattacactaaacctggcggcagcgcaaaagatg

SEQ ID NO: 61831 - DNA, 103 bp, Artificial Sequence
  Synthetic Polynucleotide
taatacgactcactataggggtgttatgataaaaatgtagtgtaattgttaacagaggagaaacaatatgactacatttaacctggcggcagcgcaaaagatg

SEQ ID NO: 61832 - DNA, 103 bp, Artificial Sequence
  Synthetic Polynucleotide
taatacgactcactatagggaagtagtgttatgataaaaatgtagtgtaaaacagaggagattacacatgatttttatcaacctggcggcagcgcaaaagatg

SEQ ID NO: 61833 - DNA, 103 bp, Artificial Sequence
  Synthetic Polynucleotide
taatacgactcactatagggaaccaaagtagtgttatgataaaaatgtagaacagaggagactacatatgtatcataacaacctggcggcagcgcaaaagatg

SEQ ID NO: 61834 - DNA, 103 bp, Artificial Sequence
  Synthetic Polynucleotide
taatacgactcactatagggcatctaaccaaagtagtgttatgataaaaaaacagaggagatttttaatgtaacactacaacctggcggcagcgcaaaagatg

SEQ ID NO: 61835 - DNA, 103 bp, Artificial Sequence
  Synthetic Polynucleotide
taatacgactcactatagggtaaaacatctaaccaaagtagtgttatgataacagaggagaatcataatgctactttggaacctggcggcagcgcaaaagatg

SEQ ID NO: 61836 - DNA, 103 bp, Artificial Sequence
  Synthetic Polynucleotide
taatacgactcactatagggttttctaaaacatctaaccaaagtagtgttaacagaggagaaacactatgttggttagaaacctggcggcagcgcaaaagatg

SEQ ID NO: 61837 - DNA, 103 bp, Artificial Sequence
  Synthetic Polynucleotide
taatacgactcactatagggcacgtaaaagcattttataaattcatagaaaacagaggagattctatatgtttataaaaaacctggcggcagcgcaaaagatg

SEQ ID NO: 61838 - DNA, 103 bp, Artificial Sequence
  Synthetic Polynucleotide
taatacgactcactatagggattttttttctaaaacatctaaccaaagtaaacagaggagatactttatgtagatgtttaacctggcggcagcgcaaaagatg

SEQ ID NO: 61839 - DNA, 103 bp, Artificial Sequence
  Synthetic Polynucleotide
taatacgactcactataggggcgatattttttttctaaaacatctaaccaaacagaggagatggttaatggttttagaaaacctggcggcagcgcaaaagatg

SEQ ID NO: 61840 - DNA, 103 bp, Artificial Sequence
  Synthetic Polynucleotide
taatacgactcactataggggtacggcgatattttttttctaaaacatctaacagaggagaagatgtatgagaaaaaaaaacctggcggcagcgcaaaagatg

SEQ ID NO: 61841 - DNA, 103 bp, Artificial Sequence
  Synthetic Polynucleotide
taatacgactcactataggggaacggtacggcgatattttttttctaaaaaacagaggagattttagatgaaaaatatcaacctggcggcagcgcaaaagatg

SEQ ID NO: 61842 - DNA, 103 bp, Artificial Sequence
  Synthetic Polynucleotide
taatacgactcactatagggaacaagaacggtacggcgatattttttttcaacagaggagagaaaaaatgtatcgccgtaacctggcggcagcgcaaaagatg

SEQ ID NO: 61843 - DNA, 103 bp, Artificial Sequence
  Synthetic Polynucleotide
taatacgactcactatagggataaaaacaagaacggtacggcgatattttaacagaggagaaaaataatgccgtaccgtaacctggcggcagcgcaaaagatg

SEQ ID NO: 61844 - DNA, 103 bp, Artificial Sequence
  Synthetic Polynucleotide
taatacgactcactatagggtttttataaaaacaagaacggtacggcgataacagaggagaatcgccatgccgttcttgaacctggcggcagcgcaaaagatg

SEQ ID NO: 61845 - DNA, 103 bp, Artificial Sequence
  Synthetic Polynucleotide
taatacgactcactatagggtgttatttttataaaaacaagaacggtacgaacagaggagacgtaccatgcttgtttttaacctggcggcagcgcaaaagatg

SEQ ID NO: 61846 - DNA, 103 bp, Artificial Sequence
  Synthetic Polynucleotide
taatacgactcactatagggttaattgttatttttataaaaacaagaacgaacagaggagacgttctatgttttataaaaacctggcggcagcgcaaaagatg

SEQ ID NO: 61847 - DNA, 103 bp, Artificial Sequence
  Synthetic Polynucleotide
taatacgactcactatagggaattgttaattgttatttttataaaaacaaaacagaggagattgtttatgtaaaaataaaacctggcggcagcgcaaaagatg

SEQ ID NO: 61848 - DNA, 103 bp, Artificial Sequence
  Synthetic Polynucleotide
taatacgactcactatagggtaggacacgtaaaagcattttataaattcaaacagaggagatgaattatgaaaatgcttaacctggcggcagcgcaaaagatg

SEQ ID NO: 61849 - DNA, 103 bp, Artificial Sequence
  Synthetic Polynucleotide
taatacgactcactatagggttgataattgttaattgttatttttataaaaacagaggagatttataatgataacaattaacctggcggcagcgcaaaagatg

SEQ ID NO: 61850 - DNA, 103 bp, Artificial Sequence
  Synthetic Polynucleotide
taatacgactcactatagggaaaatttgataattgttaattgttatttttaacagaggagaaaaaatatgaattaacaaaacctggcggcagcgcaaaagatg

SEQ ID NO: 61851 - DNA, 103 bp, Artificial Sequence
  Synthetic Polynucleotide
taatacgactcactatagggaagaaaaaatttgataattgttaattgttaaacagaggagataacaaatgacaattatcaacctggcggcagcgcaaaagatg

SEQ ID NO: 61852 - DNA, 103 bp, Artificial Sequence
  Synthetic Polynucleotide
taatacgactcactatagggtattaaagaaaaaatttgataattgttaataacagaggagaattaacatgtatcaaattaacctggcggcagcgcaaaagatg

SEQ ID NO: 61853 - DNA, 103 bp, Artificial Sequence
  Synthetic Polynucleotide
taatacgactcactatagggtaaaatattaaagaaaaaatttgataattgaacagaggagacaattaatgaattttttcaacctggcggcagcgcaaaagatg

SEQ ID NO: 61854 - DNA, 103 bp, Artificial Sequence
  Synthetic Polynucleotide
taatacgactcactatagggccacgtaaaatattaaagaaaaaatttgataacagaggagaatcaaaatgtttctttaaaacctggcggcagcgcaaaagatg

SEQ ID NO: 61855 - DNA, 103 bp, Artificial Sequence
  Synthetic Polynucleotide
taatacgactcactataggggtcaaccacgtaaaatattaaagaaaaaataacagaggagaatttttatgttaatatttaacctggcggcagcgcaaaagatg

SEQ ID NO: 61856 - DNA, 103 bp, Artificial Sequence
  Synthetic Polynucleotide
taatacgactcactataggggaatggtcaaccacgtaaaatattaaagaaaacagaggagattctttatgattttacgtaacctggcggcagcgcaaaagatg

SEQ ID NO: 61857 - DNA, 103 bp, Artificial Sequence
  Synthetic Polynucleotide
taatacgactcactatagggaccacgaatggtcaaccacgtaaaatattaaacagaggagataatatatgacgtggttgaacctggcggcagcgcaaaagatg

SEQ ID NO: 61858 - DNA, 103 bp, Artificial Sequence
  Synthetic Polynucleotide
taatacgactcactatagggttaccaccacgaatggtcaaccacgtaaaaaacagaggagattttacatggttgaccataacctggcggcagcgcaaaagatg

SEQ ID NO: 61859 - DNA, 103 bp, Artificial Sequence
  Synthetic Polynucleotide
taatacgactcactatagggtacgataggacacgtaaaagcattttataaaacagaggagattataaatggcttttacgaacctggcggcagcgcaaaagatg

SEQ ID NO: 61860 - DNA, 103 bp, Artificial Sequence
  Synthetic Polynucleotide
taatacgactcactatagggttattttaccaccacgaatggtcaaccacgaacagaggagacgtggtatgccattcgtgaacctggcggcagcgcaaaagatg

SEQ ID NO: 61861 - DNA, 103 bp, Artificial Sequence
  Synthetic Polynucleotide
taatacgactcactatagggagagattattttaccaccacgaatggtcaaaacagaggagattgaccatgcgtggtggtaacctggcggcagcgcaaaagatg

SEQ ID NO: 61862 - DNA, 103 bp, Artificial Sequence
  Synthetic Polynucleotide
taatacgactcactatagggcactaagagattattttaccaccacgaatgaacagaggagacattcgatgtggtaaaataacctggcggcagcgcaaaagatg

SEQ ID NO: 61863 - DNA, 103 bp, Artificial Sequence
  Synthetic Polynucleotide
taatacgactcactatagggtccaacactaagagattattttaccaccacaacagaggagagtggtgatgaaataatctaacctggcggcagcgcaaaagatg

SEQ ID NO: 61864 - DNA, 103 bp, Artificial Sequence
  Synthetic Polynucleotide
taatacgactcactatagggtccattccaacactaagagattattttaccaacagaggagaggtaaaatgatctcttagaacctggcggcagcgcaaaagatg

SEQ ID NO: 61865 - DNA, 103 bp, Artificial Sequence
  Synthetic Polynucleotide
taatacgactcactatagggagcattccattccaacactaagagattattaacagaggagaaataatatgttagtgttgaacctggcggcagcgcaaaagatg

SEQ ID NO: 61866 - DNA, 103 bp, Artificial Sequence
  Synthetic Polynucleotide
taatacgactcactatagggtaaacagcattccattccaacactaagagaaacagaggagatctcttatggttggaatgaacctggcggcagcgcaaaagatg

SEQ ID NO: 61867 - DNA, 103 bp, Artificial Sequence
  Synthetic Polynucleotide
taatacgactcactatagggaacattaaacagcattccattccaacactaaacagaggagatagtgtatgaatggaatgaacctggcggcagcgcaaaagatg

SEQ ID NO: 61868 - DNA, 103 bp, Artificial Sequence
  Synthetic Polynucleotide
taatacgactcactataggggtggaaacattaaacagcattccattccaaaacagaggagattggaaatgaatgctgttaacctggcggcagcgcaaaagatg

SEQ ID NO: 61869 - DNA, 103 bp, Artificial Sequence
  Synthetic Polynucleotide
taatacgactcactatagggtgagtgtggaaacattaaacagcattccataacagaggagaatggaaatgtgtttaatgaacctggcggcagcgcaaaagatg

SEQ ID NO: 61870 - DNA, 103 bp, Artificial Sequence
  Synthetic Polynucleotide
taatacgactcactatagggtcgcctacgataggacacgtaaaagcatttaacagaggagaaaatgcatgtacgtgtccaacctggcggcagcgcaaaagatg

SEQ ID NO: 61871 - DNA, 103 bp, Artificial Sequence
  Synthetic Polynucleotide
taatacgactcactatagggtacgatgagtgtggaaacattaaacagcataacagaggagaatgctgatgaatgtttccaacctggcggcagcgcaaaagatg

SEQ ID NO: 61872 - DNA, 103 bp, Artificial Sequence
  Synthetic Polynucleotide
taatacgactcactatagggaaatatacgatgagtgtggaaacattaaacaacagaggagagtttaaatgttccacactaacctggcggcagcgcaaaagatg

SEQ ID NO: 61873 - DNA, 103 bp, Artificial Sequence
  Synthetic Polynucleotide
taatacgactcactatagggcgtcaaaatatacgatgagtgtggaaacataacagaggagaatgtttatgcactcatcgaacctggcggcagcgcaaaagatg

SEQ ID NO: 61874 - DNA, 103 bp, Artificial Sequence
  Synthetic Polynucleotide
taatacgactcactataggggcatacgtcaaaatatacgatgagtgtggaaacagaggagatccacaatgatcgtatataacctggcggcagcgcaaaagatg

SEQ ID NO: 61875 - DNA, 103 bp, Artificial Sequence
  Synthetic Polynucleotide
taatacgactcactatagggtaactgcatacgtcaaaatatacgatgagtaacagaggagaactcatatgatattttgaaacctggcggcagcgcaaaagatg

SEQ ID NO: 61876 - DNA, 103 bp, Artificial Sequence
  Synthetic Polynucleotide
taatacgactcactatagggcgatgtaactgcatacgtcaaaatatacgaaacagaggagatcgtatatgttgacgtataacctggcggcagcgcaaaagatg

SEQ ID NO: 61877 - DNA, 103 bp, Artificial Sequence
  Synthetic Polynucleotide
taatacgactcactataggggtaaacgatgtaactgcatacgtcaaaataaacagaggagatattttatggtatgcagtaacctggcggcagcgcaaaagatg

SEQ ID NO: 61878 - DNA, 103 bp, Artificial Sequence
  Synthetic Polynucleotide
taatacgactcactatagggattgcgtaaacgatgtaactgcatacgtcaaacagaggagatgacgtatgcagttacataacctggcggcagcgcaaaagatg

SEQ ID NO: 61879 - DNA, 103 bp, Artificial Sequence
  Synthetic Polynucleotide
taatacgactcactatagggtgactattgcgtaaacgatgtaactgcataaacagaggagatatgcaatgacatcgtttaacctggcggcagcgcaaaagatg

SEQ ID NO: 61880 - DNA, 103 bp, Artificial Sequence
  Synthetic Polynucleotide
taatacgactcactatagggcagtctgactattgcgtaaacgatgtaactaacagaggagaagttacatggtttacgcaaacctggcggcagcgcaaaagatg

SEQ ID NO: 61881 - DNA, 103 bp, Artificial Sequence
  Synthetic Polynucleotide
taatacgactcactatagggttctatcgcctacgataggacacgtaaaagaacagaggagacttttaatggtcctatcgaacctggcggcagcgcaaaagatg

SEQ ID NO: 61882 - DNA, 103 bp, Artificial Sequence
  Synthetic Polynucleotide
taatacgactcactatagggaactacagtctgactattgcgtaaacgatgaacagaggagacatcgtatgcgcaatagtaacctggcggcagcgcaaaagatg

SEQ ID NO: 61883 - DNA, 103 bp, Artificial Sequence
  Synthetic Polynucleotide
taatacgactcactatagggaatagaactacagtctgactattgcgtaaaaacagaggagatttacgatgtagtcagacaacctggcggcagcgcaaaagatg

SEQ ID NO: 61884 - DNA, 103 bp, Artificial Sequence
  Synthetic Polynucleotide
taatacgactcactatagggagcataatagaactacagtctgactattgcaacagaggagagcaataatgagactgtagaacctggcggcagcgcaaaagatg

SEQ ID NO: 61885 - DNA, 103 bp, Artificial Sequence
  Synthetic Polynucleotide
taatacgactcactatagggtaggaagcataatagaactacagtctgactaacagaggagaagtcagatggtagttctaaacctggcggcagcgcaaaagatg

SEQ ID NO: 61886 - DNA, 103 bp, Artificial Sequence
  Synthetic Polynucleotide
taatacgactcactatagggtaatgtaggaagcataatagaactacagtcaacagaggagagactgtatgtctattatgaacctggcggcagcgcaaaagatg

SEQ ID NO: 61887 - DNA, 103 bp, Artificial Sequence
  Synthetic Polynucleotide
taatacgactcactatagggcctcctaatgtaggaagcataatagaactaaacagaggagatagttcatgtatgcttccaacctggcggcagcgcaaaagatg

SEQ ID NO: 61888 - DNA, 103 bp, Artificial Sequence
  Synthetic Polynucleotide
taatacgactcactatagggctgttcctcctaatgtaggaagcataatagaacagaggagactattaatgttcctacataacctggcggcagcgcaaaagatg

SEQ ID NO: 61889 - DNA, 103 bp, Artificial Sequence
  Synthetic Polynucleotide
taatacgactcactatagggtaaaactgttcctcctaatgtaggaagcataacagaggagaatgcttatgacattaggaaacctggcggcagcgcaaaagatg

SEQ ID NO: 61890 - DNA, 103 bp, Artificial Sequence
  Synthetic Polynucleotide
taatacgactcactataggggactttaaaactgttcctcctaatgtaggaaacagaggagatcctacatgaggaggaacaacctggcggcagcgcaaaagatg

SEQ ID NO: 61891 - DNA, 103 bp, Artificial Sequence
  Synthetic Polynucleotide
taatacgactcactatagggcaagagactttaaaactgttcctcctaatgaacagaggagacattagatggaacagtttaacctggcggcagcgcaaaagatg

SEQ ID NO: 61892 - DNA, 103 bp, Artificial Sequence
  Synthetic Polynucleotide
taatacgactcactatagggagcggttctatcgcctacgataggacacgtaacagaggagaacgtgtatgatcgtaggcaacctggcggcagcgcaaaagatg

SEQ ID NO: 61893 - DNA, 103 bp, Artificial Sequence
  Synthetic Polynucleotide
taatacgactcactatagggaaaaccaagagactttaaaactgttcctccaacagaggagaggaggaatggttttaaagaacctggcggcagcgcaaaagatg

SEQ ID NO: 61894 - DNA, 103 bp, Artificial Sequence
  Synthetic Polynucleotide
taatacgactcactatagggagattaaaaccaagagactttaaaactgttaacagaggagaaacagtatgaaagtctctaacctggcggcagcgcaaaagatg

SEQ ID NO: 61895 - DNA, 103 bp, Artificial Sequence
  Synthetic Polynucleotide
taatacgactcactataggggtaatagattaaaaccaagagactttaaaaaacagaggagattttaaatgctcttggttaacctggcggcagcgcaaaagatg

SEQ ID NO: 61896 - DNA, 103 bp, Artificial Sequence
  Synthetic Polynucleotide
taatacgactcactatagggtaacggtaatagattaaaaccaagagacttaacagaggagaaagtctatgggttttaataacctggcggcagcgcaaaagatg

SEQ ID NO: 61897 - DNA, 103 bp, Artificial Sequence
  Synthetic Polynucleotide
taatacgactcactatagggaaaactaacggtaatagattaaaaccaagaaacagaggagatcttggatgtaatctattaacctggcggcagcgcaaaagatg

SEQ ID NO: 61898 - DNA, 103 bp, Artificial Sequence
  Synthetic Polynucleotide
taatacgactcactatagggtcataaaaactaacggtaatagattaaaacaacagaggagagttttaatgtattaccgtaacctggcggcagcgcaaaagatg

SEQ ID NO: 61899 - DNA, 103 bp, Artificial Sequence
  Synthetic Polynucleotide
taatacgactcactatagggggatttcataaaaactaacggtaatagattaacagaggagaaatctaatgccgttagttaacctggcggcagcgcaaaagatg

SEQ ID NO: 61900 - DNA, 103 bp, Artificial Sequence
  Synthetic Polynucleotide
taatacgactcactatagggacaaaggatttcataaaaactaacggtaataacagaggagaattaccatgagtttttataacctggcggcagcgcaaaagatg

SEQ ID NO: 61901 - DNA, 103 bp, Artificial Sequence
  Synthetic Polynucleotide
taatacgactcactatagggataaaacaaaggatttcataaaaactaacgaacagaggagacgttagatgttatgaaataacctggcggcagcgcaaaagatg

SEQ ID NO: 61902 - DNA, 103 bp, Artificial Sequence
  Synthetic Polynucleotide
taatacgactcactatagggagtggataaaacaaaggatttcataaaaacaacagaggagagtttttatgaaatcctttaacctggcggcagcgcaaaagatg

SEQ ID NO: 61903 - DNA, 103 bp, Artificial Sequence
  Synthetic Polynucleotide
taatacgactcactatagggatatgctagtatgctcgaacatggatcctaaacagaggagataggatatgtgttcgagcaacctggcggcagcgcaaaagatg

SEQ ID NO: 61904 - DNA, 103 bp, Artificial Sequence
  Synthetic Polynucleotide
taatacgactcactatagggtttttagcggttctatcgcctacgataggaaacagaggagatcctatatgaggcgatagaacctggcggcagcgcaaaagatg

SEQ ID NO: 61905 - DNA, 103 bp, Artificial Sequence
  Synthetic Polynucleotide
taatacgactcactatagggtgtgaagtggataaaacaaaggatttcataaacagaggagatatgaaatgctttgttttaacctggcggcagcgcaaaagatg

SEQ ID NO: 61906 - DNA, 103 bp, Artificial Sequence
  Synthetic Polynucleotide
taatacgactcactatagggtaaaatgtgaagtggataaaacaaaggattaacagaggagaaatcctatgttttatccaaacctggcggcagcgcaaaagatg

SEQ ID NO: 61907 - DNA, 103 bp, Artificial Sequence
  Synthetic Polynucleotide
taatacgactcactatagggttatttaaaatgtgaagtggataaaacaaaaacagaggagatttgttatgtccacttcaaacctggcggcagcgcaaaagatg

SEQ ID NO: 61908 - DNA, 103 bp, Artificial Sequence
  Synthetic Polynucleotide
taatacgactcactataggggacatttatttaaaatgtgaagtggataaaaacagaggagatttatcatgttcacatttaacctggcggcagcgcaaaagatg

SEQ ID NO: 61909 - DNA, 103 bp, Artificial Sequence
  Synthetic Polynucleotide
taatacgactcactatagggtagtggacatttatttaaaatgtgaagtggaacagaggagaccacttatgattttaaataacctggcggcagcgcaaaagatg

SEQ ID NO: 61910 - DNA, 103 bp, Artificial Sequence
  Synthetic Polynucleotide
taatacgactcactatagggatgtatagtggacatttatttaaaatgtgaaacagaggagatcacatatgaaataaatgaacctggcggcagcgcaaaagatg

SEQ ID NO: 61911 - DNA, 103 bp, Artificial Sequence
  Synthetic Polynucleotide
taatacgactcactataggggaagaatgtatagtggacatttatttaaaaaacagaggagattttaaatgaatgtccacaacctggcggcagcgcaaaagatg

SEQ ID NO: 61912 - DNA, 103 bp, Artificial Sequence
  Synthetic Polynucleotide
taatacgactcactatagggtaacagaagaatgtatagtggacatttattaacagaggagaaataaaatgccactatacaacctggcggcagcgcaaaagatg

SEQ ID NO: 61913 - DNA, 103 bp, Artificial Sequence
  Synthetic Polynucleotide
taatacgactcactatagggaaaattaacagaagaatgtatagtggacataacagaggagaatgtccatgatacattctaacctggcggcagcgcaaaagatg

SEQ ID NO: 61914 - DNA, 103 bp, Artificial Sequence
  Synthetic Polynucleotide
taatacgactcactatagggctagtaaaattaacagaagaatgtatagtgaacagaggagacactatatgttcttctgtaacctggcggcagcgcaaaagatg

SEQ ID NO: 61915 - DNA, 103 bp, Artificial Sequence
  Synthetic Polynucleotide
taatacgactcactatagggtaggctttttagcggttctatcgcctacgaaacagaggagatcgtagatgatagaaccgaacctggcggcagcgcaaaagatg

SEQ ID NO: 61916 - DNA, 103 bp, Artificial Sequence
  Synthetic Polynucleotide
taatacgactcactatagggacgatctagtaaaattaacagaagaatgtaaacagaggagatacattatgctgttaattaacctggcggcagcgcaaaagatg

SEQ ID NO: 61917 - DNA, 103 bp, Artificial Sequence
  Synthetic Polynucleotide
taatacgactcactatagggatatgacgatctagtaaaattaacagaagaaacagaggagatcttctatgaattttactaacctggcggcagcgcaaaagatg

SEQ ID NO: 61918 - DNA, 103 bp, Artificial Sequence
  Synthetic Polynucleotide
taatacgactcactatagggatgacatatgacgatctagtaaaattaacaaacagaggagatgttaaatgtactagatcaacctggcggcagcgcaaaagatg

SEQ ID NO: 61919 - DNA, 103 bp, Artificial Sequence
  Synthetic Polynucleotide
taatacgactcactatagggattctatgacatatgacgatctagtaaaataacagaggagaattttaatggatcgtcataacctggcggcagcgcaaaagatg

SEQ ID NO: 61920 - DNA, 103 bp, Artificial Sequence
  Synthetic Polynucleotide
taatacgactcactatagggtataaattctatgacatatgacgatctagtaacagaggagaactagaatgtcatatgtcaacctggcggcagcgcaaaagatg

SEQ ID NO: 61921 - DNA, 103 bp, Artificial Sequence
  Synthetic Polynucleotide
taatacgactcactataggggaacctataaattctatgacatatgacgataacagaggagaatcgtcatgtgtcatagaaacctggcggcagcgcaaaagatg

SEQ ID NO: 61922 - DNA, 103 bp, Artificial Sequence
  Synthetic Polynucleotide
taatacgactcactatagggctatggaacctataaattctatgacatatgaacagaggagacatatgatgtagaatttaaacctggcggcagcgcaaaagatg

SEQ ID NO: 61923 - DNA, 103 bp, Artificial Sequence
  Synthetic Polynucleotide
taatacgactcactatagggatggactatggaacctataaattctatgacaacagaggagagtcataatgtttataggtaacctggcggcagcgcaaaagatg

SEQ ID NO: 61924 - DNA, 103 bp, Artificial Sequence
  Synthetic Polynucleotide
taatacgactcactataggggatccatggactatggaacctataaattctaacagaggagaagaattatgaggttccataacctggcggcagcgcaaaagatg

SEQ ID NO: 61925 - DNA, 103 bp, Artificial Sequence
  Synthetic Polynucleotide
taatacgactcactataggggtttggatccatggactatggaacctataaaacagaggagattatagatgccatagtccaacctggcggcagcgcaaaagatg

SEQ ID NO: 61926 - DNA, 103 bp, Artificial Sequence
  Synthetic Polynucleotide
taatacgactcactatagggttcgataggctttttagcggttctatcgccaacagaggagaggcgatatgaccgctaaaaacctggcggcagcgcaaaagatg

SEQ ID NO: 61927 - DNA, 103 bp, Artificial Sequence
  Synthetic Polynucleotide
taatacgactcactatagggtactagtttggatccatggactatggaaccaacagaggagaggttccatggtccatggaaacctggcggcagcgcaaaagatg

SEQ ID NO: 61928 - DNA, 103 bp, Artificial Sequence
  Synthetic Polynucleotide
taatacgactcactatagggaagtttactagtttggatccatggactatgaacagaggagacatagtatgtggatccaaaacctggcggcagcgcaaaagatg

SEQ ID NO: 61929 - DNA, 103 bp, Artificial Sequence
  Synthetic Polynucleotide
taatacgactcactatagggacgcgaagtttactagtttggatccatggaaacagaggagatccatgatgccaaactagaacctggcggcagcgcaaaagatg

SEQ ID NO: 61930 - DNA, 103 bp, Artificial Sequence
  Synthetic Polynucleotide
taatacgactcactatagggtgtatacgcgaagtttactagtttggatccaacagaggagaggatccatgctagtaaacaacctggcggcagcgcaaaagatg

SEQ ID NO: 61931 - DNA, 103 bp, Artificial Sequence
  Synthetic Polynucleotide
taatacgactcactataggggatactgtatacgcgaagtttactagtttgaacagaggagacaaactatgaaacttcgcaacctggcggcagcgcaaaagatg

SEQ ID NO: 61932 - DNA, 103 bp, Artificial Sequence
  Synthetic Polynucleotide
taatacgactcactatagggatcgcgatactgtatacgcgaagtttactaaacagaggagatagtaaatgtcgcgtataaacctggcggcagcgcaaaagatg

SEQ ID NO: 61933 - DNA, 103 bp, Artificial Sequence
  Synthetic Polynucleotide
taatacgactcactatagggcactaatcgcgatactgtatacgcgaagttaacagaggagaaacttcatgtatacagtaaacctggcggcagcgcaaaagatg

SEQ ID NO: 61934 - DNA, 103 bp, Artificial Sequence
  Synthetic Polynucleotide
taatacgactcactataggggtatacactaatcgcgatactgtatacgcgaacagaggagacgcgtaatgagtatcgcgaacctggcggcagcgcaaaagatg

SEQ ID NO: 61935 - DNA, 103 bp, Artificial Sequence
  Synthetic Polynucleotide
taatacgactcactatagggttggtgtatacactaatcgcgatactgtataacagaggagaatacagatgcgcgattagaacctggcggcagcgcaaaagatg

SEQ ID NO: 61936 - DNA, 103 bp, Artificial Sequence
  Synthetic Polynucleotide
taatacgactcactatagggtacagttggtgtatacactaatcgcgatacaacagaggagagtatcgatgttagtgtataacctggcggcagcgcaaaagatg

SEQ ID NO: 61937 - DNA, 103 bp, Artificial Sequence
  Synthetic Polynucleotide
taatacgactcactatagggagaaattcgataggctttttagcggttctaaacagaggagatagaacatgtaaaaagccaacctggcggcagcgcaaaagatg

SEQ ID NO: 61938 - DNA, 103 bp, Artificial Sequence
  Synthetic Polynucleotide
taatacgactcactatagggtttcatacagttggtgtatacactaatcgcaacagaggagagcgattatggtatacaccaacctggcggcagcgcaaaagatg

SEQ ID NO: 61939 - DNA, 103 bp, Artificial Sequence
  Synthetic Polynucleotide
taatacgactcactatagggttaattttcatacagttggtgtatacactaaacagaggagatagtgtatgcaccaactgaacctggcggcagcgcaaaagatg

SEQ ID NO: 61940 - DNA, 103 bp, Artificial Sequence
  Synthetic Polynucleotide
taatacgactcactatagggttttcttaattttcatacagttggtgtataaacagaggagatatacaatgactgtatgaaacctggcggcagcgcaaaagatg

SEQ ID NO: 61941 - DNA, 103 bp, Artificial Sequence
  Synthetic Polynucleotide
taatacgactcactatagggaactgttttcttaattttcatacagttggtaacagaggagaaccaacatgatgaaaattaacctggcggcagcgcaaaagatg

SEQ ID NO: 61942 - DNA, 103 bp, Artificial Sequence
  Synthetic Polynucleotide
taatacgactcactatagggtattaaactgttttcttaattttcatacagaacagaggagactgtatatgaattaagaaaacctggcggcagcgcaaaagatg

SEQ ID NO: 61943 - DNA, 103 bp, Artificial Sequence
  Synthetic Polynucleotide
taatacgactcactatagggtgatctattaaactgttttcttaattttcaaacagaggagatgaaaaatgagaaaacagaacctggcggcagcgcaaaagatg

SEQ ID NO: 61944 - DNA, 103 bp, Artificial Sequence
  Synthetic Polynucleotide
taatacgactcactatagggtctgttgatctattaaactgttttcttaataacagaggagaattaagatgacagtttaaaacctggcggcagcgcaaaagatg

SEQ ID NO: 61945 - DNA, 103 bp, Artificial Sequence
  Synthetic Polynucleotide
taatacgactcactatagggatatttctgttgatctattaaactgttttcaacagaggagagaaaacatgttaatagataacctggcggcagcgcaaaagatg

SEQ ID NO: 61946 - DNA, 103 bp, Artificial Sequence
  Synthetic Polynucleotide
taatacgactcactatagggattaaatatttctgttgatctattaaactgaacagaggagacagtttatgagatcaacaaacctggcggcagcgcaaaagatg

SEQ ID NO: 61947 - DNA, 103 bp, Artificial Sequence
  Synthetic Polynucleotide
taatacgactcactatagggggaggattaaatatttctgttgatctattaaacagaggagataatagatgaacagaaataacctggcggcagcgcaaaagatg

SEQ ID NO: 61948 - DNA, 103 bp, Artificial Sequence
  Synthetic Polynucleotide
taatacgactcactatagggtttgtagaaattcgataggctttttagcggaacagaggagaccgctaatgagcctatcgaacctggcggcagcgcaaaagatg

SEQ ID NO: 61949 - DNA, 103 bp, Artificial Sequence
  Synthetic Polynucleotide
taatacgactcactatagggcaaacggaggattaaatatttctgttgatcaacagaggagagatcaaatgaaatatttaaacctggcggcagcgcaaaagatg

SEQ ID NO: 61950 - DNA, 103 bp, Artificial Sequence
  Synthetic Polynucleotide
taatacgactcactatagggtgtatcaaacggaggattaaatatttctgtaacagaggagaacagaaatgtttaatcctaacctggcggcagcgcaaaagatg

SEQ ID NO: 61951 - DNA, 103 bp, Artificial Sequence
  Synthetic Polynucleotide
taatacgactcactataggggcatctgtatcaaacggaggattaaatattaacagaggagaaatattatgtcctccgttaacctggcggcagcgcaaaagatg

SEQ ID NO: 61952 - DNA, 103 bp, Artificial Sequence
  Synthetic Polynucleotide
taatacgactcactatagggatggtgcatctgtatcaaacggaggattaaaacagaggagattaatcatgcgtttgataaacctggcggcagcgcaaaagatg

SEQ ID NO: 61953 - DNA, 103 bp, Artificial Sequence
  Synthetic Polynucleotide
taatacgactcactatagggtaaatatggtgcatctgtatcaaacggaggaacagaggagacctccgatggatacagataacctggcggcagcgcaaaagatg

SEQ ID NO: 61954 - DNA, 103 bp, Artificial Sequence
  Synthetic Polynucleotide
taatacgactcactatagggatccataaatatggtgcatctgtatcaaacaacagaggagagtttgaatgagatgcaccaacctggcggcagcgcaaaagatg

SEQ ID NO: 61955 - DNA, 103 bp, Artificial Sequence
  Synthetic Polynucleotide
taatacgactcactatagggccgaaatccataaatatggtgcatctgtataacagaggagaatacagatgcaccatattaacctggcggcagcgcaaaagatg

SEQ ID NO: 61956 - DNA, 103 bp, Artificial Sequence
  Synthetic Polynucleotide
taatacgactcactatagggtgaatccgaaatccataaatatggtgcatcaacagaggagagatgcaatgtatttatggaacctggcggcagcgcaaaagatg

SEQ ID NO: 61957 - DNA, 103 bp, Artificial Sequence
  Synthetic Polynucleotide
taatacgactcactatagggacgtgtgaatccgaaatccataaatatggtaacagaggagaaccataatgatggatttcaacctggcggcagcgcaaaagatg

SEQ ID NO: 61958 - DNA, 103 bp, Artificial Sequence
  Synthetic Polynucleotide
taatacgactcactatagggaaacaacgtgtgaatccgaaatccataaataacagaggagaatttatatgtttcggattaacctggcggcagcgcaaaagatg

SEQ ID NO: 61959 - DNA, 103 bp, Artificial Sequence
  Synthetic Polynucleotide
taatacgactcactatagggattcttttgtagaaattcgataggctttttaacagaggagaaaaaagatgatcgaatttaacctggcggcagcgcaaaagatg

SEQ ID NO: 61960 - DNA, 103 bp, Artificial Sequence
  Synthetic Polynucleotide
taatacgactcactatagggcagacaaacaacgtgtgaatccgaaatccaaacagaggagatggattatggattcacacaacctggcggcagcgcaaaagatg

SEQ ID NO: 61961 - DNA, 103 bp, Artificial Sequence
  Synthetic Polynucleotide
taatacgactcactatagggcccctcagacaaacaacgtgtgaatccgaaaacagaggagattcggaatgacacgttgtaacctggcggcagcgcaaaagatg

SEQ ID NO: 61962 - DNA, 103 bp, Artificial Sequence
  Synthetic Polynucleotide
taatacgactcactatagggacgaacccctcagacaaacaacgtgtgaataacagaggagaattcacatgttgtttgtcaacctggcggcagcgcaaaagatg

SEQ ID NO: 61963 - DNA, 103 bp, Artificial Sequence
  Synthetic Polynucleotide
taatacgactcactataggggctagacgaacccctcagacaaacaacgtgaacagaggagacacgttatgtgtctgaggaacctggcggcagcgcaaaagatg

SEQ ID NO: 61964 - DNA, 103 bp, Artificial Sequence
  Synthetic Polynucleotide
taatacgactcactataggggcaacgctagacgaacccctcagacaaacaaacagaggagatgtttgatggaggggttcaacctggcggcagcgcaaaagatg

SEQ ID NO: 61965 - DNA, 103 bp, Artificial Sequence
  Synthetic Polynucleotide
taatacgactcactatagggtagaagcaacgctagacgaacccctcagacaacagaggagagtctgaatggttcgtctaaacctggcggcagcgcaaaagatg

SEQ ID NO: 61966 - DNA, 103 bp, Artificial Sequence
  Synthetic Polynucleotide
taatacgactcactatagggttatgtagaagcaacgctagacgaacccctaacagaggagaaggggtatgtctagcgttaacctggcggcagcgcaaaagatg

SEQ ID NO: 61967 - DNA, 103 bp, Artificial Sequence
  Synthetic Polynucleotide
taatacgactcactataggggaagtttatgtagaagcaacgctagacgaaaacagaggagattcgtcatgcgttgcttcaacctggcggcagcgcaaaagatg

SEQ ID NO: 61968 - DNA, 103 bp, Artificial Sequence
  Synthetic Polynucleotide
taatacgactcactataggggaatagaagtttatgtagaagcaacgctagaacagaggagactagcgatgcttctacataacctggcggcagcgcaaaagatg

SEQ ID NO: 61969 - DNA, 103 bp, Artificial Sequence
  Synthetic Polynucleotide
taatacgactcactatagggtatgggaatagaagtttatgtagaagcaacaacagaggagagttgctatgacataaactaacctggcggcagcgcaaaagatg

SEQ ID NO: 61970 - DNA, 103 bp, Artificial Sequence
  Synthetic Polynucleotide
taatacgactcactatagggaatagattcttttgtagaaattcgataggcaacagaggagagcctatatgatttctacaaacctggcggcagcgcaaaagatg

SEQ ID NO: 61971 - DNA, 103 bp, Artificial Sequence
  Synthetic Polynucleotide
taatacgactcactataggggaatatatgggaatagaagtttatgtagaaaacagaggagattctacatgaacttctataacctggcggcagcgcaaaagatg

SEQ ID NO: 61972 - DNA, 103 bp, Artificial Sequence
  Synthetic Polynucleotide
taatacgactcactatagggataaagaatatatgggaatagaagtttatgaacagaggagacataaaatgctattcccaaacctggcggcagcgcaaaagatg

SEQ ID NO: 61973 - DNA, 103 bp, Artificial Sequence
  Synthetic Polynucleotide
taatacgactcactatagggtgataataaagaatatatgggaatagaagtaacagaggagaacttctatgcccatatataacctggcggcagcgcaaaagatg

SEQ ID NO: 61974 - DNA, 103 bp, Artificial Sequence
  Synthetic Polynucleotide
taatacgactcactataggggattctgataataaagaatatatgggaataaacagaggagatattccatgatattctttaacctggcggcagcgcaaaagatg

SEQ ID NO: 61975 - DNA, 103 bp, Artificial Sequence
  Synthetic Polynucleotide
taatacgactcactatagggtatgcgattctgataataaagaatatatggaacagaggagaccatatatgctttattataacctggcggcagcgcaaaagatg

SEQ ID NO: 61976 - DNA, 103 bp, Artificial Sequence
  Synthetic Polynucleotide
taatacgactcactatagggatcggtatgcgattctgataataaagaataaacagaggagatattctatgttatcagaaaacctggcggcagcgcaaaagatg

SEQ ID NO: 61977 - DNA, 103 bp, Artificial Sequence
  Synthetic Polynucleotide
taatacgactcactataggggataaatcggtatgcgattctgataataaaaacagaggagatttattatgagaatcgcaaacctggcggcagcgcaaaagatg

SEQ ID NO: 61978 - DNA, 103 bp, Artificial Sequence
  Synthetic Polynucleotide
taatacgactcactatagggatgatgataaatcggtatgcgattctgataaacagaggagatatcagatgcgcataccgaacctggcggcagcgcaaaagatg

SEQ ID NO: 61979 - DNA, 103 bp, Artificial Sequence
  Synthetic Polynucleotide
taatacgactcactatagggagtgtatgatgataaatcggtatgcgattcaacagaggagagaatcgatgaccgatttaaacctggcggcagcgcaaaagatg

SEQ ID NO: 61980 - DNA, 103 bp, Artificial Sequence
  Synthetic Polynucleotide
taatacgactcactatagggcaaacagtgtatgatgataaatcggtatgcaacagaggagagcatacatgtttatcatcaacctggcggcagcgcaaaagatg

SEQ ID NO: 61981 - DNA, 103 bp, Artificial Sequence
  Synthetic Polynucleotide
taatacgactcactatagggcatataatagattcttttgtagaaattcgaaacagaggagatcgaatatgtacaaaagaaacctggcggcagcgcaaaagatg

SEQ ID NO: 61982 - DNA, 103 bp, Artificial Sequence
  Synthetic Polynucleotide
taatacgactcactataggggttttcaaacagtgtatgatgataaatcggaacagaggagaccgattatgcatcatacaaacctggcggcagcgcaaaagatg

SEQ ID NO: 61983 - DNA, 103 bp, Artificial Sequence
  Synthetic Polynucleotide
taatacgactcactatagggatttagttttcaaacagtgtatgatgataaaacagaggagattatcaatgtacactgttaacctggcggcagcgcaaaagatg

SEQ ID NO: 61984 - DNA, 103 bp, Artificial Sequence
  Synthetic Polynucleotide
taatacgactcactatagggataccatttagttttcaaacagtgtatgataacagaggagaatcataatgtgtttgaaaaacctggcggcagcgcaaaagatg

SEQ ID NO: 61985 - DNA, 103 bp, Artificial Sequence
  Synthetic Polynucleotide
taatacgactcactatagggtgtgtataccatttagttttcaaacagtgtaacagaggagaacactgatggaaaactaaaacctggcggcagcgcaaaagatg

SEQ ID NO: 61986 - DNA, 103 bp, Artificial Sequence
  Synthetic Polynucleotide
taatacgactcactatagggtttgatgtgtataccatttagttttcaaacaacagaggagagtttgaatgctaaatggtaacctggcggcagcgcaaaagatg

SEQ ID NO: 61987 - DNA, 103 bp, Artificial Sequence
  Synthetic Polynucleotide
taatacgactcactataggggttattttgatgtgtataccatttagttttaacagaggagaaaaactatgtggtatacaaacctggcggcagcgcaaaagatg

SEQ ID NO: 61988 - DNA, 103 bp, Artificial Sequence
  Synthetic Polynucleotide
taatacgactcactatagggtatttgttattttgatgtgtataccatttaaacagaggagataaatgatgtacacatcaaacctggcggcagcgcaaaagatg

SEQ ID NO: 61989 - DNA, 103 bp, Artificial Sequence
  Synthetic Polynucleotide
taatacgactcactataggggttagtatttgttattttgatgtgtataccaacagaggagaggtataatgatcaaaataaacctggcggcagcgcaaaagatg

SEQ ID NO: 61990 - DNA, 103 bp, Artificial Sequence
  Synthetic Polynucleotide
taatacgactcactatagggtactcgttagtatttgttattttgatgtgtaacagaggagaacacatatgaataacaaaaacctggcggcagcgcaaaagatg

SEQ ID NO: 61991 - DNA, 103 bp, Artificial Sequence
  Synthetic Polynucleotide
taatacgactcactataggggaatgtactcgttagtatttgttattttgaaacagaggagatcaaaaatgcaaatactaaacctggcggcagcgcaaaagatg

SEQ ID NO: 61992 - DNA, 103 bp, Artificial Sequence
  Synthetic Polynucleotide
taatacgactcactatagggtataccatataatagattcttttgtagaaaaacagaggagatttctaatgaagaatctaaacctggcggcagcgcaaaagatg

SEQ ID NO: 61993 - DNA, 103 bp, Artificial Sequence
  Synthetic Polynucleotide
taatacgactcactatagggttgcagaatgtactcgttagtatttgttataacagaggagaataacaatgactaacgagaacctggcggcagcgcaaaagatg

SEQ ID NO: 61994 - DNA, 103 bp, Artificial Sequence
  Synthetic Polynucleotide
taatacgactcactatagggcaatattgcagaatgtactcgttagtatttaacagaggagaaaatacatgcgagtacataacctggcggcagcgcaaaagatg

SEQ ID NO: 61995 - DNA, 103 bp, Artificial Sequence
  Synthetic Polynucleotide
taatacgactcactataggggataacaatattgcagaatgtactcgttagaacagaggagactaacgatgacattctgcaacctggcggcagcgcaaaagatg

SEQ ID NO: 61996 - DNA, 103 bp, Artificial Sequence
  Synthetic Polynucleotide
taatacgactcactatagggattacgataacaatattgcagaatgtactcaacagaggagagagtacatgctgcaatataacctggcggcagcgcaaaagatg

SEQ ID NO: 61997 - DNA, 103 bp, Artificial Sequence
  Synthetic Polynucleotide
taatacgactcactatagggttccaattacgataacaatattgcagaatgaacagaggagacattctatgatattgttaaacctggcggcagcgcaaaagatg

SEQ ID NO: 61998 - DNA, 103 bp, Artificial Sequence
  Synthetic Polynucleotide
taatacgactcactatagggtaattttccaattacgataacaatattgcaaacagaggagatgcaatatggttatcgtaaacctggcggcagcgcaaaagatg

SEQ ID NO: 61999 - DNA, 103 bp, Artificial Sequence
  Synthetic Polynucleotide
taatacgactcactatagggaacactaattttccaattacgataacaataaacagaggagatattgtatgcgtaattggaacctggcggcagcgcaaaagatg

SEQ ID NO: 62000 - DNA, 103 bp, Artificial Sequence
  Synthetic Polynucleotide
taatacgactcactatagggacccgaacactaattttccaattacgataaaacagaggagattatcgatgttggaaaataacctggcggcagcgcaaaagatg

SEQ ID NO: 62001 - DNA, 103 bp, Artificial Sequence
  Synthetic Polynucleotide
taatacgactcactatagggaactcacccgaacactaattttccaattacaacagaggagagtaattatgaaattagtgaacctggcggcagcgcaaaagatg

SEQ ID NO: 62002 - DNA, 103 bp, Artificial Sequence
  Synthetic Polynucleotide
taatacgactcactatagggaatccaactcacccgaacactaattttccaaacagaggagatggaaaatgagtgttcggaacctggcggcagcgcaaaagatg

SEQ ID NO: 62003 - DNA, 103 bp, Artificial Sequence
  Synthetic Polynucleotide
taatacgactcactatagggctccctataccatataatagattcttttgtaacagaggagaacaaaaatgtctattataaacctggcggcagcgcaaaagatg

SEQ ID NO: 62004 - DNA, 103 bp, Artificial Sequence
  Synthetic Polynucleotide
taatacgactcactatagggcacataatccaactcacccgaacactaattaacagaggagaaattagatgtcgggtgagaacctggcggcagcgcaaaagatg

SEQ ID NO: 62005 - DNA, 103 bp, Artificial Sequence
  Synthetic Polynucleotide
taatacgactcactataggggtactcacataatccaactcacccgaacacaacagaggagagtgttcatgtgagttggaaacctggcggcagcgcaaaagatg

SEQ ID NO: 62006 - DNA, 103 bp, Artificial Sequence
  Synthetic Polynucleotide
taatacgactcactatagggatccagtactcacataatccaactcacccgaacagaggagacgggtgatgtggattatgaacctggcggcagcgcaaaagatg

SEQ ID NO: 62007 - DNA, 103 bp, Artificial Sequence
  Synthetic Polynucleotide
taatacgactcactatagggatgcaatccagtactcacataatccaactcaacagaggagagagttgatgtatgtgagtaacctggcggcagcgcaaaagatg

SEQ ID NO: 62008 - DNA, 103 bp, Artificial Sequence
  Synthetic Polynucleotide
taatacgactcactatagggataatatgcaatccagtactcacataatccaacagaggagaggattaatggagtactggaacctggcggcagcgcaaaagatg

SEQ ID NO: 62009 - DNA, 103 bp, Artificial Sequence
  Synthetic Polynucleotide
taatacgactcactatagggaaaatataatatgcaatccagtactcacataacagaggagaatgtgaatgctggattgcaacctggcggcagcgcaaaagatg

SEQ ID NO: 62010 - DNA, 103 bp, Artificial Sequence
  Synthetic Polynucleotide
taatacgactcactatagggaatataaaatataatatgcaatccagtactaacagaggagaagtactatgttgcatattaacctggcggcagcgcaaaagatg

SEQ ID NO: 62011 - DNA, 103 bp, Artificial Sequence
  Synthetic Polynucleotide
taatacgactcactatagggtataaaatataaaatataatatgcaatccaaacagaggagatggattatgtattatattaacctggcggcagcgcaaaagatg

SEQ ID NO: 62012 - DNA, 103 bp, Artificial Sequence
  Synthetic Polynucleotide
taatacgactcactatagggtaaaatataaaatataaaatataatatgcaaacagaggagatgcataatgtattttataaacctggcggcagcgcaaaagatg

SEQ ID NO: 62013 - DNA, 103 bp, Artificial Sequence
  Synthetic Polynucleotide
taatacgactcactatagggaaatataaaatataaaatataaaatataataacagaggagaattataatgtatattttaaacctggcggcagcgcaaaagatg

SEQ ID NO: 62014 - DNA, 103 bp, Artificial Sequence
  Synthetic Polynucleotide
taatacgactcactatagggtacaaatatgctagtatgctcgaacatggaaacagaggagatccatgatggagcatactaacctggcggcagcgcaaaagatg

SEQ ID NO: 62015 - DNA, 103 bp, Artificial Sequence
  Synthetic Polynucleotide
taatacgactcactatagggatactctccctataccatataatagattctaacagaggagaagaatcatgtatatggtaaacctggcggcagcgcaaaagatg

SEQ ID NO: 62016 - DNA, 103 bp, Artificial Sequence
  Synthetic Polynucleotide
taatacgactcactatagggttacaaaatataaaatataaaatataaaataacagaggagaattttaatgtttatatttaacctggcggcagcgcaaaagatg

SEQ ID NO: 62017 - DNA, 103 bp, Artificial Sequence
  Synthetic Polynucleotide
taatacgactcactatagggtcttattacaaaatataaaatataaaatataacagaggagaatatttatgattttatataacctggcggcagcgcaaaagatg

SEQ ID NO: 62018 - DNA, 103 bp, Artificial Sequence
  Synthetic Polynucleotide
taatacgactcactatagggtctattcttattacaaaatataaaatataaaacagaggagattatatatgatattttgtaacctggcggcagcgcaaaagatg

SEQ ID NO: 62019 - DNA, 103 bp, Artificial Sequence
  Synthetic Polynucleotide
taatacgactcactatagggagcattctattcttattacaaaatataaaaaacagaggagattttatatgttgtaataaaacctggcggcagcgcaaaagatg

SEQ ID NO: 62020 - DNA, 103 bp, Artificial Sequence
  Synthetic Polynucleotide
taatacgactcactatagggacattagcattctattcttattacaaaataaacagaggagatattttatgataagaataaacctggcggcagcgcaaaagatg

SEQ ID NO: 62021 - DNA, 103 bp, Artificial Sequence
  Synthetic Polynucleotide
taatacgactcactatagggacttgacattagcattctattcttattacaaacagaggagatgtaatatgaatagaatgaacctggcggcagcgcaaaagatg

SEQ ID NO: 62022 - DNA, 103 bp, Artificial Sequence
  Synthetic Polynucleotide
taatacgactcactatagggaataaacttgacattagcattctattcttaaacagaggagataagaaatgaatgctaataacctggcggcagcgcaaaagatg

SEQ ID NO: 62023 - DNA, 103 bp, Artificial Sequence
  Synthetic Polynucleotide
taatacgactcactatagggattggaataaacttgacattagcattctataacagaggagaatagaaatgtaatgtcaaaacctggcggcagcgcaaaagatg

SEQ ID NO: 62024 - DNA, 103 bp, Artificial Sequence
  Synthetic Polynucleotide
taatacgactcactatagggcatttattggaataaacttgacattagcataacagaggagaatgctaatgtcaagtttaaacctggcggcagcgcaaaagatg

SEQ ID NO: 62025 - DNA, 103 bp, Artificial Sequence
  Synthetic Polynucleotide
taatacgactcactatagggtaagtcatttattggaataaacttgacattaacagaggagaaatgtcatgtttattccaaacctggcggcagcgcaaaagatg

SEQ ID NO: 62026 - DNA, 103 bp, Artificial Sequence
  Synthetic Polynucleotide
taatacgactcactataggggttttatactctccctataccatataatagaacagaggagactattaatgggtatagggaacctggcggcagcgcaaaagatg

SEQ ID NO: 62027 - DNA, 103 bp, Artificial Sequence
  Synthetic Polynucleotide
taatacgactcactatagggtttaataagtcatttattggaataaacttgaacagaggagacaagttatgtccaataaaaacctggcggcagcgcaaaagatg

SEQ ID NO: 62028 - DNA, 103 bp, Artificial Sequence
  Synthetic Polynucleotide
taatacgactcactatagggtgttttttaataagtcatttattggaataaaacagaggagattattcatgtaaatgactaacctggcggcagcgcaaaagatg

SEQ ID NO: 62029 - DNA, 103 bp, Artificial Sequence
  Synthetic Polynucleotide
taatacgactcactatagggatatatgttttttaataagtcatttattggaacagaggagaccaataatggacttattaaacctggcggcagcgcaaaagatg

SEQ ID NO: 62030 - DNA, 103 bp, Artificial Sequence
  Synthetic Polynucleotide
taatacgactcactatagggttattatatatgttttttaataagtcatttaacagaggagaaaatgaatgattaaaaaaaacctggcggcagcgcaaaagatg

SEQ ID NO: 62031 - DNA, 103 bp, Artificial Sequence
  Synthetic Polynucleotide
taatacgactcactataggggttatttattatatatgttttttaataagtaacagaggagaacttatatgaaaacatataacctggcggcagcgcaaaagatg

SEQ ID NO: 62032 - DNA, 103 bp, Artificial Sequence
  Synthetic Polynucleotide
taatacgactcactatagggccattgttatttattatatatgttttttaaaacagaggagattaaaaatgatatataataacctggcggcagcgcaaaagatg

SEQ ID NO: 62033 - DNA, 103 bp, Artificial Sequence
  Synthetic Polynucleotide
taatacgactcactatagggttcagccattgttatttattatatatgtttaacagaggagaaaacatatgtaataaataaacctggcggcagcgcaaaagatg

SEQ ID NO: 62034 - DNA, 103 bp, Artificial Sequence
  Synthetic Polynucleotide
taatacgactcactatagggtgccattcagccattgttatttattatataaacagaggagatatataatgaataacaataacctggcggcagcgcaaaagatg

SEQ ID NO: 62035 - DNA, 103 bp, Artificial Sequence
  Synthetic Polynucleotide
taatacgactcactatagggttttatgccattcagccattgttatttattaacagaggagaaataaaatgcaatggctgaacctggcggcagcgcaaaagatg

SEQ ID NO: 62036 - DNA, 103 bp, Artificial Sequence
  Synthetic Polynucleotide
taatacgactcactataggggataattttatgccattcagccattgttataacagaggagaataacaatggctgaatggaacctggcggcagcgcaaaagatg

SEQ ID NO: 62037 - DNA, 103 bp, Artificial Sequence
  Synthetic Polynucleotide
taatacgactcactatagggttaatgttttatactctccctataccatataacagaggagaatatggatgagggagagtaacctggcggcagcgcaaaagatg

SEQ ID NO: 62038 - DNA, 103 bp, Artificial Sequence
  Synthetic Polynucleotide
taatacgactcactatagggtcctcgataattttatgccattcagccattaacagaggagaaatggcatgatggcataaaacctggcggcagcgcaaaagatg

SEQ ID NO: 62039 - DNA, 103 bp, Artificial Sequence
  Synthetic Polynucleotide
taatacgactcactatagggaaatatcctcgataattttatgccattcagaacagaggagactgaatatgataaaattaaacctggcggcagcgcaaaagatg

SEQ ID NO: 62040 - DNA, 103 bp, Artificial Sequence
  Synthetic Polynucleotide
taatacgactcactatagggttttgaaatatcctcgataattttatgccaaacagaggagatggcatatgattatcgagaacctggcggcagcgcaaaagatg

SEQ ID NO: 62041 - DNA, 103 bp, Artificial Sequence
  Synthetic Polynucleotide
taatacgactcactatagggttattttttgaaatatcctcgataattttaaacagaggagataaaatatgcgaggatataacctggcggcagcgcaaaagatg

SEQ ID NO: 62042 - DNA, 103 bp, Artificial Sequence
  Synthetic Polynucleotide
taatacgactcactatagggaattattattttttgaaatatcctcgataaaacagaggagattatcgatgatatttcaaaacctggcggcagcgcaaaagatg

SEQ ID NO: 62043 - DNA, 103 bp, Artificial Sequence
  Synthetic Polynucleotide
taatacgactcactatagggctcgaaattattattttttgaaatatcctcaacagaggagagaggatatgtcaaaaaataacctggcggcagcgcaaaagatg

SEQ ID NO: 62044 - DNA, 103 bp, Artificial Sequence
  Synthetic Polynucleotide
taatacgactcactataggggcatcctcgaaattattattttttgaaataaacagaggagatatttcatgaaataataaaacctggcggcagcgcaaaagatg

SEQ ID NO: 62045 - DNA, 103 bp, Artificial Sequence
  Synthetic Polynucleotide
taatacgactcactatagggtggcggcatcctcgaaattattattttttgaacagaggagacaaaaaatgataatttcgaacctggcggcagcgcaaaagatg

SEQ ID NO: 62046 - DNA, 103 bp, Artificial Sequence
  Synthetic Polynucleotide
taatacgactcactatagggaacgatggcggcatcctcgaaattattattaacagaggagaaataatatgttcgaggataacctggcggcagcgcaaaagatg

SEQ ID NO: 62047 - DNA, 103 bp, Artificial Sequence
  Synthetic Polynucleotide
taatacgactcactatagggtaatcaacgatggcggcatcctcgaaattaaacagaggagataatttatgggatgccgcaacctggcggcagcgcaaaagatg

SEQ ID NO: 62048 - DNA, 103 bp, Artificial Sequence
  Synthetic Polynucleotide
taatacgactcactataggggacatttaatgttttatactctccctatacaacagaggagagtatagatggagtataaaaacctggcggcagcgcaaaagatg

SEQ ID NO: 62049 - DNA, 103 bp, Artificial Sequence
  Synthetic Polynucleotide
taatacgactcactatagggtcttgtaatcaacgatggcggcatcctcgaaacagaggagatcgaggatgccgccatcgaacctggcggcagcgcaaaagatg

SEQ ID NO: 62050 - DNA, 103 bp, Artificial Sequence
  Synthetic Polynucleotide
taatacgactcactatagggtgtagtcttgtaatcaacgatggcggcatcaacagaggagagatgccatgatcgttgataacctggcggcagcgcaaaagatg

SEQ ID NO: 62051 - DNA, 103 bp, Artificial Sequence
  Synthetic Polynucleotide
taatacgactcactatagggttctttgtagtcttgtaatcaacgatggcgaacagaggagacgccatatgtgattacaaaacctggcggcagcgcaaaagatg

SEQ ID NO: 62052 - DNA, 103 bp, Artificial Sequence
  Synthetic Polynucleotide
taatacgactcactataggggaacattctttgtagtcttgtaatcaacgaaacagaggagatcgttgatgacaagactaaacctggcggcagcgcaaaagatg

SEQ ID NO: 62053 - DNA, 103 bp, Artificial Sequence
  Synthetic Polynucleotide
taatacgactcactatagggcgctagaacattctttgtagtcttgtaatcaacagaggagagattacatgactacaaagaacctggcggcagcgcaaaagatg

SEQ ID NO: 62054 - DNA, 103 bp, Artificial Sequence
  Synthetic Polynucleotide
taatacgactcactatagggatagccgctagaacattctttgtagtcttgaacagaggagacaagacatgaaagaatgtaacctggcggcagcgcaaaagatg

SEQ ID NO: 62055 - DNA, 103 bp, Artificial Sequence
  Synthetic Polynucleotide
taatacgactcactatagggtaggaatagccgctagaacattctttgtagaacagaggagactacaaatgatgttctagaacctggcggcagcgcaaaagatg

SEQ ID NO: 62056 - DNA, 103 bp, Artificial Sequence
  Synthetic Polynucleotide
taatacgactcactatagggtctgttaggaatagccgctagaacattcttaacagaggagaaagaatatgctagcggctaacctggcggcagcgcaaaagatg

SEQ ID NO: 62057 - DNA, 103 bp, Artificial Sequence
  Synthetic Polynucleotide
taatacgactcactatagggaatgttctgttaggaatagccgctagaacaaacagaggagatgttctatgggctattccaacctggcggcagcgcaaaagatg

SEQ ID NO: 62058 - DNA, 103 bp, Artificial Sequence
  Synthetic Polynucleotide
taatacgactcactatagggttgcaaatgttctgttaggaatagccgctaaacagaggagatagcggatgttcctaacaaacctggcggcagcgcaaaagatg

SEQ ID NO: 62059 - DNA, 103 bp, Artificial Sequence
  Synthetic Polynucleotide
taatacgactcactataggggtacggacatttaatgttttatactctcccaacagaggagagggagaatgtaaaacattaacctggcggcagcgcaaaagatg

SEQ ID NO: 62060 - DNA, 103 bp, Artificial Sequence
  Synthetic Polynucleotide
taatacgactcactatagggaatctttgcaaatgttctgttaggaatagcaacagaggagagctattatgaacagaacaaacctggcggcagcgcaaaagatg

SEQ ID NO: 62061 - DNA, 103 bp, Artificial Sequence
  Synthetic Polynucleotide
taatacgactcactatagggggattaatctttgcaaatgttctgttaggaaacagaggagatcctaaatgaacatttgcaacctggcggcagcgcaaaagatg

SEQ ID NO: 62062 - DNA, 103 bp, Artificial Sequence
  Synthetic Polynucleotide
taatacgactcactatagggcgcccggattaatctttgcaaatgttctgtaacagaggagaacagaaatgttgcaaagaaacctggcggcagcgcaaaagatg

SEQ ID NO: 62063 - DNA, 103 bp, Artificial Sequence
  Synthetic Polynucleotide
taatacgactcactatagggaacttcgcccggattaatctttgcaaatgtaacagaggagaacatttatgaagattaataacctggcggcagcgcaaaagatg

SEQ ID NO: 62064 - DNA, 103 bp, Artificial Sequence
  Synthetic Polynucleotide
taatacgactcactatagggggaataacttcgcccggattaatctttgcaaacagaggagatgcaaaatgtaatccgggaacctggcggcagcgcaaaagatg

SEQ ID NO: 62065 - DNA, 103 bp, Artificial Sequence
  Synthetic Polynucleotide
taatacgactcactatagggtgagcggaataacttcgcccggattaatctaacagaggagaagattaatgcgggcgaagaacctggcggcagcgcaaaagatg

SEQ ID NO: 62066 - DNA, 103 bp, Artificial Sequence
  Synthetic Polynucleotide
taatacgactcactatagggagtgatgagcggaataacttcgcccggattaacagaggagaaatccgatggaagttattaacctggcggcagcgcaaaagatg

SEQ ID NO: 62067 - DNA, 103 bp, Artificial Sequence
  Synthetic Polynucleotide
taatacgactcactatagggtgattagtgatgagcggaataacttcgcccaacagaggagagggcgaatgtattccgctaacctggcggcagcgcaaaagatg

SEQ ID NO: 62068 - DNA, 103 bp, Artificial Sequence
  Synthetic Polynucleotide
taatacgactcactatagggtattatgattagtgatgagcggaataacttaacagaggagaaagttaatgcgctcatcaaacctggcggcagcgcaaaagatg

SEQ ID NO: 62069 - DNA, 103 bp, Artificial Sequence
  Synthetic Polynucleotide
taatacgactcactatagggtagaatattatgattagtgatgagcggaataacagaggagaattccgatgatcactaataacctggcggcagcgcaaaagatg

SEQ ID NO: 62070 - DNA, 103 bp, Artificial Sequence
  Synthetic Polynucleotide
taatacgactcactatagggaataagtacggacatttaatgttttatactaacagaggagaagtataatgcattaaatgaacctggcggcagcgcaaaagatg

SEQ ID NO: 62071 - DNA, 103 bp, Artificial Sequence
  Synthetic Polynucleotide
taatacgactcactatagggggttttagaatattatgattagtgatgagcaacagaggagagctcatatgtaatcataaaacctggcggcagcgcaaaagatg

SEQ ID NO: 62072 - DNA, 103 bp, Artificial Sequence
  Synthetic Polynucleotide
taatacgactcactatagggtaagaggttttagaatattatgattagtgaaacagaggagatcactaatgataatattcaacctggcggcagcgcaaaagatg

SEQ ID NO: 62073 - DNA, 103 bp, Artificial Sequence
  Synthetic Polynucleotide
taatacgactcactatagggaccaataagaggttttagaatattatgattaacagaggagaaatcatatgattctaaaaaacctggcggcagcgcaaaagatg

SEQ ID NO: 62074 - DNA, 103 bp, Artificial Sequence
  Synthetic Polynucleotide
taatacgactcactatagggttctgaccaataagaggttttagaatattaaacagaggagataatatatgaaaacctctaacctggcggcagcgcaaaagatg

SEQ ID NO: 62075 - DNA, 103 bp, Artificial Sequence
  Synthetic Polynucleotide
taatacgactcactatagggaaaacttctgaccaataagaggttttagaaaacagaggagattctaaatgctcttattgaacctggcggcagcgcaaaagatg

SEQ ID NO: 62076 - DNA, 103 bp, Artificial Sequence
  Synthetic Polynucleotide
taatacgactcactatagggaatacaaaacttctgaccaataagaggtttaacagaggagaaaacctatgattggtcagaacctggcggcagcgcaaaagatg

SEQ ID NO: 62077 - DNA, 103 bp, Artificial Sequence
  Synthetic Polynucleotide
taatacgactcactatagggtatacaatacaaaacttctgaccaataagaaacagaggagatcttatatgtcagaagttaacctggcggcagcgcaaaagatg

SEQ ID NO: 62078 - DNA, 103 bp, Artificial Sequence
  Synthetic Polynucleotide
taatacgactcactatagggtagtatatacaatacaaaacttctgaccaaaacagaggagattggtcatgagttttgtaaacctggcggcagcgcaaaagatg

SEQ ID NO: 62079 - DNA, 103 bp, Artificial Sequence
  Synthetic Polynucleotide
taatacgactcactatagggagagttagtatatacaatacaaaacttctgaacagaggagacagaagatgtgtattgtaaacctggcggcagcgcaaaagatg

SEQ ID NO: 62080 - DNA, 103 bp, Artificial Sequence
  Synthetic Polynucleotide
taatacgactcactatagggattagagagttagtatatacaatacaaaacaacagaggagagttttgatgtgtatatacaacctggcggcagcgcaaaagatg

SEQ ID NO: 62081 - DNA, 103 bp, Artificial Sequence
  Synthetic Polynucleotide
taatacgactcactatagggactttaataagtacggacatttaatgttttaacagaggagaaaaacaatgaatgtccgtaacctggcggcagcgcaaaagatg

SEQ ID NO: 62082 - DNA, 103 bp, Artificial Sequence
  Synthetic Polynucleotide
taatacgactcactatagggcatccattagagagttagtatatacaatacaacagaggagagtattgatgatactaactaacctggcggcagcgcaaaagatg

SEQ ID NO: 62083 - DNA, 103 bp, Artificial Sequence
  Synthetic Polynucleotide
taatacgactcactataggggttctcatccattagagagttagtatatacaacagaggagagtatatatgaactctctaaacctggcggcagcgcaaaagatg

SEQ ID NO: 62084 - DNA, 103 bp, Artificial Sequence
  Synthetic Polynucleotide
taatacgactcactatagggtacgtgttctcatccattagagagttagtaaacagaggagatactaaatgtctaatggaaacctggcggcagcgcaaaagatg

SEQ ID NO: 62085 - DNA, 103 bp, Artificial Sequence
  Synthetic Polynucleotide
taatacgactcactatagggtagcatacgtgttctcatccattagagagtaacagaggagaactctcatgtggatgagaaacctggcggcagcgcaaaagatg

SEQ ID NO: 62086 - DNA, 103 bp, Artificial Sequence
  Synthetic Polynucleotide
taatacgactcactatagggctccatagcatacgtgttctcatccattagaacagaggagactaatgatggagaacacgaacctggcggcagcgcaaaagatg

SEQ ID NO: 62087 - DNA, 103 bp, Artificial Sequence
  Synthetic Polynucleotide
taatacgactcactatagggagcaactccatagcatacgtgttctcatccaacagaggagaggatgaatgcacgtatgcaacctggcggcagcgcaaaagatg

SEQ ID NO: 62088 - DNA, 103 bp, Artificial Sequence
  Synthetic Polynucleotide
taatacgactcactatagggcagtaagcaactccatagcatacgtgttctaacagaggagaagaacaatgatgctatggaacctggcggcagcgcaaaagatg

SEQ ID NO: 62089 - DNA, 103 bp, Artificial Sequence
  Synthetic Polynucleotide
taatacgactcactataggggtacccagtaagcaactccatagcatacgtaacagaggagaacgtatatgatggagttgaacctggcggcagcgcaaaagatg

SEQ ID NO: 62090 - DNA, 103 bp, Artificial Sequence
  Synthetic Polynucleotide
taatacgactcactatagggggggcgtacccagtaagcaactccatagcaaacagaggagatgctatatggttgcttacaacctggcggcagcgcaaaagatg

SEQ ID NO: 62091 - DNA, 103 bp, Artificial Sequence
  Synthetic Polynucleotide
taatacgactcactatagggatacaggggcgtacccagtaagcaactccaaacagaggagatggagtatgttactgggtaacctggcggcagcgcaaaagatg

SEQ ID NO: 62092 - DNA, 103 bp, Artificial Sequence
  Synthetic Polynucleotide
taatacgactcactatagggtgaatactttaataagtacggacatttaataacagaggagaattaaaatgccgtacttaaacctggcggcagcgcaaaagatg

SEQ ID NO: 62093 - DNA, 103 bp, Artificial Sequence
  Synthetic Polynucleotide
taatacgactcactatagggcggagatacaggggcgtacccagtaagcaaaacagaggagattgcttatggggtacgccaacctggcggcagcgcaaaagatg

SEQ ID NO: 62094 - DNA, 103 bp, Artificial Sequence
  Synthetic Polynucleotide
taatacgactcactatagggacgatcggagatacaggggcgtacccagtaaacagaggagatactggatgcgcccctgtaacctggcggcagcgcaaaagatg

SEQ ID NO: 62095 - DNA, 103 bp, Artificial Sequence
  Synthetic Polynucleotide
taatacgactcactatagggctataacgatcggagatacaggggcgtaccaacagaggagaggtacgatgctgtatctcaacctggcggcagcgcaaaagatg

SEQ ID NO: 62096 - DNA, 103 bp, Artificial Sequence
  Synthetic Polynucleotide
taatacgactcactatagggtctcgctataacgatcggagatacaggggcaacagaggagagcccctatgtctccgatcaacctggcggcagcgcaaaagatg

SEQ ID NO: 62097 - DNA, 103 bp, Artificial Sequence
  Synthetic Polynucleotide
taatacgactcactatagggtgagttctcgctataacgatcggagatacaaacagaggagatgtatcatggatcgttataacctggcggcagcgcaaaagatg

SEQ ID NO: 62098 - DNA, 103 bp, Artificial Sequence
  Synthetic Polynucleotide
taatacgactcactatagggcggtatgagttctcgctataacgatcggagaacagaggagactccgaatgttatagcgaaacctggcggcagcgcaaaagatg

SEQ ID NO: 62099 - DNA, 103 bp, Artificial Sequence
  Synthetic Polynucleotide
taatacgactcactatagggaagtgcggtatgagttctcgctataacgataacagaggagaatcgttatggcgagaactaacctggcggcagcgcaaaagatg

SEQ ID NO: 62100 - DNA, 103 bp, Artificial Sequence
  Synthetic Polynucleotide
taatacgactcactatagggaatataagtgcggtatgagttctcgctataaacagaggagatatagcatgaactcatacaacctggcggcagcgcaaaagatg

SEQ ID NO: 62101 - DNA, 103 bp, Artificial Sequence
  Synthetic Polynucleotide
taatacgactcactatagggtcaaaaatataagtgcggtatgagttctcgaacagaggagacgagaaatgataccgcacaacctggcggcagcgcaaaagatg

SEQ ID NO: 62102 - DNA, 103 bp, Artificial Sequence
  Synthetic Polynucleotide
taatacgactcactatagggacccatcaaaaatataagtgcggtatgagtaacagaggagaactcatatggcacttataaacctggcggcagcgcaaaagatg

SEQ ID NO: 62103 - DNA, 103 bp, Artificial Sequence
  Synthetic Polynucleotide
taatacgactcactataggggctactgaatactttaataagtacggacataacagaggagaatgtccatgcttattaaaaacctggcggcagcgcaaaagatg

SEQ ID NO: 62104 - DNA, 103 bp, Artificial Sequence
  Synthetic Polynucleotide
taatacgactcactatagggggcttacccatcaaaaatataagtgcggtaaacagaggagataccgcatgtatatttttaacctggcggcagcgcaaaagatg

SEQ ID NO: 62105 - DNA, 103 bp, Artificial Sequence
  Synthetic Polynucleotide
taatacgactcactatagggttgttggcttacccatcaaaaatataagtgaacagaggagacacttaatgttttgatggaacctggcggcagcgcaaaagatg

SEQ ID NO: 62106 - DNA, 103 bp, Artificial Sequence
  Synthetic Polynucleotide
taatacgactcactatagggagatgttgttggcttacccatcaaaaatataacagaggagaatatttatgatgggtaagaacctggcggcagcgcaaaagatg

SEQ ID NO: 62107 - DNA, 103 bp, Artificial Sequence
  Synthetic Polynucleotide
taatacgactcactatagggcgtctagatgttgttggcttacccatcaaaaacagaggagatttgatatgtaagccaacaacctggcggcagcgcaaaagatg

SEQ ID NO: 62108 - DNA, 103 bp, Artificial Sequence
  Synthetic Polynucleotide
taatacgactcactatagggcatcacgtctagatgttgttggcttacccaaacagaggagatgggtaatgcaacaacataacctggcggcagcgcaaaagatg

SEQ ID NO: 62109 - DNA, 103 bp, Artificial Sequence
  Synthetic Polynucleotide
taatacgactcactatagggatacacatcacgtctagatgttgttggcttaacagaggagaaagccaatgacatctagaaacctggcggcagcgcaaaagatg

SEQ ID NO: 62110 - DNA, 103 bp, Artificial Sequence
  Synthetic Polynucleotide
taatacgactcactataggggttctatacacatcacgtctagatgttgttaacagaggagaaacaacatgtagacgtgaaacctggcggcagcgcaaaagatg

SEQ ID NO: 62111 - DNA, 103 bp, Artificial Sequence
  Synthetic Polynucleotide
taatacgactcactatagggtacacgttctatacacatcacgtctagatgaacagaggagacatctaatggtgatgtgtaacctggcggcagcgcaaaagatg

SEQ ID NO: 62112 - DNA, 103 bp, Artificial Sequence
  Synthetic Polynucleotide
taatacgactcactatagggatctctacacgttctatacacatcacgtctaacagaggagaagacgtatggtgtatagaaacctggcggcagcgcaaaagatg

SEQ ID NO: 62113 - DNA, 103 bp, Artificial Sequence
  Synthetic Polynucleotide
taatacgactcactataggggcgtgatctctacacgttctatacacatcaaacagaggagatgatgtatgtagaacgtgaacctggcggcagcgcaaaagatg

SEQ ID NO: 62114 - DNA, 103 bp, Artificial Sequence
  Synthetic Polynucleotide
taatacgactcactataggggattggctactgaatactttaataagtacgaacagaggagacgtactatgtaaagtattaacctggcggcagcgcaaaagatg

SEQ ID NO: 62115 - DNA, 103 bp, Artificial Sequence
  Synthetic Polynucleotide
taatacgactcactataggggggtagcgtgatctctacacgttctatacaaacagaggagatgtataatgcgtgtagagaacctggcggcagcgcaaaagatg

SEQ ID NO: 62116 - DNA, 103 bp, Artificial Sequence
  Synthetic Polynucleotide
taatacgactcactatagggtacacgggtagcgtgatctctacacgttctaacagaggagaagaacgatgagagatcacaacctggcggcagcgcaaaagatg

SEQ ID NO: 62117 - DNA, 103 bp, Artificial Sequence
  Synthetic Polynucleotide
taatacgactcactataggggcacgtacacgggtagcgtgatctctacacaacagaggagagtgtagatgtcacgctacaacctggcggcagcgcaaaagatg

SEQ ID NO: 62118 - DNA, 103 bp, Artificial Sequence
  Synthetic Polynucleotide
taatacgactcactatagggcagttgcacgtacacgggtagcgtgatctcaacagaggagagagatcatgctacccgtgaacctggcggcagcgcaaaagatg

SEQ ID NO: 62119 - DNA, 103 bp, Artificial Sequence
  Synthetic Polynucleotide
taatacgactcactatagggattaccagttgcacgtacacgggtagcgtgaacagaggagacacgctatgcgtgtacgtaacctggcggcagcgcaaaagatg

SEQ ID NO: 62120 - DNA, 103 bp, Artificial Sequence
  Synthetic Polynucleotide
taatacgactcactatagggttttaattaccagttgcacgtacacgggtaaacagaggagatacccgatgacgtgcaacaacctggcggcagcgcaaaagatg

SEQ ID NO: 62121 - DNA, 103 bp, Artificial Sequence
  Synthetic Polynucleotide
taatacgactcactatagggttttattttaattaccagttgcacgtacacaacagaggagagtgtacatgcaactggtaaacctggcggcagcgcaaaagatg

SEQ ID NO: 62122 - DNA, 103 bp, Artificial Sequence
  Synthetic Polynucleotide
taatacgactcactatagggttactttttattttaattaccagttgcacgaacagaggagacgtgcaatgggtaattaaaacctggcggcagcgcaaaagatg

SEQ ID NO: 62123 - DNA, 103 bp, Artificial Sequence
  Synthetic Polynucleotide
taatacgactcactataggggaatattactttttattttaattaccagttaacagaggagaaactggatgttaaaataaaacctggcggcagcgcaaaagatg

SEQ ID NO: 62124 - DNA, 103 bp, Artificial Sequence
  Synthetic Polynucleotide
taatacgactcactatagggcatatgaatattactttttattttaattacaacagaggagagtaattatgataaaaagtaacctggcggcagcgcaaaagatg

SEQ ID NO: 62125 - DNA, 103 bp, Artificial Sequence
  Synthetic Polynucleotide
taatacgactcactataggggaagttacaaatatgctagtatgctcgaacaacagaggagagttcgaatgtactagcataacctggcggcagcgcaaaagatg

SEQ ID NO: 62126 - DNA, 103 bp, Artificial Sequence
  Synthetic Polynucleotide
taatacgactcactataggggttaggattggctactgaatactttaataaaacagaggagattattaatgtattcagtaaacctggcggcagcgcaaaagatg

SEQ ID NO: 62127 - DNA, 103 bp, Artificial Sequence
  Synthetic Polynucleotide
taatacgactcactatagggcactacatatgaatattactttttattttaaacagaggagataaaatatgaagtaatataacctggcggcagcgcaaaagatg

SEQ ID NO: 62128 - DNA, 103 bp, Artificial Sequence
  Synthetic Polynucleotide
taatacgactcactatagggattaacactacatatgaatattactttttaaacagaggagataaaaaatgatattcataaacctggcggcagcgcaaaagatg

SEQ ID NO: 62129 - DNA, 103 bp, Artificial Sequence
  Synthetic Polynucleotide
taatacgactcactatagggttaaaattaacactacatatgaatattactaacagaggagaagtaatatgcatatgtagaacctggcggcagcgcaaaagatg

SEQ ID NO: 62130 - DNA, 103 bp, Artificial Sequence
  Synthetic Polynucleotide
taatacgactcactatagggatcatttaaaattaacactacatatgaataaacagaggagatattcaatggtagtgttaaacctggcggcagcgcaaaagatg

SEQ ID NO: 62131 - DNA, 103 bp, Artificial Sequence
  Synthetic Polynucleotide
taatacgactcactatagggttatcatcatttaaaattaacactacatataacagaggagaatatgtatggttaattttaacctggcggcagcgcaaaagatg

SEQ ID NO: 62132 - DNA, 103 bp, Artificial Sequence
  Synthetic Polynucleotide
taatacgactcactatagggccattttatcatcatttaaaattaacactaaacagaggagatagtgtatgttttaaatgaacctggcggcagcgcaaaagatg

SEQ ID NO: 62133 - DNA, 103 bp, Artificial Sequence
  Synthetic Polynucleotide
taatacgactcactatagggattatccattttatcatcatttaaaattaaaacagaggagattaattatgaatgatgataacctggcggcagcgcaaaagatg

SEQ ID NO: 62134 - DNA, 103 bp, Artificial Sequence
  Synthetic Polynucleotide
taatacgactcactatagggtggatattatccattttatcatcatttaaaaacagaggagatttaaaatgtgataaaataacctggcggcagcgcaaaagatg

SEQ ID NO: 62135 - DNA, 103 bp, Artificial Sequence
  Synthetic Polynucleotide
taatacgactcactatagggcaatatggatattatccattttatcatcataacagaggagaatgatgatgaaatggataaacctggcggcagcgcaaaagatg

SEQ ID NO: 62136 - DNA, 103 bp, Artificial Sequence
  Synthetic Polynucleotide
taatacgactcactatagggatcgtcaatatggatattatccattttatcaacagaggagagataaaatggataatatcaacctggcggcagcgcaaaagatg

SEQ ID NO: 62137 - DNA, 103 bp, Artificial Sequence
  Synthetic Polynucleotide
taatacgactcactatagggaaagagttaggattggctactgaatactttaacagaggagaaaagtaatgagtagccaaaacctggcggcagcgcaaaagatg

SEQ ID NO: 62138 - DNA, 103 bp, Artificial Sequence
  Synthetic Polynucleotide
taatacgactcactatagggttgacatcgtcaatatggatattatccattaacagaggagaaatggaatgtatccatataacctggcggcagcgcaaaagatg

SEQ ID NO: 62139 - DNA, 103 bp, Artificial Sequence
  Synthetic Polynucleotide
taatacgactcactatagggcattattgacatcgtcaatatggatattataacagaggagaataataatgatattgacgaacctggcggcagcgcaaaagatg

SEQ ID NO: 62140 - DNA, 103 bp, Artificial Sequence
  Synthetic Polynucleotide
taatacgactcactatagggaccggcattattgacatcgtcaatatggataacagaggagaatccatatggacgatgtcaacctggcggcagcgcaaaagatg

SEQ ID NO: 62141 - DNA, 103 bp, Artificial Sequence
  Synthetic Polynucleotide
taatacgactcactatagggccaataccggcattattgacatcgtcaataaacagaggagatattgaatgtgtcaataaaacctggcggcagcgcaaaagatg

SEQ ID NO: 62142 - DNA, 103 bp, Artificial Sequence
  Synthetic Polynucleotide
taatacgactcactataggggtataccaataccggcattattgacatcgtaacagaggagaacgatgatgataatgccgaacctggcggcagcgcaaaagatg

SEQ ID NO: 62143 - DNA, 103 bp, Artificial Sequence
  Synthetic Polynucleotide
taatacgactcactataggggagctgtataccaataccggcattattgacaacagaggagagtcaatatggccggtattaacctggcggcagcgcaaaagatg

SEQ ID NO: 62144 - DNA, 103 bp, Artificial Sequence
  Synthetic Polynucleotide
taatacgactcactatagggtcgatgagctgtataccaataccggcattaaacagaggagataatgcatgtattggtataacctggcggcagcgcaaaagatg

SEQ ID NO: 62145 - DNA, 103 bp, Artificial Sequence
  Synthetic Polynucleotide
taatacgactcactatagggaaaaatcgatgagctgtataccaataccggaacagaggagaccggtaatggtatacagcaacctggcggcagcgcaaaagatg

SEQ ID NO: 62146 - DNA, 103 bp, Artificial Sequence
  Synthetic Polynucleotide
taatacgactcactatagggaatctaaaaatcgatgagctgtataccaataacagaggagaattggtatgcagctcatcaacctggcggcagcgcaaaagatg

SEQ ID NO: 62147 - DNA, 103 bp, Artificial Sequence
  Synthetic Polynucleotide
taatacgactcactatagggaacgaaatctaaaaatcgatgagctgtataaacagaggagatatacaatgcatcgatttaacctggcggcagcgcaaaagatg

SEQ ID NO: 62148 - DNA, 103 bp, Artificial Sequence
  Synthetic Polynucleotide
taatacgactcactatagggattcgaaagagttaggattggctactgaataacagaggagaattcagatgccaatcctaaacctggcggcagcgcaaaagatg

SEQ ID NO: 62149 - DNA, 103 bp, Artificial Sequence
  Synthetic Polynucleotide
taatacgactcactatagggctctgaacgaaatctaaaaatcgatgagctaacagaggagaagctcaatgatttttagaaacctggcggcagcgcaaaagatg

SEQ ID NO: 62150 - DNA, 103 bp, Artificial Sequence
  Synthetic Polynucleotide
taatacgactcactatagggacatcctctgaacgaaatctaaaaatcgataacagaggagaatcgatatgtagatttcgaacctggcggcagcgcaaaagatg

SEQ ID NO: 62151 - DNA, 103 bp, Artificial Sequence
  Synthetic Polynucleotide
taatacgactcactatagggattccacatcctctgaacgaaatctaaaaaaacagaggagatttttaatgttcgttcagaacctggcggcagcgcaaaagatg

SEQ ID NO: 62152 - DNA, 103 bp, Artificial Sequence
  Synthetic Polynucleotide
taatacgactcactatagggacataattccacatcctctgaacgaaatctaacagaggagaagatttatgtcagaggataacctggcggcagcgcaaaagatg

SEQ ID NO: 62153 - DNA, 103 bp, Artificial Sequence
  Synthetic Polynucleotide
taatacgactcactatagggccataacataattccacatcctctgaacgaaacagaggagatcgttcatgggatgtggaaacctggcggcagcgcaaaagatg

SEQ ID NO: 62154 - DNA, 103 bp, Artificial Sequence
  Synthetic Polynucleotide
taatacgactcactatagggaattcccataacataattccacatcctctgaacagaggagacagaggatgtggaattataacctggcggcagcgcaaaagatg

SEQ ID NO: 62155 - DNA, 103 bp, Artificial Sequence
  Synthetic Polynucleotide
taatacgactcactatagggatacaaattcccataacataattccacatcaacagaggagagatgtgatgttatgttataacctggcggcagcgcaaaagatg

SEQ ID NO: 62156 - DNA, 103 bp, Artificial Sequence
  Synthetic Polynucleotide
taatacgactcactatagggtcaaaatacaaattcccataacataattccaacagaggagaggaattatgttatgggaaaacctggcggcagcgcaaaagatg

SEQ ID NO: 62157 - DNA, 103 bp, Artificial Sequence
  Synthetic Polynucleotide
taatacgactcactatagggtcctatcaaaatacaaattcccataacataaacagaggagatatgttatgggaatttgtaacctggcggcagcgcaaaagatg

SEQ ID NO: 62158 - DNA, 103 bp, Artificial Sequence
  Synthetic Polynucleotide
taatacgactcactatagggatagatcctatcaaaatacaaattcccataaacagaggagatatgggatgttgtattttaacctggcggcagcgcaaaagatg

SEQ ID NO: 62159 - DNA, 103 bp, Artificial Sequence
  Synthetic Polynucleotide
taatacgactcactatagggtaagtattcgaaagagttaggattggctacaacagaggagagtagccatgcctaactctaacctggcggcagcgcaaaagatg

SEQ ID NO: 62160 - DNA, 103 bp, Artificial Sequence
  Synthetic Polynucleotide
taatacgactcactatagggttattatagatcctatcaaaatacaaattcaacagaggagagaatttatgttttgatagaacctggcggcagcgcaaaagatg

SEQ ID NO: 62161 - DNA, 103 bp, Artificial Sequence
  Synthetic Polynucleotide
taatacgactcactatagggctacattattatagatcctatcaaaatacaaacagaggagatgtattatgataggatctaacctggcggcagcgcaaaagatg

SEQ ID NO: 62162 - DNA, 103 bp, Artificial Sequence
  Synthetic Polynucleotide
taatacgactcactatagggatttactacattattatagatcctatcaaaaacagaggagatttgatatgatctataataacctggcggcagcgcaaaagatg

SEQ ID NO: 62163 - DNA, 103 bp, Artificial Sequence
  Synthetic Polynucleotide
taatacgactcactatagggtttatatttactacattattatagatcctaaacagaggagataggatatgtaataatgtaacctggcggcagcgcaaaagatg

SEQ ID NO: 62164 - DNA, 103 bp, Artificial Sequence
  Synthetic Polynucleotide
taatacgactcactatagggtatattttatatttactacattattatagaaacagaggagatctataatgatgtagtaaaacctggcggcagcgcaaaagatg

SEQ ID NO: 62165 - DNA, 103 bp, Artificial Sequence
  Synthetic Polynucleotide
taatacgactcactatagggaggaatatattttatatttactacattattaacagaggagaaataatatggtaaatataaacctggcggcagcgcaaaagatg

SEQ ID NO: 62166 - DNA, 103 bp, Artificial Sequence
  Synthetic Polynucleotide
taatacgactcactatagggtgctcaggaatatattttatatttactacaaacagaggagatgtagtatgtataaaataaacctggcggcagcgcaaaagatg

SEQ ID NO: 62167 - DNA, 103 bp, Artificial Sequence
  Synthetic Polynucleotide
taatacgactcactataggggaatatgctcaggaatatattttatatttaaacagaggagataaataatgaatatattcaacctggcggcagcgcaaaagatg

SEQ ID NO: 62168 - DNA, 103 bp, Artificial Sequence
  Synthetic Polynucleotide
taatacgactcactatagggatatggaatatgctcaggaatatattttataacagaggagaataaaaatgattcctgagaacctggcggcagcgcaaaagatg

SEQ ID NO: 62169 - DNA, 103 bp, Artificial Sequence
  Synthetic Polynucleotide
taatacgactcactatagggtatttatatggaatatgctcaggaatatataacagaggagaatatatatgtgagcatataacctggcggcagcgcaaaagatg

SEQ ID NO: 62170 - DNA, 103 bp, Artificial Sequence
  Synthetic Polynucleotide
taatacgactcactatagggattaataagtattcgaaagagttaggattgaacagaggagacaatccatgctctttcgaaacctggcggcagcgcaaaagatg

SEQ ID NO: 62171 - DNA, 103 bp, Artificial Sequence
  Synthetic Polynucleotide
taatacgactcactatagggaattatatttatatggaatatgctcaggaaaacagaggagattcctgatgatattccataacctggcggcagcgcaaaagatg

SEQ ID NO: 62172 - DNA, 103 bp, Artificial Sequence
  Synthetic Polynucleotide
taatacgactcactatagggaataaaattatatttatatggaatatgctcaacagaggagagagcatatgccatataaaaacctggcggcagcgcaaaagatg

SEQ ID NO: 62173 - DNA, 103 bp, Artificial Sequence
  Synthetic Polynucleotide
taatacgactcactatagggcgattaataaaattatatttatatggaataaacagaggagatattccatgtaaatataaaacctggcggcagcgcaaaagatg

SEQ ID NO: 62174 - DNA, 103 bp, Artificial Sequence
  Synthetic Polynucleotide
taatacgactcactatagggacgtacgattaataaaattatatttatatgaacagaggagacatataatgataattttaaacctggcggcagcgcaaaagatg

SEQ ID NO: 62175 - DNA, 103 bp, Artificial Sequence
  Synthetic Polynucleotide
taatacgactcactatagggggagaacgtacgattaataaaattatatttaacagaggagaaaatatatgtttattaataacctggcggcagcgcaaaagatg

SEQ ID NO: 62176 - DNA, 103 bp, Artificial Sequence
  Synthetic Polynucleotide
taatacgactcactatagggtctacggagaacgtacgattaataaaattaaacagaggagataatttatgtaatcgtacaacctggcggcagcgcaaaagatg

SEQ ID NO: 62177 - DNA, 103 bp, Artificial Sequence
  Synthetic Polynucleotide
taatacgactcactataggggttcatctacggagaacgtacgattaataaaacagaggagattattaatggtacgttctaacctggcggcagcgcaaaagatg

SEQ ID NO: 62178 - DNA, 103 bp, Artificial Sequence
  Synthetic Polynucleotide
taatacgactcactataggggtctagttcatctacggagaacgtacgattaacagaggagaaatcgtatgttctccgtaaacctggcggcagcgcaaaagatg

SEQ ID NO: 62179 - DNA, 103 bp, Artificial Sequence
  Synthetic Polynucleotide
taatacgactcactatagggttattgtctagttcatctacggagaacgtaaacagaggagatacgttatgcgtagatgaaacctggcggcagcgcaaaagatg

SEQ ID NO: 62180 - DNA, 103 bp, Artificial Sequence
  Synthetic Polynucleotide
taatacgactcactatagggagacattattgtctagttcatctacggagaaacagaggagatctccgatgatgaactagaacctggcggcagcgcaaaagatg

SEQ ID NO: 62181 - DNA, 103 bp, Artificial Sequence
  Synthetic Polynucleotide
taatacgactcactataggggagccattaataagtattcgaaagagttagaacagaggagactaactatgtcgaatactaacctggcggcagcgcaaaagatg

SEQ ID NO: 62182 - DNA, 103 bp, Artificial Sequence
  Synthetic Polynucleotide
taatacgactcactatagggaaaaaagacattattgtctagttcatctacaacagaggagagtagatatgctagacaataacctggcggcagcgcaaaagatg

SEQ ID NO: 62183 - DNA, 103 bp, Artificial Sequence
  Synthetic Polynucleotide
taatacgactcactatagggtgtgtaaaaaagacattattgtctagttcaaacagaggagatgaactatgcaataatgtaacctggcggcagcgcaaaagatg

SEQ ID NO: 62184 - DNA, 103 bp, Artificial Sequence
  Synthetic Polynucleotide
taatacgactcactatagggaaccatgtgtaaaaaagacattattgtctaaacagaggagatagacaatgatgtcttttaacctggcggcagcgcaaaagatg

SEQ ID NO: 62185 - DNA, 103 bp, Artificial Sequence
  Synthetic Polynucleotide
taatacgactcactatagggaaaataaccatgtgtaaaaaagacattattaacagaggagaaataatatgttttttacaaacctggcggcagcgcaaaagatg

SEQ ID NO: 62186 - DNA, 103 bp, Artificial Sequence
  Synthetic Polynucleotide
taatacgactcactatagggtttaaaaaataaccatgtgtaaaaaagacaaacagaggagatgtcttatgtacacatggaacctggcggcagcgcaaaagatg

SEQ ID NO: 62187 - DNA, 103 bp, Artificial Sequence
  Synthetic Polynucleotide
taatacgactcactatagggtgtgttttaaaaaataaccatgtgtaaaaaaacagaggagatttttaatgatggttattaacctggcggcagcgcaaaagatg

SEQ ID NO: 62188 - DNA, 103 bp, Artificial Sequence
  Synthetic Polynucleotide
taatacgactcactatagggatatttgtgttttaaaaaataaccatgtgtaacagaggagaacacatatgtattttttaaacctggcggcagcgcaaaagatg

SEQ ID NO: 62189 - DNA, 103 bp, Artificial Sequence
  Synthetic Polynucleotide
taatacgactcactataggggaaccatatttgtgttttaaaaaataaccaaacagaggagatggttaatgtttaaaacaaacctggcggcagcgcaaaagatg

SEQ ID NO: 62190 - DNA, 103 bp, Artificial Sequence
  Synthetic Polynucleotide
taatacgactcactatagggtaagtgaaccatatttgtgttttaaaaaataacagaggagaatttttatgaacacaaataacctggcggcagcgcaaaagatg

SEQ ID NO: 62191 - DNA, 103 bp, Artificial Sequence
  Synthetic Polynucleotide
taatacgactcactatagggaggattaagtgaaccatatttgtgttttaaaacagaggagattaaaaatgaaatatggtaacctggcggcagcgcaaaagatg

SEQ ID NO: 62192 - DNA, 103 bp, Artificial Sequence
  Synthetic Polynucleotide
taatacgactcactatagggaataagagccattaataagtattcgaaagaaacagaggagatctttcatgtacttattaaacctggcggcagcgcaaaagatg

SEQ ID NO: 62193 - DNA, 103 bp, Artificial Sequence
  Synthetic Polynucleotide
taatacgactcactatagggaaactaggattaagtgaaccatatttgtgtaacagaggagaacacaaatgtggttcactaacctggcggcagcgcaaaagatg

SEQ ID NO: 62194 - DNA, 103 bp, Artificial Sequence
  Synthetic Polynucleotide
taatacgactcactatagggcaatcaaactaggattaagtgaaccatattaacagaggagaaatatgatgcacttaatcaacctggcggcagcgcaaaagatg

SEQ ID NO: 62195 - DNA, 103 bp, Artificial Sequence
  Synthetic Polynucleotide
taatacgactcactatagggtgagacaatcaaactaggattaagtgaaccaacagaggagaggttcaatgaatcctagtaacctggcggcagcgcaaaagatg

SEQ ID NO: 62196 - DNA, 103 bp, Artificial Sequence
  Synthetic Polynucleotide
taatacgactcactataggggataatgagacaatcaaactaggattaagtaacagaggagaacttaaatgtagtttgataacctggcggcagcgcaaaagatg

SEQ ID NO: 62197 - DNA, 103 bp, Artificial Sequence
  Synthetic Polynucleotide
taatacgactcactatagggttcctgataatgagacaatcaaactaggataacagaggagaatcctaatgtgattgtctaacctggcggcagcgcaaaagatg

SEQ ID NO: 62198 - DNA, 103 bp, Artificial Sequence
  Synthetic Polynucleotide
taatacgactcactatagggtaagtttcctgataatgagacaatcaaactaacagaggagaagtttgatggtctcattaaacctggcggcagcgcaaaagatg

SEQ ID NO: 62199 - DNA, 103 bp, Artificial Sequence
  Synthetic Polynucleotide
taatacgactcactatagggtattttaagtttcctgataatgagacaatcaacagaggagagattgtatgattatcaggaacctggcggcagcgcaaaagatg

SEQ ID NO: 62200 - DNA, 103 bp, Artificial Sequence
  Synthetic Polynucleotide
taatacgactcactatagggcattatattttaagtttcctgataatgagaaacagaggagatctcatatgcaggaaactaacctggcggcagcgcaaaagatg

SEQ ID NO: 62201 - DNA, 103 bp, Artificial Sequence
  Synthetic Polynucleotide
taatacgactcactatagggtatatcattatattttaagtttcctgataaaacagaggagattatcaatgaacttaaaaaacctggcggcagcgcaaaagatg

SEQ ID NO: 62202 - DNA, 103 bp, Artificial Sequence
  Synthetic Polynucleotide
taatacgactcactatagggcattgtatatcattatattttaagtttcctaacagaggagaaggaaaatgaaaatataaaacctggcggcagcgcaaaagatg

SEQ ID NO: 62203 - DNA, 103 bp, Artificial Sequence
  Synthetic Polynucleotide
taatacgactcactatagggtacagaataagagccattaataagtattcgaacagaggagacgaataatgattaatggcaacctggcggcagcgcaaaagatg

SEQ ID NO: 62204 - DNA, 103 bp, Artificial Sequence
  Synthetic Polynucleotide
taatacgactcactatagggctgagcattgtatatcattatattttaagtaacagaggagaacttaaatgataatgataaacctggcggcagcgcaaaagatg

SEQ ID NO: 62205 - DNA, 103 bp, Artificial Sequence
  Synthetic Polynucleotide
taatacgactcactatagggatttactgagcattgtatatcattatatttaacagaggagaaaatatatggatatacaaaacctggcggcagcgcaaaagatg

SEQ ID NO: 62206 - DNA, 103 bp, Artificial Sequence
  Synthetic Polynucleotide
taatacgactcactataggggatacatttactgagcattgtatatcattaaacagaggagataatgaatgacaatgctcaacctggcggcagcgcaaaagatg

SEQ ID NO: 62207 - DNA, 103 bp, Artificial Sequence
  Synthetic Polynucleotide
taatacgactcactatagggggcacgatacatttactgagcattgtatataacagaggagaatatacatggctcagtaaaacctggcggcagcgcaaaagatg

SEQ ID NO: 62208 - DNA, 103 bp, Artificial Sequence
  Synthetic Polynucleotide
taatacgactcactatagggaatgaggcacgatacatttactgagcattgaacagaggagacaatgcatggtaaatgtaaacctggcggcagcgcaaaagatg

SEQ ID NO: 62209 - DNA, 103 bp, Artificial Sequence
  Synthetic Polynucleotide
taatacgactcactatagggtttttaatgaggcacgatacatttactgagaacagaggagactcagtatgtgtatcgtgaacctggcggcagcgcaaaagatg

SEQ ID NO: 62210 - DNA, 103 bp, Artificial Sequence
  Synthetic Polynucleotide
taatacgactcactatagggccaaatttttaatgaggcacgatacatttaaacagaggagataaatgatgcgtgcctcaaacctggcggcagcgcaaaagatg

SEQ ID NO: 62211 - DNA, 103 bp, Artificial Sequence
  Synthetic Polynucleotide
taatacgactcactatagggcgttgccaaatttttaatgaggcacgatacaacagaggagagtatcgatgctcattaaaaacctggcggcagcgcaaaagatg

SEQ ID NO: 62212 - DNA, 103 bp, Artificial Sequence
  Synthetic Polynucleotide
taatacgactcactatagggatactcgttgccaaatttttaatgaggcacaacagaggagagtgcctatgtaaaaatttaacctggcggcagcgcaaaagatg

SEQ ID NO: 62213 - DNA, 103 bp, Artificial Sequence
  Synthetic Polynucleotide
taatacgactcactatagggtagatatactcgttgccaaatttttaatgaaacagaggagatcattaatgatttggcaaaacctggcggcagcgcaaaagatg

SEQ ID NO: 62214 - DNA, 103 bp, Artificial Sequence
  Synthetic Polynucleotide
taatacgactcactatagggattcgtacagaataagagccattaataagtaacagaggagaacttatatgtggctcttaaacctggcggcagcgcaaaagatg

SEQ ID NO: 62215 - DNA, 103 bp, Artificial Sequence
  Synthetic Polynucleotide
taatacgactcactatagggtatagtagatatactcgttgccaaatttttaacagaggagaaaaaatatggcaacgagtaacctggcggcagcgcaaaagatg

SEQ ID NO: 62216 - DNA, 103 bp, Artificial Sequence
  Synthetic Polynucleotide
taatacgactcactataggggttaatatagtagatatactcgttgccaaaaacagaggagatttggcatggagtatatcaacctggcggcagcgcaaaagatg

SEQ ID NO: 62217 - DNA, 103 bp, Artificial Sequence
  Synthetic Polynucleotide
taatacgactcactatagggtagatgttaatatagtagatatactcgttgaacagaggagacaacgaatgtatctactaaacctggcggcagcgcaaaagatg

SEQ ID NO: 62218 - DNA, 103 bp, Artificial Sequence
  Synthetic Polynucleotide
taatacgactcactatagggatgtttagatgttaatatagtagatatactaacagaggagaagtataatgactatattaaacctggcggcagcgcaaaagatg

SEQ ID NO: 62219 - DNA, 103 bp, Artificial Sequence
  Synthetic Polynucleotide
taatacgactcactataggggtcttatgtttagatgttaatatagtagataacagaggagaatctacatgattaacatcaacctggcggcagcgcaaaagatg

SEQ ID NO: 62220 - DNA, 103 bp, Artificial Sequence
  Synthetic Polynucleotide
taatacgactcactatagggaatacgtcttatgtttagatgttaatatagaacagaggagactatatatgcatctaaacaacctggcggcagcgcaaaagatg

SEQ ID NO: 62221 - DNA, 103 bp, Artificial Sequence
  Synthetic Polynucleotide
taatacgactcactatagggtagagaatacgtcttatgtttagatgttaaaacagaggagattaacaatgaaacataagaacctggcggcagcgcaaaagatg

SEQ ID NO: 62222 - DNA, 103 bp, Artificial Sequence
  Synthetic Polynucleotide
taatacgactcactatagggcgatgtagagaatacgtcttatgtttagataacagaggagaatctaaatgtaagacgtaaacctggcggcagcgcaaaagatg

SEQ ID NO: 62223 - DNA, 103 bp, Artificial Sequence
  Synthetic Polynucleotide
taatacgactcactatagggtggaccgatgtagagaatacgtcttatgttaacagaggagaaacataatgcgtattctcaacctggcggcagcgcaaaagatg

SEQ ID NO: 62224 - DNA, 103 bp, Artificial Sequence
  Synthetic Polynucleotide
taatacgactcactatagggacacttggaccgatgtagagaatacgtcttaacagaggagaaagacgatgtctctacataacctggcggcagcgcaaaagatg

SEQ ID NO: 62225 - DNA, 103 bp, Artificial Sequence
  Synthetic Polynucleotide
taatacgactcactatagggaatagattcgtacagaataagagccattaaaacagaggagattaatgatgcttattctgaacctggcggcagcgcaaaagatg

SEQ ID NO: 62226 - DNA, 103 bp, Artificial Sequence
  Synthetic Polynucleotide
taatacgactcactataggggtaatacacttggaccgatgtagagaatacaacagaggagagtattcatgacatcggtcaacctggcggcagcgcaaaagatg

SEQ ID NO: 62227 - DNA, 103 bp, Artificial Sequence
  Synthetic Polynucleotide
taatacgactcactatagggttatagtaatacacttggaccgatgtagagaacagaggagactctacatgggtccaagtaacctggcggcagcgcaaaagatg

SEQ ID NO: 62228 - DNA, 103 bp, Artificial Sequence
  Synthetic Polynucleotide
taatacgactcactatagggtcctattatagtaatacacttggaccgatgaacagaggagacatcggatgaagtgtattaacctggcggcagcgcaaaagatg

SEQ ID NO: 62229 - DNA, 103 bp, Artificial Sequence
  Synthetic Polynucleotide
taatacgactcactatagggtcatatcctattatagtaatacacttggacaacagaggagagtccaaatgtattactataacctggcggcagcgcaaaagatg

SEQ ID NO: 62230 - DNA, 103 bp, Artificial Sequence
  Synthetic Polynucleotide
taatacgactcactatagggtagaatcatatcctattatagtaatacactaacagaggagaagtgtaatgctataatagaacctggcggcagcgcaaaagatg

SEQ ID NO: 62231 - DNA, 103 bp, Artificial Sequence
  Synthetic Polynucleotide
taatacgactcactatagggtataatagaatcatatcctattatagtaataacagaggagaattactatgataggatataacctggcggcagcgcaaaagatg

SEQ ID NO: 62232 - DNA, 103 bp, Artificial Sequence
  Synthetic Polynucleotide
taatacgactcactatagggtaccatataatagaatcatatcctattataaacagaggagatataatatgatatgattcaacctggcggcagcgcaaaagatg

SEQ ID NO: 62233 - DNA, 103 bp, Artificial Sequence
  Synthetic Polynucleotide
taatacgactcactatagggctttataccatataatagaatcatatcctaaacagaggagataggatatgattctattaaacctggcggcagcgcaaaagatg

SEQ ID NO: 62234 - DNA, 103 bp, Artificial Sequence
  Synthetic Polynucleotide
taatacgactcactatagggtatatctttataccatataatagaatcataaacagaggagatatgatatgattatatggaacctggcggcagcgcaaaagatg

SEQ ID NO: 62235 - DNA, 103 bp, Artificial Sequence
  Synthetic Polynucleotide
taatacgactcactatagggtcatttatatctttataccatataatagaaaacagaggagattctatatgatggtataaaacctggcggcagcgcaaaagatg

SEQ ID NO: 62236 - DNA, 103 bp, Artificial Sequence
  Synthetic Polynucleotide
taatacgactcactatagggacgacgaagttacaaatatgctagtatgctaacagaggagaagcataatggcatatttgaacctggcggcagcgcaaaagatg

SEQ ID NO: 62237 - DNA, 103 bp, Artificial Sequence
  Synthetic Polynucleotide
taatacgactcactatagggaaaaaaatagattcgtacagaataagagccaacagaggagaggctctatgtctgtacgaaacctggcggcagcgcaaaagatg

SEQ ID NO: 62238 - DNA, 103 bp, Artificial Sequence
  Synthetic Polynucleotide
taatacgactcactatagggacttgtcatttatatctttataccatataaaacagaggagattatatatgataaagataaacctggcggcagcgcaaaagatg

SEQ ID NO: 62239 - DNA, 103 bp, Artificial Sequence
  Synthetic Polynucleotide
taatacgactcactatagggattatacttgtcatttatatctttataccaaacagaggagatggtatatggatataaataacctggcggcagcgcaaaagatg

SEQ ID NO: 62240 - DNA, 103 bp, Artificial Sequence
  Synthetic Polynucleotide
taatacgactcactatagggatatcattatacttgtcatttatatctttaaacagaggagataaagaatgaaatgacaaaacctggcggcagcgcaaaagatg

SEQ ID NO: 62241 - DNA, 103 bp, Artificial Sequence
  Synthetic Polynucleotide
taatacgactcactatagggcatagatatcattatacttgtcatttatataacagaggagaatataaatgacaagtataaacctggcggcagcgcaaaagatg

SEQ ID NO: 62242 - DNA, 103 bp, Artificial Sequence
  Synthetic Polynucleotide
taatacgactcactatagggaaaatcatagatatcattatacttgtcattaacagaggagaaatgacatgtataatgataacctggcggcagcgcaaaagatg

SEQ ID NO: 62243 - DNA, 103 bp, Artificial Sequence
  Synthetic Polynucleotide
taatacgactcactataggggcggtaaaatcatagatatcattatacttgaacagaggagacaagtaatgtgatatctaaacctggcggcagcgcaaaagatg

SEQ ID NO: 62244 - DNA, 103 bp, Artificial Sequence
  Synthetic Polynucleotide
taatacgactcactatagggatattgcggtaaaatcatagatatcattataacagaggagaataatgatgtctatgattaacctggcggcagcgcaaaagatg

SEQ ID NO: 62245 - DNA, 103 bp, Artificial Sequence
  Synthetic Polynucleotide
taatacgactcactatagggcatacatattgcggtaaaatcatagatatcaacagaggagagatatcatggattttaccaacctggcggcagcgcaaaagatg

SEQ ID NO: 62246 - DNA, 103 bp, Artificial Sequence
  Synthetic Polynucleotide
taatacgactcactatagggattagcatacatattgcggtaaaatcatagaacagaggagactatgaatgtaccgcaataacctggcggcagcgcaaaagatg

SEQ ID NO: 62247 - DNA, 103 bp, Artificial Sequence
  Synthetic Polynucleotide
taatacgactcactatagggacgctattagcatacatattgcggtaaaataacagaggagaattttaatgcaatatgtaaacctggcggcagcgcaaaagatg

SEQ ID NO: 62248 - DNA, 103 bp, Artificial Sequence
  Synthetic Polynucleotide
taatacgactcactatagggtgttcaaaaaaatagattcgtacagaataaaacagaggagattattcatgacgaatctaaacctggcggcagcgcaaaagatg

SEQ ID NO: 62249 - DNA, 103 bp, Artificial Sequence
  Synthetic Polynucleotide
taatacgactcactatagggtgtagacgctattagcatacatattgcggtaacagaggagaaccgcaatgtgtatgctaaacctggcggcagcgcaaaagatg

SEQ ID NO: 62250 - DNA, 103 bp, Artificial Sequence
  Synthetic Polynucleotide
taatacgactcactatagggatcaatgtagacgctattagcatacatattaacagaggagaaatatgatggctaatagcaacctggcggcagcgcaaaagatg

SEQ ID NO: 62251 - DNA, 103 bp, Artificial Sequence
  Synthetic Polynucleotide
taatacgactcactatagggtcactatcaatgtagacgctattagcatacaacagaggagagtatgcatgtagcgtctaaacctggcggcagcgcaaaagatg

SEQ ID NO: 62252 - DNA, 103 bp, Artificial Sequence
  Synthetic Polynucleotide
taatacgactcactatagggtatggtcactatcaatgtagacgctattagaacagaggagactaataatgtctacattgaacctggcggcagcgcaaaagatg

SEQ ID NO: 62253 - DNA, 103 bp, Artificial Sequence
  Synthetic Polynucleotide
taatacgactcactatagggacgtatatggtcactatcaatgtagacgctaacagaggagaagcgtcatgattgatagtaacctggcggcagcgcaaaagatg

SEQ ID NO: 62254 - DNA, 103 bp, Artificial Sequence
  Synthetic Polynucleotide
taatacgactcactatagggtaaacacgtatatggtcactatcaatgtagaacagaggagactacatatgtagtgaccaaacctggcggcagcgcaaaagatg

SEQ ID NO: 62255 - DNA, 103 bp, Artificial Sequence
  Synthetic Polynucleotide
taatacgactcactatagggttttttaaacacgtatatggtcactatcaaaacagaggagattgataatgaccatatacaacctggcggcagcgcaaaagatg

SEQ ID NO: 62256 - DNA, 103 bp, Artificial Sequence
  Synthetic Polynucleotide
taatacgactcactatagggtttatttttttaaacacgtatatggtcactaacagaggagaagtgacatgatacgtgttaacctggcggcagcgcaaaagatg

SEQ ID NO: 62257 - DNA, 103 bp, Artificial Sequence
  Synthetic Polynucleotide
taatacgactcactatagggtcatttttatttttttaaacacgtatatggaacagaggagaccatatatgtgtttaaaaaacctggcggcagcgcaaaagatg

SEQ ID NO: 62258 - DNA, 103 bp, Artificial Sequence
  Synthetic Polynucleotide
taatacgactcactatagggagagttcatttttatttttttaaacacgtaaacagaggagatacgtgatgaaaaaaataaacctggcggcagcgcaaaagatg

SEQ ID NO: 62259 - DNA, 103 bp, Artificial Sequence
  Synthetic Polynucleotide
taatacgactcactatagggtccgttgttcaaaaaaatagattcgtacagaacagaggagactgtacatgtctatttttaacctggcggcagcgcaaaagatg

SEQ ID NO: 62260 - DNA, 103 bp, Artificial Sequence
  Synthetic Polynucleotide
taatacgactcactatagggaattaagagttcatttttatttttttaaacaacagaggagagtttaaatgaataaaaataacctggcggcagcgcaaaagatg

SEQ ID NO: 62261 - DNA, 103 bp, Artificial Sequence
  Synthetic Polynucleotide
taatacgactcactatagggagcataattaagagttcatttttattttttaacagaggagaaaaaaaatgaaatgaactaacctggcggcagcgcaaaagatg

SEQ ID NO: 62262 - DNA, 103 bp, Artificial Sequence
  Synthetic Polynucleotide
taatacgactcactatagggctaatagcataattaagagttcatttttataacagaggagaataaaaatgaactcttaaaacctggcggcagcgcaaaagatg

SEQ ID NO: 62263 - DNA, 103 bp, Artificial Sequence
  Synthetic Polynucleotide
taatacgactcactatagggcatttctaatagcataattaagagttcattaacagaggagaaatgaaatgttaattatgaacctggcggcagcgcaaaagatg

SEQ ID NO: 62264 - DNA, 103 bp, Artificial Sequence
  Synthetic Polynucleotide
taatacgactcactatagggttatccatttctaatagcataattaagagtaacagaggagaactcttatgtatgctattaacctggcggcagcgcaaaagatg

SEQ ID NO: 62265 - DNA, 103 bp, Artificial Sequence
  Synthetic Polynucleotide
taatacgactcactatagggtgattttatccatttctaatagcataattaaacagaggagataattaatgtattagaaaaacctggcggcagcgcaaaagatg

SEQ ID NO: 62266 - DNA, 103 bp, Artificial Sequence
  Synthetic Polynucleotide
taatacgactcactatagggaattttgattttatccatttctaatagcataacagaggagaatgctaatggaaatggataacctggcggcagcgcaaaagatg

SEQ ID NO: 62267 - DNA, 103 bp, Artificial Sequence
  Synthetic Polynucleotide
taatacgactcactatagggaccgtaattttgattttatccatttctaataacagaggagaattagaatgggataaaataacctggcggcagcgcaaaagatg

SEQ ID NO: 62268 - DNA, 103 bp, Artificial Sequence
  Synthetic Polynucleotide
taatacgactcactatagggaatcaaccgtaattttgattttatccatttaacagaggagaaaatggatgaaatcaaaaaacctggcggcagcgcaaaagatg

SEQ ID NO: 62269 - DNA, 103 bp, Artificial Sequence
  Synthetic Polynucleotide
taatacgactcactatagggttttgaatcaaccgtaattttgattttatcaacagaggagagataaaatgaaaattacgaacctggcggcagcgcaaaagatg

SEQ ID NO: 62270 - DNA, 103 bp, Artificial Sequence
  Synthetic Polynucleotide
taatacgactcactatagggctaggtccgttgttcaaaaaaatagattcgaacagaggagacgaatcatgttttttgaaaacctggcggcagcgcaaaagatg

SEQ ID NO: 62271 - DNA, 103 bp, Artificial Sequence
  Synthetic Polynucleotide
taatacgactcactatagggccaatttttgaatcaaccgtaattttgattaacagaggagaaatcaaatgtacggttgaaacctggcggcagcgcaaaagatg

SEQ ID NO: 62272 - DNA, 103 bp, Artificial Sequence
  Synthetic Polynucleotide
taatacgactcactatagggcattaccaatttttgaatcaaccgtaatttaacagaggagaaaattaatgttgattcaaaacctggcggcagcgcaaaagatg

SEQ ID NO: 62273 - DNA, 103 bp, Artificial Sequence
  Synthetic Polynucleotide
taatacgactcactatagggaacaacattaccaatttttgaatcaaccgtaacagaggagaacggttatgtcaaaaattaacctggcggcagcgcaaaagatg

SEQ ID NO: 62274 - DNA, 103 bp, Artificial Sequence
  Synthetic Polynucleotide
taatacgactcactatagggatggtaacaacattaccaatttttgaatcaaacagaggagatgattcatgaattggtaaaacctggcggcagcgcaaaagatg

SEQ ID NO: 62275 - DNA, 103 bp, Artificial Sequence
  Synthetic Polynucleotide
taatacgactcactatagggacgatatggtaacaacattaccaatttttgaacagaggagacaaaaaatggtaatgttgaacctggcggcagcgcaaaagatg

SEQ ID NO: 62276 - DNA, 103 bp, Artificial Sequence
  Synthetic Polynucleotide
taatacgactcactataggggttatacgatatggtaacaacattaccaataacagaggagaattggtatggttgttaccaacctggcggcagcgcaaaagatg

SEQ ID NO: 62277 - DNA, 103 bp, Artificial Sequence
  Synthetic Polynucleotide
taatacgactcactatagggtccaagttatacgatatggtaacaacattaaacagaggagataatgtatgtaccatatcaacctggcggcagcgcaaaagatg

SEQ ID NO: 62278 - DNA, 103 bp, Artificial Sequence
  Synthetic Polynucleotide
taatacgactcactatagggttttttccaagttatacgatatggtaacaaaacagaggagattgttaatgtatcgtataaacctggcggcagcgcaaaagatg

SEQ ID NO: 62279 - DNA, 103 bp, Artificial Sequence
  Synthetic Polynucleotide
taatacgactcactatagggagttattttttccaagttatacgatatggtaacagaggagaaccataatgtataacttgaacctggcggcagcgcaaaagatg

SEQ ID NO: 62280 - DNA, 103 bp, Artificial Sequence
  Synthetic Polynucleotide
taatacgactcactatagggttaatagttattttttccaagttatacgataacagaggagaatcgtaatgcttggaaaaaacctggcggcagcgcaaaagatg

SEQ ID NO: 62281 - DNA, 103 bp, Artificial Sequence
  Synthetic Polynucleotide
taatacgactcactatagggtaccactaggtccgttgttcaaaaaaatagaacagaggagactatttatgtgaacaacgaacctggcggcagcgcaaaagatg

SEQ ID NO: 62282 - DNA, 103 bp, Artificial Sequence
  Synthetic Polynucleotide
taatacgactcactatagggtgtcgttaatagttattttttccaagttataacagaggagaataactatgaaaaaataaaacctggcggcagcgcaaaagatg

SEQ ID NO: 62283 - DNA, 103 bp, Artificial Sequence
  Synthetic Polynucleotide
taatacgactcactatagggtggtgtgtcgttaatagttattttttccaaaacagaggagattggaaatgataactattaacctggcggcagcgcaaaagatg

SEQ ID NO: 62284 - DNA, 103 bp, Artificial Sequence
  Synthetic Polynucleotide
taatacgactcactatagggttttttggtgtgtcgttaatagttatttttaacagaggagaaaaaatatgtattaacgaaacctggcggcagcgcaaaagatg

SEQ ID NO: 62285 - DNA, 103 bp, Artificial Sequence
  Synthetic Polynucleotide
taatacgactcactatagggttttcttttttggtgtgtcgttaatagttaaacagaggagataactaatgacgacacacaacctggcggcagcgcaaaagatg

SEQ ID NO: 62286 - DNA, 103 bp, Artificial Sequence
  Synthetic Polynucleotide
taatacgactcactatagggcatccttttcttttttggtgtgtcgttaataacagaggagaattaacatgacaccaaaaaacctggcggcagcgcaaaagatg

SEQ ID NO: 62287 - DNA, 103 bp, Artificial Sequence
  Synthetic Polynucleotide
taatacgactcactatagggtaatacatccttttcttttttggtgtgtcgaacagaggagacgacacatgaaaaaagaaaacctggcggcagcgcaaaagatg

SEQ ID NO: 62288 - DNA, 103 bp, Artificial Sequence
  Synthetic Polynucleotide
taatacgactcactataggggctaataatacatccttttcttttttggtgaacagaggagacaccaaatgagaaaaggaaacctggcggcagcgcaaaagatg

SEQ ID NO: 62289 - DNA, 103 bp, Artificial Sequence
  Synthetic Polynucleotide
taatacgactcactatagggattgcgctaataatacatccttttctttttaacagaggagaaaaaagatgaggatgtataacctggcggcagcgcaaaagatg

SEQ ID NO: 62290 - DNA, 103 bp, Artificial Sequence
  Synthetic Polynucleotide
taatacgactcactatagggaactgattgcgctaataatacatccttttcaacagaggagagaaaagatggtattattaaacctggcggcagcgcaaaagatg

SEQ ID NO: 62291 - DNA, 103 bp, Artificial Sequence
  Synthetic Polynucleotide
taatacgactcactatagggacagcaactgattgcgctaataatacatccaacagaggagaggatgtatgattagcgcaaacctggcggcagcgcaaaagatg

SEQ ID NO: 62292 - DNA, 103 bp, Artificial Sequence
  Synthetic Polynucleotide
taatacgactcactatagggagatataccactaggtccgttgttcaaaaaaacagaggagatttttgatgaacggacctaacctggcggcagcgcaaaagatg

SEQ ID NO: 62293 - DNA, 103 bp, Artificial Sequence
  Synthetic Polynucleotide
taatacgactcactatagggcttcaacagcaactgattgcgctaataataaacagaggagatattatatgcgcaatcagaacctggcggcagcgcaaaagatg

SEQ ID NO: 62294 - DNA, 103 bp, Artificial Sequence
  Synthetic Polynucleotide
taatacgactcactatagggtgcctcttcaacagcaactgattgcgctaaaacagaggagattagcgatgtcagttgctaacctggcggcagcgcaaaagatg

SEQ ID NO: 62295 - DNA, 103 bp, Artificial Sequence
  Synthetic Polynucleotide
taatacgactcactatagggtcttttgcctcttcaacagcaactgattgcaacagaggagagcaatcatgtgctgttgaaacctggcggcagcgcaaaagatg

SEQ ID NO: 62296 - DNA, 103 bp, Artificial Sequence
  Synthetic Polynucleotide
taatacgactcactatagggtgacatcttttgcctcttcaacagcaactgaacagaggagacagttgatgttgaagaggaacctggcggcagcgcaaaagatg

SEQ ID NO: 62297 - DNA, 103 bp, Artificial Sequence
  Synthetic Polynucleotide
taatacgactcactatagggcaccttgacatcttttgcctcttcaacagcaacagaggagagctgttatggaggcaaaaaacctggcggcagcgcaaaagatg

SEQ ID NO: 62298 - DNA, 103 bp, Artificial Sequence
  Synthetic Polynucleotide
taatacgactcactatagggtcttccaccttgacatcttttgcctcttcaaacagaggagatgaagaatgaaaagatgtaacctggcggcagcgcaaaagatg

SEQ ID NO: 62299 - DNA, 103 bp, Artificial Sequence
  Synthetic Polynucleotide
taatacgactcactatagggttttttcttccaccttgacatcttttgcctaacagaggagaaggcaaatgatgtcaaggaacctggcggcagcgcaaaagatg

SEQ ID NO: 62300 - DNA, 103 bp, Artificial Sequence
  Synthetic Polynucleotide
taatacgactcactataggggatatttttttcttccaccttgacatctttaacagaggagaaaagatatgaaggtggaaaacctggcggcagcgcaaaagatg

SEQ ID NO: 62301 - DNA, 103 bp, Artificial Sequence
  Synthetic Polynucleotide
taatacgactcactatagggatatcgatatttttttcttccaccttgacaaacagaggagatgtcaaatgggaagaaaaaacctggcggcagcgcaaaagatg

SEQ ID NO: 62302 - DNA, 103 bp, Artificial Sequence
  Synthetic Polynucleotide
taatacgactcactatagggtttcaatatcgatatttttttcttccacctaacagaggagaaggtggatgaaaaaaataaacctggcggcagcgcaaaagatg

SEQ ID NO: 62303 - DNA, 103 bp, Artificial Sequence
  Synthetic Polynucleotide
taatacgactcactataggggaacaagatataccactaggtccgttgttcaacagaggagagaacaaatgacctagtggaacctggcggcagcgcaaaagatg

SEQ ID NO: 62304 - DNA, 103 bp, Artificial Sequence
  Synthetic Polynucleotide
taatacgactcactataggggtcattttcaatatcgatatttttttcttcaacagaggagagaagaaatgaatatcgataacctggcggcagcgcaaaagatg

SEQ ID NO: 62305 - DNA, 103 bp, Artificial Sequence
  Synthetic Polynucleotide
taatacgactcactatagggtcattgtcattttcaatatcgatattttttaacagaggagaaaaaaaatgcgatattgaaacctggcggcagcgcaaaagatg

SEQ ID NO: 62306 - DNA, 103 bp, Artificial Sequence
  Synthetic Polynucleotide
taatacgactcactatagggcatcgtcattgtcattttcaatatcgatataacagaggagaatatcgatgttgaaaatgaacctggcggcagcgcaaaagatg

SEQ ID NO: 62307 - DNA, 103 bp, Artificial Sequence
  Synthetic Polynucleotide
taatacgactcactatagggcatatcatcgtcattgtcattttcaatatcaacagaggagagatattatgaatgacaataacctggcggcagcgcaaaagatg

SEQ ID NO: 62308 - DNA, 103 bp, Artificial Sequence
  Synthetic Polynucleotide
taatacgactcactatagggacatccatatcatcgtcattgtcattttcaaacagaggagatgaaaaatgcaatgacgaaacctggcggcagcgcaaaagatg

SEQ ID NO: 62309 - DNA, 103 bp, Artificial Sequence
  Synthetic Polynucleotide
taatacgactcactatagggtttctacatccatatcatcgtcattgtcataacagaggagaatgacaatgacgatgataaacctggcggcagcgcaaaagatg

SEQ ID NO: 62310 - DNA, 103 bp, Artificial Sequence
  Synthetic Polynucleotide
taatacgactcactatagggcacgctttctacatccatatcatcgtcattaacagaggagaaatgacatggatatggataacctggcggcagcgcaaaagatg

SEQ ID NO: 62311 - DNA, 103 bp, Artificial Sequence
  Synthetic Polynucleotide
taatacgactcactatagggtattacacgctttctacatccatatcatcgaacagaggagacgatgaatgggatgtagaaacctggcggcagcgcaaaagatg

SEQ ID NO: 62312 - DNA, 103 bp, Artificial Sequence
  Synthetic Polynucleotide
taatacgactcactataggggatcgtattacacgctttctacatccatataacagaggagaatatggatgtagaaagcgaacctggcggcagcgcaaaagatg

SEQ ID NO: 62313 - DNA, 103 bp, Artificial Sequence
  Synthetic Polynucleotide
taatacgactcactatagggttatagatcgtattacacgctttctacatcaacagaggagagatgtaatgagcgtgtaaaacctggcggcagcgcaaaagatg

SEQ ID NO: 62314 - DNA, 103 bp, Artificial Sequence
  Synthetic Polynucleotide
taatacgactcactatagggacatagaacaagatataccactaggtccgtaacagaggagaacggacatggtggtatataacctggcggcagcgcaaaagatg

SEQ ID NO: 62315 - DNA, 103 bp, Artificial Sequence
  Synthetic Polynucleotide
taatacgactcactatagggattttttatagatcgtattacacgctttctaacagaggagaagaaagatggtaatacgaaacctggcggcagcgcaaaagatg

SEQ ID NO: 62316 - DNA, 103 bp, Artificial Sequence
  Synthetic Polynucleotide
taatacgactcactatagggtacttattttttatagatcgtattacacgcaacagaggagagcgtgtatgacgatctataacctggcggcagcgcaaaagatg

SEQ ID NO: 62317 - DNA, 103 bp, Artificial Sequence
  Synthetic Polynucleotide
taatacgactcactatagggttatatacttattttttatagatcgtattaaacagaggagataatacatgctataaaaaaacctggcggcagcgcaaaagatg

SEQ ID NO: 62318 - DNA, 103 bp, Artificial Sequence
  Synthetic Polynucleotide
taatacgactcactatagggagtatttatatacttattttttatagatcgaacagaggagacgatctatgaaaaataagaacctggcggcagcgcaaaagatg

SEQ ID NO: 62319 - DNA, 103 bp, Artificial Sequence
  Synthetic Polynucleotide
taatacgactcactatagggtaaaaagtatttatatacttattttttataaacagaggagatataaaatgtaagtatataacctggcggcagcgcaaaagatg

SEQ ID NO: 62320 - DNA, 103 bp, Artificial Sequence
  Synthetic Polynucleotide
taatacgactcactataggggtaaataaaaagtatttatatacttattttaacagaggagaaaaataatgatataaataaacctggcggcagcgcaaaagatg

SEQ ID NO: 62321 - DNA, 103 bp, Artificial Sequence
  Synthetic Polynucleotide
taatacgactcactataggggtaccgtaaataaaaagtatttatatacttaacagaggagaaagtatatgaatacttttaacctggcggcagcgcaaaagatg

SEQ ID NO: 62322 - DNA, 103 bp, Artificial Sequence
  Synthetic Polynucleotide
taatacgactcactatagggcaagagtaccgtaaataaaaagtatttataaacagaggagatataaaatgtttttatttaacctggcggcagcgcaaaagatg

SEQ ID NO: 62323 - DNA, 103 bp, Artificial Sequence
  Synthetic Polynucleotide
taatacgactcactatagggcactacaagagtaccgtaaataaaaagtataacagaggagaatacttatgatttacggtaacctggcggcagcgcaaaagatg

SEQ ID NO: 62324 - DNA, 103 bp, Artificial Sequence
  Synthetic Polynucleotide
taatacgactcactatagggattaccactacaagagtaccgtaaataaaaaacagaggagattttatatgcggtactctaacctggcggcagcgcaaaagatg

SEQ ID NO: 62325 - DNA, 103 bp, Artificial Sequence
  Synthetic Polynucleotide
taatacgactcactatagggtagatacatagaacaagatataccactaggaacagaggagacctagtatgatatcttgtaacctggcggcagcgcaaaagatg

SEQ ID NO: 62326 - DNA, 103 bp, Artificial Sequence
  Synthetic Polynucleotide
taatacgactcactatagggggggtattaccactacaagagtaccgtaaaaacagaggagatttacgatgctcttgtagaacctggcggcagcgcaaaagatg

SEQ ID NO: 62327 - DNA, 103 bp, Artificial Sequence
  Synthetic Polynucleotide
taatacgactcactataggggagtaggggtattaccactacaagagtaccaacagaggagaggtactatggtagtggtaaacctggcggcagcgcaaaagatg

SEQ ID NO: 62328 - DNA, 103 bp, Artificial Sequence
  Synthetic Polynucleotide
taatacgactcactatagggtaatcgagtaggggtattaccactacaagaaacagaggagatcttgtatgggtaataccaacctggcggcagcgcaaaagatg

SEQ ID NO: 62329 - DNA, 103 bp, Artificial Sequence
  Synthetic Polynucleotide
taatacgactcactatagggaaaaataatcgagtaggggtattaccactaaacagaggagatagtggatgtacccctacaacctggcggcagcgcaaaagatg

SEQ ID NO: 62330 - DNA, 103 bp, Artificial Sequence
  Synthetic Polynucleotide
taatacgactcactatagggttaaaaaaaataatcgagtaggggtattacaacagaggagagtaataatgctactcgataacctggcggcagcgcaaaagatg

SEQ ID NO: 62331 - DNA, 103 bp, Artificial Sequence
  Synthetic Polynucleotide
taatacgactcactatagggtttttttaaaaaaaataatcgagtaggggtaacagaggagaacccctatgcgattatttaacctggcggcagcgcaaaagatg

SEQ ID NO: 62332 - DNA, 103 bp, Artificial Sequence
  Synthetic Polynucleotide
taatacgactcactataggggtatttttttttaaaaaaaataatcgagtaaacagaggagatactcgatgattttttttaacctggcggcagcgcaaaagatg

SEQ ID NO: 62333 - DNA, 103 bp, Artificial Sequence
  Synthetic Polynucleotide
taatacgactcactatagggaataagtatttttttttaaaaaaaataatcaacagaggagagattatatgttttaaaaaaacctggcggcagcgcaaaagatg

SEQ ID NO: 62334 - DNA, 103 bp, Artificial Sequence
  Synthetic Polynucleotide
taatacgactcactatagggatcagaataagtatttttttttaaaaaaaaaacagaggagattttttatgaaaaaaaataacctggcggcagcgcaaaagatg

SEQ ID NO: 62335 - DNA, 103 bp, Artificial Sequence
  Synthetic Polynucleotide
taatacgactcactataggggaataatcagaataagtatttttttttaaaaacagaggagatttaaaatgaaatacttaaacctggcggcagcgcaaaagatg

SEQ ID NO: 62336 - DNA, 103 bp, Artificial Sequence
  Synthetic Polynucleotide
taatacgactcactatagggtattttagatacatagaacaagatataccaaacagaggagatggtatatgttgttctataacctggcggcagcgcaaaagatg

SEQ ID NO: 62337 - DNA, 103 bp, Artificial Sequence
  Synthetic Polynucleotide
taatacgactcactatagggggctagaataatcagaataagtatttttttaacagaggagaaaaaaaatgcttattctgaacctggcggcagcgcaaaagatg

SEQ ID NO: 62338 - DNA, 103 bp, Artificial Sequence
  Synthetic Polynucleotide
taatacgactcactataggggaaatggctagaataatcagaataagtattaacagaggagaaatactatgtctgattataacctggcggcagcgcaaaagatg

SEQ ID NO: 62339 - DNA, 103 bp, Artificial Sequence
  Synthetic Polynucleotide
taatacgactcactatagggacacggaaatggctagaataatcagaataaaacagaggagattattcatgttattctagaacctggcggcagcgcaaaagatg

SEQ ID NO: 62340 - DNA, 103 bp, Artificial Sequence
  Synthetic Polynucleotide
taatacgactcactatagggaacgaacacggaaatggctagaataatcagaacagaggagactgattatgctagccattaacctggcggcagcgcaaaagatg

SEQ ID NO: 62341 - DNA, 103 bp, Artificial Sequence
  Synthetic Polynucleotide
taatacgactcactatagggatttgaacgaacacggaaatggctagaataaacagaggagatattctatgcatttccgtaacctggcggcagcgcaaaagatg

SEQ ID NO: 62342 - DNA, 103 bp, Artificial Sequence
  Synthetic Polynucleotide
taatacgactcactataggggtggcatttgaacgaacacggaaatggctaaacagaggagatagccaatgccgtgttcgaacctggcggcagcgcaaaagatg

SEQ ID NO: 62343 - DNA, 103 bp, Artificial Sequence
  Synthetic Polynucleotide
taatacgactcactatagggttgatgtggcatttgaacgaacacggaaataacagaggagaatttccatgttcgttcaaaacctggcggcagcgcaaaagatg

SEQ ID NO: 62344 - DNA, 103 bp, Artificial Sequence
  Synthetic Polynucleotide
taatacgactcactatagggtatctttgatgtggcatttgaacgaacacgaacagaggagacgtgttatgtcaaatgccaacctggcggcagcgcaaaagatg

SEQ ID NO: 62345 - DNA, 103 bp, Artificial Sequence
  Synthetic Polynucleotide
taatacgactcactatagggtcccatatctttgatgtggcatttgaacgaaacagaggagatcgttcatgtgccacatcaacctggcggcagcgcaaaagatg

SEQ ID NO: 62346 - DNA, 103 bp, Artificial Sequence
  Synthetic Polynucleotide
taatacgactcactatagggactactcccatatctttgatgtggcatttgaacagaggagacaaatgatgcatcaaagaaacctggcggcagcgcaaaagatg

SEQ ID NO: 62347 - DNA, 103 bp, Artificial Sequence
  Synthetic Polynucleotide
taatacgactcactataggggctttacgacgaagttacaaatatgctagtaacagaggagaactagcatgtttgtaactaacctggcggcagcgcaaaagatg

SEQ ID NO: 62348 - DNA, 103 bp, Artificial Sequence
  Synthetic Polynucleotide
taatacgactcactataggggacattattttagatacatagaacaagataaacagaggagatatcttatgctatgtatcaacctggcggcagcgcaaaagatg

SEQ ID NO: 62349 - DNA, 103 bp, Artificial Sequence
  Synthetic Polynucleotide
taatacgactcactatagggtttcaactactcccatatctttgatgtggcaacagaggagagccacaatgaagatatggaacctggcggcagcgcaaaagatg

SEQ ID NO: 62350 - DNA, 103 bp, Artificial Sequence
  Synthetic Polynucleotide
taatacgactcactatagggctagatttcaactactcccatatctttgataacagaggagaatcaaaatgatgggagtaaacctggcggcagcgcaaaagatg

SEQ ID NO: 62351 - DNA, 103 bp, Artificial Sequence
  Synthetic Polynucleotide
taatacgactcactatagggcagaactagatttcaactactcccatatctaacagaggagaagatatatgagtagttgaaacctggcggcagcgcaaaagatg

SEQ ID NO: 62352 - DNA, 103 bp, Artificial Sequence
  Synthetic Polynucleotide
taatacgactcactatagggcaatgcagaactagatttcaactactcccaaacagaggagatgggagatgttgaaatctaacctggcggcagcgcaaaagatg

SEQ ID NO: 62353 - DNA, 103 bp, Artificial Sequence
  Synthetic Polynucleotide
taatacgactcactataggggccaacaatgcagaactagatttcaactacaacagaggagagtagttatgatctagttcaacctggcggcagcgcaaaagatg

SEQ ID NO: 62354 - DNA, 103 bp, Artificial Sequence
  Synthetic Polynucleotide
taatacgactcactatagggggcgcgccaacaatgcagaactagatttcaaacagaggagatgaaatatggttctgcataacctggcggcagcgcaaaagatg

SEQ ID NO: 62355 - DNA, 103 bp, Artificial Sequence
  Synthetic Polynucleotide
taatacgactcactatagggtttgaggcgcgccaacaatgcagaactagaaacagaggagatctagtatggcattgttgaacctggcggcagcgcaaaagatg

SEQ ID NO: 62356 - DNA, 103 bp, Artificial Sequence
  Synthetic Polynucleotide
taatacgactcactatagggctacatttgaggcgcgccaacaatgcagaaaacagaggagattctgcatggttggcgcgaacctggcggcagcgcaaaagatg

SEQ ID NO: 62357 - DNA, 103 bp, Artificial Sequence
  Synthetic Polynucleotide
taatacgactcactatagggcaacactacatttgaggcgcgccaacaatgaacagaggagacattgtatgcgcgcctcaaacctggcggcagcgcaaaagatg

SEQ ID NO: 62358 - DNA, 103 bp, Artificial Sequence
  Synthetic Polynucleotide
taatacgactcactatagggatatccaacactacatttgaggcgcgccaaaacagaggagattggcgatgctcaaatgtaacctggcggcagcgcaaaagatg

SEQ ID NO: 62359 - DNA, 103 bp, Artificial Sequence
  Synthetic Polynucleotide
taatacgactcactatagggtgtcagacattattttagatacatagaacaaacagaggagatgttctatgtatctaaaaaacctggcggcagcgcaaaagatg

SEQ ID NO: 62360 - DNA, 103 bp, Artificial Sequence
  Synthetic Polynucleotide
taatacgactcactatagggtgaagatatccaacactacatttgaggcgcaacagaggagagcgcctatgatgtagtgtaacctggcggcagcgcaaaagatg

SEQ ID NO: 62361 - DNA, 103 bp, Artificial Sequence
  Synthetic Polynucleotide
taatacgactcactatagggtacgttgaagatatccaacactacatttgaaacagaggagatcaaatatggtgttggataacctggcggcagcgcaaaagatg

SEQ ID NO: 62362 - DNA, 103 bp, Artificial Sequence
  Synthetic Polynucleotide
taatacgactcactatagggaactatacgttgaagatatccaacactacaaacagaggagatgtagtatgggatatcttaacctggcggcagcgcaaaagatg

SEQ ID NO: 62363 - DNA, 103 bp, Artificial Sequence
  Synthetic Polynucleotide
taatacgactcactatagggtcaacaactatacgttgaagatatccaacaaacagaggagatgttggatgtcttcaacgaacctggcggcagcgcaaaagatg

SEQ ID NO: 62364 - DNA, 103 bp, Artificial Sequence
  Synthetic Polynucleotide
taatacgactcactatagggactactcaacaactatacgttgaagatatcaacagaggagagatatcatgaacgtatagaacctggcggcagcgcaaaagatg

SEQ ID NO: 62365 - DNA, 103 bp, Artificial Sequence
  Synthetic Polynucleotide
taatacgactcactatagggccatcactactcaacaactatacgttgaagaacagaggagacttcaaatgatagttgttaacctggcggcagcgcaaaagatg

SEQ ID NO: 62366 - DNA, 103 bp, Artificial Sequence
  Synthetic Polynucleotide
taatacgactcactataggggaaaaccatcactactcaacaactatacgtaacagaggagaacgtatatgtgttgagtaaacctggcggcagcgcaaaagatg

SEQ ID NO: 62367 - DNA, 103 bp, Artificial Sequence
  Synthetic Polynucleotide
taatacgactcactatagggatttagaaaaccatcactactcaacaactaaacagaggagatagttgatgagtagtgataacctggcggcagcgcaaaagatg

SEQ ID NO: 62368 - DNA, 103 bp, Artificial Sequence
  Synthetic Polynucleotide
taatacgactcactatagggattctatttagaaaaccatcactactcaacaacagaggagagttgagatgtgatggtttaacctggcggcagcgcaaaagatg

SEQ ID NO: 62369 - DNA, 103 bp, Artificial Sequence
  Synthetic Polynucleotide
taatacgactcactatagggagagaattctatttagaaaaccatcactacaacagaggagagtagtgatggttttctaaaacctggcggcagcgcaaaagatg

SEQ ID NO: 62370 - DNA, 103 bp, Artificial Sequence
  Synthetic Polynucleotide
taatacgactcactataggggatcttgtcagacattattttagatacataaacagaggagatatgtaatgaaaataatgaacctggcggcagcgcaaaagatg

SEQ ID NO: 62371 - DNA, 103 bp, Artificial Sequence
  Synthetic Polynucleotide
taatacgactcactatagggtatgaagagaattctatttagaaaaccatcaacagaggagagatggtatgctaaatagaaacctggcggcagcgcaaaagatg

SEQ ID NO: 62372 - DNA, 103 bp, Artificial Sequence
  Synthetic Polynucleotide
taatacgactcactatagggaatgatatgaagagaattctatttagaaaaaacagaggagattttctatgtagaattctaacctggcggcagcgcaaaagatg

SEQ ID NO: 62373 - DNA, 103 bp, Artificial Sequence
  Synthetic Polynucleotide
taatacgactcactataggggcaagaatgatatgaagagaattctatttaaacagaggagataaataatgttctcttcaaacctggcggcagcgcaaaagatg

SEQ ID NO: 62374 - DNA, 103 bp, Artificial Sequence
  Synthetic Polynucleotide
taatacgactcactatagggcacgtgcaagaatgatatgaagagaattctaacagaggagaagaattatgttcatatcaaacctggcggcagcgcaaaagatg

SEQ ID NO: 62375 - DNA, 103 bp, Artificial Sequence
  Synthetic Polynucleotide
taatacgactcactatagggatgtacacgtgcaagaatgatatgaagagaaacagaggagatctcttatgatcattcttaacctggcggcagcgcaaaagatg

SEQ ID NO: 62376 - DNA, 103 bp, Artificial Sequence
  Synthetic Polynucleotide
taatacgactcactatagggtaaaaatgtacacgtgcaagaatgatatgaaacagaggagatcatatatgtcttgcacgaacctggcggcagcgcaaaagatg

SEQ ID NO: 62377 - DNA, 103 bp, Artificial Sequence
  Synthetic Polynucleotide
taatacgactcactataggggatgctaaaaatgtacacgtgcaagaatgaaacagaggagatcattcatgcacgtgtacaacctggcggcagcgcaaaagatg

SEQ ID NO: 62378 - DNA, 103 bp, Artificial Sequence
  Synthetic Polynucleotide
taatacgactcactatagggagatggatgctaaaaatgtacacgtgcaagaacagaggagacttgcaatggtacattttaacctggcggcagcgcaaaagatg

SEQ ID NO: 62379 - DNA, 103 bp, Artificial Sequence
  Synthetic Polynucleotide
taatacgactcactatagggttccaagatggatgctaaaaatgtacacgtaacagaggagaacgtgtatgtttttagcaaacctggcggcagcgcaaaagatg

SEQ ID NO: 62380 - DNA, 103 bp, Artificial Sequence
  Synthetic Polynucleotide
taatacgactcactatagggtaggattccaagatggatgctaaaaatgtaaacagaggagatacattatgagcatccataacctggcggcagcgcaaaagatg

SEQ ID NO: 62381 - DNA, 103 bp, Artificial Sequence
  Synthetic Polynucleotide
taatacgactcactatagggtaacggatcttgtcagacattattttagataacagaggagaatctaaatgaatgtctgaaacctggcggcagcgcaaaagatg

SEQ ID NO: 62382 - DNA, 103 bp, Artificial Sequence
  Synthetic Polynucleotide
taatacgactcactatagggggatctaggattccaagatggatgctaaaaaacagaggagattttagatgccatcttggaacctggcggcagcgcaaaagatg

SEQ ID NO: 62383 - DNA, 103 bp, Artificial Sequence
  Synthetic Polynucleotide
taatacgactcactatagggaacaaggatctaggattccaagatggatgcaacagaggagagcatccatgttggaatccaacctggcggcagcgcaaaagatg

SEQ ID NO: 62384 - DNA, 103 bp, Artificial Sequence
  Synthetic Polynucleotide
taatacgactcactatagggaatagaacaaggatctaggattccaagatgaacagaggagacatcttatgatcctagataacctggcggcagcgcaaaagatg

SEQ ID NO: 62385 - DNA, 103 bp, Artificial Sequence
  Synthetic Polynucleotide
taatacgactcactatagggttgggaatagaacaaggatctaggattccaaacagaggagatggaatatgagatccttgaacctggcggcagcgcaaaagatg

SEQ ID NO: 62386 - DNA, 103 bp, Artificial Sequence
  Synthetic Polynucleotide
taatacgactcactatagggaaccattgggaatagaacaaggatctaggaaacagaggagatcctagatgcttgttctaaacctggcggcagcgcaaaagatg

SEQ ID NO: 62387 - DNA, 103 bp, Artificial Sequence
  Synthetic Polynucleotide
taatacgactcactataggggatgaaaccattgggaatagaacaaggatcaacagaggagagatcctatgtctattcccaacctggcggcagcgcaaaagatg

SEQ ID NO: 62388 - DNA, 103 bp, Artificial Sequence
  Synthetic Polynucleotide
taatacgactcactatagggctattgatgaaaccattgggaatagaacaaaacagaggagattgttcatgtcccaatggaacctggcggcagcgcaaaagatg

SEQ ID NO: 62389 - DNA, 103 bp, Artificial Sequence
  Synthetic Polynucleotide
taatacgactcactatagggatcttctattgatgaaaccattgggaatagaacagaggagactattcatgatggtttcaaacctggcggcagcgcaaaagatg

SEQ ID NO: 62390 - DNA, 103 bp, Artificial Sequence
  Synthetic Polynucleotide
taatacgactcactataggggtttaatcttctattgatgaaaccattgggaacagaggagacccaatatgttcatcaataacctggcggcagcgcaaaagatg

SEQ ID NO: 62391 - DNA, 103 bp, Artificial Sequence
  Synthetic Polynucleotide
taatacgactcactataggggatatgtttaatcttctattgatgaaaccaaacagaggagatggtttatgcaatagaagaacctggcggcagcgcaaaagatg

SEQ ID NO: 62392 - DNA, 103 bp, Artificial Sequence
  Synthetic Polynucleotide
taatacgactcactatagggtaaactaacggatcttgtcagacattatttaacagaggagaaaataaatgctgacaagaaacctggcggcagcgcaaaagatg

SEQ ID NO: 62393 - DNA, 103 bp, Artificial Sequence
  Synthetic Polynucleotide
taatacgactcactatagggcgtacgatatgtttaatcttctattgatgaaacagaggagatcatcaatggaagattaaaacctggcggcagcgcaaaagatg

SEQ ID NO: 62394 - DNA, 103 bp, Artificial Sequence
  Synthetic Polynucleotide
taatacgactcactataggggtgttcgtacgatatgtttaatcttctattaacagaggagaaatagaatgttaaacataaacctggcggcagcgcaaaagatg

SEQ ID NO: 62395 - DNA, 103 bp, Artificial Sequence
  Synthetic Polynucleotide
taatacgactcactatagggccatcgtgttcgtacgatatgtttaatcttaacagaggagaaagattatgcatatcgtaaacctggcggcagcgcaaaagatg

SEQ ID NO: 62396 - DNA, 103 bp, Artificial Sequence
  Synthetic Polynucleotide
taatacgactcactatagggactctccatcgtgttcgtacgatatgtttaaacagaggagataaacaatgcgtacgaacaacctggcggcagcgcaaaagatg

SEQ ID NO: 62397 - DNA, 103 bp, Artificial Sequence
  Synthetic Polynucleotide
taatacgactcactatagggcggttactctccatcgtgttcgtacgatataacagaggagaatatcgatggaacacgataacctggcggcagcgcaaaagatg

SEQ ID NO: 62398 - DNA, 103 bp, Artificial Sequence
  Synthetic Polynucleotide
taatacgactcactatagggtgctacggttactctccatcgtgttcgtacaacagaggagagtacgaatgcgatggagaaacctggcggcagcgcaaaagatg

SEQ ID NO: 62399 - DNA, 103 bp, Artificial Sequence
  Synthetic Polynucleotide
taatacgactcactatagggacttttgctacggttactctccatcgtgttaacagaggagaaacacgatggagagtaacaacctggcggcagcgcaaaagatg

SEQ ID NO: 62400 - DNA, 103 bp, Artificial Sequence
  Synthetic Polynucleotide
taatacgactcactatagggtgcttacttttgctacggttactctccatcaacagaggagagatggaatgtaaccgtagaacctggcggcagcgcaaaagatg

SEQ ID NO: 62401 - DNA, 103 bp, Artificial Sequence
  Synthetic Polynucleotide
taatacgactcactatagggggaaatgcttacttttgctacggttactctaacagaggagaagagtaatggtagcaaaaaacctggcggcagcgcaaaagatg

SEQ ID NO: 62402 - DNA, 103 bp, Artificial Sequence
  Synthetic Polynucleotide
taatacgactcactatagggttaaaggaaatgcttacttttgctacggttaacagaggagaaaccgtatgaaaagtaagaacctggcggcagcgcaaaagatg

SEQ ID NO: 62403 - DNA, 103 bp, Artificial Sequence
  Synthetic Polynucleotide
taatacgactcactataggggatattaaactaacggatcttgtcagacataacagaggagaatgtctatgaagatccgtaacctggcggcagcgcaaaagatg

SEQ ID NO: 62404 - DNA, 103 bp, Artificial Sequence
  Synthetic Polynucleotide
taatacgactcactatagggtgagattaaaggaaatgcttacttttgctaaacagaggagatagcaaatgtaagcatttaacctggcggcagcgcaaaagatg

SEQ ID NO: 62405 - DNA, 103 bp, Artificial Sequence
  Synthetic Polynucleotide
taatacgactcactatagggggatctgagattaaaggaaatgcttactttaacagaggagaaaagtaatgatttcctttaacctggcggcagcgcaaaagatg

SEQ ID NO: 62406 - DNA, 103 bp, Artificial Sequence
  Synthetic Polynucleotide
taatacgactcactatagggatccgggatctgagattaaaggaaatgcttaacagaggagaaagcatatgctttaatctaacctggcggcagcgcaaaagatg

SEQ ID NO: 62407 - DNA, 103 bp, Artificial Sequence
  Synthetic Polynucleotide
taatacgactcactatagggccagtatccgggatctgagattaaaggaaaaacagaggagatttcctatgatctcagataacctggcggcagcgcaaaagatg

SEQ ID NO: 62408 - DNA, 103 bp, Artificial Sequence
  Synthetic Polynucleotide
taatacgactcactatagggtatatccagtatccgggatctgagattaaaaacagaggagatttaatatgagatcccggaacctggcggcagcgcaaaagatg

SEQ ID NO: 62409 - DNA, 103 bp, Artificial Sequence
  Synthetic Polynucleotide
taatacgactcactatagggtaaaatatatccagtatccgggatctgagaaacagaggagatctcagatgccggatactaacctggcggcagcgcaaaagatg

SEQ ID NO: 62410 - DNA, 103 bp, Artificial Sequence
  Synthetic Polynucleotide
taatacgactcactatagggggctgtaaaatatatccagtatccgggatcaacagaggagagatcccatgtactggataaacctggcggcagcgcaaaagatg

SEQ ID NO: 62411 - DNA, 103 bp, Artificial Sequence
  Synthetic Polynucleotide
taatacgactcactataggggtgttggctgtaaaatatatccagtatccgaacagaggagacggataatggatatatttaacctggcggcagcgcaaaagatg

SEQ ID NO: 62412 - DNA, 103 bp, Artificial Sequence
  Synthetic Polynucleotide
taatacgactcactatagggtgcatgtgttggctgtaaaatatatccagtaacagaggagaactggaatgattttacagaacctggcggcagcgcaaaagatg

SEQ ID NO: 62413 - DNA, 103 bp, Artificial Sequence
  Synthetic Polynucleotide
taatacgactcactatagggatggatgcatgtgttggctgtaaaatatataacagaggagaatatatatgacagccaacaacctggcggcagcgcaaaagatg

SEQ ID NO: 62414 - DNA, 103 bp, Artificial Sequence
  Synthetic Polynucleotide
taatacgactcactatagggctaaggatattaaactaacggatcttgtcaaacagaggagatgacaaatgccgttagttaacctggcggcagcgcaaaagatg

SEQ ID NO: 62415 - DNA, 103 bp, Artificial Sequence
  Synthetic Polynucleotide
taatacgactcactataggggttgcatggatgcatgtgttggctgtaaaaaacagaggagattttacatgcaacacatgaacctggcggcagcgcaaaagatg

SEQ ID NO: 62416 - DNA, 103 bp, Artificial Sequence
  Synthetic Polynucleotide
taatacgactcactataggggaaatgttgcatggatgcatgtgttggctgaacagaggagacagccaatgcatgcatccaacctggcggcagcgcaaaagatg

SEQ ID NO: 62417 - DNA, 103 bp, Artificial Sequence
  Synthetic Polynucleotide
taatacgactcactatagggtgtaggaaatgttgcatggatgcatgtgttaacagaggagaaacacaatgatccatgcaaacctggcggcagcgcaaaagatg

SEQ ID NO: 62418 - DNA, 103 bp, Artificial Sequence
  Synthetic Polynucleotide
taatacgactcactataggggtatatgtaggaaatgttgcatggatgcataacagaggagaatgcatatgtgcaacattaacctggcggcagcgcaaaagatg

SEQ ID NO: 62419 - DNA, 103 bp, Artificial Sequence
  Synthetic Polynucleotide
taatacgactcactataggggccgggtatatgtaggaaatgttgcatggaaacagaggagatccatgatgcatttcctaaacctggcggcagcgcaaaagatg

SEQ ID NO: 62420 - DNA, 103 bp, Artificial Sequence
  Synthetic Polynucleotide
taatacgactcactatagggacatagccgggtatatgtaggaaatgttgcaacagaggagagcaacaatgcctacatataacctggcggcagcgcaaaagatg

SEQ ID NO: 62421 - DNA, 103 bp, Artificial Sequence
  Synthetic Polynucleotide
taatacgactcactataggggcggtacatagccgggtatatgtaggaaataacagaggagaatttccatgatatacccgaacctggcggcagcgcaaaagatg

SEQ ID NO: 62422 - DNA, 103 bp, Artificial Sequence
  Synthetic Polynucleotide
taatacgactcactatagggatgacgcggtacatagccgggtatatgtagaacagaggagactacatatgcccggctataacctggcggcagcgcaaaagatg

SEQ ID NO: 62423 - DNA, 103 bp, Artificial Sequence
  Synthetic Polynucleotide
taatacgactcactatagggcgatgatgacgcggtacatagccgggtataaacagaggagatataccatgctatgtaccaacctggcggcagcgcaaaagatg

SEQ ID NO: 62424 - DNA, 103 bp, Artificial Sequence
  Synthetic Polynucleotide
taatacgactcactatagggacagtcgatgatgacgcggtacatagccggaacagaggagaccggctatgtaccgcgtcaacctggcggcagcgcaaaagatg

SEQ ID NO: 62425 - DNA, 103 bp, Artificial Sequence
  Synthetic Polynucleotide
taatacgactcactataggggatgactaaggatattaaactaacggatctaacagaggagaagatccatgagtttaataaacctggcggcagcgcaaaagatg

SEQ ID NO: 62426 - DNA, 103 bp, Artificial Sequence
  Synthetic Polynucleotide
taatacgactcactatagggatcgtacagtcgatgatgacgcggtacataaacagaggagatatgtaatgcgtcatcataacctggcggcagcgcaaaagatg

SEQ ID NO: 62427 - DNA, 103 bp, Artificial Sequence
  Synthetic Polynucleotide
taatacgactcactatagggtatgtatcgtacagtcgatgatgacgcggtaacagaggagaaccgcgatgtcatcgactaacctggcggcagcgcaaaagatg

SEQ ID NO: 62428 - DNA, 103 bp, Artificial Sequence
  Synthetic Polynucleotide
taatacgactcactatagggaacattatgtatcgtacagtcgatgatgacaacagaggagagtcatcatggactgtacgaacctggcggcagcgcaaaagatg

SEQ ID NO: 62429 - DNA, 103 bp, Artificial Sequence
  Synthetic Polynucleotide
taatacgactcactatagggacggtaacattatgtatcgtacagtcgatgaacagaggagacatcgaatgtacgatacaaacctggcggcagcgcaaaagatg

SEQ ID NO: 62430 - DNA, 103 bp, Artificial Sequence
  Synthetic Polynucleotide
taatacgactcactataggggcaacacggtaacattatgtatcgtacagtaacagaggagaactgtaatgtacataatgaacctggcggcagcgcaaaagatg

SEQ ID NO: 62431 - DNA, 103 bp, Artificial Sequence
  Synthetic Polynucleotide
taatacgactcactatagggtgtacgcaacacggtaacattatgtatcgtaacagaggagaacgataatgaatgttaccaacctggcggcagcgcaaaagatg

SEQ ID NO: 62432 - DNA, 103 bp, Artificial Sequence
  Synthetic Polynucleotide
taatacgactcactatagggagcaatgtacgcaacacggtaacattatgtaacagaggagaacataaatgtaccgtgttaacctggcggcagcgcaaaagatg

SEQ ID NO: 62433 - DNA, 103 bp, Artificial Sequence
  Synthetic Polynucleotide
taatacgactcactatagggttacgagcaatgtacgcaacacggtaacataacagaggagaatgttaatgtgttgcgtaaacctggcggcagcgcaaaagatg

SEQ ID NO: 62434 - DNA, 103 bp, Artificial Sequence
  Synthetic Polynucleotide
taatacgactcactataggggtcttttacgagcaatgtacgcaacacggtaacagaggagaaccgtgatgcgtacattgaacctggcggcagcgcaaaagatg

SEQ ID NO: 62435 - DNA, 103 bp, Artificial Sequence
  Synthetic Polynucleotide
taatacgactcactatagggcgaaagtcttttacgagcaatgtacgcaacaacagaggagagttgcgatgattgctcgtaacctggcggcagcgcaaaagatg

SEQ ID NO: 62436 - DNA, 103 bp, Artificial Sequence
  Synthetic Polynucleotide
taatacgactcactataggggacaagatgactaaggatattaaactaacgaacagaggagacgttagatgaatatccttaacctggcggcagcgcaaaagatg

SEQ ID NO: 62437 - DNA, 103 bp, Artificial Sequence
  Synthetic Polynucleotide
taatacgactcactatagggattaacgaaagtcttttacgagcaatgtacaacagaggagagtacatatgtcgtaaaagaacctggcggcagcgcaaaagatg

SEQ ID NO: 62438 - DNA, 103 bp, Artificial Sequence
  Synthetic Polynucleotide
taatacgactcactataggggacaaattaacgaaagtcttttacgagcaaaacagaggagattgctcatgaaagactttaacctggcggcagcgcaaaagatg

SEQ ID NO: 62439 - DNA, 103 bp, Artificial Sequence
  Synthetic Polynucleotide
taatacgactcactataggggaggagacaaattaacgaaagtcttttacgaacagaggagacgtaaaatgctttcgttaaacctggcggcagcgcaaaagatg

SEQ ID NO: 62440 - DNA, 103 bp, Artificial Sequence
  Synthetic Polynucleotide
taatacgactcactatagggcggaggaggagacaaattaacgaaagtcttaacagaggagaaagactatggttaatttgaacctggcggcagcgcaaaagatg

SEQ ID NO: 62441 - DNA, 103 bp, Artificial Sequence
  Synthetic Polynucleotide
taatacgactcactatagggatttacggaggaggagacaaattaacgaaaaacagaggagatttcgtatgtttgtctccaacctggcggcagcgcaaaagatg

SEQ ID NO: 62442 - DNA, 103 bp, Artificial Sequence
  Synthetic Polynucleotide
taatacgactcactatagggctggaatttacggaggaggagacaaattaaaacagaggagattaattatgctcctcctcaacctggcggcagcgcaaaagatg

SEQ ID NO: 62443 - DNA, 103 bp, Artificial Sequence
  Synthetic Polynucleotide
taatacgactcactatagggacccactggaatttacggaggaggagacaaaacagaggagattgtctatgcctccgtaaaacctggcggcagcgcaaaagatg

SEQ ID NO: 62444 - DNA, 103 bp, Artificial Sequence
  Synthetic Polynucleotide
taatacgactcactatagggctaagacccactggaatttacggaggaggaaacagaggagatcctccatggtaaattccaacctggcggcagcgcaaaagatg

SEQ ID NO: 62445 - DNA, 103 bp, Artificial Sequence
  Synthetic Polynucleotide
taatacgactcactataggggttgcctaagacccactggaatttacggagaacagaggagactccgtatgttccagtggaacctggcggcagcgcaaaagatg

SEQ ID NO: 62446 - DNA, 103 bp, Artificial Sequence
  Synthetic Polynucleotide
taatacgactcactatagggtacttgttgcctaagacccactggaatttaaacagaggagataaattatggtgggtcttaacctggcggcagcgcaaaagatg

SEQ ID NO: 62447 - DNA, 103 bp, Artificial Sequence
  Synthetic Polynucleotide
taatacgactcactatagggttctagacaagatgactaaggatattaaacaacagaggagagtttaaatgccttagtcaaacctggcggcagcgcaaaagatg

SEQ ID NO: 62448 - DNA, 103 bp, Artificial Sequence
  Synthetic Polynucleotide
taatacgactcactatagggttgtatacttgttgcctaagacccactggaaacagaggagatccagtatgtcttaggcaaacctggcggcagcgcaaaagatg

SEQ ID NO: 62449 - DNA, 103 bp, Artificial Sequence
  Synthetic Polynucleotide
taatacgactcactatagggcaaaattgtatacttgttgcctaagacccaaacagaggagatgggtcatgggcaacaagaacctggcggcagcgcaaaagatg

SEQ ID NO: 62450 - DNA, 103 bp, Artificial Sequence
  Synthetic Polynucleotide
taatacgactcactatagggtggtgcaaaattgtatacttgttgcctaagaacagaggagacttaggatgcaagtatacaacctggcggcagcgcaaaagatg

SEQ ID NO: 62451 - DNA, 103 bp, Artificial Sequence
  Synthetic Polynucleotide
taatacgactcactatagggatgaatggtgcaaaattgtatacttgttgcaacagaggagagcaacaatgatacaatttaacctggcggcagcgcaaaagatg

SEQ ID NO: 62452 - DNA, 103 bp, Artificial Sequence
  Synthetic Polynucleotide
taatacgactcactatagggtaattatgaatggtgcaaaattgtatacttaacagaggagaaagtatatgattttgcacaacctggcggcagcgcaaaagatg

SEQ ID NO: 62453 - DNA, 103 bp, Artificial Sequence
  Synthetic Polynucleotide
taatacgactcactatagggttctgtaattatgaatggtgcaaaattgtaaacagaggagatacaatatggcaccattcaacctggcggcagcgcaaaagatg

SEQ ID NO: 62454 - DNA, 103 bp, Artificial Sequence
  Synthetic Polynucleotide
taatacgactcactatagggaataattctgtaattatgaatggtgcaaaaaacagaggagattttgcatgattcataataacctggcggcagcgcaaaagatg

SEQ ID NO: 62455 - DNA, 103 bp, Artificial Sequence
  Synthetic Polynucleotide
taatacgactcactatagggaagccaataattctgtaattatgaatggtgaacagaggagacaccatatgtaattacagaacctggcggcagcgcaaaagatg

SEQ ID NO: 62456 - DNA, 103 bp, Artificial Sequence
  Synthetic Polynucleotide
taatacgactcactatagggcacgaaagccaataattctgtaattatgaaaacagaggagattcataatgacagaattaaacctggcggcagcgcaaaagatg

SEQ ID NO: 62457 - DNA, 103 bp, Artificial Sequence
  Synthetic Polynucleotide
taatacgactcactatagggctggtcacgaaagccaataattctgtaattaacagaggagaaattacatgattattggcaacctggcggcagcgcaaaagatg

SEQ ID NO: 62458 - DNA, 103 bp, Artificial Sequence
  Synthetic Polynucleotide
taatacgactcactatagggttaacgctttacgacgaagttacaaatatgaacagaggagacatattatgaacttcgtcaacctggcggcagcgcaaaagatg

SEQ ID NO: 62459 - DNA, 103 bp, Artificial Sequence
  Synthetic Polynucleotide
taatacgactcactatagggcgccattctagacaagatgactaaggatataacagaggagaatatccatggtcatcttgaacctggcggcagcgcaaaagatg

SEQ ID NO: 62460 - DNA, 103 bp, Artificial Sequence
  Synthetic Polynucleotide
taatacgactcactatagggagcaactggtcacgaaagccaataattctgaacagaggagacagaatatgtggctttcgaacctggcggcagcgcaaaagatg

SEQ ID NO: 62461 - DNA, 103 bp, Artificial Sequence
  Synthetic Polynucleotide
taatacgactcactatagggggtcgagcaactggtcacgaaagccaataaaacagaggagattattgatgttcgtgaccaacctggcggcagcgcaaaagatg

SEQ ID NO: 62462 - DNA, 103 bp, Artificial Sequence
  Synthetic Polynucleotide
taatacgactcactatagggcgtatggtcgagcaactggtcacgaaagccaacagaggagaggctttatggaccagttgaacctggcggcagcgcaaaagatg

SEQ ID NO: 62463 - DNA, 103 bp, Artificial Sequence
  Synthetic Polynucleotide
taatacgactcactataggggtaaacgtatggtcgagcaactggtcacgaaacagaggagatcgtgaatggttgctcgaaacctggcggcagcgcaaaagatg

SEQ ID NO: 62464 - DNA, 103 bp, Artificial Sequence
  Synthetic Polynucleotide
taatacgactcactatagggaaaaagtaaacgtatggtcgagcaactggtaacagaggagaaccagtatgtcgaccataaacctggcggcagcgcaaaagatg

SEQ ID NO: 62465 - DNA, 103 bp, Artificial Sequence
  Synthetic Polynucleotide
taatacgactcactatagggtacgcaaaaagtaaacgtatggtcgagcaaaacagaggagattgctcatgcatacgtttaacctggcggcagcgcaaaagatg

SEQ ID NO: 62466 - DNA, 103 bp, Artificial Sequence
  Synthetic Polynucleotide
taatacgactcactatagggatgtatacgcaaaaagtaaacgtatggtcgaacagaggagacgaccaatggtttactttaacctggcggcagcgcaaaagatg

SEQ ID NO: 62467 - DNA, 103 bp, Artificial Sequence
  Synthetic Polynucleotide
taatacgactcactatagggcggacatgtatacgcaaaaagtaaacgtataacagaggagaatacgtatgctttttgcgaacctggcggcagcgcaaaagatg

SEQ ID NO: 62468 - DNA, 103 bp, Artificial Sequence
  Synthetic Polynucleotide
taatacgactcactatagggtcacccggacatgtatacgcaaaaagtaaaaacagaggagatttactatgtgcgtatacaacctggcggcagcgcaaaagatg

SEQ ID NO: 62469 - DNA, 103 bp, Artificial Sequence
  Synthetic Polynucleotide
taatacgactcactatagggatatatcacccggacatgtatacgcaaaaaaacagaggagatttttgatgatacatgtcaacctggcggcagcgcaaaagatg

SEQ ID NO: 62470 - DNA, 103 bp, Artificial Sequence
  Synthetic Polynucleotide
taatacgactcactatagggagatacgccattctagacaagatgactaagaacagaggagacttagtatgcttgtctagaacctggcggcagcgcaaaagatg

SEQ ID NO: 62471 - DNA, 103 bp, Artificial Sequence
  Synthetic Polynucleotide
taatacgactcactataggggtacgatatatcacccggacatgtatacgcaacagaggagagcgtatatgtgtccgggtaacctggcggcagcgcaaaagatg

SEQ ID NO: 62472 - DNA, 103 bp, Artificial Sequence
  Synthetic Polynucleotide
taatacgactcactatagggaccctgtacgatatatcacccggacatgtaaacagaggagatacatgatggggtgatataacctggcggcagcgcaaaagatg

SEQ ID NO: 62473 - DNA, 103 bp, Artificial Sequence
  Synthetic Polynucleotide
taatacgactcactatagggagcataccctgtacgatatatcacccggacaacagaggagagtccggatgatatatcgtaacctggcggcagcgcaaaagatg

SEQ ID NO: 62474 - DNA, 103 bp, Artificial Sequence
  Synthetic Polynucleotide
taatacgactcactatagggtcatgagcataccctgtacgatatatcaccaacagaggagaggtgatatgtcgtacaggaacctggcggcagcgcaaaagatg

SEQ ID NO: 62475 - DNA, 103 bp, Artificial Sequence
  Synthetic Polynucleotide
taatacgactcactatagggattggtcatgagcataccctgtacgatataaacagaggagatatatcatgcagggtatgaacctggcggcagcgcaaaagatg

SEQ ID NO: 62476 - DNA, 103 bp, Artificial Sequence
  Synthetic Polynucleotide
taatacgactcactatagggcattcattggtcatgagcataccctgtacgaacagaggagacgtacaatgtatgctcataacctggcggcagcgcaaaagatg

SEQ ID NO: 62477 - DNA, 103 bp, Artificial Sequence
  Synthetic Polynucleotide
taatacgactcactatagggtaatccattcattggtcatgagcataccctaacagaggagaagggtaatgtcatgaccaaacctggcggcagcgcaaaagatg

SEQ ID NO: 62478 - DNA, 103 bp, Artificial Sequence
  Synthetic Polynucleotide
taatacgactcactatagggcacggtaatccattcattggtcatgagcataacagaggagaatgctcatgaccaatgaaaacctggcggcagcgcaaaagatg

SEQ ID NO: 62479 - DNA, 103 bp, Artificial Sequence
  Synthetic Polynucleotide
taatacgactcactatagggataaacacggtaatccattcattggtcatgaacagaggagacatgacatgtgaatggataacctggcggcagcgcaaaagatg

SEQ ID NO: 62480 - DNA, 103 bp, Artificial Sequence
  Synthetic Polynucleotide
taatacgactcactatagggaccaaataaacacggtaatccattcattggaacagaggagaccaatgatgggattaccgaacctggcggcagcgcaaaagatg

SEQ ID NO: 62481 - DNA, 103 bp, Artificial Sequence
  Synthetic Polynucleotide
taatacgactcactatagggcagttagatacgccattctagacaagatgaaacagaggagatcatctatgctagaatggaacctggcggcagcgcaaaagatg

SEQ ID NO: 62482 - DNA, 103 bp, Artificial Sequence
  Synthetic Polynucleotide
taatacgactcactatagggataggaccaaataaacacggtaatccattcaacagaggagagaatggatgaccgtgtttaacctggcggcagcgcaaaagatg

SEQ ID NO: 62483 - DNA, 103 bp, Artificial Sequence
  Synthetic Polynucleotide
taatacgactcactatagggaagcaataggaccaaataaacacggtaatcaacagaggagagattacatggtttatttgaacctggcggcagcgcaaaagatg

SEQ ID NO: 62484 - DNA, 103 bp, Artificial Sequence
  Synthetic Polynucleotide
taatacgactcactatagggcatggaagcaataggaccaaataaacacggaacagaggagaccgtgtatgtttggtcctaacctggcggcagcgcaaaagatg

SEQ ID NO: 62485 - DNA, 103 bp, Artificial Sequence
  Synthetic Polynucleotide
taatacgactcactatagggggtagcatggaagcaataggaccaaataaaaacagaggagatttattatgtcctattgcaacctggcggcagcgcaaaagatg

SEQ ID NO: 62486 - DNA, 103 bp, Artificial Sequence
  Synthetic Polynucleotide
taatacgactcactatagggtattaggtagcatggaagcaataggaccaaaacagaggagattggtcatgttgcttccaaacctggcggcagcgcaaaagatg

SEQ ID NO: 62487 - DNA, 103 bp, Artificial Sequence
  Synthetic Polynucleotide
taatacgactcactatagggatttatattaggtagcatggaagcaataggaacagaggagacctattatgtccatgctaaacctggcggcagcgcaaaagatg

SEQ ID NO: 62488 - DNA, 103 bp, Artificial Sequence
  Synthetic Polynucleotide
taatacgactcactatagggatttgatttatattaggtagcatggaagcaaacagaggagatgcttcatggctacctaaaacctggcggcagcgcaaaagatg

SEQ ID NO: 62489 - DNA, 103 bp, Artificial Sequence
  Synthetic Polynucleotide
taatacgactcactatagggcaagtatttgatttatattaggtagcatggaacagaggagaccatgcatgctaatataaaacctggcggcagcgcaaaagatg

SEQ ID NO: 62490 - DNA, 103 bp, Artificial Sequence
  Synthetic Polynucleotide
taatacgactcactatagggggaatcaagtatttgatttatattaggtagaacagaggagactacctatgataaatcaaaacctggcggcagcgcaaaagatg

SEQ ID NO: 62491 - DNA, 103 bp, Artificial Sequence
  Synthetic Polynucleotide
taatacgactcactatagggacctaggaatcaagtatttgatttatattaaacagaggagataatatatgtcaaatactaacctggcggcagcgcaaaagatg

SEQ ID NO: 62492 - DNA, 103 bp, Artificial Sequence
  Synthetic Polynucleotide
taatacgactcactatagggacccgcagttagatacgccattctagacaaaacagaggagattgtctatgatggcgtataacctggcggcagcgcaaaagatg

SEQ ID NO: 62493 - DNA, 103 bp, Artificial Sequence
  Synthetic Polynucleotide
taatacgactcactatagggtgtagacctaggaatcaagtatttgatttaaacagaggagataaatcatgtacttgattaacctggcggcagcgcaaaagatg

SEQ ID NO: 62494 - DNA, 103 bp, Artificial Sequence
  Synthetic Polynucleotide
taatacgactcactataggggcttctgtagacctaggaatcaagtatttgaacagaggagacaaataatggattcctagaacctggcggcagcgcaaaagatg

SEQ ID NO: 62495 - DNA, 103 bp, Artificial Sequence
  Synthetic Polynucleotide
taatacgactcactatagggtggcagcttctgtagacctaggaatcaagtaacagaggagaacttgaatgctaggtctaaacctggcggcagcgcaaaagatg

SEQ ID NO: 62496 - DNA, 103 bp, Artificial Sequence
  Synthetic Polynucleotide
taatacgactcactatagggtatattggcagcttctgtagacctaggaataacagaggagaattcctatgtctacagaaaacctggcggcagcgcaaaagatg

SEQ ID NO: 62497 - DNA, 103 bp, Artificial Sequence
  Synthetic Polynucleotide
taatacgactcactatagggcagactatattggcagcttctgtagacctaaacagaggagataggtcatgagaagctgcaacctggcggcagcgcaaaagatg

SEQ ID NO: 62498 - DNA, 103 bp, Artificial Sequence
  Synthetic Polynucleotide
taatacgactcactatagggtaacacagactatattggcagcttctgtagaacagaggagactacagatgctgccaataaacctggcggcagcgcaaaagatg

SEQ ID NO: 62499 - DNA, 103 bp, Artificial Sequence
  Synthetic Polynucleotide
taatacgactcactatagggttatgtaacacagactatattggcagcttcaacagaggagagaagctatgaatatagtcaacctggcggcagcgcaaaagatg

SEQ ID NO: 62500 - DNA, 103 bp, Artificial Sequence
  Synthetic Polynucleotide
taatacgactcactatagggaactattatgtaacacagactatattggcaaacagaggagatgccaaatgagtctgtgtaacctggcggcagcgcaaaagatg

SEQ ID NO: 62501 - DNA, 103 bp, Artificial Sequence
  Synthetic Polynucleotide
taatacgactcactatagggaagtaaactattatgtaacacagactatataacagaggagaatatagatggtgttacataacctggcggcagcgcaaaagatg

SEQ ID NO: 62502 - DNA, 103 bp, Artificial Sequence
  Synthetic Polynucleotide
taatacgactcactatagggcatgaaagtaaactattatgtaacacagacaacagaggagagtctgtatgacataatagaacctggcggcagcgcaaaagatg

SEQ ID NO: 62503 - DNA, 103 bp, Artificial Sequence
  Synthetic Polynucleotide
taatacgactcactatagggcctaaacccgcagttagatacgccattctaaacagaggagatagaatatggtatctaacaacctggcggcagcgcaaaagatg

SEQ ID NO: 62504 - DNA, 103 bp, Artificial Sequence
  Synthetic Polynucleotide
taatacgactcactataggggaaatcatgaaagtaaactattatgtaacaaacagaggagatgttacatgatagtttacaacctggcggcagcgcaaaagatg

SEQ ID NO: 62505 - DNA, 103 bp, Artificial Sequence
  Synthetic Polynucleotide
taatacgactcactatagggataatgaaatcatgaaagtaaactattatgaacagaggagacataatatgttactttcaaacctggcggcagcgcaaaagatg

SEQ ID NO: 62506 - DNA, 103 bp, Artificial Sequence
  Synthetic Polynucleotide
taatacgactcactatagggcaccgataatgaaatcatgaaagtaaactaaacagaggagatagtttatgttcatgattaacctggcggcagcgcaaaagatg

SEQ ID NO: 62507 - DNA, 103 bp, Artificial Sequence
  Synthetic Polynucleotide
taatacgactcactatagggaaatacaccgataatgaaatcatgaaagtaaacagaggagatactttatggatttcattaacctggcggcagcgcaaaagatg

SEQ ID NO: 62508 - DNA, 103 bp, Artificial Sequence
  Synthetic Polynucleotide
taatacgactcactatagggttggaaaatacaccgataatgaaatcatgaaacagaggagatcatgaatgcattatcggaacctggcggcagcgcaaaagatg

SEQ ID NO: 62509 - DNA, 103 bp, Artificial Sequence
  Synthetic Polynucleotide
taatacgactcactatagggtgtatttggaaaatacaccgataatgaaataacagaggagaatttcaatgtcggtgtataacctggcggcagcgcaaaagatg

SEQ ID NO: 62510 - DNA, 103 bp, Artificial Sequence
  Synthetic Polynucleotide
taatacgactcactataggggtggatgtatttggaaaatacaccgataataacagaggagaattatcatggtattttccaacctggcggcagcgcaaaagatg

SEQ ID NO: 62511 - DNA, 103 bp, Artificial Sequence
  Synthetic Polynucleotide
taatacgactcactatagggctctagtggatgtatttggaaaatacaccgaacagaggagacggtgtatgttccaaataaacctggcggcagcgcaaaagatg

SEQ ID NO: 62512 - DNA, 103 bp, Artificial Sequence
  Synthetic Polynucleotide
taatacgactcactatagggggttgctctagtggatgtatttggaaaataaacagaggagatattttatgaatacatccaacctggcggcagcgcaaaagatg

SEQ ID NO: 62513 - DNA, 103 bp, Artificial Sequence
  Synthetic Polynucleotide
taatacgactcactatagggcatacggttgctctagtggatgtatttggaaacagaggagatccaaaatgatccactagaacctggcggcagcgcaaaagatg

SEQ ID NO: 62514 - DNA, 103 bp, Artificial Sequence
  Synthetic Polynucleotide
taatacgactcactatagggtaaagcctaaacccgcagttagatacgccaaacagaggagatggcgtatgtaactgcggaacctggcggcagcgcaaaagatg

SEQ ID NO: 62515 - DNA, 103 bp, Artificial Sequence
  Synthetic Polynucleotide
taatacgactcactatagggttattcatacggttgctctagtggatgtataacagaggagaatacatatgctagagcaaaacctggcggcagcgcaaaagatg

SEQ ID NO: 62516 - DNA, 103 bp, Artificial Sequence
  Synthetic Polynucleotide
taatacgactcactatagggtctgattattcatacggttgctctagtggaaacagaggagatccactatggcaaccgtaaacctggcggcagcgcaaaagatg

SEQ ID NO: 62517 - DNA, 103 bp, Artificial Sequence
  Synthetic Polynucleotide
taatacgactcactataggggtaaatctgattattcatacggttgctctaaacagaggagatagagcatgcgtatgaataacctggcggcagcgcaaaagatg

SEQ ID NO: 62518 - DNA, 103 bp, Artificial Sequence
  Synthetic Polynucleotide
taatacgactcactatagggatggggtaaatctgattattcatacggttgaacagaggagacaaccgatggaataatcaaacctggcggcagcgcaaaagatg

SEQ ID NO: 62519 - DNA, 103 bp, Artificial Sequence
  Synthetic Polynucleotide
taatacgactcactatagggactagatggggtaaatctgattattcatacaacagaggagagtatgaatgatcagatttaacctggcggcagcgcaaaagatg

SEQ ID NO: 62520 - DNA, 103 bp, Artificial Sequence
  Synthetic Polynucleotide
taatacgactcactataggggaagcactagatggggtaaatctgattattaacagaggagaaataatatgatttaccccaacctggcggcagcgcaaaagatg

SEQ ID NO: 62521 - DNA, 103 bp, Artificial Sequence
  Synthetic Polynucleotide
taatacgactcactatagggtgaaagaagcactagatggggtaaatctgaaacagaggagatcagatatgccccatctaaacctggcggcagcgcaaaagatg

SEQ ID NO: 62522 - DNA, 103 bp, Artificial Sequence
  Synthetic Polynucleotide
taatacgactcactatagggtaaggtgaaagaagcactagatggggtaaaaacagaggagatttaccatgtctagtgctaacctggcggcagcgcaaaagatg

SEQ ID NO: 62523 - DNA, 103 bp, Artificial Sequence
  Synthetic Polynucleotide
taatacgactcactatagggcttaataaggtgaaagaagcactagatgggaacagaggagacccatcatgtgcttctttaacctggcggcagcgcaaaagatg

SEQ ID NO: 62524 - DNA, 103 bp, Artificial Sequence
  Synthetic Polynucleotide
taatacgactcactatagggaacgacttaataaggtgaaagaagcactagaacagaggagactagtgatgctttcacctaacctggcggcagcgcaaaagatg

SEQ ID NO: 62525 - DNA, 103 bp, Artificial Sequence
  Synthetic Polynucleotide
taatacgactcactatagggtaaactaaagcctaaacccgcagttagataaacagaggagatatctaatggcgggtttaaacctggcggcagcgcaaaagatg

SEQ ID NO: 62526 - DNA, 103 bp, Artificial Sequence
  Synthetic Polynucleotide
taatacgactcactatagggatataaacgacttaataaggtgaaagaagcaacagaggagagcttctatgaccttattaaacctggcggcagcgcaaaagatg

SEQ ID NO: 62527 - DNA, 103 bp, Artificial Sequence
  Synthetic Polynucleotide
taatacgactcactatagggatgtgatataaacgacttaataaggtgaaaaacagaggagatttcacatgattaagtcgaacctggcggcagcgcaaaagatg

SEQ ID NO: 62528 - DNA, 103 bp, Artificial Sequence
  Synthetic Polynucleotide
taatacgactcactatagggatacaatgtgatataaacgacttaataaggaacagaggagaccttatatggtcgtttataacctggcggcagcgcaaaagatg

SEQ ID NO: 62529 - DNA, 103 bp, Artificial Sequence
  Synthetic Polynucleotide
taatacgactcactatagggactatatacaatgtgatataaacgacttaaaacagaggagattaagtatgttatatcacaacctggcggcagcgcaaaagatg

SEQ ID NO: 62530 - DNA, 103 bp, Artificial Sequence
  Synthetic Polynucleotide
taatacgactcactatagggtataaactatatacaatgtgatataaacgaaacagaggagatcgtttatgtcacattgtaacctggcggcagcgcaaaagatg

SEQ ID NO: 62531 - DNA, 103 bp, Artificial Sequence
  Synthetic Polynucleotide
taatacgactcactatagggaaagttataaactatatacaatgtgatataaacagaggagatatatcatgttgtatataaacctggcggcagcgcaaaagatg

SEQ ID NO: 62532 - DNA, 103 bp, Artificial Sequence
  Synthetic Polynucleotide
taatacgactcactatagggaggttaaagttataaactatatacaatgtgaacagaggagacacattatgtatagtttaaacctggcggcagcgcaaaagatg

SEQ ID NO: 62533 - DNA, 103 bp, Artificial Sequence
  Synthetic Polynucleotide
taatacgactcactatagggatcgaaggttaaagttataaactatatacaaacagaggagatgtataatgtttataactaacctggcggcagcgcaaaagatg

SEQ ID NO: 62534 - DNA, 103 bp, Artificial Sequence
  Synthetic Polynucleotide
taatacgactcactatagggctcgtatcgaaggttaaagttataaactataacagaggagaatagttatgaactttaacaacctggcggcagcgcaaaagatg

SEQ ID NO: 62535 - DNA, 103 bp, Artificial Sequence
  Synthetic Polynucleotide
taatacgactcactatagggaacctctcgtatcgaaggttaaagttataaaacagaggagattataaatgtaaccttcgaacctggcggcagcgcaaaagatg

SEQ ID NO: 62536 - DNA, 103 bp, Artificial Sequence
  Synthetic Polynucleotide
taatacgactcactataggggaaactaaactaaagcctaaacccgcagttaacagaggagaaactgcatgtttaggcttaacctggcggcagcgcaaaagatg

SEQ ID NO: 62537 - DNA, 103 bp, Artificial Sequence
  Synthetic Polynucleotide
taatacgactcactatagggtccacaacctctcgtatcgaaggttaaagtaacagaggagaactttaatgttcgatacgaacctggcggcagcgcaaaagatg

SEQ ID NO: 62538 - DNA, 103 bp, Artificial Sequence
  Synthetic Polynucleotide
taatacgactcactataggggaagatccacaacctctcgtatcgaaggttaacagaggagaaaccttatgtacgagaggaacctggcggcagcgcaaaagatg

SEQ ID NO: 62539 - DNA, 103 bp, Artificial Sequence
  Synthetic Polynucleotide
taatacgactcactatagggtcgtagaagatccacaacctctcgtatcgaaacagaggagatcgataatggaggttgtgaacctggcggcagcgcaaaagatg

SEQ ID NO: 62540 - DNA, 103 bp, Artificial Sequence
  Synthetic Polynucleotide
taatacgactcactatagggcaatgtcgtagaagatccacaacctctcgtaacagaggagaacgagaatgtgtggatctaacctggcggcagcgcaaaagatg

SEQ ID NO: 62541 - DNA, 103 bp, Artificial Sequence
  Synthetic Polynucleotide
taatacgactcactataggggttatcaatgtcgtagaagatccacaacctaacagaggagaaggttgatgatcttctacaacctggcggcagcgcaaaagatg

SEQ ID NO: 62542 - DNA, 103 bp, Artificial Sequence
  Synthetic Polynucleotide
taatacgactcactatagggtcagagttatcaatgtcgtagaagatccacaacagaggagagtggatatgctacgacataacctggcggcagcgcaaaagatg

SEQ ID NO: 62543 - DNA, 103 bp, Artificial Sequence
  Synthetic Polynucleotide
taatacgactcactatagggagaaatcagagttatcaatgtcgtagaagaaacagaggagatcttctatgacattgataaacctggcggcagcgcaaaagatg

SEQ ID NO: 62544 - DNA, 103 bp, Artificial Sequence
  Synthetic Polynucleotide
taatacgactcactataggggttcaagaaatcagagttatcaatgtcgtaaacagaggagatacgacatggataactctaacctggcggcagcgcaaaagatg

SEQ ID NO: 62545 - DNA, 103 bp, Artificial Sequence
  Synthetic Polynucleotide
taatacgactcactatagggatgatgttcaagaaatcagagttatcaatgaacagaggagacattgaatgctctgatttaacctggcggcagcgcaaaagatg

SEQ ID NO: 62546 - DNA, 103 bp, Artificial Sequence
  Synthetic Polynucleotide
taatacgactcactatagggcgcagatgatgttcaagaaatcagagttataacagaggagaataactatgatttcttgaaacctggcggcagcgcaaaagatg

SEQ ID NO: 62547 - DNA, 103 bp, Artificial Sequence
  Synthetic Polynucleotide
taatacgactcactatagggatatagaaactaaactaaagcctaaacccgaacagaggagacgggttatggctttagttaacctggcggcagcgcaaaagatg

SEQ ID NO: 62548 - DNA, 103 bp, Artificial Sequence
  Synthetic Polynucleotide
taatacgactcactatagggattagcgcagatgatgttcaagaaatcagaaacagaggagatctgatatgttgaacatcaacctggcggcagcgcaaaagatg

SEQ ID NO: 62549 - DNA, 103 bp, Artificial Sequence
  Synthetic Polynucleotide
taatacgactcactatagggttttaattagcgcagatgatgttcaagaaaaacagaggagatttcttatgcatcatctgaacctggcggcagcgcaaaagatg

SEQ ID NO: 62550 - DNA, 103 bp, Artificial Sequence
  Synthetic Polynucleotide
taatacgactcactatagggaaaacttttaattagcgcagatgatgttcaaacagaggagatgaacaatgtctgcgctaaacctggcggcagcgcaaaagatg

SEQ ID NO: 62551 - DNA, 103 bp, Artificial Sequence
  Synthetic Polynucleotide
taatacgactcactatagggatagtaaaacttttaattagcgcagatgataacagaggagaatcatcatggctaattaaaacctggcggcagcgcaaaagatg

SEQ ID NO: 62552 - DNA, 103 bp, Artificial Sequence
  Synthetic Polynucleotide
taatacgactcactatagggggtatatagtaaaacttttaattagcgcagaacagaggagactgcgcatgttaaaagttaacctggcggcagcgcaaaagatg

SEQ ID NO: 62553 - DNA, 103 bp, Artificial Sequence
  Synthetic Polynucleotide
taatacgactcactatagggaggcaggtatatagtaaaacttttaattagaacagaggagactaattatgagttttactaacctggcggcagcgcaaaagatg

SEQ ID NO: 62554 - DNA, 103 bp, Artificial Sequence
  Synthetic Polynucleotide
taatacgactcactatagggtttctaggcaggtatatagtaaaacttttaaacagaggagataaaagatgtactatataaacctggcggcagcgcaaaagatg

SEQ ID NO: 62555 - DNA, 103 bp, Artificial Sequence
  Synthetic Polynucleotide
taatacgactcactatagggccgaatttctaggcaggtatatagtaaaacaacagaggagagttttaatgtatacctgcaacctggcggcagcgcaaaagatg

SEQ ID NO: 62556 - DNA, 103 bp, Artificial Sequence
  Synthetic Polynucleotide
taatacgactcactatagggtggtgccgaatttctaggcaggtatatagtaacagaggagaactataatgctgcctagaaacctggcggcagcgcaaaagatg

SEQ ID NO: 62557 - DNA, 103 bp, Artificial Sequence
  Synthetic Polynucleotide
taatacgactcactatagggactggtggtgccgaatttctaggcaggtataacagaggagaatacctatgtagaaattcaacctggcggcagcgcaaaagatg

SEQ ID NO: 62558 - DNA, 103 bp, Artificial Sequence
  Synthetic Polynucleotide
taatacgactcactatagggtatagatatagaaactaaactaaagcctaaaacagaggagattaggcatgagtttagttaacctggcggcagcgcaaaagatg

SEQ ID NO: 62559 - DNA, 103 bp, Artificial Sequence
  Synthetic Polynucleotide
taatacgactcactatagggcggttactggtggtgccgaatttctaggcaaacagaggagatgcctaatgattcggcacaacctggcggcagcgcaaaagatg

SEQ ID NO: 62560 - DNA, 103 bp, Artificial Sequence
  Synthetic Polynucleotide
taatacgactcactataggggtacgcggttactggtggtgccgaatttctaacagaggagaagaaatatggcaccaccaaacctggcggcagcgcaaaagatg

SEQ ID NO: 62561 - DNA, 103 bp, Artificial Sequence
  Synthetic Polynucleotide
taatacgactcactatagggaccgtgtacgcggttactggtggtgccgaaaacagaggagattcggcatgaccagtaacaacctggcggcagcgcaaaagatg

SEQ ID NO: 62562 - DNA, 103 bp, Artificial Sequence
  Synthetic Polynucleotide
taatacgactcactatagggcaatgaccgtgtacgcggttactggtggtgaacagaggagacaccacatgtaaccgcgtaacctggcggcagcgcaaaagatg

SEQ ID NO: 62563 - DNA, 103 bp, Artificial Sequence
  Synthetic Polynucleotide
taatacgactcactatagggagcagcaatgaccgtgtacgcggttactggaacagaggagaccagtaatggcgtacacgaacctggcggcagcgcaaaagatg

SEQ ID NO: 62564 - DNA, 103 bp, Artificial Sequence
  Synthetic Polynucleotide
taatacgactcactataggggtgacagcagcaatgaccgtgtacgcggttaacagaggagaaaccgcatgcacggtcataacctggcggcagcgcaaaagatg

SEQ ID NO: 62565 - DNA, 103 bp, Artificial Sequence
  Synthetic Polynucleotide
taatacgactcactatagggtatgagtgacagcagcaatgaccgtgtacgaacagaggagacgtacaatgtcattgctgaacctggcggcagcgcaaaagatg

SEQ ID NO: 62566 - DNA, 103 bp, Artificial Sequence
  Synthetic Polynucleotide
taatacgactcactatagggatatttatgagtgacagcagcaatgaccgtaacagaggagaacggtcatggctgctgtcaacctggcggcagcgcaaaagatg

SEQ ID NO: 62567 - DNA, 103 bp, Artificial Sequence
  Synthetic Polynucleotide
taatacgactcactataggggtccgatatttatgagtgacagcagcaatgaacagaggagacattgcatgtgtcactcaaacctggcggcagcgcaaaagatg

SEQ ID NO: 62568 - DNA, 103 bp, Artificial Sequence
  Synthetic Polynucleotide
taatacgactcactatagggaagtagtccgatatttatgagtgacagcagaacagaggagactgctgatgctcataaataacctggcggcagcgcaaaagatg

SEQ ID NO: 62569 - DNA, 103 bp, Artificial Sequence
  Synthetic Polynucleotide
taatacgactcactatagggttgatttaacgctttacgacgaagttacaaaacagaggagattgtaaatgcgtcgtaaaaacctggcggcagcgcaaaagatg

SEQ ID NO: 62570 - DNA, 103 bp, Artificial Sequence
  Synthetic Polynucleotide
taatacgactcactataggggtagatatagatatagaaactaaactaaagaacagaggagactttagatgagtttctataacctggcggcagcgcaaaagatg

SEQ ID NO: 62571 - DNA, 103 bp, Artificial Sequence
  Synthetic Polynucleotide
taatacgactcactatagggagaataagtagtccgatatttatgagtgacaacagaggagagtcactatgaaatatcggaacctggcggcagcgcaaaagatg

SEQ ID NO: 62572 - DNA, 103 bp, Artificial Sequence
  Synthetic Polynucleotide
taatacgactcactatagggaaaatagaataagtagtccgatatttatgaaacagaggagatcataaatgtcggactacaacctggcggcagcgcaaaagatg

SEQ ID NO: 62573 - DNA, 103 bp, Artificial Sequence
  Synthetic Polynucleotide
taatacgactcactatagggtttgtaaaatagaataagtagtccgatattaacagaggagaaatatcatgctacttattaacctggcggcagcgcaaaagatg

SEQ ID NO: 62574 - DNA, 103 bp, Artificial Sequence
  Synthetic Polynucleotide
taatacgactcactatagggcattatttgtaaaatagaataagtagtccgaacagaggagacggactatgtattctattaacctggcggcagcgcaaaagatg

SEQ ID NO: 62575 - DNA, 103 bp, Artificial Sequence
  Synthetic Polynucleotide
taatacgactcactatagggacagccattatttgtaaaatagaataagtaaacagaggagatacttaatgtattttacaaacctggcggcagcgcaaaagatg

SEQ ID NO: 62576 - DNA, 103 bp, Artificial Sequence
  Synthetic Polynucleotide
taatacgactcactatagggtacaaacagccattatttgtaaaatagaataacagaggagaattctaatgtacaaataaaacctggcggcagcgcaaaagatg

SEQ ID NO: 62577 - DNA, 103 bp, Artificial Sequence
  Synthetic Polynucleotide
taatacgactcactatagggtattatacaaacagccattatttgtaaaataacagaggagaattttaatgataatggctaacctggcggcagcgcaaaagatg

SEQ ID NO: 62578 - DNA, 103 bp, Artificial Sequence
  Synthetic Polynucleotide
taatacgactcactatagggtggtctattatacaaacagccattatttgtaacagaggagaacaaatatgggctgtttgaacctggcggcagcgcaaaagatg

SEQ ID NO: 62579 - DNA, 103 bp, Artificial Sequence
  Synthetic Polynucleotide
taatacgactcactatagggtatcgtggtctattatacaaacagccattaaacagaggagataatggatgtttgtataaaacctggcggcagcgcaaaagatg

SEQ ID NO: 62580 - DNA, 103 bp, Artificial Sequence
  Synthetic Polynucleotide
taatacgactcactataggggatattatcgtggtctattatacaaacagcaacagaggagagctgttatgataatagacaacctggcggcagcgcaaaagatg

SEQ ID NO: 62581 - DNA, 103 bp, Artificial Sequence
  Synthetic Polynucleotide
taatacgactcactatagggtagatgtagatatagatatagaaactaaacaacagaggagagtttagatgctatatctaaacctggcggcagcgcaaaagatg

SEQ ID NO: 62582 - DNA, 103 bp, Artificial Sequence
  Synthetic Polynucleotide
taatacgactcactatagggcctctgatattatcgtggtctattatacaaaacagaggagattgtatatgagaccacgaaacctggcggcagcgcaaaagatg

SEQ ID NO: 62583 - DNA, 103 bp, Artificial Sequence
  Synthetic Polynucleotide
taatacgactcactatagggtaactcctctgatattatcgtggtctattaaacagaggagataatagatgacgataataaacctggcggcagcgcaaaagatg

SEQ ID NO: 62584 - DNA, 103 bp, Artificial Sequence
  Synthetic Polynucleotide
taatacgactcactataggggtaaataactcctctgatattatcgtggtcaacagaggagagaccacatgaatatcagaaacctggcggcagcgcaaaagatg

SEQ ID NO: 62585 - DNA, 103 bp, Artificial Sequence
  Synthetic Polynucleotide
taatacgactcactatagggtcaaagtaaataactcctctgatattatcgaacagaggagacgataaatgcagaggagtaacctggcggcagcgcaaaagatg

SEQ ID NO: 62586 - DNA, 103 bp, Artificial Sequence
  Synthetic Polynucleotide
taatacgactcactatagggctggttcaaagtaaataactcctctgatataacagaggagaatatcaatggagttatttaacctggcggcagcgcaaaagatg

SEQ ID NO: 62587 - DNA, 103 bp, Artificial Sequence
  Synthetic Polynucleotide
taatacgactcactatagggatggactggttcaaagtaaataactcctctaacagaggagaagaggaatgatttactttaacctggcggcagcgcaaaagatg

SEQ ID NO: 62588 - DNA, 103 bp, Artificial Sequence
  Synthetic Polynucleotide
taatacgactcactatagggtttccatggactggttcaaagtaaataactaacagaggagaagttatatgctttgaaccaacctggcggcagcgcaaaagatg

SEQ ID NO: 62589 - DNA, 103 bp, Artificial Sequence
  Synthetic Polynucleotide
taatacgactcactatagggtatcttttccatggactggttcaaagtaaaaacagaggagatttactatgaaccagtccaacctggcggcagcgcaaaagatg

SEQ ID NO: 62590 - DNA, 103 bp, Artificial Sequence
  Synthetic Polynucleotide
taatacgactcactatagggaactttatcttttccatggactggttcaaaaacagaggagatttgaaatggtccatggaaacctggcggcagcgcaaaagatg

SEQ ID NO: 62591 - DNA, 103 bp, Artificial Sequence
  Synthetic Polynucleotide
taatacgactcactatagggcctaaaactttatcttttccatggactggtaacagaggagaaccagtatgtggaaaagaaacctggcggcagcgcaaaagatg

SEQ ID NO: 62592 - DNA, 103 bp, Artificial Sequence
  Synthetic Polynucleotide
taatacgactcactatagggagacatagatgtagatatagatatagaaacaacagaggagagtttctatgtctatatctaacctggcggcagcgcaaaagatg

SEQ ID NO: 62593 - DNA, 103 bp, Artificial Sequence
  Synthetic Polynucleotide
taatacgactcactatagggctgatcctaaaactttatcttttccatggaaacagaggagatccatgatgaagataaagaacctggcggcagcgcaaaagatg

SEQ ID NO: 62594 - DNA, 103 bp, Artificial Sequence
  Synthetic Polynucleotide
taatacgactcactatagggaataactgatcctaaaactttatcttttccaacagaggagaggaaaaatgaaagttttaaacctggcggcagcgcaaaagatg

SEQ ID NO: 62595 - DNA, 103 bp, Artificial Sequence
  Synthetic Polynucleotide
taatacgactcactatagggaatccaataactgatcctaaaactttatctaacagaggagaagataaatgtttaggatcaacctggcggcagcgcaaaagatg

SEQ ID NO: 62596 - DNA, 103 bp, Artificial Sequence
  Synthetic Polynucleotide
taatacgactcactatagggattttaatccaataactgatcctaaaacttaacagaggagaaagtttatggatcagttaaacctggcggcagcgcaaaagatg

SEQ ID NO: 62597 - DNA, 103 bp, Artificial Sequence
  Synthetic Polynucleotide
taatacgactcactatagggtccggattttaatccaataactgatcctaaaacagaggagattaggaatggttattggaaacctggcggcagcgcaaaagatg

SEQ ID NO: 62598 - DNA, 103 bp, Artificial Sequence
  Synthetic Polynucleotide
taatacgactcactatagggtacgttccggattttaatccaataactgataacagaggagaatcagtatgtggattaaaaacctggcggcagcgcaaaagatg

SEQ ID NO: 62599 - DNA, 103 bp, Artificial Sequence
  Synthetic Polynucleotide
taatacgactcactatagggaattatacgttccggattttaatccaataaaacagaggagattattgatgtaaaatccgaacctggcggcagcgcaaaagatg

SEQ ID NO: 62600 - DNA, 103 bp, Artificial Sequence
  Synthetic Polynucleotide
taatacgactcactatagggtatcaaattatacgttccggattttaatccaacagaggagaggattaatgtccggaacgaacctggcggcagcgcaaaagatg

SEQ ID NO: 62601 - DNA, 103 bp, Artificial Sequence
  Synthetic Polynucleotide
taatacgactcactatagggtgaattatcaaattatacgttccggattttaacagaggagaaaaatcatgaacgtataaaacctggcggcagcgcaaaagatg

SEQ ID NO: 62602 - DNA, 103 bp, Artificial Sequence
  Synthetic Polynucleotide
taatacgactcactatagggaacgatgaattatcaaattatacgttccggaacagaggagaccggaaatgataatttgaaacctggcggcagcgcaaaagatg

SEQ ID NO: 62603 - DNA, 103 bp, Artificial Sequence
  Synthetic Polynucleotide
taatacgactcactataggggataaagacatagatgtagatatagatataaacagaggagatatatcatgatctacatcaacctggcggcagcgcaaaagatg

SEQ ID NO: 62604 - DNA, 103 bp, Artificial Sequence
  Synthetic Polynucleotide
taatacgactcactatagggcccgtaacgatgaattatcaaattatacgtaacagaggagaacgtatatgttgataattaacctggcggcagcgcaaaagatg

SEQ ID NO: 62605 - DNA, 103 bp, Artificial Sequence
  Synthetic Polynucleotide
taatacgactcactatagggatatccccgtaacgatgaattatcaaattaaacagaggagataatttatgaattcatcgaacctggcggcagcgcaaaagatg

SEQ ID NO: 62606 - DNA, 103 bp, Artificial Sequence
  Synthetic Polynucleotide
taatacgactcactataggggactaatatccccgtaacgatgaattatcaaacagaggagatgataaatgatcgttacgaacctggcggcagcgcaaaagatg

SEQ ID NO: 62607 - DNA, 103 bp, Artificial Sequence
  Synthetic Polynucleotide
taatacgactcactatagggtcctcgactaatatccccgtaacgatgaataacagaggagaattcatatgtacggggataacctggcggcagcgcaaaagatg

SEQ ID NO: 62608 - DNA, 103 bp, Artificial Sequence
  Synthetic Polynucleotide
taatacgactcactatagggttacatcctcgactaatatccccgtaacgaaacagaggagatcgttaatgggatattagaacctggcggcagcgcaaaagatg

SEQ ID NO: 62609 - DNA, 103 bp, Artificial Sequence
  Synthetic Polynucleotide
taatacgactcactatagggtggaattacatcctcgactaatatccccgtaacagaggagaacggggatgttagtcgagaacctggcggcagcgcaaaagatg

SEQ ID NO: 62610 - DNA, 103 bp, Artificial Sequence
  Synthetic Polynucleotide
taatacgactcactataggggcctatggaattacatcctcgactaatatcaacagaggagagatattatgcgaggatgtaacctggcggcagcgcaaaagatg

SEQ ID NO: 62611 - DNA, 103 bp, Artificial Sequence
  Synthetic Polynucleotide
taatacgactcactatagggggactgcctatggaattacatcctcgactaaacagaggagatagtcgatgatgtaattcaacctggcggcagcgcaaaagatg

SEQ ID NO: 62612 - DNA, 103 bp, Artificial Sequence
  Synthetic Polynucleotide
taatacgactcactatagggtttctggactgcctatggaattacatcctcaacagaggagagaggatatgattccatagaacctggcggcagcgcaaaagatg

SEQ ID NO: 62613 - DNA, 103 bp, Artificial Sequence
  Synthetic Polynucleotide
taatacgactcactatagggaaatatttctggactgcctatggaattacaaacagaggagatgtaatatgataggcagtaacctggcggcagcgcaaaagatg

SEQ ID NO: 62614 - DNA, 103 bp, Artificial Sequence
  Synthetic Polynucleotide
taatacgactcactatagggtgttggataaagacatagatgtagatatagaacagaggagactatatatgcatctatgtaacctggcggcagcgcaaaagatg

SEQ ID NO: 62615 - DNA, 103 bp, Artificial Sequence
  Synthetic Polynucleotide
taatacgactcactatagggccgataaatatttctggactgcctatggaaaacagaggagattccatatgcagtccagaaacctggcggcagcgcaaaagatg

SEQ ID NO: 62616 - DNA, 103 bp, Artificial Sequence
  Synthetic Polynucleotide
taatacgactcactatagggtgttaccgataaatatttctggactgcctaaacagaggagataggcaatgcagaaatataacctggcggcagcgcaaaagatg

SEQ ID NO: 62617 - DNA, 103 bp, Artificial Sequence
  Synthetic Polynucleotide
taatacgactcactatagggaaagatgttaccgataaatatttctggactaacagaggagaagtccaatgatatttatcaacctggcggcagcgcaaaagatg

SEQ ID NO: 62618 - DNA, 103 bp, Artificial Sequence
  Synthetic Polynucleotide
taatacgactcactatagggtttacaaagatgttaccgataaatatttctaacagaggagaagaaatatgtatcggtaaaacctggcggcagcgcaaaagatg

SEQ ID NO: 62619 - DNA, 103 bp, Artificial Sequence
  Synthetic Polynucleotide
taatacgactcactatagggatctgtttacaaagatgttaccgataaataaacagaggagatatttaatggtaacatctaacctggcggcagcgcaaaagatg

SEQ ID NO: 62620 - DNA, 103 bp, Artificial Sequence
  Synthetic Polynucleotide
taatacgactcactatagggaccatatctgtttacaaagatgttaccgataacagaggagaatcggtatgatctttgtaaacctggcggcagcgcaaaagatg

SEQ ID NO: 62621 - DNA, 103 bp, Artificial Sequence
  Synthetic Polynucleotide
taatacgactcactataggggctacaccatatctgtttacaaagatgttaaacagaggagataacatatgtgtaaacagaacctggcggcagcgcaaaagatg

SEQ ID NO: 62622 - DNA, 103 bp, Artificial Sequence
  Synthetic Polynucleotide
taatacgactcactatagggcatatgctacaccatatctgtttacaaagaaacagaggagatctttgatgacagatatgaacctggcggcagcgcaaaagatg

SEQ ID NO: 62623 - DNA, 103 bp, Artificial Sequence
  Synthetic Polynucleotide
taatacgactcactatagggataaacatatgctacaccatatctgtttacaacagaggagagtaaacatgtatggtgtaaacctggcggcagcgcaaaagatg

SEQ ID NO: 62624 - DNA, 103 bp, Artificial Sequence
  Synthetic Polynucleotide
taatacgactcactatagggtctaaataaacatatgctacaccatatctgaacagaggagacagataatgtgtagcataaacctggcggcagcgcaaaagatg

SEQ ID NO: 62625 - DNA, 103 bp, Artificial Sequence
  Synthetic Polynucleotide
taatacgactcactatagggtttagtgttggataaagacatagatgtagaaacagaggagatctacaatgatgtctttaaacctggcggcagcgcaaaagatg

SEQ ID NO: 62626 - DNA, 103 bp, Artificial Sequence
  Synthetic Polynucleotide
taatacgactcactatagggctgtatctaaataaacatatgctacaccataacagaggagaatggtgatgcatatgtttaacctggcggcagcgcaaaagatg

SEQ ID NO: 62627 - DNA, 103 bp, Artificial Sequence
  Synthetic Polynucleotide
taatacgactcactatagggtacatctgtatctaaataaacatatgctacaacagaggagagtagcaatggtttatttaaacctggcggcagcgcaaaagatg

SEQ ID NO: 62628 - DNA, 103 bp, Artificial Sequence
  Synthetic Polynucleotide
taatacgactcactatagggatatttacatctgtatctaaataaacatataacagaggagaatatgtatgtttagatacaacctggcggcagcgcaaaagatg

SEQ ID NO: 62629 - DNA, 103 bp, Artificial Sequence
  Synthetic Polynucleotide
taatacgactcactatagggtagatatatttacatctgtatctaaataaaaacagaggagatttattatgatacagatgaacctggcggcagcgcaaaagatg

SEQ ID NO: 62630 - DNA, 103 bp, Artificial Sequence
  Synthetic Polynucleotide
taatacgactcactatagggaattgtagatatatttacatctgtatctaaaacagaggagattagatatggatgtaaataacctggcggcagcgcaaaagatg

SEQ ID NO: 62631 - DNA, 103 bp, Artificial Sequence
  Synthetic Polynucleotide
taatacgactcactatagggccaataattgtagatatatttacatctgtaaacagaggagatacagaatgaaatatatcaacctggcggcagcgcaaaagatg

SEQ ID NO: 62632 - DNA, 103 bp, Artificial Sequence
  Synthetic Polynucleotide
taatacgactcactatagggcctttccaataattgtagatatatttacataacagaggagaatgtaaatgtatctacaaaacctggcggcagcgcaaaagatg

SEQ ID NO: 62633 - DNA, 103 bp, Artificial Sequence
  Synthetic Polynucleotide
taatacgactcactatagggtaacgcctttccaataattgtagatatattaacagaggagaaatataatgacaattattaacctggcggcagcgcaaaagatg

SEQ ID NO: 62634 - DNA, 103 bp, Artificial Sequence
  Synthetic Polynucleotide
taatacgactcactatagggatagataacgcctttccaataattgtagataacagaggagaatctacatgtattggaaaaacctggcggcagcgcaaaagatg

SEQ ID NO: 62635 - DNA, 103 bp, Artificial Sequence
  Synthetic Polynucleotide
taatacgactcactatagggttgaaatagataacgcctttccaataattgaacagaggagacaattaatggaaaggcgtaacctggcggcagcgcaaaagatg

SEQ ID NO: 62636 - DNA, 103 bp, Artificial Sequence
  Synthetic Polynucleotide
taatacgactcactatagggatatttttagtgttggataaagacatagataacagaggagaatctatatgtttatccaaaacctggcggcagcgcaaaagatg

SEQ ID NO: 62637 - DNA, 103 bp, Artificial Sequence
  Synthetic Polynucleotide
taatacgactcactatagggattttttgaaatagataacgcctttccaataacagaggagaattggaatggcgttatctaacctggcggcagcgcaaaagatg

SEQ ID NO: 62638 - DNA, 103 bp, Artificial Sequence
  Synthetic Polynucleotide
taatacgactcactatagggtgatcattttttgaaatagataacgcctttaacagaggagaaaaggcatgatctatttcaacctggcggcagcgcaaaagatg

SEQ ID NO: 62639 - DNA, 103 bp, Artificial Sequence
  Synthetic Polynucleotide
taatacgactcactatagggatctctgatcattttttgaaatagataacgaacagaggagacgttatatgtttcaaaaaaacctggcggcagcgcaaaagatg

SEQ ID NO: 62640 - DNA, 103 bp, Artificial Sequence
  Synthetic Polynucleotide
taatacgactcactatagggcgctaatctctgatcattttttgaaatagaaacagaggagatctattatgaaaaatgataacctggcggcagcgcaaaagatg

SEQ ID NO: 62641 - DNA, 103 bp, Artificial Sequence
  Synthetic Polynucleotide
taatacgactcactatagggccacacgctaatctctgatcattttttgaaaacagaggagattcaaaatgtgatcagagaacctggcggcagcgcaaaagatg

SEQ ID NO: 62642 - DNA, 103 bp, Artificial Sequence
  Synthetic Polynucleotide
taatacgactcactatagggtaactccacacgctaatctctgatcattttaacagaggagaaaaatgatgagagattagaacctggcggcagcgcaaaagatg

SEQ ID NO: 62643 - DNA, 103 bp, Artificial Sequence
  Synthetic Polynucleotide
taatacgactcactatagggaccaataactccacacgctaatctctgatcaacagaggagagatcagatgttagcgtgtaacctggcggcagcgcaaaagatg

SEQ ID NO: 62644 - DNA, 103 bp, Artificial Sequence
  Synthetic Polynucleotide
taatacgactcactataggggaaataccaataactccacacgctaatctcaacagaggagagagattatggtgtggagtaacctggcggcagcgcaaaagatg

SEQ ID NO: 62645 - DNA, 103 bp, Artificial Sequence
  Synthetic Polynucleotide
taatacgactcactatagggtgtaagaaataccaataactccacacgctaaacagaggagatagcgtatggagttattgaacctggcggcagcgcaaaagatg

SEQ ID NO: 62646 - DNA, 103 bp, Artificial Sequence
  Synthetic Polynucleotide
taatacgactcactatagggatttatgtaagaaataccaataactccacaaacagaggagatgtggaatgattggtattaacctggcggcagcgcaaaagatg

SEQ ID NO: 62647 - DNA, 103 bp, Artificial Sequence
  Synthetic Polynucleotide
taatacgactcactatagggctattatatttttagtgttggataaagacaaacagaggagatgtcttatgccaacactaaacctggcggcagcgcaaaagatg

SEQ ID NO: 62648 - DNA, 103 bp, Artificial Sequence
  Synthetic Polynucleotide
taatacgactcactatagggttttcatttatgtaagaaataccaataactaacagaggagaagttatatgtatttcttaaacctggcggcagcgcaaaagatg

SEQ ID NO: 62649 - DNA, 103 bp, Artificial Sequence
  Synthetic Polynucleotide
taatacgactcactatagggttatcttttcatttatgtaagaaataccaaaacagaggagattggtaatgcttacataaaacctggcggcagcgcaaaagatg

SEQ ID NO: 62650 - DNA, 103 bp, Artificial Sequence
  Synthetic Polynucleotide
taatacgactcactatagggatgtattatcttttcatttatgtaagaaataacagaggagaatttctatgataaatgaaaacctggcggcagcgcaaaagatg

SEQ ID NO: 62651 - DNA, 103 bp, Artificial Sequence
  Synthetic Polynucleotide
taatacgactcactatagggagaaaatgtattatcttttcatttatgtaaaacagaggagattacatatgtgaaaagataacctggcggcagcgcaaaagatg

SEQ ID NO: 62652 - DNA, 103 bp, Artificial Sequence
  Synthetic Polynucleotide
taatacgactcactatagggttgtaagaaaatgtattatcttttcatttaaacagaggagataaatgatgagataatacaacctggcggcagcgcaaaagatg

SEQ ID NO: 62653 - DNA, 103 bp, Artificial Sequence
  Synthetic Polynucleotide
taatacgactcactataggggttaattgtaagaaaatgtattatcttttcaacagaggagagaaaagatgatacattttaacctggcggcagcgcaaaagatg

SEQ ID NO: 62654 - DNA, 103 bp, Artificial Sequence
  Synthetic Polynucleotide
taatacgactcactatagggttctcgttaattgtaagaaaatgtattatcaacagaggagagataatatgttttcttacaacctggcggcagcgcaaaagatg

SEQ ID NO: 62655 - DNA, 103 bp, Artificial Sequence
  Synthetic Polynucleotide
taatacgactcactatagggcgccattctcgttaattgtaagaaaatgtaaacagaggagatacattatgttacaattaaacctggcggcagcgcaaaagatg

SEQ ID NO: 62656 - DNA, 103 bp, Artificial Sequence
  Synthetic Polynucleotide
taatacgactcactatagggtcaaacgccattctcgttaattgtaagaaaaacagaggagatttcttatgattaacgagaacctggcggcagcgcaaaagatg

SEQ ID NO: 62657 - DNA, 103 bp, Artificial Sequence
  Synthetic Polynucleotide
taatacgactcactatagggatatatcaaacgccattctcgttaattgtaaacagaggagatacaatatgcgagaatggaacctggcggcagcgcaaaagatg

SEQ ID NO: 62658 - DNA, 103 bp, Artificial Sequence
  Synthetic Polynucleotide
taatacgactcactatagggattagctattatatttttagtgttggataaaacagaggagattatccatgactaaaaataacctggcggcagcgcaaaagatg

SEQ ID NO: 62659 - DNA, 103 bp, Artificial Sequence
  Synthetic Polynucleotide
taatacgactcactatagggaactgatatatcaaacgccattctcgttaaaacagaggagattaacgatgatggcgtttaacctggcggcagcgcaaaagatg

SEQ ID NO: 62660 - DNA, 103 bp, Artificial Sequence
  Synthetic Polynucleotide
taatacgactcactataggggcattaactgatatatcaaacgccattctcaacagaggagagagaatatggtttgatataacctggcggcagcgcaaaagatg

SEQ ID NO: 62661 - DNA, 103 bp, Artificial Sequence
  Synthetic Polynucleotide
taatacgactcactatagggtagatgcattaactgatatatcaaacgccaaacagaggagatggcgtatgatatatcagaacctggcggcagcgcaaaagatg

SEQ ID NO: 62662 - DNA, 103 bp, Artificial Sequence
  Synthetic Polynucleotide
taatacgactcactatagggtgttttagatgcattaactgatatatcaaaaacagaggagatttgatatgtcagttaataacctggcggcagcgcaaaagatg

SEQ ID NO: 62663 - DNA, 103 bp, Artificial Sequence
  Synthetic Polynucleotide
taatacgactcactatagggtttattgttttagatgcattaactgatataaacagaggagatatatcatgtaatgcatcaacctggcggcagcgcaaaagatg

SEQ ID NO: 62664 - DNA, 103 bp, Artificial Sequence
  Synthetic Polynucleotide
taatacgactcactatagggatgcatttattgttttagatgcattaactgaacagaggagacagttaatgcatctaaaaaacctggcggcagcgcaaaagatg

SEQ ID NO: 62665 - DNA, 103 bp, Artificial Sequence
  Synthetic Polynucleotide
taatacgactcactatagggaactaatgcatttattgttttagatgcattaacagaggagaaatgcaatgaaaacaataaacctggcggcagcgcaaaagatg

SEQ ID NO: 62666 - DNA, 103 bp, Artificial Sequence
  Synthetic Polynucleotide
taatacgactcactatagggaagtaaactaatgcatttattgttttagataacagaggagaatctaaatgaataaatgcaacctggcggcagcgcaaaagatg

SEQ ID NO: 62667 - DNA, 103 bp, Artificial Sequence
  Synthetic Polynucleotide
taatacgactcactatagggtagaaaagtaaactaatgcatttattgtttaacagaggagaaaacaaatgatgcattagaacctggcggcagcgcaaaagatg

SEQ ID NO: 62668 - DNA, 103 bp, Artificial Sequence
  Synthetic Polynucleotide
taatacgactcactatagggctgagtagaaaagtaaactaatgcatttataacagaggagaataaatatgttagtttacaacctggcggcagcgcaaaagatg

SEQ ID NO: 62669 - DNA, 103 bp, Artificial Sequence
  Synthetic Polynucleotide
taatacgactcactatagggaaaatattagctattatatttttagtgttgaacagaggagacaacacatgaaatataataacctggcggcagcgcaaaagatg

SEQ ID NO: 62670 - DNA, 103 bp, Artificial Sequence
  Synthetic Polynucleotide
taatacgactcactatagggttttgctgagtagaaaagtaaactaatgcaaacagaggagatgcattatgttacttttcaacctggcggcagcgcaaaagatg

SEQ ID NO: 62671 - DNA, 103 bp, Artificial Sequence
  Synthetic Polynucleotide
taatacgactcactatagggatttattttgctgagtagaaaagtaaactaaacagaggagatagtttatgtttctactcaacctggcggcagcgcaaaagatg

SEQ ID NO: 62672 - DNA, 103 bp, Artificial Sequence
  Synthetic Polynucleotide
taatacgactcactataggggactaatttattttgctgagtagaaaagtaaacagaggagatactttatgactcagcaaaacctggcggcagcgcaaaagatg

SEQ ID NO: 62673 - DNA, 103 bp, Artificial Sequence
  Synthetic Polynucleotide
taatacgactcactatagggcgtatgactaatttattttgctgagtagaaaacagaggagattctacatggcaaaataaaacctggcggcagcgcaaaagatg

SEQ ID NO: 62674 - DNA, 103 bp, Artificial Sequence
  Synthetic Polynucleotide
taatacgactcactatagggcattacgtatgactaatttattttgctgagaacagaggagactcagcatgataaattagaacctggcggcagcgcaaaagatg

SEQ ID NO: 62675 - DNA, 103 bp, Artificial Sequence
  Synthetic Polynucleotide
taatacgactcactatagggaacttcattacgtatgactaatttattttgaacagaggagacaaaatatgttagtcataaacctggcggcagcgcaaaagatg

SEQ ID NO: 62676 - DNA, 103 bp, Artificial Sequence
  Synthetic Polynucleotide
taatacgactcactatagggtcattaacttcattacgtatgactaatttaaacagaggagataaattatgcatacgtaaaacctggcggcagcgcaaaagatg

SEQ ID NO: 62677 - DNA, 103 bp, Artificial Sequence
  Synthetic Polynucleotide
taatacgactcactataggggtgtatcattaacttcattacgtatgactaaacagaggagatagtcaatggtaatgaagaacctggcggcagcgcaaaagatg

SEQ ID NO: 62678 - DNA, 103 bp, Artificial Sequence
  Synthetic Polynucleotide
taatacgactcactatagggatagtgtgtatcattaacttcattacgtataacagaggagaatacgtatggaagttaataacctggcggcagcgcaaaagatg

SEQ ID NO: 62679 - DNA, 103 bp, Artificial Sequence
  Synthetic Polynucleotide
taatacgactcactatagggacagtatagtgtgtatcattaacttcattaaacagaggagataatgaatgtaatgatacaacctggcggcagcgcaaaagatg

SEQ ID NO: 62680 - DNA, 103 bp, Artificial Sequence
  Synthetic Polynucleotide
taatacgactcactatagggttctattgatttaacgctttacgacgaagtaacagaggagaacttcgatgtaaagcgttaacctggcggcagcgcaaaagatg

SEQ ID NO: 62681 - DNA, 103 bp, Artificial Sequence
  Synthetic Polynucleotide
taatacgactcactataggggtaataaaatattagctattatatttttagaacagaggagactaaaaatgtaatagctaaacctggcggcagcgcaaaagatg

SEQ ID NO: 62682 - DNA, 103 bp, Artificial Sequence
  Synthetic Polynucleotide
taatacgactcactatagggattcgacagtatagtgtgtatcattaacttaacagaggagaaagttaatgatacacactaacctggcggcagcgcaaaagatg

SEQ ID NO: 62683 - DNA, 103 bp, Artificial Sequence
  Synthetic Polynucleotide
taatacgactcactatagggatcaaattcgacagtatagtgtgtatcattaacagaggagaaatgatatgcactatactaacctggcggcagcgcaaaagatg

SEQ ID NO: 62684 - DNA, 103 bp, Artificial Sequence
  Synthetic Polynucleotide
taatacgactcactatagggtccctatcaaattcgacagtatagtgtgtaaacagaggagatacacaatgtactgtcgaaacctggcggcagcgcaaaagatg

SEQ ID NO: 62685 - DNA, 103 bp, Artificial Sequence
  Synthetic Polynucleotide
taatacgactcactatagggctttgtccctatcaaattcgacagtatagtaacagaggagaactataatgtcgaatttgaacctggcggcagcgcaaaagatg

SEQ ID NO: 62686 - DNA, 103 bp, Artificial Sequence
  Synthetic Polynucleotide
taatacgactcactatagggaactactttgtccctatcaaattcgacagtaacagaggagaactgtcatgtttgataggaacctggcggcagcgcaaaagatg

SEQ ID NO: 62687 - DNA, 103 bp, Artificial Sequence
  Synthetic Polynucleotide
taatacgactcactataggggtgtcaactactttgtccctatcaaattcgaacagaggagacgaattatgtagggacaaaacctggcggcagcgcaaaagatg

SEQ ID NO: 62688 - DNA, 103 bp, Artificial Sequence
  Synthetic Polynucleotide
taatacgactcactatagggtaaacgtgtcaactactttgtccctatcaaaacagaggagattgataatgacaaagtagaacctggcggcagcgcaaaagatg

SEQ ID NO: 62689 - DNA, 103 bp, Artificial Sequence
  Synthetic Polynucleotide
taatacgactcactatagggcgaaataaacgtgtcaactactttgtccctaacagaggagaagggacatggtagttgacaacctggcggcagcgcaaaagatg

SEQ ID NO: 62690 - DNA, 103 bp, Artificial Sequence
  Synthetic Polynucleotide
taatacgactcactatagggttatacgaaataaacgtgtcaactactttgaacagaggagacaaagtatgtgacacgttaacctggcggcagcgcaaaagatg

SEQ ID NO: 62691 - DNA, 103 bp, Artificial Sequence
  Synthetic Polynucleotide
taatacgactcactataggggtctattatacgaaataaacgtgtcaactaaacagaggagatagttgatgcgtttatttaacctggcggcagcgcaaaagatg

SEQ ID NO: 62692 - DNA, 103 bp, Artificial Sequence
  Synthetic Polynucleotide
taatacgactcactatagggtgattgtaataaaatattagctattatattaacagaggagaaatataatggctaatattaacctggcggcagcgcaaaagatg

SEQ ID NO: 62693 - DNA, 103 bp, Artificial Sequence
  Synthetic Polynucleotide
taatacgactcactatagggattatgtctattatacgaaataaacgtgtcaacagaggagagacacgatgatttcgtataacctggcggcagcgcaaaagatg

SEQ ID NO: 62694 - DNA, 103 bp, Artificial Sequence
  Synthetic Polynucleotide
taatacgactcactataggggagtcattatgtctattatacgaaataaacaacagaggagagtttatatggtataatagaacctggcggcagcgcaaaagatg

SEQ ID NO: 62695 - DNA, 103 bp, Artificial Sequence
  Synthetic Polynucleotide
taatacgactcactatagggctatggagtcattatgtctattatacgaaaaacagaggagatttcgtatgatagacataaacctggcggcagcgcaaaagatg

SEQ ID NO: 62696 - DNA, 103 bp, Artificial Sequence
  Synthetic Polynucleotide
taatacgactcactatagggtatctctatggagtcattatgtctattataaacagaggagatataatatgcataatgacaacctggcggcagcgcaaaagatg

SEQ ID NO: 62697 - DNA, 103 bp, Artificial Sequence
  Synthetic Polynucleotide
taatacgactcactatagggcctcttatctctatggagtcattatgtctaaacagaggagatagacaatgtgactccataacctggcggcagcgcaaaagatg

SEQ ID NO: 62698 - DNA, 103 bp, Artificial Sequence
  Synthetic Polynucleotide
taatacgactcactataggggcacccctcttatctctatggagtcattataacagaggagaataatgatgccatagagaaacctggcggcagcgcaaaagatg

SEQ ID NO: 62699 - DNA, 103 bp, Artificial Sequence
  Synthetic Polynucleotide
taatacgactcactatagggtggaagcacccctcttatctctatggagtcaacagaggagagactccatggagataagaaacctggcggcagcgcaaaagatg

SEQ ID NO: 62700 - DNA, 103 bp, Artificial Sequence
  Synthetic Polynucleotide
taatacgactcactatagggtcctctggaagcacccctcttatctctatgaacagaggagacatagaatgaagaggggtaacctggcggcagcgcaaaagatg

SEQ ID NO: 62701 - DNA, 103 bp, Artificial Sequence
  Synthetic Polynucleotide
taatacgactcactatagggtagtttcctctggaagcacccctcttatctaacagaggagaagataaatggggtgcttcaacctggcggcagcgcaaaagatg

SEQ ID NO: 62702 - DNA, 103 bp, Artificial Sequence
  Synthetic Polynucleotide
taatacgactcactataggggatattagtttcctctggaagcacccctctaacagaggagaagagggatgcttccagagaacctggcggcagcgcaaaagatg

SEQ ID NO: 62703 - DNA, 103 bp, Artificial Sequence
  Synthetic Polynucleotide
taatacgactcactatagggccggatgattgtaataaaatattagctattaacagaggagaaatagcatgtattttattaacctggcggcagcgcaaaagatg

SEQ ID NO: 62704 - DNA, 103 bp, Artificial Sequence
  Synthetic Polynucleotide
taatacgactcactatagggcaaccgatattagtttcctctggaagcaccaacagaggagaggtgctatgagaggaaacaacctggcggcagcgcaaaagatg

SEQ ID NO: 62705 - DNA, 103 bp, Artificial Sequence
  Synthetic Polynucleotide
taatacgactcactatagggccgtgcaaccgatattagtttcctctggaaaacagaggagattccagatgaaactaataaacctggcggcagcgcaaaagatg

SEQ ID NO: 62706 - DNA, 103 bp, Artificial Sequence
  Synthetic Polynucleotide
taatacgactcactatagggattaaccgtgcaaccgatattagtttcctcaacagaggagagaggaaatgaatatcggtaacctggcggcagcgcaaaagatg

SEQ ID NO: 62707 - DNA, 103 bp, Artificial Sequence
  Synthetic Polynucleotide
taatacgactcactatagggggcgtattaaccgtgcaaccgatattagttaacagaggagaaactaaatgcggttgcacaacctggcggcagcgcaaaagatg

SEQ ID NO: 62708 - DNA, 103 bp, Artificial Sequence
  Synthetic Polynucleotide
taatacgactcactatagggtaaccggcgtattaaccgtgcaaccgatataacagaggagaatatcgatggcacggttaaacctggcggcagcgcaaaagatg

SEQ ID NO: 62709 - DNA, 103 bp, Artificial Sequence
  Synthetic Polynucleotide
taatacgactcactatagggcatactaaccggcgtattaaccgtgcaaccaacagaggagaggttgcatggttaatacgaacctggcggcagcgcaaaagatg

SEQ ID NO: 62710 - DNA, 103 bp, Artificial Sequence
  Synthetic Polynucleotide
taatacgactcactatagggtaagtcatactaaccggcgtattaaccgtgaacagaggagacacggtatgtacgccggtaacctggcggcagcgcaaaagatg

SEQ ID NO: 62711 - DNA, 103 bp, Artificial Sequence
  Synthetic Polynucleotide
taatacgactcactatagggacaagtaagtcatactaaccggcgtattaaaacagaggagattaataatgcggttagtaaacctggcggcagcgcaaaagatg

SEQ ID NO: 62712 - DNA, 103 bp, Artificial Sequence
  Synthetic Polynucleotide
taatacgactcactatagggattatacaagtaagtcatactaaccggcgtaacagaggagaacgccgatgagtatgactaacctggcggcagcgcaaaagatg

SEQ ID NO: 62713 - DNA, 103 bp, Artificial Sequence
  Synthetic Polynucleotide
taatacgactcactatagggtacttattatacaagtaagtcatactaaccaacagaggagaggttagatggacttacttaacctggcggcagcgcaaaagatg

SEQ ID NO: 62714 - DNA, 103 bp, Artificial Sequence
  Synthetic Polynucleotide
taatacgactcactatagggaatatccggatgattgtaataaaatattagaacagaggagactaataatgtattacaataacctggcggcagcgcaaaagatg

SEQ ID NO: 62715 - DNA, 103 bp, Artificial Sequence
  Synthetic Polynucleotide
taatacgactcactatagggaactatacttattatacaagtaagtcatacaacagaggagagtatgaatgacttgtataaacctggcggcagcgcaaaagatg

SEQ ID NO: 62716 - DNA, 103 bp, Artificial Sequence
  Synthetic Polynucleotide
taatacgactcactatagggtttaaaactatacttattatacaagtaagtaacagaggagaacttacatgtataataagaacctggcggcagcgcaaaagatg

SEQ ID NO: 62717 - DNA, 103 bp, Artificial Sequence
  Synthetic Polynucleotide
taatacgactcactatagggattagtttaaaactatacttattatacaagaacagaggagacttgtaatgtaagtatagaacctggcggcagcgcaaaagatg

SEQ ID NO: 62718 - DNA, 103 bp, Artificial Sequence
  Synthetic Polynucleotide
taatacgactcactatagggctaaaattagtttaaaactatacttattataacagaggagaataataatgatagttttaaacctggcggcagcgcaaaagatg

SEQ ID NO: 62719 - DNA, 103 bp, Artificial Sequence
  Synthetic Polynucleotide
taatacgactcactatagggttctgctaaaattagtttaaaactatacttaacagaggagaaagtatatgtttaaactaaacctggcggcagcgcaaaagatg

SEQ ID NO: 62720 - DNA, 103 bp, Artificial Sequence
  Synthetic Polynucleotide
taatacgactcactatagggatatattctgctaaaattagtttaaaactaaacagaggagatagtttatgactaattttaacctggcggcagcgcaaaagatg

SEQ ID NO: 62721 - DNA, 103 bp, Artificial Sequence
  Synthetic Polynucleotide
taatacgactcactataggggtcttatatattctgctaaaattagtttaaaacagaggagattaaacatgttttagcagaacctggcggcagcgcaaaagatg

SEQ ID NO: 62722 - DNA, 103 bp, Artificial Sequence
  Synthetic Polynucleotide
taatacgactcactatagggtctgtgtcttatatattctgctaaaattagaacagaggagactaattatggcagaatataacctggcggcagcgcaaaagatg

SEQ ID NO: 62723 - DNA, 103 bp, Artificial Sequence
  Synthetic Polynucleotide
taatacgactcactataggggtatttctgtgtcttatatattctgctaaaaacagaggagatttagcatgatatataagaacctggcggcagcgcaaaagatg

SEQ ID NO: 62724 - DNA, 103 bp, Artificial Sequence
  Synthetic Polynucleotide
taatacgactcactatagggatacagtatttctgtgtcttatatattctgaacagaggagacagaatatgtaagacacaaacctggcggcagcgcaaaagatg

SEQ ID NO: 62725 - DNA, 103 bp, Artificial Sequence
  Synthetic Polynucleotide
taatacgactcactatagggagaagaatatccggatgattgtaataaaataacagaggagaattttaatgcaatcatccaacctggcggcagcgcaaaagatg

SEQ ID NO: 62726 - DNA, 103 bp, Artificial Sequence
  Synthetic Polynucleotide
taatacgactcactataggggccggatacagtatttctgtgtcttatataaacagaggagatatataatgcacagaaataacctggcggcagcgcaaaagatg

SEQ ID NO: 62727 - DNA, 103 bp, Artificial Sequence
  Synthetic Polynucleotide
taatacgactcactatagggatattgccggatacagtatttctgtgtcttaacagaggagaaagacaatgaaatactgtaacctggcggcagcgcaaaagatg

SEQ ID NO: 62728 - DNA, 103 bp, Artificial Sequence
  Synthetic Polynucleotide
taatacgactcactatagggaataaatattgccggatacagtatttctgtaacagaggagaacagaaatgctgtatccgaacctggcggcagcgcaaaagatg

SEQ ID NO: 62729 - DNA, 103 bp, Artificial Sequence
  Synthetic Polynucleotide
taatacgactcactatagggtgccgaataaatattgccggatacagtattaacagaggagaaatactatgtccggcaataacctggcggcagcgcaaaagatg

SEQ ID NO: 62730 - DNA, 103 bp, Artificial Sequence
  Synthetic Polynucleotide
taatacgactcactatagggatcaatgccgaataaatattgccggatacaaacagaggagatgtatcatgcaatatttaaacctggcggcagcgcaaaagatg

SEQ ID NO: 62731 - DNA, 103 bp, Artificial Sequence
  Synthetic Polynucleotide
taatacgactcactataggggtgtcatcaatgccgaataaatattgccggaacagaggagaccggcaatgtttattcggaacctggcggcagcgcaaaagatg

SEQ ID NO: 62732 - DNA, 103 bp, Artificial Sequence
  Synthetic Polynucleotide
taatacgactcactatagggatctagtgtcatcaatgccgaataaatattaacagaggagaaatattatgtcggcattgaacctggcggcagcgcaaaagatg

SEQ ID NO: 62733 - DNA, 103 bp, Artificial Sequence
  Synthetic Polynucleotide
taatacgactcactatagggaaatcatctagtgtcatcaatgccgaataaaacagaggagattattcatgattgatgacaacctggcggcagcgcaaaagatg

SEQ ID NO: 62734 - DNA, 103 bp, Artificial Sequence
  Synthetic Polynucleotide
taatacgactcactatagggtaaccaaatcatctagtgtcatcaatgccgaacagaggagacggcatatgtgacactagaacctggcggcagcgcaaaagatg

SEQ ID NO: 62735 - DNA, 103 bp, Artificial Sequence
  Synthetic Polynucleotide
taatacgactcactatagggtttaataaccaaatcatctagtgtcatcaaaacagaggagattgatgatgctagatgataacctggcggcagcgcaaaagatg

SEQ ID NO: 62736 - DNA, 103 bp, Artificial Sequence
  Synthetic Polynucleotide
taatacgactcactatagggatcgtagaagaatatccggatgattgtaataacagaggagaattacaatgatccggataaacctggcggcagcgcaaaagatg

SEQ ID NO: 62737 - DNA, 103 bp, Artificial Sequence
  Synthetic Polynucleotide
taatacgactcactatagggtactgtttaataaccaaatcatctagtgtcaacagaggagagacactatgtgatttggtaacctggcggcagcgcaaaagatg

SEQ ID NO: 62738 - DNA, 103 bp, Artificial Sequence
  Synthetic Polynucleotide
taatacgactcactatagggcgccatactgtttaataaccaaatcatctaaacagaggagatagatgatgtggttattaaacctggcggcagcgcaaaagatg

SEQ ID NO: 62739 - DNA, 103 bp, Artificial Sequence
  Synthetic Polynucleotide
taatacgactcactatagggaatgtcgccatactgtttaataaccaaatcaacagaggagagatttgatgattaaacagaacctggcggcagcgcaaaagatg

SEQ ID NO: 62740 - DNA, 103 bp, Artificial Sequence
  Synthetic Polynucleotide
taatacgactcactatagggagatcaatgtcgccatactgtttaataaccaacagaggagaggttatatgacagtatggaacctggcggcagcgcaaaagatg

SEQ ID NO: 62741 - DNA, 103 bp, Artificial Sequence
  Synthetic Polynucleotide
taatacgactcactatagggataatagatcaatgtcgccatactgtttaaaacagaggagattaaacatgatggcgacaaacctggcggcagcgcaaaagatg

SEQ ID NO: 62742 - DNA, 103 bp, Artificial Sequence
  Synthetic Polynucleotide
taatacgactcactatagggattaaataatagatcaatgtcgccatactgaacagaggagacagtatatggacattgataacctggcggcagcgcaaaagatg

SEQ ID NO: 62743 - DNA, 103 bp, Artificial Sequence
  Synthetic Polynucleotide
taatacgactcactatagggttctcattaaataatagatcaatgtcgccaaacagaggagatggcgaatgtgatctattaacctggcggcagcgcaaaagatg

SEQ ID NO: 62744 - DNA, 103 bp, Artificial Sequence
  Synthetic Polynucleotide
taatacgactcactatagggtaagtttctcattaaataatagatcaatgtaacagaggagaacattgatgtattatttaaacctggcggcagcgcaaaagatg

SEQ ID NO: 62745 - DNA, 103 bp, Artificial Sequence
  Synthetic Polynucleotide
taatacgactcactatagggcactttaagtttctcattaaataatagatcaacagaggagagatctaatgtttaatgagaacctggcggcagcgcaaaagatg

SEQ ID NO: 62746 - DNA, 103 bp, Artificial Sequence
  Synthetic Polynucleotide
taatacgactcactataggggagtccactttaagtttctcattaaataataacagaggagaattattatgtgagaaactaacctggcggcagcgcaaaagatg

SEQ ID NO: 62747 - DNA, 103 bp, Artificial Sequence
  Synthetic Polynucleotide
taatacgactcactataggggtgagatcgtagaagaatatccggatgattaacagaggagaaatcatatggatattcttaacctggcggcagcgcaaaagatg

SEQ ID NO: 62748 - DNA, 103 bp, Artificial Sequence
  Synthetic Polynucleotide
taatacgactcactatagggaatcggagtccactttaagtttctcattaaaacagaggagattaatgatgaacttaaagaacctggcggcagcgcaaaagatg

SEQ ID NO: 62749 - DNA, 103 bp, Artificial Sequence
  Synthetic Polynucleotide
taatacgactcactatagggtcccgaatcggagtccactttaagtttctcaacagaggagagagaaaatgaaagtggacaacctggcggcagcgcaaaagatg

SEQ ID NO: 62750 - DNA, 103 bp, Artificial Sequence
  Synthetic Polynucleotide
taatacgactcactatagggaataatcccgaatcggagtccactttaagtaacagaggagaacttaaatgggactccgaaacctggcggcagcgcaaaagatg

SEQ ID NO: 62751 - DNA, 103 bp, Artificial Sequence
  Synthetic Polynucleotide
taatacgactcactatagggagtcaaataatcccgaatcggagtccacttaacagaggagaaagtggatgccgattcggaacctggcggcagcgcaaaagatg

SEQ ID NO: 62752 - DNA, 103 bp, Artificial Sequence
  Synthetic Polynucleotide
taatacgactcactataggggacaaagtcaaataatcccgaatcggagtcaacagaggagagactccatgtcgggattaaacctggcggcagcgcaaaagatg

SEQ ID NO: 62753 - DNA, 103 bp, Artificial Sequence
  Synthetic Polynucleotide
taatacgactcactatagggaagttgacaaagtcaaataatcccgaatcgaacagaggagacgattcatgattatttgaaacctggcggcagcgcaaaagatg

SEQ ID NO: 62754 - DNA, 103 bp, Artificial Sequence
  Synthetic Polynucleotide
taatacgactcactatagggttacaaagttgacaaagtcaaataatcccgaacagaggagacgggatatgttgactttgaacctggcggcagcgcaaaagatg

SEQ ID NO: 62755 - DNA, 103 bp, Artificial Sequence
  Synthetic Polynucleotide
taatacgactcactatagggatcctttacaaagttgacaaagtcaaataaaacagaggagattatttatgtttgtcaacaacctggcggcagcgcaaaagatg

SEQ ID NO: 62756 - DNA, 103 bp, Artificial Sequence
  Synthetic Polynucleotide
taatacgactcactatagggataatatcctttacaaagttgacaaagtcaaacagaggagatgacttatgcaactttgtaacctggcggcagcgcaaaagatg

SEQ ID NO: 62757 - DNA, 103 bp, Artificial Sequence
  Synthetic Polynucleotide
taatacgactcactatagggaacatataatatcctttacaaagttgacaaaacagaggagattgtcaatgttgtaaaggaacctggcggcagcgcaaaagatg

SEQ ID NO: 62758 - DNA, 103 bp, Artificial Sequence
  Synthetic Polynucleotide
taatacgactcactatagggagttagtgagatcgtagaagaatatccggaaacagaggagatccggaatgtcttctacgaacctggcggcagcgcaaaagatg

SEQ ID NO: 62759 - DNA, 103 bp, Artificial Sequence
  Synthetic Polynucleotide
taatacgactcactatagggatcacaacatataatatcctttacaaagttaacagaggagaaactttatgaaggatattaacctggcggcagcgcaaaagatg

SEQ ID NO: 62760 - DNA, 103 bp, Artificial Sequence
  Synthetic Polynucleotide
taatacgactcactatagggctagaatcacaacatataatatcctttacaaacagaggagatgtaaaatgtattatatgaacctggcggcagcgcaaaagatg

SEQ ID NO: 62761 - DNA, 103 bp, Artificial Sequence
  Synthetic Polynucleotide
taatacgactcactatagggctattctagaatcacaacatataatatcctaacagaggagaaggataatgtatgttgtgaacctggcggcagcgcaaaagatg

SEQ ID NO: 62762 - DNA, 103 bp, Artificial Sequence
  Synthetic Polynucleotide
taatacgactcactatagggtactactattctagaatcacaacatataataacagaggagaattataatgtgtgattctaacctggcggcagcgcaaaagatg

SEQ ID NO: 62763 - DNA, 103 bp, Artificial Sequence
  Synthetic Polynucleotide
taatacgactcactatagggagagctactactattctagaatcacaacataacagaggagaatgttgatgttctagaataacctggcggcagcgcaaaagatg

SEQ ID NO: 62764 - DNA, 103 bp, Artificial Sequence
  Synthetic Polynucleotide
taatacgactcactatagggtagatagagctactactattctagaatcacaacagaggagagtgattatggaatagtagaacctggcggcagcgcaaaagatg

SEQ ID NO: 62765 - DNA, 103 bp, Artificial Sequence
  Synthetic Polynucleotide
taatacgactcactatagggtagactagatagagctactactattctagaaacagaggagatctagaatggtagtagctaacctggcggcagcgcaaaagatg

SEQ ID NO: 62766 - DNA, 103 bp, Artificial Sequence
  Synthetic Polynucleotide
taatacgactcactataggggatactagactagatagagctactactattaacagaggagaaatagtatgagctctatcaacctggcggcagcgcaaaagatg

SEQ ID NO: 62767 - DNA, 103 bp, Artificial Sequence
  Synthetic Polynucleotide
taatacgactcactataggggtttagatactagactagatagagctactaaacagaggagatagtagatgtatctagtcaacctggcggcagcgcaaaagatg

SEQ ID NO: 62768 - DNA, 103 bp, Artificial Sequence
  Synthetic Polynucleotide
taatacgactcactatagggccaatgtttagatactagactagatagagcaacagaggagagctctaatgagtctagtaaacctggcggcagcgcaaaagatg

SEQ ID NO: 62769 - DNA, 103 bp, Artificial Sequence
  Synthetic Polynucleotide
taatacgactcactatagggacattagttagtgagatcgtagaagaatataacagaggagaatattcatgtacgatctcaacctggcggcagcgcaaaagatg

SEQ ID NO: 62770 - DNA, 103 bp, Artificial Sequence
  Synthetic Polynucleotide
taatacgactcactatagggaattcccaatgtttagatactagactagataacagaggagaatctagatgagtatctaaaacctggcggcagcgcaaaagatg

SEQ ID NO: 62771 - DNA, 103 bp, Artificial Sequence
  Synthetic Polynucleotide
taatacgactcactatagggttgtcaattcccaatgtttagatactagacaacagaggagagtctagatgctaaacattaacctggcggcagcgcaaaagatg

SEQ ID NO: 62772 - DNA, 103 bp, Artificial Sequence
  Synthetic Polynucleotide
taatacgactcactatagggtttatttgtcaattcccaatgtttagatacaacagaggagagtatctatgcattgggaaaacctggcggcagcgcaaaagatg

SEQ ID NO: 62773 - DNA, 103 bp, Artificial Sequence
  Synthetic Polynucleotide
taatacgactcactatagggtactttttatttgtcaattcccaatgtttaaacagaggagataaacaatgggaattgacaacctggcggcagcgcaaaagatg

SEQ ID NO: 62774 - DNA, 103 bp, Artificial Sequence
  Synthetic Polynucleotide
taatacgactcactatagggacctatactttttatttgtcaattcccaataacagaggagaattgggatgtgacaaataaacctggcggcagcgcaaaagatg

SEQ ID NO: 62775 - DNA, 103 bp, Artificial Sequence
  Synthetic Polynucleotide
taatacgactcactatagggcatacacctatactttttatttgtcaattcaacagaggagagaattgatgaataaaaagaacctggcggcagcgcaaaagatg

SEQ ID NO: 62776 - DNA, 103 bp, Artificial Sequence
  Synthetic Polynucleotide
taatacgactcactatagggaatgccatacacctatactttttatttgtcaacagaggagagacaaaatgaaagtatagaacctggcggcagcgcaaaagatg

SEQ ID NO: 62777 - DNA, 103 bp, Artificial Sequence
  Synthetic Polynucleotide
taatacgactcactatagggcggctaatgccatacacctatactttttataacagaggagaataaaaatgataggtgtaaacctggcggcagcgcaaaagatg

SEQ ID NO: 62778 - DNA, 103 bp, Artificial Sequence
  Synthetic Polynucleotide
taatacgactcactatagggatgttcggctaatgccatacacctatacttaacagaggagaaagtatatgtgtatggcaaacctggcggcagcgcaaaagatg

SEQ ID NO: 62779 - DNA, 103 bp, Artificial Sequence
  Synthetic Polynucleotide
taatacgactcactataggggctatatgttcggctaatgccatacacctaaacagaggagataggtgatgggcattagcaacctggcggcagcgcaaaagatg

SEQ ID NO: 62780 - DNA, 103 bp, Artificial Sequence
  Synthetic Polynucleotide
taatacgactcactatagggaagaaacattagttagtgagatcgtagaagaacagaggagacttctaatgtctcactaaaacctggcggcagcgcaaaagatg

SEQ ID NO: 62781 - DNA, 103 bp, Artificial Sequence
  Synthetic Polynucleotide
taatacgactcactatagggtatcagctatatgttcggctaatgccatacaacagaggagagtatggatgtagccgaacaacctggcggcagcgcaaaagatg

SEQ ID NO: 62782 - DNA, 103 bp, Artificial Sequence
  Synthetic Polynucleotide
taatacgactcactatagggaatactatcagctatatgttcggctaatgcaacagaggagagcattaatggaacatataaacctggcggcagcgcaaaagatg

SEQ ID NO: 62783 - DNA, 103 bp, Artificial Sequence
  Synthetic Polynucleotide
taatacgactcactatagggattggaatactatcagctatatgttcggctaacagaggagaagccgaatgtatagctgaaacctggcggcagcgcaaaagatg

SEQ ID NO: 62784 - DNA, 103 bp, Artificial Sequence
  Synthetic Polynucleotide
taatacgactcactatagggcagatattggaatactatcagctatatgttaacagaggagaaacataatgctgatagtaaacctggcggcagcgcaaaagatg

SEQ ID NO: 62785 - DNA, 103 bp, Artificial Sequence
  Synthetic Polynucleotide
taatacgactcactatagggtagctcagatattggaatactatcagctataacagaggagaatagctatgagtattccaaacctggcggcagcgcaaaagatg

SEQ ID NO: 62786 - DNA, 103 bp, Artificial Sequence
  Synthetic Polynucleotide
taatacgactcactatagggctagatagctcagatattggaatactatcaaacagaggagatgatagatgtccaatatcaacctggcggcagcgcaaaagatg

SEQ ID NO: 62787 - DNA, 103 bp, Artificial Sequence
  Synthetic Polynucleotide
taatacgactcactataggggtggtctagatagctcagatattggaatacaacagaggagagtattcatgtatctgagcaacctggcggcagcgcaaaagatg

SEQ ID NO: 62788 - DNA, 103 bp, Artificial Sequence
  Synthetic Polynucleotide
taatacgactcactataggggtatcgtggtctagatagctcagatattggaacagaggagaccaataatggagctatctaacctggcggcagcgcaaaagatg

SEQ ID NO: 62789 - DNA, 103 bp, Artificial Sequence
  Synthetic Polynucleotide
taatacgactcactatagggagattgtatcgtggtctagatagctcagataacagaggagaatctgaatgatctagaccaacctggcggcagcgcaaaagatg

SEQ ID NO: 62790 - DNA, 103 bp, Artificial Sequence
  Synthetic Polynucleotide
taatacgactcactatagggtacatagattgtatcgtggtctagatagctaacagaggagaagctatatggaccacgataacctggcggcagcgcaaaagatg

SEQ ID NO: 62791 - DNA, 103 bp, Artificial Sequence
  Synthetic Polynucleotide
taatacgactcactataggggtttattctattgatttaacgctttacgacaacagaggagagtcgtaatgcgttaaatcaacctggcggcagcgcaaaagatg

SEQ ID NO: 62792 - DNA, 103 bp, Artificial Sequence
  Synthetic Polynucleotide
taatacgactcactatagggaaccaaagaaacattagttagtgagatcgtaacagaggagaacgatcatgctaactaataacctggcggcagcgcaaaagatg

SEQ ID NO: 62793 - DNA, 103 bp, Artificial Sequence
  Synthetic Polynucleotide
taatacgactcactatagggatacttacatagattgtatcgtggtctagaaacagaggagatctagaatgcgatacaataacctggcggcagcgcaaaagatg

SEQ ID NO: 62794 - DNA, 103 bp, Artificial Sequence
  Synthetic Polynucleotide
taatacgactcactatagggcgtaaatacttacatagattgtatcgtggtaacagaggagaaccacgatgcaatctatgaacctggcggcagcgcaaaagatg

SEQ ID NO: 62795 - DNA, 103 bp, Artificial Sequence
  Synthetic Polynucleotide
taatacgactcactataggggtcctcgtaaatacttacatagattgtatcaacagaggagagatacaatgtatgtaagtaacctggcggcagcgcaaaagatg

SEQ ID NO: 62796 - DNA, 103 bp, Artificial Sequence
  Synthetic Polynucleotide
taatacgactcactatagggagtgtgtcctcgtaaatacttacatagattaacagaggagaaatctaatgaagtatttaaacctggcggcagcgcaaaagatg

SEQ ID NO: 62797 - DNA, 103 bp, Artificial Sequence
  Synthetic Polynucleotide
taatacgactcactatagggctctcagtgtgtcctcgtaaatacttacataacagaggagaatgtaaatgtttacgaggaacctggcggcagcgcaaaagatg

SEQ ID NO: 62798 - DNA, 103 bp, Artificial Sequence
  Synthetic Polynucleotide
taatacgactcactatagggctatgctctcagtgtgtcctcgtaaatactaacagaggagaagtattatggaggacacaaacctggcggcagcgcaaaagatg

SEQ ID NO: 62799 - DNA, 103 bp, Artificial Sequence
  Synthetic Polynucleotide
taatacgactcactatagggatcctctatgctctcagtgtgtcctcgtaaaacagaggagattacgaatgcacactgagaacctggcggcagcgcaaaagatg

SEQ ID NO: 62800 - DNA, 103 bp, Artificial Sequence
  Synthetic Polynucleotide
taatacgactcactatagggaattcatcctctatgctctcagtgtgtcctaacagaggagaaggacaatgtgagagcataacctggcggcagcgcaaaagatg

SEQ ID NO: 62801 - DNA, 103 bp, Artificial Sequence
  Synthetic Polynucleotide
taatacgactcactatagggaatcaaattcatcctctatgctctcagtgtaacagaggagaacactgatggcatagaggaacctggcggcagcgcaaaagatg

SEQ ID NO: 62802 - DNA, 103 bp, Artificial Sequence
  Synthetic Polynucleotide
taatacgactcactatagggaaaataatcaaattcatcctctatgctctcaacagaggagagagagcatggaggatgaaaacctggcggcagcgcaaaagatg

SEQ ID NO: 62803 - DNA, 103 bp, Artificial Sequence
  Synthetic Polynucleotide
taatacgactcactatagggagtataaccaaagaaacattagttagtgagaacagaggagactcactatgtaatgtttcaacctggcggcagcgcaaaagatg

SEQ ID NO: 62804 - DNA, 103 bp, Artificial Sequence
  Synthetic Polynucleotide
taatacgactcactatagggtcttcaaaataatcaaattcatcctctatgaacagaggagacatagaatgtgaatttgaaacctggcggcagcgcaaaagatg

SEQ ID NO: 62805 - DNA, 103 bp, Artificial Sequence
  Synthetic Polynucleotide
taatacgactcactatagggcatcgtcttcaaaataatcaaattcatcctaacagaggagaaggatgatgttgattattaacctggcggcagcgcaaaagatg

SEQ ID NO: 62806 - DNA, 103 bp, Artificial Sequence
  Synthetic Polynucleotide
taatacgactcactatagggcgaatcatcgtcttcaaaataatcaaattcaacagaggagagaatttatgtattttgaaaacctggcggcagcgcaaaagatg

SEQ ID NO: 62807 - DNA, 103 bp, Artificial Sequence
  Synthetic Polynucleotide
taatacgactcactataggggtcgacgaatcatcgtcttcaaaataatcaaacagaggagatgattaatgtgaagacgaaacctggcggcagcgcaaaagatg

SEQ ID NO: 62808 - DNA, 103 bp, Artificial Sequence
  Synthetic Polynucleotide
taatacgactcactatagggaacatgtcgacgaatcatcgtcttcaaaataacagaggagaattttgatgacgatgattaacctggcggcagcgcaaaagatg

SEQ ID NO: 62809 - DNA, 103 bp, Artificial Sequence
  Synthetic Polynucleotide
taatacgactcactataggggacagaacatgtcgacgaatcatcgtcttcaacagaggagagaagacatggattcgtcgaacctggcggcagcgcaaaagatg

SEQ ID NO: 62810 - DNA, 103 bp, Artificial Sequence
  Synthetic Polynucleotide
taatacgactcactataggggttacgacagaacatgtcgacgaatcatcgaacagaggagacgatgaatggtcgacatgaacctggcggcagcgcaaaagatg

SEQ ID NO: 62811 - DNA, 103 bp, Artificial Sequence
  Synthetic Polynucleotide
taatacgactcactatagggtgtcggttacgacagaacatgtcgacgaataacagaggagaattcgtatgcatgttctgaacctggcggcagcgcaaaagatg

SEQ ID NO: 62812 - DNA, 103 bp, Artificial Sequence
  Synthetic Polynucleotide
taatacgactcactatagggttccctgtcggttacgacagaacatgtcgaaacagaggagatcgacaatgtctgtcgtaaacctggcggcagcgcaaaagatg

SEQ ID NO: 62813 - DNA, 103 bp, Artificial Sequence
  Synthetic Polynucleotide
taatacgactcactatagggtccgtttccctgtcggttacgacagaacataacagaggagaatgttcatgcgtaaccgaaacctggcggcagcgcaaaagatg

SEQ ID NO: 62814 - DNA, 103 bp, Artificial Sequence
  Synthetic Polynucleotide
taatacgactcactatagggatactagtataaccaaagaaacattagttaaacagaggagataactaatgtttctttggaacctggcggcagcgcaaaagatg

SEQ ID NO: 62815 - DNA, 103 bp, Artificial Sequence
  Synthetic Polynucleotide
taatacgactcactatagggatacatccgtttccctgtcggttacgacagaacagaggagactgtcgatgccgacagggaacctggcggcagcgcaaaagatg

SEQ ID NO: 62816 - DNA, 103 bp, Artificial Sequence
  Synthetic Polynucleotide
taatacgactcactatagggaaattatacatccgtttccctgtcggttacaacagaggagagtaaccatgagggaaacgaacctggcggcagcgcaaaagatg

SEQ ID NO: 62817 - DNA, 103 bp, Artificial Sequence
  Synthetic Polynucleotide
taatacgactcactatagggataaaaaattatacatccgtttccctgtcgaacagaggagacgacagatgaacggatgtaacctggcggcagcgcaaaagatg

SEQ ID NO: 62818 - DNA, 103 bp, Artificial Sequence
  Synthetic Polynucleotide
taatacgactcactatagggacactataaaaaattatacatccgtttcccaacagaggagagggaaaatgatgtataataacctggcggcagcgcaaaagatg

SEQ ID NO: 62819 - DNA, 103 bp, Artificial Sequence
  Synthetic Polynucleotide
taatacgactcactatagggcctgcacactataaaaaattatacatccgtaacagaggagaacggatatgtaattttttaacctggcggcagcgcaaaagatg

SEQ ID NO: 62820 - DNA, 103 bp, Artificial Sequence
  Synthetic Polynucleotide
taatacgactcactatagggcatatcctgcacactataaaaaattatacaaacagaggagatgtataatgttttatagtaacctggcggcagcgcaaaagatg

SEQ ID NO: 62821 - DNA, 103 bp, Artificial Sequence
  Synthetic Polynucleotide
taatacgactcactatagggtttatcatatcctgcacactataaaaaattaacagaggagaaattttatgtagtgtgcaaacctggcggcagcgcaaaagatg

SEQ ID NO: 62822 - DNA, 103 bp, Artificial Sequence
  Synthetic Polynucleotide
taatacgactcactatagggatatttttatcatatcctgcacactataaaaacagaggagatttataatgtgcaggataaacctggcggcagcgcaaaagatg

SEQ ID NO: 62823 - DNA, 103 bp, Artificial Sequence
  Synthetic Polynucleotide
taatacgactcactatagggcaattatatttttatcatatcctgcacactaacagaggagaagtgtgatggatatgataaacctggcggcagcgcaaaagatg

SEQ ID NO: 62824 - DNA, 103 bp, Artificial Sequence
  Synthetic Polynucleotide
taatacgactcactatagggtacaacaattatatttttatcatatcctgcaacagaggagagcaggaatggataaaaataacctggcggcagcgcaaaagatg

SEQ ID NO: 62825 - DNA, 103 bp, Artificial Sequence
  Synthetic Polynucleotide
taatacgactcactatagggtgactatactagtataaccaaagaaacattaacagaggagaaatgttatgttggttataaacctggcggcagcgcaaaagatg

SEQ ID NO: 62826 - DNA, 103 bp, Artificial Sequence
  Synthetic Polynucleotide
taatacgactcactatagggatggatacaacaattatatttttatcatataacagaggagaatatgaatgaaatataataacctggcggcagcgcaaaagatg

SEQ ID NO: 62827 - DNA, 103 bp, Artificial Sequence
  Synthetic Polynucleotide
taatacgactcactatagggtgggaatggatacaacaattatatttttataacagaggagaataaaaatgtaattgttgaacctggcggcagcgcaaaagatg

SEQ ID NO: 62828 - DNA, 103 bp, Artificial Sequence
  Synthetic Polynucleotide
taatacgactcactatagggtagaatgggaatggatacaacaattatattaacagaggagaaatataatggttgtatccaacctggcggcagcgcaaaagatg

SEQ ID NO: 62829 - DNA, 103 bp, Artificial Sequence
  Synthetic Polynucleotide
taatacgactcactataggggtgattagaatgggaatggatacaacaattaacagaggagaaattgtatgatccattccaacctggcggcagcgcaaaagatg

SEQ ID NO: 62830 - DNA, 103 bp, Artificial Sequence
  Synthetic Polynucleotide
taatacgactcactatagggataatgtgattagaatgggaatggatacaaaacagaggagattgtatatgttcccattcaacctggcggcagcgcaaaagatg

SEQ ID NO: 62831 - DNA, 103 bp, Artificial Sequence
  Synthetic Polynucleotide
taatacgactcactatagggatcatataatgtgattagaatgggaatggaaacagaggagatccattatgattctaatcaacctggcggcagcgcaaaagatg

SEQ ID NO: 62832 - DNA, 103 bp, Artificial Sequence
  Synthetic Polynucleotide
taatacgactcactatagggacagaatcatataatgtgattagaatgggaaacagaggagatcccatatgaatcacattaacctggcggcagcgcaaaagatg

SEQ ID NO: 62833 - DNA, 103 bp, Artificial Sequence
  Synthetic Polynucleotide
taatacgactcactatagggtttttacagaatcatataatgtgattagaaaacagaggagattctaaatgcattatatgaacctggcggcagcgcaaaagatg

SEQ ID NO: 62834 - DNA, 103 bp, Artificial Sequence
  Synthetic Polynucleotide
taatacgactcactatagggataattttttacagaatcatataatgtgataacagaggagaatcacaatgtatgattctaacctggcggcagcgcaaaagatg

SEQ ID NO: 62835 - DNA, 103 bp, Artificial Sequence
  Synthetic Polynucleotide
taatacgactcactatagggacagtataattttttacagaatcatataataacagaggagaattataatgttctgtaaaaacctggcggcagcgcaaaagatg

SEQ ID NO: 62836 - DNA, 103 bp, Artificial Sequence
  Synthetic Polynucleotide
taatacgactcactataggggatcgtgactatactagtataaccaaagaaaacagaggagattctttatgtatactagtaacctggcggcagcgcaaaagatg

SEQ ID NO: 62837 - DNA, 103 bp, Artificial Sequence
  Synthetic Polynucleotide
taatacgactcactataggggtgttacagtataattttttacagaatcataacagaggagaatgattatgtaaaaaattaacctggcggcagcgcaaaagatg

SEQ ID NO: 62838 - DNA, 103 bp, Artificial Sequence
  Synthetic Polynucleotide
taatacgactcactatagggtcattgtgttacagtataattttttacagaaacagaggagatctgtaatgaattatactaacctggcggcagcgcaaaagatg

SEQ ID NO: 62839 - DNA, 103 bp, Artificial Sequence
  Synthetic Polynucleotide
taatacgactcactatagggctacttcattgtgttacagtataattttttaacagaggagaaaaaaaatgtactgtaacaacctggcggcagcgcaaaagatg

SEQ ID NO: 62840 - DNA, 103 bp, Artificial Sequence
  Synthetic Polynucleotide
taatacgactcactatagggtgcaactacttcattgtgttacagtataataacagaggagaattataatgtaacacaataacctggcggcagcgcaaaagatg

SEQ ID NO: 62841 - DNA, 103 bp, Artificial Sequence
  Synthetic Polynucleotide
taatacgactcactatagggatctatgcaactacttcattgtgttacagtaacagaggagaactgtaatgcaatgaagtaacctggcggcagcgcaaaagatg

SEQ ID NO: 62842 - DNA, 103 bp, Artificial Sequence
  Synthetic Polynucleotide
taatacgactcactatagggtatacatctatgcaactacttcattgtgttaacagaggagaaacacaatgaagtagttgaacctggcggcagcgcaaaagatg

SEQ ID NO: 62843 - DNA, 103 bp, Artificial Sequence
  Synthetic Polynucleotide
taatacgactcactatagggacctatatacatctatgcaactacttcattaacagaggagaaatgaaatggttgcatagaacctggcggcagcgcaaaagatg

SEQ ID NO: 62844 - DNA, 103 bp, Artificial Sequence
  Synthetic Polynucleotide
taatacgactcactatagggatctgacctatatacatctatgcaactactaacagaggagaagtagtatgatagatgtaaacctggcggcagcgcaaaagatg

SEQ ID NO: 62845 - DNA, 103 bp, Artificial Sequence
  Synthetic Polynucleotide
taatacgactcactatagggccagtatctgacctatatacatctatgcaaaacagaggagattgcatatgtgtatatagaacctggcggcagcgcaaaagatg

SEQ ID NO: 62846 - DNA, 103 bp, Artificial Sequence
  Synthetic Polynucleotide
taatacgactcactatagggtcaaaccagtatctgacctatatacatctaaacagaggagatagatgatgataggtcagaacctggcggcagcgcaaaagatg

SEQ ID NO: 62847 - DNA, 103 bp, Artificial Sequence
  Synthetic Polynucleotide
taatacgactcactatagggtgtctgatcgtgactatactagtataaccaaacagaggagatggttaatgtagtatagtaacctggcggcagcgcaaaagatg

SEQ ID NO: 62848 - DNA, 103 bp, Artificial Sequence
  Synthetic Polynucleotide
taatacgactcactataggggtttatcaaaccagtatctgacctatatacaacagaggagagtatatatgtcagatactaacctggcggcagcgcaaaagatg

SEQ ID NO: 62849 - DNA, 103 bp, Artificial Sequence
  Synthetic Polynucleotide
taatacgactcactatagggaaaaagtttatcaaaccagtatctgacctaaacagaggagataggtcatgtactggtttaacctggcggcagcgcaaaagatg

SEQ ID NO: 62850 - DNA, 103 bp, Artificial Sequence
  Synthetic Polynucleotide
taatacgactcactatagggggaataaaaagtttatcaaaccagtatctgaacagaggagacagataatggtttgataaaacctggcggcagcgcaaaagatg

SEQ ID NO: 62851 - DNA, 103 bp, Artificial Sequence
  Synthetic Polynucleotide
taatacgactcactatagggcatgtggaataaaaagtttatcaaaccagtaacagaggagaactggtatgataaactttaacctggcggcagcgcaaaagatg

SEQ ID NO: 62852 - DNA, 103 bp, Artificial Sequence
  Synthetic Polynucleotide
taatacgactcactatagggatactcatgtggaataaaaagtttatcaaaaacagaggagatttgatatgctttttattaacctggcggcagcgcaaaagatg

SEQ ID NO: 62853 - DNA, 103 bp, Artificial Sequence
  Synthetic Polynucleotide
taatacgactcactatagggcaaacatactcatgtggaataaaaagtttaaacagaggagataaactatgtattccacaaacctggcggcagcgcaaaagatg

SEQ ID NO: 62854 - DNA, 103 bp, Artificial Sequence
  Synthetic Polynucleotide
taatacgactcactatagggaaagtcaaacatactcatgtggaataaaaaaacagaggagatttttaatgcacatgagtaacctggcggcagcgcaaaagatg

SEQ ID NO: 62855 - DNA, 103 bp, Artificial Sequence
  Synthetic Polynucleotide
taatacgactcactatagggaccataaagtcaaacatactcatgtggaataacagaggagaattccaatggagtatgttaacctggcggcagcgcaaaagatg

SEQ ID NO: 62856 - DNA, 103 bp, Artificial Sequence
  Synthetic Polynucleotide
taatacgactcactataggggtctaaccataaagtcaaacatactcatgtaacagaggagaacatgaatgtgtttgactaacctggcggcagcgcaaaagatg

SEQ ID NO: 62857 - DNA, 103 bp, Artificial Sequence
  Synthetic Polynucleotide
taatacgactcactatagggtgcgggtctaaccataaagtcaaacatactaacagaggagaagtatgatggactttatgaacctggcggcagcgcaaaagatg

SEQ ID NO: 62858 - DNA, 103 bp, Artificial Sequence
  Synthetic Polynucleotide
taatacgactcactatagggttatttgtctgatcgtgactatactagtataacagaggagaatactaatgtagtcacgaaacctggcggcagcgcaaaagatg

SEQ ID NO: 62859 - DNA, 103 bp, Artificial Sequence
  Synthetic Polynucleotide
taatacgactcactatagggaagtatgcgggtctaaccataaagtcaaacaacagaggagagtttgaatgtatggttagaacctggcggcagcgcaaaagatg

SEQ ID NO: 62860 - DNA, 103 bp, Artificial Sequence
  Synthetic Polynucleotide
taatacgactcactatagggtgttaaagtatgcgggtctaaccataaagtaacagaggagaactttaatgttagacccgaacctggcggcagcgcaaaagatg

SEQ ID NO: 62861 - DNA, 103 bp, Artificial Sequence
  Synthetic Polynucleotide
taatacgactcactatagggtgatttgttaaagtatgcgggtctaaccataacagaggagaatggttatgcccgcatacaacctggcggcagcgcaaaagatg

SEQ ID NO: 62862 - DNA, 103 bp, Artificial Sequence
  Synthetic Polynucleotide
taatacgactcactatagggttcagtgatttgttaaagtatgcgggtctaaacagaggagatagaccatgatactttaaaacctggcggcagcgcaaaagatg

SEQ ID NO: 62863 - DNA, 103 bp, Artificial Sequence
  Synthetic Polynucleotide
taatacgactcactatagggcaattttcagtgatttgttaaagtatgcggaacagaggagaccgcatatgttaacaaataacctggcggcagcgcaaaagatg

SEQ ID NO: 62864 - DNA, 103 bp, Artificial Sequence
  Synthetic Polynucleotide
taatacgactcactatagggaactccaattttcagtgatttgttaaagtaaacagaggagatactttatgaaatcactgaacctggcggcagcgcaaaagatg

SEQ ID NO: 62865 - DNA, 103 bp, Artificial Sequence
  Synthetic Polynucleotide
taatacgactcactatagggtacctaactccaattttcagtgatttgttaaacagaggagataacaaatgactgaaaataacctggcggcagcgcaaaagatg

SEQ ID NO: 62866 - DNA, 103 bp, Artificial Sequence
  Synthetic Polynucleotide
taatacgactcactataggggtcaatacctaactccaattttcagtgattaacagaggagaaatcacatgaaattggagaacctggcggcagcgcaaaagatg

SEQ ID NO: 62867 - DNA, 103 bp, Artificial Sequence
  Synthetic Polynucleotide
taatacgactcactataggggagatgtcaatacctaactccaattttcagaacagaggagactgaaaatgggagttaggaacctggcggcagcgcaaaagatg

SEQ ID NO: 62868 - DNA, 103 bp, Artificial Sequence
  Synthetic Polynucleotide
taatacgactcactatagggattctgagatgtcaatacctaactccaattaacagaggagaaattggatgtaggtattgaacctggcggcagcgcaaaagatg

SEQ ID NO: 62869 - DNA, 103 bp, Artificial Sequence
  Synthetic Polynucleotide
taatacgactcactatagggtttctttatttgtctgatcgtgactatactaacagaggagaagtataatgacgatcagaaacctggcggcagcgcaaaagatg

SEQ ID NO: 62870 - DNA, 103 bp, Artificial Sequence
  Synthetic Polynucleotide
taatacgactcactatagggaactgattctgagatgtcaatacctaactcaacagaggagagagttaatgattgacatcaacctggcggcagcgcaaaagatg

SEQ ID NO: 62871 - DNA, 103 bp, Artificial Sequence
  Synthetic Polynucleotide
taatacgactcactatagggacggcaactgattctgagatgtcaatacctaacagaggagaaggtatatgcatctcagaaacctggcggcagcgcaaaagatg

SEQ ID NO: 62872 - DNA, 103 bp, Artificial Sequence
  Synthetic Polynucleotide
taatacgactcactatagggccagaacggcaactgattctgagatgtcaaaacagaggagattgacaatgcagaatcagaacctggcggcagcgcaaaagatg

SEQ ID NO: 62873 - DNA, 103 bp, Artificial Sequence
  Synthetic Polynucleotide
taatacgactcactatagggatgttccagaacggcaactgattctgagataacagaggagaatctcaatgtcagttgccaacctggcggcagcgcaaaagatg

SEQ ID NO: 62874 - DNA, 103 bp, Artificial Sequence
  Synthetic Polynucleotide
taatacgactcactatagggatttaatgttccagaacggcaactgattctaacagaggagaagaatcatgtgccgttctaacctggcggcagcgcaaaagatg

SEQ ID NO: 62875 - DNA, 103 bp, Artificial Sequence
  Synthetic Polynucleotide
taatacgactcactatagggaatacatttaatgttccagaacggcaactgaacagaggagacagttgatgttctggaacaacctggcggcagcgcaaaagatg

SEQ ID NO: 62876 - DNA, 103 bp, Artificial Sequence
  Synthetic Polynucleotide
taatacgactcactatagggtaaaaaatacatttaatgttccagaacggcaacagaggagagccgttatggaacattaaaacctggcggcagcgcaaaagatg

SEQ ID NO: 62877 - DNA, 103 bp, Artificial Sequence
  Synthetic Polynucleotide
taatacgactcactatagggtatcataaaaaatacatttaatgttccagaaacagaggagatctggaatgttaaatgtaaacctggcggcagcgcaaaagatg

SEQ ID NO: 62878 - DNA, 103 bp, Artificial Sequence
  Synthetic Polynucleotide
taatacgactcactataggggaatatatcataaaaaatacatttaatgttaacagaggagaaacattatgtgtatttttaacctggcggcagcgcaaaagatg

SEQ ID NO: 62879 - DNA, 103 bp, Artificial Sequence
  Synthetic Polynucleotide
taatacgactcactatagggcgttggaatatatcataaaaaatacatttaaacagaggagataaatgatgtttttatgaaacctggcggcagcgcaaaagatg

SEQ ID NO: 62880 - DNA, 103 bp, Artificial Sequence
  Synthetic Polynucleotide
taatacgactcactatagggctgattttctttatttgtctgatcgtgactaacagaggagaagtcacatgcagacaaataacctggcggcagcgcaaaagatg

SEQ ID NO: 62881 - DNA, 103 bp, Artificial Sequence
  Synthetic Polynucleotide
taatacgactcactatagggaaatgcgttggaatatatcataaaaaatacaacagaggagagtatttatgatgatatataacctggcggcagcgcaaaagatg

SEQ ID NO: 62882 - DNA, 103 bp, Artificial Sequence
  Synthetic Polynucleotide
taatacgactcactatagggcacataaatgcgttggaatatatcataaaaaacagaggagattttatatgatattccaaaacctggcggcagcgcaaaagatg

SEQ ID NO: 62883 - DNA, 103 bp, Artificial Sequence
  Synthetic Polynucleotide
taatacgactcactatagggatacccacataaatgcgttggaatatatcaaacagaggagatgatatatgccaacgcataacctggcggcagcgcaaaagatg

SEQ ID NO: 62884 - DNA, 103 bp, Artificial Sequence
  Synthetic Polynucleotide
taatacgactcactataggggttgtatacccacataaatgcgttggaataaacagaggagatattccatggcatttatgaacctggcggcagcgcaaaagatg

SEQ ID NO: 62885 - DNA, 103 bp, Artificial Sequence
  Synthetic Polynucleotide
taatacgactcactataggggacttgttgtatacccacataaatgcgttgaacagaggagacaacgcatgtatgtgggtaacctggcggcagcgcaaaagatg

SEQ ID NO: 62886 - DNA, 103 bp, Artificial Sequence
  Synthetic Polynucleotide
taatacgactcactataggggtaatgacttgttgtatacccacataaatgaacagaggagacatttaatggggtatacaaacctggcggcagcgcaaaagatg

SEQ ID NO: 62887 - DNA, 103 bp, Artificial Sequence
  Synthetic Polynucleotide
taatacgactcactatagggtattagtaatgacttgttgtatacccacataacagaggagaatgtggatgtacaacaagaacctggcggcagcgcaaaagatg

SEQ ID NO: 62888 - DNA, 103 bp, Artificial Sequence
  Synthetic Polynucleotide
taatacgactcactatagggtactctattagtaatgacttgttgtataccaacagaggagaggtataatgcaagtcattaacctggcggcagcgcaaaagatg

SEQ ID NO: 62889 - DNA, 103 bp, Artificial Sequence
  Synthetic Polynucleotide
taatacgactcactatagggtggaatactctattagtaatgacttgttgtaacagaggagaacaacaatgcattactaaaacctggcggcagcgcaaaagatg

SEQ ID NO: 62890 - DNA, 103 bp, Artificial Sequence
  Synthetic Polynucleotide
taatacgactcactatagggactcttggaatactctattagtaatgacttaacagaggagaaagtcaatgctaatagagaacctggcggcagcgcaaaagatg

SEQ ID NO: 62891 - DNA, 103 bp, Artificial Sequence
  Synthetic Polynucleotide
taatacgactcactatagggatcatctgattttctttatttgtctgatcgaacagaggagacgatcaatgaaataaagaaacctggcggcagcgcaaaagatg

SEQ ID NO: 62892 - DNA, 103 bp, Artificial Sequence
  Synthetic Polynucleotide
taatacgactcactatagggttaaaactcttggaatactctattagtaataacagaggagaattactatgagagtattcaacctggcggcagcgcaaaagatg

SEQ ID NO: 62893 - DNA, 103 bp, Artificial Sequence
  Synthetic Polynucleotide
taatacgactcactataggggccaattaaaactcttggaatactctattaaacagaggagataatagatgattccaagaaacctggcggcagcgcaaaagatg

SEQ ID NO: 62894 - DNA, 103 bp, Artificial Sequence
  Synthetic Polynucleotide
taatacgactcactatagggtactagccaattaaaactcttggaatactcaacagaggagagagtatatgaagagttttaacctggcggcagcgcaaaagatg

SEQ ID NO: 62895 - DNA, 103 bp, Artificial Sequence
  Synthetic Polynucleotide
taatacgactcactatagggttaaatactagccaattaaaactcttggaaaacagaggagattccaaatgttttaattgaacctggcggcagcgcaaaagatg

SEQ ID NO: 62896 - DNA, 103 bp, Artificial Sequence
  Synthetic Polynucleotide
taatacgactcactatagggtcttgttaaatactagccaattaaaactctaacagaggagaagagttatgattggctagaacctggcggcagcgcaaaagatg

SEQ ID NO: 62897 - DNA, 103 bp, Artificial Sequence
  Synthetic Polynucleotide
taatacgactcactatagggtcttctcttgttaaatactagccaattaaaaacagaggagatttaatatgctagtatttaacctggcggcagcgcaaaagatg

SEQ ID NO: 62898 - DNA, 103 bp, Artificial Sequence
  Synthetic Polynucleotide
taatacgactcactatagggaaatctcttctcttgttaaatactagccaaaacagaggagattggctatgatttaacaaaacctggcggcagcgcaaaagatg

SEQ ID NO: 62899 - DNA, 103 bp, Artificial Sequence
  Synthetic Polynucleotide
taatacgactcactatagggtgttgaaatctcttctcttgttaaatactaaacagaggagatagtatatgacaagagaaaacctggcggcagcgcaaaagatg

SEQ ID NO: 62900 - DNA, 103 bp, Artificial Sequence
  Synthetic Polynucleotide
taatacgactcactatagggcagtctgttgaaatctcttctcttgttaaaaacagaggagatttaacatgagaagagataacctggcggcagcgcaaaagatg

SEQ ID NO: 62901 - DNA, 103 bp, Artificial Sequence
  Synthetic Polynucleotide
taatacgactcactatagggataaacagtctgttgaaatctcttctcttgaacagaggagacaagagatgagatttcaaaacctggcggcagcgcaaaagatg

SEQ ID NO: 62902 - DNA, 103 bp, Artificial Sequence
  Synthetic Polynucleotide
taatacgactcactataggggtgacgtacaaaaaaataaaactagagattaacagaggagaaatctcatgttttattttaacctggcggcagcgcaaaagatg

SEQ ID NO: 62903 - DNA, 103 bp, Artificial Sequence
  Synthetic Polynucleotide
taatacgactcactatagggaaatggtttattctattgatttaacgctttaacagaggagaaaagcgatgaatcaatagaacctggcggcagcgcaaaagatg

SEQ ID NO: 62904 - DNA, 103 bp, Artificial Sequence
  Synthetic Polynucleotide
taatacgactcactatagggcatcaatcatctgattttctttatttgtctaacagaggagaagacaaatgaagaaaatcaacctggcggcagcgcaaaagatg

SEQ ID NO: 62905 - DNA, 103 bp, Artificial Sequence
  Synthetic Polynucleotide
taatacgactcactatagggagttcataaacagtctgttgaaatctcttcaacagaggagagaagagatgtcaacagacaacctggcggcagcgcaaaagatg

SEQ ID NO: 62906 - DNA, 103 bp, Artificial Sequence
  Synthetic Polynucleotide
taatacgactcactatagggattcgagttcataaacagtctgttgaaatcaacagaggagagatttcatgagactgtttaacctggcggcagcgcaaaagatg

SEQ ID NO: 62907 - DNA, 103 bp, Artificial Sequence
  Synthetic Polynucleotide
taatacgactcactataggggcggcattcgagttcataaacagtctgttgaacagaggagacaacagatggtttatgaaaacctggcggcagcgcaaaagatg

SEQ ID NO: 62908 - DNA, 103 bp, Artificial Sequence
  Synthetic Polynucleotide
taatacgactcactatagggataaggcggcattcgagttcataaacagtcaacagaggagagactgtatgtgaactcgaaacctggcggcagcgcaaaagatg

SEQ ID NO: 62909 - DNA, 103 bp, Artificial Sequence
  Synthetic Polynucleotide
taatacgactcactatagggcgacaataaggcggcattcgagttcataaaaacagaggagatttatgatgtcgaatgccaacctggcggcagcgcaaaagatg

SEQ ID NO: 62910 - DNA, 103 bp, Artificial Sequence
  Synthetic Polynucleotide
taatacgactcactatagggataagcgacaataaggcggcattcgagttcaacagaggagagaactcatgtgccgccttaacctggcggcagcgcaaaagatg

SEQ ID NO: 62911 - DNA, 103 bp, Artificial Sequence
  Synthetic Polynucleotide
taatacgactcactatagggtcaatataagcgacaataaggcggcattcgaacagaggagacgaatgatgccttattgtaacctggcggcagcgcaaaagatg

SEQ ID NO: 62912 - DNA, 103 bp, Artificial Sequence
  Synthetic Polynucleotide
taatacgactcactatagggcatcatcaatataagcgacaataaggcggcaacagaggagagccgccatgttgtcgcttaacctggcggcagcgcaaaagatg

SEQ ID NO: 62913 - DNA, 103 bp, Artificial Sequence
  Synthetic Polynucleotide
taatacgactcactatagggttcgacatcatcaatataagcgacaataagaacagaggagacttattatggcttatattaacctggcggcagcgcaaaagatg

SEQ ID NO: 62914 - DNA, 103 bp, Artificial Sequence
  Synthetic Polynucleotide
taatacgactcactataggggagaattcgacatcatcaatataagcgacaaacagaggagatgtcgcatgtattgatgaaacctggcggcagcgcaaaagatg

SEQ ID NO: 62915 - DNA, 103 bp, Artificial Sequence
  Synthetic Polynucleotide
taatacgactcactatagggttattcatcaatcatctgattttctttattaacagaggagaaataaaatgaatcagatgaacctggcggcagcgcaaaagatg

SEQ ID NO: 62916 - DNA, 103 bp, Artificial Sequence
  Synthetic Polynucleotide
taatacgactcactatagggattgggagaattcgacatcatcaatataagaacagaggagacttataatgatgatgtcgaacctggcggcagcgcaaaagatg

SEQ ID NO: 62917 - DNA, 103 bp, Artificial Sequence
  Synthetic Polynucleotide
taatacgactcactatagggatgatattgggagaattcgacatcatcaataacagaggagaattgatatggtcgaattcaacctggcggcagcgcaaaagatg

SEQ ID NO: 62918 - DNA, 103 bp, Artificial Sequence
  Synthetic Polynucleotide
taatacgactcactatagggcagtgatgatattgggagaattcgacatcaaacagaggagatgatgtatgattctcccaaacctggcggcagcgcaaaagatg

SEQ ID NO: 62919 - DNA, 103 bp, Artificial Sequence
  Synthetic Polynucleotide
taatacgactcactatagggctcatcagtgatgatattgggagaattcgaaacagaggagatcgaatatgcccaatatcaacctggcggcagcgcaaaagatg

SEQ ID NO: 62920 - DNA, 103 bp, Artificial Sequence
  Synthetic Polynucleotide
taatacgactcactatagggagctactcatcagtgatgatattgggagaaaacagaggagattctccatgtatcatcacaacctggcggcagcgcaaaagatg

SEQ ID NO: 62921 - DNA, 103 bp, Artificial Sequence
  Synthetic Polynucleotide
taatacgactcactatagggagatgagctactcatcagtgatgatattggaacagaggagaccaataatgtcactgatgaacctggcggcagcgcaaaagatg

SEQ ID NO: 62922 - DNA, 103 bp, Artificial Sequence
  Synthetic Polynucleotide
taatacgactcactatagggtaacaagatgagctactcatcagtgatgataacagaggagaatcatcatggatgagtagaacctggcggcagcgcaaaagatg

SEQ ID NO: 62923 - DNA, 103 bp, Artificial Sequence
  Synthetic Polynucleotide
taatacgactcactatagggcctgataacaagatgagctactcatcagtgaacagaggagacactgaatggtagctcataacctggcggcagcgcaaaagatg

SEQ ID NO: 62924 - DNA, 103 bp, Artificial Sequence
  Synthetic Polynucleotide
taatacgactcactatagggtggatcctgataacaagatgagctactcataacagaggagaatgagtatgtcatcttgtaacctggcggcagcgcaaaagatg

SEQ ID NO: 62925 - DNA, 103 bp, Artificial Sequence
  Synthetic Polynucleotide
taatacgactcactatagggaagcttggatcctgataacaagatgagctaaacagaggagatagctcatgttgttatcaaacctggcggcagcgcaaaagatg

SEQ ID NO: 62926 - DNA, 103 bp, Artificial Sequence
  Synthetic Polynucleotide
taatacgactcactatagggatgtattattcatcaatcatctgattttctaacagaggagaagaaaaatggatgattgaaacctggcggcagcgcaaaagatg

SEQ ID NO: 62927 - DNA, 103 bp, Artificial Sequence
  Synthetic Polynucleotide
taatacgactcactatagggttagaaagcttggatcctgataacaagatgaacagaggagacatcttatgatcaggatcaacctggcggcagcgcaaaagatg

SEQ ID NO: 62928 - DNA, 103 bp, Artificial Sequence
  Synthetic Polynucleotide
taatacgactcactatagggcgtctttagaaagcttggatcctgataacaaacagaggagatgttatatggatccaagcaacctggcggcagcgcaaaagatg

SEQ ID NO: 62929 - DNA, 103 bp, Artificial Sequence
  Synthetic Polynucleotide
taatacgactcactatagggaatgacgtctttagaaagcttggatcctgaaacagaggagatcaggaatgaagctttctaacctggcggcagcgcaaaagatg

SEQ ID NO: 62930 - DNA, 103 bp, Artificial Sequence
  Synthetic Polynucleotide
taatacgactcactatagggggtttaatgacgtctttagaaagcttggataacagaggagaatccaaatgttctaaagaaacctggcggcagcgcaaaagatg

SEQ ID NO: 62931 - DNA, 103 bp, Artificial Sequence
  Synthetic Polynucleotide
taatacgactcactatagggtcgagggtttaatgacgtctttagaaagctaacagaggagaagctttatgaagacgtcaaacctggcggcagcgcaaaagatg

SEQ ID NO: 62932 - DNA, 103 bp, Artificial Sequence
  Synthetic Polynucleotide
taatacgactcactatagggcatgatcgagggtttaatgacgtctttagaaacagaggagatctaaaatggtcattaaaaacctggcggcagcgcaaaagatg

SEQ ID NO: 62933 - DNA, 103 bp, Artificial Sequence
  Synthetic Polynucleotide
taatacgactcactatagggccattcatgatcgagggtttaatgacgtctaacagaggagaagacgtatgtaaaccctcaacctggcggcagcgcaaaagatg

SEQ ID NO: 62934 - DNA, 103 bp, Artificial Sequence
  Synthetic Polynucleotide
taatacgactcactatagggtaaatccattcatgatcgagggtttaatgaaacagaggagatcattaatgcctcgatcaaacctggcggcagcgcaaaagatg

SEQ ID NO: 62935 - DNA, 103 bp, Artificial Sequence
  Synthetic Polynucleotide
taatacgactcactataggggatgataaatccattcatgatcgagggtttaacagaggagaaaacccatgatcatgaataacctggcggcagcgcaaaagatg

SEQ ID NO: 62936 - DNA, 103 bp, Artificial Sequence
  Synthetic Polynucleotide
taatacgactcactatagggacgatgatgataaatccattcatgatcgagaacagaggagactcgatatggaatggattaacctggcggcagcgcaaaagatg

SEQ ID NO: 62937 - DNA, 103 bp, Artificial Sequence
  Synthetic Polynucleotide
taatacgactcactatagggtttaaatgtattattcatcaatcatctgataacagaggagaatcagaatgttgatgaataacctggcggcagcgcaaaagatg

SEQ ID NO: 62938 - DNA, 103 bp, Artificial Sequence
  Synthetic Polynucleotide
taatacgactcactatagggtaaaaacgatgatgataaatccattcatgaaacagaggagatcatgaatggatttatcaaacctggcggcagcgcaaaagatg

SEQ ID NO: 62939 - DNA, 103 bp, Artificial Sequence
  Synthetic Polynucleotide
taatacgactcactatagggcaacataaaaacgatgatgataaatccattaacagaggagaaatggaatgatcatcatcaacctggcggcagcgcaaaagatg

SEQ ID NO: 62940 - DNA, 103 bp, Artificial Sequence
  Synthetic Polynucleotide
taatacgactcactatagggatgtccaacataaaaacgatgatgataaataacagaggagaatttatatgcatcgttttaacctggcggcagcgcaaaagatg

SEQ ID NO: 62941 - DNA, 103 bp, Artificial Sequence
  Synthetic Polynucleotide
taatacgactcactatagggagcttatgtccaacataaaaacgatgatgaaacagaggagatcatcaatgtttttatgtaacctggcggcagcgcaaaagatg

SEQ ID NO: 62942 - DNA, 103 bp, Artificial Sequence
  Synthetic Polynucleotide
taatacgactcactataggggactaagcttatgtccaacataaaaacgataacagaggagaatcgttatgatgttggacaacctggcggcagcgcaaaagatg

SEQ ID NO: 62943 - DNA, 103 bp, Artificial Sequence
  Synthetic Polynucleotide
taatacgactcactatagggaaacggactaagcttatgtccaacataaaaaacagaggagattttatatgggacataagaacctggcggcagcgcaaaagatg

SEQ ID NO: 62944 - DNA, 103 bp, Artificial Sequence
  Synthetic Polynucleotide
taatacgactcactatagggtggacaaacggactaagcttatgtccaacaaacagaggagatgttggatgtaagcttagaacctggcggcagcgcaaaagatg

SEQ ID NO: 62945 - DNA, 103 bp, Artificial Sequence
  Synthetic Polynucleotide
taatacgactcactatagggagatgtggacaaacggactaagcttatgtcaacagaggagagacataatgttagtccgtaacctggcggcagcgcaaaagatg

SEQ ID NO: 62946 - DNA, 103 bp, Artificial Sequence
  Synthetic Polynucleotide
taatacgactcactatagggtctatagatgtggacaaacggactaagcttaacagaggagaaagcttatgccgtttgtcaacctggcggcagcgcaaaagatg

SEQ ID NO: 62947 - DNA, 103 bp, Artificial Sequence
  Synthetic Polynucleotide
taatacgactcactatagggcatcgtctatagatgtggacaaacggactaaacagaggagatagtccatgtgtccacataacctggcggcagcgcaaaagatg

SEQ ID NO: 62948 - DNA, 103 bp, Artificial Sequence
  Synthetic Polynucleotide
taatacgactcactatagggataaatttaaatgtattattcatcaatcataacagaggagaatgattatggaataatacaacctggcggcagcgcaaaagatg

SEQ ID NO: 62949 - DNA, 103 bp, Artificial Sequence
  Synthetic Polynucleotide
taatacgactcactataggggaaatcatcgtctatagatgtggacaaacgaacagaggagacgtttgatgacatctataaacctggcggcagcgcaaaagatg

SEQ ID NO: 62950 - DNA, 103 bp, Artificial Sequence
  Synthetic Polynucleotide
taatacgactcactatagggattcagaaatcatcgtctatagatgtggacaacagaggagagtccacatgtatagacgaaacctggcggcagcgcaaaagatg

SEQ ID NO: 62951 - DNA, 103 bp, Artificial Sequence
  Synthetic Polynucleotide
taatacgactcactatagggcaataattcagaaatcatcgtctatagatgaacagaggagacatctaatgacgatgattaacctggcggcagcgcaaaagatg

SEQ ID NO: 62952 - DNA, 103 bp, Artificial Sequence
  Synthetic Polynucleotide
taatacgactcactatagggatatgcaataattcagaaatcatcgtctataacagaggagaatagacatggatttctgaaacctggcggcagcgcaaaagatg

SEQ ID NO: 62953 - DNA, 103 bp, Artificial Sequence
  Synthetic Polynucleotide
taatacgactcactataggggagatatatgcaataattcagaaatcatcgaacagaggagacgatgaatgctgaattataacctggcggcagcgcaaaagatg

SEQ ID NO: 62954 - DNA, 103 bp, Artificial Sequence
  Synthetic Polynucleotide
taatacgactcactatagggagagagagatatatgcaataattcagaaataacagaggagaatttctatgttattgcataacctggcggcagcgcaaaagatg

SEQ ID NO: 62955 - DNA, 103 bp, Artificial Sequence
  Synthetic Polynucleotide
taatacgactcactataggggttaaagagagagatatatgcaataattcaaacagaggagatgaattatggcatatatcaacctggcggcagcgcaaaagatg

SEQ ID NO: 62956 - DNA, 103 bp, Artificial Sequence
  Synthetic Polynucleotide
taatacgactcactatagggctggagttaaagagagagatatatgcaataaacagaggagatattgcatgtatctctctaacctggcggcagcgcaaaagatg

SEQ ID NO: 62957 - DNA, 103 bp, Artificial Sequence
  Synthetic Polynucleotide
taatacgactcactatagggagttcctggagttaaagagagagatatatgaacagaggagacatataatgctctctttaaacctggcggcagcgcaaaagatg

SEQ ID NO: 62958 - DNA, 103 bp, Artificial Sequence
  Synthetic Polynucleotide
taatacgactcactatagggtgacaagttcctggagttaaagagagagataacagaggagaatctctatgtttaactccaacctggcggcagcgcaaaagatg

SEQ ID NO: 62959 - DNA, 103 bp, Artificial Sequence
  Synthetic Polynucleotide
taatacgactcactatagggagatgataaatttaaatgtattattcatcaaacagaggagatgatgaatgatacatttaaacctggcggcagcgcaaaagatg

SEQ ID NO: 62960 - DNA, 103 bp, Artificial Sequence
  Synthetic Polynucleotide
taatacgactcactatagggcatcctgacaagttcctggagttaaagagaaacagaggagatctcttatgctccaggaaaacctggcggcagcgcaaaagatg

SEQ ID NO: 62961 - DNA, 103 bp, Artificial Sequence
  Synthetic Polynucleotide
taatacgactcactatagggtggaccatcctgacaagttcctggagttaaaacagaggagattaactatgggaacttgtaacctggcggcagcgcaaaagatg

SEQ ID NO: 62962 - DNA, 103 bp, Artificial Sequence
  Synthetic Polynucleotide
taatacgactcactatagggtaaagtggaccatcctgacaagttcctggaaacagaggagatccaggatgttgtcaggaaacctggcggcagcgcaaaagatg

SEQ ID NO: 62963 - DNA, 103 bp, Artificial Sequence
  Synthetic Polynucleotide
taatacgactcactatagggcatgttaaagtggaccatcctgacaagttcaacagaggagagaacttatgaggatggtcaacctggcggcagcgcaaaagatg

SEQ ID NO: 62964 - DNA, 103 bp, Artificial Sequence
  Synthetic Polynucleotide
taatacgactcactataggggagaacatgttaaagtggaccatcctgacaaacagaggagatgtcagatgggtccacttaacctggcggcagcgcaaaagatg

SEQ ID NO: 62965 - DNA, 103 bp, Artificial Sequence
  Synthetic Polynucleotide
taatacgactcactatagggtaggcgagaacatgttaaagtggaccatccaacagaggagaggatggatgactttaacaaacctggcggcagcgcaaaagatg

SEQ ID NO: 62966 - DNA, 103 bp, Artificial Sequence
  Synthetic Polynucleotide
taatacgactcactatagggtctcttaggcgagaacatgttaaagtggacaacagaggagagtccacatgaacatgttcaacctggcggcagcgcaaaagatg

SEQ ID NO: 62967 - DNA, 103 bp, Artificial Sequence
  Synthetic Polynucleotide
taatacgactcactatagggttttatctcttaggcgagaacatgttaaagaacagaggagactttaaatggttctcgccaacctggcggcagcgcaaaagatg

SEQ ID NO: 62968 - DNA, 103 bp, Artificial Sequence
  Synthetic Polynucleotide
taatacgactcactatagggaagatttttatctcttaggcgagaacatgtaacagaggagaacatgtatgcgcctaagaaacctggcggcagcgcaaaagatg

SEQ ID NO: 62969 - DNA, 103 bp, Artificial Sequence
  Synthetic Polynucleotide
taatacgactcactatagggatccaaagatttttatctcttaggcgagaaaacagaggagattctcgatgaagagataaaacctggcggcagcgcaaaagatg

SEQ ID NO: 62970 - DNA, 103 bp, Artificial Sequence
  Synthetic Polynucleotide
taatacgactcactatagggcttacagatgataaatttaaatgtattattaacagaggagaaataatatgtttaaatttaacctggcggcagcgcaaaagatg

SEQ ID NO: 62971 - DNA, 103 bp, Artificial Sequence
  Synthetic Polynucleotide
taatacgactcactatagggcaaccatccaaagatttttatctcttaggcaacagaggagagcctaaatgataaaaatcaacctggcggcagcgcaaaagatg

SEQ ID NO: 62972 - DNA, 103 bp, Artificial Sequence
  Synthetic Polynucleotide
taatacgactcactatagggacatgcaaccatccaaagatttttatctctaacagaggagaagagatatgaatctttggaacctggcggcagcgcaaaagatg

SEQ ID NO: 62973 - DNA, 103 bp, Artificial Sequence
  Synthetic Polynucleotide
taatacgactcactatagggaagtcacatgcaaccatccaaagatttttaaacagaggagataaaaaatgttggatggtaacctggcggcagcgcaaaagatg

SEQ ID NO: 62974 - DNA, 103 bp, Artificial Sequence
  Synthetic Polynucleotide
taatacgactcactataggggagaaaagtcacatgcaaccatccaaagataacagaggagaatctttatgtggttgcataacctggcggcagcgcaaaagatg

SEQ ID NO: 62975 - DNA, 103 bp, Artificial Sequence
  Synthetic Polynucleotide
taatacgactcactatagggatttagagaaaagtcacatgcaaccatccaaacagaggagatggatgatggcatgtgacaacctggcggcagcgcaaaagatg

SEQ ID NO: 62976 - DNA, 103 bp, Artificial Sequence
  Synthetic Polynucleotide
taatacgactcactatagggtcatcatttagagaaaagtcacatgcaaccaacagaggagaggttgcatgtgacttttcaacctggcggcagcgcaaaagatg

SEQ ID NO: 62977 - DNA, 103 bp, Artificial Sequence
  Synthetic Polynucleotide
taatacgactcactatagggcaacatcatcatttagagaaaagtcacatgaacagaggagacatgtgatgtttctctaaaacctggcggcagcgcaaaagatg

SEQ ID NO: 62978 - DNA, 103 bp, Artificial Sequence
  Synthetic Polynucleotide
taatacgactcactatagggttgggcaacatcatcatttagagaaaagtcaacagaggagagactttatgctaaatgataacctggcggcagcgcaaaagatg

SEQ ID NO: 62979 - DNA, 103 bp, Artificial Sequence
  Synthetic Polynucleotide
taatacgactcactatagggggatcttgggcaacatcatcatttagagaaaacagaggagattctctatgtgatgatgtaacctggcggcagcgcaaaagatg

SEQ ID NO: 62980 - DNA, 103 bp, Artificial Sequence
  Synthetic Polynucleotide
taatacgactcactatagggagagaggatcttgggcaacatcatcatttaaacagaggagataaatgatgatgttgcccaacctggcggcagcgcaaaagatg

SEQ ID NO: 62981 - DNA, 103 bp, Artificial Sequence
  Synthetic Polynucleotide
taatacgactcactatagggaaaatcttacagatgataaatttaaatgtaaacagaggagatacattatgatttatcataacctggcggcagcgcaaaagatg

SEQ ID NO: 62982 - DNA, 103 bp, Artificial Sequence
  Synthetic Polynucleotide
taatacgactcactatagggatttaagagaggatcttgggcaacatcatcaacagaggagagatgatatggcccaagataacctggcggcagcgcaaaagatg

SEQ ID NO: 62983 - DNA, 103 bp, Artificial Sequence
  Synthetic Polynucleotide
taatacgactcactataggggattcatttaagagaggatcttgggcaacaaacagaggagatgttgcatgagatcctctaacctggcggcagcgcaaaagatg

SEQ ID NO: 62984 - DNA, 103 bp, Artificial Sequence
  Synthetic Polynucleotide
taatacgactcactatagggggatggattcatttaagagaggatcttgggaacagaggagacccaagatgctctcttaaaacctggcggcagcgcaaaagatg

SEQ ID NO: 62985 - DNA, 103 bp, Artificial Sequence
  Synthetic Polynucleotide
taatacgactcactatagggggataggatggattcatttaagagaggatcaacagaggagagatcctatgttaaatgaaaacctggcggcagcgcaaaagatg

SEQ ID NO: 62986 - DNA, 103 bp, Artificial Sequence
  Synthetic Polynucleotide
taatacgactcactatagggtacaaggataggatggattcatttaagagaaacagaggagatctcttatgtgaatccataacctggcggcagcgcaaaagatg

SEQ ID NO: 62987 - DNA, 103 bp, Artificial Sequence
  Synthetic Polynucleotide
taatacgactcactatagggtcttgtacaaggataggatggattcatttaaacagaggagataaatgatgccatcctataacctggcggcagcgcaaaagatg

SEQ ID NO: 62988 - DNA, 103 bp, Artificial Sequence
  Synthetic Polynucleotide
taatacgactcactataggggtccatcttgtacaaggataggatggattcaacagaggagagaatccatgctatccttgaacctggcggcagcgcaaaagatg

SEQ ID NO: 62989 - DNA, 103 bp, Artificial Sequence
  Synthetic Polynucleotide
taatacgactcactatagggagactgtccatcttgtacaaggataggatgaacagaggagacatcctatgcttgtacaaaacctggcggcagcgcaaaagatg

SEQ ID NO: 62990 - DNA, 103 bp, Artificial Sequence
  Synthetic Polynucleotide
taatacgactcactatagggaaaatagactgtccatcttgtacaaggataaacagaggagatatcctatgacaagatggaacctggcggcagcgcaaaagatg

SEQ ID NO: 62991 - DNA, 103 bp, Artificial Sequence
  Synthetic Polynucleotide
taatacgactcactatagggtaaggaaaatagactgtccatcttgtacaaaacagaggagattgtacatgatggacagtaacctggcggcagcgcaaaagatg

SEQ ID NO: 62992 - DNA, 103 bp, Artificial Sequence
  Synthetic Polynucleotide
taatacgactcactatagggtctcaaaaatcttacagatgataaatttaaaacagaggagattaaatatgtcatctgtaaacctggcggcagcgcaaaagatg

SEQ ID NO: 62993 - DNA, 103 bp, Artificial Sequence
  Synthetic Polynucleotide
taatacgactcactatagggccatctaaggaaaatagactgtccatcttgaacagaggagacaagatatgcagtctattaacctggcggcagcgcaaaagatg

SEQ ID NO: 62994 - DNA, 103 bp, Artificial Sequence
  Synthetic Polynucleotide
taatacgactcactatagggttaaaccatctaaggaaaatagactgtccaaacagaggagatggacaatgtattttcctaacctggcggcagcgcaaaagatg

SEQ ID NO: 62995 - DNA, 103 bp, Artificial Sequence
  Synthetic Polynucleotide
taatacgactcactatagggaaatattaaaccatctaaggaaaatagactaacagaggagaagtctaatgtccttagataacctggcggcagcgcaaaagatg

SEQ ID NO: 62996 - DNA, 103 bp, Artificial Sequence
  Synthetic Polynucleotide
taatacgactcactatagggaacaaaaatattaaaccatctaaggaaaataacagaggagaattttcatgagatggtttaacctggcggcagcgcaaaagatg

SEQ ID NO: 62997 - DNA, 103 bp, Artificial Sequence
  Synthetic Polynucleotide
taatacgactcactatagggtgggtaacaaaaatattaaaccatctaaggaacagaggagaccttagatggtttaatataacctggcggcagcgcaaaagatg

SEQ ID NO: 62998 - DNA, 103 bp, Artificial Sequence
  Synthetic Polynucleotide
taatacgactcactataggggatcatgggtaacaaaaatattaaaccatcaacagaggagagatggtatgatatttttgaacctggcggcagcgcaaaagatg

SEQ ID NO: 62999 - DNA, 103 bp, Artificial Sequence
  Synthetic Polynucleotide
taatacgactcactatagggttatagatcatgggtaacaaaaatattaaaaacagaggagatttaatatgtttgttaccaacctggcggcagcgcaaaagatg

SEQ ID NO: 63000 - DNA, 103 bp, Artificial Sequence
  Synthetic Polynucleotide
taatacgactcactatagggtacctttatagatcatgggtaacaaaaataaacagaggagatattttatgtacccatgaaacctggcggcagcgcaaaagatg

SEQ ID NO: 63001 - DNA, 103 bp, Artificial Sequence
  Synthetic Polynucleotide
taatacgactcactatagggaggtctacctttatagatcatgggtaacaaaacagaggagattgttaatgatgatctataacctggcggcagcgcaaaagatg

SEQ ID NO: 63002 - DNA, 103 bp, Artificial Sequence
  Synthetic Polynucleotide
taatacgactcactatagggcgattaggtctacctttatagatcatgggtaacagaggagaacccatatgctataaaggaacctggcggcagcgcaaaagatg

SEQ ID NO: 63003 - DNA, 103 bp, Artificial Sequence
  Synthetic Polynucleotide
taatacgactcactatagggagatatctcaaaaatcttacagatgataaaaacagaggagatttatcatgtgtaagattaacctggcggcagcgcaaaagatg

SEQ ID NO: 63004 - DNA, 103 bp, Artificial Sequence
  Synthetic Polynucleotide
taatacgactcactatagggcaagacgattaggtctacctttatagatcaaacagaggagatgatctatgaaggtagacaacctggcggcagcgcaaaagatg

SEQ ID NO: 63005 - DNA, 103 bp, Artificial Sequence
  Synthetic Polynucleotide
taatacgactcactatagggtcatccaagacgattaggtctacctttataaacagaggagatataaaatgagacctaataacctggcggcagcgcaaaagatg

SEQ ID NO: 63006 - DNA, 103 bp, Artificial Sequence
  Synthetic Polynucleotide
taatacgactcactatagggtatggtcatccaagacgattaggtctacctaacagaggagaaggtagatgtaatcgtctaacctggcggcagcgcaaaagatg

SEQ ID NO: 63007 - DNA, 103 bp, Artificial Sequence
  Synthetic Polynucleotide
taatacgactcactatagggaaatatatggtcatccaagacgattaggtcaacagaggagagacctaatggtcttggataacctggcggcagcgcaaaagatg

SEQ ID NO: 63008 - DNA, 103 bp, Artificial Sequence
  Synthetic Polynucleotide
taatacgactcactataggggaaataaatatatggtcatccaagacgattaacagaggagaaatcgtatgggatgaccaaacctggcggcagcgcaaaagatg

SEQ ID NO: 63009 - DNA, 103 bp, Artificial Sequence
  Synthetic Polynucleotide
taatacgactcactatagggaactggaaataaatatatggtcatccaagaaacagaggagatcttggatgaccatatataacctggcggcagcgcaaaagatg

SEQ ID NO: 63010 - DNA, 103 bp, Artificial Sequence
  Synthetic Polynucleotide
taatacgactcactatagggaataaaactggaaataaatatatggtcatcaacagaggagagatgacatgatatttattaacctggcggcagcgcaaaagatg

SEQ ID NO: 63011 - DNA, 103 bp, Artificial Sequence
  Synthetic Polynucleotide
taatacgactcactatagggcgtataataaaactggaaataaatatatggaacagaggagaccatatatgtatttccagaacctggcggcagcgcaaaagatg

SEQ ID NO: 63012 - DNA, 103 bp, Artificial Sequence
  Synthetic Polynucleotide
taatacgactcactatagggttatgcgtataataaaactggaaataaataaacagaggagatatttaatgccagttttaaacctggcggcagcgcaaaagatg

SEQ ID NO: 63013 - DNA, 103 bp, Artificial Sequence
  Synthetic Polynucleotide
taatacgactcactatagggacaatttatgcgtataataaaactggaaataacagaggagaatttccatgtttattataaacctggcggcagcgcaaaagatg

SEQ ID NO: 63014 - DNA, 103 bp, Artificial Sequence
  Synthetic Polynucleotide
taatacgactcactatagggccacaaaatggtttattctattgatttaacaacagaggagagttaaaatgatagaataaaacctggcggcagcgcaaaagatg

SEQ ID NO: 63015 - DNA, 103 bp, Artificial Sequence
  Synthetic Polynucleotide
taatacgactcactatagggtaatgagatatctcaaaaatcttacagatgaacagaggagacatctgatggatttttgaaacctggcggcagcgcaaaagatg

SEQ ID NO: 63016 - DNA, 103 bp, Artificial Sequence
  Synthetic Polynucleotide
taatacgactcactatagggtttttacaatttatgcgtataataaaactgaacagaggagacagtttatgtatacgcataacctggcggcagcgcaaaagatg

SEQ ID NO: 63017 - DNA, 103 bp, Artificial Sequence
  Synthetic Polynucleotide
taatacgactcactatagggacatatttttacaatttatgcgtataataaaacagaggagattattaatggcataaattaacctggcggcagcgcaaaagatg

SEQ ID NO: 63018 - DNA, 103 bp, Artificial Sequence
  Synthetic Polynucleotide
taatacgactcactatagggacctaacatatttttacaatttatgcgtataacagaggagaatacgcatgaattgtaaaaacctggcggcagcgcaaaagatg

SEQ ID NO: 63019 - DNA, 103 bp, Artificial Sequence
  Synthetic Polynucleotide
taatacgactcactatagggagtaaacctaacatatttttacaatttatgaacagaggagacataaaatgtaaaaatataacctggcggcagcgcaaaagatg

SEQ ID NO: 63020 - DNA, 103 bp, Artificial Sequence
  Synthetic Polynucleotide
taatacgactcactatagggattttagtaaacctaacatatttttacaataacagaggagaattgtaatgatatgttagaacctggcggcagcgcaaaagatg

SEQ ID NO: 63021 - DNA, 103 bp, Artificial Sequence
  Synthetic Polynucleotide
taatacgactcactataggggagacattttagtaaacctaacatatttttaacagaggagaaaaaatatgttaggtttaaacctggcggcagcgcaaaagatg

SEQ ID NO: 63022 - DNA, 103 bp, Artificial Sequence
  Synthetic Polynucleotide
taatacgactcactatagggcccgcgagacattttagtaaacctaacataaacagaggagatatgttatgtttactaaaaacctggcggcagcgcaaaagatg

SEQ ID NO: 63023 - DNA, 103 bp, Artificial Sequence
  Synthetic Polynucleotide
taatacgactcactatagggaatgccccgcgagacattttagtaaacctaaacagaggagataggttatgtaaaatgtcaacctggcggcagcgcaaaagatg

SEQ ID NO: 63024 - DNA, 103 bp, Artificial Sequence
  Synthetic Polynucleotide
taatacgactcactatagggcgattaatgccccgcgagacattttagtaaaacagaggagattactaatgtgtctcgcgaacctggcggcagcgcaaaagatg

SEQ ID NO: 63025 - DNA, 103 bp, Artificial Sequence
  Synthetic Polynucleotide
taatacgactcactatagggaaaaacgattaatgccccgcgagacattttaacagaggagaaaaatgatgcgcggggcaaacctggcggcagcgcaaaagatg

SEQ ID NO: 63026 - DNA, 103 bp, Artificial Sequence
  Synthetic Polynucleotide
taatacgactcactatagggtattttaatgagatatctcaaaaatcttacaacagaggagagtaagaatgttgagatataacctggcggcagcgcaaaagatg

SEQ ID NO: 63027 - DNA, 103 bp, Artificial Sequence
  Synthetic Polynucleotide
taatacgactcactatagggccttcaaaaacgattaatgccccgcgagacaacagaggagagtctcgatgggcattaataacctggcggcagcgcaaaagatg

SEQ ID NO: 63028 - DNA, 103 bp, Artificial Sequence
  Synthetic Polynucleotide
taatacgactcactatagggccaatccttcaaaaacgattaatgccccgcaacagaggagagcggggatgtaatcgtttaacctggcggcagcgcaaaagatg

SEQ ID NO: 63029 - DNA, 103 bp, Artificial Sequence
  Synthetic Polynucleotide
taatacgactcactatagggtttgtccaatccttcaaaaacgattaatgcaacagaggagagcattaatggtttttgaaaacctggcggcagcgcaaaagatg

SEQ ID NO: 63030 - DNA, 103 bp, Artificial Sequence
  Synthetic Polynucleotide
taatacgactcactatagggccagatttgtccaatccttcaaaaacgattaacagaggagaaatcgtatgtgaaggattaacctggcggcagcgcaaaagatg

SEQ ID NO: 63031 - DNA, 103 bp, Artificial Sequence
  Synthetic Polynucleotide
taatacgactcactatagggtttttccagatttgtccaatccttcaaaaaaacagaggagatttttgatggattggacaaacctggcggcagcgcaaaagatg

SEQ ID NO: 63032 - DNA, 103 bp, Artificial Sequence
  Synthetic Polynucleotide
taatacgactcactatagggtgttgtttttccagatttgtccaatccttcaacagaggagagaaggaatggacaaatctaacctggcggcagcgcaaaagatg

SEQ ID NO: 63033 - DNA, 103 bp, Artificial Sequence
  Synthetic Polynucleotide
taatacgactcactatagggcattgtgttgtttttccagatttgtccaataacagaggagaattggaatgatctggaaaaacctggcggcagcgcaaaagatg

SEQ ID NO: 63034 - DNA, 103 bp, Artificial Sequence
  Synthetic Polynucleotide
taatacgactcactatagggtcatacattgtgttgtttttccagatttgtaacagaggagaacaaatatggaaaaacaaaacctggcggcagcgcaaaagatg

SEQ ID NO: 63035 - DNA, 103 bp, Artificial Sequence
  Synthetic Polynucleotide
taatacgactcactataggggatgttcatacattgtgttgtttttccagaaacagaggagatctggaatgacaacacaaaacctggcggcagcgcaaaagatg

SEQ ID NO: 63036 - DNA, 103 bp, Artificial Sequence
  Synthetic Polynucleotide
taatacgactcactatagggtccatgatgttcatacattgtgttgtttttaacagaggagaaaaaacatgacaatgtataacctggcggcagcgcaaaagatg

SEQ ID NO: 63037 - DNA, 103 bp, Artificial Sequence
  Synthetic Polynucleotide
taatacgactcactatagggaataatattttaatgagatatctcaaaaataacagaggagaatttttatgatatctcataacctggcggcagcgcaaaagatg

SEQ ID NO: 63038 - DNA, 103 bp, Artificial Sequence
  Synthetic Polynucleotide
taatacgactcactatagggtagattccatgatgttcatacattgtgttgaacagaggagacaacacatggtatgaacaaacctggcggcagcgcaaaagatg

SEQ ID NO: 63039 - DNA, 103 bp, Artificial Sequence
  Synthetic Polynucleotide
taatacgactcactatagggcggtatagattccatgatgttcatacattgaacagaggagacaatgtatgaacatcatgaacctggcggcagcgcaaaagatg

SEQ ID NO: 63040 - DNA, 103 bp, Artificial Sequence
  Synthetic Polynucleotide
taatacgactcactatagggtttgtcggtatagattccatgatgttcataaacagaggagatatgaaatgcatggaatcaacctggcggcagcgcaaaagatg

SEQ ID NO: 63041 - DNA, 103 bp, Artificial Sequence
  Synthetic Polynucleotide
taatacgactcactatagggtcgtgtttgtcggtatagattccatgatgtaacagaggagaacatcaatgaatctatacaacctggcggcagcgcaaaagatg

SEQ ID NO: 63042 - DNA, 103 bp, Artificial Sequence
  Synthetic Polynucleotide
taatacgactcactatagggttttatcgtgtttgtcggtatagattccataacagaggagaatggaaatgataccgacaaacctggcggcagcgcaaaagatg

SEQ ID NO: 63043 - DNA, 103 bp, Artificial Sequence
  Synthetic Polynucleotide
taatacgactcactatagggagatattttatcgtgtttgtcggtatagataacagaggagaatctatatggacaaacacaacctggcggcagcgcaaaagatg

SEQ ID NO: 63044 - DNA, 103 bp, Artificial Sequence
  Synthetic Polynucleotide
taatacgactcactatagggagttaagatattttatcgtgtttgtcggtaaacagaggagataccgaatgacacgataaaacctggcggcagcgcaaaagatg

SEQ ID NO: 63045 - DNA, 103 bp, Artificial Sequence
  Synthetic Polynucleotide
taatacgactcactatagggcggaaagttaagatattttatcgtgtttgtaacagaggagaacaaacatgataaaatataacctggcggcagcgcaaaagatg

SEQ ID NO: 63046 - DNA, 103 bp, Artificial Sequence
  Synthetic Polynucleotide
taatacgactcactatagggctctgcggaaagttaagatattttatcgtgaacagaggagacacgatatgatatcttaaaacctggcggcagcgcaaaagatg

SEQ ID NO: 63047 - DNA, 103 bp, Artificial Sequence
  Synthetic Polynucleotide
taatacgactcactatagggtggatctctgcggaaagttaagatattttaaacagaggagataaaatatgttaactttcaacctggcggcagcgcaaaagatg

SEQ ID NO: 63048 - DNA, 103 bp, Artificial Sequence
  Synthetic Polynucleotide
taatacgactcactatagggaccctaataatattttaatgagatatctcaaacagaggagatgagatatgtcattaaaaaacctggcggcagcgcaaaagatg

SEQ ID NO: 63049 - DNA, 103 bp, Artificial Sequence
  Synthetic Polynucleotide
taatacgactcactataggggacagtggatctctgcggaaagttaagataaacagaggagatatcttatgtttccgcagaacctggcggcagcgcaaaagatg

SEQ ID NO: 63050 - DNA, 103 bp, Artificial Sequence
  Synthetic Polynucleotide
taatacgactcactatagggccagtgacagtggatctctgcggaaagttaaacagaggagataacttatggcagagatcaacctggcggcagcgcaaaagatg

SEQ ID NO: 63051 - DNA, 103 bp, Artificial Sequence
  Synthetic Polynucleotide
taatacgactcactatagggtctttccagtgacagtggatctctgcggaaaacagaggagattccgcatggatccactgaacctggcggcagcgcaaaagatg

SEQ ID NO: 63052 - DNA, 103 bp, Artificial Sequence
  Synthetic Polynucleotide
taatacgactcactatagggtatcatctttccagtgacagtggatctctgaacagaggagacagagaatgactgtcactaacctggcggcagcgcaaaagatg

SEQ ID NO: 63053 - DNA, 103 bp, Artificial Sequence
  Synthetic Polynucleotide
taatacgactcactatagggtcatctatcatctttccagtgacagtggataacagaggagaatccacatgcactggaaaaacctggcggcagcgcaaaagatg

SEQ ID NO: 63054 - DNA, 103 bp, Artificial Sequence
  Synthetic Polynucleotide
taatacgactcactataggggatagtcatctatcatctttccagtgacagaacagaggagactgtcaatggaaagatgaaacctggcggcagcgcaaaagatg

SEQ ID NO: 63055 - DNA, 103 bp, Artificial Sequence
  Synthetic Polynucleotide
taatacgactcactatagggagttagatagtcatctatcatctttccagtaacagaggagaactggaatgatgatagataacctggcggcagcgcaaaagatg

SEQ ID NO: 63056 - DNA, 103 bp, Artificial Sequence
  Synthetic Polynucleotide
taatacgactcactatagggttacgagttagatagtcatctatcatctttaacagaggagaaaagatatgagatgactaaacctggcggcagcgcaaaagatg

SEQ ID NO: 63057 - DNA, 103 bp, Artificial Sequence
  Synthetic Polynucleotide
taatacgactcactatagggtttttttacgagttagatagtcatctatcaaacagaggagatgatagatgactatctaaaacctggcggcagcgcaaaagatg

SEQ ID NO: 63058 - DNA, 103 bp, Artificial Sequence
  Synthetic Polynucleotide
taatacgactcactatagggataggtttttttacgagttagatagtcatcaacagaggagagatgacatgctaactcgtaacctggcggcagcgcaaaagatg

SEQ ID NO: 63059 - DNA, 103 bp, Artificial Sequence
  Synthetic Polynucleotide
taatacgactcactatagggtactgaccctaataatattttaatgagataaacagaggagatatctcatgaaaatattaaacctggcggcagcgcaaaagatg

SEQ ID NO: 63060 - DNA, 103 bp, Artificial Sequence
  Synthetic Polynucleotide
taatacgactcactatagggtcattataggtttttttacgagttagatagaacagaggagactatctatgtcgtaaaaaaacctggcggcagcgcaaaagatg

SEQ ID NO: 63061 - DNA, 103 bp, Artificial Sequence
  Synthetic Polynucleotide
taatacgactcactatagggtatgatcattataggtttttttacgagttaaacagaggagataactcatgaaaaaacctaacctggcggcagcgcaaaagatg

SEQ ID NO: 63062 - DNA, 103 bp, Artificial Sequence
  Synthetic Polynucleotide
taatacgactcactatagggaactatatgatcattataggtttttttacgaacagaggagacgtaaaatgacctataataacctggcggcagcgcaaaagatg

SEQ ID NO: 63063 - DNA, 103 bp, Artificial Sequence
  Synthetic Polynucleotide
taatacgactcactatagggagattaactatatgatcattataggtttttaacagaggagaaaaaacatgtaatgatcaaacctggcggcagcgcaaaagatg

SEQ ID NO: 63064 - DNA, 103 bp, Artificial Sequence
  Synthetic Polynucleotide
taatacgactcactatagggataatagattaactatatgatcattataggaacagaggagacctataatgatcatatagaacctggcggcagcgcaaaagatg

SEQ ID NO: 63065 - DNA, 103 bp, Artificial Sequence
  Synthetic Polynucleotide
taatacgactcactatagggacaaaataatagattaactatatgatcattaacagaggagaaatgatatgatagttaataacctggcggcagcgcaaaagatg

SEQ ID NO: 63066 - DNA, 103 bp, Artificial Sequence
  Synthetic Polynucleotide
taatacgactcactatagggtttgcacaaaataatagattaactatatgaaacagaggagatcatatatgtaatctattaacctggcggcagcgcaaaagatg

SEQ ID NO: 63067 - DNA, 103 bp, Artificial Sequence
  Synthetic Polynucleotide
taatacgactcactatagggatctatttgcacaaaataatagattaactaaacagaggagatagttaatgtattattttaacctggcggcagcgcaaaagatg

SEQ ID NO: 63068 - DNA, 103 bp, Artificial Sequence
  Synthetic Polynucleotide
taatacgactcactatagggctcccatctatttgcacaaaataatagattaacagaggagaaatctaatgttttgtgcaaacctggcggcagcgcaaaagatg

SEQ ID NO: 63069 - DNA, 103 bp, Artificial Sequence
  Synthetic Polynucleotide
taatacgactcactataggggcaaactcccatctatttgcacaaaataataacagaggagaattattatgtgcaaatagaacctggcggcagcgcaaaagatg

SEQ ID NO: 63070 - DNA, 103 bp, Artificial Sequence
  Synthetic Polynucleotide
taatacgactcactatagggatgagtactgaccctaataatattttaatgaacagaggagacattaaatgattattaggaacctggcggcagcgcaaaagatg

SEQ ID NO: 63071 - DNA, 103 bp, Artificial Sequence
  Synthetic Polynucleotide
taatacgactcactatagggaagatgcaaactcccatctatttgcacaaaaacagaggagatttgtgatgatagatgggaacctggcggcagcgcaaaagatg

SEQ ID NO: 63072 - DNA, 103 bp, Artificial Sequence
  Synthetic Polynucleotide
taatacgactcactatagggtataaaagatgcaaactcccatctatttgcaacagaggagagcaaatatgtgggagtttaacctggcggcagcgcaaaagatg

SEQ ID NO: 63073 - DNA, 103 bp, Artificial Sequence
  Synthetic Polynucleotide
taatacgactcactatagggtcttgtataaaagatgcaaactcccatctaaacagaggagatagatgatggtttgcatcaacctggcggcagcgcaaaagatg

SEQ ID NO: 63074 - DNA, 103 bp, Artificial Sequence
  Synthetic Polynucleotide
taatacgactcactatagggattgttcttgtataaaagatgcaaactcccaacagaggagagggagtatgcatcttttaaacctggcggcagcgcaaaagatg

SEQ ID NO: 63075 - DNA, 103 bp, Artificial Sequence
  Synthetic Polynucleotide
taatacgactcactatagggttctaattgttcttgtataaaagatgcaaaaacagaggagatttgcaatgtttatacaaaacctggcggcagcgcaaaagatg

SEQ ID NO: 63076 - DNA, 103 bp, Artificial Sequence
  Synthetic Polynucleotide
taatacgactcactatagggccctgttctaattgttcttgtataaaagataacagaggagaatctttatgacaagaacaaacctggcggcagcgcaaaagatg

SEQ ID NO: 63077 - DNA, 103 bp, Artificial Sequence
  Synthetic Polynucleotide
taatacgactcactatagggtaattccctgttctaattgttcttgtataaaacagaggagattatacatgaacaattagaacctggcggcagcgcaaaagatg

SEQ ID NO: 63078 - DNA, 103 bp, Artificial Sequence
  Synthetic Polynucleotide
taatacgactcactatagggtaaagtaattccctgttctaattgttcttgaacagaggagacaagaaatgttagaacagaacctggcggcagcgcaaaagatg

SEQ ID NO: 63079 - DNA, 103 bp, Artificial Sequence
  Synthetic Polynucleotide
taatacgactcactatagggactattaaagtaattccctgttctaattgtaacagaggagaacaattatgacagggaataacctggcggcagcgcaaaagatg

SEQ ID NO: 63080 - DNA, 103 bp, Artificial Sequence
  Synthetic Polynucleotide
taatacgactcactatagggtatcaactattaaagtaattccctgttctaaacagaggagatagaacatggaattacttaacctggcggcagcgcaaaagatg

SEQ ID NO: 63081 - DNA, 103 bp, Artificial Sequence
  Synthetic Polynucleotide
taatacgactcactatagggtgataatgagtactgaccctaataatatttaacagaggagaaaatatatgtagggtcagaacctggcggcagcgcaaaagatg

SEQ ID NO: 63082 - DNA, 103 bp, Artificial Sequence
  Synthetic Polynucleotide
taatacgactcactataggggtatctatcaactattaaagtaattccctgaacagaggagacagggaatgactttaataaacctggcggcagcgcaaaagatg

SEQ ID NO: 63083 - DNA, 103 bp, Artificial Sequence
  Synthetic Polynucleotide
taatacgactcactatagggaacgcgtatctatcaactattaaagtaattaacagaggagaaattacatgaatagttgaaacctggcggcagcgcaaaagatg

SEQ ID NO: 63084 - DNA, 103 bp, Artificial Sequence
  Synthetic Polynucleotide
taatacgactcactatagggcagagaacgcgtatctatcaactattaaagaacagaggagactttaaatgttgatagataacctggcggcagcgcaaaagatg

SEQ ID NO: 63085 - DNA, 103 bp, Artificial Sequence
  Synthetic Polynucleotide
taatacgactcactatagggtactccagagaacgcgtatctatcaactataacagaggagaatagttatgagatacgcgaacctggcggcagcgcaaaagatg

SEQ ID NO: 63086 - DNA, 103 bp, Artificial Sequence
  Synthetic Polynucleotide
taatacgactcactatagggtatgctactccagagaacgcgtatctatcaaacagaggagatgatagatgcgcgttctcaacctggcggcagcgcaaaagatg

SEQ ID NO: 63087 - DNA, 103 bp, Artificial Sequence
  Synthetic Polynucleotide
taatacgactcactatagggtggcatatgctactccagagaacgcgtatcaacagaggagagatacgatgtctctggagaacctggcggcagcgcaaaagatg

SEQ ID NO: 63088 - DNA, 103 bp, Artificial Sequence
  Synthetic Polynucleotide
taatacgactcactatagggagcggtggcatatgctactccagagaacgcaacagaggagagcgttcatgggagtagcaaacctggcggcagcgcaaaagatg

SEQ ID NO: 63089 - DNA, 103 bp, Artificial Sequence
  Synthetic Polynucleotide
taatacgactcactatagggcctttagcggtggcatatgctactccagagaacagaggagactctggatgagcatatgcaacctggcggcagcgcaaaagatg

SEQ ID NO: 63090 - DNA, 103 bp, Artificial Sequence
  Synthetic Polynucleotide
taatacgactcactatagggacgcgcctttagcggtggcatatgctactcaacagaggagagagtagatgatgccaccgaacctggcggcagcgcaaaagatg

SEQ ID NO: 63091 - DNA, 103 bp, Artificial Sequence
  Synthetic Polynucleotide
taatacgactcactatagggcattgacgcgcctttagcggtggcatatgcaacagaggagagcatatatgaccgctaaaaacctggcggcagcgcaaaagatg

SEQ ID NO: 63092 - DNA, 103 bp, Artificial Sequence
  Synthetic Polynucleotide
taatacgactcactatagggatatatgataatgagtactgaccctaataaaacagaggagattattaatgtcagtactcaacctggcggcagcgcaaaagatg

SEQ ID NO: 63093 - DNA, 103 bp, Artificial Sequence
  Synthetic Polynucleotide
taatacgactcactatagggagagtcattgacgcgcctttagcggtggcaaacagaggagatgccacatgtaaaggcgcaacctggcggcagcgcaaaagatg

SEQ ID NO: 63094 - DNA, 103 bp, Artificial Sequence
  Synthetic Polynucleotide
taatacgactcactatagggtactgagagtcattgacgcgcctttagcggaacagaggagaccgctaatggcgcgtcaaaacctggcggcagcgcaaaagatg

SEQ ID NO: 63095 - DNA, 103 bp, Artificial Sequence
  Synthetic Polynucleotide
taatacgactcactatagggactcttactgagagtcattgacgcgcctttaacagaggagaaaaggcatgtcaatgactaacctggcggcagcgcaaaagatg

SEQ ID NO: 63096 - DNA, 103 bp, Artificial Sequence
  Synthetic Polynucleotide
taatacgactcactatagggtcataactcttactgagagtcattgacgcgaacagaggagacgcgtcatggactctcagaacctggcggcagcgcaaaagatg

SEQ ID NO: 63097 - DNA, 103 bp, Artificial Sequence
  Synthetic Polynucleotide
taatacgactcactatagggcagattcataactcttactgagagtcattgaacagaggagacaatgaatgtcagtaagaaacctggcggcagcgcaaaagatg

SEQ ID NO: 63098 - DNA, 103 bp, Artificial Sequence
  Synthetic Polynucleotide
taatacgactcactatagggcaatccagattcataactcttactgagagtaacagaggagaactctcatgaagagttataacctggcggcagcgcaaaagatg

SEQ ID NO: 63099 - DNA, 103 bp, Artificial Sequence
  Synthetic Polynucleotide
taatacgactcactatagggttaggcaatccagattcataactcttactgaacagaggagacagtaaatgttatgaatcaacctggcggcagcgcaaaagatg

SEQ ID NO: 63100 - DNA, 103 bp, Artificial Sequence
  Synthetic Polynucleotide
taatacgactcactatagggcgggtttaggcaatccagattcataactctaacagaggagaagagttatgaatctggataacctggcggcagcgcaaaagatg

SEQ ID NO: 63101 - DNA, 103 bp, Artificial Sequence
  Synthetic Polynucleotide
taatacgactcactatagggtaagtcgggtttaggcaatccagattcataaacagaggagatatgaaatgggattgcctaacctggcggcagcgcaaaagatg

SEQ ID NO: 63102 - DNA, 103 bp, Artificial Sequence
  Synthetic Polynucleotide
taatacgactcactatagggataactaagtcgggtttaggcaatccagataacagaggagaatctggatggcctaaaccaacctggcggcagcgcaaaagatg

SEQ ID NO: 63103 - DNA, 103 bp, Artificial Sequence
  Synthetic Polynucleotide
taatacgactcactatagggtgccaatatatgataatgagtactgaccctaacagaggagaagggtcatgactcattataacctggcggcagcgcaaaagatg

SEQ ID NO: 63104 - DNA, 103 bp, Artificial Sequence
  Synthetic Polynucleotide
taatacgactcactatagggagaatataactaagtcgggtttaggcaatcaacagaggagagattgcatgaacccgactaacctggcggcagcgcaaaagatg

SEQ ID NO: 63105 - DNA, 103 bp, Artificial Sequence
  Synthetic Polynucleotide
taatacgactcactatagggttccaagaatataactaagtcgggtttaggaacagaggagacctaaaatggacttagttaacctggcggcagcgcaaaagatg

SEQ ID NO: 63106 - DNA, 103 bp, Artificial Sequence
  Synthetic Polynucleotide
taatacgactcactatagggccagattccaagaatataactaagtcgggtaacagaggagaacccgaatgagttatattaacctggcggcagcgcaaaagatg

SEQ ID NO: 63107 - DNA, 103 bp, Artificial Sequence
  Synthetic Polynucleotide
taatacgactcactatagggtgctaccagattccaagaatataactaagtaacagaggagaacttagatgtattcttggaacctggcggcagcgcaaaagatg

SEQ ID NO: 63108 - DNA, 103 bp, Artificial Sequence
  Synthetic Polynucleotide
taatacgactcactatagggttctttgctaccagattccaagaatataacaacagaggagagttataatgttggaatctaacctggcggcagcgcaaaagatg

SEQ ID NO: 63109 - DNA, 103 bp, Artificial Sequence
  Synthetic Polynucleotide
taatacgactcactatagggttaatttctttgctaccagattccaagaataacagaggagaattcttatgatctggtagaacctggcggcagcgcaaaagatg

SEQ ID NO: 63110 - DNA, 103 bp, Artificial Sequence
  Synthetic Polynucleotide
taatacgactcactatagggttctattaatttctttgctaccagattccaaacagaggagatggaatatggtagcaaagaacctggcggcagcgcaaaagatg

SEQ ID NO: 63111 - DNA, 103 bp, Artificial Sequence
  Synthetic Polynucleotide
taatacgactcactataggggacgtttctattaatttctttgctaccagaaacagaggagatctggtatgaaagaaattaacctggcggcagcgcaaaagatg

SEQ ID NO: 63112 - DNA, 103 bp, Artificial Sequence
  Synthetic Polynucleotide
taatacgactcactatagggtcgccgacgtttctattaatttctttgctaaacagaggagatagcaaatgaattaatagaacctggcggcagcgcaaaagatg

SEQ ID NO: 63113 - DNA, 103 bp, Artificial Sequence
  Synthetic Polynucleotide
taatacgactcactatagggtttcctcgccgacgtttctattaatttcttaacagaggagaaagaaaatgatagaaacgaacctggcggcagcgcaaaagatg

SEQ ID NO: 63114 - DNA, 103 bp, Artificial Sequence
  Synthetic Polynucleotide
taatacgactcactataggggctgctgccaatatatgataatgagtactgaacagaggagacagtacatgttatcatataacctggcggcagcgcaaaagatg

SEQ ID NO: 63115 - DNA, 103 bp, Artificial Sequence
  Synthetic Polynucleotide
taatacgactcactatagggataaatttcctcgccgacgtttctattaataacagaggagaattaatatgaacgtcggcaacctggcggcagcgcaaaagatg

SEQ ID NO: 63116 - DNA, 103 bp, Artificial Sequence
  Synthetic Polynucleotide
taatacgactcactatagggtcttcataaatttcctcgccgacgtttctaaacagaggagatagaaaatgcggcgaggaaacctggcggcagcgcaaaagatg

SEQ ID NO: 63117 - DNA, 103 bp, Artificial Sequence
  Synthetic Polynucleotide
taatacgactcactatagggctacatcttcataaatttcctcgccgacgtaacagaggagaacgtcgatgaggaaatttaacctggcggcagcgcaaaagatg

SEQ ID NO: 63118 - DNA, 103 bp, Artificial Sequence
  Synthetic Polynucleotide
taatacgactcactataggggaatgctacatcttcataaatttcctcgccaacagaggagaggcgagatgatttatgaaaacctggcggcagcgcaaaagatg

SEQ ID NO: 63119 - DNA, 103 bp, Artificial Sequence
  Synthetic Polynucleotide
taatacgactcactatagggtgttggaatgctacatcttcataaatttccaacagaggagaggaaatatgtgaagatgtaacctggcggcagcgcaaaagatg

SEQ ID NO: 63120 - DNA, 103 bp, Artificial Sequence
  Synthetic Polynucleotide
taatacgactcactatagggccttttgttggaatgctacatcttcataaaaacagaggagatttatgatgatgtagcataacctggcggcagcgcaaaagatg

SEQ ID NO: 63121 - DNA, 103 bp, Artificial Sequence
  Synthetic Polynucleotide
taatacgactcactatagggtaataccttttgttggaatgctacatcttcaacagaggagagaagatatggcattccaaaacctggcggcagcgcaaaagatg

SEQ ID NO: 63122 - DNA, 103 bp, Artificial Sequence
  Synthetic Polynucleotide
taatacgactcactatagggtcttgtaataccttttgttggaatgctacaaacagaggagatgtagcatgccaacaaaaaacctggcggcagcgcaaaagatg

SEQ ID NO: 63123 - DNA, 103 bp, Artificial Sequence
  Synthetic Polynucleotide
taatacgactcactatagggtatattcttgtaataccttttgttggaatgaacagaggagacattccatgaaaaggtataacctggcggcagcgcaaaagatg

SEQ ID NO: 63124 - DNA, 103 bp, Artificial Sequence
  Synthetic Polynucleotide
taatacgactcactatagggttttttatattcttgtaataccttttgttgaacagaggagacaacaaatggtattacaaaacctggcggcagcgcaaaagatg

SEQ ID NO: 63125 - DNA, 103 bp, Artificial Sequence
  Synthetic Polynucleotide
taatacgactcactatagggttgcaccacaaaatggtttattctattgataacagaggagaatcaatatgataaaccataacctggcggcagcgcaaaagatg

SEQ ID NO: 63126 - DNA, 103 bp, Artificial Sequence
  Synthetic Polynucleotide
taatacgactcactatagggtaatagctgctgccaatatatgataatgagaacagaggagactcattatgatatattggaacctggcggcagcgcaaaagatg

SEQ ID NO: 63127 - DNA, 103 bp, Artificial Sequence
  Synthetic Polynucleotide
taatacgactcactatagggatcatttttttatattcttgtaatacctttaacagaggagaaaaggtatgacaagaataaacctggcggcagcgcaaaagatg

SEQ ID NO: 63128 - DNA, 103 bp, Artificial Sequence
  Synthetic Polynucleotide
taatacgactcactatagggcttcaatcatttttttatattcttgtaataaacagaggagatattacatgaatataaaaaacctggcggcagcgcaaaagatg

SEQ ID NO: 63129 - DNA, 103 bp, Artificial Sequence
  Synthetic Polynucleotide
taatacgactcactatagggtccttcttcaatcatttttttatattcttgaacagaggagacaagaaatgaaaaaaatgaacctggcggcagcgcaaaagatg

SEQ ID NO: 63130 - DNA, 103 bp, Artificial Sequence
  Synthetic Polynucleotide
taatacgactcactatagggtcttctccttcttcaatcatttttttatataacagaggagaatataaatgaatgattgaaacctggcggcagcgcaaaagatg

SEQ ID NO: 63131 - DNA, 103 bp, Artificial Sequence
  Synthetic Polynucleotide
taatacgactcactataggggaatatcttctccttcttcaatcattttttaacagaggagaaaaaaaatgttgaagaagaacctggcggcagcgcaaaagatg

SEQ ID NO: 63132 - DNA, 103 bp, Artificial Sequence
  Synthetic Polynucleotide
taatacgactcactatagggccaatgaatatcttctccttcttcaatcataacagaggagaatgattatggaaggagaaaacctggcggcagcgcaaaagatg

SEQ ID NO: 63133 - DNA, 103 bp, Artificial Sequence
  Synthetic Polynucleotide
taatacgactcactatagggatttgccaatgaatatcttctccttcttcaaacagaggagatgaagaatgagaagatataacctggcggcagcgcaaaagatg

SEQ ID NO: 63134 - DNA, 103 bp, Artificial Sequence
  Synthetic Polynucleotide
taatacgactcactatagggaaataatttgccaatgaatatcttctccttaacagaggagaaaggagatgatattcattaacctggcggcagcgcaaaagatg

SEQ ID NO: 63135 - DNA, 103 bp, Artificial Sequence
  Synthetic Polynucleotide
taatacgactcactatagggagaagaaataatttgccaatgaatatcttcaacagaggagagaagatatgcattggcaaaacctggcggcagcgcaaaagatg

SEQ ID NO: 63136 - DNA, 103 bp, Artificial Sequence
  Synthetic Polynucleotide
taatacgactcactatagggaattcagaagaaataatttgccaatgaataaacagaggagatattcaatggcaaattataacctggcggcagcgcaaaagatg

SEQ ID NO: 63137 - DNA, 103 bp, Artificial Sequence
  Synthetic Polynucleotide
taatacgactcactatagggataagtaatagctgctgccaatatatgataaacagaggagatatcatatgttggcagcaaacctggcggcagcgcaaaagatg

SEQ ID NO: 63138 - DNA, 103 bp, Artificial Sequence
  Synthetic Polynucleotide
taatacgactcactatagggcctcgaattcagaagaaataatttgccaataacagaggagaattggcatgttatttcttaacctggcggcagcgcaaaagatg

SEQ ID NO: 63139 - DNA, 103 bp, Artificial Sequence
  Synthetic Polynucleotide
taatacgactcactatagggatcttcctcgaattcagaagaaataatttgaacagaggagacaaattatgtcttctgaaaacctggcggcagcgcaaaagatg

SEQ ID NO: 63140 - DNA, 103 bp, Artificial Sequence
  Synthetic Polynucleotide
taatacgactcactatagggtttacatcttcctcgaattcagaagaaataaacagaggagatatttcatgtgaattcgaaacctggcggcagcgcaaaagatg

SEQ ID NO: 63141 - DNA, 103 bp, Artificial Sequence
  Synthetic Polynucleotide
taatacgactcactatagggccttctttacatcttcctcgaattcagaagaacagaggagacttctgatgtcgaggaagaacctggcggcagcgcaaaagatg

SEQ ID NO: 63142 - DNA, 103 bp, Artificial Sequence
  Synthetic Polynucleotide
taatacgactcactatagggcaactccttctttacatcttcctcgaattcaacagaggagagaattcatggaagatgtaaacctggcggcagcgcaaaagatg

SEQ ID NO: 63143 - DNA, 103 bp, Artificial Sequence
  Synthetic Polynucleotide
taatacgactcactatagggttaatcaactccttctttacatcttcctcgaacagaggagacgaggaatgtgtaaagaaaacctggcggcagcgcaaaagatg

SEQ ID NO: 63144 - DNA, 103 bp, Artificial Sequence
  Synthetic Polynucleotide
taatacgactcactatagggtattcttaatcaactccttctttacatcttaacagaggagaaagatgatgagaaggagtaacctggcggcagcgcaaaagatg

SEQ ID NO: 63145 - DNA, 103 bp, Artificial Sequence
  Synthetic Polynucleotide
taatacgactcactatagggaactatattcttaatcaactccttctttacaacagaggagagtaaagatggagttgattaacctggcggcagcgcaaaagatg

SEQ ID NO: 63146 - DNA, 103 bp, Artificial Sequence
  Synthetic Polynucleotide
taatacgactcactatagggtctataactatattcttaatcaactccttcaacagaggagagaaggaatggattaagaaaacctggcggcagcgcaaaagatg

SEQ ID NO: 63147 - DNA, 103 bp, Artificial Sequence
  Synthetic Polynucleotide
taatacgactcactatagggtagcctctataactatattcttaatcaactaacagaggagaagttgaatgagaatatagaacctggcggcagcgcaaaagatg

SEQ ID NO: 63148 - DNA, 103 bp, Artificial Sequence
  Synthetic Polynucleotide
taatacgactcactatagggataaaataagtaatagctgctgccaatataaacagaggagatatattatgagcagctataacctggcggcagcgcaaaagatg

SEQ ID NO: 63149 - DNA, 103 bp, Artificial Sequence
  Synthetic Polynucleotide
taatacgactcactatagggatgtatagcctctataactatattcttaataacagaggagaattaagatgatagttataaacctggcggcagcgcaaaagatg

SEQ ID NO: 63150 - DNA, 103 bp, Artificial Sequence
  Synthetic Polynucleotide
taatacgactcactatagggaccgtatgtatagcctctataactatattcaacagaggagagaatatatgtatagaggcaacctggcggcagcgcaaaagatg

SEQ ID NO: 63151 - DNA, 103 bp, Artificial Sequence
  Synthetic Polynucleotide
taatacgactcactatagggcagtaaccgtatgtatagcctctataactaaacagaggagatagttaatgaggctatacaacctggcggcagcgcaaaagatg

SEQ ID NO: 63152 - DNA, 103 bp, Artificial Sequence
  Synthetic Polynucleotide
taatacgactcactatagggtggtccagtaaccgtatgtatagcctctataacagaggagaatagagatgatacatacgaacctggcggcagcgcaaaagatg

SEQ ID NO: 63153 - DNA, 103 bp, Artificial Sequence
  Synthetic Polynucleotide
taatacgactcactatagggcccactggtccagtaaccgtatgtatagccaacagaggagaggctatatgtacggttacaacctggcggcagcgcaaaagatg

SEQ ID NO: 63154 - DNA, 103 bp, Artificial Sequence
  Synthetic Polynucleotide
taatacgactcactataggggttgccccactggtccagtaaccgtatgtaaacagaggagatacataatgttactggacaacctggcggcagcgcaaaagatg

SEQ ID NO: 63155 - DNA, 103 bp, Artificial Sequence
  Synthetic Polynucleotide
taatacgactcactatagggccacagttgccccactggtccagtaaccgtaacagaggagaacggttatgggaccagtgaacctggcggcagcgcaaaagatg

SEQ ID NO: 63156 - DNA, 103 bp, Artificial Sequence
  Synthetic Polynucleotide
taatacgactcactatagggtacatccacagttgccccactggtccagtaaacagaggagatactggatgagtggggcaaacctggcggcagcgcaaaagatg

SEQ ID NO: 63157 - DNA, 103 bp, Artificial Sequence
  Synthetic Polynucleotide
taatacgactcactatagggtttattacatccacagttgccccactggtcaacagaggagagaccagatgggcaactgtaacctggcggcagcgcaaaagatg

SEQ ID NO: 63158 - DNA, 103 bp, Artificial Sequence
  Synthetic Polynucleotide
taatacgactcactatagggttcactttattacatccacagttgccccacaacagaggagagtggggatgctgtggatgaacctggcggcagcgcaaaagatg

SEQ ID NO: 63159 - DNA, 103 bp, Artificial Sequence
  Synthetic Polynucleotide
taatacgactcactatagggataaaataaaataagtaatagctgctgccaaacagaggagatggcagatgctattacttaacctggcggcagcgcaaaagatg

SEQ ID NO: 63160 - DNA, 103 bp, Artificial Sequence
  Synthetic Polynucleotide
taatacgactcactataggggtaatttcactttattacatccacagttgcaacagaggagagcaactatggatgtaataaacctggcggcagcgcaaaagatg

SEQ ID NO: 63161 - DNA, 103 bp, Artificial Sequence
  Synthetic Polynucleotide
taatacgactcactatagggaaaatgtaatttcactttattacatccacaaacagaggagatgtggaatgaataaagtgaacctggcggcagcgcaaaagatg

SEQ ID NO: 63162 - DNA, 103 bp, Artificial Sequence
  Synthetic Polynucleotide
taatacgactcactatagggttataaaaatgtaatttcactttattacataacagaggagaatgtaaatgagtgaaattaacctggcggcagcgcaaaagatg

SEQ ID NO: 63163 - DNA, 103 bp, Artificial Sequence
  Synthetic Polynucleotide
taatacgactcactatagggtctatttataaaaatgtaatttcactttataacagaggagaataaagatgaattacattaacctggcggcagcgcaaaagatg

SEQ ID NO: 63164 - DNA, 103 bp, Artificial Sequence
  Synthetic Polynucleotide
taatacgactcactatagggtaacatctatttataaaaatgtaatttcacaacagaggagagtgaaaatgcatttttataacctggcggcagcgcaaaagatg

SEQ ID NO: 63165 - DNA, 103 bp, Artificial Sequence
  Synthetic Polynucleotide
taatacgactcactatagggtgcactaacatctatttataaaaatgtaataacagaggagaattacaatgttataaataaacctggcggcagcgcaaaagatg

SEQ ID NO: 63166 - DNA, 103 bp, Artificial Sequence
  Synthetic Polynucleotide
taatacgactcactatagggaacactgcactaacatctatttataaaaataacagaggagaatttttatgaatagatgtaacctggcggcagcgcaaaagatg

SEQ ID NO: 63167 - DNA, 103 bp, Artificial Sequence
  Synthetic Polynucleotide
taatacgactcactatagggtttttaacactgcactaacatctatttataaacagaggagatataaaatgatgttagtgaacctggcggcagcgcaaaagatg

SEQ ID NO: 63168 - DNA, 103 bp, Artificial Sequence
  Synthetic Polynucleotide
taatacgactcactatagggtccattttttaacactgcactaacatctataacagaggagaatagatatgagtgcagtgaacctggcggcagcgcaaaagatg

SEQ ID NO: 63169 - DNA, 103 bp, Artificial Sequence
  Synthetic Polynucleotide
taatacgactcactatagggcttcatccattttttaacactgcactaacaaacagaggagatgttagatgagtgttaaaaacctggcggcagcgcaaaagatg

SEQ ID NO: 63170 - DNA, 103 bp, Artificial Sequence
  Synthetic Polynucleotide
taatacgactcactataggggaaaaataaaataaaataagtaatagctgcaacagaggagagcagctatgacttattttaacctggcggcagcgcaaaagatg

SEQ ID NO: 63171 - DNA, 103 bp, Artificial Sequence
  Synthetic Polynucleotide
taatacgactcactatagggatatccttcatccattttttaacactgcacaacagaggagagtgcagatgtaaaaaatgaacctggcggcagcgcaaaagatg

SEQ ID NO: 63172 - DNA, 103 bp, Artificial Sequence
  Synthetic Polynucleotide
taatacgactcactataggggagtaatatccttcatccattttttaacacaacagaggagagtgttaatgaatggatgaaacctggcggcagcgcaaaagatg

SEQ ID NO: 63173 - DNA, 103 bp, Artificial Sequence
  Synthetic Polynucleotide
taatacgactcactatagggtgccagagtaatatccttcatccattttttaacagaggagaaaaaaaatgatgaaggataacctggcggcagcgcaaaagatg

SEQ ID NO: 63174 - DNA, 103 bp, Artificial Sequence
  Synthetic Polynucleotide
taatacgactcactatagggcaagttgccagagtaatatccttcatccataacagaggagaatggatatgggatattacaacctggcggcagcgcaaaagatg

SEQ ID NO: 63175 - DNA, 103 bp, Artificial Sequence
  Synthetic Polynucleotide
taatacgactcactataggggattccaagttgccagagtaatatccttcaaacagaggagatgaaggatgttactctggaacctggcggcagcgcaaaagatg

SEQ ID NO: 63176 - DNA, 103 bp, Artificial Sequence
  Synthetic Polynucleotide
taatacgactcactataggggaactgattccaagttgccagagtaatatcaacagaggagagatattatgctggcaactaacctggcggcagcgcaaaagatg

SEQ ID NO: 63177 - DNA, 103 bp, Artificial Sequence
  Synthetic Polynucleotide
taatacgactcactatagggtccgagaactgattccaagttgccagagtaaacagaggagatactctatgaacttggaaaacctggcggcagcgcaaaagatg

SEQ ID NO: 63178 - DNA, 103 bp, Artificial Sequence
  Synthetic Polynucleotide
taatacgactcactatagggacgtatccgagaactgattccaagttgccaaacagaggagatggcaaatgggaatcagtaacctggcggcagcgcaaaagatg

SEQ ID NO: 63179 - DNA, 103 bp, Artificial Sequence
  Synthetic Polynucleotide
taatacgactcactatagggcagatacgtatccgagaactgattccaagtaacagaggagaacttggatgcagttctcgaacctggcggcagcgcaaaagatg

SEQ ID NO: 63180 - DNA, 103 bp, Artificial Sequence
  Synthetic Polynucleotide
taatacgactcactatagggcatatcagatacgtatccgagaactgattcaacagaggagagaatcaatgctcggatacaacctggcggcagcgcaaaagatg

SEQ ID NO: 63181 - DNA, 103 bp, Artificial Sequence
  Synthetic Polynucleotide
taatacgactcactatagggataaagaaaaataaaataaaataagtaataaacagaggagatattacatgttttattttaacctggcggcagcgcaaaagatg

SEQ ID NO: 63182 - DNA, 103 bp, Artificial Sequence
  Synthetic Polynucleotide
taatacgactcactataggggtatgcatatcagatacgtatccgagaactaacagaggagaagttctatgatacgtatcaacctggcggcagcgcaaaagatg

SEQ ID NO: 63183 - DNA, 103 bp, Artificial Sequence
  Synthetic Polynucleotide
taatacgactcactataggggtttagtatgcatatcagatacgtatccgaaacagaggagatcggatatgtatctgataaacctggcggcagcgcaaaagatg

SEQ ID NO: 63184 - DNA, 103 bp, Artificial Sequence
  Synthetic Polynucleotide
taatacgactcactatagggtgcgagtttagtatgcatatcagatacgtaaacagaggagatacgtaatggatatgcataacctggcggcagcgcaaaagatg

SEQ ID NO: 63185 - DNA, 103 bp, Artificial Sequence
  Synthetic Polynucleotide
taatacgactcactatagggattgatgcgagtttagtatgcatatcagataacagaggagaatctgaatggcatactaaaacctggcggcagcgcaaaagatg

SEQ ID NO: 63186 - DNA, 103 bp, Artificial Sequence
  Synthetic Polynucleotide
taatacgactcactataggggagttattgatgcgagtttagtatgcatataacagaggagaatatgcatgctaaactcgaacctggcggcagcgcaaaagatg

SEQ ID NO: 63187 - DNA, 103 bp, Artificial Sequence
  Synthetic Polynucleotide
taatacgactcactatagggtaattgagttattgatgcgagtttagtatgaacagaggagacatactatgctcgcatcaaacctggcggcagcgcaaaagatg

SEQ ID NO: 63188 - DNA, 103 bp, Artificial Sequence
  Synthetic Polynucleotide
taatacgactcactatagggataactaattgagttattgatgcgagtttaaacagaggagataaactatgatcaataacaacctggcggcagcgcaaaagatg

SEQ ID NO: 63189 - DNA, 103 bp, Artificial Sequence
  Synthetic Polynucleotide
taatacgactcactatagggtggcaataactaattgagttattgatgcgaaacagaggagatcgcatatgtaactcaataacctggcggcagcgcaaaagatg

SEQ ID NO: 63190 - DNA, 103 bp, Artificial Sequence
  Synthetic Polynucleotide
taatacgactcactatagggtatcttggcaataactaattgagttattgaaacagaggagatcaataatgcaattagttaacctggcggcagcgcaaaagatg

SEQ ID NO: 63191 - DNA, 103 bp, Artificial Sequence
  Synthetic Polynucleotide
taatacgactcactataggggtttctatcttggcaataactaattgagttaacagaggagaaactcaatgagttattgcaacctggcggcagcgcaaaagatg

SEQ ID NO: 63192 - DNA, 103 bp, Artificial Sequence
  Synthetic Polynucleotide
taatacgactcactatagggataaaataaagaaaaataaaataaaataagaacagaggagacttattatgttttattttaacctggcggcagcgcaaaagatg

SEQ ID NO: 63193 - DNA, 103 bp, Artificial Sequence
  Synthetic Polynucleotide
taatacgactcactatagggctatagtttctatcttggcaataactaattaacagaggagaaattagatgttgccaagaaacctggcggcagcgcaaaagatg

SEQ ID NO: 63194 - DNA, 103 bp, Artificial Sequence
  Synthetic Polynucleotide
taatacgactcactatagggattatctatagtttctatcttggcaataacaacagaggagagttattatgaagatagaaaacctggcggcagcgcaaaagatg

SEQ ID NO: 63195 - DNA, 103 bp, Artificial Sequence
  Synthetic Polynucleotide
taatacgactcactatagggatatcattatctatagtttctatcttggcaaacagaggagatgccaaatgagaaactataacctggcggcagcgcaaaagatg

SEQ ID NO: 63196 - DNA, 103 bp, Artificial Sequence
  Synthetic Polynucleotide
taatacgactcactatagggttaatatatcattatctatagtttctatctaacagaggagaagatagatgctatagataaacctggcggcagcgcaaaagatg

SEQ ID NO: 63197 - DNA, 103 bp, Artificial Sequence
  Synthetic Polynucleotide
taatacgactcactataggggttgtttaatatatcattatctatagtttcaacagaggagagaaactatggataatgataacctggcggcagcgcaaaagatg

SEQ ID NO: 63198 - DNA, 103 bp, Artificial Sequence
  Synthetic Polynucleotide
taatacgactcactatagggatgtcgttgtttaatatatcattatctataaacagaggagatatagaatgtgatatattaacctggcggcagcgcaaaagatg

SEQ ID NO: 63199 - DNA, 103 bp, Artificial Sequence
  Synthetic Polynucleotide
taatacgactcactatagggttacaatgtcgttgtttaatatatcattataacagaggagaataatgatgtattaaacaaacctggcggcagcgcaaaagatg

SEQ ID NO: 63200 - DNA, 103 bp, Artificial Sequence
  Synthetic Polynucleotide
taatacgactcactataggggaaatttacaatgtcgttgtttaatatatcaacagaggagagatataatgaacaacgacaacctggcggcagcgcaaaagatg

SEQ ID NO: 63201 - DNA, 103 bp, Artificial Sequence
  Synthetic Polynucleotide
taatacgactcactatagggataatgaaatttacaatgtcgttgtttaataacagaggagaattaaaatgcgacattgtaacctggcggcagcgcaaaagatg

SEQ ID NO: 63202 - DNA, 103 bp, Artificial Sequence
  Synthetic Polynucleotide
taatacgactcactatagggtacacataatgaaatttacaatgtcgttgtaacagaggagaacaacgatgttgtaaattaacctggcggcagcgcaaaagatg

SEQ ID NO: 63203 - DNA, 103 bp, Artificial Sequence
  Synthetic Polynucleotide
taatacgactcactatagggaaataataaaataaagaaaaataaaataaaaacagaggagatttattatgtttttctttaacctggcggcagcgcaaaagatg

SEQ ID NO: 63204 - DNA, 103 bp, Artificial Sequence
  Synthetic Polynucleotide
taatacgactcactatagggtgatctacacataatgaaatttacaatgtcaacagaggagagacattatgaatttcattaacctggcggcagcgcaaaagatg

SEQ ID NO: 63205 - DNA, 103 bp, Artificial Sequence
  Synthetic Polynucleotide
taatacgactcactatagggaagtttgatctacacataatgaaatttacaaacagaggagatgtaaaatgcattatgtgaacctggcggcagcgcaaaagatg

SEQ ID NO: 63206 - DNA, 103 bp, Artificial Sequence
  Synthetic Polynucleotide
taatacgactcactatagggtatttaagtttgatctacacataatgaaataacagaggagaatttcaatgtgtgtagataacctggcggcagcgcaaaagatg

SEQ ID NO: 63207 - DNA, 103 bp, Artificial Sequence
  Synthetic Polynucleotide
taatacgactcactatagggtggattatttaagtttgatctacacataataacagaggagaattatgatgagatcaaacaacctggcggcagcgcaaaagatg

SEQ ID NO: 63208 - DNA, 103 bp, Artificial Sequence
  Synthetic Polynucleotide
taatacgactcactatagggataaatggattatttaagtttgatctacacaacagaggagagtgtagatgaaacttaaaaacctggcggcagcgcaaaagatg

SEQ ID NO: 63209 - DNA, 103 bp, Artificial Sequence
  Synthetic Polynucleotide
taatacgactcactatagggaagagataaatggattatttaagtttgatcaacagaggagagatcaaatgtaaataatcaacctggcggcagcgcaaaagatg

SEQ ID NO: 63210 - DNA, 103 bp, Artificial Sequence
  Synthetic Polynucleotide
taatacgactcactatagggtaggaaagagataaatggattatttaagttaacagaggagaaacttaatgaatccatttaacctggcggcagcgcaaaagatg

SEQ ID NO: 63211 - DNA, 103 bp, Artificial Sequence
  Synthetic Polynucleotide
taatacgactcactataggggtatctaggaaagagataaatggattatttaacagaggagaaaataaatgatttatctcaacctggcggcagcgcaaaagatg

SEQ ID NO: 63212 - DNA, 103 bp, Artificial Sequence
  Synthetic Polynucleotide
taatacgactcactatagggatacagtatctaggaaagagataaatggataacagaggagaatccatatgtctctttccaacctggcggcagcgcaaaagatg

SEQ ID NO: 63213 - DNA, 103 bp, Artificial Sequence
  Synthetic Polynucleotide
taatacgactcactatagggagtatatacagtatctaggaaagagataaaaacagaggagatttatcatgttcctagataacctggcggcagcgcaaaagatg

SEQ ID NO: 63214 - DNA, 103 bp, Artificial Sequence
  Synthetic Polynucleotide
taatacgactcactataggggtgaaaaataataaaataaagaaaaataaaaacagaggagatttattatgctttattttaacctggcggcagcgcaaaagatg

SEQ ID NO: 63215 - DNA, 103 bp, Artificial Sequence
  Synthetic Polynucleotide
taatacgactcactatagggataatagtatatacagtatctaggaaagagaacagaggagactctttatgagatactgtaacctggcggcagcgcaaaagatg

SEQ ID NO: 63216 - DNA, 103 bp, Artificial Sequence
  Synthetic Polynucleotide
taatacgactcactataggggatctataatagtatatacagtatctaggaaacagaggagatcctagatgctgtatataaacctggcggcagcgcaaaagatg

SEQ ID NO: 63217 - DNA, 103 bp, Artificial Sequence
  Synthetic Polynucleotide
taatacgactcactatagggctcttgatctataatagtatatacagtatcaacagaggagagatactatgtatactattaacctggcggcagcgcaaaagatg

SEQ ID NO: 63218 - DNA, 103 bp, Artificial Sequence
  Synthetic Polynucleotide
taatacgactcactatagggtagatctcttgatctataatagtatatacaaacagaggagatgtataatgtattatagaaacctggcggcagcgcaaaagatg

SEQ ID NO: 63219 - DNA, 103 bp, Artificial Sequence
  Synthetic Polynucleotide
taatacgactcactatagggtctgatagatctcttgatctataatagtataacagaggagaatactaatgtagatcaagaacctggcggcagcgcaaaagatg

SEQ ID NO: 63220 - DNA, 103 bp, Artificial Sequence
  Synthetic Polynucleotide
taatacgactcactatagggctcgttctgatagatctcttgatctataataacagaggagaattataatgcaagagatcaacctggcggcagcgcaaaagatg

SEQ ID NO: 63221 - DNA, 103 bp, Artificial Sequence
  Synthetic Polynucleotide
taatacgactcactatagggatcaactcgttctgatagatctcttgatctaacagaggagaagatcaatggatctatcaaacctggcggcagcgcaaaagatg

SEQ ID NO: 63222 - DNA, 103 bp, Artificial Sequence
  Synthetic Polynucleotide
taatacgactcactatagggaattaatcaactcgttctgatagatctcttaacagaggagaaagagaatgatcagaacgaacctggcggcagcgcaaaagatg

SEQ ID NO: 63223 - DNA, 103 bp, Artificial Sequence
  Synthetic Polynucleotide
taatacgactcactatagggtaatgaattaatcaactcgttctgatagataacagaggagaatctatatgaacgagttgaacctggcggcagcgcaaaagatg

SEQ ID NO: 63224 - DNA, 103 bp, Artificial Sequence
  Synthetic Polynucleotide
taatacgactcactatagggtcgtctaatgaattaatcaactcgttctgaaacagaggagatcagaaatggttgattaaaacctggcggcagcgcaaaagatg

SEQ ID NO: 63225 - DNA, 103 bp, Artificial Sequence
  Synthetic Polynucleotide
taatacgactcactatagggatatggtgaaaaataataaaataaagaaaaaacagaggagattttctatgttttattataacctggcggcagcgcaaaagatg

SEQ ID NO: 63226 - DNA, 103 bp, Artificial Sequence
  Synthetic Polynucleotide
taatacgactcactatagggtattgtcgtctaatgaattaatcaactcgtaacagaggagaacgagtatgttaattcataacctggcggcagcgcaaaagatg

SEQ ID NO: 63227 - DNA, 103 bp, Artificial Sequence
  Synthetic Polynucleotide
taatacgactcactatagggaattttattgtcgtctaatgaattaatcaaaacagaggagattgattatgtcattagacaacctggcggcagcgcaaaagatg

SEQ ID NO: 63228 - DNA, 103 bp, Artificial Sequence
  Synthetic Polynucleotide
taatacgactcactatagggtcgataattttattgtcgtctaatgaattaaacagaggagataattcatgagacgacaaaacctggcggcagcgcaaaagatg

SEQ ID NO: 63229 - DNA, 103 bp, Artificial Sequence
  Synthetic Polynucleotide
taatacgactcactatagggtacaatcgataattttattgtcgtctaatgaacagaggagacattagatgacaataaaaaacctggcggcagcgcaaaagatg

SEQ ID NO: 63230 - DNA, 103 bp, Artificial Sequence
  Synthetic Polynucleotide
taatacgactcactatagggaactatacaatcgataattttattgtcgtcaacagaggagagacgacatgaaaattatcaacctggcggcagcgcaaaagatg

SEQ ID NO: 63231 - DNA, 103 bp, Artificial Sequence
  Synthetic Polynucleotide
taatacgactcactatagggttattaactatacaatcgataattttattgaacagaggagacaataaatgtatcgattgaacctggcggcagcgcaaaagatg

SEQ ID NO: 63232 - DNA, 103 bp, Artificial Sequence
  Synthetic Polynucleotide
taatacgactcactatagggtaaacttattaactatacaatcgataatttaacagaggagaaaattaatgattgtatagaacctggcggcagcgcaaaagatg

SEQ ID NO: 63233 - DNA, 103 bp, Artificial Sequence
  Synthetic Polynucleotide
taatacgactcactataggggctcataaacttattaactatacaatcgataacagaggagaatcgatatgatagttaataacctggcggcagcgcaaaagatg

SEQ ID NO: 63234 - DNA, 103 bp, Artificial Sequence
  Synthetic Polynucleotide
taatacgactcactatagggtaaaagctcataaacttattaactatacaaaacagaggagattgtatatgtaataagttaacctggcggcagcgcaaaagatg

SEQ ID NO: 63235 - DNA, 103 bp, Artificial Sequence
  Synthetic Polynucleotide
taatacgactcactatagggccttataaaagctcataaacttattaactaaacagaggagatagttaatgagtttatgaaacctggcggcagcgcaaaagatg

SEQ ID NO: 63236 - DNA, 103 bp, Artificial Sequence
  Synthetic Polynucleotide
taatacgactcactatagggaaaagttgcaccacaaaatggtttattctaaacagaggagatagaatatgccattttgtaacctggcggcagcgcaaaagatg

SEQ ID NO: 63237 - DNA, 103 bp, Artificial Sequence
  Synthetic Polynucleotide
taatacgactcactataggggatctatatggtgaaaaataataaaataaaaacagaggagatttattatgttatttttcaacctggcggcagcgcaaaagatg

SEQ ID NO: 63238 - DNA, 103 bp, Artificial Sequence
  Synthetic Polynucleotide
taatacgactcactataggggttatccttataaaagctcataaacttattaacagaggagaaataagatgatgagctttaacctggcggcagcgcaaaagatg

SEQ ID NO: 63239 - DNA, 103 bp, Artificial Sequence
  Synthetic Polynucleotide
taatacgactcactatagggtctaggttatccttataaaagctcataaacaacagaggagagtttatatgcttttataaaacctggcggcagcgcaaaagatg

SEQ ID NO: 63240 - DNA, 103 bp, Artificial Sequence
  Synthetic Polynucleotide
taatacgactcactatagggtattttctaggttatccttataaaagctcaaacagaggagatgagctatgataaggataaacctggcggcagcgcaaaagatg

SEQ ID NO: 63241 - DNA, 103 bp, Artificial Sequence
  Synthetic Polynucleotide
taatacgactcactatagggtactatattttctaggttatccttataaaaaacagaggagattttatatggataacctaaacctggcggcagcgcaaaagatg

SEQ ID NO: 63242 - DNA, 103 bp, Artificial Sequence
  Synthetic Polynucleotide
taatacgactcactataggggcatctactatattttctaggttatccttaaacagaggagataaggaatgcctagaaaaaacctggcggcagcgcaaaagatg

SEQ ID NO: 63243 - DNA, 103 bp, Artificial Sequence
  Synthetic Polynucleotide
taatacgactcactatagggtgatagcatctactatattttctaggttataacagaggagaataaccatgaaaatatagaacctggcggcagcgcaaaagatg

SEQ ID NO: 63244 - DNA, 103 bp, Artificial Sequence
  Synthetic Polynucleotide
taatacgactcactatagggagtaatgatagcatctactatattttctagaacagaggagactagaaatgatagtagataacctggcggcagcgcaaaagatg

SEQ ID NO: 63245 - DNA, 103 bp, Artificial Sequence
  Synthetic Polynucleotide
taatacgactcactatagggtttagagtaatgatagcatctactatatttaacagaggagaaaatatatgagatgctataacctggcggcagcgcaaaagatg

SEQ ID NO: 63246 - DNA, 103 bp, Artificial Sequence
  Synthetic Polynucleotide
taatacgactcactatagggtatattttagagtaatgatagcatctactaaacagaggagatagtagatgctatcattaaacctggcggcagcgcaaaagatg

SEQ ID NO: 63247 - DNA, 103 bp, Artificial Sequence
  Synthetic Polynucleotide
taatacgactcactatagggcattatatattttagagtaatgatagcatcaacagaggagagatgctatgattactctaaacctggcggcagcgcaaaagatg

SEQ ID NO: 63248 - DNA, 103 bp, Artificial Sequence
  Synthetic Polynucleotide
taatacgactcactatagggtgattgatctatatggtgaaaaataataaaaacagaggagatttattatgtttcaccataacctggcggcagcgcaaaagatg

SEQ ID NO: 63249 - DNA, 103 bp, Artificial Sequence
  Synthetic Polynucleotide
taatacgactcactatagggttattcattatatattttagagtaatgataaacagaggagatatcatatgtctaaaataaacctggcggcagcgcaaaagatg

SEQ ID NO: 63250 - DNA, 103 bp, Artificial Sequence
  Synthetic Polynucleotide
taatacgactcactatagggctggattattcattatatattttagagtaaaacagaggagattactcatgaatatataaaacctggcggcagcgcaaaagatg

SEQ ID NO: 63251 - DNA, 103 bp, Artificial Sequence
  Synthetic Polynucleotide
taatacgactcactatagggaaaatctggattattcattatatattttagaacagaggagactaaaaatgataatgaataacctggcggcagcgcaaaagatg

SEQ ID NO: 63252 - DNA, 103 bp, Artificial Sequence
  Synthetic Polynucleotide
taatacgactcactataggggttttaaaatctggattattcattatatataacagaggagaatatatatggaataatccaacctggcggcagcgcaaaagatg

SEQ ID NO: 63253 - DNA, 103 bp, Artificial Sequence
  Synthetic Polynucleotide
taatacgactcactatagggacgtagttttaaaatctggattattcattaaacagaggagataatgaatgatccagattaacctggcggcagcgcaaaagatg

SEQ ID NO: 63254 - DNA, 103 bp, Artificial Sequence
  Synthetic Polynucleotide
taatacgactcactatagggtgcatacgtagttttaaaatctggattattaacagaggagaaataatatggattttaaaaacctggcggcagcgcaaaagatg

SEQ ID NO: 63255 - DNA, 103 bp, Artificial Sequence
  Synthetic Polynucleotide
taatacgactcactatagggacttctgcatacgtagttttaaaatctggaaacagaggagatccagaatgtaaaactacaacctggcggcagcgcaaaagatg

SEQ ID NO: 63256 - DNA, 103 bp, Artificial Sequence
  Synthetic Polynucleotide
taatacgactcactatagggcgagtacttctgcatacgtagttttaaaataacagaggagaattttaatgctacgtatgaacctggcggcagcgcaaaagatg

SEQ ID NO: 63257 - DNA, 103 bp, Artificial Sequence
  Synthetic Polynucleotide
taatacgactcactatagggggaaccgagtacttctgcatacgtagttttaacagaggagaaaaactatgtatgcagaaaacctggcggcagcgcaaaagatg

SEQ ID NO: 63258 - DNA, 103 bp, Artificial Sequence
  Synthetic Polynucleotide
taatacgactcactatagggattctggaaccgagtacttctgcatacgtaaacagaggagatacgtaatgagaagtactaacctggcggcagcgcaaaagatg

SEQ ID NO: 63259 - DNA, 103 bp, Artificial Sequence
  Synthetic Polynucleotide
taatacgactcactatagggtctaatgattgatctatatggtgaaaaataaacagaggagatattttatgccatatagaaacctggcggcagcgcaaaagatg

SEQ ID NO: 63260 - DNA, 103 bp, Artificial Sequence
  Synthetic Polynucleotide
taatacgactcactatagggccgctattctggaaccgagtacttctgcataacagaggagaatgcagatgtactcggttaacctggcggcagcgcaaaagatg

SEQ ID NO: 63261 - DNA, 103 bp, Artificial Sequence
  Synthetic Polynucleotide
taatacgactcactatagggtatatccgctattctggaaccgagtacttcaacagaggagagaagtaatgggttccagaaacctggcggcagcgcaaaagatg

SEQ ID NO: 63262 - DNA, 103 bp, Artificial Sequence
  Synthetic Polynucleotide
taatacgactcactatagggatatctatatccgctattctggaaccgagtaacagaggagaactcggatgcagaatagcaacctggcggcagcgcaaaagatg

SEQ ID NO: 63263 - DNA, 103 bp, Artificial Sequence
  Synthetic Polynucleotide
taatacgactcactataggggtttaatatctatatccgctattctggaacaacagaggagagttccaatgtagcggataaacctggcggcagcgcaaaagatg

SEQ ID NO: 63264 - DNA, 103 bp, Artificial Sequence
  Synthetic Polynucleotide
taatacgactcactatagggtacttgtttaatatctatatccgctattctaacagaggagaagaataatggatatagataacctggcggcagcgcaaaagatg

SEQ ID NO: 63265 - DNA, 103 bp, Artificial Sequence
  Synthetic Polynucleotide
taatacgactcactatagggcgtattacttgtttaatatctatatccgctaacagaggagaagcggaatgagatattaaaacctggcggcagcgcaaaagatg

SEQ ID NO: 63266 - DNA, 103 bp, Artificial Sequence
  Synthetic Polynucleotide
taatacgactcactatagggtctcacgtattacttgtttaatatctatataacagaggagaatatagatgttaaacaagaacctggcggcagcgcaaaagatg

SEQ ID NO: 63267 - DNA, 103 bp, Artificial Sequence
  Synthetic Polynucleotide
taatacgactcactatagggtatattctcacgtattacttgtttaatatcaacagaggagagatattatgcaagtaataaacctggcggcagcgcaaaagatg

SEQ ID NO: 63268 - DNA, 103 bp, Artificial Sequence
  Synthetic Polynucleotide
taatacgactcactatagggtgtagtatattctcacgtattacttgtttaaacagaggagataaacaatgaatacgtgaaacctggcggcagcgcaaaagatg

SEQ ID NO: 63269 - DNA, 103 bp, Artificial Sequence
  Synthetic Polynucleotide
taatacgactcactatagggacaattgtagtatattctcacgtattacttaacagaggagaaagtaaatggtgagaataaacctggcggcagcgcaaaagatg

SEQ ID NO: 63270 - DNA, 103 bp, Artificial Sequence
  Synthetic Polynucleotide
taatacgactcactataggggatgatctaatgattgatctatatggtgaaaacagaggagattcaccatgtagatcaataacctggcggcagcgcaaaagatg

SEQ ID NO: 63271 - DNA, 103 bp, Artificial Sequence
  Synthetic Polynucleotide
taatacgactcactatagggattagacaattgtagtatattctcacgtataacagaggagaatacgtatgaatatactaaacctggcggcagcgcaaaagatg

SEQ ID NO: 63272 - DNA, 103 bp, Artificial Sequence
  Synthetic Polynucleotide
taatacgactcactatagggatatcattagacaattgtagtatattctcaaacagaggagatgagaaatgactacaattaacctggcggcagcgcaaaagatg

SEQ ID NO: 63273 - DNA, 103 bp, Artificial Sequence
  Synthetic Polynucleotide
taatacgactcactatagggcgcggatatcattagacaattgtagtatataacagaggagaatatacatgaattgtctaaacctggcggcagcgcaaaagatg

SEQ ID NO: 63274 - DNA, 103 bp, Artificial Sequence
  Synthetic Polynucleotide
taatacgactcactatagggtcgttcgcggatatcattagacaattgtagaacagaggagactacaaatgtctaatgataacctggcggcagcgcaaaagatg

SEQ ID NO: 63275 - DNA, 103 bp, Artificial Sequence
  Synthetic Polynucleotide
taatacgactcactatagggaaatatcgttcgcggatatcattagacaataacagaggagaattgtcatgtgatatccgaacctggcggcagcgcaaaagatg

SEQ ID NO: 63276 - DNA, 103 bp, Artificial Sequence
  Synthetic Polynucleotide
taatacgactcactatagggttcacaaatatcgttcgcggatatcattagaacagaggagactaatgatgtccgcgaacaacctggcggcagcgcaaaagatg

SEQ ID NO: 63277 - DNA, 103 bp, Artificial Sequence
  Synthetic Polynucleotide
taatacgactcactatagggatattttcacaaatatcgttcgcggatatcaacagaggagagatatcatggaacgatataacctggcggcagcgcaaaagatg

SEQ ID NO: 63278 - DNA, 103 bp, Artificial Sequence
  Synthetic Polynucleotide
taatacgactcactatagggttttaatattttcacaaatatcgttcgcggaacagaggagaccgcgaatgatatttgtgaacctggcggcagcgcaaaagatg

SEQ ID NO: 63279 - DNA, 103 bp, Artificial Sequence
  Synthetic Polynucleotide
taatacgactcactatagggtttttttttaatattttcacaaatatcgttaacagaggagaaacgatatgtgtgaaaataacctggcggcagcgcaaaagatg

SEQ ID NO: 63280 - DNA, 103 bp, Artificial Sequence
  Synthetic Polynucleotide
taatacgactcactatagggaagtatttttttttaatattttcacaaataaacagaggagatatttgatgaaatattaaaacctggcggcagcgcaaaagatg

SEQ ID NO: 63281 - DNA, 103 bp, Artificial Sequence
  Synthetic Polynucleotide
taatacgactcactatagggattttgatgatctaatgattgatctatatgaacagaggagacatataatgcaatcattaaacctggcggcagcgcaaaagatg

SEQ ID NO: 63282 - DNA, 103 bp, Artificial Sequence
  Synthetic Polynucleotide
taatacgactcactatagggaaaaaaagtatttttttttaatattttcacaacagaggagagtgaaaatgttaaaaaaaaacctggcggcagcgcaaaagatg

SEQ ID NO: 63283 - DNA, 103 bp, Artificial Sequence
  Synthetic Polynucleotide
taatacgactcactatagggttaataaaaaaagtatttttttttaatattaacagaggagaaatattatgaaaaaatacaacctggcggcagcgcaaaagatg

SEQ ID NO: 63284 - DNA, 103 bp, Artificial Sequence
  Synthetic Polynucleotide
taatacgactcactataggggtcatttaataaaaaaagtatttttttttaaacagaggagataaaaaatgatactttttaacctggcggcagcgcaaaagatg

SEQ ID NO: 63285 - DNA, 103 bp, Artificial Sequence
  Synthetic Polynucleotide
taatacgactcactataggggagacgtcatttaataaaaaaagtatttttaacagaggagaaaaaatatgttttttattaacctggcggcagcgcaaaagatg

SEQ ID NO: 63286 - DNA, 103 bp, Artificial Sequence
  Synthetic Polynucleotide
taatacgactcactatagggacgaagagacgtcatttaataaaaaaagtaaacagaggagatactttatgtattaaatgaacctggcggcagcgcaaaagatg

SEQ ID NO: 63287 - DNA, 103 bp, Artificial Sequence
  Synthetic Polynucleotide
taatacgactcactatagggaattcacgaagagacgtcatttaataaaaaaacagaggagatttttaatgaatgacgtcaacctggcggcagcgcaaaagatg

SEQ ID NO: 63288 - DNA, 103 bp, Artificial Sequence
  Synthetic Polynucleotide
taatacgactcactatagggttctaaattcacgaagagacgtcatttaataacagaggagaattaaaatgcgtctcttcaacctggcggcagcgcaaaagatg

SEQ ID NO: 63289 - DNA, 103 bp, Artificial Sequence
  Synthetic Polynucleotide
taatacgactcactatagggtaattttctaaattcacgaagagacgtcataacagaggagaatgacgatgcttcgtgaaaacctggcggcagcgcaaaagatg

SEQ ID NO: 63290 - DNA, 103 bp, Artificial Sequence
  Synthetic Polynucleotide
taatacgactcactatagggcagcataattttctaaattcacgaagagacaacagaggagagtctctatgtgaatttagaacctggcggcagcgcaaaagatg

SEQ ID NO: 63291 - DNA, 103 bp, Artificial Sequence
  Synthetic Polynucleotide
taatacgactcactatagggtagcacagcataattttctaaattcacgaaaacagaggagattcgtgatgttagaaaataacctggcggcagcgcaaaagatg

SEQ ID NO: 63292 - DNA, 103 bp, Artificial Sequence
  Synthetic Polynucleotide
taatacgactcactatagggaacatattttgatgatctaatgattgatctaacagaggagaagatcaatgattagatcaaacctggcggcagcgcaaaagatg

SEQ ID NO: 63293 - DNA, 103 bp, Artificial Sequence
  Synthetic Polynucleotide
taatacgactcactatagggatatatagcacagcataattttctaaattcaacagaggagagaatttatgaaattatgcaacctggcggcagcgcaaaagatg

SEQ ID NO: 63294 - DNA, 103 bp, Artificial Sequence
  Synthetic Polynucleotide
taatacgactcactataggggcgtgatatatagcacagcataattttctaaacagaggagatagaaaatgatgctgtgcaacctggcggcagcgcaaaagatg

SEQ ID NO: 63295 - DNA, 103 bp, Artificial Sequence
  Synthetic Polynucleotide
taatacgactcactatagggctgatgcgtgatatatagcacagcataattaacagaggagaaattatatggtgctatataacctggcggcagcgcaaaagatg

SEQ ID NO: 63296 - DNA, 103 bp, Artificial Sequence
  Synthetic Polynucleotide
taatacgactcactatagggatatcctgatgcgtgatatatagcacagcaaacagaggagatgctgtatgatatatcacaacctggcggcagcgcaaaagatg

SEQ ID NO: 63297 - DNA, 103 bp, Artificial Sequence
  Synthetic Polynucleotide
taatacgactcactatagggtctttatatcctgatgcgtgatatatagcaaacagaggagatgctatatgtcacgcatcaacctggcggcagcgcaaaagatg

SEQ ID NO: 63298 - DNA, 103 bp, Artificial Sequence
  Synthetic Polynucleotide
taatacgactcactatagggatttttctttatatcctgatgcgtgatataaacagaggagatatatcatgcatcaggataacctggcggcagcgcaaaagatg

SEQ ID NO: 63299 - DNA, 103 bp, Artificial Sequence
  Synthetic Polynucleotide
taatacgactcactatagggtttagatttttctttatatcctgatgcgtgaacagaggagacacgcaatgggatataaaaacctggcggcagcgcaaaagatg

SEQ ID NO: 63300 - DNA, 103 bp, Artificial Sequence
  Synthetic Polynucleotide
taatacgactcactatagggattaatttagatttttctttatatcctgataacagaggagaatcaggatgtaaagaaaaaacctggcggcagcgcaaaagatg

SEQ ID NO: 63301 - DNA, 103 bp, Artificial Sequence
  Synthetic Polynucleotide
taatacgactcactatagggctctaattaatttagatttttctttatatcaacagaggagagatataatgaaaaatctaaacctggcggcagcgcaaaagatg

SEQ ID NO: 63302 - DNA, 103 bp, Artificial Sequence
  Synthetic Polynucleotide
taatacgactcactatagggaaagtctctaattaatttagatttttctttaacagaggagaaaagaaatgtctaaattaaacctggcggcagcgcaaaagatg

SEQ ID NO: 63303 - DNA, 103 bp, Artificial Sequence
  Synthetic Polynucleotide
taatacgactcactatagggattgaaacatattttgatgatctaatgattaacagaggagaaatcatatgatcatcaaaaacctggcggcagcgcaaaagatg

SEQ ID NO: 63304 - DNA, 103 bp, Artificial Sequence
  Synthetic Polynucleotide
taatacgactcactataggggttataaagtctctaattaatttagattttaacagaggagaaaaatcatgattaattagaacctggcggcagcgcaaaagatg

SEQ ID NO: 63305 - DNA, 103 bp, Artificial Sequence
  Synthetic Polynucleotide
taatacgactcactatagggtatctgttataaagtctctaattaatttagaacagaggagactaaatatgttagagactaacctggcggcagcgcaaaagatg

SEQ ID NO: 63306 - DNA, 103 bp, Artificial Sequence
  Synthetic Polynucleotide
taatacgactcactatagggatccctatctgttataaagtctctaattaaaacagaggagattaattatggactttataaacctggcggcagcgcaaaagatg

SEQ ID NO: 63307 - DNA, 103 bp, Artificial Sequence
  Synthetic Polynucleotide
taatacgactcactatagggttatcatccctatctgttataaagtctctaaacagaggagatagagaatgtataacagaaacctggcggcagcgcaaaagatg

SEQ ID NO: 63308 - DNA, 103 bp, Artificial Sequence
  Synthetic Polynucleotide
taatacgactcactatagggaatatttatcatccctatctgttataaagtaacagaggagaactttaatgcagatagggaacctggcggcagcgcaaaagatg

SEQ ID NO: 63309 - DNA, 103 bp, Artificial Sequence
  Synthetic Polynucleotide
taatacgactcactataggggattaaatatttatcatccctatctgttataacagaggagaataacaatgagggatgataacctggcggcagcgcaaaagatg

SEQ ID NO: 63310 - DNA, 103 bp, Artificial Sequence
  Synthetic Polynucleotide
taatacgactcactatagggttaatgattaaatatttatcatccctatctaacagaggagaagatagatgtgataaataaacctggcggcagcgcaaaagatg

SEQ ID NO: 63311 - DNA, 103 bp, Artificial Sequence
  Synthetic Polynucleotide
taatacgactcactatagggatagcttaatgattaaatatttatcatcccaacagaggagagggatgatgaatatttaaaacctggcggcagcgcaaaagatg

SEQ ID NO: 63312 - DNA, 103 bp, Artificial Sequence
  Synthetic Polynucleotide
taatacgactcactatagggaagcaatagcttaatgattaaatatttatcaacagaggagagataaaatgttaatcattaacctggcggcagcgcaaaagatg

SEQ ID NO: 63313 - DNA, 103 bp, Artificial Sequence
  Synthetic Polynucleotide
taatacgactcactatagggccgggaagcaatagcttaatgattaaatataacagaggagaatatttatgcattaagctaacctggcggcagcgcaaaagatg

SEQ ID NO: 63314 - DNA, 103 bp, Artificial Sequence
  Synthetic Polynucleotide
taatacgactcactatagggggatgattgaaacatattttgatgatctaaaacagaggagattagatatgcaaaatatgaacctggcggcagcgcaaaagatg

SEQ ID NO: 63315 - DNA, 103 bp, Artificial Sequence
  Synthetic Polynucleotide
taatacgactcactatagggctaatccgggaagcaatagcttaatgattaaacagaggagataatcaatgagctattgcaacctggcggcagcgcaaaagatg

SEQ ID NO: 63316 - DNA, 103 bp, Artificial Sequence
  Synthetic Polynucleotide
taatacgactcactatagggatcgtctaatccgggaagcaatagcttaataacagaggagaattaagatgttgcttcccaacctggcggcagcgcaaaagatg

SEQ ID NO: 63317 - DNA, 103 bp, Artificial Sequence
  Synthetic Polynucleotide
taatacgactcactatagggattctatcgtctaatccgggaagcaatagcaacagaggagagctattatgtcccggattaacctggcggcagcgcaaaagatg

SEQ ID NO: 63318 - DNA, 103 bp, Artificial Sequence
  Synthetic Polynucleotide
taatacgactcactatagggtataaattctatcgtctaatccgggaagcaaacagaggagatgcttcatggattagacgaacctggcggcagcgcaaaagatg

SEQ ID NO: 63319 - DNA, 103 bp, Artificial Sequence
  Synthetic Polynucleotide
taatacgactcactatagggcatgttataaattctatcgtctaatccgggaacagaggagacccggaatggacgatagaaacctggcggcagcgcaaaagatg

SEQ ID NO: 63320 - DNA, 103 bp, Artificial Sequence
  Synthetic Polynucleotide
taatacgactcactatagggtcgttcatgttataaattctatcgtctaataacagaggagaattagaatgtagaatttaaacctggcggcagcgcaaaagatg

SEQ ID NO: 63321 - DNA, 103 bp, Artificial Sequence
  Synthetic Polynucleotide
taatacgactcactataggggtttatcgttcatgttataaattctatcgtaacagaggagaacgataatgtttataacaaacctggcggcagcgcaaaagatg

SEQ ID NO: 63322 - DNA, 103 bp, Artificial Sequence
  Synthetic Polynucleotide
taatacgactcactatagggaatttgtttatcgttcatgttataaattctaacagaggagaagaattatgaacatgaacaacctggcggcagcgcaaaagatg

SEQ ID NO: 63323 - DNA, 103 bp, Artificial Sequence
  Synthetic Polynucleotide
taatacgactcactatagggtttataatttgtttatcgttcatgttataaaacagaggagattataaatggaacgataaaacctggcggcagcgcaaaagatg

SEQ ID NO: 63324 - DNA, 103 bp, Artificial Sequence
  Synthetic Polynucleotide
taatacgactcactatagggatatttttataatttgtttatcgttcatgtaacagaggagaacatgaatgataaacaaaaacctggcggcagcgcaaaagatg

SEQ ID NO: 63325 - DNA, 103 bp, Artificial Sequence
  Synthetic Polynucleotide
taatacgactcactatagggctttaggatgattgaaacatattttgatgaaacagaggagatcatcaatgtatgtttcaaacctggcggcagcgcaaaagatg

SEQ ID NO: 63326 - DNA, 103 bp, Artificial Sequence
  Synthetic Polynucleotide
taatacgactcactatagggactatatatttttataatttgtttatcgttaacagaggagaaacgatatgcaaattataaacctggcggcagcgcaaaagatg

SEQ ID NO: 63327 - DNA, 103 bp, Artificial Sequence
  Synthetic Polynucleotide
taatacgactcactatagggattatactatatatttttataatttgtttaaacagaggagataaacaatgtataaaaataacctggcggcagcgcaaaagatg

SEQ ID NO: 63328 - DNA, 103 bp, Artificial Sequence
  Synthetic Polynucleotide
taatacgactcactatagggtaaatattatactatatatttttataatttaacagaggagaaaattaatgaaatatataaacctggcggcagcgcaaaagatg

SEQ ID NO: 63329 - DNA, 103 bp, Artificial Sequence
  Synthetic Polynucleotide
taatacgactcactatagggttgtttaaatattatactatatatttttataacagaggagaataaaaatgtatagtataaacctggcggcagcgcaaaagatg

SEQ ID NO: 63330 - DNA, 103 bp, Artificial Sequence
  Synthetic Polynucleotide
taatacgactcactatagggtgagattgtttaaatattatactatatattaacagaggagaaatataatgtataatattaacctggcggcagcgcaaaagatg

SEQ ID NO: 63331 - DNA, 103 bp, Artificial Sequence
  Synthetic Polynucleotide
taatacgactcactatagggctttctgagattgtttaaatattatactataacagaggagaatagtaatgtatttaaacaacctggcggcagcgcaaaagatg

SEQ ID NO: 63332 - DNA, 103 bp, Artificial Sequence
  Synthetic Polynucleotide
taatacgactcactatagggcatatctttctgagattgtttaaatattataacagaggagaataataatgaaacaatctaacctggcggcagcgcaaaagatg

SEQ ID NO: 63333 - DNA, 103 bp, Artificial Sequence
  Synthetic Polynucleotide
taatacgactcactatagggtgtagcatatctttctgagattgtttaaataacagaggagaatttaaatgatctcagaaaacctggcggcagcgcaaaagatg

SEQ ID NO: 63334 - DNA, 103 bp, Artificial Sequence
  Synthetic Polynucleotide
taatacgactcactatagggaatcttgtagcatatctttctgagattgttaacagaggagaaacaatatgagaaagataaacctggcggcagcgcaaaagatg

SEQ ID NO: 63335 - DNA, 103 bp, Artificial Sequence
  Synthetic Polynucleotide
taatacgactcactatagggtcctaaatcttgtagcatatctttctgagaaacagaggagatctcagatggatatgctaaacctggcggcagcgcaaaagatg

SEQ ID NO: 63336 - DNA, 103 bp, Artificial Sequence
  Synthetic Polynucleotide
taatacgactcactatagggatactctttaggatgattgaaacatattttaacagaggagaaaaataatgttcaatcataacctggcggcagcgcaaaagatg

SEQ ID NO: 63337 - DNA, 103 bp, Artificial Sequence
  Synthetic Polynucleotide
taatacgactcactatagggccgtatcctaaatcttgtagcatatctttcaacagaggagagaaagaatggctacaagaaacctggcggcagcgcaaaagatg

SEQ ID NO: 63338 - DNA, 103 bp, Artificial Sequence
  Synthetic Polynucleotide
taatacgactcactatagggtatatccgtatcctaaatcttgtagcatataacagaggagaatatgcatgaagatttagaacctggcggcagcgcaaaagatg

SEQ ID NO: 63339 - DNA, 103 bp, Artificial Sequence
  Synthetic Polynucleotide
taatacgactcactatagggtcctatatatccgtatcctaaatcttgtagaacagaggagactacaaatgttaggatacaacctggcggcagcgcaaaagatg

SEQ ID NO: 63340 - DNA, 103 bp, Artificial Sequence
  Synthetic Polynucleotide
taatacgactcactataggggtgtctcctatatatccgtatcctaaatctaacagaggagaagatttatgatacggataaacctggcggcagcgcaaaagatg

SEQ ID NO: 63341 - DNA, 103 bp, Artificial Sequence
  Synthetic Polynucleotide
taatacgactcactatagggtaatagtgtctcctatatatccgtatcctaaacagaggagataggatatggatatatagaacctggcggcagcgcaaaagatg

SEQ ID NO: 63342 - DNA, 103 bp, Artificial Sequence
  Synthetic Polynucleotide
taatacgactcactatagggtgtactaatagtgtctcctatatatccgtaaacagaggagatacggaatgataggagacaacctggcggcagcgcaaaagatg

SEQ ID NO: 63343 - DNA, 103 bp, Artificial Sequence
  Synthetic Polynucleotide
taatacgactcactatagggaagaatgtactaatagtgtctcctatatataacagaggagaatatatatgagacactataacctggcggcagcgcaaaagatg

SEQ ID NO: 63344 - DNA, 103 bp, Artificial Sequence
  Synthetic Polynucleotide
taatacgactcactatagggctttgaagaatgtactaatagtgtctcctaaacagaggagataggagatgctattagtaaacctggcggcagcgcaaaagatg

SEQ ID NO: 63345 - DNA, 103 bp, Artificial Sequence
  Synthetic Polynucleotide
taatacgactcactataggggttctctttgaagaatgtactaatagtgtcaacagaggagagacactatgagtacattcaacctggcggcagcgcaaaagatg

SEQ ID NO: 63346 - DNA, 103 bp, Artificial Sequence
  Synthetic Polynucleotide
taatacgactcactatagggtctgtgttctctttgaagaatgtactaataaacagaggagatattagatgattcttcaaaacctggcggcagcgcaaaagatg

SEQ ID NO: 63347 - DNA, 103 bp, Artificial Sequence
  Synthetic Polynucleotide
taatacgactcactatagggtcgtaaaaagttgcaccacaaaatggtttaaacagaggagataaaccatgttgtggtgcaacctggcggcagcgcaaaagatg

SEQ ID NO: 63348 - DNA, 103 bp, Artificial Sequence
  Synthetic Polynucleotide
taatacgactcactatagggttaccatactctttaggatgattgaaacataacagaggagaatgtttatgtcatcctaaaacctggcggcagcgcaaaagatg

SEQ ID NO: 63349 - DNA, 103 bp, Artificial Sequence
  Synthetic Polynucleotide
taatacgactcactatagggggatttctgtgttctctttgaagaatgtacaacagaggagagtacatatgtcaaagagaaacctggcggcagcgcaaaagatg

SEQ ID NO: 63350 - DNA, 103 bp, Artificial Sequence
  Synthetic Polynucleotide
taatacgactcactatagggtggacggatttctgtgttctctttgaagaaaacagaggagattcttcatggagaacacaaacctggcggcagcgcaaaagatg

SEQ ID NO: 63351 - DNA, 103 bp, Artificial Sequence
  Synthetic Polynucleotide
taatacgactcactatagggtttcttggacggatttctgtgttctctttgaacagaggagacaaagaatgcacagaaataacctggcggcagcgcaaaagatg

SEQ ID NO: 63352 - DNA, 103 bp, Artificial Sequence
  Synthetic Polynucleotide
taatacgactcactatagggttttatttcttggacggatttctgtgttctaacagaggagaagaacaatgaaatccgtcaacctggcggcagcgcaaaagatg

SEQ ID NO: 63353 - DNA, 103 bp, Artificial Sequence
  Synthetic Polynucleotide
taatacgactcactatagggaatgcttttatttcttggacggatttctgtaacagaggagaacagaaatgcgtccaagaaacctggcggcagcgcaaaagatg

SEQ ID NO: 63354 - DNA, 103 bp, Artificial Sequence
  Synthetic Polynucleotide
taatacgactcactataggggttaaaatgcttttatttcttggacggattaacagaggagaaatccgatgaagaaataaaacctggcggcagcgcaaaagatg

SEQ ID NO: 63355 - DNA, 103 bp, Artificial Sequence
  Synthetic Polynucleotide
taatacgactcactatagggctaaagttaaaatgcttttatttcttggacaacagaggagagtccaaatgataaaagcaaacctggcggcagcgcaaaagatg

SEQ ID NO: 63356 - DNA, 103 bp, Artificial Sequence
  Synthetic Polynucleotide
taatacgactcactataggggtcttctaaagttaaaatgcttttatttctaacagaggagaagaaatatgagcattttaaacctggcggcagcgcaaaagatg

SEQ ID NO: 63357 - DNA, 103 bp, Artificial Sequence
  Synthetic Polynucleotide
taatacgactcactatagggtccacgtcttctaaagttaaaatgcttttaaacagaggagataaaagatgtttaactttaacctggcggcagcgcaaaagatg

SEQ ID NO: 63358 - DNA, 103 bp, Artificial Sequence
  Synthetic Polynucleotide
taatacgactcactatagggaactatccacgtcttctaaagttaaaatgcaacagaggagagcatttatgctttagaagaacctggcggcagcgcaaaagatg

SEQ ID NO: 63359 - DNA, 103 bp, Artificial Sequence
  Synthetic Polynucleotide
taatacgactcactataggggtcatttaccatactctttaggatgattgaaacagaggagatcaatcatgctaaagagtaacctggcggcagcgcaaaagatg

SEQ ID NO: 63360 - DNA, 103 bp, Artificial Sequence
  Synthetic Polynucleotide
taatacgactcactatagggtaagaaactatccacgtcttctaaagttaaaacagaggagattaactatggaagacgtgaacctggcggcagcgcaaaagatg

SEQ ID NO: 63361 - DNA, 103 bp, Artificial Sequence
  Synthetic Polynucleotide
taatacgactcactataggggtagttaagaaactatccacgtcttctaaaaacagaggagatttagaatgcgtggatagaacctggcggcagcgcaaaagatg

SEQ ID NO: 63362 - DNA, 103 bp, Artificial Sequence
  Synthetic Polynucleotide
taatacgactcactatagggataatgtagttaagaaactatccacgtcttaacagaggagaaagacgatgatagtttctaacctggcggcagcgcaaaagatg

SEQ ID NO: 63363 - DNA, 103 bp, Artificial Sequence
  Synthetic Polynucleotide
taatacgactcactatagggggatgataatgtagttaagaaactatccacaacagaggagagtggatatgttcttaactaacctggcggcagcgcaaaagatg

SEQ ID NO: 63364 - DNA, 103 bp, Artificial Sequence
  Synthetic Polynucleotide
taatacgactcactataggggttatggatgataatgtagttaagaaactaaacagaggagatagtttatgaactacattaacctggcggcagcgcaaaagatg

SEQ ID NO: 63365 - DNA, 103 bp, Artificial Sequence
  Synthetic Polynucleotide
taatacgactcactatagggctttagttatggatgataatgtagttaagaaacagaggagatcttaaatgcattatcataacctggcggcagcgcaaaagatg

SEQ ID NO: 63366 - DNA, 103 bp, Artificial Sequence
  Synthetic Polynucleotide
taatacgactcactatagggcgattctttagttatggatgataatgtagtaacagaggagaactacaatgtcatccataaacctggcggcagcgcaaaagatg

SEQ ID NO: 63367 - DNA, 103 bp, Artificial Sequence
  Synthetic Polynucleotide
taatacgactcactatagggtgatgcgattctttagttatggatgataataacagaggagaattatcatgcataactaaaacctggcggcagcgcaaaagatg

SEQ ID NO: 63368 - DNA, 103 bp, Artificial Sequence
  Synthetic Polynucleotide
taatacgactcactatagggttatttgatgcgattctttagttatggatgaacagaggagacatccaatgctaaagaataacctggcggcagcgcaaaagatg

SEQ ID NO: 63369 - DNA, 103 bp, Artificial Sequence
  Synthetic Polynucleotide
taatacgactcactatagggtaattttatttgatgcgattctttagttataacagaggagaataactatggaatcgcataacctggcggcagcgcaaaagatg

SEQ ID NO: 63370 - DNA, 103 bp, Artificial Sequence
  Synthetic Polynucleotide
taatacgactcactataggggaagagtcatttaccatactctttaggatgaacagaggagacatcctatggagtatggtaacctggcggcagcgcaaaagatg

SEQ ID NO: 63371 - DNA, 103 bp, Artificial Sequence
  Synthetic Polynucleotide
taatacgactcactataggggtcaataattttatttgatgcgattctttaaacagaggagataaagaatggcatcaaataacctggcggcagcgcaaaagatg

SEQ ID NO: 63372 - DNA, 103 bp, Artificial Sequence
  Synthetic Polynucleotide
taatacgactcactatagggtgtcagtcaataattttatttgatgcgattaacagaggagaaatcgcatgaaataaaataacctggcggcagcgcaaaagatg

SEQ ID NO: 63373 - DNA, 103 bp, Artificial Sequence
  Synthetic Polynucleotide
taatacgactcactatagggtgcgatgtcagtcaataattttatttgatgaacagaggagacatcaaatgaaattattgaacctggcggcagcgcaaaagatg

SEQ ID NO: 63374 - DNA, 103 bp, Artificial Sequence
  Synthetic Polynucleotide
taatacgactcactatagggacggatgcgatgtcagtcaataattttattaacagaggagaaataaaatgattgactgaaacctggcggcagcgcaaaagatg

SEQ ID NO: 63375 - DNA, 103 bp, Artificial Sequence
  Synthetic Polynucleotide
taatacgactcactatagggtacaaacggatgcgatgtcagtcaataattaacagaggagaaattatatgctgacatcgaacctggcggcagcgcaaaagatg

SEQ ID NO: 63376 - DNA, 103 bp, Artificial Sequence
  Synthetic Polynucleotide
taatacgactcactatagggacatgtacaaacggatgcgatgtcagtcaaaacagaggagattgactatgatcgcatccaacctggcggcagcgcaaaagatg

SEQ ID NO: 63377 - DNA, 103 bp, Artificial Sequence
  Synthetic Polynucleotide
taatacgactcactatagggtcattacatgtacaaacggatgcgatgtcaaacagaggagatgacatatgatccgtttgaacctggcggcagcgcaaaagatg

SEQ ID NO: 63378 - DNA, 103 bp, Artificial Sequence
  Synthetic Polynucleotide
taatacgactcactatagggttaaatcattacatgtacaaacggatgcgaaacagaggagatcgcatatgtttgtacataacctggcggcagcgcaaaagatg

SEQ ID NO: 63379 - DNA, 103 bp, Artificial Sequence
  Synthetic Polynucleotide
taatacgactcactatagggacattttaaatcattacatgtacaaacggaaacagaggagatccgttatgacatgtaataacctggcggcagcgcaaaagatg

SEQ ID NO: 63380 - DNA, 103 bp, Artificial Sequence
  Synthetic Polynucleotide
taatacgactcactatagggactacacattttaaatcattacatgtacaaaacagaggagattgtacatgtaatgatttaacctggcggcagcgcaaaagatg

SEQ ID NO: 63381 - DNA, 103 bp, Artificial Sequence
  Synthetic Polynucleotide
taatacgactcactataggggatgggaagagtcatttaccatactctttaaacagaggagataaagaatgtggtaaatgaacctggcggcagcgcaaaagatg

SEQ ID NO: 63382 - DNA, 103 bp, Artificial Sequence
  Synthetic Polynucleotide
taatacgactcactataggggcatgactacacattttaaatcattacatgaacagaggagacatgtaatgatttaaaataacctggcggcagcgcaaaagatg

SEQ ID NO: 63383 - DNA, 103 bp, Artificial Sequence
  Synthetic Polynucleotide
taatacgactcactatagggaataagcatgactacacattttaaatcattaacagaggagaaatgatatgaaatgtgtaaacctggcggcagcgcaaaagatg

SEQ ID NO: 63384 - DNA, 103 bp, Artificial Sequence
  Synthetic Polynucleotide
taatacgactcactatagggttatcaataagcatgactacacattttaaaaacagaggagatttaaaatgtgtagtcataacctggcggcagcgcaaaagatg

SEQ ID NO: 63385 - DNA, 103 bp, Artificial Sequence
  Synthetic Polynucleotide
taatacgactcactataggggatctttatcaataagcatgactacacattaacagaggagaaatgtgatgtcatgcttaaacctggcggcagcgcaaaagatg

SEQ ID NO: 63386 - DNA, 103 bp, Artificial Sequence
  Synthetic Polynucleotide
taatacgactcactatagggttttagatctttatcaataagcatgactacaacagaggagagtagtcatgcttattgataacctggcggcagcgcaaaagatg

SEQ ID NO: 63387 - DNA, 103 bp, Artificial Sequence
  Synthetic Polynucleotide
taatacgactcactatagggttaatttttagatctttatcaataagcatgaacagaggagacatgctatgtgataaagaaacctggcggcagcgcaaaagatg

SEQ ID NO: 63388 - DNA, 103 bp, Artificial Sequence
  Synthetic Polynucleotide
taatacgactcactatagggccgctttaatttttagatctttatcaataaaacagaggagattattgatgaagatctaaaacctggcggcagcgcaaaagatg

SEQ ID NO: 63389 - DNA, 103 bp, Artificial Sequence
  Synthetic Polynucleotide
taatacgactcactatagggaggacccgctttaatttttagatctttatcaacagaggagagataaaatgctaaaaattaacctggcggcagcgcaaaagatg

SEQ ID NO: 63390 - DNA, 103 bp, Artificial Sequence
  Synthetic Polynucleotide
taatacgactcactatagggtaccgaggacccgctttaatttttagatctaacagaggagaagatctatgaattaaagcaacctggcggcagcgcaaaagatg

SEQ ID NO: 63391 - DNA, 103 bp, Artificial Sequence
  Synthetic Polynucleotide
taatacgactcactataggggtacgtaccgaggacccgctttaatttttaaacagaggagataaaaaatgaagcgggtcaacctggcggcagcgcaaaagatg

SEQ ID NO: 63392 - DNA, 103 bp, Artificial Sequence
  Synthetic Polynucleotide
taatacgactcactatagggaattagatgggaagagtcatttaccatactaacagaggagaagtatgatgaatgactctaacctggcggcagcgcaaaagatg

SEQ ID NO: 63393 - DNA, 103 bp, Artificial Sequence
  Synthetic Polynucleotide
taatacgactcactataggggttaagtacgtaccgaggacccgctttaataacagaggagaattaaaatgggtcctcggaacctggcggcagcgcaaaagatg

SEQ ID NO: 63394 - DNA, 103 bp, Artificial Sequence
  Synthetic Polynucleotide
taatacgactcactatagggatagcgttaagtacgtaccgaggacccgctaacagaggagaagcgggatgtcggtacgtaacctggcggcagcgcaaaagatg

SEQ ID NO: 63395 - DNA, 103 bp, Artificial Sequence
  Synthetic Polynucleotide
taatacgactcactataggggactgatagcgttaagtacgtaccgaggacaacagaggagagtcctcatgacgtacttaaacctggcggcagcgcaaaagatg

SEQ ID NO: 63396 - DNA, 103 bp, Artificial Sequence
  Synthetic Polynucleotide
taatacgactcactatagggatgaggactgatagcgttaagtacgtaccgaacagaggagacggtacatgcttaacgctaacctggcggcagcgcaaaagatg

SEQ ID NO: 63397 - DNA, 103 bp, Artificial Sequence
  Synthetic Polynucleotide
taatacgactcactatagggtaggcatgaggactgatagcgttaagtacgaacagaggagacgtactatgcgctatcagaacctggcggcagcgcaaaagatg

SEQ ID NO: 63398 - DNA, 103 bp, Artificial Sequence
  Synthetic Polynucleotide
taatacgactcactatagggcatcataggcatgaggactgatagcgttaaaacagaggagattaacgatgtcagtcctcaacctggcggcagcgcaaaagatg

SEQ ID NO: 63399 - DNA, 103 bp, Artificial Sequence
  Synthetic Polynucleotide
taatacgactcactatagggaaaaacatcataggcatgaggactgatagcaacagaggagagctatcatgcctcatgccaacctggcggcagcgcaaaagatg

SEQ ID NO: 63400 - DNA, 103 bp, Artificial Sequence
  Synthetic Polynucleotide
taatacgactcactatagggtttctaaaaacatcataggcatgaggactgaacagaggagacagtccatgtgcctatgaaacctggcggcagcgcaaaagatg

SEQ ID NO: 63401 - DNA, 103 bp, Artificial Sequence
  Synthetic Polynucleotide
taatacgactcactatagggtagattttctaaaaacatcataggcatgagaacagaggagactcatgatgatgatgtttaacctggcggcagcgcaaaagatg

SEQ ID NO: 63402 - DNA, 103 bp, Artificial Sequence
  Synthetic Polynucleotide
taatacgactcactataggggttattagattttctaaaaacatcataggcaacagaggagagcctatatggtttttagaaacctggcggcagcgcaaaagatg

SEQ ID NO: 63403 - DNA, 103 bp, Artificial Sequence
  Synthetic Polynucleotide
taatacgactcactatagggccagaaattagatgggaagagtcatttaccaacagaggagaggtaaaatgctcttcccaaacctggcggcagcgcaaaagatg

SEQ ID NO: 63404 - DNA, 103 bp, Artificial Sequence
  Synthetic Polynucleotide
taatacgactcactatagggttcaagttattagattttctaaaaacatcaaacagaggagatgatgtatgtagaaaatcaacctggcggcagcgcaaaagatg

SEQ ID NO: 63405 - DNA, 103 bp, Artificial Sequence
  Synthetic Polynucleotide
taatacgactcactatagggtctctttcaagttattagattttctaaaaaaacagaggagatttttaatgaatctaataaacctggcggcagcgcaaaagatg

SEQ ID NO: 63406 - DNA, 103 bp, Artificial Sequence
  Synthetic Polynucleotide
taatacgactcactatagggtattatctctttcaagttattagattttctaacagaggagaagaaaaatgaataacttgaacctggcggcagcgcaaaagatg

SEQ ID NO: 63407 - DNA, 103 bp, Artificial Sequence
  Synthetic Polynucleotide
taatacgactcactatagggttttctattatctctttcaagttattagataacagaggagaatctaaatgcttgaaagaaacctggcggcagcgcaaaagatg

SEQ ID NO: 63408 - DNA, 103 bp, Artificial Sequence
  Synthetic Polynucleotide
taatacgactcactatagggattcattttctattatctctttcaagttataacagaggagaataactatgaagagataaaacctggcggcagcgcaaaagatg

SEQ ID NO: 63409 - DNA, 103 bp, Artificial Sequence
  Synthetic Polynucleotide
taatacgactcactatagggtttagattcattttctattatctctttcaaaacagaggagattgaaaatgataatagaaaacctggcggcagcgcaaaagatg

SEQ ID NO: 63410 - DNA, 103 bp, Artificial Sequence
  Synthetic Polynucleotide
taatacgactcactatagggttttgtttagattcattttctattatctctaacagaggagaagagatatgagaaaatgaaacctggcggcagcgcaaaagatg

SEQ ID NO: 63411 - DNA, 103 bp, Artificial Sequence
  Synthetic Polynucleotide
taatacgactcactatagggctagattttgtttagattcattttctattaaacagaggagataatagatgatgaatctaaacctggcggcagcgcaaaagatg

SEQ ID NO: 63412 - DNA, 103 bp, Artificial Sequence
  Synthetic Polynucleotide
taatacgactcactatagggagagtctagattttgtttagattcattttcaacagaggagagaaaatatgtctaaacaaaacctggcggcagcgcaaaagatg

SEQ ID NO: 63413 - DNA, 103 bp, Artificial Sequence
  Synthetic Polynucleotide
taatacgactcactataggggatatagagtctagattttgtttagattcaaacagaggagatgaatcatgacaaaatctaacctggcggcagcgcaaaagatg

SEQ ID NO: 63414 - DNA, 103 bp, Artificial Sequence
  Synthetic Polynucleotide
taatacgactcactatagggaacgtccagaaattagatgggaagagtcataacagaggagaatgactatgcccatctaaaacctggcggcagcgcaaaagatg

SEQ ID NO: 63415 - DNA, 103 bp, Artificial Sequence
  Synthetic Polynucleotide
taatacgactcactatagggaaacagatatagagtctagattttgtttagaacagaggagactaaacatgatctagactaacctggcggcagcgcaaaagatg

SEQ ID NO: 63416 - DNA, 103 bp, Artificial Sequence
  Synthetic Polynucleotide
taatacgactcactatagggaacagaaacagatatagagtctagattttgaacagaggagacaaaatatggactctataaacctggcggcagcgcaaaagatg

SEQ ID NO: 63417 - DNA, 103 bp, Artificial Sequence
  Synthetic Polynucleotide
taatacgactcactataggggtcataacagaaacagatatagagtctagaaacagaggagatctagaatgtatatctgtaacctggcggcagcgcaaaagatg

SEQ ID NO: 63418 - DNA, 103 bp, Artificial Sequence
  Synthetic Polynucleotide
taatacgactcactatagggttggagtcataacagaaacagatatagagtaacagaggagaactctaatgctgtttctgaacctggcggcagcgcaaaagatg

SEQ ID NO: 63419 - DNA, 103 bp, Artificial Sequence
  Synthetic Polynucleotide
taatacgactcactatagggattaattggagtcataacagaaacagatataacagaggagaatatctatgtctgttatgaacctggcggcagcgcaaaagatg

SEQ ID NO: 63420 - DNA, 103 bp, Artificial Sequence
  Synthetic Polynucleotide
taatacgactcactatagggatgggattaattggagtcataacagaaacaaacagaggagatgtttcatgtatgactccaacctggcggcagcgcaaaagatg

SEQ ID NO: 63421 - DNA, 103 bp, Artificial Sequence
  Synthetic Polynucleotide
taatacgactcactatagggctaacatgggattaattggagtcataacagaacagaggagactgttaatgctccaattaaacctggcggcagcgcaaaagatg

SEQ ID NO: 63422 - DNA, 103 bp, Artificial Sequence
  Synthetic Polynucleotide
taatacgactcactatagggttccgctaacatgggattaattggagtcataacagaggagaatgactatgattaatcccaacctggcggcagcgcaaaagatg

SEQ ID NO: 63423 - DNA, 103 bp, Artificial Sequence
  Synthetic Polynucleotide
taatacgactcactatagggcacgattccgctaacatgggattaattggaaacagaggagatccaatatgtcccatgttaacctggcggcagcgcaaaagatg

SEQ ID NO: 63424 - DNA, 103 bp, Artificial Sequence
  Synthetic Polynucleotide
taatacgactcactatagggaatcacacgattccgctaacatgggattaaaacagaggagattaatcatgtgttagcggaacctggcggcagcgcaaaagatg

SEQ ID NO: 63425 - DNA, 103 bp, Artificial Sequence
  Synthetic Polynucleotide
taatacgactcactatagggtggtgaacgtccagaaattagatgggaagaaacagaggagatcttccatgctaatttctaacctggcggcagcgcaaaagatg

SEQ ID NO: 63426 - DNA, 103 bp, Artificial Sequence
  Synthetic Polynucleotide
taatacgactcactataggggacagaatcacacgattccgctaacatgggaacagaggagacccatgatggcggaatcgaacctggcggcagcgcaaaagatg

SEQ ID NO: 63427 - DNA, 103 bp, Artificial Sequence
  Synthetic Polynucleotide
taatacgactcactatagggttattgacagaatcacacgattccgctaacaacagaggagagttagcatgatcgtgtgaaacctggcggcagcgcaaaagatg

SEQ ID NO: 63428 - DNA, 103 bp, Artificial Sequence
  Synthetic Polynucleotide
taatacgactcactatagggatgccttattgacagaatcacacgattccgaacagaggagacggaatatggtgattctgaacctggcggcagcgcaaaagatg

SEQ ID NO: 63429 - DNA, 103 bp, Artificial Sequence
  Synthetic Polynucleotide
taatacgactcactatagggtttaaatgccttattgacagaatcacacgaaacagaggagatcgtgtatgtctgtcaataacctggcggcagcgcaaaagatg

SEQ ID NO: 63430 - DNA, 103 bp, Artificial Sequence
  Synthetic Polynucleotide
taatacgactcactatagggaattttttaaatgccttattgacagaatcaaacagaggagatgattcatgcaataaggcaacctggcggcagcgcaaaagatg

SEQ ID NO: 63431 - DNA, 103 bp, Artificial Sequence
  Synthetic Polynucleotide
taatacgactcactatagggatggaaattttttaaatgccttattgacagaacagaggagactgtcaatgaggcatttaaacctggcggcagcgcaaaagatg

SEQ ID NO: 63432 - DNA, 103 bp, Artificial Sequence
  Synthetic Polynucleotide
taatacgactcactatagggtcctgatggaaattttttaaatgccttattaacagaggagaaataagatgtttaaaaaaaacctggcggcagcgcaaaagatg

SEQ ID NO: 63433 - DNA, 103 bp, Artificial Sequence
  Synthetic Polynucleotide
taatacgactcactatagggaacattcctgatggaaattttttaaatgccaacagaggagaggcattatgaaaatttccaacctggcggcagcgcaaaagatg

SEQ ID NO: 63434 - DNA, 103 bp, Artificial Sequence
  Synthetic Polynucleotide
taatacgactcactatagggcagcaaacattcctgatggaaattttttaaaacagaggagattaaaaatgttccatcagaacctggcggcagcgcaaaagatg

SEQ ID NO: 63435 - DNA, 103 bp, Artificial Sequence
  Synthetic Polynucleotide
taatacgactcactataggggacttcagcaaacattcctgatggaaatttaacagaggagaaaatttatgtcaggaatgaacctggcggcagcgcaaaagatg

SEQ ID NO: 63436 - DNA, 103 bp, Artificial Sequence
  Synthetic Polynucleotide
taatacgactcactataggggacattggtgaacgtccagaaattagatggaacagaggagaccatctatgttctggacgaacctggcggcagcgcaaaagatg

SEQ ID NO: 63437 - DNA, 103 bp, Artificial Sequence
  Synthetic Polynucleotide
taatacgactcactatagggtatttgacttcagcaaacattcctgatggaaacagaggagatccatcatgaatgtttgcaacctggcggcagcgcaaaagatg

SEQ ID NO: 63438 - DNA, 103 bp, Artificial Sequence
  Synthetic Polynucleotide
taatacgactcactatagggcatcgtatttgacttcagcaaacattcctgaacagaggagacaggaaatgttgctgaagaacctggcggcagcgcaaaagatg

SEQ ID NO: 63439 - DNA, 103 bp, Artificial Sequence
  Synthetic Polynucleotide
taatacgactcactatagggctcgccatcgtatttgacttcagcaaacataacagaggagaatgtttatggaagtcaaaaacctggcggcagcgcaaaagatg

SEQ ID NO: 63440 - DNA, 103 bp, Artificial Sequence
  Synthetic Polynucleotide
taatacgactcactatagggactctctcgccatcgtatttgacttcagcaaacagaggagatgctgaatgcaaatacgaaacctggcggcagcgcaaaagatg

SEQ ID NO: 63441 - DNA, 103 bp, Artificial Sequence
  Synthetic Polynucleotide
taatacgactcactatagggcttgtactctctcgccatcgtatttgacttaacagaggagaaagtcaatgacgatggcgaacctggcggcagcgcaaaagatg

SEQ ID NO: 63442 - DNA, 103 bp, Artificial Sequence
  Synthetic Polynucleotide
taatacgactcactatagggatgaacttgtactctctcgccatcgtatttaacagaggagaaaatacatgggcgagagaaacctggcggcagcgcaaaagatg

SEQ ID NO: 63443 - DNA, 103 bp, Artificial Sequence
  Synthetic Polynucleotide
taatacgactcactatagggtttttatgaacttgtactctctcgccatcgaacagaggagacgatggatggagagtacaaacctggcggcagcgcaaaagatg

SEQ ID NO: 63444 - DNA, 103 bp, Artificial Sequence
  Synthetic Polynucleotide
taatacgactcactatagggtattatttttatgaacttgtactctctcgcaacagaggagagcgagaatgtacaagttcaacctggcggcagcgcaaaagatg

SEQ ID NO: 63445 - DNA, 103 bp, Artificial Sequence
  Synthetic Polynucleotide
taatacgactcactatagggctcgttattatttttatgaacttgtactctaacagaggagaagagtaatggttcataaaaacctggcggcagcgcaaaagatg

SEQ ID NO: 63446 - DNA, 103 bp, Artificial Sequence
  Synthetic Polynucleotide
taatacgactcactataggggcaaactcgttattatttttatgaacttgtaacagaggagaacaagtatgtaaaaataaaacctggcggcagcgcaaaagatg

SEQ ID NO: 63447 - DNA, 103 bp, Artificial Sequence
  Synthetic Polynucleotide
taatacgactcactatagggctagagacattggtgaacgtccagaaattaaacagaggagataatttatggacgttcacaacctggcggcagcgcaaaagatg

SEQ ID NO: 63448 - DNA, 103 bp, Artificial Sequence
  Synthetic Polynucleotide
taatacgactcactatagggaaaaggcaaactcgttattatttttatgaaaacagaggagattcataatgataataacgaacctggcggcagcgcaaaagatg

SEQ ID NO: 63449 - DNA, 103 bp, Artificial Sequence
  Synthetic Polynucleotide
taatacgactcactatagggactaaaaaaggcaaactcgttattatttttaacagaggagaaaaaatatgaacgagtttaacctggcggcagcgcaaaagatg

SEQ ID NO: 63450 - DNA, 103 bp, Artificial Sequence
  Synthetic Polynucleotide
taatacgactcactatagggtttctactaaaaaaggcaaactcgttattaaacagaggagataataaatggtttgccttaacctggcggcagcgcaaaagatg

SEQ ID NO: 63451 - DNA, 103 bp, Artificial Sequence
  Synthetic Polynucleotide
taatacgactcactatagggtcatgtttctactaaaaaaggcaaactcgtaacagaggagaacgagtatgccttttttaaacctggcggcagcgcaaaagatg

SEQ ID NO: 63452 - DNA, 103 bp, Artificial Sequence
  Synthetic Polynucleotide
taatacgactcactatagggtggtttcatgtttctactaaaaaaggcaaaaacagaggagatttgccatgtttagtagaaacctggcggcagcgcaaaagatg

SEQ ID NO: 63453 - DNA, 103 bp, Artificial Sequence
  Synthetic Polynucleotide
taatacgactcactatagggagtactggtttcatgtttctactaaaaaagaacagaggagactttttatgtagaaacataacctggcggcagcgcaaaagatg

SEQ ID NO: 63454 - DNA, 103 bp, Artificial Sequence
  Synthetic Polynucleotide
taatacgactcactatagggaagagagtactggtttcatgtttctactaaaacagaggagattagtaatgacatgaaacaacctggcggcagcgcaaaagatg

SEQ ID NO: 63455 - DNA, 103 bp, Artificial Sequence
  Synthetic Polynucleotide
taatacgactcactatagggtttataagagagtactggtttcatgtttctaacagaggagaagaaacatgaaaccagtaaacctggcggcagcgcaaaagatg

SEQ ID NO: 63456 - DNA, 103 bp, Artificial Sequence
  Synthetic Polynucleotide
taatacgactcactatagggtccactttataagagagtactggtttcatgaacagaggagacatgaaatgagtactctcaacctggcggcagcgcaaaagatg

SEQ ID NO: 63457 - DNA, 103 bp, Artificial Sequence
  Synthetic Polynucleotide
taatacgactcactataggggataatccactttataagagagtactggttaacagaggagaaaccagatgtctcttataaacctggcggcagcgcaaaagatg

SEQ ID NO: 63458 - DNA, 103 bp, Artificial Sequence
  Synthetic Polynucleotide
taatacgactcactatagggctagttcgtaaaaagttgcaccacaaaatgaacagaggagacattttatggtgcaacttaacctggcggcagcgcaaaagatg

SEQ ID NO: 63459 - DNA, 103 bp, Artificial Sequence
  Synthetic Polynucleotide
taatacgactcactatagggagtggctagagacattggtgaacgtccagaaacagaggagatctggaatgtcaccaatgaacctggcggcagcgcaaaagatg

SEQ ID NO: 63460 - DNA, 103 bp, Artificial Sequence
  Synthetic Polynucleotide
taatacgactcactatagggtttgagataatccactttataagagagtacaacagaggagagtactcatgtataaagtgaacctggcggcagcgcaaaagatg

SEQ ID NO: 63461 - DNA, 103 bp, Artificial Sequence
  Synthetic Polynucleotide
taatacgactcactatagggtattctttgagataatccactttataagagaacagaggagactcttaatgagtggattaaacctggcggcagcgcaaaagatg

SEQ ID NO: 63462 - DNA, 103 bp, Artificial Sequence
  Synthetic Polynucleotide
taatacgactcactataggggtatgtattctttgagataatccactttataacagaggagaataaagatgattatctcaaacctggcggcagcgcaaaagatg

SEQ ID NO: 63463 - DNA, 103 bp, Artificial Sequence
  Synthetic Polynucleotide
taatacgactcactatagggtttcggtatgtattctttgagataatccacaacagaggagagtggatatgctcaaagaaaacctggcggcagcgcaaaagatg

SEQ ID NO: 63464 - DNA, 103 bp, Artificial Sequence
  Synthetic Polynucleotide
taatacgactcactatagggaatgctttcggtatgtattctttgagataaaacagaggagattatctatgagaatacataacctggcggcagcgcaaaagatg

SEQ ID NO: 63465 - DNA, 103 bp, Artificial Sequence
  Synthetic Polynucleotide
taatacgactcactatagggttttaaatgctttcggtatgtattctttgaaacagaggagatcaaagatgacataccgaaacctggcggcagcgcaaaagatg

SEQ ID NO: 63466 - DNA, 103 bp, Artificial Sequence
  Synthetic Polynucleotide
taatacgactcactatagggagcttttttaaatgctttcggtatgtattcaacagaggagagaatacatgccgaaagcaaacctggcggcagcgcaaaagatg

SEQ ID NO: 63467 - DNA, 103 bp, Artificial Sequence
  Synthetic Polynucleotide
taatacgactcactataggggacgtagcttttttaaatgctttcggtatgaacagaggagacataccatgagcatttaaaacctggcggcagcgcaaaagatg

SEQ ID NO: 63468 - DNA, 103 bp, Artificial Sequence
  Synthetic Polynucleotide
taatacgactcactatagggcgatagacgtagcttttttaaatgctttcgaacagaggagacgaaagatgttaaaaaagaacctggcggcagcgcaaaagatg

SEQ ID NO: 63469 - DNA, 103 bp, Artificial Sequence
  Synthetic Polynucleotide
taatacgactcactatagggcaatacgatagacgtagcttttttaaatgcaacagaggagagcatttatgaaagctacgaacctggcggcagcgcaaaagatg

SEQ ID NO: 63470 - DNA, 103 bp, Artificial Sequence
  Synthetic Polynucleotide
taatacgactcactataggggccaaagtggctagagacattggtgaacgtaacagaggagaacgttcatgaatgtctctaacctggcggcagcgcaaaagatg

SEQ ID NO: 63471 - DNA, 103 bp, Artificial Sequence
  Synthetic Polynucleotide
taatacgactcactataggggaatccaatacgatagacgtagcttttttaaacagaggagataaaaaatgtacgtctataacctggcggcagcgcaaaagatg

SEQ ID NO: 63472 - DNA, 103 bp, Artificial Sequence
  Synthetic Polynucleotide
taatacgactcactatagggtttcagaatccaatacgatagacgtagcttaacagaggagaaagctaatgctatcgtataacctggcggcagcgcaaaagatg

SEQ ID NO: 63473 - DNA, 103 bp, Artificial Sequence
  Synthetic Polynucleotide
taatacgactcactatagggaacaatttcagaatccaatacgatagacgtaacagaggagaacgtctatggtattggataacctggcggcagcgcaaaagatg

SEQ ID NO: 63474 - DNA, 103 bp, Artificial Sequence
  Synthetic Polynucleotide
taatacgactcactatagggacaagaacaatttcagaatccaatacgataaacagaggagatatcgtatgggattctgaaacctggcggcagcgcaaaagatg

SEQ ID NO: 63475 - DNA, 103 bp, Artificial Sequence
  Synthetic Polynucleotide
taatacgactcactatagggcgtctacaagaacaatttcagaatccaataaacagaggagatattggatgctgaaattgaacctggcggcagcgcaaaagatg

SEQ ID NO: 63476 - DNA, 103 bp, Artificial Sequence
  Synthetic Polynucleotide
taatacgactcactatagggatgttcgtctacaagaacaatttcagaatcaacagaggagagattctatgattgttcttaacctggcggcagcgcaaaagatg

SEQ ID NO: 63477 - DNA, 103 bp, Artificial Sequence
  Synthetic Polynucleotide
taatacgactcactatagggacattatgttcgtctacaagaacaatttcaaacagaggagatgaaatatgtcttgtagaaacctggcggcagcgcaaaagatg

SEQ ID NO: 63478 - DNA, 103 bp, Artificial Sequence
  Synthetic Polynucleotide
taatacgactcactataggggctgtacattatgttcgtctacaagaacaaaacagaggagattgttcatgtagacgaacaacctggcggcagcgcaaaagatg

SEQ ID NO: 63479 - DNA, 103 bp, Artificial Sequence
  Synthetic Polynucleotide
taatacgactcactatagggcgggagctgtacattatgttcgtctacaagaacagaggagacttgtaatggaacataataacctggcggcagcgcaaaagatg

SEQ ID NO: 63480 - DNA, 103 bp, Artificial Sequence
  Synthetic Polynucleotide
taatacgactcactatagggccaaacgggagctgtacattatgttcgtctaacagaggagaagacgaatgtaatgtacaaacctggcggcagcgcaaaagatg

SEQ ID NO: 63481 - DNA, 103 bp, Artificial Sequence
  Synthetic Polynucleotide
taatacgactcactatagggttagtgccaaagtggctagagacattggtgaacagaggagacaccaaatgctctagccaaacctggcggcagcgcaaaagatg

SEQ ID NO: 63482 - DNA, 103 bp, Artificial Sequence
  Synthetic Polynucleotide
taatacgactcactatagggaacttccaaacgggagctgtacattatgttaacagaggagaaacataatgtacagctccaacctggcggcagcgcaaaagatg

SEQ ID NO: 63483 - DNA, 103 bp, Artificial Sequence
  Synthetic Polynucleotide
taatacgactcactatagggacctaaacttccaaacgggagctgtacattaacagaggagaaatgtaatgctcccgtttaacctggcggcagcgcaaaagatg

SEQ ID NO: 63484 - DNA, 103 bp, Artificial Sequence
  Synthetic Polynucleotide
taatacgactcactatagggtgtatacctaaacttccaaacgggagctgtaacagaggagaacagctatggtttggaagaacctggcggcagcgcaaaagatg

SEQ ID NO: 63485 - DNA, 103 bp, Artificial Sequence
  Synthetic Polynucleotide
taatacgactcactatagggttttgtgtatacctaaacttccaaacgggaaacagaggagatcccgtatggaagtttagaacctggcggcagcgcaaaagatg

SEQ ID NO: 63486 - DNA, 103 bp, Artificial Sequence
  Synthetic Polynucleotide
taatacgactcactatagggtttctttttgtgtatacctaaacttccaaaaacagaggagatttggaatgttaggtataaacctggcggcagcgcaaaagatg

SEQ ID NO: 63487 - DNA, 103 bp, Artificial Sequence
  Synthetic Polynucleotide
taatacgactcactatagggtattctttctttttgtgtatacctaaacttaacagaggagaaagtttatgtatacacaaaacctggcggcagcgcaaaagatg

SEQ ID NO: 63488 - DNA, 103 bp, Artificial Sequence
  Synthetic Polynucleotide
taatacgactcactatagggttttatattctttctttttgtgtatacctaaacagaggagataggtaatgacaaaaagaaacctggcggcagcgcaaaagatg

SEQ ID NO: 63489 - DNA, 103 bp, Artificial Sequence
  Synthetic Polynucleotide
taatacgactcactatagggagagtttttatattctttctttttgtgtataacagaggagaatacacatgaagaaagaaaacctggcggcagcgcaaaagatg

SEQ ID NO: 63490 - DNA, 103 bp, Artificial Sequence
  Synthetic Polynucleotide
taatacgactcactatagggatgttagagtttttatattctttctttttgaacagaggagacaaaaaatgagaatataaaacctggcggcagcgcaaaagatg

SEQ ID NO: 63491 - DNA, 103 bp, Artificial Sequence
  Synthetic Polynucleotide
taatacgactcactatagggaacacatgttagagtttttatattctttctaacagaggagaagaaagatgataaaaactaacctggcggcagcgcaaaagatg

SEQ ID NO: 63492 - DNA, 103 bp, Artificial Sequence
  Synthetic Polynucleotide
taatacgactcactatagggcgctattagtgccaaagtggctagagacataacagaggagaatgtctatggccactttgaacctggcggcagcgcaaaagatg

SEQ ID NO: 63493 - DNA, 103 bp, Artificial Sequence
  Synthetic Polynucleotide
taatacgactcactatagggaaacaaacacatgttagagtttttatattcaacagaggagagaatatatgaactctaacaacctggcggcagcgcaaaagatg

SEQ ID NO: 63494 - DNA, 103 bp, Artificial Sequence
  Synthetic Polynucleotide
taatacgactcactatagggaacacaaacaaacacatgttagagtttttaaacagaggagataaaaaatgtaacatgtgaacctggcggcagcgcaaaagatg

SEQ ID NO: 63495 - DNA, 103 bp, Artificial Sequence
  Synthetic Polynucleotide
taatacgactcactatagggagtcaaacacaaacaaacacatgttagagtaacagaggagaactctaatgtgtgtttgtaacctggcggcagcgcaaaagatg

SEQ ID NO: 63496 - DNA, 103 bp, Artificial Sequence
  Synthetic Polynucleotide
taatacgactcactatagggcaaacagtcaaacacaaacaaacacatgttaacagaggagaaacatgatgttgtttgtgaacctggcggcagcgcaaaagatg

SEQ ID NO: 63497 - DNA, 103 bp, Artificial Sequence
  Synthetic Polynucleotide
taatacgactcactatagggaagtacaaacagtcaaacacaaacaaacacaacagaggagagtgtttatgtgtgtttgaaacctggcggcagcgcaaaagatg

SEQ ID NO: 63498 - DNA, 103 bp, Artificial Sequence
  Synthetic Polynucleotide
taatacgactcactatagggcatcaaagtacaaacagtcaaacacaaacaaacagaggagatgtttgatgttgactgttaacctggcggcagcgcaaaagatg

SEQ ID NO: 63499 - DNA, 103 bp, Artificial Sequence
  Synthetic Polynucleotide
taatacgactcactataggggaatccatcaaagtacaaacagtcaaacacaacagaggagagtgtttatgtgtttgtacaacctggcggcagcgcaaaagatg

SEQ ID NO: 63500 - DNA, 103 bp, Artificial Sequence
  Synthetic Polynucleotide
taatacgactcactatagggatatcgaatccatcaaagtacaaacagtcaaacagaggagatgactgatggtactttgaaacctggcggcagcgcaaaagatg

SEQ ID NO: 63501 - DNA, 103 bp, Artificial Sequence
  Synthetic Polynucleotide
taatacgactcactatagggccgtcatatcgaatccatcaaagtacaaacaacagaggagagtttgtatgttgatggataacctggcggcagcgcaaaagatg

SEQ ID NO: 63502 - DNA, 103 bp, Artificial Sequence
  Synthetic Polynucleotide
taatacgactcactatagggaatgtccgtcatatcgaatccatcaaagtaaacagaggagatactttatgggattcgataacctggcggcagcgcaaaagatg

SEQ ID NO: 63503 - DNA, 103 bp, Artificial Sequence
  Synthetic Polynucleotide
taatacgactcactatagggatgatcgctattagtgccaaagtggctagaaacagaggagatctagcatgtttggcactaacctggcggcagcgcaaaagatg

SEQ ID NO: 63504 - DNA, 103 bp, Artificial Sequence
  Synthetic Polynucleotide
taatacgactcactatagggaatggaatgtccgtcatatcgaatccatcaaacagaggagatgatggatgcgatatgacaacctggcggcagcgcaaaagatg

SEQ ID NO: 63505 - DNA, 103 bp, Artificial Sequence
  Synthetic Polynucleotide
taatacgactcactatagggtgtacaatggaatgtccgtcatatcgaatcaacagaggagagattcgatgtgacggacaaacctggcggcagcgcaaaagatg

SEQ ID NO: 63506 - DNA, 103 bp, Artificial Sequence
  Synthetic Polynucleotide
taatacgactcactatagggtcgtttgtacaatggaatgtccgtcatatcaacagaggagagatatgatggacattccaaacctggcggcagcgcaaaagatg

SEQ ID NO: 63507 - DNA, 103 bp, Artificial Sequence
  Synthetic Polynucleotide
taatacgactcactataggggatcttcgtttgtacaatggaatgtccgtcaacagaggagagacggaatgtccattgtaaacctggcggcagcgcaaaagatg

SEQ ID NO: 63508 - DNA, 103 bp, Artificial Sequence
  Synthetic Polynucleotide
taatacgactcactataggggaaaagatcttcgtttgtacaatggaatgtaacagaggagaacattcatgtgtacaaacaacctggcggcagcgcaaaagatg

SEQ ID NO: 63509 - DNA, 103 bp, Artificial Sequence
  Synthetic Polynucleotide
taatacgactcactatagggtttgagaaaagatcttcgtttgtacaatggaacagaggagaccattgatgaaacgaagaaacctggcggcagcgcaaaagatg

SEQ ID NO: 63510 - DNA, 103 bp, Artificial Sequence
  Synthetic Polynucleotide
taatacgactcactatagggacatctttgagaaaagatcttcgtttgtacaacagaggagagtacaaatgaagatctttaacctggcggcagcgcaaaagatg

SEQ ID NO: 63511 - DNA, 103 bp, Artificial Sequence
  Synthetic Polynucleotide
taatacgactcactatagggccataacatctttgagaaaagatcttcgttaacagaggagaaacgaaatgcttttctcaaacctggcggcagcgcaaaagatg

SEQ ID NO: 63512 - DNA, 103 bp, Artificial Sequence
  Synthetic Polynucleotide
taatacgactcactatagggctcgaccataacatctttgagaaaagatctaacagaggagaagatctatgctcaaagataacctggcggcagcgcaaaagatg

SEQ ID NO: 63513 - DNA, 103 bp, Artificial Sequence
  Synthetic Polynucleotide
taatacgactcactatagggggtatctcgaccataacatctttgagaaaaaacagaggagattttctatgagatgttataacctggcggcagcgcaaaagatg

SEQ ID NO: 63514 - DNA, 103 bp, Artificial Sequence
  Synthetic Polynucleotide
taatacgactcactatagggagcgaatgatcgctattagtgccaaagtggaacagaggagaccacttatgcactaatagaacctggcggcagcgcaaaagatg

SEQ ID NO: 63515 - DNA, 103 bp, Artificial Sequence
  Synthetic Polynucleotide
taatacgactcactatagggtattgggtatctcgaccataacatctttgaaacagaggagatcaaagatgttatggtcgaacctggcggcagcgcaaaagatg

SEQ ID NO: 63516 - DNA, 103 bp, Artificial Sequence
  Synthetic Polynucleotide
taatacgactcactatagggtattctattgggtatctcgaccataacatcaacagaggagagatgttatggtcgagataaacctggcggcagcgcaaaagatg

SEQ ID NO: 63517 - DNA, 103 bp, Artificial Sequence
  Synthetic Polynucleotide
taatacgactcactatagggaatactattctattgggtatctcgaccataaacagaggagatatggtatggatacccaaaacctggcggcagcgcaaaagatg

SEQ ID NO: 63518 - DNA, 103 bp, Artificial Sequence
  Synthetic Polynucleotide
taatacgactcactatagggctgagaatactattctattgggtatctcgaaacagaggagatcgagaatgccaatagaaaacctggcggcagcgcaaaagatg

SEQ ID NO: 63519 - DNA, 103 bp, Artificial Sequence
  Synthetic Polynucleotide
taatacgactcactatagggcaactctgagaatactattctattgggtataacagaggagaatacccatgagaatagtaaacctggcggcagcgcaaaagatg

SEQ ID NO: 63520 - DNA, 103 bp, Artificial Sequence
  Synthetic Polynucleotide
taatacgactcactatagggttcgtcaactctgagaatactattctattgaacagaggagacaatagatgagtattctcaacctggcggcagcgcaaaagatg

SEQ ID NO: 63521 - DNA, 103 bp, Artificial Sequence
  Synthetic Polynucleotide
taatacgactcactatagggtaatattcgtcaactctgagaatactattcaacagaggagagaatagatgtctcagagtaacctggcggcagcgcaaaagatg

SEQ ID NO: 63522 - DNA, 103 bp, Artificial Sequence
  Synthetic Polynucleotide
taatacgactcactataggggttactaatattcgtcaactctgagaatacaacagaggagagtattcatggagttgacgaacctggcggcagcgcaaaagatg

SEQ ID NO: 63523 - DNA, 103 bp, Artificial Sequence
  Synthetic Polynucleotide
taatacgactcactataggggactcgttactaatattcgtcaactctgagaacagaggagactcagaatggacgaatataacctggcggcagcgcaaaagatg

SEQ ID NO: 63524 - DNA, 103 bp, Artificial Sequence
  Synthetic Polynucleotide
taatacgactcactatagggactgagactcgttactaatattcgtcaactaacagaggagaagttgaatgatattagtaaacctggcggcagcgcaaaagatg

SEQ ID NO: 63525 - DNA, 103 bp, Artificial Sequence
  Synthetic Polynucleotide
taatacgactcactatagggtgttaagcgaatgatcgctattagtgccaaaacagaggagattggcaatgatagcgatcaacctggcggcagcgcaaaagatg

SEQ ID NO: 63526 - DNA, 103 bp, Artificial Sequence
  Synthetic Polynucleotide
taatacgactcactatagggagttaactgagactcgttactaatattcgtaacagaggagaacgaatatgagtaacgagaacctggcggcagcgcaaaagatg

SEQ ID NO: 63527 - DNA, 103 bp, Artificial Sequence
  Synthetic Polynucleotide
taatacgactcactatagggacgtcagttaactgagactcgttactaataaacagaggagatattagatgcgagtctcaaacctggcggcagcgcaaaagatg

SEQ ID NO: 63528 - DNA, 103 bp, Artificial Sequence
  Synthetic Polynucleotide
taatacgactcactatagggccaatacgtcagttaactgagactcgttacaacagaggagagtaacgatgctcagttaaaacctggcggcagcgcaaaagatg

SEQ ID NO: 63529 - DNA, 103 bp, Artificial Sequence
  Synthetic Polynucleotide
taatacgactcactatagggatcatccaatacgtcagttaactgagactcaacagaggagagagtctatgttaactgacaacctggcggcagcgcaaaagatg

SEQ ID NO: 63530 - DNA, 103 bp, Artificial Sequence
  Synthetic Polynucleotide
taatacgactcactatagggagtgcatcatccaatacgtcagttaactgaaacagaggagatcagttatgtgacgtattaacctggcggcagcgcaaaagatg

SEQ ID NO: 63531 - DNA, 103 bp, Artificial Sequence
  Synthetic Polynucleotide
taatacgactcactatagggttgttagtgcatcatccaatacgtcagttaaacagaggagataactgatgtattggatgaacctggcggcagcgcaaaagatg

SEQ ID NO: 63532 - DNA, 103 bp, Artificial Sequence
  Synthetic Polynucleotide
taatacgactcactatagggttttcttgttagtgcatcatccaatacgtcaacagaggagagacgtaatggatgatgcaaacctggcggcagcgcaaaagatg

SEQ ID NO: 63533 - DNA, 103 bp, Artificial Sequence
  Synthetic Polynucleotide
taatacgactcactatagggtctaattttcttgttagtgcatcatccaataacagaggagaattggaatgtgcactaacaacctggcggcagcgcaaaagatg

SEQ ID NO: 63534 - DNA, 103 bp, Artificial Sequence
  Synthetic Polynucleotide
taatacgactcactatagggatccttctaattttcttgttagtgcatcataacagaggagaatgatgatgtaacaagaaaacctggcggcagcgcaaaagatg

SEQ ID NO: 63535 - DNA, 103 bp, Artificial Sequence
  Synthetic Polynucleotide
taatacgactcactataggggaccaatccttctaattttcttgttagtgcaacagaggagagcactaatgagaaaattaaacctggcggcagcgcaaaagatg

SEQ ID NO: 63536 - DNA, 103 bp, Artificial Sequence
  Synthetic Polynucleotide
taatacgactcactataggggaagatgttaagcgaatgatcgctattagtaacagaggagaactaatatggatcattcgaacctggcggcagcgcaaaagatg

SEQ ID NO: 63537 - DNA, 103 bp, Artificial Sequence
  Synthetic Polynucleotide
taatacgactcactatagggtttaagaccaatccttctaattttcttgttaacagaggagaaacaagatgattagaaggaacctggcggcagcgcaaaagatg

SEQ ID NO: 63538 - DNA, 103 bp, Artificial Sequence
  Synthetic Polynucleotide
taatacgactcactatagggtatcttttaagaccaatccttctaattttcaacagaggagagaaaatatgaaggattggaacctggcggcagcgcaaaagatg

SEQ ID NO: 63539 - DNA, 103 bp, Artificial Sequence
  Synthetic Polynucleotide
taatacgactcactatagggattaatatcttttaagaccaatccttctaaaacagaggagattagaaatgttggtcttaaacctggcggcagcgcaaaagatg

SEQ ID NO: 63540 - DNA, 103 bp, Artificial Sequence
  Synthetic Polynucleotide
taatacgactcactatagggactccattaatatcttttaagaccaatcctaacagaggagaaggattatgcttaaaagaaacctggcggcagcgcaaaagatg

SEQ ID NO: 63541 - DNA, 103 bp, Artificial Sequence
  Synthetic Polynucleotide
taatacgactcactatagggcgtatactccattaatatcttttaagaccaaacagaggagatggtctatgaagatattaaacctggcggcagcgcaaaagatg

SEQ ID NO: 63542 - DNA, 103 bp, Artificial Sequence
  Synthetic Polynucleotide
taatacgactcactatagggcggctcgtatactccattaatatcttttaaaacagaggagattaaaaatgattaatggaaacctggcggcagcgcaaaagatg

SEQ ID NO: 63543 - DNA, 103 bp, Artificial Sequence
  Synthetic Polynucleotide
taatacgactcactatagggtttcccggctcgtatactccattaatatctaacagaggagaagatatatgtggagtataaacctggcggcagcgcaaaagatg

SEQ ID NO: 63544 - DNA, 103 bp, Artificial Sequence
  Synthetic Polynucleotide
taatacgactcactatagggttctttttcccggctcgtatactccattaaaacagaggagattaatgatgtatacgagcaacctggcggcagcgcaaaagatg

SEQ ID NO: 63545 - DNA, 103 bp, Artificial Sequence
  Synthetic Polynucleotide
taatacgactcactatagggccatcttctttttcccggctcgtatactccaacagaggagaggagtaatggagccgggaaacctggcggcagcgcaaaagatg

SEQ ID NO: 63546 - DNA, 103 bp, Artificial Sequence
  Synthetic Polynucleotide
taatacgactcactatagggtttaaccatcttctttttcccggctcgtataacagaggagaatacgaatggggaaaaagaacctggcggcagcgcaaaagatg

SEQ ID NO: 63547 - DNA, 103 bp, Artificial Sequence
  Synthetic Polynucleotide
taatacgactcactatagggatgtagaagatgttaagcgaatgatcgctaaacagaggagatagcgaatgttcgcttaaaacctggcggcagcgcaaaagatg

SEQ ID NO: 63548 - DNA, 103 bp, Artificial Sequence
  Synthetic Polynucleotide
taatacgactcactatagggttatttttaaccatcttctttttcccggctaacagaggagaagccggatgaaagaagataacctggcggcagcgcaaaagatg

SEQ ID NO: 63549 - DNA, 103 bp, Artificial Sequence
  Synthetic Polynucleotide
taatacgactcactatagggtcgctttatttttaaccatcttctttttccaacagaggagaggaaaaatgagatggttaaacctggcggcagcgcaaaagatg

SEQ ID NO: 63550 - DNA, 103 bp, Artificial Sequence
  Synthetic Polynucleotide
taatacgactcactatagggtagtctcgctttatttttaaccatcttcttaacagaggagaaagaagatggttaaaaataacctggcggcagcgcaaaagatg

SEQ ID NO: 63551 - DNA, 103 bp, Artificial Sequence
  Synthetic Polynucleotide
taatacgactcactatagggtcaaatagtctcgctttatttttaaccatcaacagaggagagatggtatgaaataaagcaacctggcggcagcgcaaaagatg

SEQ ID NO: 63552 - DNA, 103 bp, Artificial Sequence
  Synthetic Polynucleotide
taatacgactcactatagggctcgttcaaatagtctcgctttatttttaaaacagaggagattaaaaatgaagcgagacaacctggcggcagcgcaaaagatg

SEQ ID NO: 63553 - DNA, 103 bp, Artificial Sequence
  Synthetic Polynucleotide
taatacgactcactataggggaaccctcgttcaaatagtctcgctttattaacagaggagaaataaaatgagactatttaacctggcggcagcgcaaaagatg

SEQ ID NO: 63554 - DNA, 103 bp, Artificial Sequence
  Synthetic Polynucleotide
taatacgactcactatagggccatggaaccctcgttcaaatagtctcgctaacagaggagaagcgagatgatttgaacgaacctggcggcagcgcaaaagatg

SEQ ID NO: 63555 - DNA, 103 bp, Artificial Sequence
  Synthetic Polynucleotide
taatacgactcactatagggatctgccatggaaccctcgttcaaatagtcaacagaggagagactatatgaacgagggtaacctggcggcagcgcaaaagatg

SEQ ID NO: 63556 - DNA, 103 bp, Artificial Sequence
  Synthetic Polynucleotide
taatacgactcactataggggcagaatctgccatggaaccctcgttcaaaaacagaggagatttgaaatggggttccataacctggcggcagcgcaaaagatg

SEQ ID NO: 63557 - DNA, 103 bp, Artificial Sequence
  Synthetic Polynucleotide
taatacgactcactatagggaatcggcagaatctgccatggaaccctcgtaacagaggagaacgaggatgccatggcagaacctggcggcagcgcaaaagatg

SEQ ID NO: 63558 - DNA, 103 bp, Artificial Sequence
  Synthetic Polynucleotide
taatacgactcactatagggtaataatgtagaagatgttaagcgaatgataacagaggagaatcattatgttaacatctaacctggcggcagcgcaaaagatg

SEQ ID NO: 63559 - DNA, 103 bp, Artificial Sequence
  Synthetic Polynucleotide
taatacgactcactatagggtactaaatcggcagaatctgccatggaaccaacagaggagaggttccatggcagattctaacctggcggcagcgcaaaagatg

SEQ ID NO: 63560 - DNA, 103 bp, Artificial Sequence
  Synthetic Polynucleotide
taatacgactcactatagggagtactactaaatcggcagaatctgccatgaacagaggagacatggcatgttctgccgaaacctggcggcagcgcaaaagatg

SEQ ID NO: 63561 - DNA, 103 bp, Artificial Sequence
  Synthetic Polynucleotide
taatacgactcactatagggcacctagtactactaaatcggcagaatctgaacagaggagacagattatgccgatttagaacctggcggcagcgcaaaagatg

SEQ ID NO: 63562 - DNA, 103 bp, Artificial Sequence
  Synthetic Polynucleotide
taatacgactcactataggggtaagcacctagtactactaaatcggcagaaacagaggagatctgccatgttagtagtaaacctggcggcagcgcaaaagatg

SEQ ID NO: 63563 - DNA, 103 bp, Artificial Sequence
  Synthetic Polynucleotide
taatacgactcactatagggccatagtaagcacctagtactactaaatcgaacagaggagacgatttatgagtactaggaacctggcggcagcgcaaaagatg

SEQ ID NO: 63564 - DNA, 103 bp, Artificial Sequence
  Synthetic Polynucleotide
taatacgactcactatagggctttaccatagtaagcacctagtactactaaacagaggagatagtagatgtaggtgcttaacctggcggcagcgcaaaagatg

SEQ ID NO: 63565 - DNA, 103 bp, Artificial Sequence
  Synthetic Polynucleotide
taatacgactcactatagggtgctcctttaccatagtaagcacctagtacaacagaggagagtactaatggcttactataacctggcggcagcgcaaaagatg

SEQ ID NO: 63566 - DNA, 103 bp, Artificial Sequence
  Synthetic Polynucleotide
taatacgactcactatagggccctttgctcctttaccatagtaagcacctaacagaggagaaggtgcatgctatggtaaaacctggcggcagcgcaaaagatg

SEQ ID NO: 63567 - DNA, 103 bp, Artificial Sequence
  Synthetic Polynucleotide
taatacgactcactatagggtaccaccctttgctcctttaccatagtaagaacagaggagacttactatggtaaaggagaacctggcggcagcgcaaaagatg

SEQ ID NO: 63568 - DNA, 103 bp, Artificial Sequence
  Synthetic Polynucleotide
taatacgactcactatagggcataataccaccctttgctcctttaccataaacagaggagatatggtatgggagcaaagaacctggcggcagcgcaaaagatg

SEQ ID NO: 63569 - DNA, 103 bp, Artificial Sequence
  Synthetic Polynucleotide
taatacgactcactatagggtacaactagttcgtaaaaagttgcaccacaaacagaggagatgtggtatgactttttacaacctggcggcagcgcaaaagatg

SEQ ID NO: 63570 - DNA, 103 bp, Artificial Sequence
  Synthetic Polynucleotide
taatacgactcactatagggccagttaataatgtagaagatgttaagcgaaacagaggagatcgcttatgatcttctacaacctggcggcagcgcaaaagatg

SEQ ID NO: 63571 - DNA, 103 bp, Artificial Sequence
  Synthetic Polynucleotide
taatacgactcactatagggactgccataataccaccctttgctcctttaaacagaggagataaaggatgaaagggtggaacctggcggcagcgcaaaagatg

SEQ ID NO: 63572 - DNA, 103 bp, Artificial Sequence
  Synthetic Polynucleotide
taatacgactcactataggggaaagactgccataataccaccctttgctcaacagaggagagagcaaatggtggtattaaacctggcggcagcgcaaaagatg

SEQ ID NO: 63573 - DNA, 103 bp, Artificial Sequence
  Synthetic Polynucleotide
taatacgactcactatagggcattagaaagactgccataataccacccttaacagaggagaaagggtatgattatggcaaacctggcggcagcgcaaaagatg

SEQ ID NO: 63574 - DNA, 103 bp, Artificial Sequence
  Synthetic Polynucleotide
taatacgactcactatagggcaacccattagaaagactgccataataccaaacagaggagatggtatatgggcagtcttaacctggcggcagcgcaaaagatg

SEQ ID NO: 63575 - DNA, 103 bp, Artificial Sequence
  Synthetic Polynucleotide
taatacgactcactatagggcgtaacaacccattagaaagactgccataaaacagaggagattatggatgtctttctaaaacctggcggcagcgcaaaagatg

SEQ ID NO: 63576 - DNA, 103 bp, Artificial Sequence
  Synthetic Polynucleotide
taatacgactcactatagggatcatcgtaacaacccattagaaagactgcaacagaggagagcagtcatgctaatgggtaacctggcggcagcgcaaaagatg

SEQ ID NO: 63577 - DNA, 103 bp, Artificial Sequence
  Synthetic Polynucleotide
taatacgactcactataggggattcatcatcgtaacaacccattagaaagaacagaggagactttctatggggttgttaaacctggcggcagcgcaaaagatg

SEQ ID NO: 63578 - DNA, 103 bp, Artificial Sequence
  Synthetic Polynucleotide
taatacgactcactatagggtaccggattcatcatcgtaacaacccattaaacagaggagataatggatggttacgatgaacctggcggcagcgcaaaagatg

SEQ ID NO: 63579 - DNA, 103 bp, Artificial Sequence
  Synthetic Polynucleotide
taatacgactcactatagggccatttaccggattcatcatcgtaacaaccaacagaggagaggttgtatggatgatgaaaacctggcggcagcgcaaaagatg

SEQ ID NO: 63580 - DNA, 103 bp, Artificial Sequence
  Synthetic Polynucleotide
taatacgactcactataggggtcttccatttaccggattcatcatcgtaaaacagaggagattacgaatgtgaatccggaacctggcggcagcgcaaaagatg

SEQ ID NO: 63581 - DNA, 103 bp, Artificial Sequence
  Synthetic Polynucleotide
taatacgactcactatagggatcaaccagttaataatgtagaagatgttaaacagaggagataacatatgctacattataacctggcggcagcgcaaaagatg

SEQ ID NO: 63582 - DNA, 103 bp, Artificial Sequence
  Synthetic Polynucleotide
taatacgactcactatagggttaccgtcttccatttaccggattcatcataacagaggagaatgatgatgccggtaaataacctggcggcagcgcaaaagatg

SEQ ID NO: 63583 - DNA, 103 bp, Artificial Sequence
  Synthetic Polynucleotide
taatacgactcactatagggtttagttaccgtcttccatttaccggattcaacagaggagagaatccatgaaatggaagaacctggcggcagcgcaaaagatg

SEQ ID NO: 63584 - DNA, 103 bp, Artificial Sequence
  Synthetic Polynucleotide
taatacgactcactataggggaacatttagttaccgtcttccatttaccgaacagaggagacggtaaatggaagacggtaacctggcggcagcgcaaaagatg

SEQ ID NO: 63585 - DNA, 103 bp, Artificial Sequence
  Synthetic Polynucleotide
taatacgactcactataggggtcctgaacatttagttaccgtcttccattaacagaggagaaatggaatgcggtaactaaacctggcggcagcgcaaaagatg

SEQ ID NO: 63586 - DNA, 103 bp, Artificial Sequence
  Synthetic Polynucleotide
taatacgactcactatagggatcatgtcctgaacatttagttaccgtcttaacagaggagaaagacgatgactaaatgtaacctggcggcagcgcaaaagatg

SEQ ID NO: 63587 - DNA, 103 bp, Artificial Sequence
  Synthetic Polynucleotide
taatacgactcactatagggttatcatcatgtcctgaacatttagttaccaacagaggagaggtaacatgatgttcaggaacctggcggcagcgcaaaagatg

SEQ ID NO: 63588 - DNA, 103 bp, Artificial Sequence
  Synthetic Polynucleotide
taatacgactcactatagggacgtattatcatcatgtcctgaacatttagaacagaggagactaaatatgcaggacatgaacctggcggcagcgcaaaagatg

SEQ ID NO: 63589 - DNA, 103 bp, Artificial Sequence
  Synthetic Polynucleotide
taatacgactcactatagggccttaacgtattatcatcatgtcctgaacaaacagaggagatgttcaatgcatgatgataacctggcggcagcgcaaaagatg

SEQ ID NO: 63590 - DNA, 103 bp, Artificial Sequence
  Synthetic Polynucleotide
taatacgactcactatagggaaaacccttaacgtattatcatcatgtcctaacagaggagaaggacaatgtgataatacaacctggcggcagcgcaaaagatg

SEQ ID NO: 63591 - DNA, 103 bp, Artificial Sequence
  Synthetic Polynucleotide
taatacgactcactatagggcttgcaaaacccttaacgtattatcatcataacagaggagaatgatgatgatacgttaaaacctggcggcagcgcaaaagatg

SEQ ID NO: 63592 - DNA, 103 bp, Artificial Sequence
  Synthetic Polynucleotide
taatacgactcactatagggattaaatcaaccagttaataatgtagaagaaacagaggagatcttctatgttattaactaacctggcggcagcgcaaaagatg

SEQ ID NO: 63593 - DNA, 103 bp, Artificial Sequence
  Synthetic Polynucleotide
taatacgactcactatagggttggtcttgcaaaacccttaacgtattatcaacagaggagagataatatgttaagggttaacctggcggcagcgcaaaagatg

SEQ ID NO: 63594 - DNA, 103 bp, Artificial Sequence
  Synthetic Polynucleotide
taatacgactcactataggggttaattggtcttgcaaaacccttaacgtaaacagaggagatacgttatgggttttgcaaacctggcggcagcgcaaaagatg

SEQ ID NO: 63595 - DNA, 103 bp, Artificial Sequence
  Synthetic Polynucleotide
taatacgactcactatagggccatcgttaattggtcttgcaaaacccttaaacagaggagataagggatgtgcaagaccaacctggcggcagcgcaaaagatg

SEQ ID NO: 63596 - DNA, 103 bp, Artificial Sequence
  Synthetic Polynucleotide
taatacgactcactatagggtttaaccatcgttaattggtcttgcaaaacaacagaggagagttttgatggaccaattaaacctggcggcagcgcaaaagatg

SEQ ID NO: 63597 - DNA, 103 bp, Artificial Sequence
  Synthetic Polynucleotide
taatacgactcactatagggttaattttaaccatcgttaattggtcttgcaacagaggagagcaagaatgattaacgataacctggcggcagcgcaaaagatg

SEQ ID NO: 63598 - DNA, 103 bp, Artificial Sequence
  Synthetic Polynucleotide
taatacgactcactatagggccttgttaattttaaccatcgttaattggtaacagaggagaaccaatatgcgatggttaaacctggcggcagcgcaaaagatg

SEQ ID NO: 63599 - DNA, 103 bp, Artificial Sequence
  Synthetic Polynucleotide
taatacgactcactataggggggatccttgttaattttaaccatcgttaaaacagaggagattaacgatggttaaaattaacctggcggcagcgcaaaagatg

SEQ ID NO: 63600 - DNA, 103 bp, Artificial Sequence
  Synthetic Polynucleotide
taatacgactcactatagggtttttgggatccttgttaattttaaccatcaacagaggagagatggtatgaattaacaaaacctggcggcagcgcaaaagatg

SEQ ID NO: 63601 - DNA, 103 bp, Artificial Sequence
  Synthetic Polynucleotide
taatacgactcactataggggaatttttttgggatccttgttaattttaaaacagaggagattaaaaatgacaaggatcaacctggcggcagcgcaaaagatg

SEQ ID NO: 63602 - DNA, 103 bp, Artificial Sequence
  Synthetic Polynucleotide
taatacgactcactatagggctctggaatttttttgggatccttgttaataacagaggagaattaacatggatcccaaaaacctggcggcagcgcaaaagatg

SEQ ID NO: 63603 - DNA, 103 bp, Artificial Sequence
  Synthetic Polynucleotide
taatacgactcactataggggatagattaaatcaaccagttaataatgtaaacagaggagatacattatgaactggttgaacctggcggcagcgcaaaagatg

SEQ ID NO: 63604 - DNA, 103 bp, Artificial Sequence
  Synthetic Polynucleotide
taatacgactcactatagggaaccactctggaatttttttgggatccttgaacagaggagacaaggaatgcaaaaaaataacctggcggcagcgcaaaagatg

SEQ ID NO: 63605 - DNA, 103 bp, Artificial Sequence
  Synthetic Polynucleotide
taatacgactcactatagggctaccaaccactctggaatttttttgggataacagaggagaatcccaatgaaattccagaacctggcggcagcgcaaaagatg

SEQ ID NO: 63606 - DNA, 103 bp, Artificial Sequence
  Synthetic Polynucleotide
taatacgactcactatagggattaactaccaaccactctggaatttttttaacagaggagaaaaaaaatgccagagtggaacctggcggcagcgcaaaagatg

SEQ ID NO: 63607 - DNA, 103 bp, Artificial Sequence
  Synthetic Polynucleotide
taatacgactcactatagggattttattaactaccaaccactctggaattaacagaggagaaattccatggtggttggtaacctggcggcagcgcaaaagatg

SEQ ID NO: 63608 - DNA, 103 bp, Artificial Sequence
  Synthetic Polynucleotide
taatacgactcactatagggtatagattttattaactaccaaccactctgaacagaggagacagagtatgtggtagttaaacctggcggcagcgcaaaagatg

SEQ ID NO: 63609 - DNA, 103 bp, Artificial Sequence
  Synthetic Polynucleotide
taatacgactcactataggggggaatatagattttattaactaccaaccaaacagaggagatggttgatggttaataaaaacctggcggcagcgcaaaagatg

SEQ ID NO: 63610 - DNA, 103 bp, Artificial Sequence
  Synthetic Polynucleotide
taatacgactcactatagggaaatcgggaatatagattttattaactaccaacagaggagaggtagtatgtaaaatctaaacctggcggcagcgcaaaagatg

SEQ ID NO: 63611 - DNA, 103 bp, Artificial Sequence
  Synthetic Polynucleotide
taatacgactcactatagggctacaaaatcgggaatatagattttattaaaacagaggagattaataatgtctatattcaacctggcggcagcgcaaaagatg

SEQ ID NO: 63612 - DNA, 103 bp, Artificial Sequence
  Synthetic Polynucleotide
taatacgactcactatagggctctactacaaaatcgggaatatagattttaacagaggagaaaaatcatgattcccgataacctggcggcagcgcaaaagatg

SEQ ID NO: 63613 - DNA, 103 bp, Artificial Sequence
  Synthetic Polynucleotide
taatacgactcactatagggggatcctctactacaaaatcgggaatatagaacagaggagactatatatgcgattttgtaacctggcggcagcgcaaaagatg

SEQ ID NO: 63614 - DNA, 103 bp, Artificial Sequence
  Synthetic Polynucleotide
taatacgactcactatagggtgctagatagattaaatcaaccagttaataaacagaggagatattaaatggttgatttaaacctggcggcagcgcaaaagatg

SEQ ID NO: 63615 - DNA, 103 bp, Artificial Sequence
  Synthetic Polynucleotide
taatacgactcactataggggtttcggatcctctactacaaaatcgggaaaacagaggagattcccgatgttgtagtagaacctggcggcagcgcaaaagatg

SEQ ID NO: 63616 - DNA, 103 bp, Artificial Sequence
  Synthetic Polynucleotide
taatacgactcactatagggagattgtttcggatcctctactacaaaatcaacagaggagagattttatggtagaggataacctggcggcagcgcaaaagatg

SEQ ID NO: 63617 - DNA, 103 bp, Artificial Sequence
  Synthetic Polynucleotide
taatacgactcactatagggatttgagattgtttcggatcctctactacaaacagaggagatgtagtatgggatccgaaaacctggcggcagcgcaaaagatg

SEQ ID NO: 63618 - DNA, 103 bp, Artificial Sequence
  Synthetic Polynucleotide
taatacgactcactatagggcccatatttgagattgtttcggatcctctaaacagaggagatagaggatgcgaaacaataacctggcggcagcgcaaaagatg

SEQ ID NO: 63619 - DNA, 103 bp, Artificial Sequence
  Synthetic Polynucleotide
taatacgactcactatagggaatttcccatatttgagattgtttcggatcaacagaggagagatccgatgcaatctcaaaacctggcggcagcgcaaaagatg

SEQ ID NO: 63620 - DNA, 103 bp, Artificial Sequence
  Synthetic Polynucleotide
taatacgactcactatagggcctgaaatttcccatatttgagattgtttcaacagaggagagaaacaatgtcaaatatgaacctggcggcagcgcaaaagatg

SEQ ID NO: 63621 - DNA, 103 bp, Artificial Sequence
  Synthetic Polynucleotide
taatacgactcactatagggctgctcctgaaatttcccatatttgagattaacagaggagaaatctcatgtatgggaaaaacctggcggcagcgcaaaagatg

SEQ ID NO: 63622 - DNA, 103 bp, Artificial Sequence
  Synthetic Polynucleotide
taatacgactcactatagggaaactctgctcctgaaatttcccatatttgaacagaggagacaaataatggaaatttcaaacctggcggcagcgcaaaagatg

SEQ ID NO: 63623 - DNA, 103 bp, Artificial Sequence
  Synthetic Polynucleotide
taatacgactcactataggggatgtaaactctgctcctgaaatttcccataacagaggagaatgggaatgttcaggagcaacctggcggcagcgcaaaagatg

SEQ ID NO: 63624 - DNA, 103 bp, Artificial Sequence
  Synthetic Polynucleotide
taatacgactcactatagggtggaagatgtaaactctgctcctgaaatttaacagaggagaaaatttatggagcagagtaacctggcggcagcgcaaaagatg

SEQ ID NO: 63625 - DNA, 103 bp, Artificial Sequence
  Synthetic Polynucleotide
taatacgactcactatagggtccattgctagatagattaaatcaaccagtaacagaggagaactggtatgtttaatctaaacctggcggcagcgcaaaagatg

SEQ ID NO: 63626 - DNA, 103 bp, Artificial Sequence
  Synthetic Polynucleotide
taatacgactcactatagggtgacttggaagatgtaaactctgctcctgaaacagaggagatcaggaatggagtttacaaacctggcggcagcgcaaaagatg

SEQ ID NO: 63627 - DNA, 103 bp, Artificial Sequence
  Synthetic Polynucleotide
taatacgactcactataggggtatgtgacttggaagatgtaaactctgctaacagaggagaagcagaatgtacatcttcaacctggcggcagcgcaaaagatg

SEQ ID NO: 63628 - DNA, 103 bp, Artificial Sequence
  Synthetic Polynucleotide
taatacgactcactatagggtcgctgtatgtgacttggaagatgtaaactaacagaggagaagtttaatgcttccaagtaacctggcggcagcgcaaaagatg

SEQ ID NO: 63629 - DNA, 103 bp, Artificial Sequence
  Synthetic Polynucleotide
taatacgactcactatagggtccattcgctgtatgtgacttggaagatgtaacagaggagaacatctatgaagtcacataacctggcggcagcgcaaaagatg

SEQ ID NO: 63630 - DNA, 103 bp, Artificial Sequence
  Synthetic Polynucleotide
taatacgactcactataggggatattccattcgctgtatgtgacttggaaaacagaggagattccaaatgacatacagcaacctggcggcagcgcaaaagatg

SEQ ID NO: 63631 - DNA, 103 bp, Artificial Sequence
  Synthetic Polynucleotide
taatacgactcactatagggtaatcgatattccattcgctgtatgtgactaacagaggagaagtcacatgcagcgaatgaacctggcggcagcgcaaaagatg

SEQ ID NO: 63632 - DNA, 103 bp, Artificial Sequence
  Synthetic Polynucleotide
taatacgactcactatagggaaatctaatcgatattccattcgctgtatgaacagaggagacatacaatgaatggaataaacctggcggcagcgcaaaagatg

SEQ ID NO: 63633 - DNA, 103 bp, Artificial Sequence
  Synthetic Polynucleotide
taatacgactcactatagggctaggaaatctaatcgatattccattcgctaacagaggagaagcgaaatgaatatcgataacctggcggcagcgcaaaagatg

SEQ ID NO: 63634 - DNA, 103 bp, Artificial Sequence
  Synthetic Polynucleotide
taatacgactcactatagggtaaatctaggaaatctaatcgatattccataacagaggagaatggaaatgcgattagataacctggcggcagcgcaaaagatg

SEQ ID NO: 63635 - DNA, 103 bp, Artificial Sequence
  Synthetic Polynucleotide
taatacgactcactatagggcctagtaaatctaggaaatctaatcgatataacagaggagaatatcgatgagatttcctaacctggcggcagcgcaaaagatg

SEQ ID NO: 63636 - DNA, 103 bp, Artificial Sequence
  Synthetic Polynucleotide
taatacgactcactataggggacggtccattgctagatagattaaatcaaaacagaggagattgattatgtctatctagaacctggcggcagcgcaaaagatg

SEQ ID NO: 63637 - DNA, 103 bp, Artificial Sequence
  Synthetic Polynucleotide
taatacgactcactatagggctaatcctagtaaatctaggaaatctaatcaacagaggagagattagatgtcctagattaacctggcggcagcgcaaaagatg

SEQ ID NO: 63638 - DNA, 103 bp, Artificial Sequence
  Synthetic Polynucleotide
taatacgactcactatagggcttctctaatcctagtaaatctaggaaatcaacagaggagagatttcatggatttactaaacctggcggcagcgcaaaagatg

SEQ ID NO: 63639 - DNA, 103 bp, Artificial Sequence
  Synthetic Polynucleotide
taatacgactcactatagggtttatcttctctaatcctagtaaatctaggaacagaggagacctagaatgactaggattaacctggcggcagcgcaaaagatg

SEQ ID NO: 63640 - DNA, 103 bp, Artificial Sequence
  Synthetic Polynucleotide
taatacgactcactatagggcacgttttatcttctctaatcctagtaaataacagaggagaatttacatggattagagaaacctggcggcagcgcaaaagatg

SEQ ID NO: 63641 - DNA, 103 bp, Artificial Sequence
  Synthetic Polynucleotide
taatacgactcactatagggctttccacgttttatcttctctaatcctagaacagaggagactaggaatggagaagataaacctggcggcagcgcaaaagatg

SEQ ID NO: 63642 - DNA, 103 bp, Artificial Sequence
  Synthetic Polynucleotide
taatacgactcactatagggagattctttccacgttttatcttctctaataacagaggagaattagaatggataaaacgaacctggcggcagcgcaaaagatg

SEQ ID NO: 63643 - DNA, 103 bp, Artificial Sequence
  Synthetic Polynucleotide
taatacgactcactatagggtgagtagattctttccacgttttatcttctaacagaggagaagaagaatgaacgtggaaaacctggcggcagcgcaaaagatg

SEQ ID NO: 63644 - DNA, 103 bp, Artificial Sequence
  Synthetic Polynucleotide
taatacgactcactatagggttagatgagtagattctttccacgttttataacagaggagaataaaaatgggaaagaataacctggcggcagcgcaaaagatg

SEQ ID NO: 63645 - DNA, 103 bp, Artificial Sequence
  Synthetic Polynucleotide
taatacgactcactatagggatcgtttagatgagtagattctttccacgtaacagaggagaacgtggatggaatctactaacctggcggcagcgcaaaagatg

SEQ ID NO: 63646 - DNA, 103 bp, Artificial Sequence
  Synthetic Polynucleotide
taatacgactcactatagggactaaatcgtttagatgagtagattctttcaacagaggagagaaagaatgtactcatctaacctggcggcagcgcaaaagatg

SEQ ID NO: 63647 - DNA, 103 bp, Artificial Sequence
  Synthetic Polynucleotide
taatacgactcactatagggtgtccgacggtccattgctagatagattaaaacagaggagattaatcatgctagcaatgaacctggcggcagcgcaaaagatg

SEQ ID NO: 63648 - DNA, 103 bp, Artificial Sequence
  Synthetic Polynucleotide
taatacgactcactatagggaatttactaaatcgtttagatgagtagattaacagaggagaaatctaatgatctaaacgaacctggcggcagcgcaaaagatg

SEQ ID NO: 63649 - DNA, 103 bp, Artificial Sequence
  Synthetic Polynucleotide
taatacgactcactatagggagtcaaatttactaaatcgtttagatgagtaacagaggagaactcatatgaacgatttaaacctggcggcagcgcaaaagatg

SEQ ID NO: 63650 - DNA, 103 bp, Artificial Sequence
  Synthetic Polynucleotide
taatacgactcactataggggatttagtcaaatttactaaatcgtttagaaacagaggagatctaaaatgtttagtaaaaacctggcggcagcgcaaaagatg

SEQ ID NO: 63651 - DNA, 103 bp, Artificial Sequence
  Synthetic Polynucleotide
taatacgactcactatagggattaagatttagtcaaatttactaaatcgtaacagaggagaacgattatgtaaatttgaaacctggcggcagcgcaaaagatg

SEQ ID NO: 63652 - DNA, 103 bp, Artificial Sequence
  Synthetic Polynucleotide
taatacgactcactatagggtaactattaagatttagtcaaatttactaaaacagaggagattagtaatgttgactaaaaacctggcggcagcgcaaaagatg

SEQ ID NO: 63653 - DNA, 103 bp, Artificial Sequence
  Synthetic Polynucleotide
taatacgactcactataggggtatgtaactattaagatttagtcaaatttaacagaggagaaaatttatgtaaatcttaaacctggcggcagcgcaaaagatg

SEQ ID NO: 63654 - DNA, 103 bp, Artificial Sequence
  Synthetic Polynucleotide
taatacgactcactatagggagtttgtatgtaactattaagatttagtcaaacagaggagatgactaatgcttaatagtaacctggcggcagcgcaaaagatg

SEQ ID NO: 63655 - DNA, 103 bp, Artificial Sequence
  Synthetic Polynucleotide
taatacgactcactatagggttttcagtttgtatgtaactattaagatttaacagaggagaaaatctatgtagttacataacctggcggcagcgcaaaagatg

SEQ ID NO: 63656 - DNA, 103 bp, Artificial Sequence
  Synthetic Polynucleotide
taatacgactcactatagggtttaattttcagtttgtatgtaactattaaaacagaggagattaataatgacatacaaaaacctggcggcagcgcaaaagatg

SEQ ID NO: 63657 - DNA, 103 bp, Artificial Sequence
  Synthetic Polynucleotide
taatacgactcactataggggttattttaattttcagtttgtatgtaactaacagaggagaagttacatgcaaactgaaaacctggcggcagcgcaaaagatg

SEQ ID NO: 63658 - DNA, 103 bp, Artificial Sequence
  Synthetic Polynucleotide
taatacgactcactataggggacactgtccgacggtccattgctagatagaacagaggagactatctatgaatggaccgaacctggcggcagcgcaaaagatg

SEQ ID NO: 63659 - DNA, 103 bp, Artificial Sequence
  Synthetic Polynucleotide
taatacgactcactatagggatagtgttattttaattttcagtttgtatgaacagaggagacatacaatgtgaaaattaaacctggcggcagcgcaaaagatg

SEQ ID NO: 63660 - DNA, 103 bp, Artificial Sequence
  Synthetic Polynucleotide
taatacgactcactatagggactaaatagtgttattttaattttcagtttaacagaggagaaaactgatgattaaaataaacctggcggcagcgcaaaagatg

SEQ ID NO: 63661 - DNA, 103 bp, Artificial Sequence
  Synthetic Polynucleotide
taatacgactcactatagggcaccaactaaatagtgttattttaattttcaacagaggagagaaaatatgaataacactaacctggcggcagcgcaaaagatg

SEQ ID NO: 63662 - DNA, 103 bp, Artificial Sequence
  Synthetic Polynucleotide
taatacgactcactataggggcgatcaccaactaaatagtgttattttaaaacagaggagattaaaaatgcactatttaaacctggcggcagcgcaaaagatg

SEQ ID NO: 63663 - DNA, 103 bp, Artificial Sequence
  Synthetic Polynucleotide
taatacgactcactatagggccatggcgatcaccaactaaatagtgttataacagaggagaataacaatgtttagttggaacctggcggcagcgcaaaagatg

SEQ ID NO: 63664 - DNA, 103 bp, Artificial Sequence
  Synthetic Polynucleotide
taatacgactcactatagggaccatccatggcgatcaccaactaaatagtaacagaggagaactattatgttggtgatcaacctggcggcagcgcaaaagatg

SEQ ID NO: 63665 - DNA, 103 bp, Artificial Sequence
  Synthetic Polynucleotide
taatacgactcactatagggataacaccatccatggcgatcaccaactaaaacagaggagattagttatggatcgccataacctggcggcagcgcaaaagatg

SEQ ID NO: 63666 - DNA, 103 bp, Artificial Sequence
  Synthetic Polynucleotide
taatacgactcactatagggatacaataacaccatccatggcgatcaccaaacagaggagatggtgaatgccatggatgaacctggcggcagcgcaaaagatg

SEQ ID NO: 63667 - DNA, 103 bp, Artificial Sequence
  Synthetic Polynucleotide
taatacgactcactatagggacagtatacaataacaccatccatggcgataacagaggagaatcgccatggatggtgttaacctggcggcagcgcaaaagatg

SEQ ID NO: 63668 - DNA, 103 bp, Artificial Sequence
  Synthetic Polynucleotide
taatacgactcactatagggtttagacagtatacaataacaccatccatgaacagaggagacatggaatgtgttattgtaacctggcggcagcgcaaaagatg

SEQ ID NO: 63669 - DNA, 103 bp, Artificial Sequence
  Synthetic Polynucleotide
taatacgactcactatagggagaatgacactgtccgacggtccattgctaaacagaggagatagcaaatgaccgtcggaaacctggcggcagcgcaaaagatg

SEQ ID NO: 63670 - DNA, 103 bp, Artificial Sequence
  Synthetic Polynucleotide
taatacgactcactatagggacgcgtttagacagtatacaataacaccataacagaggagaatggtgatgttgtatactaacctggcggcagcgcaaaagatg

SEQ ID NO: 63671 - DNA, 103 bp, Artificial Sequence
  Synthetic Polynucleotide
taatacgactcactatagggtactaacgcgtttagacagtatacaataacaacagaggagagttattatgtactgtctaaacctggcggcagcgcaaaagatg

SEQ ID NO: 63672 - DNA, 103 bp, Artificial Sequence
  Synthetic Polynucleotide
taatacgactcactatagggtgttttactaacgcgtttagacagtatacaaacagaggagatgtataatgtctaaacgcaacctggcggcagcgcaaaagatg

SEQ ID NO: 63673 - DNA, 103 bp, Artificial Sequence
  Synthetic Polynucleotide
taatacgactcactatagggcaccatgttttactaacgcgtttagacagtaacagaggagaactgtcatgacgcgttagaacctggcggcagcgcaaaagatg

SEQ ID NO: 63674 - DNA, 103 bp, Artificial Sequence
  Synthetic Polynucleotide
taatacgactcactatagggttcctcaccatgttttactaacgcgtttagaacagaggagactaaacatgttagtaaaaaacctggcggcagcgcaaaagatg

SEQ ID NO: 63675 - DNA, 103 bp, Artificial Sequence
  Synthetic Polynucleotide
taatacgactcactatagggtttatttcctcaccatgttttactaacgcgaacagaggagacgcgttatgaaaacatggaacctggcggcagcgcaaaagatg

SEQ ID NO: 63676 - DNA, 103 bp, Artificial Sequence
  Synthetic Polynucleotide
taatacgactcactatagggtatgatttatttcctcaccatgttttactaaacagaggagatagtaaatgatggtgaggaacctggcggcagcgcaaaagatg

SEQ ID NO: 63677 - DNA, 103 bp, Artificial Sequence
  Synthetic Polynucleotide
taatacgactcactatagggttttatatgatttatttcctcaccatgtttaacagaggagaaaacatatggaggaaataaacctggcggcagcgcaaaagatg

SEQ ID NO: 63678 - DNA, 103 bp, Artificial Sequence
  Synthetic Polynucleotide
taatacgactcactatagggtcattttttatatgatttatttcctcaccaaacagaggagatggtgaatgaataaatcaaacctggcggcagcgcaaaagatg

SEQ ID NO: 63679 - DNA, 103 bp, Artificial Sequence
  Synthetic Polynucleotide
taatacgactcactatagggtgaaatcattttttatatgatttatttcctaacagaggagaaggaaaatgatcatataaaacctggcggcagcgcaaaagatg

SEQ ID NO: 63680 - DNA, 103 bp, Artificial Sequence
  Synthetic Polynucleotide
taatacgactcactatagggactcatacaactagttcgtaaaaagttgcaaacagaggagatgcaacatgttacgaactaacctggcggcagcgcaaaagatg

SEQ ID NO: 63681 - DNA, 103 bp, Artificial Sequence
  Synthetic Polynucleotide
taatacgactcactatagggacatgagaatgacactgtccgacggtccataacagaggagaatggacatgcggacagtgaacctggcggcagcgcaaaagatg

SEQ ID NO: 63682 - DNA, 103 bp, Artificial Sequence
  Synthetic Polynucleotide
taatacgactcactatagggaatcatgaaatcattttttatatgatttataacagaggagaataaatatgataaaaaataacctggcggcagcgcaaaagatg

SEQ ID NO: 63683 - DNA, 103 bp, Artificial Sequence
  Synthetic Polynucleotide
taatacgactcactatagggggtttaatcatgaaatcattttttatatgaaacagaggagatcatatatgaaatgatttaacctggcggcagcgcaaaagatg

SEQ ID NO: 63684 - DNA, 103 bp, Artificial Sequence
  Synthetic Polynucleotide
taatacgactcactatagggaacatggtttaatcatgaaatcattttttaaacagaggagataaaaaatgatttcatgaaacctggcggcagcgcaaaagatg

SEQ ID NO: 63685 - DNA, 103 bp, Artificial Sequence
  Synthetic Polynucleotide
taatacgactcactatagggttcacaacatggtttaatcatgaaatcattaacagaggagaaatgatatgatgattaaaaacctggcggcagcgcaaaagatg

SEQ ID NO: 63686 - DNA, 103 bp, Artificial Sequence
  Synthetic Polynucleotide
taatacgactcactatagggactctttcacaacatggtttaatcatgaaaaacagaggagatttcatatgtaaaccatgaacctggcggcagcgcaaaagatg

SEQ ID NO: 63687 - DNA, 103 bp, Artificial Sequence
  Synthetic Polynucleotide
taatacgactcactatagggcacaaactctttcacaacatggtttaatcaaacagaggagatgattaatgcatgttgtgaacctggcggcagcgcaaaagatg

SEQ ID NO: 63688 - DNA, 103 bp, Artificial Sequence
  Synthetic Polynucleotide
taatacgactcactatagggtttttcacaaactctttcacaacatggtttaacagaggagaaaaccaatgtgtgaaagaaacctggcggcagcgcaaaagatg

SEQ ID NO: 63689 - DNA, 103 bp, Artificial Sequence
  Synthetic Polynucleotide
taatacgactcactatagggttgactttttcacaaactctttcacaacataacagaggagaatgttgatgaagagtttgaacctggcggcagcgcaaaagatg

SEQ ID NO: 63690 - DNA, 103 bp, Artificial Sequence
  Synthetic Polynucleotide
taatacgactcactatagggcgttcttgactttttcacaaactctttcacaacagaggagagtgaaaatgtttgtgaaaaacctggcggcagcgcaaaagatg

SEQ ID NO: 63691 - DNA, 103 bp, Artificial Sequence
  Synthetic Polynucleotide
taatacgactcactataggggtgtacgttcttgactttttcacaaactctaacagaggagaagagttatggaaaaagtcaacctggcggcagcgcaaaagatg

SEQ ID NO: 63692 - DNA, 103 bp, Artificial Sequence
  Synthetic Polynucleotide
taatacgactcactatagggtaagaacatgagaatgacactgtccgacggaacagaggagaccgtcgatgagtgtcattaacctggcggcagcgcaaaagatg

SEQ ID NO: 63693 - DNA, 103 bp, Artificial Sequence
  Synthetic Polynucleotide
taatacgactcactatagggtcgatgtgtacgttcttgactttttcacaaaacagaggagattgtgaatgagtcaagaaaacctggcggcagcgcaaaagatg

SEQ ID NO: 63694 - DNA, 103 bp, Artificial Sequence
  Synthetic Polynucleotide
taatacgactcactataggggtccgtcgatgtgtacgttcttgactttttaacagaggagaaaaaagatgagaacgtacaacctggcggcagcgcaaaagatg

SEQ ID NO: 63695 - DNA, 103 bp, Artificial Sequence
  Synthetic Polynucleotide
taatacgactcactatagggagattgtccgtcgatgtgtacgttcttgacaacagaggagagtcaagatggtacacatcaacctggcggcagcgcaaaagatg

SEQ ID NO: 63696 - DNA, 103 bp, Artificial Sequence
  Synthetic Polynucleotide
taatacgactcactatagggtttttagattgtccgtcgatgtgtacgttcaacagaggagagaacgtatgcatcgacggaacctggcggcagcgcaaaagatg

SEQ ID NO: 63697 - DNA, 103 bp, Artificial Sequence
  Synthetic Polynucleotide
taatacgactcactatagggtattgtttttagattgtccgtcgatgtgtaaacagaggagatacacaatgacggacaataacctggcggcagcgcaaaagatg

SEQ ID NO: 63698 - DNA, 103 bp, Artificial Sequence
  Synthetic Polynucleotide
taatacgactcactatagggcactgtattgtttttagattgtccgtcgataacagaggagaatcgacatgcaatctaaaaacctggcggcagcgcaaaagatg

SEQ ID NO: 63699 - DNA, 103 bp, Artificial Sequence
  Synthetic Polynucleotide
taatacgactcactataggggcaatcactgtattgtttttagattgtccgaacagaggagacggacaatgtaaaaacaaaacctggcggcagcgcaaaagatg

SEQ ID NO: 63700 - DNA, 103 bp, Artificial Sequence
  Synthetic Polynucleotide
taatacgactcactatagggaatctgcaatcactgtattgtttttagattaacagaggagaaatctaatgacaatacagaacctggcggcagcgcaaaagatg

SEQ ID NO: 63701 - DNA, 103 bp, Artificial Sequence
  Synthetic Polynucleotide
taatacgactcactatagggtggcaaatctgcaatcactgtattgtttttaacagaggagaaaaaacatgacagtgattaacctggcggcagcgcaaaagatg

SEQ ID NO: 63702 - DNA, 103 bp, Artificial Sequence
  Synthetic Polynucleotide
taatacgactcactatagggagatatggcaaatctgcaatcactgtattgaacagaggagacaatacatggattgcagaaacctggcggcagcgcaaaagatg

SEQ ID NO: 63703 - DNA, 103 bp, Artificial Sequence
  Synthetic Polynucleotide
taatacgactcactatagggttgattaagaacatgagaatgacactgtccaacagaggagaggacagatgcattctcataacctggcggcagcgcaaaagatg

SEQ ID NO: 63704 - DNA, 103 bp, Artificial Sequence
  Synthetic Polynucleotide
taatacgactcactatagggtatccagatatggcaaatctgcaatcactgaacagaggagacagtgaatgcagatttgcaacctggcggcagcgcaaaagatg

SEQ ID NO: 63705 - DNA, 103 bp, Artificial Sequence
  Synthetic Polynucleotide
taatacgactcactatagggagcattatccagatatggcaaatctgcaataacagaggagaattgcaatgttgccatataacctggcggcagcgcaaaagatg

SEQ ID NO: 63706 - DNA, 103 bp, Artificial Sequence
  Synthetic Polynucleotide
taatacgactcactatagggaatacagcattatccagatatggcaaatctaacagaggagaagatttatgatatctggaaacctggcggcagcgcaaaagatg

SEQ ID NO: 63707 - DNA, 103 bp, Artificial Sequence
  Synthetic Polynucleotide
taatacgactcactatagggcatccaatacagcattatccagatatggcaaacagaggagatgccatatgtggataatgaacctggcggcagcgcaaaagatg

SEQ ID NO: 63708 - DNA, 103 bp, Artificial Sequence
  Synthetic Polynucleotide
taatacgactcactataggggcatacatccaatacagcattatccagataaacagaggagatatctgatgaatgctgtaaacctggcggcagcgcaaaagatg

SEQ ID NO: 63709 - DNA, 103 bp, Artificial Sequence
  Synthetic Polynucleotide
taatacgactcactataggggatttgcatacatccaatacagcattatccaacagaggagaggataaatgtgtattggaaacctggcggcagcgcaaaagatg

SEQ ID NO: 63710 - DNA, 103 bp, Artificial Sequence
  Synthetic Polynucleotide
taatacgactcactatagggatactgatttgcatacatccaatacagcataacagaggagaatgctgatgtggatgtataacctggcggcagcgcaaaagatg

SEQ ID NO: 63711 - DNA, 103 bp, Artificial Sequence
  Synthetic Polynucleotide
taatacgactcactatagggtttatatactgatttgcatacatccaatacaacagaggagagtattgatggtatgcaaaaacctggcggcagcgcaaaagatg

SEQ ID NO: 63712 - DNA, 103 bp, Artificial Sequence
  Synthetic Polynucleotide
taatacgactcactatagggttctttttatatactgatttgcatacatccaacagaggagaggatgtatgcaaatcagtaacctggcggcagcgcaaaagatg

SEQ ID NO: 63713 - DNA, 103 bp, Artificial Sequence
  Synthetic Polynucleotide
taatacgactcactatagggatacattctttttatatactgatttgcataaacagaggagatatgcaatgcagtatataaacctggcggcagcgcaaaagatg

SEQ ID NO: 63714 - DNA, 103 bp, Artificial Sequence
  Synthetic Polynucleotide
taatacgactcactataggggtacattgattaagaacatgagaatgacacaacagaggagagtgtcaatgtcatgttctaacctggcggcagcgcaaaagatg

SEQ ID NO: 63715 - DNA, 103 bp, Artificial Sequence
  Synthetic Polynucleotide
taatacgactcactatagggtcttgatacattctttttatatactgatttaacagaggagaaaatcaatgtataaaaagaacctggcggcagcgcaaaagatg

SEQ ID NO: 63716 - DNA, 103 bp, Artificial Sequence
  Synthetic Polynucleotide
taatacgactcactataggggatattcttgatacattctttttatatactaacagaggagaagtataatgaaagaatgtaacctggcggcagcgcaaaagatg

SEQ ID NO: 63717 - DNA, 103 bp, Artificial Sequence
  Synthetic Polynucleotide
taatacgactcactatagggatctggatattcttgatacattctttttataacagaggagaataaaaatgatgtatcaaaacctggcggcagcgcaaaagatg

SEQ ID NO: 63718 - DNA, 103 bp, Artificial Sequence
  Synthetic Polynucleotide
taatacgactcactatagggagcaaatctggatattcttgatacattcttaacagaggagaaagaatatgtcaagaataaacctggcggcagcgcaaaagatg

SEQ ID NO: 63719 - DNA, 103 bp, Artificial Sequence
  Synthetic Polynucleotide
taatacgactcactatagggaaattagcaaatctggatattcttgatacaaacagaggagatgtatcatgaatatccagaacctggcggcagcgcaaaagatg

SEQ ID NO: 63720 - DNA, 103 bp, Artificial Sequence
  Synthetic Polynucleotide
taatacgactcactatagggttatcaaattagcaaatctggatattcttgaacagaggagacaagaaatgccagatttgaacctggcggcagcgcaaaagatg

SEQ ID NO: 63721 - DNA, 103 bp, Artificial Sequence
  Synthetic Polynucleotide
taatacgactcactatagggtatctttatcaaattagcaaatctggatataacagaggagaatatccatgtttgctaataacctggcggcagcgcaaaagatg

SEQ ID NO: 63722 - DNA, 103 bp, Artificial Sequence
  Synthetic Polynucleotide
taatacgactcactatagggtcatctatctttatcaaattagcaaatctgaacagaggagacagattatgtaatttgataacctggcggcagcgcaaaagatg

SEQ ID NO: 63723 - DNA, 103 bp, Artificial Sequence
  Synthetic Polynucleotide
taatacgactcactatagggcatcatcatctatctttatcaaattagcaaaacagaggagattgctaatgtgataaagaaacctggcggcagcgcaaaagatg

SEQ ID NO: 63724 - DNA, 103 bp, Artificial Sequence
  Synthetic Polynucleotide
taatacgactcactatagggcttgtcatcatcatctatctttatcaaattaacagaggagaaatttgatgaagatagataacctggcggcagcgcaaaagatg

SEQ ID NO: 63725 - DNA, 103 bp, Artificial Sequence
  Synthetic Polynucleotide
taatacgactcactatagggtgtatgtacattgattaagaacatgagaataacagaggagaattctcatgttcttaatcaacctggcggcagcgcaaaagatg

SEQ ID NO: 63726 - DNA, 103 bp, Artificial Sequence
  Synthetic Polynucleotide
taatacgactcactatagggggagtcttgtcatcatcatctatctttatcaacagaggagagataaaatgagatgatgaaacctggcggcagcgcaaaagatg

SEQ ID NO: 63727 - DNA, 103 bp, Artificial Sequence
  Synthetic Polynucleotide
taatacgactcactatagggcggtaggagtcttgtcatcatcatctatctaacagaggagaagatagatgatgatgacaaacctggcggcagcgcaaaagatg

SEQ ID NO: 63728 - DNA, 103 bp, Artificial Sequence
  Synthetic Polynucleotide
taatacgactcactatagggtacaccggtaggagtcttgtcatcatcatcaacagaggagagatgatatggacaagactaacctggcggcagcgcaaaagatg

SEQ ID NO: 63729 - DNA, 103 bp, Artificial Sequence
  Synthetic Polynucleotide
taatacgactcactatagggttatatacaccggtaggagtcttgtcatcaaacagaggagatgatgaatggactcctacaacctggcggcagcgcaaaagatg

SEQ ID NO: 63730 - DNA, 103 bp, Artificial Sequence
  Synthetic Polynucleotide
taatacgactcactatagggaataattatatacaccggtaggagtcttgtaacagaggagaacaagaatgctaccggtgaacctggcggcagcgcaaaagatg

SEQ ID NO: 63731 - DNA, 103 bp, Artificial Sequence
  Synthetic Polynucleotide
taatacgactcactatagggtttaaaataattatatacaccggtaggagtaacagaggagaactcctatgggtgtatataacctggcggcagcgcaaaagatg

SEQ ID NO: 63732 - DNA, 103 bp, Artificial Sequence
  Synthetic Polynucleotide
taatacgactcactatagggttaggtttaaaataattatatacaccggtaaacagaggagataccggatgatataattaaacctggcggcagcgcaaaagatg

SEQ ID NO: 63733 - DNA, 103 bp, Artificial Sequence
  Synthetic Polynucleotide
taatacgactcactatagggcatctttaggtttaaaataattatatacacaacagaggagagtgtatatgattattttaaacctggcggcagcgcaaaagatg

SEQ ID NO: 63734 - DNA, 103 bp, Artificial Sequence
  Synthetic Polynucleotide
taatacgactcactatagggaatagcatctttaggtttaaaataattataaacagaggagatataatatgtttaaacctaacctggcggcagcgcaaaagatg

SEQ ID NO: 63735 - DNA, 103 bp, Artificial Sequence
  Synthetic Polynucleotide
taatacgactcactatagggacagaaatagcatctttaggtttaaaataaaacagaggagattatttatgacctaaagaaacctggcggcagcgcaaaagatg

SEQ ID NO: 63736 - DNA, 103 bp, Artificial Sequence
  Synthetic Polynucleotide
taatacgactcactatagggagtgatgtatgtacattgattaagaacatgaacagaggagacatgttatgaatcaatgtaacctggcggcagcgcaaaagatg

SEQ ID NO: 63737 - DNA, 103 bp, Artificial Sequence
  Synthetic Polynucleotide
taatacgactcactatagggtaataacagaaatagcatctttaggtttaaaacagaggagattaaacatgaagatgctaaacctggcggcagcgcaaaagatg

SEQ ID NO: 63738 - DNA, 103 bp, Artificial Sequence
  Synthetic Polynucleotide
taatacgactcactatagggggatataataacagaaatagcatctttaggaacagaggagacctaaaatggctatttctaacctggcggcagcgcaaaagatg

SEQ ID NO: 63739 - DNA, 103 bp, Artificial Sequence
  Synthetic Polynucleotide
taatacgactcactatagggcctatggatataataacagaaatagcatctaacagaggagaagatgcatgttctgttataacctggcggcagcgcaaaagatg

SEQ ID NO: 63740 - DNA, 103 bp, Artificial Sequence
  Synthetic Polynucleotide
taatacgactcactatagggcctttcctatggatataataacagaaatagaacagaggagactatttatgttattatataacctggcggcagcgcaaaagatg

SEQ ID NO: 63741 - DNA, 103 bp, Artificial Sequence
  Synthetic Polynucleotide
taatacgactcactatagggtttatcctttcctatggatataataacagaaacagaggagatctgttatgatatccataaacctggcggcagcgcaaaagatg

SEQ ID NO: 63742 - DNA, 103 bp, Artificial Sequence
  Synthetic Polynucleotide
taatacgactcactatagggacatctttatcctttcctatggatataataaacagaggagatattatatgcataggaaaaacctggcggcagcgcaaaagatg

SEQ ID NO: 63743 - DNA, 103 bp, Artificial Sequence
  Synthetic Polynucleotide
taatacgactcactatagggcacagacatctttatcctttcctatggataaacagaggagatatccaatggaaaggataaacctggcggcagcgcaaaagatg

SEQ ID NO: 63744 - DNA, 103 bp, Artificial Sequence
  Synthetic Polynucleotide
taatacgactcactatagggtagttcacagacatctttatcctttcctataacagaggagaataggaatggataaagataacctggcggcagcgcaaaagatg

SEQ ID NO: 63745 - DNA, 103 bp, Artificial Sequence
  Synthetic Polynucleotide
taatacgactcactatagggattaatagttcacagacatctttatcctttaacagaggagaaaaggaatgagatgtctgaacctggcggcagcgcaaaagatg

SEQ ID NO: 63746 - DNA, 103 bp, Artificial Sequence
  Synthetic Polynucleotide
taatacgactcactatagggatgcgattaatagttcacagacatctttataacagaggagaataaagatgtctgtgaacaacctggcggcagcgcaaaagatg

SEQ ID NO: 63747 - DNA, 103 bp, Artificial Sequence
  Synthetic Polynucleotide
taatacgactcactatagggatgacagtgatgtatgtacattgattaagaaacagaggagatcttaaatgatgtacataaacctggcggcagcgcaaaagatg

SEQ ID NO: 63748 - DNA, 103 bp, Artificial Sequence
  Synthetic Polynucleotide
taatacgactcactatagggatcggatgcgattaatagttcacagacatcaacagaggagagatgtcatggaactattaaacctggcggcagcgcaaaagatg

SEQ ID NO: 63749 - DNA, 103 bp, Artificial Sequence
  Synthetic Polynucleotide
taatacgactcactataggggctttatcggatgcgattaatagttcacagaacagaggagactgtgaatgattaatcgcaacctggcggcagcgcaaaagatg

SEQ ID NO: 63750 - DNA, 103 bp, Artificial Sequence
  Synthetic Polynucleotide
taatacgactcactatagggcacacgctttatcggatgcgattaatagttaacagaggagaaactatatgtcgcatccgaacctggcggcagcgcaaaagatg

SEQ ID NO: 63751 - DNA, 103 bp, Artificial Sequence
  Synthetic Polynucleotide
taatacgactcactatagggacacgcacacgctttatcggatgcgattaaaacagaggagattaatcatgtccgataaaaacctggcggcagcgcaaaagatg

SEQ ID NO: 63752 - DNA, 103 bp, Artificial Sequence
  Synthetic Polynucleotide
taatacgactcactatagggtctatacacgcacacgctttatcggatgcgaacagaggagacgcatcatgtaaagcgtgaacctggcggcagcgcaaaagatg

SEQ ID NO: 63753 - DNA, 103 bp, Artificial Sequence
  Synthetic Polynucleotide
taatacgactcactatagggttaactctatacacgcacacgctttatcggaacagaggagaccgataatgcgtgtgcgtaacctggcggcagcgcaaaagatg

SEQ ID NO: 63754 - DNA, 103 bp, Artificial Sequence
  Synthetic Polynucleotide
taatacgactcactatagggtgaatttaactctatacacgcacacgctttaacagaggagaaaagcgatggcgtgtataaacctggcggcagcgcaaaagatg

SEQ ID NO: 63755 - DNA, 103 bp, Artificial Sequence
  Synthetic Polynucleotide
taatacgactcactatagggttatatgaatttaactctatacacgcacacaacagaggagagtgtgcatgtatagagttaacctggcggcagcgcaaaagatg

SEQ ID NO: 63756 - DNA, 103 bp, Artificial Sequence
  Synthetic Polynucleotide
taatacgactcactatagggctactttatatgaatttaactctatacacgaacagaggagacgtgtaatgagttaaattaacctggcggcagcgcaaaagatg

SEQ ID NO: 63757 - DNA, 103 bp, Artificial Sequence
  Synthetic Polynucleotide
taatacgactcactatagggaatggctactttatatgaatttaactctataacagaggagaatagagatgaattcatataacctggcggcagcgcaaaagatg

SEQ ID NO: 63758 - DNA, 103 bp, Artificial Sequence
  Synthetic Polynucleotide
taatacgactcactatagggggtagatgacagtgatgtatgtacattgataacagaggagaatcaatatgcatacatcaaacctggcggcagcgcaaaagatg

SEQ ID NO: 63759 - DNA, 103 bp, Artificial Sequence
  Synthetic Polynucleotide
taatacgactcactatagggggaagaatggctactttatatgaatttaacaacagaggagagttaaaatgatataaagtaacctggcggcagcgcaaaagatg

SEQ ID NO: 63760 - DNA, 103 bp, Artificial Sequence
  Synthetic Polynucleotide
taatacgactcactatagggtcatgggaagaatggctactttatatgaataacagaggagaattcatatgaagtagccaaacctggcggcagcgcaaaagatg

SEQ ID NO: 63761 - DNA, 103 bp, Artificial Sequence
  Synthetic Polynucleotide
taatacgactcactatagggaacattcatgggaagaatggctactttataaacagaggagatataaaatggccattcttaacctggcggcagcgcaaaagatg

SEQ ID NO: 63762 - DNA, 103 bp, Artificial Sequence
  Synthetic Polynucleotide
taatacgactcactatagggaaggaaacattcatgggaagaatggctactaacagaggagaagtagcatgtcttcccataacctggcggcagcgcaaaagatg

SEQ ID NO: 63763 - DNA, 103 bp, Artificial Sequence
  Synthetic Polynucleotide
taatacgactcactatagggtaaagaaggaaacattcatgggaagaatggaacagaggagaccattcatgccatgaatgaacctggcggcagcgcaaaagatg

SEQ ID NO: 63764 - DNA, 103 bp, Artificial Sequence
  Synthetic Polynucleotide
taatacgactcactatagggtttggtaaagaaggaaacattcatgggaagaacagaggagacttcccatgaatgtttccaacctggcggcagcgcaaaagatg

SEQ ID NO: 63765 - DNA, 103 bp, Artificial Sequence
  Synthetic Polynucleotide
taatacgactcactatagggtttcctttggtaaagaaggaaacattcatgaacagaggagacatgaaatgttccttcttaacctggcggcagcgcaaaagatg

SEQ ID NO: 63766 - DNA, 103 bp, Artificial Sequence
  Synthetic Polynucleotide
taatacgactcactatagggacgcatttcctttggtaaagaaggaaacataacagaggagaatgtttatgtctttaccaaacctggcggcagcgcaaaagatg

SEQ ID NO: 63767 - DNA, 103 bp, Artificial Sequence
  Synthetic Polynucleotide
taatacgactcactatagggcaatgacgcatttcctttggtaaagaaggaaacagaggagatccttcatgaccaaaggaaacctggcggcagcgcaaaagatg

SEQ ID NO: 63768 - DNA, 103 bp, Artificial Sequence
  Synthetic Polynucleotide
taatacgactcactatagggataatcaatgacgcatttcctttggtaaagaacagaggagactttacatgaggaaatgcaacctggcggcagcgcaaaagatg

SEQ ID NO: 63769 - DNA, 103 bp, Artificial Sequence
  Synthetic Polynucleotide
taatacgactcactataggggaattggtagatgacagtgatgtatgtacaaacagaggagatgtacaatgatcactgtcaacctggcggcagcgcaaaagatg

SEQ ID NO: 63770 - DNA, 103 bp, Artificial Sequence
  Synthetic Polynucleotide
taatacgactcactatagggggagaataatcaatgacgcatttcctttggaacagaggagaccaaagatgatgcgtcataacctggcggcagcgcaaaagatg

SEQ ID NO: 63771 - DNA, 103 bp, Artificial Sequence
  Synthetic Polynucleotide
taatacgactcactatagggaaacaggagaataatcaatgacgcatttccaacagaggagaggaaatatgtcattgattaacctggcggcagcgcaaaagatg

SEQ ID NO: 63772 - DNA, 103 bp, Artificial Sequence
  Synthetic Polynucleotide
taatacgactcactatagggaagtcaaacaggagaataatcaatgacgcaaacagaggagatgcgtcatggattattctaacctggcggcagcgcaaaagatg

SEQ ID NO: 63773 - DNA, 103 bp, Artificial Sequence
  Synthetic Polynucleotide
taatacgactcactatagggtagagaagtcaaacaggagaataatcaatgaacagaggagacattgaatgttctcctgtaacctggcggcagcgcaaaagatg

SEQ ID NO: 63774 - DNA, 103 bp, Artificial Sequence
  Synthetic Polynucleotide
taatacgactcactatagggattgatagagaagtcaaacaggagaataataacagaggagaattattatgctgtttgacaacctggcggcagcgcaaaagatg

SEQ ID NO: 63775 - DNA, 103 bp, Artificial Sequence
  Synthetic Polynucleotide
taatacgactcactataggggccgcattgatagagaagtcaaacaggagaaacagaggagatctcctatgtgacttctcaacctggcggcagcgcaaaagatg

SEQ ID NO: 63776 - DNA, 103 bp, Artificial Sequence
  Synthetic Polynucleotide
taatacgactcactataggggaggtgccgcattgatagagaagtcaaacaaacagaggagatgtttgatgtctctatcaaacctggcggcagcgcaaaagatg

SEQ ID NO: 63777 - DNA, 103 bp, Artificial Sequence
  Synthetic Polynucleotide
taatacgactcactatagggtaagagaggtgccgcattgatagagaagtcaacagaggagagacttcatgatcaatgcgaacctggcggcagcgcaaaagatg

SEQ ID NO: 63778 - DNA, 103 bp, Artificial Sequence
  Synthetic Polynucleotide
taatacgactcactatagggcttcttaagagaggtgccgcattgatagagaacagaggagactctatatgtgcggcaccaacctggcggcagcgcaaaagatg

SEQ ID NO: 63779 - DNA, 103 bp, Artificial Sequence
  Synthetic Polynucleotide
taatacgactcactatagggttacacttcttaagagaggtgccgcattgaaacagaggagatcaatgatgcacctctctaacctggcggcagcgcaaaagatg

SEQ ID NO: 63780 - DNA, 103 bp, Artificial Sequence
  Synthetic Polynucleotide
taatacgactcactatagggtggatgaattggtagatgacagtgatgtataacagaggagaatacatatgtgtcatctaaacctggcggcagcgcaaaagatg

SEQ ID NO: 63781 - DNA, 103 bp, Artificial Sequence
  Synthetic Polynucleotide
taatacgactcactatagggatcggttacacttcttaagagaggtgccgcaacagaggagagcggcaatgctcttaagaaacctggcggcagcgcaaaagatg

SEQ ID NO: 63782 - DNA, 103 bp, Artificial Sequence
  Synthetic Polynucleotide
taatacgactcactatagggttattatcggttacacttcttaagagaggtaacagaggagaacctctatgaagaagtgtaacctggcggcagcgcaaaagatg

SEQ ID NO: 63783 - DNA, 103 bp, Artificial Sequence
  Synthetic Polynucleotide
taatacgactcactatagggcaacattattatcggttacacttcttaagaaacagaggagatcttaaatggtgtaaccgaacctggcggcagcgcaaaagatg

SEQ ID NO: 63784 - DNA, 103 bp, Artificial Sequence
  Synthetic Polynucleotide
taatacgactcactatagggtataacaacattattatcggttacacttctaacagaggagaagaagtatgaccgataataacctggcggcagcgcaaaagatg

SEQ ID NO: 63785 - DNA, 103 bp, Artificial Sequence
  Synthetic Polynucleotide
taatacgactcactatagggctagatataacaacattattatcggttacaaacagaggagatgtaacatgtaataatgtaacctggcggcagcgcaaaagatg

SEQ ID NO: 63786 - DNA, 103 bp, Artificial Sequence
  Synthetic Polynucleotide
taatacgactcactatagggtgtgtctagatataacaacattattatcggaacagaggagaccgataatgatgttgttaaacctggcggcagcgcaaaagatg

SEQ ID NO: 63787 - DNA, 103 bp, Artificial Sequence
  Synthetic Polynucleotide
taatacgactcactatagggacgtttgtgtctagatataacaacattattaacagaggagaaataatatggttatatctaacctggcggcagcgcaaaagatg

SEQ ID NO: 63788 - DNA, 103 bp, Artificial Sequence
  Synthetic Polynucleotide
taatacgactcactatagggtgaagacgtttgtgtctagatataacaacaaacagaggagatgttgtatgatctagacaaacctggcggcagcgcaaaagatg

SEQ ID NO: 63789 - DNA, 103 bp, Artificial Sequence
  Synthetic Polynucleotide
taatacgactcactatagggcgccatgaagacgtttgtgtctagatataaaacagaggagattatatatggacacaaacaacctggcggcagcgcaaaagatg

SEQ ID NO: 63790 - DNA, 103 bp, Artificial Sequence
  Synthetic Polynucleotide
taatacgactcactatagggaatctcgccatgaagacgtttgtgtctagaaacagaggagatctagaatgaaacgtcttaacctggcggcagcgcaaaagatg

SEQ ID NO: 63791 - DNA, 103 bp, Artificial Sequence
  Synthetic Polynucleotide
taatacgactcactataggggataaactcatacaactagttcgtaaaaagaacagaggagactttttatgaactagttgaacctggcggcagcgcaaaagatg

SEQ ID NO: 63792 - DNA, 103 bp, Artificial Sequence
  Synthetic Polynucleotide
taatacgactcactataggggttgttggatgaattggtagatgacagtgaaacagaggagatcactgatgtctaccaataacctggcggcagcgcaaaagatg

SEQ ID NO: 63793 - DNA, 103 bp, Artificial Sequence
  Synthetic Polynucleotide
taatacgactcactatagggctcggaatctcgccatgaagacgtttgtgtaacagaggagaacacaaatgtcttcatggaacctggcggcagcgcaaaagatg

SEQ ID NO: 63794 - DNA, 103 bp, Artificial Sequence
  Synthetic Polynucleotide
taatacgactcactatagggtggaactcggaatctcgccatgaagacgttaacagaggagaaacgtcatgatggcgagaaacctggcggcagcgcaaaagatg

SEQ ID NO: 63795 - DNA, 103 bp, Artificial Sequence
  Synthetic Polynucleotide
taatacgactcactatagggccaattggaactcggaatctcgccatgaagaacagaggagacttcatatggagattccgaacctggcggcagcgcaaaagatg

SEQ ID NO: 63796 - DNA, 103 bp, Artificial Sequence
  Synthetic Polynucleotide
taatacgactcactatagggttgaaccaattggaactcggaatctcgccaaacagaggagatggcgaatgtccgagttcaacctggcggcagcgcaaaagatg

SEQ ID NO: 63797 - DNA, 103 bp, Artificial Sequence
  Synthetic Polynucleotide
taatacgactcactatagggaaaacttgaaccaattggaactcggaatctaacagaggagaagattcatggttccaattaacctggcggcagcgcaaaagatg

SEQ ID NO: 63798 - DNA, 103 bp, Artificial Sequence
  Synthetic Polynucleotide
taatacgactcactatagggtatataaaacttgaaccaattggaactcggaacagaggagaccgagtatgaattggttcaacctggcggcagcgcaaaagatg

SEQ ID NO: 63799 - DNA, 103 bp, Artificial Sequence
  Synthetic Polynucleotide
taatacgactcactatagggatacttatataaaacttgaaccaattggaaaacagaggagattccaaatggttcaagttaacctggcggcagcgcaaaagatg

SEQ ID NO: 63800 - DNA, 103 bp, Artificial Sequence
  Synthetic Polynucleotide
taatacgactcactatagggactttatacttatataaaacttgaaccaataacagaggagaattggtatgagttttataaacctggcggcagcgcaaaagatg

SEQ ID NO: 63801 - DNA, 103 bp, Artificial Sequence
  Synthetic Polynucleotide
taatacgactcactataggggttggactttatacttatataaaacttgaaaacagaggagattcaagatgtatataagtaacctggcggcagcgcaaaagatg

SEQ ID NO: 63802 - DNA, 103 bp, Artificial Sequence
  Synthetic Polynucleotide
taatacgactcactatagggcaatagttggactttatacttatataaaacaacagaggagagttttaatgaagtataaaaacctggcggcagcgcaaaagatg

SEQ ID NO: 63803 - DNA, 103 bp, Artificial Sequence
  Synthetic Polynucleotide
taatacgactcactatagggcttatgttgttggatgaattggtagatgacaacagaggagagtcatcatgcaattcatcaacctggcggcagcgcaaaagatg

SEQ ID NO: 63804 - DNA, 103 bp, Artificial Sequence
  Synthetic Polynucleotide
taatacgactcactatagggtagaacaatagttggactttatacttatataacagaggagaatataaatgtaaagtccaaacctggcggcagcgcaaaagatg

SEQ ID NO: 63805 - DNA, 103 bp, Artificial Sequence
  Synthetic Polynucleotide
taatacgactcactatagggtaatatagaacaatagttggactttatactaacagaggagaagtataatgtccaactataacctggcggcagcgcaaaagatg

SEQ ID NO: 63806 - DNA, 103 bp, Artificial Sequence
  Synthetic Polynucleotide
taatacgactcactatagggatatataatatagaacaatagttggactttaacagaggagaaaagtcatgctattgttcaacctggcggcagcgcaaaagatg

SEQ ID NO: 63807 - DNA, 103 bp, Artificial Sequence
  Synthetic Polynucleotide
taatacgactcactatagggctaccatatataatatagaacaatagttggaacagaggagaccaactatggttctatataacctggcggcagcgcaaaagatg

SEQ ID NO: 63808 - DNA, 103 bp, Artificial Sequence
  Synthetic Polynucleotide
taatacgactcactatagggatcaactaccatatataatatagaacaataaacagaggagatattgtatgatattatataacctggcggcagcgcaaaagatg

SEQ ID NO: 63809 - DNA, 103 bp, Artificial Sequence
  Synthetic Polynucleotide
taatacgactcactataggggatccatcaactaccatatataatatagaaaacagaggagattctatatgatatatggtaacctggcggcagcgcaaaagatg

SEQ ID NO: 63810 - DNA, 103 bp, Artificial Sequence
  Synthetic Polynucleotide
taatacgactcactatagggtcacagatccatcaactaccatatataataaacagaggagatattatatgtggtagttgaacctggcggcagcgcaaaagatg

SEQ ID NO: 63811 - DNA, 103 bp, Artificial Sequence
  Synthetic Polynucleotide
taatacgactcactatagggatacatcacagatccatcaactaccatataaacagaggagatatatgatggttgatggaaacctggcggcagcgcaaaagatg

SEQ ID NO: 63812 - DNA, 103 bp, Artificial Sequence
  Synthetic Polynucleotide
taatacgactcactatagggattgcatacatcacagatccatcaactaccaacagaggagaggtagtatgtggatctgtaacctggcggcagcgcaaaagatg

SEQ ID NO: 63813 - DNA, 103 bp, Artificial Sequence
  Synthetic Polynucleotide
taatacgactcactatagggcagctattgcatacatcacagatccatcaaaacagaggagattgatgatgctgtgatgtaacctggcggcagcgcaaaagatg

SEQ ID NO: 63814 - DNA, 103 bp, Artificial Sequence
  Synthetic Polynucleotide
taatacgactcactatagggaaaagcttatgttgttggatgaattggtagaacagaggagactaccaatgcatccaacaaacctggcggcagcgcaaaagatg

SEQ ID NO: 63815 - DNA, 103 bp, Artificial Sequence
  Synthetic Polynucleotide
taatacgactcactatagggattatcagctattgcatacatcacagatccaacagaggagaggatctatgatgtatgcaaacctggcggcagcgcaaaagatg

SEQ ID NO: 63816 - DNA, 103 bp, Artificial Sequence
  Synthetic Polynucleotide
taatacgactcactataggggttttattatcagctattgcatacatcacaaacagaggagatgtgatatgtgcaatagcaacctggcggcagcgcaaaagatg

SEQ ID NO: 63817 - DNA, 103 bp, Artificial Sequence
  Synthetic Polynucleotide
taatacgactcactatagggtgtgagttttattatcagctattgcatacaaacagaggagatgtatgatgtagctgataaacctggcggcagcgcaaaagatg

SEQ ID NO: 63818 - DNA, 103 bp, Artificial Sequence
  Synthetic Polynucleotide
taatacgactcactatagggaattgtgtgagttttattatcagctattgcaacagaggagagcaataatggataataaaaacctggcggcagcgcaaaagatg

SEQ ID NO: 63819 - DNA, 103 bp, Artificial Sequence
  Synthetic Polynucleotide
taatacgactcactatagggctaataattgtgtgagttttattatcagctaacagaggagaagctgaatgtaaaactcaaacctggcggcagcgcaaaagatg

SEQ ID NO: 63820 - DNA, 103 bp, Artificial Sequence
  Synthetic Polynucleotide
taatacgactcactatagggttttgctaataattgtgtgagttttattataacagaggagaataataatgctcacacaaaacctggcggcagcgcaaaagatg

SEQ ID NO: 63821 - DNA, 103 bp, Artificial Sequence
  Synthetic Polynucleotide
taatacgactcactatagggtatatttttgctaataattgtgtgagttttaacagaggagaaaaactatgacaattattaacctggcggcagcgcaaaagatg

SEQ ID NO: 63822 - DNA, 103 bp, Artificial Sequence
  Synthetic Polynucleotide
taatacgactcactatagggtctaatatatttttgctaataattgtgtgaaacagaggagatcacacatgtattagcaaaacctggcggcagcgcaaaagatg

SEQ ID NO: 63823 - DNA, 103 bp, Artificial Sequence
  Synthetic Polynucleotide
taatacgactcactatagggtattgtctaatatatttttgctaataattgaacagaggagacaattaatggcaaaaataaacctggcggcagcgcaaaagatg

SEQ ID NO: 63824 - DNA, 103 bp, Artificial Sequence
  Synthetic Polynucleotide
taatacgactcactatagggtgtagtattgtctaatatatttttgctaataacagaggagaattagcatgaatatattaaacctggcggcagcgcaaaagatg

SEQ ID NO: 63825 - DNA, 103 bp, Artificial Sequence
  Synthetic Polynucleotide
taatacgactcactatagggttttgaaaagcttatgttgttggatgaattaacagaggagaaattcaatgaacaacataaacctggcggcagcgcaaaagatg

SEQ ID NO: 63826 - DNA, 103 bp, Artificial Sequence
  Synthetic Polynucleotide
taatacgactcactatagggttaattgtagtattgtctaatatatttttgaacagaggagacaaaaaatgattagacaaaacctggcggcagcgcaaaagatg

SEQ ID NO: 63827 - DNA, 103 bp, Artificial Sequence
  Synthetic Polynucleotide
taatacgactcactatagggcatcgttaattgtagtattgtctaatatataacagaggagaatatatatgacaatactaaacctggcggcagcgcaaaagatg

SEQ ID NO: 63828 - DNA, 103 bp, Artificial Sequence
  Synthetic Polynucleotide
taatacgactcactataggggcactcatcgttaattgtagtattgtctaaaacagaggagattagacatgactacaattaacctggcggcagcgcaaaagatg

SEQ ID NO: 63829 - DNA, 103 bp, Artificial Sequence
  Synthetic Polynucleotide
taatacgactcactatagggcatctgcactcatcgttaattgtagtattgaacagaggagacaatacatgaattaacgaaacctggcggcagcgcaaaagatg

SEQ ID NO: 63830 - DNA, 103 bp, Artificial Sequence
  Synthetic Polynucleotide
taatacgactcactatagggaacagcatctgcactcatcgttaattgtagaacagaggagactacaaatgacgatgagtaacctggcggcagcgcaaaagatg

SEQ ID NO: 63831 - DNA, 103 bp, Artificial Sequence
  Synthetic Polynucleotide
taatacgactcactatagggaaaataacagcatctgcactcatcgttaataacagaggagaattaacatggagtgcagaaacctggcggcagcgcaaaagatg

SEQ ID NO: 63832 - DNA, 103 bp, Artificial Sequence
  Synthetic Polynucleotide
taatacgactcactatagggggttcaaaataacagcatctgcactcatcgaacagaggagacgatgaatgcagatgctgaacctggcggcagcgcaaaagatg

SEQ ID NO: 63833 - DNA, 103 bp, Artificial Sequence
  Synthetic Polynucleotide
taatacgactcactatagggtctgtggttcaaaataacagcatctgcactaacagaggagaagtgcaatggctgttattaacctggcggcagcgcaaaagatg

SEQ ID NO: 63834 - DNA, 103 bp, Artificial Sequence
  Synthetic Polynucleotide
taatacgactcactatagggcttaatctgtggttcaaaataacagcatctaacagaggagaagatgcatgtattttgaaaacctggcggcagcgcaaaagatg

SEQ ID NO: 63835 - DNA, 103 bp, Artificial Sequence
  Synthetic Polynucleotide
taatacgactcactatagggagaatcttaatctgtggttcaaaataacagaacagaggagactgttaatgtgaaccacaaacctggcggcagcgcaaaagatg

SEQ ID NO: 63836 - DNA, 103 bp, Artificial Sequence
  Synthetic Polynucleotide
taatacgactcactataggggatgattttgaaaagcttatgttgttggataacagaggagaatccaaatgcataagcttaacctggcggcagcgcaaaagatg

SEQ ID NO: 63837 - DNA, 103 bp, Artificial Sequence
  Synthetic Polynucleotide
taatacgactcactatagggtatcgagaatcttaatctgtggttcaaaataacagaggagaattttgatgcacagattaaacctggcggcagcgcaaaagatg

SEQ ID NO: 63838 - DNA, 103 bp, Artificial Sequence
  Synthetic Polynucleotide
taatacgactcactatagggatctctatcgagaatcttaatctgtggttcaacagaggagagaaccaatgattaagattaacctggcggcagcgcaaaagatg

SEQ ID NO: 63839 - DNA, 103 bp, Artificial Sequence
  Synthetic Polynucleotide
taatacgactcactatagggatctcatctctatcgagaatcttaatctgtaacagaggagaacagatatggattctcgaaacctggcggcagcgcaaaagatg

SEQ ID NO: 63840 - DNA, 103 bp, Artificial Sequence
  Synthetic Polynucleotide
taatacgactcactatagggtaagcatctcatctctatcgagaatcttaaaacagaggagattaagaatgtcgatagagaacctggcggcagcgcaaaagatg

SEQ ID NO: 63841 - DNA, 103 bp, Artificial Sequence
  Synthetic Polynucleotide
taatacgactcactatagggtccattaagcatctcatctctatcgagaataacagaggagaattctcatgagagatgagaacctggcggcagcgcaaaagatg

SEQ ID NO: 63842 - DNA, 103 bp, Artificial Sequence
  Synthetic Polynucleotide
taatacgactcactataggggatgatccattaagcatctcatctctatcgaacagaggagacgatagatgtgagatgctaacctggcggcagcgcaaaagatg

SEQ ID NO: 63843 - DNA, 103 bp, Artificial Sequence
  Synthetic Polynucleotide
taatacgactcactatagggcacacgatgatccattaagcatctcatctcaacagaggagagagatgatgtgcttaatgaacctggcggcagcgcaaaagatg

SEQ ID NO: 63844 - DNA, 103 bp, Artificial Sequence
  Synthetic Polynucleotide
taatacgactcactatagggcatatcacacgatgatccattaagcatctcaacagaggagagagatgatgaatggatcaaacctggcggcagcgcaaaagatg

SEQ ID NO: 63845 - DNA, 103 bp, Artificial Sequence
  Synthetic Polynucleotide
taatacgactcactatagggctgttcatatcacacgatgatccattaagcaacagaggagagcttaaatgatcatcgtgaacctggcggcagcgcaaaagatg

SEQ ID NO: 63846 - DNA, 103 bp, Artificial Sequence
  Synthetic Polynucleotide
taatacgactcactatagggaatgtctgttcatatcacacgatgatccataacagaggagaatggatatgcgtgtgataaacctggcggcagcgcaaaagatg

SEQ ID NO: 63847 - DNA, 103 bp, Artificial Sequence
  Synthetic Polynucleotide
taatacgactcactatagggataatgatgattttgaaaagcttatgttgtaacagaggagaacaacaatggcttttcaaaacctggcggcagcgcaaaagatg

SEQ ID NO: 63848 - DNA, 103 bp, Artificial Sequence
  Synthetic Polynucleotide
taatacgactcactatagggaatacaatgtctgttcatatcacacgatgaaacagaggagatcatcgatggatatgaacaacctggcggcagcgcaaaagatg

SEQ ID NO: 63849 - DNA, 103 bp, Artificial Sequence
  Synthetic Polynucleotide
taatacgactcactatagggatcataatacaatgtctgttcatatcacacaacagaggagagtgtgaatggaacagacaaacctggcggcagcgcaaaagatg

SEQ ID NO: 63850 - DNA, 103 bp, Artificial Sequence
  Synthetic Polynucleotide
taatacgactcactatagggaattcatcataatacaatgtctgttcatataacagaggagaatatgaatggacattgtaaacctggcggcagcgcaaaagatg

SEQ ID NO: 63851 - DNA, 103 bp, Artificial Sequence
  Synthetic Polynucleotide
taatacgactcactatagggtggtaaattcatcataatacaatgtctgttaacagaggagaaacagaatgtgtattatgaacctggcggcagcgcaaaagatg

SEQ ID NO: 63852 - DNA, 103 bp, Artificial Sequence
  Synthetic Polynucleotide
taatacgactcactatagggatatctggtaaattcatcataatacaatgtaacagaggagaacattgatgtatgatgaaaacctggcggcagcgcaaaagatg

SEQ ID NO: 63853 - DNA, 103 bp, Artificial Sequence
  Synthetic Polynucleotide
taatacgactcactatagggctcctatatctggtaaattcatcataatacaacagaggagagtattaatgtgaatttacaacctggcggcagcgcaaaagatg

SEQ ID NO: 63854 - DNA, 103 bp, Artificial Sequence
  Synthetic Polynucleotide
taatacgactcactataggggaattctcctatatctggtaaattcatcataacagaggagaatgatgatgttaccagataacctggcggcagcgcaaaagatg

SEQ ID NO: 63855 - DNA, 103 bp, Artificial Sequence
  Synthetic Polynucleotide
taatacgactcactataggggaaccgaattctcctatatctggtaaattcaacagaggagagaatttatgagatataggaacctggcggcagcgcaaaagatg

SEQ ID NO: 63856 - DNA, 103 bp, Artificial Sequence
  Synthetic Polynucleotide
taatacgactcactatagggtactggaaccgaattctcctatatctggtaaacagaggagataccagatgtaggagaataacctggcggcagcgcaaaagatg

SEQ ID NO: 63857 - DNA, 103 bp, Artificial Sequence
  Synthetic Polynucleotide
taatacgactcactatagggcaatatactggaaccgaattctcctatatcaacagaggagagatataatggaattcggtaacctggcggcagcgcaaaagatg

SEQ ID NO: 63858 - DNA, 103 bp, Artificial Sequence
  Synthetic Polynucleotide
taatacgactcactatagggatattataatgatgattttgaaaagcttataacagaggagaataagcatgtcaaaatcaaacctggcggcagcgcaaaagatg

SEQ ID NO: 63859 - DNA, 103 bp, Artificial Sequence
  Synthetic Polynucleotide
taatacgactcactatagggttccccaatatactggaaccgaattctcctaacagaggagaaggagaatgcggttccagaacctggcggcagcgcaaaagatg

SEQ ID NO: 63860 - DNA, 103 bp, Artificial Sequence
  Synthetic Polynucleotide
taatacgactcactatagggcatatttccccaatatactggaaccgaattaacagaggagaaattcgatgccagtatataacctggcggcagcgcaaaagatg

SEQ ID NO: 63861 - DNA, 103 bp, Artificial Sequence
  Synthetic Polynucleotide
taatacgactcactatagggaggttcatatttccccaatatactggaaccaacagaggagaggttccatgatattggggaacctggcggcagcgcaaaagatg

SEQ ID NO: 63862 - DNA, 103 bp, Artificial Sequence
  Synthetic Polynucleotide
taatacgactcactatagggatgtcaggttcatatttccccaatatactgaacagaggagacagtatatgggggaaataaacctggcggcagcgcaaaagatg

SEQ ID NO: 63863 - DNA, 103 bp, Artificial Sequence
  Synthetic Polynucleotide
taatacgactcactatagggtaatcatgtcaggttcatatttccccaataaacagaggagatattggatgaatatgaacaacctggcggcagcgcaaaagatg

SEQ ID NO: 63864 - DNA, 103 bp, Artificial Sequence
  Synthetic Polynucleotide
taatacgactcactatagggaatcttaatcatgtcaggttcatatttcccaacagaggagagggaaaatggaacctgacaacctggcggcagcgcaaaagatg

SEQ ID NO: 63865 - DNA, 103 bp, Artificial Sequence
  Synthetic Polynucleotide
taatacgactcactatagggagagcaatcttaatcatgtcaggttcatataacagaggagaatatgaatgtgacatgataacctggcggcagcgcaaaagatg

SEQ ID NO: 63866 - DNA, 103 bp, Artificial Sequence
  Synthetic Polynucleotide
taatacgactcactatagggctgaaagagcaatcttaatcatgtcaggttaacagaggagaaacctgatgtgattaagaaacctggcggcagcgcaaaagatg

SEQ ID NO: 63867 - DNA, 103 bp, Artificial Sequence
  Synthetic Polynucleotide
taatacgactcactatagggagccactgaaagagcaatcttaatcatgtcaacagaggagagacatgatgaagattgctaacctggcggcagcgcaaaagatg

SEQ ID NO: 63868 - DNA, 103 bp, Artificial Sequence
  Synthetic Polynucleotide
taatacgactcactatagggttaccagccactgaaagagcaatcttaatcaacagaggagagattaaatgtgctctttcaacctggcggcagcgcaaaagatg

SEQ ID NO: 63869 - DNA, 103 bp, Artificial Sequence
  Synthetic Polynucleotide
taatacgactcactatagggccatcatattataatgatgattttgaaaagaacagaggagacttttcatgatcatcattaacctggcggcagcgcaaaagatg

SEQ ID NO: 63870 - DNA, 103 bp, Artificial Sequence
  Synthetic Polynucleotide
taatacgactcactatagggttaaattaccagccactgaaagagcaatctaacagaggagaagattgatgtttcagtggaacctggcggcagcgcaaaagatg

SEQ ID NO: 63871 - DNA, 103 bp, Artificial Sequence
  Synthetic Polynucleotide
taatacgactcactatagggtcttattaaattaccagccactgaaagagcaacagaggagagctcttatggtggctggtaacctggcggcagcgcaaaagatg

SEQ ID NO: 63872 - DNA, 103 bp, Artificial Sequence
  Synthetic Polynucleotide
taatacgactcactatagggtgatttcttattaaattaccagccactgaaaacagaggagattcagtatgtggtaatttaacctggcggcagcgcaaaagatg

SEQ ID NO: 63873 - DNA, 103 bp, Artificial Sequence
  Synthetic Polynucleotide
taatacgactcactatagggagtcttgatttcttattaaattaccagccaaacagaggagatggctgatgatttaataaaacctggcggcagcgcaaaagatg

SEQ ID NO: 63874 - DNA, 103 bp, Artificial Sequence
  Synthetic Polynucleotide
taatacgactcactatagggaatgtagtcttgatttcttattaaattaccaacagaggagaggtaatatgataagaaataacctggcggcagcgcaaaagatg

SEQ ID NO: 63875 - DNA, 103 bp, Artificial Sequence
  Synthetic Polynucleotide
taatacgactcactatagggccgggaatgtagtcttgatttcttattaaaaacagaggagatttaatatgaaatcaagaaacctggcggcagcgcaaaagatg

SEQ ID NO: 63876 - DNA, 103 bp, Artificial Sequence
  Synthetic Polynucleotide
taatacgactcactataggggtctcccgggaatgtagtcttgatttcttaaacagaggagataagaaatgaagactacaaacctggcggcagcgcaaaagatg

SEQ ID NO: 63877 - DNA, 103 bp, Artificial Sequence
  Synthetic Polynucleotide
taatacgactcactataggggccgcgtctcccgggaatgtagtcttgattaacagaggagaaatcaaatgtacattcccaacctggcggcagcgcaaaagatg

SEQ ID NO: 63878 - DNA, 103 bp, Artificial Sequence
  Synthetic Polynucleotide
taatacgactcactatagggctatagccgcgtctcccgggaatgtagtctaacagaggagaagactaatgtcccgggagaacctggcggcagcgcaaaagatg

SEQ ID NO: 63879 - DNA, 103 bp, Artificial Sequence
  Synthetic Polynucleotide
taatacgactcactatagggagtagctatagccgcgtctcccgggaatgtaacagaggagaacattcatgggagacgcgaacctggcggcagcgcaaaagatg

SEQ ID NO: 63880 - DNA, 103 bp, Artificial Sequence
  Synthetic Polynucleotide
taatacgactcactataggggcgatccatcatattataatgatgattttgaacagaggagacaaaatatgcattataataacctggcggcagcgcaaaagatg

SEQ ID NO: 63881 - DNA, 103 bp, Artificial Sequence
  Synthetic Polynucleotide
taatacgactcactatagggaacgtagtagctatagccgcgtctcccgggaacagaggagacccgggatgcgcggctataacctggcggcagcgcaaaagatg

SEQ ID NO: 63882 - DNA, 103 bp, Artificial Sequence
  Synthetic Polynucleotide
taatacgactcactatagggccgtaaacgtagtagctatagccgcgtctcaacagaggagagagacgatgctatagctaaacctggcggcagcgcaaaagatg

SEQ ID NO: 63883 - DNA, 103 bp, Artificial Sequence
  Synthetic Polynucleotide
taatacgactcactatagggctataccgtaaacgtagtagctatagccgcaacagaggagagcggctatggctactacgaacctggcggcagcgcaaaagatg

SEQ ID NO: 63884 - DNA, 103 bp, Artificial Sequence
  Synthetic Polynucleotide
taatacgactcactatagggagaggctataccgtaaacgtagtagctataaacagaggagatatagcatgtacgtttacaacctggcggcagcgcaaaagatg

SEQ ID NO: 63885 - DNA, 103 bp, Artificial Sequence
  Synthetic Polynucleotide
taatacgactcactatagggtatctagaggctataccgtaaacgtagtagaacagaggagactactaatgttacggtataacctggcggcagcgcaaaagatg

SEQ ID NO: 63886 - DNA, 103 bp, Artificial Sequence
  Synthetic Polynucleotide
taatacgactcactatagggaaaattatctagaggctataccgtaaacgtaacagaggagaacgtttatggtatagcctaacctggcggcagcgcaaaagatg

SEQ ID NO: 63887 - DNA, 103 bp, Artificial Sequence
  Synthetic Polynucleotide
taatacgactcactatagggcttaaaaaattatctagaggctataccgtaaacagaggagatacggtatggcctctagaaacctggcggcagcgcaaaagatg

SEQ ID NO: 63888 - DNA, 103 bp, Artificial Sequence
  Synthetic Polynucleotide
taatacgactcactatagggttgtgcttaaaaaattatctagaggctataaacagaggagatatagcatgtagataattaacctggcggcagcgcaaaagatg

SEQ ID NO: 63889 - DNA, 103 bp, Artificial Sequence
  Synthetic Polynucleotide
taatacgactcactatagggttattttgtgcttaaaaaattatctagaggaacagaggagacctctaatgaattttttaaacctggcggcagcgcaaaagatg

SEQ ID NO: 63890 - DNA, 103 bp, Artificial Sequence
  Synthetic Polynucleotide
taatacgactcactataggggttttttattttgtgcttaaaaaattatctaacagaggagaagataaatgtttaagcacaacctggcggcagcgcaaaagatg

SEQ ID NO: 63891 - DNA, 103 bp, Artificial Sequence
  Synthetic Polynucleotide
taatacgactcactatagggtgatggcgatccatcatattataatgatgaaacagaggagatcatcaatgtaatatgataacctggcggcagcgcaaaagatg

SEQ ID NO: 63892 - DNA, 103 bp, Artificial Sequence
  Synthetic Polynucleotide
taatacgactcactatagggattatgttttttattttgtgcttaaaaaataacagaggagaatttttatggcacaaaataacctggcggcagcgcaaaagatg

SEQ ID NO: 63893 - DNA, 103 bp, Artificial Sequence
  Synthetic Polynucleotide
taatacgactcactatagggttaaaattatgttttttattttgtgcttaaaacagaggagattaagcatgaaataaaaaaacctggcggcagcgcaaaagatg

SEQ ID NO: 63894 - DNA, 103 bp, Artificial Sequence
  Synthetic Polynucleotide
taatacgactcactatagggctagtttaaaattatgttttttattttgtgaacagaggagacacaaaatgaaaaacataaacctggcggcagcgcaaaagatg

SEQ ID NO: 63895 - DNA, 103 bp, Artificial Sequence
  Synthetic Polynucleotide
taatacgactcactatagggatagactagtttaaaattatgttttttattaacagaggagaaataaaatgcataattttaacctggcggcagcgcaaaagatg

SEQ ID NO: 63896 - DNA, 103 bp, Artificial Sequence
  Synthetic Polynucleotide
taatacgactcactatagggatgaaatagactagtttaaaattatgttttaacagaggagaaaaacaatgttttaaactaacctggcggcagcgcaaaagatg

SEQ ID NO: 63897 - DNA, 103 bp, Artificial Sequence
  Synthetic Polynucleotide
taatacgactcactatagggatagtatgaaatagactagtttaaaattataacagaggagaataattatgaactagtctaacctggcggcagcgcaaaagatg

SEQ ID NO: 63898 - DNA, 103 bp, Artificial Sequence
  Synthetic Polynucleotide
taatacgactcactatagggacaaaatagtatgaaatagactagtttaaaaacagaggagatttaaaatggtctatttcaacctggcggcagcgcaaaagatg

SEQ ID NO: 63899 - DNA, 103 bp, Artificial Sequence
  Synthetic Polynucleotide
taatacgactcactatagggatcacacaaaatagtatgaaatagactagtaacagaggagaactagtatgtttcatactaacctggcggcagcgcaaaagatg

SEQ ID NO: 63900 - DNA, 103 bp, Artificial Sequence
  Synthetic Polynucleotide
taatacgactcactatagggtggtgatcacacaaaatagtatgaaatagaaacagaggagatctattatgtactattttaacctggcggcagcgcaaaagatg

SEQ ID NO: 63901 - DNA, 103 bp, Artificial Sequence
  Synthetic Polynucleotide
taatacgactcactataggggtccatggtgatcacacaaaatagtatgaaaacagaggagattcataatgttttgtgtgaacctggcggcagcgcaaaagatg

SEQ ID NO: 63902 - DNA, 103 bp, Artificial Sequence
  Synthetic Polynucleotide
taatacgactcactatagggtaaacgataaactcatacaactagttcgtaaacagaggagatacgaaatggttgtatgaaacctggcggcagcgcaaaagatg

SEQ ID NO: 63903 - DNA, 103 bp, Artificial Sequence
  Synthetic Polynucleotide
taatacgactcactatagggagaaatgatggcgatccatcatattataataacagaggagaattataatgtgatggatcaacctggcggcagcgcaaaagatg

SEQ ID NO: 63904 - DNA, 103 bp, Artificial Sequence
  Synthetic Polynucleotide
taatacgactcactatagggtttatgtccatggtgatcacacaaaatagtaacagaggagaactattatgtgtgatcacaacctggcggcagcgcaaaagatg

SEQ ID NO: 63905 - DNA, 103 bp, Artificial Sequence
  Synthetic Polynucleotide
taatacgactcactatagggctatctttatgtccatggtgatcacacaaaaacagaggagatttgtgatgtcaccatggaacctggcggcagcgcaaaagatg

SEQ ID NO: 63906 - DNA, 103 bp, Artificial Sequence
  Synthetic Polynucleotide
taatacgactcactatagggaatatctatctttatgtccatggtgatcacaacagaggagagtgatcatgatggacataaacctggcggcagcgcaaaagatg

SEQ ID NO: 63907 - DNA, 103 bp, Artificial Sequence
  Synthetic Polynucleotide
taatacgactcactatagggatactaatatctatctttatgtccatggtgaacagaggagacaccatatgcataaagataacctggcggcagcgcaaaagatg

SEQ ID NO: 63908 - DNA, 103 bp, Artificial Sequence
  Synthetic Polynucleotide
taatacgactcactatagggcaaaaatactaatatctatctttatgtccaaacagaggagatggacaatgagatagataaacctggcggcagcgcaaaagatg

SEQ ID NO: 63909 - DNA, 103 bp, Artificial Sequence
  Synthetic Polynucleotide
taatacgactcactatagggatcaccaaaaatactaatatctatctttataacagaggagaataaagatggatattagtaacctggcggcagcgcaaaagatg

SEQ ID NO: 63910 - DNA, 103 bp, Artificial Sequence
  Synthetic Polynucleotide
taatacgactcactatagggaatttatcaccaaaaatactaatatctatcaacagaggagagatagaatgtagtattttaacctggcggcagcgcaaaagatg

SEQ ID NO: 63911 - DNA, 103 bp, Artificial Sequence
  Synthetic Polynucleotide
taatacgactcactatagggccgtaaatttatcaccaaaaatactaatataacagaggagaatattaatgtttttggtgaacctggcggcagcgcaaaagatg

SEQ ID NO: 63912 - DNA, 103 bp, Artificial Sequence
  Synthetic Polynucleotide
taatacgactcactatagggagtcaccgtaaatttatcaccaaaaatactaacagaggagaagtattatgggtgataaaaacctggcggcagcgcaaaagatg

SEQ ID NO: 63913 - DNA, 103 bp, Artificial Sequence
  Synthetic Polynucleotide
taatacgactcactatagggctagtagtcaccgtaaatttatcaccaaaaaacagaggagattttggatgtaaatttacaacctggcggcagcgcaaaagatg

SEQ ID NO: 63914 - DNA, 103 bp, Artificial Sequence
  Synthetic Polynucleotide
taatacgactcactatagggtttggagaaatgatggcgatccatcatattaacagaggagaaatatgatggatcgccataacctggcggcagcgcaaaagatg

SEQ ID NO: 63915 - DNA, 103 bp, Artificial Sequence
  Synthetic Polynucleotide
taatacgactcactatagggccctcctagtagtcaccgtaaatttatcacaacagaggagagtgataatgttacggtgaaacctggcggcagcgcaaaagatg

SEQ ID NO: 63916 - DNA, 103 bp, Artificial Sequence
  Synthetic Polynucleotide
taatacgactcactatagggattttccctcctagtagtcaccgtaaatttaacagaggagaaaatttatggtgactactaacctggcggcagcgcaaaagatg

SEQ ID NO: 63917 - DNA, 103 bp, Artificial Sequence
  Synthetic Polynucleotide
taatacgactcactatagggtcttcattttccctcctagtagtcaccgtaaacagaggagatacggtatgtactaggagaacctggcggcagcgcaaaagatg

SEQ ID NO: 63918 - DNA, 103 bp, Artificial Sequence
  Synthetic Polynucleotide
taatacgactcactatagggttctttcttcattttccctcctagtagtcaaacagaggagatgactaatgggagggaaaaacctggcggcagcgcaaaagatg

SEQ ID NO: 63919 - DNA, 103 bp, Artificial Sequence
  Synthetic Polynucleotide
taatacgactcactatagggattttttctttcttcattttccctcctagtaacagaggagaactaggatggaaaatgaaaacctggcggcagcgcaaaagatg

SEQ ID NO: 63920 - DNA, 103 bp, Artificial Sequence
  Synthetic Polynucleotide
taatacgactcactatagggtagatattttttctttcttcattttccctcaacagaggagagagggaatgtgaagaaagaacctggcggcagcgcaaaagatg

SEQ ID NO: 63921 - DNA, 103 bp, Artificial Sequence
  Synthetic Polynucleotide
taatacgactcactatagggagaggtagatattttttctttcttcattttaacagaggagaaaaatgatgaaagaaaaaaacctggcggcagcgcaaaagatg

SEQ ID NO: 63922 - DNA, 103 bp, Artificial Sequence
  Synthetic Polynucleotide
taatacgactcactatagggtttggagaggtagatattttttctttcttcaacagaggagagaagaaatgaaaaatatcaacctggcggcagcgcaaaagatg

SEQ ID NO: 63923 - DNA, 103 bp, Artificial Sequence
  Synthetic Polynucleotide
taatacgactcactatagggttctttttggagaggtagatattttttcttaacagaggagaaagaaaatgtatctacctaacctggcggcagcgcaaaagatg

SEQ ID NO: 63924 - DNA, 103 bp, Artificial Sequence
  Synthetic Polynucleotide
taatacgactcactatagggaatttttctttttggagaggtagatattttaacagaggagaaaaataatgacctctccaaacctggcggcagcgcaaaagatg

SEQ ID NO: 63925 - DNA, 103 bp, Artificial Sequence
  Synthetic Polynucleotide
taatacgactcactatagggtattctttggagaaatgatggcgatccatcaacagaggagagatggaatgccatcatttaacctggcggcagcgcaaaagatg

SEQ ID NO: 63926 - DNA, 103 bp, Artificial Sequence
  Synthetic Polynucleotide
taatacgactcactatagggtagtaaatttttctttttggagaggtagataacagaggagaatctacatgtccaaaaagaacctggcggcagcgcaaaagatg

SEQ ID NO: 63927 - DNA, 103 bp, Artificial Sequence
  Synthetic Polynucleotide
taatacgactcactatagggatcagtagtaaatttttctttttggagaggaacagaggagacctctcatgaaagaaaaaaacctggcggcagcgcaaaagatg

SEQ ID NO: 63928 - DNA, 103 bp, Artificial Sequence
  Synthetic Polynucleotide
taatacgactcactatagggataacatcagtagtaaatttttctttttggaacagaggagaccaaaaatgaaaatttacaacctggcggcagcgcaaaagatg

SEQ ID NO: 63929 - DNA, 103 bp, Artificial Sequence
  Synthetic Polynucleotide
taatacgactcactataggggtttgataacatcagtagtaaatttttcttaacagaggagaaagaaaatgttactactgaacctggcggcagcgcaaaagatg

SEQ ID NO: 63930 - DNA, 103 bp, Artificial Sequence
  Synthetic Polynucleotide
taatacgactcactatagggattaggtttgataacatcagtagtaaatttaacagaggagaaaatttatgactgatgttaacctggcggcagcgcaaaagatg

SEQ ID NO: 63931 - DNA, 103 bp, Artificial Sequence
  Synthetic Polynucleotide
taatacgactcactatagggagataattaggtttgataacatcagtagtaaacagaggagatactacatgtgttatcaaaacctggcggcagcgcaaaagatg

SEQ ID NO: 63932 - DNA, 103 bp, Artificial Sequence
  Synthetic Polynucleotide
taatacgactcactataggggctcaagataattaggtttgataacatcagaacagaggagactgatgatgtcaaacctaaacctggcggcagcgcaaaagatg

SEQ ID NO: 63933 - DNA, 103 bp, Artificial Sequence
  Synthetic Polynucleotide
taatacgactcactatagggatcgtgctcaagataattaggtttgataacaacagaggagagttatcatgcctaattataacctggcggcagcgcaaaagatg

SEQ ID NO: 63934 - DNA, 103 bp, Artificial Sequence
  Synthetic Polynucleotide
taatacgactcactatagggaagttatcgtgctcaagataattaggtttgaacagaggagacaaaccatgttatcttgaaacctggcggcagcgcaaaagatg

SEQ ID NO: 63935 - DNA, 103 bp, Artificial Sequence
  Synthetic Polynucleotide
taatacgactcactatagggctaataagttatcgtgctcaagataattagaacagaggagactaattatgttgagcacgaacctggcggcagcgcaaaagatg

SEQ ID NO: 63936 - DNA, 103 bp, Artificial Sequence
  Synthetic Polynucleotide
taatacgactcactatagggagatatattctttggagaaatgatggcgataacagaggagaatcgccatgatttctccaaacctggcggcagcgcaaaagatg

SEQ ID NO: 63937 - DNA, 103 bp, Artificial Sequence
  Synthetic Polynucleotide
taatacgactcactatagggtctatctaataagttatcgtgctcaagataaacagaggagatatcttatgcacgataacaacctggcggcagcgcaaaagatg

SEQ ID NO: 63938 - DNA, 103 bp, Artificial Sequence
  Synthetic Polynucleotide
taatacgactcactatagggtcatctctatctaataagttatcgtgctcaaacagaggagatgagcaatgtaacttattaacctggcggcagcgcaaaagatg

SEQ ID NO: 63939 - DNA, 103 bp, Artificial Sequence
  Synthetic Polynucleotide
taatacgactcactatagggacatctcatctctatctaataagttatcgtaacagaggagaacgataatgtattagataaacctggcggcagcgcaaaagatg

SEQ ID NO: 63940 - DNA, 103 bp, Artificial Sequence
  Synthetic Polynucleotide
taatacgactcactatagggagtagacatctcatctctatctaataagttaacagaggagaaacttaatggatagagataacctggcggcagcgcaaaagatg

SEQ ID NO: 63941 - DNA, 103 bp, Artificial Sequence
  Synthetic Polynucleotide
taatacgactcactatagggagaatagtagacatctcatctctatctaataacagaggagaattagaatgagatgagataacctggcggcagcgcaaaagatg

SEQ ID NO: 63942 - DNA, 103 bp, Artificial Sequence
  Synthetic Polynucleotide
taatacgactcactatagggcctctagaatagtagacatctcatctctataacagaggagaatagagatgagatgtctaaacctggcggcagcgcaaaagatg

SEQ ID NO: 63943 - DNA, 103 bp, Artificial Sequence
  Synthetic Polynucleotide
taatacgactcactatagggatattcctctagaatagtagacatctcatcaacagaggagagatgagatgtctactattaacctggcggcagcgcaaaagatg

SEQ ID NO: 63944 - DNA, 103 bp, Artificial Sequence
  Synthetic Polynucleotide
taatacgactcactatagggataaaatattcctctagaatagtagacatcaacagaggagagatgtcatgtattctagaaacctggcggcagcgcaaaagatg

SEQ ID NO: 63945 - DNA, 103 bp, Artificial Sequence
  Synthetic Polynucleotide
taatacgactcactatagggtgtacataaaatattcctctagaatagtagaacagaggagactactaatgtagaggaataacctggcggcagcgcaaaagatg

SEQ ID NO: 63946 - DNA, 103 bp, Artificial Sequence
  Synthetic Polynucleotide
taatacgactcactatagggacctctgtacataaaatattcctctagaataacagaggagaattctaatggaatattttaacctggcggcagcgcaaaagatg

SEQ ID NO: 63947 - DNA, 103 bp, Artificial Sequence
  Synthetic Polynucleotide
taatacgactcactatagggttattagatatattctttggagaaatgatgaacagaggagacatcatatgtccaaagaaaacctggcggcagcgcaaaagatg

SEQ ID NO: 63948 - DNA, 103 bp, Artificial Sequence
  Synthetic Polynucleotide
taatacgactcactatagggaatagacctctgtacataaaatattcctctaacagaggagaagaggaatgttttatgtaaacctggcggcagcgcaaaagatg

SEQ ID NO: 63949 - DNA, 103 bp, Artificial Sequence
  Synthetic Polynucleotide
taatacgactcactatagggggcctaatagacctctgtacataaaatattaacagaggagaaatattatgtgtacagagaacctggcggcagcgcaaaagatg

SEQ ID NO: 63950 - DNA, 103 bp, Artificial Sequence
  Synthetic Polynucleotide
taatacgactcactatagggtctgaggcctaatagacctctgtacataaaaacagaggagatttatgatgagaggtctaaacctggcggcagcgcaaaagatg

SEQ ID NO: 63951 - DNA, 103 bp, Artificial Sequence
  Synthetic Polynucleotide
taatacgactcactatagggtttattctgaggcctaatagacctctgtacaacagaggagagtacagatgtctattaggaacctggcggcagcgcaaaagatg

SEQ ID NO: 63952 - DNA, 103 bp, Artificial Sequence
  Synthetic Polynucleotide
taatacgactcactatagggcatattttattctgaggcctaatagacctcaacagaggagagaggtcatgtaggcctcaaacctggcggcagcgcaaaagatg

SEQ ID NO: 63953 - DNA, 103 bp, Artificial Sequence
  Synthetic Polynucleotide
taatacgactcactatagggtcgtccatattttattctgaggcctaatagaacagaggagactattaatgctcagaataaacctggcggcagcgcaaaagatg

SEQ ID NO: 63954 - DNA, 103 bp, Artificial Sequence
  Synthetic Polynucleotide
taatacgactcactatagggaaaagtcgtccatattttattctgaggcctaacagaggagaaggcctatgaataaaataaacctggcggcagcgcaaaagatg

SEQ ID NO: 63955 - DNA, 103 bp, Artificial Sequence
  Synthetic Polynucleotide
taatacgactcactatagggcgttaaaaagtcgtccatattttattctgaaacagaggagatcagaaatgaatatggacaacctggcggcagcgcaaaagatg

SEQ ID NO: 63956 - DNA, 103 bp, Artificial Sequence
  Synthetic Polynucleotide
taatacgactcactatagggaatttcgttaaaaagtcgtccatattttataacagaggagaataaaaatgggacgacttaacctggcggcagcgcaaaagatg

SEQ ID NO: 63957 - DNA, 103 bp, Artificial Sequence
  Synthetic Polynucleotide
taatacgactcactatagggtttctaatttcgttaaaaagtcgtccatataacagaggagaatatggatgactttttaaaacctggcggcagcgcaaaagatg

SEQ ID NO: 63958 - DNA, 103 bp, Artificial Sequence
  Synthetic Polynucleotide
taatacgactcactatagggtctacttattagatatattctttggagaaaaacagaggagatttctcatgagaatatataacctggcggcagcgcaaaagatg

SEQ ID NO: 63959 - DNA, 103 bp, Artificial Sequence
  Synthetic Polynucleotide
taatacgactcactatagggcgaattttctaatttcgttaaaaagtcgtcaacagaggagagacgacatgttaacgaaaaacctggcggcagcgcaaaagatg

SEQ ID NO: 63960 - DNA, 103 bp, Artificial Sequence
  Synthetic Polynucleotide
taatacgactcactatagggattgtcgaattttctaatttcgttaaaaagaacagaggagactttttatggaaattagaaacctggcggcagcgcaaaagatg

SEQ ID NO: 63961 - DNA, 103 bp, Artificial Sequence
  Synthetic Polynucleotide
taatacgactcactataggggcatcattgtcgaattttctaatttcgttaaacagaggagataacgaatgtagaaaattaacctggcggcagcgcaaaagatg

SEQ ID NO: 63962 - DNA, 103 bp, Artificial Sequence
  Synthetic Polynucleotide
taatacgactcactatagggcttccgcatcattgtcgaattttctaatttaacagaggagaaaattaatgaattcgacaaacctggcggcagcgcaaaagatg

SEQ ID NO: 63963 - DNA, 103 bp, Artificial Sequence
  Synthetic Polynucleotide
taatacgactcactatagggttgttcttccgcatcattgtcgaattttctaacagaggagaagaaaaatggacaatgataacctggcggcagcgcaaaagatg

SEQ ID NO: 63964 - DNA, 103 bp, Artificial Sequence
  Synthetic Polynucleotide
taatacgactcactatagggccgaattgttcttccgcatcattgtcgaataacagaggagaattcgaatgtgatgcggaaacctggcggcagcgcaaaagatg

SEQ ID NO: 63965 - DNA, 103 bp, Artificial Sequence
  Synthetic Polynucleotide
taatacgactcactatagggtagtaccgaattgttcttccgcatcattgtaacagaggagaacaatgatgcggaagaacaacctggcggcagcgcaaaagatg

SEQ ID NO: 63966 - DNA, 103 bp, Artificial Sequence
  Synthetic Polynucleotide
taatacgactcactatagggttctatagtaccgaattgttcttccgcatcaacagaggagagatgcgatggaacaattcaacctggcggcagcgcaaaagatg

SEQ ID NO: 63967 - DNA, 103 bp, Artificial Sequence
  Synthetic Polynucleotide
taatacgactcactatagggagttcttctatagtaccgaattgttcttccaacagaggagaggaagaatgattcggtacaacctggcggcagcgcaaaagatg

SEQ ID NO: 63968 - DNA, 103 bp, Artificial Sequence
  Synthetic Polynucleotide
taatacgactcactataggggtttgagttcttctatagtaccgaattgttaacagaggagaaacaatatggtactatagaacctggcggcagcgcaaaagatg

SEQ ID NO: 63969 - DNA, 103 bp, Artificial Sequence
  Synthetic Polynucleotide
taatacgactcactatagggaggactctacttattagatatattctttggaacagaggagaccaaagatgatatctaataacctggcggcagcgcaaaagatg

SEQ ID NO: 63970 - DNA, 103 bp, Artificial Sequence
  Synthetic Polynucleotide
taatacgactcactatagggtttctgtttgagttcttctatagtaccgaaaacagaggagattcggtatgatagaagaaaacctggcggcagcgcaaaagatg

SEQ ID NO: 63971 - DNA, 103 bp, Artificial Sequence
  Synthetic Polynucleotide
taatacgactcactatagggctaagtttctgtttgagttcttctatagtaaacagaggagatactatatgagaactcaaaacctggcggcagcgcaaaagatg

SEQ ID NO: 63972 - DNA, 103 bp, Artificial Sequence
  Synthetic Polynucleotide
taatacgactcactatagggttaatctaagtttctgtttgagttcttctaaacagaggagatagaagatgtcaaacagaaacctggcggcagcgcaaaagatg

SEQ ID NO: 63973 - DNA, 103 bp, Artificial Sequence
  Synthetic Polynucleotide
taatacgactcactatagggagcatttaatctaagtttctgtttgagttcaacagaggagagaactcatgcagaaacttaacctggcggcagcgcaaaagatg

SEQ ID NO: 63974 - DNA, 103 bp, Artificial Sequence
  Synthetic Polynucleotide
taatacgactcactatagggtcttcagcatttaatctaagtttctgtttgaacagaggagacaaacaatgacttagattaacctggcggcagcgcaaaagatg

SEQ ID NO: 63975 - DNA, 103 bp, Artificial Sequence
  Synthetic Polynucleotide
taatacgactcactatagggctccctcttcagcatttaatctaagtttctaacagaggagaagaaacatggattaaatgaacctggcggcagcgcaaaagatg

SEQ ID NO: 63976 - DNA, 103 bp, Artificial Sequence
  Synthetic Polynucleotide
taatacgactcactatagggatcggctccctcttcagcatttaatctaagaacagaggagacttagaatgaatgctgaaaacctggcggcagcgcaaaagatg

SEQ ID NO: 63977 - DNA, 103 bp, Artificial Sequence
  Synthetic Polynucleotide
taatacgactcactatagggaagttatcggctccctcttcagcatttaataacagaggagaattaaaatgtgaagagggaacctggcggcagcgcaaaagatg

SEQ ID NO: 63978 - DNA, 103 bp, Artificial Sequence
  Synthetic Polynucleotide
taatacgactcactatagggctataaagttatcggctccctcttcagcataacagaggagaatgctgatgagggagccgaacctggcggcagcgcaaaagatg

SEQ ID NO: 63979 - DNA, 103 bp, Artificial Sequence
  Synthetic Polynucleotide
taatacgactcactatagggataatctataaagttatcggctccctcttcaacagaggagagaagagatggccgataacaacctggcggcagcgcaaaagatg

SEQ ID NO: 63980 - DNA, 103 bp, Artificial Sequence
  Synthetic Polynucleotide
taatacgactcactataggggcatgaggactctacttattagatatattcaacagaggagagaatatatgtaataagtaaacctggcggcagcgcaaaagatg

SEQ ID NO: 63981 - DNA, 103 bp, Artificial Sequence
  Synthetic Polynucleotide
taatacgactcactatagggtttatataatctataaagttatcggctcccaacagaggagagggagcatgtaactttataacctggcggcagcgcaaaagatg

SEQ ID NO: 63982 - DNA, 103 bp, Artificial Sequence
  Synthetic Polynucleotide
taatacgactcactataggggtacctttatataatctataaagttatcggaacagaggagaccgataatgttatagattaacctggcggcagcgcaaaagatg

SEQ ID NO: 63983 - DNA, 103 bp, Artificial Sequence
  Synthetic Polynucleotide
taatacgactcactatagggtgtttgtacctttatataatctataaagttaacagaggagaaactttatggattatataaacctggcggcagcgcaaaagatg

SEQ ID NO: 63984 - DNA, 103 bp, Artificial Sequence
  Synthetic Polynucleotide
taatacgactcactatagggtatcctgtttgtacctttatataatctataaacagaggagatatagaatgtataaaggtaacctggcggcagcgcaaaagatg

SEQ ID NO: 63985 - DNA, 103 bp, Artificial Sequence
  Synthetic Polynucleotide
taatacgactcactatagggatagatatcctgtttgtacctttatataataacagaggagaattataatgaggtacaaaaacctggcggcagcgcaaaagatg

SEQ ID NO: 63986 - DNA, 103 bp, Artificial Sequence
  Synthetic Polynucleotide
taatacgactcactatagggctatcatagatatcctgtttgtacctttataacagaggagaataaagatgcaaacaggaaacctggcggcagcgcaaaagatg

SEQ ID NO: 63987 - DNA, 103 bp, Artificial Sequence
  Synthetic Polynucleotide
taatacgactcactatagggcaatcctatcatagatatcctgtttgtaccaacagaggagaggtacaatgaggatatctaacctggcggcagcgcaaaagatg

SEQ ID NO: 63988 - DNA, 103 bp, Artificial Sequence
  Synthetic Polynucleotide
taatacgactcactataggggcacacaatcctatcatagatatcctgtttaacagaggagaaaacagatgatctatgataacctggcggcagcgcaaaagatg

SEQ ID NO: 63989 - DNA, 103 bp, Artificial Sequence
  Synthetic Polynucleotide
taatacgactcactatagggcacacgcacacaatcctatcatagatatccaacagaggagaggatatatgtgataggataacctggcggcagcgcaaaagatg

SEQ ID NO: 63990 - DNA, 103 bp, Artificial Sequence
  Synthetic Polynucleotide
taatacgactcactatagggtaccacacacgcacacaatcctatcatagaaacagaggagatctatgatgggattgtgtaacctggcggcagcgcaaaagatg

SEQ ID NO: 63991 - DNA, 103 bp, Artificial Sequence
  Synthetic Polynucleotide
taatacgactcactatagggactaagcatgaggactctacttattagataaacagaggagatatctaatgagtagagtcaacctggcggcagcgcaaaagatg

SEQ ID NO: 63992 - DNA, 103 bp, Artificial Sequence
  Synthetic Polynucleotide
taatacgactcactatagggacatctaccacacacgcacacaatcctatcaacagaggagagataggatggtgtgcgtgaacctggcggcagcgcaaaagatg

SEQ ID NO: 63993 - DNA, 103 bp, Artificial Sequence
  Synthetic Polynucleotide
taatacgactcactatagggtccaaacatctaccacacacgcacacaatcaacagaggagagattgtatgcgtgtgtggaacctggcggcagcgcaaaagatg

SEQ ID NO: 63994 - DNA, 103 bp, Artificial Sequence
  Synthetic Polynucleotide
taatacgactcactatagggctttctccaaacatctaccacacacgcacaaacagaggagatgtgcgatggtggtagataacctggcggcagcgcaaaagatg

SEQ ID NO: 63995 - DNA, 103 bp, Artificial Sequence
  Synthetic Polynucleotide
taatacgactcactatagggttctcctttctccaaacatctaccacacacaacagaggagagtgtgtatgagatgtttgaacctggcggcagcgcaaaagatg

SEQ ID NO: 63996 - DNA, 103 bp, Artificial Sequence
  Synthetic Polynucleotide
taatacgactcactatagggacagtttctcctttctccaaacatctaccaaacagaggagatggtagatgtttggagaaaacctggcggcagcgcaaaagatg

SEQ ID NO: 63997 - DNA, 103 bp, Artificial Sequence
  Synthetic Polynucleotide
taatacgactcactatagggagaaaacagtttctcctttctccaaacatcaacagaggagagatgttatgagaaaggagaacctggcggcagcgcaaaagatg

SEQ ID NO: 63998 - DNA, 103 bp, Artificial Sequence
  Synthetic Polynucleotide
taatacgactcactatagggcatctagaaaacagtttctcctttctccaaaacagaggagattggagatgggagaaactaacctggcggcagcgcaaaagatg

SEQ ID NO: 63999 - DNA, 103 bp, Artificial Sequence
  Synthetic Polynucleotide
taatacgactcactatagggatttccatctagaaaacagtttctcctttcaacagaggagagaaaggatgaactgttttaacctggcggcagcgcaaaagatg

SEQ ID NO: 64000 - DNA, 103 bp, Artificial Sequence
  Synthetic Polynucleotide
taatacgactcactatagggacaatatttccatctagaaaacagtttctcaacagaggagagagaaaatgttttctagaaacctggcggcagcgcaaaagatg

SEQ ID NO: 64001 - DNA, 103 bp, Artificial Sequence
  Synthetic Polynucleotide
taatacgactcactatagggcgtaaacaatatttccatctagaaaacagtaacagaggagaactgttatgtagatggaaaacctggcggcagcgcaaaagatg

SEQ ID NO: 64002 - DNA, 103 bp, Artificial Sequence
  Synthetic Polynucleotide
taatacgactcactatagggaaattactaagcatgaggactctacttattaacagaggagaaataagatgagtcctcataacctggcggcagcgcaaaagatg

SEQ ID NO: 64003 - DNA, 103 bp, Artificial Sequence
  Synthetic Polynucleotide
taatacgactcactatagggtagctcgtaaacaatatttccatctagaaaaacagaggagatttctaatgggaaatattaacctggcggcagcgcaaaagatg

SEQ ID NO: 64004 - DNA, 103 bp, Artificial Sequence
  Synthetic Polynucleotide
taatacgactcactatagggtttaatagctcgtaaacaatatttccatctaacagaggagaagatggatgtattgtttaaacctggcggcagcgcaaaagatg

SEQ ID NO: 64005 - DNA, 103 bp, Artificial Sequence
  Synthetic Polynucleotide
taatacgactcactatagggaacagtttaatagctcgtaaacaatatttcaacagaggagagaaataatgtttacgagcaacctggcggcagcgcaaaagatg

SEQ ID NO: 64006 - DNA, 103 bp, Artificial Sequence
  Synthetic Polynucleotide
taatacgactcactatagggcaataaacagtttaatagctcgtaaacaataacagaggagaattgttatggagctattaaacctggcggcagcgcaaaagatg

SEQ ID NO: 64007 - DNA, 103 bp, Artificial Sequence
  Synthetic Polynucleotide
taatacgactcactatagggatcatcaataaacagtttaatagctcgtaaaacagaggagattacgaatgattaaactgaacctggcggcagcgcaaaagatg

SEQ ID NO: 64008 - DNA, 103 bp, Artificial Sequence
  Synthetic Polynucleotide
taatacgactcactatagggatgggatcatcaataaacagtttaatagctaacagaggagaagctatatgactgtttataacctggcggcagcgcaaaagatg

SEQ ID NO: 64009 - DNA, 103 bp, Artificial Sequence
  Synthetic Polynucleotide
taatacgactcactatagggcaagtatgggatcatcaataaacagtttaaaacagaggagattaaacatgttattgatgaacctggcggcagcgcaaaagatg

SEQ ID NO: 64010 - DNA, 103 bp, Artificial Sequence
  Synthetic Polynucleotide
taatacgactcactatagggcttatcaagtatgggatcatcaataaacagaacagaggagactgtttatggatgatcccaacctggcggcagcgcaaaagatg

SEQ ID NO: 64011 - DNA, 103 bp, Artificial Sequence
  Synthetic Polynucleotide
taatacgactcactatagggtttatcttatcaagtatgggatcatcaataaacagaggagatattgaatgtcccatactaacctggcggcagcgcaaaagatg

SEQ ID NO: 64012 - DNA, 103 bp, Artificial Sequence
  Synthetic Polynucleotide
taatacgactcactatagggtagattttatcttatcaagtatgggatcataacagaggagaatgatcatgtacttgataaacctggcggcagcgcaaaagatg

SEQ ID NO: 64013 - DNA, 103 bp, Artificial Sequence
  Synthetic Polynucleotide
taatacgactcactatagggatttctcaaacaataacgttcaacaacataaacagaggagatatgttatggaacgttataacctggcggcagcgcaaaagatg

SEQ ID NO: 64014 - DNA, 103 bp, Artificial Sequence
  Synthetic Polynucleotide
taatacgactcactatagggaagatgtgacgtacaaaaaaataaaactagaacagaggagactagttatgtttttttgtaacctggcggcagcgcaaaagatg

SEQ ID NO: 64015 - DNA, 103 bp, Artificial Sequence
  Synthetic Polynucleotide
taatacgactcactatagggttatgtaaacgataaactcatacaactagtaacagaggagaactagtatgatgagtttaaacctggcggcagcgcaaaagatg

SEQ ID NO: 64016 - DNA, 103 bp, Artificial Sequence
  Synthetic Polynucleotide
taatacgactcactatagggtagttaaattactaagcatgaggactctacaacagaggagagtagagatgtcatgcttaaacctggcggcagcgcaaaagatg

SEQ ID NO: 64017 - DNA, 103 bp, Artificial Sequence
  Synthetic Polynucleotide
taatacgactcactatagggcagtatagattttatcttatcaagtatgggaacagaggagacccataatggataagataaacctggcggcagcgcaaaagatg

SEQ ID NO: 64018 - DNA, 103 bp, Artificial Sequence
  Synthetic Polynucleotide
taatacgactcactatagggttctgcagtatagattttatcttatcaagtaacagaggagaacttgaatggataaaatcaacctggcggcagcgcaaaagatg

SEQ ID NO: 64019 - DNA, 103 bp, Artificial Sequence
  Synthetic Polynucleotide
taatacgactcactataggggtctattctgcagtatagattttatcttataacagaggagaataagaatgaatctatacaacctggcggcagcgcaaaagatg

SEQ ID NO: 64020 - DNA, 103 bp, Artificial Sequence
  Synthetic Polynucleotide
taatacgactcactatagggcactagtctattctgcagtatagattttataacagaggagaataaaaatgatactgcagaacctggcggcagcgcaaaagatg

SEQ ID NO: 64021 - DNA, 103 bp, Artificial Sequence
  Synthetic Polynucleotide
taatacgactcactatagggacatacactagtctattctgcagtatagataacagaggagaatctatatggcagaatagaacctggcggcagcgcaaaagatg

SEQ ID NO: 64022 - DNA, 103 bp, Artificial Sequence
  Synthetic Polynucleotide
taatacgactcactatagggtttccacatacactagtctattctgcagtaaacagaggagatactgcatgatagactagaacctggcggcagcgcaaaagatg

SEQ ID NO: 64023 - DNA, 103 bp, Artificial Sequence
  Synthetic Polynucleotide
taatacgactcactatagggtaacatttccacatacactagtctattctgaacagaggagacagaatatgctagtgtataacctggcggcagcgcaaaagatg

SEQ ID NO: 64024 - DNA, 103 bp, Artificial Sequence
  Synthetic Polynucleotide
taatacgactcactatagggttctataacatttccacatacactagtctaaacagaggagatagactatggtatgtggaaacctggcggcagcgcaaaagatg

SEQ ID NO: 64025 - DNA, 103 bp, Artificial Sequence
  Synthetic Polynucleotide
taatacgactcactatagggtaattttctataacatttccacatacactaaacagaggagatagtgtatgtggaaatgtaacctggcggcagcgcaaaagatg

SEQ ID NO: 64026 - DNA, 103 bp, Artificial Sequence
  Synthetic Polynucleotide
taatacgactcactatagggacttttaattttctataacatttccacataaacagaggagatatgtgatgatgttatagaacctggcggcagcgcaaaagatg

SEQ ID NO: 64027 - DNA, 103 bp, Artificial Sequence
  Synthetic Polynucleotide
taatacgactcactatagggtaaaatagttaaattactaagcatgaggacaacagaggagagtcctcatgcttagtaataacctggcggcagcgcaaaagatg

SEQ ID NO: 64028 - DNA, 103 bp, Artificial Sequence
  Synthetic Polynucleotide
taatacgactcactatagggcattaacttttaattttctataacatttccaacagaggagaggaaatatgatagaaaataacctggcggcagcgcaaaagatg

SEQ ID NO: 64029 - DNA, 103 bp, Artificial Sequence
  Synthetic Polynucleotide
taatacgactcactataggggctctcattaacttttaattttctataacaaacagaggagatgttatatgaaattaaaaaacctggcggcagcgcaaaagatg

SEQ ID NO: 64030 - DNA, 103 bp, Artificial Sequence
  Synthetic Polynucleotide
taatacgactcactatagggattttgctctcattaacttttaattttctaaacagaggagatagaaaatgaaaagttaaaacctggcggcagcgcaaaagatg

SEQ ID NO: 64031 - DNA, 103 bp, Artificial Sequence
  Synthetic Polynucleotide
taatacgactcactatagggattatattttgctctcattaacttttaattaacagaggagaaattaaatgttaatgagaaacctggcggcagcgcaaaagatg

SEQ ID NO: 64032 - DNA, 103 bp, Artificial Sequence
  Synthetic Polynucleotide
taatacgactcactatagggacaacattatattttgctctcattaactttaacagaggagaaaagttatggagagcaaaaacctggcggcagcgcaaaagatg

SEQ ID NO: 64033 - DNA, 103 bp, Artificial Sequence
  Synthetic Polynucleotide
taatacgactcactatagggagaatacaacattatattttgctctcattaaacagaggagataatgaatgcaaaatataaacctggcggcagcgcaaaagatg

SEQ ID NO: 64034 - DNA, 103 bp, Artificial Sequence
  Synthetic Polynucleotide
taatacgactcactatagggggattagaatacaacattatattttgctctaacagaggagaagagcaatgtataatgttaacctggcggcagcgcaaaagatg

SEQ ID NO: 64035 - DNA, 103 bp, Artificial Sequence
  Synthetic Polynucleotide
taatacgactcactatagggatatgggattagaatacaacattatattttaacagaggagaaaaataatgtgttgtattaacctggcggcagcgcaaaagatg

SEQ ID NO: 64036 - DNA, 103 bp, Artificial Sequence
  Synthetic Polynucleotide
taatacgactcactatagggaataaatatgggattagaatacaacattataacagaggagaataatgatgtattctaataacctggcggcagcgcaaaagatg

SEQ ID NO: 64037 - DNA, 103 bp, Artificial Sequence
  Synthetic Polynucleotide
taatacgactcactatagggaaaataataaatatgggattagaatacaacaacagaggagagttgtaatgtaatcccataacctggcggcagcgcaaaagatg

SEQ ID NO: 64038 - DNA, 103 bp, Artificial Sequence
  Synthetic Polynucleotide
taatacgactcactatagggttaactaaaatagttaaattactaagcatgaacagaggagacatgctatgtaatttaacaacctggcggcagcgcaaaagatg

SEQ ID NO: 64039 - DNA, 103 bp, Artificial Sequence
  Synthetic Polynucleotide
taatacgactcactatagggccgtgaaaataataaatatgggattagaataacagaggagaattctaatgccatatttaaacctggcggcagcgcaaaagatg

SEQ ID NO: 64040 - DNA, 103 bp, Artificial Sequence
  Synthetic Polynucleotide
taatacgactcactatagggtatctccgtgaaaataataaatatgggattaacagaggagaaatcccatgtttattattaacctggcggcagcgcaaaagatg

SEQ ID NO: 64041 - DNA, 103 bp, Artificial Sequence
  Synthetic Polynucleotide
taatacgactcactatagggacctatatctccgtgaaaataataaatatgaacagaggagacatattatgtattttcacaacctggcggcagcgcaaaagatg

SEQ ID NO: 64042 - DNA, 103 bp, Artificial Sequence
  Synthetic Polynucleotide
taatacgactcactatagggactacacctatatctccgtgaaaataataaaacagaggagattattaatgtcacggagaaacctggcggcagcgcaaaagatg

SEQ ID NO: 64043 - DNA, 103 bp, Artificial Sequence
  Synthetic Polynucleotide
taatacgactcactataggggcaaaactacacctatatctccgtgaaaataacagaggagaattttcatggagatatagaacctggcggcagcgcaaaagatg

SEQ ID NO: 64044 - DNA, 103 bp, Artificial Sequence
  Synthetic Polynucleotide
taatacgactcactatagggtcactgcaaaactacacctatatctccgtgaacagaggagacacggaatgataggtgtaaacctggcggcagcgcaaaagatg

SEQ ID NO: 64045 - DNA, 103 bp, Artificial Sequence
  Synthetic Polynucleotide
taatacgactcactataggggacggtcactgcaaaactacacctatatctaacagaggagaagatatatgtgtagttttaacctggcggcagcgcaaaagatg

SEQ ID NO: 64046 - DNA, 103 bp, Artificial Sequence
  Synthetic Polynucleotide
taatacgactcactatagggatcaggacggtcactgcaaaactacacctaaacagaggagataggtgatgttttgcagtaacctggcggcagcgcaaaagatg

SEQ ID NO: 64047 - DNA, 103 bp, Artificial Sequence
  Synthetic Polynucleotide
taatacgactcactatagggatattatcaggacggtcactgcaaaactacaacagaggagagtagttatgcagtgaccgaacctggcggcagcgcaaaagatg

SEQ ID NO: 64048 - DNA, 103 bp, Artificial Sequence
  Synthetic Polynucleotide
taatacgactcactatagggagataatattatcaggacggtcactgcaaaaacagaggagatttgcaatgaccgtcctgaacctggcggcagcgcaaaagatg

SEQ ID NO: 64049 - DNA, 103 bp, Artificial Sequence
  Synthetic Polynucleotide
taatacgactcactatagggagttgttaactaaaatagttaaattactaaaacagaggagattagtaatgtaactatttaacctggcggcagcgcaaaagatg

SEQ ID NO: 64050 - DNA, 103 bp, Artificial Sequence
  Synthetic Polynucleotide
taatacgactcactatagggcatatagataatattatcaggacggtcactaacagaggagaagtgacatgcctgataataacctggcggcagcgcaaaagatg

SEQ ID NO: 64051 - DNA, 103 bp, Artificial Sequence
  Synthetic Polynucleotide
taatacgactcactatagggcccatcatatagataatattatcaggacggaacagaggagaccgtccatgtaatattataacctggcggcagcgcaaaagatg

SEQ ID NO: 64052 - DNA, 103 bp, Artificial Sequence
  Synthetic Polynucleotide
taatacgactcactatagggatccacccatcatatagataatattatcagaacagaggagactgataatgttatctataaacctggcggcagcgcaaaagatg

SEQ ID NO: 64053 - DNA, 103 bp, Artificial Sequence
  Synthetic Polynucleotide
taatacgactcactatagggatcatatccacccatcatatagataatattaacagaggagaaatattatgtatatgatgaacctggcggcagcgcaaaagatg

SEQ ID NO: 64054 - DNA, 103 bp, Artificial Sequence
  Synthetic Polynucleotide
taatacgactcactatagggtactgatcatatccacccatcatatagataaacagaggagatatctaatggatgggtggaacctggcggcagcgcaaaagatg

SEQ ID NO: 64055 - DNA, 103 bp, Artificial Sequence
  Synthetic Polynucleotide
taatacgactcactatagggacgggtactgatcatatccacccatcatataacagaggagaatatgaatggtggatatgaacctggcggcagcgcaaaagatg

SEQ ID NO: 64056 - DNA, 103 bp, Artificial Sequence
  Synthetic Polynucleotide
taatacgactcactatagggtctatacgggtactgatcatatccacccataacagaggagaatgggtatgtatgatcagaacctggcggcagcgcaaaagatg

SEQ ID NO: 64057 - DNA, 103 bp, Artificial Sequence
  Synthetic Polynucleotide
taatacgactcactataggggaacttctatacgggtactgatcatatccaaacagaggagatggataatgtcagtacccaacctggcggcagcgcaaaagatg

SEQ ID NO: 64058 - DNA, 103 bp, Artificial Sequence
  Synthetic Polynucleotide
taatacgactcactatagggcctttgaacttctatacgggtactgatcataacagaggagaatgatcatgacccgtataaacctggcggcagcgcaaaagatg

SEQ ID NO: 64059 - DNA, 103 bp, Artificial Sequence
  Synthetic Polynucleotide
taatacgactcactatagggtataacctttgaacttctatacgggtactgaacagaggagacagtacatgtatagaagtaacctggcggcagcgcaaaagatg

SEQ ID NO: 64060 - DNA, 103 bp, Artificial Sequence
  Synthetic Polynucleotide
taatacgactcactatagggaaaatagttgttaactaaaatagttaaattaacagaggagaaatttaatgattttagttaacctggcggcagcgcaaaagatg

SEQ ID NO: 64061 - DNA, 103 bp, Artificial Sequence
  Synthetic Polynucleotide
taatacgactcactatagggtacactataacctttgaacttctatacgggaacagaggagacccgtaatgaagttcaaaaacctggcggcagcgcaaaagatg

SEQ ID NO: 64062 - DNA, 103 bp, Artificial Sequence
  Synthetic Polynucleotide
taatacgactcactatagggtattgtacactataacctttgaacttctataacagaggagaatagaaatgcaaaggttaaacctggcggcagcgcaaaagatg

SEQ ID NO: 64063 - DNA, 103 bp, Artificial Sequence
  Synthetic Polynucleotide
taatacgactcactatagggacatgtattgtacactataacctttgaactaacagaggagaagttcaatggttatagtgaacctggcggcagcgcaaaagatg

SEQ ID NO: 64064 - DNA, 103 bp, Artificial Sequence
  Synthetic Polynucleotide
taatacgactcactatagggtttgtacatgtattgtacactataacctttaacagaggagaaaaggtatgagtgtacaaaacctggcggcagcgcaaaagatg

SEQ ID NO: 64065 - DNA, 103 bp, Artificial Sequence
  Synthetic Polynucleotide
taatacgactcactatagggaagaatttgtacatgtattgtacactataaaacagaggagattatagatgacaatacataacctggcggcagcgcaaaagatg

SEQ ID NO: 64066 - DNA, 103 bp, Artificial Sequence
  Synthetic Polynucleotide
taatacgactcactatagggtatccaagaatttgtacatgtattgtacacaacagaggagagtgtacatgacatgtacaaacctggcggcagcgcaaaagatg

SEQ ID NO: 64067 - DNA, 103 bp, Artificial Sequence
  Synthetic Polynucleotide
taatacgactcactatagggtcatatatccaagaatttgtacatgtattgaacagaggagacaatacatgtacaaattcaacctggcggcagcgcaaaagatg

SEQ ID NO: 64068 - DNA, 103 bp, Artificial Sequence
  Synthetic Polynucleotide
taatacgactcactataggggtatatcatatatccaagaatttgtacatgaacagaggagacatgtaatgattcttggaaacctggcggcagcgcaaaagatg

SEQ ID NO: 64069 - DNA, 103 bp, Artificial Sequence
  Synthetic Polynucleotide
taatacgactcactatagggctctggtatatcatatatccaagaatttgtaacagaggagaacaaatatgtggatatataacctggcggcagcgcaaaagatg

SEQ ID NO: 64070 - DNA, 103 bp, Artificial Sequence
  Synthetic Polynucleotide
taatacgactcactatagggtttagctctggtatatcatatatccaagaaaacagaggagattcttgatgatatgatataacctggcggcagcgcaaaagatg

SEQ ID NO: 64071 - DNA, 103 bp, Artificial Sequence
  Synthetic Polynucleotide
taatacgactcactatagggcataaaaaatagttgttaactaaaatagttaacagaggagaaactatatgagttaacaaaacctggcggcagcgcaaaagatg

SEQ ID NO: 64072 - DNA, 103 bp, Artificial Sequence
  Synthetic Polynucleotide
taatacgactcactataggggatattttagctctggtatatcatatatccaacagaggagaggatatatgatataccagaacctggcggcagcgcaaaagatg

SEQ ID NO: 64073 - DNA, 103 bp, Artificial Sequence
  Synthetic Polynucleotide
taatacgactcactatagggacgaggatattttagctctggtatatcataaacagaggagatatgatatgccagagctaaacctggcggcagcgcaaaagatg

SEQ ID NO: 64074 - DNA, 103 bp, Artificial Sequence
  Synthetic Polynucleotide
taatacgactcactatagggttagaacgaggatattttagctctggtataaacagaggagatataccatggctaaaataaacctggcggcagcgcaaaagatg

SEQ ID NO: 64075 - DNA, 103 bp, Artificial Sequence
  Synthetic Polynucleotide
taatacgactcactatagggcacaattagaacgaggatattttagctctgaacagaggagacagagcatgaatatcctcaacctggcggcagcgcaaaagatg

SEQ ID NO: 64076 - DNA, 103 bp, Artificial Sequence
  Synthetic Polynucleotide
taatacgactcactatagggtcctccacaattagaacgaggatattttagaacagaggagactaaaaatgcctcgttctaacctggcggcagcgcaaaagatg

SEQ ID NO: 64077 - DNA, 103 bp, Artificial Sequence
  Synthetic Polynucleotide
taatacgactcactataggggcaactcctccacaattagaacgaggatataacagaggagaatatccatgttctaattgaacctggcggcagcgcaaaagatg

SEQ ID NO: 64078 - DNA, 103 bp, Artificial Sequence
  Synthetic Polynucleotide
taatacgactcactatagggcatcagcaactcctccacaattagaacgagaacagaggagactcgttatgattgtggagaacctggcggcagcgcaaaagatg

SEQ ID NO: 64079 - DNA, 103 bp, Artificial Sequence
  Synthetic Polynucleotide
taatacgactcactatagggttcatcatcagcaactcctccacaattagaaacagaggagatctaatatgggaggagttaacctggcggcagcgcaaaagatg

SEQ ID NO: 64080 - DNA, 103 bp, Artificial Sequence
  Synthetic Polynucleotide
taatacgactcactatagggatgtattcatcatcagcaactcctccacaaaacagaggagattgtggatgagttgctgaaacctggcggcagcgcaaaagatg

SEQ ID NO: 64081 - DNA, 103 bp, Artificial Sequence
  Synthetic Polynucleotide
taatacgactcactatagggaataaatgtattcatcatcagcaactcctcaacagaggagagaggagatgctgatgatgaacctggcggcagcgcaaaagatg

SEQ ID NO: 64082 - DNA, 103 bp, Artificial Sequence
  Synthetic Polynucleotide
taatacgactcactatagggtttaacataaaaaatagttgttaactaaaaaacagaggagattttagatgacaactattaacctggcggcagcgcaaaagatg

SEQ ID NO: 64083 - DNA, 103 bp, Artificial Sequence
  Synthetic Polynucleotide
taatacgactcactatagggtatgcaataaatgtattcatcatcagcaacaacagaggagagttgctatggatgaatacaacctggcggcagcgcaaaagatg

SEQ ID NO: 64084 - DNA, 103 bp, Artificial Sequence
  Synthetic Polynucleotide
taatacgactcactatagggtcgcctatgcaataaatgtattcatcatcaaacagaggagatgatgaatgatacatttaaacctggcggcagcgcaaaagatg

SEQ ID NO: 64085 - DNA, 103 bp, Artificial Sequence
  Synthetic Polynucleotide
taatacgactcactatagggcctgatcgcctatgcaataaatgtattcataacagaggagaatgaatatgtttattgcaaacctggcggcagcgcaaaagatg

SEQ ID NO: 64086 - DNA, 103 bp, Artificial Sequence
  Synthetic Polynucleotide
taatacgactcactatagggtgaatcctgatcgcctatgcaataaatgtaaacagaggagatacattatgtgcataggcaacctggcggcagcgcaaaagatg

SEQ ID NO: 64087 - DNA, 103 bp, Artificial Sequence
  Synthetic Polynucleotide
taatacgactcactatagggaacgatgaatcctgatcgcctatgcaataaaacagaggagattattgatgaggcgatcaaacctggcggcagcgcaaaagatg

SEQ ID NO: 64088 - DNA, 103 bp, Artificial Sequence
  Synthetic Polynucleotide
taatacgactcactatagggatatcaacgatgaatcctgatcgcctatgcaacagaggagagcatagatgatcaggattaacctggcggcagcgcaaaagatg

SEQ ID NO: 64089 - DNA, 103 bp, Artificial Sequence
  Synthetic Polynucleotide
taatacgactcactatagggactagatatcaacgatgaatcctgatcgccaacagaggagaggcgatatggattcatcgaacctggcggcagcgcaaaagatg

SEQ ID NO: 64090 - DNA, 103 bp, Artificial Sequence
  Synthetic Polynucleotide
taatacgactcactatagggtcaatactagatatcaacgatgaatcctgaaacagaggagatcaggaatgatcgttgataacctggcggcagcgcaaaagatg

SEQ ID NO: 64091 - DNA, 103 bp, Artificial Sequence
  Synthetic Polynucleotide
taatacgactcactatagggatctatcaatactagatatcaacgatgaataacagaggagaattcatatgtgatatctaaacctggcggcagcgcaaaagatg

SEQ ID NO: 64092 - DNA, 103 bp, Artificial Sequence
  Synthetic Polynucleotide
taatacgactcactatagggcttccatctatcaatactagatatcaacgaaacagaggagatcgttgatgtctagtattaacctggcggcagcgcaaaagatg

SEQ ID NO: 64093 - DNA, 103 bp, Artificial Sequence
  Synthetic Polynucleotide
taatacgactcactatagggctcgatttaacataaaaaatagttgttaacaacagaggagagttaacatgtattttttaaacctggcggcagcgcaaaagatg

SEQ ID NO: 64094 - DNA, 103 bp, Artificial Sequence
  Synthetic Polynucleotide
taatacgactcactataggggatggcttccatctatcaatactagatatcaacagaggagagatatcatgtattgatagaacctggcggcagcgcaaaagatg

SEQ ID NO: 64095 - DNA, 103 bp, Artificial Sequence
  Synthetic Polynucleotide
taatacgactcactataggggttttgatggcttccatctatcaatactagaacagaggagactagtaatgatagatggaaacctggcggcagcgcaaaagatg

SEQ ID NO: 64096 - DNA, 103 bp, Artificial Sequence
  Synthetic Polynucleotide
taatacgactcactatagggatatggttttgatggcttccatctatcaataacagaggagaattgatatgtggaagccaaacctggcggcagcgcaaaagatg

SEQ ID NO: 64097 - DNA, 103 bp, Artificial Sequence
  Synthetic Polynucleotide
taatacgactcactatagggtatcaatatggttttgatggcttccatctaaacagaggagatagatgatggccatcaaaaacctggcggcagcgcaaaagatg

SEQ ID NO: 64098 - DNA, 103 bp, Artificial Sequence
  Synthetic Polynucleotide
taatacgactcactatagggacgtttatcaatatggttttgatggcttccaacagaggagaggaagcatgcaaaaccataacctggcggcagcgcaaaagatg

SEQ ID NO: 64099 - DNA, 103 bp, Artificial Sequence
  Synthetic Polynucleotide
taatacgactcactatagggagcatacgtttatcaatatggttttgatggaacagaggagaccatcaatgccatattgaaacctggcggcagcgcaaaagatg

SEQ ID NO: 64100 - DNA, 103 bp, Artificial Sequence
  Synthetic Polynucleotide
taatacgactcactatagggattttagcatacgtttatcaatatggttttaacagaggagaaaaaccatgttgataaacaacctggcggcagcgcaaaagatg

SEQ ID NO: 64101 - DNA, 103 bp, Artificial Sequence
  Synthetic Polynucleotide
taatacgactcactatagggctcgcattttagcatacgtttatcaatatgaacagaggagacatattatgaaacgtatgaacctggcggcagcgcaaaagatg

SEQ ID NO: 64102 - DNA, 103 bp, Artificial Sequence
  Synthetic Polynucleotide
taatacgactcactatagggtgtctctcgcattttagcatacgtttatcaaacagaggagatgataaatgtatgctaaaaacctggcggcagcgcaaaagatg

SEQ ID NO: 64103 - DNA, 103 bp, Artificial Sequence
  Synthetic Polynucleotide
taatacgactcactatagggcattttgtctctcgcattttagcatacgttaacagaggagaaacgtaatgtaaaatgcgaacctggcggcagcgcaaaagatg

SEQ ID NO: 64104 - DNA, 103 bp, Artificial Sequence
  Synthetic Polynucleotide
taatacgactcactatagggttctactcgatttaacataaaaaatagttgaacagaggagacaactaatgtttatgttaaacctggcggcagcgcaaaagatg

SEQ ID NO: 64105 - DNA, 103 bp, Artificial Sequence
  Synthetic Polynucleotide
taatacgactcactatagggtatcacattttgtctctcgcattttagcataacagaggagaatgctaatgtgcgagagaaacctggcggcagcgcaaaagatg

SEQ ID NO: 64106 - DNA, 103 bp, Artificial Sequence
  Synthetic Polynucleotide
taatacgactcactatagggaccaatatcacattttgtctctcgcattttaacagaggagaaaaatgatggagacaaaaaacctggcggcagcgcaaaagatg

SEQ ID NO: 64107 - DNA, 103 bp, Artificial Sequence
  Synthetic Polynucleotide
taatacgactcactataggggctacaccaatatcacattttgtctctcgcaacagaggagagcgagaatgaaaatgtgaaacctggcggcagcgcaaaagatg

SEQ ID NO: 64108 - DNA, 103 bp, Artificial Sequence
  Synthetic Polynucleotide
taatacgactcactatagggacatcgctacaccaatatcacattttgtctaacagaggagaagacaaatggtgatattgaacctggcggcagcgcaaaagatg

SEQ ID NO: 64109 - DNA, 103 bp, Artificial Sequence
  Synthetic Polynucleotide
taatacgactcactataggggtttaacatcgctacaccaatatcacatttaacagaggagaaaatgtatgattggtgtaaacctggcggcagcgcaaaagatg

SEQ ID NO: 64110 - DNA, 103 bp, Artificial Sequence
  Synthetic Polynucleotide
taatacgactcactatagggaatccgtttaacatcgctacaccaatatcaaacagaggagatgatatatgtgtagcgataacctggcggcagcgcaaaagatg

SEQ ID NO: 64111 - DNA, 103 bp, Artificial Sequence
  Synthetic Polynucleotide
taatacgactcactatagggatattaatccgtttaacatcgctacaccaaaacagaggagattggtgatgcgatgttaaaacctggcggcagcgcaaaagatg

SEQ ID NO: 64112 - DNA, 103 bp, Artificial Sequence
  Synthetic Polynucleotide
taatacgactcactataggggacatatattaatccgtttaacatcgctacaacagaggagagtagcgatgttaaacggaaacctggcggcagcgcaaaagatg

SEQ ID NO: 64113 - DNA, 103 bp, Artificial Sequence
  Synthetic Polynucleotide
taatacgactcactatagggcctatgacatatattaatccgtttaacatcaacagaggagagatgttatgcggattaataacctggcggcagcgcaaaagatg

SEQ ID NO: 64114 - DNA, 103 bp, Artificial Sequence
  Synthetic Polynucleotide
taatacgactcactatagggctccgcctatgacatatattaatccgtttaaacagaggagataaacgatgtaatatatgaacctggcggcagcgcaaaagatg

SEQ ID NO: 64115 - DNA, 103 bp, Artificial Sequence
  Synthetic Polynucleotide
taatacgactcactatagggagtggttctactcgatttaacataaaaaataacagaggagaatttttatggttaaatcgaacctggcggcagcgcaaaagatg

SEQ ID NO: 64116 - DNA, 103 bp, Artificial Sequence
  Synthetic Polynucleotide
taatacgactcactatagggaacaactccgcctatgacatatattaatccaacagaggagaggattaatgtatgtcataaacctggcggcagcgcaaaagatg

SEQ ID NO: 64117 - DNA, 103 bp, Artificial Sequence
  Synthetic Polynucleotide
taatacgactcactatagggcctttaacaactccgcctatgacatatattaacagaggagaaatataatgcataggcggaacctggcggcagcgcaaaagatg

SEQ ID NO: 64118 - DNA, 103 bp, Artificial Sequence
  Synthetic Polynucleotide
taatacgactcactatagggtgtcacctttaacaactccgcctatgacataacagaggagaatgtcaatggcggagttgaacctggcggcagcgcaaaagatg

SEQ ID NO: 64119 - DNA, 103 bp, Artificial Sequence
  Synthetic Polynucleotide
taatacgactcactatagggacatgtgtcacctttaacaactccgcctataacagaggagaataggcatggttgttaaaaacctggcggcagcgcaaaagatg

SEQ ID NO: 64120 - DNA, 103 bp, Artificial Sequence
  Synthetic Polynucleotide
taatacgactcactatagggtcggtacatgtgtcacctttaacaactccgaacagaggagacggagtatgtaaaggtgaaacctggcggcagcgcaaaagatg

SEQ ID NO: 64121 - DNA, 103 bp, Artificial Sequence
  Synthetic Polynucleotide
taatacgactcactataggggtgtgtcggtacatgtgtcacctttaacaaaacagaggagattgttaatggtgacacataacctggcggcagcgcaaaagatg

SEQ ID NO: 64122 - DNA, 103 bp, Artificial Sequence
  Synthetic Polynucleotide
taatacgactcactatagggctcaagtgtgtcggtacatgtgtcacctttaacagaggagaaaaggtatgacatgtaccaacctggcggcagcgcaaaagatg

SEQ ID NO: 64123 - DNA, 103 bp, Artificial Sequence
  Synthetic Polynucleotide
taatacgactcactatagggaaactctcaagtgtgtcggtacatgtgtcaaacagaggagatgacacatgtaccgacacaacctggcggcagcgcaaaagatg

SEQ ID NO: 64124 - DNA, 103 bp, Artificial Sequence
  Synthetic Polynucleotide
taatacgactcactatagggctgataaactctcaagtgtgtcggtacatgaacagaggagacatgtaatgacacacttgaacctggcggcagcgcaaaagatg

SEQ ID NO: 64125 - DNA, 103 bp, Artificial Sequence
  Synthetic Polynucleotide
taatacgactcactatagggatcttctgataaactctcaagtgtgtcggtaacagaggagaaccgacatgcttgagagtaacctggcggcagcgcaaaagatg

SEQ ID NO: 64126 - DNA, 103 bp, Artificial Sequence
  Synthetic Polynucleotide
taatacgactcactatagggatggcttatgtaaacgataaactcatacaaaacagaggagattgtatatgtttatcgttaacctggcggcagcgcaaaagatg

SEQ ID NO: 64127 - DNA, 103 bp, Artificial Sequence
  Synthetic Polynucleotide
taatacgactcactatagggaacatagtggttctactcgatttaacataaaacagaggagattatgtatgatcgagtagaacctggcggcagcgcaaaagatg

SEQ ID NO: 64128 - DNA, 103 bp, Artificial Sequence
  Synthetic Polynucleotide
taatacgactcactatagggcatccatcttctgataaactctcaagtgtgaacagaggagacacactatggagtttatcaacctggcggcagcgcaaaagatg

SEQ ID NO: 64129 - DNA, 103 bp, Artificial Sequence
  Synthetic Polynucleotide
taatacgactcactatagggtcatccatccatcttctgataaactctcaaaacagaggagattgagaatgtatcagaagaacctggcggcagcgcaaaagatg

SEQ ID NO: 64130 - DNA, 103 bp, Artificial Sequence
  Synthetic Polynucleotide
taatacgactcactatagggatgcatcatccatccatcttctgataaactaacagaggagaagtttaatggaagatggaaacctggcggcagcgcaaaagatg

SEQ ID NO: 64131 - DNA, 103 bp, Artificial Sequence
  Synthetic Polynucleotide
taatacgactcactatagggcgttgatgcatcatccatccatcttctgataacagaggagaatcagaatgtggatggataacctggcggcagcgcaaaagatg

SEQ ID NO: 64132 - DNA, 103 bp, Artificial Sequence
  Synthetic Polynucleotide
taatacgactcactataggggaagacgttgatgcatcatccatccatcttaacagaggagaaagatgatgggatgatgcaacctggcggcagcgcaaaagatg

SEQ ID NO: 64133 - DNA, 103 bp, Artificial Sequence
  Synthetic Polynucleotide
taatacgactcactatagggtattggaagacgttgatgcatcatccatccaacagaggagaggatggatgatgcatcaaaacctggcggcagcgcaaaagatg

SEQ ID NO: 64134 - DNA, 103 bp, Artificial Sequence
  Synthetic Polynucleotide
taatacgactcactatagggacatttattggaagacgttgatgcatcatcaacagaggagagatgatatgtcaacgtctaacctggcggcagcgcaaaagatg

SEQ ID NO: 64135 - DNA, 103 bp, Artificial Sequence
  Synthetic Polynucleotide
taatacgactcactatagggattggacatttattggaagacgttgatgcaaacagaggagatgcatcatggtcttccaaaacctggcggcagcgcaaaagatg

SEQ ID NO: 64136 - DNA, 103 bp, Artificial Sequence
  Synthetic Polynucleotide
taatacgactcactataggggacatattggacatttattggaagacgttgaacagaggagacaacgtatgccaataaataacctggcggcagcgcaaaagatg

SEQ ID NO: 64137 - DNA, 103 bp, Artificial Sequence
  Synthetic Polynucleotide
taatacgactcactatagggtcgtcgacatattggacatttattggaagaaacagaggagatcttccatgaaatgtccaaacctggcggcagcgcaaaagatg

SEQ ID NO: 64138 - DNA, 103 bp, Artificial Sequence
  Synthetic Polynucleotide
taatacgactcactataggggtattaacatagtggttctactcgatttaaaacagaggagattaaatatggtagaaccaaacctggcggcagcgcaaaagatg

SEQ ID NO: 64139 - DNA, 103 bp, Artificial Sequence
  Synthetic Polynucleotide
taatacgactcactatagggaacaatcgtcgacatattggacatttattgaacagaggagacaataaatgtccaatatgaacctggcggcagcgcaaaagatg

SEQ ID NO: 64140 - DNA, 103 bp, Artificial Sequence
  Synthetic Polynucleotide
taatacgactcactataggggtatgaacaatcgtcgacatattggacattaacagaggagaaatgtcatgtatgtcgacaacctggcggcagcgcaaaagatg

SEQ ID NO: 64141 - DNA, 103 bp, Artificial Sequence
  Synthetic Polynucleotide
taatacgactcactatagggtgccggtatgaacaatcgtcgacatattggaacagaggagaccaataatgcgacgattgaacctggcggcagcgcaaaagatg

SEQ ID NO: 64142 - DNA, 103 bp, Artificial Sequence
  Synthetic Polynucleotide
taatacgactcactatagggaattttgccggtatgaacaatcgtcgacataacagaggagaatgtcgatgattgttcataacctggcggcagcgcaaaagatg

SEQ ID NO: 64143 - DNA, 103 bp, Artificial Sequence
  Synthetic Polynucleotide
taatacgactcactatagggatataaattttgccggtatgaacaatcgtcaacagaggagagacgatatgtcataccggaacctggcggcagcgcaaaagatg

SEQ ID NO: 64144 - DNA, 103 bp, Artificial Sequence
  Synthetic Polynucleotide
taatacgactcactatagggctgatatataaattttgccggtatgaacaaaacagaggagattgttcatgccggcaaaaaacctggcggcagcgcaaaagatg

SEQ ID NO: 64145 - DNA, 103 bp, Artificial Sequence
  Synthetic Polynucleotide
taatacgactcactataggggcctcctgatatataaattttgccggtatgaacagaggagacataccatgaaaatttataacctggcggcagcgcaaaagatg

SEQ ID NO: 64146 - DNA, 103 bp, Artificial Sequence
  Synthetic Polynucleotide
taatacgactcactataggggtgtagcctcctgatatataaattttgccgaacagaggagacggcaaatgttatatatcaacctggcggcagcgcaaaagatg

SEQ ID NO: 64147 - DNA, 103 bp, Artificial Sequence
  Synthetic Polynucleotide
taatacgactcactatagggctattgtgtagcctcctgatatataaatttaacagaggagaaaatttatgtatcaggagaacctggcggcagcgcaaaagatg

SEQ ID NO: 64148 - DNA, 103 bp, Artificial Sequence
  Synthetic Polynucleotide
taatacgactcactatagggcactactattgtgtagcctcctgatatataaacagaggagatatataatgggaggctacaacctggcggcagcgcaaaagatg

SEQ ID NO: 64149 - DNA, 103 bp, Artificial Sequence
  Synthetic Polynucleotide
taatacgactcactatagggaataagtattaacatagtggttctactcgaaacagaggagatcgagtatgaccactatgaacctggcggcagcgcaaaagatg

SEQ ID NO: 64150 - DNA, 103 bp, Artificial Sequence
  Synthetic Polynucleotide
taatacgactcactatagggaactacactactattgtgtagcctcctgataacagaggagaatcaggatgctacacaataacctggcggcagcgcaaaagatg

SEQ ID NO: 64151 - DNA, 103 bp, Artificial Sequence
  Synthetic Polynucleotide
taatacgactcactatagggccattaactacactactattgtgtagcctcaacagaggagagaggctatgcaatagtagaacctggcggcagcgcaaaagatg

SEQ ID NO: 64152 - DNA, 103 bp, Artificial Sequence
  Synthetic Polynucleotide
taatacgactcactatagggatattccattaactacactactattgtgtaaacagaggagatacacaatggtagtgtagaacctggcggcagcgcaaaagatg

SEQ ID NO: 64153 - DNA, 103 bp, Artificial Sequence
  Synthetic Polynucleotide
taatacgactcactatagggatttgatattccattaactacactactattaacagaggagaaatagtatggtagttaataacctggcggcagcgcaaaagatg

SEQ ID NO: 64154 - DNA, 103 bp, Artificial Sequence
  Synthetic Polynucleotide
taatacgactcactatagggactagatttgatattccattaactacactaaacagaggagatagtgtatgtaatggaataacctggcggcagcgcaaaagatg

SEQ ID NO: 64155 - DNA, 103 bp, Artificial Sequence
  Synthetic Polynucleotide
taatacgactcactatagggtaaggactagatttgatattccattaactaaacagaggagatagttaatggaatatcaaaacctggcggcagcgcaaaagatg

SEQ ID NO: 64156 - DNA, 103 bp, Artificial Sequence
  Synthetic Polynucleotide
taatacgactcactatagggatagctaaggactagatttgatattccattaacagaggagaaatggaatgtcaaatctaaacctggcggcagcgcaaaagatg

SEQ ID NO: 64157 - DNA, 103 bp, Artificial Sequence
  Synthetic Polynucleotide
taatacgactcactatagggggattatagctaaggactagatttgatattaacagaggagaaatatcatgtctagtcctaacctggcggcagcgcaaaagatg

SEQ ID NO: 64158 - DNA, 103 bp, Artificial Sequence
  Synthetic Polynucleotide
taatacgactcactatagggatatcggattatagctaaggactagatttgaacagaggagacaaatcatgtccttagctaacctggcggcagcgcaaaagatg

SEQ ID NO: 64159 - DNA, 103 bp, Artificial Sequence
  Synthetic Polynucleotide
taatacgactcactatagggatcatatatcggattatagctaaggactagaacagaggagactagtcatgagctataataacctggcggcagcgcaaaagatg

SEQ ID NO: 64160 - DNA, 103 bp, Artificial Sequence
  Synthetic Polynucleotide
taatacgactcactatagggatatgaataagtattaacatagtggttctaaacagaggagatagaacatgtatgttaataacctggcggcagcgcaaaagatg

SEQ ID NO: 64161 - DNA, 103 bp, Artificial Sequence
  Synthetic Polynucleotide
taatacgactcactatagggcattcatcatatatcggattatagctaaggaacagaggagaccttagatgtaatccgataacctggcggcagcgcaaaagatg

SEQ ID NO: 64162 - DNA, 103 bp, Artificial Sequence
  Synthetic Polynucleotide
taatacgactcactatagggtggtccattcatcatatatcggattatagcaacagaggagagctataatgcgatatatgaacctggcggcagcgcaaaagatg

SEQ ID NO: 64163 - DNA, 103 bp, Artificial Sequence
  Synthetic Polynucleotide
taatacgactcactatagggtaatttggtccattcatcatatatcggattaacagaggagaaatccgatgtatgatgaaaacctggcggcagcgcaaaagatg

SEQ ID NO: 64164 - DNA, 103 bp, Artificial Sequence
  Synthetic Polynucleotide
taatacgactcactataggggatgataatttggtccattcatcatatatcaacagaggagagatataatgtgaatggacaacctggcggcagcgcaaaagatg

SEQ ID NO: 64165 - DNA, 103 bp, Artificial Sequence
  Synthetic Polynucleotide
taatacgactcactatagggttaatgatgataatttggtccattcatcataacagaggagaatgatgatgggaccaaataacctggcggcagcgcaaaagatg

SEQ ID NO: 64166 - DNA, 103 bp, Artificial Sequence
  Synthetic Polynucleotide
taatacgactcactatagggaatatttaatgatgataatttggtccattcaacagaggagagaatggatgaaattatcaaacctggcggcagcgcaaaagatg

SEQ ID NO: 64167 - DNA, 103 bp, Artificial Sequence
  Synthetic Polynucleotide
taatacgactcactatagggctaggaatatttaatgatgataatttggtcaacagaggagagaccaaatgatcatcattaacctggcggcagcgcaaaagatg

SEQ ID NO: 64168 - DNA, 103 bp, Artificial Sequence
  Synthetic Polynucleotide
taatacgactcactatagggtaattctaggaatatttaatgatgataattaacagaggagaaattatatgcattaaataaacctggcggcagcgcaaaagatg

SEQ ID NO: 64169 - DNA, 103 bp, Artificial Sequence
  Synthetic Polynucleotide
taatacgactcactatagggaggattaattctaggaatatttaatgatgaaacagaggagatcatcaatgaatattcctaacctggcggcagcgcaaaagatg

SEQ ID NO: 64170 - DNA, 103 bp, Artificial Sequence
  Synthetic Polynucleotide
taatacgactcactatagggagagcaggattaattctaggaatatttaataacagaggagaattaaaatgtcctagaataacctggcggcagcgcaaaagatg

SEQ ID NO: 64171 - DNA, 103 bp, Artificial Sequence
  Synthetic Polynucleotide
taatacgactcactatagggctaaaatatgaataagtattaacatagtggaacagaggagaccactaatgtaatacttaaacctggcggcagcgcaaaagatg

SEQ ID NO: 64172 - DNA, 103 bp, Artificial Sequence
  Synthetic Polynucleotide
taatacgactcactatagggaccatagagcaggattaattctaggaatataacagaggagaatattcatggaattaatcaacctggcggcagcgcaaaagatg

SEQ ID NO: 64173 - DNA, 103 bp, Artificial Sequence
  Synthetic Polynucleotide
taatacgactcactatagggcactgaccatagagcaggattaattctaggaacagaggagacctagaatgaatcctgctaacctggcggcagcgcaaaagatg

SEQ ID NO: 64174 - DNA, 103 bp, Artificial Sequence
  Synthetic Polynucleotide
taatacgactcactatagggttatgcactgaccatagagcaggattaattaacagaggagaaattaaatgtgctctatgaacctggcggcagcgcaaaagatg

SEQ ID NO: 64175 - DNA, 103 bp, Artificial Sequence
  Synthetic Polynucleotide
taatacgactcactatagggctttattatgcactgaccatagagcaggataacagaggagaatcctgatgtatggtcagaacctggcggcagcgcaaaagatg

SEQ ID NO: 64176 - DNA, 103 bp, Artificial Sequence
  Synthetic Polynucleotide
taatacgactcactatagggatatactttattatgcactgaccatagagcaacagaggagagctctaatgtcagtgcataacctggcggcagcgcaaaagatg

SEQ ID NO: 64177 - DNA, 103 bp, Artificial Sequence
  Synthetic Polynucleotide
taatacgactcactatagggcctacatatactttattatgcactgaccataacagaggagaatggtcatggcataataaaacctggcggcagcgcaaaagatg

SEQ ID NO: 64178 - DNA, 103 bp, Artificial Sequence
  Synthetic Polynucleotide
taatacgactcactatagggttcctcctacatatactttattatgcactgaacagaggagacagtgcatgataaagtataacctggcggcagcgcaaaagatg

SEQ ID NO: 64179 - DNA, 103 bp, Artificial Sequence
  Synthetic Polynucleotide
taatacgactcactatagggagatattcctcctacatatactttattatgaacagaggagacataatatggtatatgtaaacctggcggcagcgcaaaagatg

SEQ ID NO: 64180 - DNA, 103 bp, Artificial Sequence
  Synthetic Polynucleotide
taatacgactcactatagggtcatcagatattcctcctacatatactttaaacagaggagataaagtatgtgtaggaggaacctggcggcagcgcaaaagatg

SEQ ID NO: 64181 - DNA, 103 bp, Artificial Sequence
  Synthetic Polynucleotide
taatacgactcactataggggaatatcatcagatattcctcctacatataaacagaggagatatatgatggaggaatataacctggcggcagcgcaaaagatg

SEQ ID NO: 64182 - DNA, 103 bp, Artificial Sequence
  Synthetic Polynucleotide
taatacgactcactatagggaaaaactaaaatatgaataagtattaacataacagaggagaatgttaatgcttattcataacctggcggcagcgcaaaagatg

SEQ ID NO: 64183 - DNA, 103 bp, Artificial Sequence
  Synthetic Polynucleotide
taatacgactcactatagggagtttgaatatcatcagatattcctcctacaacagaggagagtaggaatgatatctgataacctggcggcagcgcaaaagatg

SEQ ID NO: 64184 - DNA, 103 bp, Artificial Sequence
  Synthetic Polynucleotide
taatacgactcactataggggtattagtttgaatatcatcagatattcctaacagaggagaaggaatatgtgatgatataacctggcggcagcgcaaaagatg

SEQ ID NO: 64185 - DNA, 103 bp, Artificial Sequence
  Synthetic Polynucleotide
taatacgactcactatagggcagatgtattagtttgaatatcatcagataaacagaggagatatctgatgatattcaaaaacctggcggcagcgcaaaagatg

SEQ ID NO: 64186 - DNA, 103 bp, Artificial Sequence
  Synthetic Polynucleotide
taatacgactcactatagggtgtttcagatgtattagtttgaatatcatcaacagaggagagatgatatgcaaactaataacctggcggcagcgcaaaagatg

SEQ ID NO: 64187 - DNA, 103 bp, Artificial Sequence
  Synthetic Polynucleotide
taatacgactcactatagggttgtatgtttcagatgtattagtttgaataaacagaggagatattcaatgtaatacatcaacctggcggcagcgcaaaagatg

SEQ ID NO: 64188 - DNA, 103 bp, Artificial Sequence
  Synthetic Polynucleotide
taatacgactcactatagggctttgttgtatgtttcagatgtattagtttaacagaggagaaaactaatgcatctgaaaaacctggcggcagcgcaaaagatg

SEQ ID NO: 64189 - DNA, 103 bp, Artificial Sequence
  Synthetic Polynucleotide
taatacgactcactatagggtttttctttgttgtatgtttcagatgtattaacagaggagaaatacaatggaaacatacaacctggcggcagcgcaaaagatg

SEQ ID NO: 64190 - DNA, 103 bp, Artificial Sequence
  Synthetic Polynucleotide
taatacgactcactatagggcgatctttttctttgttgtatgtttcagataacagaggagaatctgaatgatacaacaaaacctggcggcagcgcaaaagatg

SEQ ID NO: 64191 - DNA, 103 bp, Artificial Sequence
  Synthetic Polynucleotide
taatacgactcactatagggtccaacgatctttttctttgttgtatgtttaacagaggagaaaacatatgacaaagaaaaacctggcggcagcgcaaaagatg

SEQ ID NO: 64192 - DNA, 103 bp, Artificial Sequence
  Synthetic Polynucleotide
taatacgactcactatagggcaatgtccaacgatctttttctttgttgtaaacagaggagatacaacatggaaaaagataacctggcggcagcgcaaaagatg

SEQ ID NO: 64193 - DNA, 103 bp, Artificial Sequence
  Synthetic Polynucleotide
taatacgactcactatagggatcctaaaaactaaaatatgaataagtattaacagaggagaaatactatgtcatattttaacctggcggcagcgcaaaagatg

SEQ ID NO: 64194 - DNA, 103 bp, Artificial Sequence
  Synthetic Polynucleotide
taatacgactcactatagggttatccaatgtccaacgatctttttctttgaacagaggagacaaagaatgagatcgttgaacctggcggcagcgcaaaagatg

SEQ ID NO: 64195 - DNA, 103 bp, Artificial Sequence
  Synthetic Polynucleotide
taatacgactcactataggggactattatccaatgtccaacgatctttttaacagaggagaaaaaagatggttggacataacctggcggcagcgcaaaagatg

SEQ ID NO: 64196 - DNA, 103 bp, Artificial Sequence
  Synthetic Polynucleotide
taatacgactcactatagggcacgtgactattatccaatgtccaacgatcaacagaggagagatcgtatgacattggataacctggcggcagcgcaaaagatg

SEQ ID NO: 64197 - DNA, 103 bp, Artificial Sequence
  Synthetic Polynucleotide
taatacgactcactatagggggtaacacgtgactattatccaatgtccaaaacagaggagattggacatgggataatagaacctggcggcagcgcaaaagatg

SEQ ID NO: 64198 - DNA, 103 bp, Artificial Sequence
  Synthetic Polynucleotide
taatacgactcactatagggtgcgtggtaacacgtgactattatccaatgaacagaggagacattggatgatagtcacgaacctggcggcagcgcaaaagatg

SEQ ID NO: 64199 - DNA, 103 bp, Artificial Sequence
  Synthetic Polynucleotide
taatacgactcactatagggataattgcgtggtaacacgtgactattatcaacagaggagagataatatgcacgtgttaaacctggcggcagcgcaaaagatg

SEQ ID NO: 64200 - DNA, 103 bp, Artificial Sequence
  Synthetic Polynucleotide
taatacgactcactatagggattatataattgcgtggtaacacgtgactaaacagaggagatagtcaatggttaccacgaacctggcggcagcgcaaaagatg

SEQ ID NO: 64201 - DNA, 103 bp, Artificial Sequence
  Synthetic Polynucleotide
taatacgactcactatagggtatacattatataattgcgtggtaacacgtaacagaggagaacgtgtatgcacgcaattaacctggcggcagcgcaaaagatg

SEQ ID NO: 64202 - DNA, 103 bp, Artificial Sequence
  Synthetic Polynucleotide
taatacgactcactataggggcatttatacattatataattgcgtggtaaaacagaggagattaccaatgaattatataaacctggcggcagcgcaaaagatg

SEQ ID NO: 64203 - DNA, 103 bp, Artificial Sequence
  Synthetic Polynucleotide
taatacgactcactatagggggttcgcatttatacattatataattgcgtaacagaggagaacgcaaatgtataatgtaaacctggcggcagcgcaaaagatg

SEQ ID NO: 64204 - DNA, 103 bp, Artificial Sequence
  Synthetic Polynucleotide
taatacgactcactatagggtatcaatcctaaaaactaaaatatgaataaaacagaggagattattcatgttttagtttaacctggcggcagcgcaaaagatg

SEQ ID NO: 64205 - DNA, 103 bp, Artificial Sequence
  Synthetic Polynucleotide
taatacgactcactatagggtaatcggttcgcatttatacattatataataacagaggagaattataatgtgtataaataacctggcggcagcgcaaaagatg

SEQ ID NO: 64206 - DNA, 103 bp, Artificial Sequence
  Synthetic Polynucleotide
taatacgactcactatagggatgtttaatcggttcgcatttatacattataacagaggagaataatgatgaaatgcgaaaacctggcggcagcgcaaaagatg

SEQ ID NO: 64207 - DNA, 103 bp, Artificial Sequence
  Synthetic Polynucleotide
taatacgactcactatagggtatttatgtttaatcggttcgcatttatacaacagaggagagtataaatgcgaaccgataacctggcggcagcgcaaaagatg

SEQ ID NO: 64208 - DNA, 103 bp, Artificial Sequence
  Synthetic Polynucleotide
taatacgactcactatagggatggatatttatgtttaatcggttcgcattaacagaggagaaatgcgatgcgattaaacaacctggcggcagcgcaaaagatg

SEQ ID NO: 64209 - DNA, 103 bp, Artificial Sequence
  Synthetic Polynucleotide
taatacgactcactatagggttccaatggatatttatgtttaatcggttcaacagaggagagaaccgatgaaacataaaaacctggcggcagcgcaaaagatg

SEQ ID NO: 64210 - DNA, 103 bp, Artificial Sequence
  Synthetic Polynucleotide
taatacgactcactatagggtgtttttccaatggatatttatgtttaatcaacagaggagagattaaatgtaaatatccaacctggcggcagcgcaaaagatg

SEQ ID NO: 64211 - DNA, 103 bp, Artificial Sequence
  Synthetic Polynucleotide
taatacgactcactatagggtactgtgtttttccaatggatatttatgttaacagaggagaaacataatgatccattggaacctggcggcagcgcaaaagatg

SEQ ID NO: 64212 - DNA, 103 bp, Artificial Sequence
  Synthetic Polynucleotide
taatacgactcactatagggtcgtgtactgtgtttttccaatggatatttaacagaggagaaaatatatgttggaaaaaaacctggcggcagcgcaaaagatg

SEQ ID NO: 64213 - DNA, 103 bp, Artificial Sequence
  Synthetic Polynucleotide
taatacgactcactatagggatcattcgtgtactgtgtttttccaatggaaacagaggagatccattatgaaaacacagaacctggcggcagcgcaaaagatg

SEQ ID NO: 64214 - DNA, 103 bp, Artificial Sequence
  Synthetic Polynucleotide
taatacgactcactatagggagaaaatcattcgtgtactgtgtttttccaaacagaggagatggaaaatgacagtacacaacctggcggcagcgcaaaagatg

SEQ ID NO: 64215 - DNA, 103 bp, Artificial Sequence
  Synthetic Polynucleotide
taatacgactcactatagggttgattatcaatcctaaaaactaaaatatgaacagaggagacatattatggtttttaggaacctggcggcagcgcaaaagatg

SEQ ID NO: 64216 - DNA, 103 bp, Artificial Sequence
  Synthetic Polynucleotide
taatacgactcactatagggactttagaaaatcattcgtgtactgtgtttaacagaggagaaaacacatgacacgaatgaacctggcggcagcgcaaaagatg

SEQ ID NO: 64217 - DNA, 103 bp, Artificial Sequence
  Synthetic Polynucleotide
taatacgactcactatagggcaagtactttagaaaatcattcgtgtactgaacagaggagacagtacatgaatgattttaacctggcggcagcgcaaaagatg

SEQ ID NO: 64218 - DNA, 103 bp, Artificial Sequence
  Synthetic Polynucleotide
taatacgactcactatagggctttccaagtactttagaaaatcattcgtgaacagaggagacacgaaatgttttctaaaaacctggcggcagcgcaaaagatg

SEQ ID NO: 64219 - DNA, 103 bp, Artificial Sequence
  Synthetic Polynucleotide
taatacgactcactatagggtaaaactttccaagtactttagaaaatcataacagaggagaatgattatgtaaagtactaacctggcggcagcgcaaaagatg

SEQ ID NO: 64220 - DNA, 103 bp, Artificial Sequence
  Synthetic Polynucleotide
taatacgactcactatagggacatataaaactttccaagtactttagaaaaacagaggagatttctaatgtacttggaaaacctggcggcagcgcaaaagatg

SEQ ID NO: 64221 - DNA, 103 bp, Artificial Sequence
  Synthetic Polynucleotide
taatacgactcactatagggcaactacatataaaactttccaagtactttaacagaggagaaaagtaatgggaaagtttaacctggcggcagcgcaaaagatg

SEQ ID NO: 64222 - DNA, 103 bp, Artificial Sequence
  Synthetic Polynucleotide
taatacgactcactatagggtctatcaactacatataaaactttccaagtaacagaggagaacttggatggttttatataacctggcggcagcgcaaaagatg

SEQ ID NO: 64223 - DNA, 103 bp, Artificial Sequence
  Synthetic Polynucleotide
taatacgactcactatagggtttgttctatcaactacatataaaactttcaacagaggagagaaagtatgatatgtagtaacctggcggcagcgcaaaagatg

SEQ ID NO: 64224 - DNA, 103 bp, Artificial Sequence
  Synthetic Polynucleotide
taatacgactcactatagggtgtattttgttctatcaactacatataaaaaacagaggagattttatatgtagttgataaacctggcggcagcgcaaaagatg

SEQ ID NO: 64225 - DNA, 103 bp, Artificial Sequence
  Synthetic Polynucleotide
taatacgactcactatagggaaatatgtattttgttctatcaactacataaacagaggagatatgtaatggatagaacaaacctggcggcagcgcaaaagatg

SEQ ID NO: 64226 - DNA, 103 bp, Artificial Sequence
  Synthetic Polynucleotide
taatacgactcactatagggttatgttgattatcaatcctaaaaactaaaaacagaggagatttagtatgtaggattgaaacctggcggcagcgcaaaagatg

SEQ ID NO: 64227 - DNA, 103 bp, Artificial Sequence
  Synthetic Polynucleotide
taatacgactcactatagggacaaaaaatatgtattttgttctatcaactaacagaggagaagttgaatgaacaaaataaacctggcggcagcgcaaaagatg

SEQ ID NO: 64228 - DNA, 103 bp, Artificial Sequence
  Synthetic Polynucleotide
taatacgactcactatagggtttttacaaaaaatatgtattttgttctataacagaggagaatagaaatgaatacatataacctggcggcagcgcaaaagatg

SEQ ID NO: 64229 - DNA, 103 bp, Artificial Sequence
  Synthetic Polynucleotide
taatacgactcactatagggatttatttttacaaaaaatatgtattttgtaacagaggagaacaaaaatgatattttttaacctggcggcagcgcaaaagatg

SEQ ID NO: 64230 - DNA, 103 bp, Artificial Sequence
  Synthetic Polynucleotide
taatacgactcactatagggaagtgatttatttttacaaaaaatatgtataacagaggagaatacatatgttttgtaaaaacctggcggcagcgcaaaagatg

SEQ ID NO: 64231 - DNA, 103 bp, Artificial Sequence
  Synthetic Polynucleotide
taatacgactcactatagggataaaaagtgatttatttttacaaaaaataaacagaggagatattttatgtaaaaataaaacctggcggcagcgcaaaagatg

SEQ ID NO: 64232 - DNA, 103 bp, Artificial Sequence
  Synthetic Polynucleotide
taatacgactcactatagggttagtataaaaagtgatttatttttacaaaaacagaggagatttgtaatgataaatcacaacctggcggcagcgcaaaagatg

SEQ ID NO: 64233 - DNA, 103 bp, Artificial Sequence
  Synthetic Polynucleotide
taatacgactcactatagggtcatattagtataaaaagtgatttatttttaacagaggagaaaaaatatgtcactttttaacctggcggcagcgcaaaagatg

SEQ ID NO: 64234 - DNA, 103 bp, Artificial Sequence
  Synthetic Polynucleotide
taatacgactcactatagggtcgtgtcatattagtataaaaagtgatttaaacagaggagataaatcatgttttatactaacctggcggcagcgcaaaagatg

SEQ ID NO: 64235 - DNA, 103 bp, Artificial Sequence
  Synthetic Polynucleotide
taatacgactcactataggggacaatcgtgtcatattagtataaaaagtgaacagaggagacactttatgtactaatataacctggcggcagcgcaaaagatg

SEQ ID NO: 64236 - DNA, 103 bp, Artificial Sequence
  Synthetic Polynucleotide
taatacgactcactataggggtattgacaatcgtgtcatattagtataaaaacagaggagatttataatgatatgacacaacctggcggcagcgcaaaagatg

SEQ ID NO: 64237 - DNA, 103 bp, Artificial Sequence
  Synthetic Polynucleotide
taatacgactcactatagggtgttaatggcttatgtaaacgataaactcaaacagaggagatgagttatgcgtttacataacctggcggcagcgcaaaagatg

SEQ ID NO: 64238 - DNA, 103 bp, Artificial Sequence
  Synthetic Polynucleotide
taatacgactcactatagggaatttttatgttgattatcaatcctaaaaaaacagaggagatttttaatgttgataatcaacctggcggcagcgcaaaagatg

SEQ ID NO: 64239 - DNA, 103 bp, Artificial Sequence
  Synthetic Polynucleotide
taatacgactcactatagggcaaaagtattgacaatcgtgtcatattagtaacagaggagaactaatatgacacgattgaacctggcggcagcgcaaaagatg

SEQ ID NO: 64240 - DNA, 103 bp, Artificial Sequence
  Synthetic Polynucleotide
taatacgactcactatagggagtaacaaaagtattgacaatcgtgtcataaacagaggagatatgacatgattgtcaataacctggcggcagcgcaaaagatg

SEQ ID NO: 64241 - DNA, 103 bp, Artificial Sequence
  Synthetic Polynucleotide
taatacgactcactatagggatattagtaacaaaagtattgacaatcgtgaacagaggagacacgatatgcaatactttaacctggcggcagcgcaaaagatg

SEQ ID NO: 64242 - DNA, 103 bp, Artificial Sequence
  Synthetic Polynucleotide
taatacgactcactatagggtaatgatattagtaacaaaagtattgacaaaacagaggagattgtcaatgcttttgttaaacctggcggcagcgcaaaagatg

SEQ ID NO: 64243 - DNA, 103 bp, Artificial Sequence
  Synthetic Polynucleotide
taatacgactcactatagggtatactaatgatattagtaacaaaagtattaacagaggagaaatactatggttactaataacctggcggcagcgcaaaagatg

SEQ ID NO: 64244 - DNA, 103 bp, Artificial Sequence
  Synthetic Polynucleotide
taatacgactcactatagggtagagtatactaatgatattagtaacaaaaaacagaggagattttgtatgtaatatcataacctggcggcagcgcaaaagatg

SEQ ID NO: 64245 - DNA, 103 bp, Artificial Sequence
  Synthetic Polynucleotide
taatacgactcactatagggaggtgtagagtatactaatgatattagtaaaacagaggagattactaatgtcattagtaaacctggcggcagcgcaaaagatg

SEQ ID NO: 64246 - DNA, 103 bp, Artificial Sequence
  Synthetic Polynucleotide
taatacgactcactatagggggataaggtgtagagtatactaatgatattaacagaggagaaatatcatgagtatactcaacctggcggcagcgcaaaagatg

SEQ ID NO: 64247 - DNA, 103 bp, Artificial Sequence
  Synthetic Polynucleotide
taatacgactcactatagggtctgaggataaggtgtagagtatactaatgaacagaggagacattagatgactctacacaacctggcggcagcgcaaaagatg

SEQ ID NO: 64248 - DNA, 103 bp, Artificial Sequence
  Synthetic Polynucleotide
taatacgactcactatagggctgtgtctgaggataaggtgtagagtatacaacagaggagagtatacatgacaccttataacctggcggcagcgcaaaagatg

SEQ ID NO: 64249 - DNA, 103 bp, Artificial Sequence
  Synthetic Polynucleotide
taatacgactcactataggggtattaatttttatgttgattatcaatcctaacagaggagaaggattatgaatcaacataacctggcggcagcgcaaaagatg

SEQ ID NO: 64250 - DNA, 103 bp, Artificial Sequence
  Synthetic Polynucleotide
taatacgactcactataggggatatctgtgtctgaggataaggtgtagagaacagaggagactctacatgttatcctcaaacctggcggcagcgcaaaagatg

SEQ ID NO: 64251 - DNA, 103 bp, Artificial Sequence
  Synthetic Polynucleotide
taatacgactcactatagggttttagatatctgtgtctgaggataaggtgaacagaggagacaccttatgctcagacacaacctggcggcagcgcaaaagatg

SEQ ID NO: 64252 - DNA, 103 bp, Artificial Sequence
  Synthetic Polynucleotide
taatacgactcactatagggtatttttttagatatctgtgtctgaggataaacagaggagatatcctatgacacagataaacctggcggcagcgcaaaagatg

SEQ ID NO: 64253 - DNA, 103 bp, Artificial Sequence
  Synthetic Polynucleotide
taatacgactcactatagggtcacctatttttttagatatctgtgtctgaaacagaggagatcagacatggatatctaaaacctggcggcagcgcaaaagatg

SEQ ID NO: 64254 - DNA, 103 bp, Artificial Sequence
  Synthetic Polynucleotide
taatacgactcactatagggcatcatcacctatttttttagatatctgtgaacagaggagacacagaatgctaaaaaaaaacctggcggcagcgcaaaagatg

SEQ ID NO: 64255 - DNA, 103 bp, Artificial Sequence
  Synthetic Polynucleotide
taatacgactcactatagggagttgcatcatcacctatttttttagatataacagaggagaatatctatgaaaataggtaacctggcggcagcgcaaaagatg

SEQ ID NO: 64256 - DNA, 103 bp, Artificial Sequence
  Synthetic Polynucleotide
taatacgactcactataggggatagagttgcatcatcacctatttttttaaacagaggagataaaaaatgaggtgatgaaacctggcggcagcgcaaaagatg

SEQ ID NO: 64257 - DNA, 103 bp, Artificial Sequence
  Synthetic Polynucleotide
taatacgactcactatagggtacatgatagagttgcatcatcacctatttaacagaggagaaaatagatgatgatgcaaaacctggcggcagcgcaaaagatg

SEQ ID NO: 64258 - DNA, 103 bp, Artificial Sequence
  Synthetic Polynucleotide
taatacgactcactatagggtctactacatgatagagttgcatcatcaccaacagaggagaggtgatatggcaactctaaacctggcggcagcgcaaaagatg

SEQ ID NO: 64259 - DNA, 103 bp, Artificial Sequence
  Synthetic Polynucleotide
taatacgactcactatagggttatttctactacatgatagagttgcatcaaacagaggagatgatgcatgtctatcatgaacctggcggcagcgcaaaagatg

SEQ ID NO: 64260 - DNA, 103 bp, Artificial Sequence
  Synthetic Polynucleotide
taatacgactcactatagggatgatgtattaatttttatgttgattatcaaacagaggagatgataaatgacataaaaaaacctggcggcagcgcaaaagatg

SEQ ID NO: 64261 - DNA, 103 bp, Artificial Sequence
  Synthetic Polynucleotide
taatacgactcactatagggttatattatttctactacatgatagagttgaacagaggagacaactcatgcatgtagtaaacctggcggcagcgcaaaagatg

SEQ ID NO: 64262 - DNA, 103 bp, Artificial Sequence
  Synthetic Polynucleotide
taatacgactcactatagggatcatttatattatttctactacatgatagaacagaggagactatcaatgagtagaaataacctggcggcagcgcaaaagatg

SEQ ID NO: 64263 - DNA, 103 bp, Artificial Sequence
  Synthetic Polynucleotide
taatacgactcactatagggacataatcatttatattatttctactacataacagaggagaatgtagatgaaataatataacctggcggcagcgcaaaagatg

SEQ ID NO: 64264 - DNA, 103 bp, Artificial Sequence
  Synthetic Polynucleotide
taatacgactcactatagggtaacaacataatcatttatattatttctacaacagaggagagtagaaatgatataaatgaacctggcggcagcgcaaaagatg

SEQ ID NO: 64265 - DNA, 103 bp, Artificial Sequence
  Synthetic Polynucleotide
taatacgactcactatagggactcataacaacataatcatttatattattaacagaggagaaataatatgaatgattataacctggcggcagcgcaaaagatg

SEQ ID NO: 64266 - DNA, 103 bp, Artificial Sequence
  Synthetic Polynucleotide
taatacgactcactatagggcaagcactcataacaacataatcatttataaacagaggagatataaaatgttatgttgtaacctggcggcagcgcaaaagatg

SEQ ID NO: 64267 - DNA, 103 bp, Artificial Sequence
  Synthetic Polynucleotide
taatacgactcactatagggtataccaagcactcataacaacataatcataacagaggagaatgattatgttgttatgaaacctggcggcagcgcaaaagatg

SEQ ID NO: 64268 - DNA, 103 bp, Artificial Sequence
  Synthetic Polynucleotide
taatacgactcactatagggctccttataccaagcactcataacaacataaacagaggagatatgttatgatgagtgctaacctggcggcagcgcaaaagatg

SEQ ID NO: 64269 - DNA, 103 bp, Artificial Sequence
  Synthetic Polynucleotide
taatacgactcactatagggttgggctccttataccaagcactcataacaaacagaggagatgttatatgtgcttggtaaacctggcggcagcgcaaaagatg

SEQ ID NO: 64270 - DNA, 103 bp, Artificial Sequence
  Synthetic Polynucleotide
taatacgactcactatagggtggaattgggctccttataccaagcactcaaacagaggagatgagtgatgggtataaggaacctggcggcagcgcaaaagatg

SEQ ID NO: 64271 - DNA, 103 bp, Artificial Sequence
  Synthetic Polynucleotide
taatacgactcactatagggaattgatgatgtattaatttttatgttgataacagaggagaatcaacatgaaaattaataacctggcggcagcgcaaaagatg

SEQ ID NO: 64272 - DNA, 103 bp, Artificial Sequence
  Synthetic Polynucleotide
taatacgactcactatagggaataatggaattgggctccttataccaagcaacagaggagagcttggatgaaggagcccaacctggcggcagcgcaaaagatg

SEQ ID NO: 64273 - DNA, 103 bp, Artificial Sequence
  Synthetic Polynucleotide
taatacgactcactatagggaaaagaataatggaattgggctccttatacaacagaggagagtataaatggcccaattcaacctggcggcagcgcaaaagatg

SEQ ID NO: 64274 - DNA, 103 bp, Artificial Sequence
  Synthetic Polynucleotide
taatacgactcactatagggcagctaaaagaataatggaattgggctcctaacagaggagaaggagcatgattccattaaacctggcggcagcgcaaaagatg

SEQ ID NO: 64275 - DNA, 103 bp, Artificial Sequence
  Synthetic Polynucleotide
taatacgactcactatagggtttggcagctaaaagaataatggaattgggaacagaggagacccaatatgattattcttaacctggcggcagcgcaaaagatg

SEQ ID NO: 64276 - DNA, 103 bp, Artificial Sequence
  Synthetic Polynucleotide
taatacgactcactatagggtcacttttggcagctaaaagaataatggaaaacagaggagattccatatgtcttttagcaacctggcggcagcgcaaaagatg

SEQ ID NO: 64277 - DNA, 103 bp, Artificial Sequence
  Synthetic Polynucleotide
taatacgactcactatagggagacgtcacttttggcagctaaaagaataaaacagaggagattattcatgtagctgccaaacctggcggcagcgcaaaagatg

SEQ ID NO: 64278 - DNA, 103 bp, Artificial Sequence
  Synthetic Polynucleotide
taatacgactcactatagggatacaagacgtcacttttggcagctaaaagaacagaggagacttttaatggccaaaagtaacctggcggcagcgcaaaagatg

SEQ ID NO: 64279 - DNA, 103 bp, Artificial Sequence
  Synthetic Polynucleotide
taatacgactcactatagggtcaaaatacaagacgtcacttttggcagctaacagaggagaagctgcatgaagtgacgtaacctggcggcagcgcaaaagatg

SEQ ID NO: 64280 - DNA, 103 bp, Artificial Sequence
  Synthetic Polynucleotide
taatacgactcactatagggaattatcaaaatacaagacgtcacttttggaacagaggagaccaaaaatgacgtcttgtaacctggcggcagcgcaaaagatg

SEQ ID NO: 64281 - DNA, 103 bp, Artificial Sequence
  Synthetic Polynucleotide
taatacgactcactatagggggtataattatcaaaatacaagacgtcactaacagaggagaagtgacatgttgtattttaacctggcggcagcgcaaaagatg

SEQ ID NO: 64282 - DNA, 103 bp, Artificial Sequence
  Synthetic Polynucleotide
taatacgactcactatagggttcaaaattgatgatgtattaatttttatgaacagaggagacataaaatgtaatacatcaacctggcggcagcgcaaaagatg

SEQ ID NO: 64283 - DNA, 103 bp, Artificial Sequence
  Synthetic Polynucleotide
taatacgactcactatagggtccttggtataattatcaaaatacaagacgaacagaggagacgtcttatgttttgataaaacctggcggcagcgcaaaagatg

SEQ ID NO: 64284 - DNA, 103 bp, Artificial Sequence
  Synthetic Polynucleotide
taatacgactcactatagggttttatccttggtataattatcaaaatacaaacagaggagatgtattatgataattataaacctggcggcagcgcaaaagatg

SEQ ID NO: 64285 - DNA, 103 bp, Artificial Sequence
  Synthetic Polynucleotide
taatacgactcactatagggtgatattttatccttggtataattatcaaaaacagaggagatttgatatgtataccaagaacctggcggcagcgcaaaagatg

SEQ ID NO: 64286 - DNA, 103 bp, Artificial Sequence
  Synthetic Polynucleotide
taatacgactcactatagggtcgtatgatattttatccttggtataattaaacagaggagataattaatgcaaggataaaacctggcggcagcgcaaaagatg

SEQ ID NO: 64287 - DNA, 103 bp, Artificial Sequence
  Synthetic Polynucleotide
taatacgactcactataggggagaatcgtatgatattttatccttggtataacagaggagaataccaatgataaaatataacctggcggcagcgcaaaagatg

SEQ ID NO: 64288 - DNA, 103 bp, Artificial Sequence
  Synthetic Polynucleotide
taatacgactcactataggggtatggagaatcgtatgatattttatccttaacagaggagaaaggatatgatatcatacaacctggcggcagcgcaaaagatg

SEQ ID NO: 64289 - DNA, 103 bp, Artificial Sequence
  Synthetic Polynucleotide
taatacgactcactatagggtcatcgtatggagaatcgtatgatattttaaacagaggagataaaatatgatacgattcaacctggcggcagcgcaaaagatg

SEQ ID NO: 64290 - DNA, 103 bp, Artificial Sequence
  Synthetic Polynucleotide
taatacgactcactatagggctagatcatcgtatggagaatcgtatgataaacagaggagatatcatatgattctccataacctggcggcagcgcaaaagatg

SEQ ID NO: 64291 - DNA, 103 bp, Artificial Sequence
  Synthetic Polynucleotide
taatacgactcactatagggtgtaactagatcatcgtatggagaatcgtaaacagaggagatacgatatgccatacgataacctggcggcagcgcaaaagatg

SEQ ID NO: 64292 - DNA, 103 bp, Artificial Sequence
  Synthetic Polynucleotide
taatacgactcactatagggatagttgtaactagatcatcgtatggagaaaacagaggagattctccatgcgatgatctaacctggcggcagcgcaaaagatg

SEQ ID NO: 64293 - DNA, 103 bp, Artificial Sequence
  Synthetic Polynucleotide
taatacgactcactataggggtattttcaaaattgatgatgtattaatttaacagaggagaaaattaatgcatcatcaaaacctggcggcagcgcaaaagatg

SEQ ID NO: 64294 - DNA, 103 bp, Artificial Sequence
  Synthetic Polynucleotide
taatacgactcactatagggttgtaatagttgtaactagatcatcgtatgaacagaggagacatacgatgatctagttaaacctggcggcagcgcaaaagatg

SEQ ID NO: 64295 - DNA, 103 bp, Artificial Sequence
  Synthetic Polynucleotide
taatacgactcactatagggtttaattgtaatagttgtaactagatcatcaacagaggagagatgatatggttacaactaacctggcggcagcgcaaaagatg

SEQ ID NO: 64296 - DNA, 103 bp, Artificial Sequence
  Synthetic Polynucleotide
taatacgactcactatagggaatgatttaattgtaatagttgtaactagaaacagaggagatctagtatgaactattacaacctggcggcagcgcaaaagatg

SEQ ID NO: 64297 - DNA, 103 bp, Artificial Sequence
  Synthetic Polynucleotide
taatacgactcactatagggcagtcaatgatttaattgtaatagttgtaaaacagaggagattacaaatgttacaattaaacctggcggcagcgcaaaagatg

SEQ ID NO: 64298 - DNA, 103 bp, Artificial Sequence
  Synthetic Polynucleotide
taatacgactcactatagggtttagcagtcaatgatttaattgtaatagtaacagaggagaactattatgattaaatcaaacctggcggcagcgcaaaagatg

SEQ ID NO: 64299 - DNA, 103 bp, Artificial Sequence
  Synthetic Polynucleotide
taatacgactcactataggggcatctttagcagtcaatgatttaattgtaaacagaggagatacaatatgatcattgacaacctggcggcagcgcaaaagatg

SEQ ID NO: 64300 - DNA, 103 bp, Artificial Sequence
  Synthetic Polynucleotide
taatacgactcactatagggtaccggcatctttagcagtcaatgatttaaaacagaggagattaaatatgtgactgctaaacctggcggcagcgcaaaagatg

SEQ ID NO: 64301 - DNA, 103 bp, Artificial Sequence
  Synthetic Polynucleotide
taatacgactcactatagggataagtaccggcatctttagcagtcaatgaaacagaggagatcattgatggctaaagataacctggcggcagcgcaaaagatg

SEQ ID NO: 64302 - DNA, 103 bp, Artificial Sequence
  Synthetic Polynucleotide
taatacgactcactatagggcatacataagtaccggcatctttagcagtcaacagaggagagactgcatgagatgccggaacctggcggcagcgcaaaagatg

SEQ ID NO: 64303 - DNA, 103 bp, Artificial Sequence
  Synthetic Polynucleotide
taatacgactcactatagggatgcacatacataagtaccggcatctttagaacagaggagactaaagatgccggtacttaacctggcggcagcgcaaaagatg

SEQ ID NO: 64304 - DNA, 103 bp, Artificial Sequence
  Synthetic Polynucleotide
taatacgactcactatagggactaagtattttcaaaattgatgatgtattaacagaggagaaatacaatgtcaattttgaacctggcggcagcgcaaaagatg

SEQ ID NO: 64305 - DNA, 103 bp, Artificial Sequence
  Synthetic Polynucleotide
taatacgactcactatagggaaagaatgcacatacataagtaccggcatcaacagaggagagatgccatgacttatgtaaacctggcggcagcgcaaaagatg

SEQ ID NO: 64306 - DNA, 103 bp, Artificial Sequence
  Synthetic Polynucleotide
taatacgactcactataggggtcataaagaatgcacatacataagtaccgaacagaggagacggtacatgtgtatgtgcaacctggcggcagcgcaaaagatg

SEQ ID NO: 64307 - DNA, 103 bp, Artificial Sequence
  Synthetic Polynucleotide
taatacgactcactatagggttgatgtcataaagaatgcacatacataagaacagaggagacttatgatggtgcattctaacctggcggcagcgcaaaagatg

SEQ ID NO: 64308 - DNA, 103 bp, Artificial Sequence
  Synthetic Polynucleotide
taatacgactcactatagggtgtagttgatgtcataaagaatgcacatacaacagaggagagtatgtatgttctttatgaacctggcggcagcgcaaaagatg

SEQ ID NO: 64309 - DNA, 103 bp, Artificial Sequence
  Synthetic Polynucleotide
taatacgactcactatagggtcatttgtagttgatgtcataaagaatgcaaacagaggagatgcattatgtatgacatcaacctggcggcagcgcaaaagatg

SEQ ID NO: 64310 - DNA, 103 bp, Artificial Sequence
  Synthetic Polynucleotide
taatacgactcactatagggcagtatcatttgtagttgatgtcataaagaaacagaggagatctttaatgcatcaactaaacctggcggcagcgcaaaagatg

SEQ ID NO: 64311 - DNA, 103 bp, Artificial Sequence
  Synthetic Polynucleotide
taatacgactcactatagggtttatcagtatcatttgtagttgatgtcataacagaggagaatgacaatgactacaaataacctggcggcagcgcaaaagatg

SEQ ID NO: 64312 - DNA, 103 bp, Artificial Sequence
  Synthetic Polynucleotide
taatacgactcactatagggtctactttatcagtatcatttgtagttgataacagaggagaatcaacatgaaatgatacaacctggcggcagcgcaaaagatg

SEQ ID NO: 64313 - DNA, 103 bp, Artificial Sequence
  Synthetic Polynucleotide
taatacgactcactatagggcataatctactttatcagtatcatttgtagaacagaggagactacaaatgatactgataaacctggcggcagcgcaaaagatg

SEQ ID NO: 64314 - DNA, 103 bp, Artificial Sequence
  Synthetic Polynucleotide
taatacgactcactatagggttcttcataatctactttatcagtatcattaacagaggagaaatgatatggataaagtaaacctggcggcagcgcaaaagatg

SEQ ID NO: 64315 - DNA, 103 bp, Artificial Sequence
  Synthetic Polynucleotide
taatacgactcactatagggtggaaactaagtattttcaaaattgatgataacagaggagaatcatcatgtttgaaaataacctggcggcagcgcaaaagatg

SEQ ID NO: 64316 - DNA, 103 bp, Artificial Sequence
  Synthetic Polynucleotide
taatacgactcactataggggagtattcttcataatctactttatcagtaaacagaggagatactgaatgagtagattaaacctggcggcagcgcaaaagatg

SEQ ID NO: 64317 - DNA, 103 bp, Artificial Sequence
  Synthetic Polynucleotide
taatacgactcactatagggctgtagagtattcttcataatctactttataacagaggagaataaagatgattatgaagaacctggcggcagcgcaaaagatg

SEQ ID NO: 64318 - DNA, 103 bp, Artificial Sequence
  Synthetic Polynucleotide
taatacgactcactatagggcaactctgtagagtattcttcataatctacaacagaggagagtagatatggaagaatacaacctggcggcagcgcaaaagatg

SEQ ID NO: 64319 - DNA, 103 bp, Artificial Sequence
  Synthetic Polynucleotide
taatacgactcactatagggacaatcaactctgtagagtattcttcataaaacagaggagattatgaatgatactctacaacctggcggcagcgcaaaagatg

SEQ ID NO: 64320 - DNA, 103 bp, Artificial Sequence
  Synthetic Polynucleotide
taatacgactcactatagggtgtttacaatcaactctgtagagtattcttaacagaggagaaagaatatgctacagagtaacctggcggcagcgcaaaagatg

SEQ ID NO: 64321 - DNA, 103 bp, Artificial Sequence
  Synthetic Polynucleotide
taatacgactcactatagggatctgtgtttacaatcaactctgtagagtaaacagaggagatactctatggagttgattaacctggcggcagcgcaaaagatg

SEQ ID NO: 64322 - DNA, 103 bp, Artificial Sequence
  Synthetic Polynucleotide
taatacgactcactatagggtcactatctgtgtttacaatcaactctgtaaacagaggagatacagaatggattgtaaaaacctggcggcagcgcaaaagatg

SEQ ID NO: 64323 - DNA, 103 bp, Artificial Sequence
  Synthetic Polynucleotide
taatacgactcactatagggtcgattcactatctgtgtttacaatcaactaacagaggagaagttgaatgtaaacacagaacctggcggcagcgcaaaagatg

SEQ ID NO: 64324 - DNA, 103 bp, Artificial Sequence
  Synthetic Polynucleotide
taatacgactcactatagggtatagtcgattcactatctgtgtttacaataacagaggagaattgtaatgacagatagtaacctggcggcagcgcaaaagatg

SEQ ID NO: 64325 - DNA, 103 bp, Artificial Sequence
  Synthetic Polynucleotide
taatacgactcactatagggatgtctatagtcgattcactatctgtgtttaacagaggagaaaacacatgtagtgaatcaacctggcggcagcgcaaaagatg

SEQ ID NO: 64326 - DNA, 103 bp, Artificial Sequence
  Synthetic Polynucleotide
taatacgactcactatagggctacgtggaaactaagtattttcaaaattgaacagaggagacaatttatgaaatacttaaacctggcggcagcgcaaaagatg

SEQ ID NO: 64327 - DNA, 103 bp, Artificial Sequence
  Synthetic Polynucleotide
taatacgactcactataggggtattatgtctatagtcgattcactatctgaacagaggagacagataatgaatcgactaaacctggcggcagcgcaaaagatg

SEQ ID NO: 64328 - DNA, 103 bp, Artificial Sequence
  Synthetic Polynucleotide
taatacgactcactatagggagatagtattatgtctatagtcgattcactaacagaggagaagtgaaatgactatagacaacctggcggcagcgcaaaagatg

SEQ ID NO: 64329 - DNA, 103 bp, Artificial Sequence
  Synthetic Polynucleotide
taatacgactcactataggggatccagatagtattatgtctatagtcgataacagaggagaatcgacatgagacataataacctggcggcagcgcaaaagatg

SEQ ID NO: 64330 - DNA, 103 bp, Artificial Sequence
  Synthetic Polynucleotide
taatacgactcactataggggtgaagatccagatagtattatgtctatagaacagaggagactatagatgtaatactataacctggcggcagcgcaaaagatg

SEQ ID NO: 64331 - DNA, 103 bp, Artificial Sequence
  Synthetic Polynucleotide
taatacgactcactatagggtgaatgtgaagatccagatagtattatgtcaacagaggagagacataatgctatctggaaacctggcggcagcgcaaaagatg

SEQ ID NO: 64332 - DNA, 103 bp, Artificial Sequence
  Synthetic Polynucleotide
taatacgactcactatagggtccggtgaatgtgaagatccagatagtattaacagaggagaaatactatgtggatcttcaacctggcggcagcgcaaaagatg

SEQ ID NO: 64333 - DNA, 103 bp, Artificial Sequence
  Synthetic Polynucleotide
taatacgactcactatagggtagtttccggtgaatgtgaagatccagataaacagaggagatatctgatgcttcacattaacctggcggcagcgcaaaagatg

SEQ ID NO: 64334 - DNA, 103 bp, Artificial Sequence
  Synthetic Polynucleotide
taatacgactcactatagggagaactagtttccggtgaatgtgaagatccaacagaggagaggatctatgcattcaccgaacctggcggcagcgcaaaagatg

SEQ ID NO: 64335 - DNA, 103 bp, Artificial Sequence
  Synthetic Polynucleotide
taatacgactcactatagggttctcagaactagtttccggtgaatgtgaaaacagaggagattcacaatgaccggaaacaacctggcggcagcgcaaaagatg

SEQ ID NO: 64336 - DNA, 103 bp, Artificial Sequence
  Synthetic Polynucleotide
taatacgactcactatagggcaggtttctcagaactagtttccggtgaataacagaggagaattcacatgaaactagttaacctggcggcagcgcaaaagatg

SEQ ID NO: 64337 - DNA, 103 bp, Artificial Sequence
  Synthetic Polynucleotide
taatacgactcactatagggattgactacgtggaaactaagtattttcaaaacagaggagattgaaaatgcttagtttcaacctggcggcagcgcaaaagatg

SEQ ID NO: 64338 - DNA, 103 bp, Artificial Sequence
  Synthetic Polynucleotide
taatacgactcactatagggataatcaggtttctcagaactagtttccggaacagaggagaccggaaatgagttctgagaacctggcggcagcgcaaaagatg

SEQ ID NO: 64339 - DNA, 103 bp, Artificial Sequence
  Synthetic Polynucleotide
taatacgactcactatagggtttatataatcaggtttctcagaactagttaacagaggagaaactagatgtgagaaaccaacctggcggcagcgcaaaagatg

SEQ ID NO: 64340 - DNA, 103 bp, Artificial Sequence
  Synthetic Polynucleotide
taatacgactcactatagggaattatttatataatcaggtttctcagaacaacagaggagagttctgatgaacctgattaacctggcggcagcgcaaaagatg

SEQ ID NO: 64341 - DNA, 103 bp, Artificial Sequence
  Synthetic Polynucleotide
taatacgactcactatagggattaaaattatttatataatcaggtttctcaacagaggagagagaaaatggattatataaacctggcggcagcgcaaaagatg

SEQ ID NO: 64342 - DNA, 103 bp, Artificial Sequence
  Synthetic Polynucleotide
taatacgactcactataggggagcaattaaaattatttatataatcaggtaacagaggagaacctgaatgtataaataaaacctggcggcagcgcaaaagatg

SEQ ID NO: 64343 - DNA, 103 bp, Artificial Sequence
  Synthetic Polynucleotide
taatacgactcactatagggccaacgagcaattaaaattatttatataataacagaggagaattataatgataattttaaacctggcggcagcgcaaaagatg

SEQ ID NO: 64344 - DNA, 103 bp, Artificial Sequence
  Synthetic Polynucleotide
taatacgactcactatagggaaataccaacgagcaattaaaattatttataacagaggagaataaatatgtttaattgcaacctggcggcagcgcaaaagatg

SEQ ID NO: 64345 - DNA, 103 bp, Artificial Sequence
  Synthetic Polynucleotide
taatacgactcactatagggatttcaaataccaacgagcaattaaaattaaacagaggagataatttatgttgctcgttaacctggcggcagcgcaaaagatg

SEQ ID NO: 64346 - DNA, 103 bp, Artificial Sequence
  Synthetic Polynucleotide
taatacgactcactatagggtcgcgatttcaaataccaacgagcaattaaaacagaggagattaattatgcgttggtataacctggcggcagcgcaaaagatg

SEQ ID NO: 64347 - DNA, 103 bp, Artificial Sequence
  Synthetic Polynucleotide
taatacgactcactatagggcggagtcgcgatttcaaataccaacgagcaaacagaggagatgctcgatggtatttgaaaacctggcggcagcgcaaaagatg

SEQ ID NO: 64348 - DNA, 103 bp, Artificial Sequence
  Synthetic Polynucleotide
taatacgactcactatagggaaagctgttaatggcttatgtaaacgataaaacagaggagattatcgatgacataagccaacctggcggcagcgcaaaagatg

SEQ ID NO: 64349 - DNA, 103 bp, Artificial Sequence
  Synthetic Polynucleotide
taatacgactcactataggggtttcattgactacgtggaaactaagtattaacagaggagaaatactatgtttccacgtaacctggcggcagcgcaaaagatg

SEQ ID NO: 64350 - DNA, 103 bp, Artificial Sequence
  Synthetic Polynucleotide
taatacgactcactatagggggtcccggagtcgcgatttcaaataccaacaacagaggagagttggtatgtgaaatcgcaacctggcggcagcgcaaaagatg

SEQ ID NO: 64351 - DNA, 103 bp, Artificial Sequence
  Synthetic Polynucleotide
taatacgactcactatagggtaattggtcccggagtcgcgatttcaaataaacagaggagatatttgatgtcgcgactcaacctggcggcagcgcaaaagatg

SEQ ID NO: 64352 - DNA, 103 bp, Artificial Sequence
  Synthetic Polynucleotide
taatacgactcactatagggatcagtaattggtcccggagtcgcgatttcaacagaggagagaaatcatgactccgggaaacctggcggcagcgcaaaagatg

SEQ ID NO: 64353 - DNA, 103 bp, Artificial Sequence
  Synthetic Polynucleotide
taatacgactcactatagggacattatcagtaattggtcccggagtcgcgaacagaggagacgcgacatggggaccaataacctggcggcagcgcaaaagatg

SEQ ID NO: 64354 - DNA, 103 bp, Artificial Sequence
  Synthetic Polynucleotide
taatacgactcactatagggtttctacattatcagtaattggtcccggagaacagaggagactccggatgcaattactgaacctggcggcagcgcaaaagatg

SEQ ID NO: 64355 - DNA, 103 bp, Artificial Sequence
  Synthetic Polynucleotide
taatacgactcactatagggatgattttctacattatcagtaattggtccaacagaggagaggaccaatgactgataataacctggcggcagcgcaaaagatg

SEQ ID NO: 64356 - DNA, 103 bp, Artificial Sequence
  Synthetic Polynucleotide
taatacgactcactatagggtctgtatgattttctacattatcagtaattaacagaggagaaattacatgtaatgtagaaacctggcggcagcgcaaaagatg

SEQ ID NO: 64357 - DNA, 103 bp, Artificial Sequence
  Synthetic Polynucleotide
taatacgactcactatagggcagtgtctgtatgattttctacattatcagaacagaggagactgataatgtagaaaatcaacctggcggcagcgcaaaagatg

SEQ ID NO: 64358 - DNA, 103 bp, Artificial Sequence
  Synthetic Polynucleotide
taatacgactcactatagggtgtgacagtgtctgtatgattttctacattaacagaggagaaatgtaatgaatcatacaaacctggcggcagcgcaaaagatg

SEQ ID NO: 64359 - DNA, 103 bp, Artificial Sequence
  Synthetic Polynucleotide
taatacgactcactataggggtgtatgtgacagtgtctgtatgattttctaacagaggagaagaaaaatgtacagacacaacctggcggcagcgcaaaagatg

SEQ ID NO: 64360 - DNA, 103 bp, Artificial Sequence
  Synthetic Polynucleotide
taatacgactcactatagggcaaatgtttcattgactacgtggaaactaaaacagaggagattagttatgacgtagtcaaacctggcggcagcgcaaaagatg

SEQ ID NO: 64361 - DNA, 103 bp, Artificial Sequence
  Synthetic Polynucleotide
taatacgactcactatagggcactagtgtatgtgacagtgtctgtatgataacagaggagaatcataatgacactgtcaaacctggcggcagcgcaaaagatg

SEQ ID NO: 64362 - DNA, 103 bp, Artificial Sequence
  Synthetic Polynucleotide
taatacgactcactataggggatatcactagtgtatgtgacagtgtctgtaacagaggagaacagacatggtcacatacaacctggcggcagcgcaaaagatg

SEQ ID NO: 64363 - DNA, 103 bp, Artificial Sequence
  Synthetic Polynucleotide
taatacgactcactatagggttaatgatatcactagtgtatgtgacagtgaacagaggagacactgtatgatacactagaacctggcggcagcgcaaaagatg

SEQ ID NO: 64364 - DNA, 103 bp, Artificial Sequence
  Synthetic Polynucleotide
taatacgactcactatagggctgtattaatgatatcactagtgtatgtgaaacagaggagatcacatatgctagtgataaacctggcggcagcgcaaaagatg

SEQ ID NO: 64365 - DNA, 103 bp, Artificial Sequence
  Synthetic Polynucleotide
taatacgactcactatagggacttactgtattaatgatatcactagtgtaaacagaggagatacactatggatatcattaacctggcggcagcgcaaaagatg

SEQ ID NO: 64366 - DNA, 103 bp, Artificial Sequence
  Synthetic Polynucleotide
taatacgactcactataggggatgtacttactgtattaatgatatcactaaacagaggagatagtgaatgcattaatacaacctggcggcagcgcaaaagatg

SEQ ID NO: 64367 - DNA, 103 bp, Artificial Sequence
  Synthetic Polynucleotide
taatacgactcactatagggtagatgatgtacttactgtattaatgatataacagaggagaatatcaatgatacagtaaaacctggcggcagcgcaaaagatg

SEQ ID NO: 64368 - DNA, 103 bp, Artificial Sequence
  Synthetic Polynucleotide
taatacgactcactatagggttctctagatgatgtacttactgtattaataacagaggagaattaatatggtaagtacaaacctggcggcagcgcaaaagatg

SEQ ID NO: 64369 - DNA, 103 bp, Artificial Sequence
  Synthetic Polynucleotide
taatacgactcactataggggtggattctctagatgatgtacttactgtaaacagaggagatacagtatgtacatcatcaacctggcggcagcgcaaaagatg

SEQ ID NO: 64370 - DNA, 103 bp, Artificial Sequence
  Synthetic Polynucleotide
taatacgactcactatagggctgttgtggattctctagatgatgtacttaaacagaggagataagtaatgcatctagagaacctggcggcagcgcaaaagatg

SEQ ID NO: 64371 - DNA, 103 bp, Artificial Sequence
  Synthetic Polynucleotide
taatacgactcactataggggagctcaaatgtttcattgactacgtggaaaacagaggagattccacatggtcaatgaaaacctggcggcagcgcaaaagatg

SEQ ID NO: 64372 - DNA, 103 bp, Artificial Sequence
  Synthetic Polynucleotide
taatacgactcactatagggcttgactgttgtggattctctagatgatgtaacagaggagaacatcaatgagagaatccaacctggcggcagcgcaaaagatg

SEQ ID NO: 64373 - DNA, 103 bp, Artificial Sequence
  Synthetic Polynucleotide
taatacgactcactataggggacgtcttgactgttgtggattctctagataacagaggagaatctagatgatccacaacaacctggcggcagcgcaaaagatg

SEQ ID NO: 64374 - DNA, 103 bp, Artificial Sequence
  Synthetic Polynucleotide
taatacgactcactataggggtcccgacgtcttgactgttgtggattctcaacagaggagagagaatatgcaacagtcaaacctggcggcagcgcaaaagatg

SEQ ID NO: 64375 - DNA, 103 bp, Artificial Sequence
  Synthetic Polynucleotide
taatacgactcactatagggaattggtcccgacgtcttgactgttgtggaaacagaggagatccacaatggtcaagacgaacctggcggcagcgcaaaagatg

SEQ ID NO: 64376 - DNA, 103 bp, Artificial Sequence
  Synthetic Polynucleotide
taatacgactcactatagggttagtaattggtcccgacgtcttgactgttaacagaggagaaacagtatggacgtcgggaacctggcggcagcgcaaaagatg

SEQ ID NO: 64377 - DNA, 103 bp, Artificial Sequence
  Synthetic Polynucleotide
taatacgactcactatagggctttattagtaattggtcccgacgtcttgaaacagaggagatcaagaatgcgggaccaaaacctggcggcagcgcaaaagatg

SEQ ID NO: 64378 - DNA, 103 bp, Artificial Sequence
  Synthetic Polynucleotide
taatacgactcactatagggatcttctttattagtaattggtcccgacgtaacagaggagaacgtcgatgccaattactaacctggcggcagcgcaaaagatg

SEQ ID NO: 64379 - DNA, 103 bp, Artificial Sequence
  Synthetic Polynucleotide
taatacgactcactataggggtatgatcttctttattagtaattggtcccaacagaggagagggaccatgtactaataaaacctggcggcagcgcaaaagatg

SEQ ID NO: 64380 - DNA, 103 bp, Artificial Sequence
  Synthetic Polynucleotide
taatacgactcactatagggtgactgtatgatcttctttattagtaattgaacagaggagacaattaatgataaagaagaacctggcggcagcgcaaaagatg

SEQ ID NO: 64381 - DNA, 103 bp, Artificial Sequence
  Synthetic Polynucleotide
taatacgactcactataggggtctgtgactgtatgatcttctttattagtaacagaggagaactaatatggaagatcataacctggcggcagcgcaaaagatg

SEQ ID NO: 64382 - DNA, 103 bp, Artificial Sequence
  Synthetic Polynucleotide
taatacgactcactatagggacgatgagctcaaatgtttcattgactacgaacagaggagacgtagtatgtgaaacattaacctggcggcagcgcaaaagatg

SEQ ID NO: 64383 - DNA, 103 bp, Artificial Sequence
  Synthetic Polynucleotide
taatacgactcactatagggacagtgtctgtgactgtatgatcttctttaaacagaggagataaagaatgtcatacagtaacctggcggcagcgcaaaagatg

SEQ ID NO: 64384 - DNA, 103 bp, Artificial Sequence
  Synthetic Polynucleotide
taatacgactcactatagggatgagacagtgtctgtgactgtatgatcttaacagaggagaaagatcatgcagtcacagaacctggcggcagcgcaaaagatg

SEQ ID NO: 64385 - DNA, 103 bp, Artificial Sequence
  Synthetic Polynucleotide
taatacgactcactatagggagtgtatgagacagtgtctgtgactgtatgaacagaggagacatacaatgacagacactaacctggcggcagcgcaaaagatg

SEQ ID NO: 64386 - DNA, 103 bp, Artificial Sequence
  Synthetic Polynucleotide
taatacgactcactatagggactgtagtgtatgagacagtgtctgtgactaacagaggagaagtcacatgcactgtctcaacctggcggcagcgcaaaagatg

SEQ ID NO: 64387 - DNA, 103 bp, Artificial Sequence
  Synthetic Polynucleotide
taatacgactcactatagggtacttactgtagtgtatgagacagtgtctgaacagaggagacagacaatgtctcatacaaacctggcggcagcgcaaaagatg

SEQ ID NO: 64388 - DNA, 103 bp, Artificial Sequence
  Synthetic Polynucleotide
taatacgactcactatagggtgatgtacttactgtagtgtatgagacagtaacagaggagaactgtcatgtacactacaaacctggcggcagcgcaaaagatg

SEQ ID NO: 64389 - DNA, 103 bp, Artificial Sequence
  Synthetic Polynucleotide
taatacgactcactatagggtcagatgatgtacttactgtagtgtatgagaacagaggagactcataatgtacagtaagaacctggcggcagcgcaaaagatg

SEQ ID NO: 64390 - DNA, 103 bp, Artificial Sequence
  Synthetic Polynucleotide
taatacgactcactatagggcaatttcagatgatgtacttactgtagtgtaacagaggagaacactaatgtaagtacataacctggcggcagcgcaaaagatg

SEQ ID NO: 64391 - DNA, 103 bp, Artificial Sequence
  Synthetic Polynucleotide
taatacgactcactatagggagtgacaatttcagatgatgtacttactgtaacagaggagaacagtaatgacatcatctaacctggcggcagcgcaaaagatg

SEQ ID NO: 64392 - DNA, 103 bp, Artificial Sequence
  Synthetic Polynucleotide
taatacgactcactatagggttagtagtgacaatttcagatgatgtacttaacagaggagaaagtacatgatctgaaataacctggcggcagcgcaaaagatg

SEQ ID NO: 64393 - DNA, 103 bp, Artificial Sequence
  Synthetic Polynucleotide
taatacgactcactatagggtctgtacgatgagctcaaatgtttcattgaaacagaggagatcaatgatgcatttgagcaacctggcggcagcgcaaaagatg

SEQ ID NO: 64394 - DNA, 103 bp, Artificial Sequence
  Synthetic Polynucleotide
taatacgactcactatagggttgatttagtagtgacaatttcagatgatgaacagaggagacatcatatgaaattgtcaaacctggcggcagcgcaaaagatg

SEQ ID NO: 64395 - DNA, 103 bp, Artificial Sequence
  Synthetic Polynucleotide
taatacgactcactatagggggcggttgatttagtagtgacaatttcagaaacagaggagatctgaaatggtcactactaacctggcggcagcgcaaaagatg

SEQ ID NO: 64396 - DNA, 103 bp, Artificial Sequence
  Synthetic Polynucleotide
taatacgactcactatagggtcattggcggttgatttagtagtgacaattaacagaggagaaattgtatgtactaaatcaacctggcggcagcgcaaaagatg

SEQ ID NO: 64397 - DNA, 103 bp, Artificial Sequence
  Synthetic Polynucleotide
taatacgactcactataggggcgcatcattggcggttgatttagtagtgaaacagaggagatcactaatgaatcaaccgaacctggcggcagcgcaaaagatg

SEQ ID NO: 64398 - DNA, 103 bp, Artificial Sequence
  Synthetic Polynucleotide
taatacgactcactatagggattgtgcgcatcattggcggttgatttagtaacagaggagaactaaaatgaccgccaataacctggcggcagcgcaaaagatg

SEQ ID NO: 64399 - DNA, 103 bp, Artificial Sequence
  Synthetic Polynucleotide
taatacgactcactatagggttatcattgtgcgcatcattggcggttgataacagaggagaatcaacatgcaatgatgcaacctggcggcagcgcaaaagatg

SEQ ID NO: 64400 - DNA, 103 bp, Artificial Sequence
  Synthetic Polynucleotide
taatacgactcactataggggttcattatcattgtgcgcatcattggcggaacagaggagaccgccaatgatgcgcacaaacctggcggcagcgcaaaagatg

SEQ ID NO: 64401 - DNA, 103 bp, Artificial Sequence
  Synthetic Polynucleotide
taatacgactcactatagggagatggttcattatcattgtgcgcatcattaacagaggagaaatgatatgcacaatgataacctggcggcagcgcaaaagatg

SEQ ID NO: 64402 - DNA, 103 bp, Artificial Sequence
  Synthetic Polynucleotide
taatacgactcactatagggacagtagatggttcattatcattgtgcgcaaacagaggagatgcgcaatgtgataatgaaacctggcggcagcgcaaaagatg

SEQ ID NO: 64403 - DNA, 103 bp, Artificial Sequence
  Synthetic Polynucleotide
taatacgactcactataggggtgacacagtagatggttcattatcattgtaacagaggagaacaatgatgatgaaccataacctggcggcagcgcaaaagatg

SEQ ID NO: 64404 - DNA, 103 bp, Artificial Sequence
  Synthetic Polynucleotide
taatacgactcactatagggaacgttctgtacgatgagctcaaatgtttcaacagaggagagaaacaatggagctcatcaacctggcggcagcgcaaaagatg

SEQ ID NO: 64405 - DNA, 103 bp, Artificial Sequence
  Synthetic Polynucleotide
taatacgactcactatagggtgttggtgacacagtagatggttcattatcaacagaggagagataatatgccatctactaacctggcggcagcgcaaaagatg

SEQ ID NO: 64406 - DNA, 103 bp, Artificial Sequence
  Synthetic Polynucleotide
taatacgactcactatagggacagttgttggtgacacagtagatggttcaaacagaggagatgaaccatgtactgtgtcaacctggcggcagcgcaaaagatg

SEQ ID NO: 64407 - DNA, 103 bp, Artificial Sequence
  Synthetic Polynucleotide
taatacgactcactatagggtttttacagttgttggtgacacagtagatgaacagaggagacatctaatgtgtcaccaaaacctggcggcagcgcaaaagatg

SEQ ID NO: 64408 - DNA, 103 bp, Artificial Sequence
  Synthetic Polynucleotide
taatacgactcactataggggatgttttttacagttgttggtgacacagtaacagaggagaactgtgatgccaacaactaacctggcggcagcgcaaaagatg

SEQ ID NO: 64409 - DNA, 103 bp, Artificial Sequence
  Synthetic Polynucleotide
taatacgactcactatagggttcgtgatgttttttacagttgttggtgacaacagaggagagtcaccatgaactgtaaaaacctggcggcagcgcaaaagatg

SEQ ID NO: 64410 - DNA, 103 bp, Artificial Sequence
  Synthetic Polynucleotide
taatacgactcactatagggtagatttcgtgatgttttttacagttgttgaacagaggagacaacaaatgtaaaaaacaaacctggcggcagcgcaaaagatg

SEQ ID NO: 64411 - DNA, 103 bp, Artificial Sequence
  Synthetic Polynucleotide
taatacgactcactatagggacctatagatttcgtgatgttttttacagtaacagaggagaactgtaatgaacatcacgaacctggcggcagcgcaaaagatg

SEQ ID NO: 64412 - DNA, 103 bp, Artificial Sequence
  Synthetic Polynucleotide
taatacgactcactatagggtacttacctatagatttcgtgatgttttttaacagaggagaaaaaaaatgcacgaaatcaacctggcggcagcgcaaaagatg

SEQ ID NO: 64413 - DNA, 103 bp, Artificial Sequence
  Synthetic Polynucleotide
taatacgactcactatagggtactatacttacctatagatttcgtgatgtaacagaggagaacatcaatgaatctatagaacctggcggcagcgcaaaagatg

SEQ ID NO: 64414 - DNA, 103 bp, Artificial Sequence
  Synthetic Polynucleotide
taatacgactcactatagggtttagtactatacttacctatagatttcgtaacagaggagaacgaaaatgataggtaagaacctggcggcagcgcaaaagatg

SEQ ID NO: 64415 - DNA, 103 bp, Artificial Sequence
  Synthetic Polynucleotide
taatacgactcactatagggacgagaacgttctgtacgatgagctcaaataacagaggagaatttgaatgcatcgtacaaacctggcggcagcgcaaaagatg

SEQ ID NO: 64416 - DNA, 103 bp, Artificial Sequence
  Synthetic Polynucleotide
taatacgactcactatagggtagtctttagtactatacttacctatagataacagaggagaatctatatgtaagtatagaacctggcggcagcgcaaaagatg

SEQ ID NO: 64417 - DNA, 103 bp, Artificial Sequence
  Synthetic Polynucleotide
taatacgactcactatagggtgacatagtctttagtactatacttacctaaacagaggagataggtaatgatagtactaaacctggcggcagcgcaaaagatg

SEQ ID NO: 64418 - DNA, 103 bp, Artificial Sequence
  Synthetic Polynucleotide
taatacgactcactatagggtactttgacatagtctttagtactatacttaacagaggagaaagtatatgactaaagacaacctggcggcagcgcaaaagatg

SEQ ID NO: 64419 - DNA, 103 bp, Artificial Sequence
  Synthetic Polynucleotide
taatacgactcactatagggccaaatactttgacatagtctttagtactaaacagaggagatagtacatgagactatgtaacctggcggcagcgcaaaagatg

SEQ ID NO: 64420 - DNA, 103 bp, Artificial Sequence
  Synthetic Polynucleotide
taatacgactcactatagggcaataccaaatactttgacatagtctttagaacagaggagactaaagatgatgtcaaagaacctggcggcagcgcaaaagatg

SEQ ID NO: 64421 - DNA, 103 bp, Artificial Sequence
  Synthetic Polynucleotide
taatacgactcactatagggtgctgcaataccaaatactttgacatagtcaacagaggagagactatatgaaagtatttaacctggcggcagcgcaaaagatg

SEQ ID NO: 64422 - DNA, 103 bp, Artificial Sequence
  Synthetic Polynucleotide
taatacgactcactatagggattaatgctgcaataccaaatactttgacaaacagaggagatgtcaaatgatttggtataacctggcggcagcgcaaaagatg

SEQ ID NO: 64423 - DNA, 103 bp, Artificial Sequence
  Synthetic Polynucleotide
taatacgactcactatagggatataattaatgctgcaataccaaatacttaacagaggagaaagtatatggtattgcagaacctggcggcagcgcaaaagatg

SEQ ID NO: 64424 - DNA, 103 bp, Artificial Sequence
  Synthetic Polynucleotide
taatacgactcactatagggcgacaatataattaatgctgcaataccaaaaacagaggagatttggtatggcagcattaaacctggcggcagcgcaaaagatg

SEQ ID NO: 64425 - DNA, 103 bp, Artificial Sequence
  Synthetic Polynucleotide
taatacgactcactatagggacggccgacaatataattaatgctgcaataaacagaggagatattgcatgattaattataacctggcggcagcgcaaaagatg

SEQ ID NO: 64426 - DNA, 103 bp, Artificial Sequence
  Synthetic Polynucleotide
taatacgactcactatagggcctgtacgagaacgttctgtacgatgagctaacagaggagaagctcaatgtacagaacgaacctggcggcagcgcaaaagatg

SEQ ID NO: 64427 - DNA, 103 bp, Artificial Sequence
  Synthetic Polynucleotide
taatacgactcactatagggttgccacggccgacaatataattaatgctgaacagaggagacagcatatgttatattgtaacctggcggcagcgcaaaagatg

SEQ ID NO: 64428 - DNA, 103 bp, Artificial Sequence
  Synthetic Polynucleotide
taatacgactcactataggggaaaattgccacggccgacaatataattaaaacagaggagattaattatgttgtcggccaacctggcggcagcgcaaaagatg

SEQ ID NO: 64429 - DNA, 103 bp, Artificial Sequence
  Synthetic Polynucleotide
taatacgactcactatagggatacagaaaattgccacggccgacaatataaacagaggagatatattatgggccgtggcaacctggcggcagcgcaaaagatg

SEQ ID NO: 64430 - DNA, 103 bp, Artificial Sequence
  Synthetic Polynucleotide
taatacgactcactatagggacgtaatacagaaaattgccacggccgacaaacagaggagatgtcggatgtggcaatttaacctggcggcagcgcaaaagatg

SEQ ID NO: 64431 - DNA, 103 bp, Artificial Sequence
  Synthetic Polynucleotide
taatacgactcactatagggataatacgtaatacagaaaattgccacggcaacagaggagagccgtgatgattttctgtaacctggcggcagcgcaaaagatg

SEQ ID NO: 64432 - DNA, 103 bp, Artificial Sequence
  Synthetic Polynucleotide
taatacgactcactatagggcatatataatacgtaatacagaaaattgccaacagaggagaggcaatatgctgtattacaacctggcggcagcgcaaaagatg

SEQ ID NO: 64433 - DNA, 103 bp, Artificial Sequence
  Synthetic Polynucleotide
taatacgactcactatagggtattacatatataatacgtaatacagaaaaaacagaggagattttctatgttacgtattaacctggcggcagcgcaaaagatg

SEQ ID NO: 64434 - DNA, 103 bp, Artificial Sequence
  Synthetic Polynucleotide
taatacgactcactatagggacgtttattacatatataatacgtaatacaaacagaggagatgtattatgtattatataaacctggcggcagcgcaaaagatg

SEQ ID NO: 64435 - DNA, 103 bp, Artificial Sequence
  Synthetic Polynucleotide
taatacgactcactatagggcgtgaacgtttattacatatataatacgtaaacagaggagatacgtaatgtatatgtaaaacctggcggcagcgcaaaagatg

SEQ ID NO: 64436 - DNA, 103 bp, Artificial Sequence
  Synthetic Polynucleotide
taatacgactcactatagggatttacgtgaacgtttattacatatataataacagaggagaattataatggtaataaacaacctggcggcagcgcaaaagatg

SEQ ID NO: 64437 - DNA, 103 bp, Artificial Sequence
  Synthetic Polynucleotide
taatacgactcactatagggtacgtcctgtacgagaacgttctgtacgataacagaggagaatcgtaatgaacgttctcaacctggcggcagcgcaaaagatg

SEQ ID NO: 64438 - DNA, 103 bp, Artificial Sequence
  Synthetic Polynucleotide
taatacgactcactatagggtttgtatttacgtgaacgtttattacatataacagaggagaatatgtatgaaacgttcaaacctggcggcagcgcaaaagatg

SEQ ID NO: 64439 - DNA, 103 bp, Artificial Sequence
  Synthetic Polynucleotide
taatacgactcactatagggtctgttttgtatttacgtgaacgtttattaaacagaggagataataaatgttcacgtaaaacctggcggcagcgcaaaagatg

SEQ ID NO: 64440 - DNA, 103 bp, Artificial Sequence
  Synthetic Polynucleotide
taatacgactcactatagggtgttttctgttttgtatttacgtgaacgttaacagaggagaaacgttatggtaaatacaaacctggcggcagcgcaaaagatg

SEQ ID NO: 64441 - DNA, 103 bp, Artificial Sequence
  Synthetic Polynucleotide
taatacgactcactataggggactttgttttctgttttgtatttacgtgaaacagaggagatcacgtatgtacaaaacaaacctggcggcagcgcaaaagatg

SEQ ID NO: 64442 - DNA, 103 bp, Artificial Sequence
  Synthetic Polynucleotide
taatacgactcactatagggatctagactttgttttctgttttgtatttaaacagaggagataaataatgaacagaaaaaacctggcggcagcgcaaaagatg

SEQ ID NO: 64443 - DNA, 103 bp, Artificial Sequence
  Synthetic Polynucleotide
taatacgactcactatagggtcaaaatctagactttgttttctgttttgtaacagaggagaacaaaaatgaaaacaaagaacctggcggcagcgcaaaagatg

SEQ ID NO: 64444 - DNA, 103 bp, Artificial Sequence
  Synthetic Polynucleotide
taatacgactcactataggggtaagtcaaaatctagactttgttttctgtaacagaggagaacagaaatgaaagtctagaacctggcggcagcgcaaaagatg

SEQ ID NO: 64445 - DNA, 103 bp, Artificial Sequence
  Synthetic Polynucleotide
taatacgactcactatagggtttatgtaagtcaaaatctagactttgtttaacagaggagaaaacaaatgctagattttaacctggcggcagcgcaaaagatg

SEQ ID NO: 64446 - DNA, 103 bp, Artificial Sequence
  Synthetic Polynucleotide
taatacgactcactatagggagacatttatgtaagtcaaaatctagacttaacagaggagaaagtctatgttttgacttaacctggcggcagcgcaaaagatg

SEQ ID NO: 64447 - DNA, 103 bp, Artificial Sequence
  Synthetic Polynucleotide
taatacgactcactatagggattccagacatttatgtaagtcaaaatctaaacagaggagatagattatgacttacataaacctggcggcagcgcaaaagatg

SEQ ID NO: 64448 - DNA, 103 bp, Artificial Sequence
  Synthetic Polynucleotide
taatacgactcactatagggatagttacgtcctgtacgagaacgttctgtaacagaggagaacagaaatgtctcgtacaaacctggcggcagcgcaaaagatg

SEQ ID NO: 64449 - DNA, 103 bp, Artificial Sequence
  Synthetic Polynucleotide
taatacgactcactatagggttactattccagacatttatgtaagtcaaaaacagaggagatttgacatgcataaatgtaacctggcggcagcgcaaaagatg

SEQ ID NO: 64450 - DNA, 103 bp, Artificial Sequence
  Synthetic Polynucleotide
taatacgactcactatagggagattttactattccagacatttatgtaagaacagaggagacttacaatgatgtctggaaacctggcggcagcgcaaaagatg

SEQ ID NO: 64451 - DNA, 103 bp, Artificial Sequence
  Synthetic Polynucleotide
taatacgactcactatagggatgatagattttactattccagacatttataacagaggagaataaatatgtggaatagtaacctggcggcagcgcaaaagatg

SEQ ID NO: 64452 - DNA, 103 bp, Artificial Sequence
  Synthetic Polynucleotide
taatacgactcactatagggtcaaaatgatagattttactattccagacaaacagaggagatgtctgatgtagtaaaataacctggcggcagcgcaaaagatg

SEQ ID NO: 64453 - DNA, 103 bp, Artificial Sequence
  Synthetic Polynucleotide
taatacgactcactatagggcccgctcaaaatgatagattttactattccaacagaggagaggaataatgaaatctatcaacctggcggcagcgcaaaagatg

SEQ ID NO: 64454 - DNA, 103 bp, Artificial Sequence
  Synthetic Polynucleotide
taatacgactcactataggggatgacccgctcaaaatgatagattttactaacagaggagaagtaaaatgtatcattttaacctggcggcagcgcaaaagatg

SEQ ID NO: 64455 - DNA, 103 bp, Artificial Sequence
  Synthetic Polynucleotide
taatacgactcactatagggaaccagatgacccgctcaaaatgatagattaacagaggagaaatctaatgttttgagcgaacctggcggcagcgcaaaagatg

SEQ ID NO: 64456 - DNA, 103 bp, Artificial Sequence
  Synthetic Polynucleotide
taatacgactcactatagggtcctaaaccagatgacccgctcaaaatgataacagaggagaatcattatgagcgggtcaaacctggcggcagcgcaaaagatg

SEQ ID NO: 64457 - DNA, 103 bp, Artificial Sequence
  Synthetic Polynucleotide
taatacgactcactataggggtctttcctaaaccagatgacccgctcaaaaacagaggagatttgagatggtcatctggaacctggcggcagcgcaaaagatg

SEQ ID NO: 64458 - DNA, 103 bp, Artificial Sequence
  Synthetic Polynucleotide
taatacgactcactatagggtggctgtctttcctaaaccagatgacccgcaacagaggagagcgggtatgctggtttagaacctggcggcagcgcaaaagatg

SEQ ID NO: 64459 - DNA, 103 bp, Artificial Sequence
  Synthetic Polynucleotide
taatacgactcactatagggctgttaaagctgttaatggcttatgtaaacaacagaggagagtttacatgagccattaaaacctggcggcagcgcaaaagatg

SEQ ID NO: 64460 - DNA, 103 bp, Artificial Sequence
  Synthetic Polynucleotide
taatacgactcactatagggagtttatagttacgtcctgtacgagaacgtaacagaggagaacgttcatgtacaggacgaacctggcggcagcgcaaaagatg

SEQ ID NO: 64461 - DNA, 103 bp, Artificial Sequence
  Synthetic Polynucleotide
taatacgactcactatagggggctatggctgtctttcctaaaccagatgaaacagaggagatcatctatgttaggaaagaacctggcggcagcgcaaaagatg

SEQ ID NO: 64462 - DNA, 103 bp, Artificial Sequence
  Synthetic Polynucleotide
taatacgactcactatagggcttttggctatggctgtctttcctaaaccaaacagaggagatggtttatgaaagacagcaacctggcggcagcgcaaaagatg

SEQ ID NO: 64463 - DNA, 103 bp, Artificial Sequence
  Synthetic Polynucleotide
taatacgactcactatagggatagtcttttggctatggctgtctttcctaaacagaggagataggaaatgcagccatagaacctggcggcagcgcaaaagatg

SEQ ID NO: 64464 - DNA, 103 bp, Artificial Sequence
  Synthetic Polynucleotide
taatacgactcactatagggttcccatagtcttttggctatggctgtcttaacagaggagaaagacaatgatagccaaaaacctggcggcagcgcaaaagatg

SEQ ID NO: 64465 - DNA, 103 bp, Artificial Sequence
  Synthetic Polynucleotide
taatacgactcactatagggatatattcccatagtcttttggctatggctaacagaggagaagccatatgcaaaagactaacctggcggcagcgcaaaagatg

SEQ ID NO: 64466 - DNA, 103 bp, Artificial Sequence
  Synthetic Polynucleotide
taatacgactcactatagggtccaaatatattcccatagtcttttggctaaacagaggagatagccaatggactatgggaacctggcggcagcgcaaaagatg

SEQ ID NO: 64467 - DNA, 103 bp, Artificial Sequence
  Synthetic Polynucleotide
taatacgactcactatagggacaaatccaaatatattcccatagtcttttaacagaggagaaaaagaatgtgggaatataacctggcggcagcgcaaaagatg

SEQ ID NO: 64468 - DNA, 103 bp, Artificial Sequence
  Synthetic Polynucleotide
taatacgactcactatagggacaccacaaatccaaatatattcccatagtaacagaggagaactatgatgatatatttgaacctggcggcagcgcaaaagatg

SEQ ID NO: 64469 - DNA, 103 bp, Artificial Sequence
  Synthetic Polynucleotide
taatacgactcactatagggatgggacaccacaaatccaaatatattcccaacagaggagagggaatatgtttggatttaacctggcggcagcgcaaaagatg

SEQ ID NO: 64470 - DNA, 103 bp, Artificial Sequence
  Synthetic Polynucleotide
taatacgactcactataggggtggtatgggacaccacaaatccaaatataaacagaggagatatattatgatttgtggtaacctggcggcagcgcaaaagatg

SEQ ID NO: 64471 - DNA, 103 bp, Artificial Sequence
  Synthetic Polynucleotide
taatacgactcactatagggaaaccagtttatagttacgtcctgtacgagaacagaggagactcgtaatggacgtaactaacctggcggcagcgcaaaagatg

SEQ ID NO: 64472 - DNA, 103 bp, Artificial Sequence
  Synthetic Polynucleotide
taatacgactcactatagggatctagtggtatgggacaccacaaatccaaaacagaggagattggatatgtggtgtcccaacctggcggcagcgcaaaagatg

SEQ ID NO: 64473 - DNA, 103 bp, Artificial Sequence
  Synthetic Polynucleotide
taatacgactcactatagggaggaaatctagtggtatgggacaccacaaaaacagaggagatttgtgatgtcccataccaacctggcggcagcgcaaaagatg

SEQ ID NO: 64474 - DNA, 103 bp, Artificial Sequence
  Synthetic Polynucleotide
taatacgactcactatagggggacgaggaaatctagtggtatgggacaccaacagaggagaggtgtcatgtaccactagaacctggcggcagcgcaaaagatg

SEQ ID NO: 64475 - DNA, 103 bp, Artificial Sequence
  Synthetic Polynucleotide
taatacgactcactatagggccataggacgaggaaatctagtggtatgggaacagaggagacccataatgctagatttcaacctggcggcagcgcaaaagatg

SEQ ID NO: 64476 - DNA, 103 bp, Artificial Sequence
  Synthetic Polynucleotide
taatacgactcactatagggtcgttccataggacgaggaaatctagtggtaacagaggagaaccactatgtttcctcgtaacctggcggcagcgcaaaagatg

SEQ ID NO: 64477 - DNA, 103 bp, Artificial Sequence
  Synthetic Polynucleotide
taatacgactcactatagggccttctcgttccataggacgaggaaatctaaacagaggagatagattatgtcgtcctataacctggcggcagcgcaaaagatg

SEQ ID NO: 64478 - DNA, 103 bp, Artificial Sequence
  Synthetic Polynucleotide
taatacgactcactatagggcaacaccttctcgttccataggacgaggaaaacagaggagattcctcatgctatggaacaacctggcggcagcgcaaaagatg

SEQ ID NO: 64479 - DNA, 103 bp, Artificial Sequence
  Synthetic Polynucleotide
taatacgactcactataggggtaatcaacaccttctcgttccataggacgaacagaggagacgtcctatggaacgagaaaacctggcggcagcgcaaaagatg

SEQ ID NO: 64480 - DNA, 103 bp, Artificial Sequence
  Synthetic Polynucleotide
taatacgactcactatagggtaatggtaatcaacaccttctcgttccataaacagaggagatatggaatgagaaggtgtaacctggcggcagcgcaaaagatg

SEQ ID NO: 64481 - DNA, 103 bp, Artificial Sequence
  Synthetic Polynucleotide
taatacgactcactatagggtaacgtaatggtaatcaacaccttctcgttaacagaggagaaacgagatggtgttgattaacctggcggcagcgcaaaagatg

SEQ ID NO: 64482 - DNA, 103 bp, Artificial Sequence
  Synthetic Polynucleotide
taatacgactcactatagggaatataaaccagtttatagttacgtcctgtaacagaggagaacaggaatgaactataaaaacctggcggcagcgcaaaagatg

SEQ ID NO: 64483 - DNA, 103 bp, Artificial Sequence
  Synthetic Polynucleotide
taatacgactcactatagggtctgttaacgtaatggtaatcaacaccttcaacagaggagagaaggtatggattaccataacctggcggcagcgcaaaagatg

SEQ ID NO: 64484 - DNA, 103 bp, Artificial Sequence
  Synthetic Polynucleotide
taatacgactcactataggggcctctctgttaacgtaatggtaatcaacaaacagaggagatgttgaatgccattacgtaacctggcggcagcgcaaaagatg

SEQ ID NO: 64485 - DNA, 103 bp, Artificial Sequence
  Synthetic Polynucleotide
taatacgactcactatagggagattgcctctctgttaacgtaatggtaataacagaggagaattaccatgacgttaacaaacctggcggcagcgcaaaagatg

SEQ ID NO: 64486 - DNA, 103 bp, Artificial Sequence
  Synthetic Polynucleotide
taatacgactcactatagggcttccagattgcctctctgttaacgtaatgaacagaggagacattacatgaacagagagaacctggcggcagcgcaaaagatg

SEQ ID NO: 64487 - DNA, 103 bp, Artificial Sequence
  Synthetic Polynucleotide
taatacgactcactatagggattcccttccagattgcctctctgttaacgaacagaggagacgttaaatgagaggcaataacctggcggcagcgcaaaagatg

SEQ ID NO: 64488 - DNA, 103 bp, Artificial Sequence
  Synthetic Polynucleotide
taatacgactcactatagggtggctattcccttccagattgcctctctgtaacagaggagaacagagatgcaatctggaaacctggcggcagcgcaaaagatg

SEQ ID NO: 64489 - DNA, 103 bp, Artificial Sequence
  Synthetic Polynucleotide
taatacgactcactatagggtccggtggctattcccttccagattgcctcaacagaggagagaggcaatgtggaagggaaacctggcggcagcgcaaaagatg

SEQ ID NO: 64490 - DNA, 103 bp, Artificial Sequence
  Synthetic Polynucleotide
taatacgactcactatagggaagtttccggtggctattcccttccagattaacagaggagaaatctgatggggaatagcaacctggcggcagcgcaaaagatg

SEQ ID NO: 64491 - DNA, 103 bp, Artificial Sequence
  Synthetic Polynucleotide
taatacgactcactatagggctagaaagtttccggtggctattcccttccaacagaggagaggaaggatgtagccaccgaacctggcggcagcgcaaaagatg

SEQ ID NO: 64492 - DNA, 103 bp, Artificial Sequence
  Synthetic Polynucleotide
taatacgactcactatagggatgttctagaaagtttccggtggctattccaacagaggagaggaataatgaccggaaacaacctggcggcagcgcaaaagatg

SEQ ID NO: 64493 - DNA, 103 bp, Artificial Sequence
  Synthetic Polynucleotide
taatacgactcactataggggaacaaatataaaccagtttatagttacgtaacagaggagaacgtaaatgtaaactggtaacctggcggcagcgcaaaagatg

SEQ ID NO: 64494 - DNA, 103 bp, Artificial Sequence
  Synthetic Polynucleotide
taatacgactcactatagggtcagtatgttctagaaagtttccggtggctaacagaggagaagccacatgaaactttctaacctggcggcagcgcaaaagatg

SEQ ID NO: 64495 - DNA, 103 bp, Artificial Sequence
  Synthetic Polynucleotide
taatacgactcactatagggaaaactcagtatgttctagaaagtttccggaacagaggagaccggaaatgttctagaacaacctggcggcagcgcaaaagatg

SEQ ID NO: 64496 - DNA, 103 bp, Artificial Sequence
  Synthetic Polynucleotide
taatacgactcactatagggtcctaaaaactcagtatgttctagaaagttaacagaggagaaactttatggaacatactaacctggcggcagcgcaaaagatg

SEQ ID NO: 64497 - DNA, 103 bp, Artificial Sequence
  Synthetic Polynucleotide
taatacgactcactatagggatatttcctaaaaactcagtatgttctagaaacagaggagatctagaatgtactgagttaacctggcggcagcgcaaaagatg

SEQ ID NO: 64498 - DNA, 103 bp, Artificial Sequence
  Synthetic Polynucleotide
taatacgactcactatagggcgtaaatatttcctaaaaactcagtatgttaacagaggagaaacataatgagtttttagaacctggcggcagcgcaaaagatg

SEQ ID NO: 64499 - DNA, 103 bp, Artificial Sequence
  Synthetic Polynucleotide
taatacgactcactatagggagttccgtaaatatttcctaaaaactcagtaacagaggagaactgagatgttaggaaataacctggcggcagcgcaaaagatg

SEQ ID NO: 64500 - DNA, 103 bp, Artificial Sequence
  Synthetic Polynucleotide
taatacgactcactatagggttagaagttccgtaaatatttcctaaaaacaacagaggagagtttttatgaaatatttaaacctggcggcagcgcaaaagatg

SEQ ID NO: 64501 - DNA, 103 bp, Artificial Sequence
  Synthetic Polynucleotide
taatacgactcactatagggctgttttagaagttccgtaaatatttcctaaacagaggagataggaaatgtttacggaaaacctggcggcagcgcaaaagatg

SEQ ID NO: 64502 - DNA, 103 bp, Artificial Sequence
  Synthetic Polynucleotide
taatacgactcactatagggcacagctgttttagaagttccgtaaatattaacagaggagaaatattatgggaacttctaacctggcggcagcgcaaaagatg

SEQ ID NO: 64503 - DNA, 103 bp, Artificial Sequence
  Synthetic Polynucleotide
taatacgactcactataggggtattcacagctgttttagaagttccgtaaaacagaggagattacggatgttctaaaacaacctggcggcagcgcaaaagatg

SEQ ID NO: 64504 - DNA, 103 bp, Artificial Sequence
  Synthetic Polynucleotide
taatacgactcactatagggatcttgaacaaatataaaccagtttatagtaacagaggagaactataatgtggtttataaacctggcggcagcgcaaaagatg

SEQ ID NO: 64505 - DNA, 103 bp, Artificial Sequence
  Synthetic Polynucleotide
taatacgactcactatagggccgctgtattcacagctgttttagaagttcaacagaggagagaacttatgaaacagctgaacctggcggcagcgcaaaagatg

SEQ ID NO: 64506 - DNA, 103 bp, Artificial Sequence
  Synthetic Polynucleotide
taatacgactcactatagggaatagccgctgtattcacagctgttttagaaacagaggagatctaaaatggctgtgaataacctggcggcagcgcaaaagatg

SEQ ID NO: 64507 - DNA, 103 bp, Artificial Sequence
  Synthetic Polynucleotide
taatacgactcactatagggttattaatagccgctgtattcacagctgttaacagaggagaaacagcatggaatacagcaacctggcggcagcgcaaaagatg

SEQ ID NO: 64508 - DNA, 103 bp, Artificial Sequence
  Synthetic Polynucleotide
taatacgactcactatagggtacgattattaatagccgctgtattcacagaacagaggagactgtgaatgcagcggctaaacctggcggcagcgcaaaagatg

SEQ ID NO: 64509 - DNA, 103 bp, Artificial Sequence
  Synthetic Polynucleotide
taatacgactcactatagggacaaatacgattattaatagccgctgtattaacagaggagaaatacaatggctattaataacctggcggcagcgcaaaagatg

SEQ ID NO: 64510 - DNA, 103 bp, Artificial Sequence
  Synthetic Polynucleotide
taatacgactcactatagggatcacacaaatacgattattaatagccgctaacagaggagaagcggcatgtaataatcgaacctggcggcagcgcaaaagatg

SEQ ID NO: 64511 - DNA, 103 bp, Artificial Sequence
  Synthetic Polynucleotide
taatacgactcactatagggaatccatcacacaaatacgattattaatagaacagaggagactattaatgatcgtatttaacctggcggcagcgcaaaagatg

SEQ ID NO: 64512 - DNA, 103 bp, Artificial Sequence
  Synthetic Polynucleotide
taatacgactcactataggggtttaaatccatcacacaaatacgattattaacagaggagaaataatatgatttgtgtgaacctggcggcagcgcaaaagatg

SEQ ID NO: 64513 - DNA, 103 bp, Artificial Sequence
  Synthetic Polynucleotide
taatacgactcactatagggtcgatgtttaaatccatcacacaaatacgaaacagaggagatcgtatatgtgtgatggaaacctggcggcagcgcaaaagatg

SEQ ID NO: 64514 - DNA, 103 bp, Artificial Sequence
  Synthetic Polynucleotide
taatacgactcactatagggcaccgtcgatgtttaaatccatcacacaaaaacagaggagatttgtgatgtggatttaaaacctggcggcagcgcaaaagatg

SEQ ID NO: 64515 - DNA, 103 bp, Artificial Sequence
  Synthetic Polynucleotide
taatacgactcactatagggtatctatcttgaacaaatataaaccagtttaacagaggagaaaactgatgtatatttgtaacctggcggcagcgcaaaagatg

SEQ ID NO: 64516 - DNA, 103 bp, Artificial Sequence
  Synthetic Polynucleotide
taatacgactcactatagggtctaacaccgtcgatgtttaaatccatcacaacagaggagagtgatgatgttaaacatcaacctggcggcagcgcaaaagatg

SEQ ID NO: 64517 - DNA, 103 bp, Artificial Sequence
  Synthetic Polynucleotide
taatacgactcactatagggagacttctaacaccgtcgatgtttaaatccaacagaggagaggatttatgcatcgacggaacctggcggcagcgcaaaagatg

SEQ ID NO: 64518 - DNA, 103 bp, Artificial Sequence
  Synthetic Polynucleotide
taatacgactcactatagggttttaagacttctaacaccgtcgatgtttaaacagaggagataaacaatgacggtgttaaacctggcggcagcgcaaaagatg

SEQ ID NO: 64519 - DNA, 103 bp, Artificial Sequence
  Synthetic Polynucleotide
taatacgactcactatagggagtatttttaagacttctaacaccgtcgataacagaggagaatcgacatggttagaagtaacctggcggcagcgcaaaagatg

SEQ ID NO: 64520 - DNA, 103 bp, Artificial Sequence
  Synthetic Polynucleotide
taatacgactcactatagggaggtaagtatttttaagacttctaacaccgaacagaggagacggtgtatgaagtcttaaaacctggcggcagcgcaaaagatg

SEQ ID NO: 64521 - DNA, 103 bp, Artificial Sequence
  Synthetic Polynucleotide
taatacgactcactataggggcattaggtaagtatttttaagacttctaaaacagaggagattagaaatgttaaaaataaacctggcggcagcgcaaaagatg

SEQ ID NO: 64522 - DNA, 103 bp, Artificial Sequence
  Synthetic Polynucleotide
taatacgactcactataggggtaaggcattaggtaagtatttttaagactaacagaggagaagtcttatgaatacttacaacctggcggcagcgcaaaagatg

SEQ ID NO: 64523 - DNA, 103 bp, Artificial Sequence
  Synthetic Polynucleotide
taatacgactcactatagggaccgagtaaggcattaggtaagtatttttaaacagaggagataaaaaatgttacctaataacctggcggcagcgcaaaagatg

SEQ ID NO: 64524 - DNA, 103 bp, Artificial Sequence
  Synthetic Polynucleotide
taatacgactcactatagggtatacaccgagtaaggcattaggtaagtataacagaggagaatacttatgtaatgccttaacctggcggcagcgcaaaagatg

SEQ ID NO: 64525 - DNA, 103 bp, Artificial Sequence
  Synthetic Polynucleotide
taatacgactcactatagggttttatatacaccgagtaaggcattaggtaaacagaggagatacctaatgccttactcgaacctggcggcagcgcaaaagatg

SEQ ID NO: 64526 - DNA, 103 bp, Artificial Sequence
  Synthetic Polynucleotide
taatacgactcactatagggatttgtatctatcttgaacaaatataaaccaacagaggagaggtttaatgttgttcaagaacctggcggcagcgcaaaagatg

SEQ ID NO: 64527 - DNA, 103 bp, Artificial Sequence
  Synthetic Polynucleotide
taatacgactcactataggggtaggttttatatacaccgagtaaggcattaacagaggagaaatgccatgctcggtgtaaacctggcggcagcgcaaaagatg

SEQ ID NO: 64528 - DNA, 103 bp, Artificial Sequence
  Synthetic Polynucleotide
taatacgactcactataggggagaggtaggttttatatacaccgagtaagaacagaggagacttactatgtgtatataaaacctggcggcagcgcaaaagatg

SEQ ID NO: 64529 - DNA, 103 bp, Artificial Sequence
  Synthetic Polynucleotide
taatacgactcactatagggtttaagagaggtaggttttatatacaccgaaacagaggagatcggtgatgataaaacctaacctggcggcagcgcaaaagatg

SEQ ID NO: 64530 - DNA, 103 bp, Artificial Sequence
  Synthetic Polynucleotide
taatacgactcactatagggaccattttaagagaggtaggttttatatacaacagaggagagtatatatgacctacctcaacctggcggcagcgcaaaagatg

SEQ ID NO: 64531 - DNA, 103 bp, Artificial Sequence
  Synthetic Polynucleotide
taatacgactcactatagggtctcaaccattttaagagaggtaggttttaaacagaggagataaaacatgcctctcttaaacctggcggcagcgcaaaagatg

SEQ ID NO: 64532 - DNA, 103 bp, Artificial Sequence
  Synthetic Polynucleotide
taatacgactcactatagggcttggtctcaaccattttaagagaggtaggaacagaggagacctaccatgcttaaaatgaacctggcggcagcgcaaaagatg

SEQ ID NO: 64533 - DNA, 103 bp, Artificial Sequence
  Synthetic Polynucleotide
taatacgactcactatagggcgaagcttggtctcaaccattttaagagagaacagaggagactctctatgaatggttgaaacctggcggcagcgcaaaagatg

SEQ ID NO: 64534 - DNA, 103 bp, Artificial Sequence
  Synthetic Polynucleotide
taatacgactcactatagggtacgacgaagcttggtctcaaccattttaaaacagaggagattaaaaatgttgagaccaaacctggcggcagcgcaaaagatg

SEQ ID NO: 64535 - DNA, 103 bp, Artificial Sequence
  Synthetic Polynucleotide
taatacgactcactataggggtttctacgacgaagcttggtctcaaccataacagaggagaatggttatgaccaagcttaacctggcggcagcgcaaaagatg

SEQ ID NO: 64536 - DNA, 103 bp, Artificial Sequence
  Synthetic Polynucleotide
taatacgactcactatagggtcagtgtttctacgacgaagcttggtctcaaacagaggagatgagacatggcttcgtcgaacctggcggcagcgcaaaagatg

SEQ ID NO: 64537 - DNA, 103 bp, Artificial Sequence
  Synthetic Polynucleotide
taatacgactcactatagggatcggatttgtatctatcttgaacaaatataacagaggagaatatttatgcaagatagaaacctggcggcagcgcaaaagatg

SEQ ID NO: 64538 - DNA, 103 bp, Artificial Sequence
  Synthetic Polynucleotide
taatacgactcactatagggccgcttcagtgtttctacgacgaagcttggaacagaggagaccaagcatggtcgtagaaaacctggcggcagcgcaaaagatg

SEQ ID NO: 64539 - DNA, 103 bp, Artificial Sequence
  Synthetic Polynucleotide
taatacgactcactatagggatcgtccgcttcagtgtttctacgacgaagaacagaggagacttcgtatgagaaacactaacctggcggcagcgcaaaagatg

SEQ ID NO: 64540 - DNA, 103 bp, Artificial Sequence
  Synthetic Polynucleotide
taatacgactcactatagggatcttatcgtccgcttcagtgtttctacgaaacagaggagatcgtagatgcactgaagcaacctggcggcagcgcaaaagatg

SEQ ID NO: 64541 - DNA, 103 bp, Artificial Sequence
  Synthetic Polynucleotide
taatacgactcactataggggatgaatcttatcgtccgcttcagtgtttcaacagaggagagaaacaatgaagcggacgaacctggcggcagcgcaaaagatg

SEQ ID NO: 64542 - DNA, 103 bp, Artificial Sequence
  Synthetic Polynucleotide
taatacgactcactataggggcgacgatgaatcttatcgtccgcttcagtaacagaggagaactgaaatggacgataagaacctggcggcagcgcaaaagatg

SEQ ID NO: 64543 - DNA, 103 bp, Artificial Sequence
  Synthetic Polynucleotide
taatacgactcactatagggatcgcgcgacgatgaatcttatcgtccgctaacagaggagaagcggaatgtaagattcaaacctggcggcagcgcaaaagatg

SEQ ID NO: 64544 - DNA, 103 bp, Artificial Sequence
  Synthetic Polynucleotide
taatacgactcactatagggccaacatcgcgcgacgatgaatcttatcgtaacagaggagaacgataatgttcatcgtcaacctggcggcagcgcaaaagatg

SEQ ID NO: 64545 - DNA, 103 bp, Artificial Sequence
  Synthetic Polynucleotide
taatacgactcactatagggttttgccaacatcgcgcgacgatgaatcttaacagaggagaaagattatgcgtcgcgcgaacctggcggcagcgcaaaagatg

SEQ ID NO: 64546 - DNA, 103 bp, Artificial Sequence
  Synthetic Polynucleotide
taatacgactcactatagggtccgtttttgccaacatcgcgcgacgatgaaacagaggagatcatcgatgcgcgatgttaacctggcggcagcgcaaaagatg

SEQ ID NO: 64547 - DNA, 103 bp, Artificial Sequence
  Synthetic Polynucleotide
taatacgactcactatagggccatatccgtttttgccaacatcgcgcgacaacagaggagagtcgcgatgtgttggcaaaacctggcggcagcgcaaaagatg

SEQ ID NO: 64548 - DNA, 103 bp, Artificial Sequence
  Synthetic Polynucleotide
taatacgactcactatagggaagttatcggatttgtatctatcttgaacaaacagaggagatgttcaatgtagatacaaaacctggcggcagcgcaaaagatg

SEQ ID NO: 64549 - DNA, 103 bp, Artificial Sequence
  Synthetic Polynucleotide
taatacgactcactatagggctcatccatatccgtttttgccaacatcgcaacagaggagagcgatgatggcaaaaacgaacctggcggcagcgcaaaagatg

SEQ ID NO: 64550 - DNA, 103 bp, Artificial Sequence
  Synthetic Polynucleotide
taatacgactcactatagggttggcctcatccatatccgtttttgccaacaacagaggagagttggcatgaacggatataacctggcggcagcgcaaaagatg

SEQ ID NO: 64551 - DNA, 103 bp, Artificial Sequence
  Synthetic Polynucleotide
taatacgactcactatagggcttcgttggcctcatccatatccgtttttgaacagaggagacaaaaaatgatatggatgaacctggcggcagcgcaaaagatg

SEQ ID NO: 64552 - DNA, 103 bp, Artificial Sequence
  Synthetic Polynucleotide
taatacgactcactatagggacctgcttcgttggcctcatccatatccgtaacagaggagaacggatatggatgaggccaacctggcggcagcgcaaaagatg

SEQ ID NO: 64553 - DNA, 103 bp, Artificial Sequence
  Synthetic Polynucleotide
taatacgactcactatagggaatagacctgcttcgttggcctcatccataaacagaggagatatggaatgggccaacgaaacctggcggcagcgcaaaagatg

SEQ ID NO: 64554 - DNA, 103 bp, Artificial Sequence
  Synthetic Polynucleotide
taatacgactcactatagggtgttgaatagacctgcttcgttggcctcataacagaggagaatgaggatgacgaagcagaacctggcggcagcgcaaaagatg

SEQ ID NO: 64555 - DNA, 103 bp, Artificial Sequence
  Synthetic Polynucleotide
taatacgactcactatagggagtagtgttgaatagacctgcttcgttggcaacagaggagagccaacatggcaggtctaaacctggcggcagcgcaaaagatg

SEQ ID NO: 64556 - DNA, 103 bp, Artificial Sequence
  Synthetic Polynucleotide
taatacgactcactatagggataatagtagtgttgaatagacctgcttcgaacagaggagacgaagcatgtctattcaaaacctggcggcagcgcaaaagatg

SEQ ID NO: 64557 - DNA, 103 bp, Artificial Sequence
  Synthetic Polynucleotide
taatacgactcactatagggcttcaataatagtagtgttgaatagacctgaacagaggagacaggtcatgtcaacactaaacctggcggcagcgcaaaagatg

SEQ ID NO: 64558 - DNA, 103 bp, Artificial Sequence
  Synthetic Polynucleotide
taatacgactcactatagggattatcttcaataatagtagtgttgaatagaacagaggagactattcatgactactattaacctggcggcagcgcaaaagatg

SEQ ID NO: 64559 - DNA, 103 bp, Artificial Sequence
  Synthetic Polynucleotide
taatacgactcactatagggcaaaaaagttatcggatttgtatctatcttaacagaggagaaagataatgacaaatccgaacctggcggcagcgcaaaagatg

SEQ ID NO: 64560 - DNA, 103 bp, Artificial Sequence
  Synthetic Polynucleotide
taatacgactcactatagggttcacattatcttcaataatagtagtgttgaacagaggagacaacacatgtattattgaaacctggcggcagcgcaaaagatg

SEQ ID NO: 64561 - DNA, 103 bp, Artificial Sequence
  Synthetic Polynucleotide
taatacgactcactatagggctaaattcacattatcttcaataatagtagaacagaggagactactaatgttgaagataaacctggcggcagcgcaaaagatg

SEQ ID NO: 64562 - DNA, 103 bp, Artificial Sequence
  Synthetic Polynucleotide
taatacgactcactatagggatatgctaaattcacattatcttcaataataacagaggagaattattatggataatgtgaacctggcggcagcgcaaaagatg

SEQ ID NO: 64563 - DNA, 103 bp, Artificial Sequence
  Synthetic Polynucleotide
taatacgactcactatagggttactatatgctaaattcacattatcttcaaacagaggagatgaagaatgtgtgaatttaacctggcggcagcgcaaaagatg

SEQ ID NO: 64564 - DNA, 103 bp, Artificial Sequence
  Synthetic Polynucleotide
taatacgactcactatagggttaacttactatatgctaaattcacattataacagaggagaataatgatgatttagcataacctggcggcagcgcaaaagatg

SEQ ID NO: 64565 - DNA, 103 bp, Artificial Sequence
  Synthetic Polynucleotide
taatacgactcactatagggctgaattaacttactatatgctaaattcacaacagaggagagtgaatatggcatatagtaacctggcggcagcgcaaaagatg

SEQ ID NO: 64566 - DNA, 103 bp, Artificial Sequence
  Synthetic Polynucleotide
taatacgactcactatagggagtatctgaattaacttactatatgctaaaaacagaggagatttagcatgtagtaagttaacctggcggcagcgcaaaagatg

SEQ ID NO: 64567 - DNA, 103 bp, Artificial Sequence
  Synthetic Polynucleotide
taatacgactcactatagggcctgtagtatctgaattaacttactatatgaacagaggagacatataatgagttaattcaacctggcggcagcgcaaaagatg

SEQ ID NO: 64568 - DNA, 103 bp, Artificial Sequence
  Synthetic Polynucleotide
taatacgactcactatagggacggtcctgtagtatctgaattaacttactaacagaggagaagtaagatgattcagataaacctggcggcagcgcaaaagatg

SEQ ID NO: 64569 - DNA, 103 bp, Artificial Sequence
  Synthetic Polynucleotide
taatacgactcactatagggctaatacggtcctgtagtatctgaattaacaacagaggagagttaatatggatactacaaacctggcggcagcgcaaaagatg

SEQ ID NO: 64570 - DNA, 103 bp, Artificial Sequence
  Synthetic Polynucleotide
taatacgactcactatagggatcatctgttaaagctgttaatggcttatgaacagaggagacataagatgttaacagctaacctggcggcagcgcaaaagatg

SEQ ID NO: 64571 - DNA, 103 bp, Artificial Sequence
  Synthetic Polynucleotide
taatacgactcactatagggtttgtcaaaaaagttatcggatttgtatctaacagaggagaagatacatgtccgataacaacctggcggcagcgcaaaagatg

SEQ ID NO: 64572 - DNA, 103 bp, Artificial Sequence
  Synthetic Polynucleotide
taatacgactcactatagggacattctaatacggtcctgtagtatctgaaaacagaggagattcagaatgtacaggaccaacctggcggcagcgcaaaagatg

SEQ ID NO: 64573 - DNA, 103 bp, Artificial Sequence
  Synthetic Polynucleotide
taatacgactcactatagggaaaatacattctaatacggtcctgtagtataacagaggagaatactaatggaccgtattaacctggcggcagcgcaaaagatg

SEQ ID NO: 64574 - DNA, 103 bp, Artificial Sequence
  Synthetic Polynucleotide
taatacgactcactataggggtgttaaaatacattctaatacggtcctgtaacagaggagaacaggaatgtattagaataacctggcggcagcgcaaaagatg

SEQ ID NO: 64575 - DNA, 103 bp, Artificial Sequence
  Synthetic Polynucleotide
taatacgactcactatagggaattagtgttaaaatacattctaatacggtaacagaggagaaccgtaatggaatgtattaacctggcggcagcgcaaaagatg

SEQ ID NO: 64576 - DNA, 103 bp, Artificial Sequence
  Synthetic Polynucleotide
taatacgactcactatagggatcttaattagtgttaaaatacattctaataacagaggagaattagaatgtattttaacaacctggcggcagcgcaaaagatg

SEQ ID NO: 64577 - DNA, 103 bp, Artificial Sequence
  Synthetic Polynucleotide
taatacgactcactatagggattatatcttaattagtgttaaaatacattaacagaggagaaatgtaatgtaacactaaaacctggcggcagcgcaaaagatg

SEQ ID NO: 64578 - DNA, 103 bp, Artificial Sequence
  Synthetic Polynucleotide
taatacgactcactatagggcaagtattatatcttaattagtgttaaaataacagaggagaattttaatgctaattaagaacctggcggcagcgcaaaagatg

SEQ ID NO: 64579 - DNA, 103 bp, Artificial Sequence
  Synthetic Polynucleotide
taatacgactcactatagggtcagtcaagtattatatcttaattagtgttaacagaggagaaacactatgtaagatataaacctggcggcagcgcaaaagatg

SEQ ID NO: 64580 - DNA, 103 bp, Artificial Sequence
  Synthetic Polynucleotide
taatacgactcactatagggttaagtcagtcaagtattatatcttaattaaacagaggagataattaatgtataatactaacctggcggcagcgcaaaagatg

SEQ ID NO: 64581 - DNA, 103 bp, Artificial Sequence
  Synthetic Polynucleotide
taatacgactcactatagggaagttttaagtcagtcaagtattatatcttaacagaggagaaagataatgtacttgactaacctggcggcagcgcaaaagatg

SEQ ID NO: 64582 - DNA, 103 bp, Artificial Sequence
  Synthetic Polynucleotide
taatacgactcactatagggtagaatttgtcaaaaaagttatcggatttgaacagaggagacaaatcatgtaactttttaacctggcggcagcgcaaaagatg

SEQ ID NO: 64583 - DNA, 103 bp, Artificial Sequence
  Synthetic Polynucleotide
taatacgactcactatagggttatcaagttttaagtcagtcaagtattataacagaggagaataataatggactgacttaacctggcggcagcgcaaaagatg

SEQ ID NO: 64584 - DNA, 103 bp, Artificial Sequence
  Synthetic Polynucleotide
taatacgactcactatagggattaattatcaagttttaagtcagtcaagtaacagaggagaacttgaatgacttaaaacaacctggcggcagcgcaaaagatg

SEQ ID NO: 64585 - DNA, 103 bp, Artificial Sequence
  Synthetic Polynucleotide
taatacgactcactatagggatattattaattatcaagttttaagtcagtaacagaggagaactgacatgaaacttgataacctggcggcagcgcaaaagatg

SEQ ID NO: 64586 - DNA, 103 bp, Artificial Sequence
  Synthetic Polynucleotide
taatacgactcactataggggaattatattattaattatcaagttttaagaacagaggagacttaaaatgtgataattaaacctggcggcagcgcaaaagatg

SEQ ID NO: 64587 - DNA, 103 bp, Artificial Sequence
  Synthetic Polynucleotide
taatacgactcactatagggaaaacgaattatattattaattatcaagttaacagaggagaaacttgatgattaataataacctggcggcagcgcaaaagatg

SEQ ID NO: 64588 - DNA, 103 bp, Artificial Sequence
  Synthetic Polynucleotide
taatacgactcactatagggatataaaaacgaattatattattaattatcaacagaggagagataatatgtaatataataacctggcggcagcgcaaaagatg

SEQ ID NO: 64589 - DNA, 103 bp, Artificial Sequence
  Synthetic Polynucleotide
taatacgactcactataggggtcacatataaaaacgaattatattattaaaacagaggagattaataatgtaattcgttaacctggcggcagcgcaaaagatg

SEQ ID NO: 64590 - DNA, 103 bp, Artificial Sequence
  Synthetic Polynucleotide
taatacgactcactatagggaaatagtcacatataaaaacgaattatattaacagaggagaaatataatgcgtttttataacctggcggcagcgcaaaagatg

SEQ ID NO: 64591 - DNA, 103 bp, Artificial Sequence
  Synthetic Polynucleotide
taatacgactcactatagggcgttaaaatagtcacatataaaaacgaattaacagaggagaaattcgatgttatatgtgaacctggcggcagcgcaaaagatg

SEQ ID NO: 64592 - DNA, 103 bp, Artificial Sequence
  Synthetic Polynucleotide
taatacgactcactatagggttagacgttaaaatagtcacatataaaaacaacagaggagagtttttatgtgtgactataacctggcggcagcgcaaaagatg

SEQ ID NO: 64593 - DNA, 103 bp, Artificial Sequence
  Synthetic Polynucleotide
taatacgactcactatagggtcccgtagaatttgtcaaaaaagttatcggaacagaggagaccgataatgtttttgacaaacctggcggcagcgcaaaagatg

SEQ ID NO: 64594 - DNA, 103 bp, Artificial Sequence
  Synthetic Polynucleotide
taatacgactcactatagggtacatttagacgttaaaatagtcacatataaacagaggagatatatgatgctattttaaaacctggcggcagcgcaaaagatg

SEQ ID NO: 64595 - DNA, 103 bp, Artificial Sequence
  Synthetic Polynucleotide
taatacgactcactatagggactaatacatttagacgttaaaatagtcacaacagaggagagtgactatgttaacgtctaacctggcggcagcgcaaaagatg

SEQ ID NO: 64596 - DNA, 103 bp, Artificial Sequence
  Synthetic Polynucleotide
taatacgactcactatagggatttaactaatacatttagacgttaaaataaacagaggagatattttatggtctaaatgaacctggcggcagcgcaaaagatg

SEQ ID NO: 64597 - DNA, 103 bp, Artificial Sequence
  Synthetic Polynucleotide
taatacgactcactatagggttaatatttaactaatacatttagacgttaaacagaggagataacgtatgaatgtattaaacctggcggcagcgcaaaagatg

SEQ ID NO: 64598 - DNA, 103 bp, Artificial Sequence
  Synthetic Polynucleotide
taatacgactcactatagggtaagtttaatatttaactaatacatttagaaacagaggagatctaaaatgattagttaaaacctggcggcagcgcaaaagatg

SEQ ID NO: 64599 - DNA, 103 bp, Artificial Sequence
  Synthetic Polynucleotide
taatacgactcactatagggcgtggtaagtttaatatttaactaatacataacagaggagaatgtatatgttaaatattaacctggcggcagcgcaaaagatg

SEQ ID NO: 64600 - DNA, 103 bp, Artificial Sequence
  Synthetic Polynucleotide
taatacgactcactatagggttttacgtggtaagtttaatatttaactaaaacagaggagattagttatgtattaaactaacctggcggcagcgcaaaagatg

SEQ ID NO: 64601 - DNA, 103 bp, Artificial Sequence
  Synthetic Polynucleotide
taatacgactcactatagggttaagttttacgtggtaagtttaatatttaaacagaggagataaataatgaacttaccaaacctggcggcagcgcaaaagatg

SEQ ID NO: 64602 - DNA, 103 bp, Artificial Sequence
  Synthetic Polynucleotide
taatacgactcactatagggaaattttaagttttacgtggtaagtttaataacagaggagaattaaaatgaccacgtaaaacctggcggcagcgcaaaagatg

SEQ ID NO: 64603 - DNA, 103 bp, Artificial Sequence
  Synthetic Polynucleotide
taatacgactcactatagggattttaaattttaagttttacgtggtaagtaacagaggagaacttacatggtaaaacttaacctggcggcagcgcaaaagatg

SEQ ID NO: 64604 - DNA, 103 bp, Artificial Sequence
  Synthetic Polynucleotide
taatacgactcactataggggtggatcccgtagaatttgtcaaaaaagttaacagaggagaaactttatggacaaattcaacctggcggcagcgcaaaagatg

SEQ ID NO: 64605 - DNA, 103 bp, Artificial Sequence
  Synthetic Polynucleotide
taatacgactcactatagggataccattttaaattttaagttttacgtggaacagaggagaccacgtatgacttaaaataacctggcggcagcgcaaaagatg

SEQ ID NO: 64606 - DNA, 103 bp, Artificial Sequence
  Synthetic Polynucleotide
taatacgactcactatagggatgaaataccattttaaattttaagttttaaacagaggagataaaacatgaaatttaaaaacctggcggcagcgcaaaagatg

SEQ ID NO: 64607 - DNA, 103 bp, Artificial Sequence
  Synthetic Polynucleotide
taatacgactcactatagggcgtcaatgaaataccattttaaattttaagaacagaggagacttaaaatgtaaaatggtaacctggcggcagcgcaaaagatg

SEQ ID NO: 64608 - DNA, 103 bp, Artificial Sequence
  Synthetic Polynucleotide
taatacgactcactatagggtcatccgtcaatgaaataccattttaaattaacagaggagaaatttaatgtggtatttcaacctggcggcagcgcaaaagatg

SEQ ID NO: 64609 - DNA, 103 bp, Artificial Sequence
  Synthetic Polynucleotide
taatacgactcactatagggtatgatcatccgtcaatgaaataccattttaacagaggagaaaaatgatgtttcattgaaacctggcggcagcgcaaaagatg

SEQ ID NO: 64610 - DNA, 103 bp, Artificial Sequence
  Synthetic Polynucleotide
taatacgactcactatagggtaatgtatgatcatccgtcaatgaaataccaacagaggagaggtattatgttgacggataacctggcggcagcgcaaaagatg

SEQ ID NO: 64611 - DNA, 103 bp, Artificial Sequence
  Synthetic Polynucleotide
taatacgactcactataggggttcataatgtatgatcatccgtcaatgaaaacagaggagattcattatgggatgatcaaacctggcggcagcgcaaaagatg

SEQ ID NO: 64612 - DNA, 103 bp, Artificial Sequence
  Synthetic Polynucleotide
taatacgactcactatagggtgaaagttcataatgtatgatcatccgtcaaacagaggagatgacggatgatcatacataacctggcggcagcgcaaaagatg

SEQ ID NO: 64613 - DNA, 103 bp, Artificial Sequence
  Synthetic Polynucleotide
taatacgactcactataggggtccttgaaagttcataatgtatgatcatcaacagaggagagatgatatgacattatgaaacctggcggcagcgcaaaagatg

SEQ ID NO: 64614 - DNA, 103 bp, Artificial Sequence
  Synthetic Polynucleotide
taatacgactcactataggggacaagtccttgaaagttcataatgtatgaaacagaggagatcatacatgatgaactttaacctggcggcagcgcaaaagatg

SEQ ID NO: 64615 - DNA, 103 bp, Artificial Sequence
  Synthetic Polynucleotide
taatacgactcactatagggttaaagtggatcccgtagaatttgtcaaaaaacagaggagattttgaatgattctacggaacctggcggcagcgcaaaagatg

SEQ ID NO: 64616 - DNA, 103 bp, Artificial Sequence
  Synthetic Polynucleotide
taatacgactcactataggggttaagacaagtccttgaaagttcataatgaacagaggagacattatatgctttcaaggaacctggcggcagcgcaaaagatg

SEQ ID NO: 64617 - DNA, 103 bp, Artificial Sequence
  Synthetic Polynucleotide
taatacgactcactatagggtgtcagttaagacaagtccttgaaagttcaaacagaggagatgaactatgaaggacttgaacctggcggcagcgcaaaagatg

SEQ ID NO: 64618 - DNA, 103 bp, Artificial Sequence
  Synthetic Polynucleotide
taatacgactcactataggggcaattgtcagttaagacaagtccttgaaaaacagaggagatttcaaatgcttgtcttaaacctggcggcagcgcaaaagatg

SEQ ID NO: 64619 - DNA, 103 bp, Artificial Sequence
  Synthetic Polynucleotide
taatacgactcactatagggtttttgcaattgtcagttaagacaagtcctaacagaggagaaggactatgcttaactgaaacctggcggcagcgcaaaagatg

SEQ ID NO: 64620 - DNA, 103 bp, Artificial Sequence
  Synthetic Polynucleotide
taatacgactcactatagggattgatttttgcaattgtcagttaagacaaaacagaggagattgtctatgctgacaattaacctggcggcagcgcaaaagatg

SEQ ID NO: 64621 - DNA, 103 bp, Artificial Sequence
  Synthetic Polynucleotide
taatacgactcactataggggacccattgatttttgcaattgtcagttaaaacagaggagattaactatgaattgcaaaaacctggcggcagcgcaaaagatg

SEQ ID NO: 64622 - DNA, 103 bp, Artificial Sequence
  Synthetic Polynucleotide
taatacgactcactatagggccaacgacccattgatttttgcaattgtcaaacagaggagatgacaaatgcaaaaatcaaacctggcggcagcgcaaaagatg

SEQ ID NO: 64623 - DNA, 103 bp, Artificial Sequence
  Synthetic Polynucleotide
taatacgactcactatagggatggtccaacgacccattgatttttgcaataacagaggagaattgcaatgatcaatgggaacctggcggcagcgcaaaagatg

SEQ ID NO: 64624 - DNA, 103 bp, Artificial Sequence
  Synthetic Polynucleotide
taatacgactcactatagggtattaatggtccaacgacccattgatttttaacagaggagaaaaaatatgtgggtcgttaacctggcggcagcgcaaaagatg

SEQ ID NO: 64625 - DNA, 103 bp, Artificial Sequence
  Synthetic Polynucleotide
taatacgactcactatagggtttcctattaatggtccaacgacccattgaaacagaggagatcaatgatgcgttggaccaacctggcggcagcgcaaaagatg

SEQ ID NO: 64626 - DNA, 103 bp, Artificial Sequence
  Synthetic Polynucleotide
taatacgactcactatagggcacttttaaagtggatcccgtagaatttgtaacagaggagaacaaatatgacgggatccaacctggcggcagcgcaaaagatg

SEQ ID NO: 64627 - DNA, 103 bp, Artificial Sequence
  Synthetic Polynucleotide
taatacgactcactatagggcaccttttcctattaatggtccaacgacccaacagaggagagggtcgatggaccattaaaacctggcggcagcgcaaaagatg

SEQ ID NO: 64628 - DNA, 103 bp, Artificial Sequence
  Synthetic Polynucleotide
taatacgactcactataggggaatccaccttttcctattaatggtccaacaacagaggagagttggaatgttaataggaaacctggcggcagcgcaaaagatg

SEQ ID NO: 64629 - DNA, 103 bp, Artificial Sequence
  Synthetic Polynucleotide
taatacgactcactatagggctaccgaatccaccttttcctattaatggtaacagaggagaaccattatgaggaaaaggaacctggcggcagcgcaaaagatg

SEQ ID NO: 64630 - DNA, 103 bp, Artificial Sequence
  Synthetic Polynucleotide
taatacgactcactatagggaaatactaccgaatccaccttttcctattaaacagaggagataatagatgaaggtggataacctggcggcagcgcaaaagatg

SEQ ID NO: 64631 - DNA, 103 bp, Artificial Sequence
  Synthetic Polynucleotide
taatacgactcactatagggagtataaatactaccgaatccaccttttccaacagaggagaggaaaaatgggattcggtaacctggcggcagcgcaaaagatg

SEQ ID NO: 64632 - DNA, 103 bp, Artificial Sequence
  Synthetic Polynucleotide
taatacgactcactatagggttagtagtataaatactaccgaatccacctaacagaggagaaggtggatgcggtagtataacctggcggcagcgcaaaagatg

SEQ ID NO: 64633 - DNA, 103 bp, Artificial Sequence
  Synthetic Polynucleotide
taatacgactcactatagggtgtcattagtagtataaatactaccgaatcaacagaggagagattcgatggtatttataaacctggcggcagcgcaaaagatg

SEQ ID NO: 64634 - DNA, 103 bp, Artificial Sequence
  Synthetic Polynucleotide
taatacgactcactatagggattattgtcattagtagtataaatactaccaacagaggagaggtagtatgtatactactaacctggcggcagcgcaaaagatg

SEQ ID NO: 64635 - DNA, 103 bp, Artificial Sequence
  Synthetic Polynucleotide
taatacgactcactatagggacataattattgtcattagtagtataaataaacagaggagatatttaatgtactaatgaaacctggcggcagcgcaaaagatg

SEQ ID NO: 64636 - DNA, 103 bp, Artificial Sequence
  Synthetic Polynucleotide
taatacgactcactatagggttactacataattattgtcattagtagtataacagaggagaatactaatgatgacaataaacctggcggcagcgcaaaagatg

SEQ ID NO: 64637 - DNA, 103 bp, Artificial Sequence
  Synthetic Polynucleotide
taatacgactcactatagggtatgacacttttaaagtggatcccgtagaaaacagaggagattctacatgatccactttaacctggcggcagcgcaaaagatg

SEQ ID NO: 64638 - DNA, 103 bp, Artificial Sequence
  Synthetic Polynucleotide
taatacgactcactatagggtatttttactacataattattgtcattagtaacagaggagaactaatatgaataattataacctggcggcagcgcaaaagatg

SEQ ID NO: 64639 - DNA, 103 bp, Artificial Sequence
  Synthetic Polynucleotide
taatacgactcactatagggggctctatttttactacataattattgtcaaacagaggagatgacaaatgttatgtagtaacctggcggcagcgcaaaagatg

SEQ ID NO: 64640 - DNA, 103 bp, Artificial Sequence
  Synthetic Polynucleotide
taatacgactcactatagggctttgggctctatttttactacataattataacagaggagaataattatgtagtaaaaaaacctggcggcagcgcaaaagatg

SEQ ID NO: 64641 - DNA, 103 bp, Artificial Sequence
  Synthetic Polynucleotide
taatacgactcactataggggttagctttgggctctatttttactacataaacagaggagatatgtaatgaaaatagagaacctggcggcagcgcaaaagatg

SEQ ID NO: 64642 - DNA, 103 bp, Artificial Sequence
  Synthetic Polynucleotide
taatacgactcactataggggatccgttagctttgggctctatttttactaacagaggagaagtaaaatgagagcccaaaacctggcggcagcgcaaaagatg

SEQ ID NO: 64643 - DNA, 103 bp, Artificial Sequence
  Synthetic Polynucleotide
taatacgactcactatagggataatgatccgttagctttgggctctatttaacagaggagaaaatagatgccaaagctaaacctggcggcagcgcaaaagatg

SEQ ID NO: 64644 - DNA, 103 bp, Artificial Sequence
  Synthetic Polynucleotide
taatacgactcactatagggagtaaataatgatccgttagctttgggctcaacagaggagagagcccatggctaacggaaacctggcggcagcgcaaaagatg

SEQ ID NO: 64645 - DNA, 103 bp, Artificial Sequence
  Synthetic Polynucleotide
taatacgactcactatagggtgttcagtaaataatgatccgttagctttgaacagaggagacaaagcatgcggatcattaacctggcggcagcgcaaaagatg

SEQ ID NO: 64646 - DNA, 103 bp, Artificial Sequence
  Synthetic Polynucleotide
taatacgactcactatagggatgcctgttcagtaaataatgatccgttagaacagaggagactaacgatgcattatttaaacctggcggcagcgcaaaagatg

SEQ ID NO: 64647 - DNA, 103 bp, Artificial Sequence
  Synthetic Polynucleotide
taatacgactcactatagggataaaatgcctgttcagtaaataatgatccaacagaggagaggatcaatgtttactgaaaacctggcggcagcgcaaaagatg

SEQ ID NO: 64648 - DNA, 103 bp, Artificial Sequence
  Synthetic Polynucleotide
taatacgactcactatagggcccggtatgacacttttaaagtggatcccgaacagaggagacgggatatgctttaaaagaacctggcggcagcgcaaaagatg

SEQ ID NO: 64649 - DNA, 103 bp, Artificial Sequence
  Synthetic Polynucleotide
taatacgactcactatagggctagtataaaatgcctgttcagtaaataataacagaggagaattattatgtgaacaggcaacctggcggcagcgcaaaagatg

SEQ ID NO: 64650 - DNA, 103 bp, Artificial Sequence
  Synthetic Polynucleotide
taatacgactcactataggggtactctagtataaaatgcctgttcagtaaaacagaggagattactgatgaggcattttaacctggcggcagcgcaaaagatg

SEQ ID NO: 64651 - DNA, 103 bp, Artificial Sequence
  Synthetic Polynucleotide
taatacgactcactatagggtttaagtactctagtataaaatgcctgttcaacagaggagagaacagatgttttatactaacctggcggcagcgcaaaagatg

SEQ ID NO: 64652 - DNA, 103 bp, Artificial Sequence
  Synthetic Polynucleotide
taatacgactcactataggggatggtttaagtactctagtataaaatgccaacagaggagaggcattatgtactagagtaacctggcggcagcgcaaaagatg

SEQ ID NO: 64653 - DNA, 103 bp, Artificial Sequence
  Synthetic Polynucleotide
taatacgactcactatagggtaacggatggtttaagtactctagtataaaaacagaggagatttataatggagtacttaaacctggcggcagcgcaaaagatg

SEQ ID NO: 64654 - DNA, 103 bp, Artificial Sequence
  Synthetic Polynucleotide
taatacgactcactatagggttcgataacggatggtttaagtactctagtaacagaggagaactagaatgcttaaaccaaacctggcggcagcgcaaaagatg

SEQ ID NO: 64655 - DNA, 103 bp, Artificial Sequence
  Synthetic Polynucleotide
taatacgactcactatagggcattcttcgataacggatggtttaagtactaacagaggagaagtactatgaccatccgtaacctggcggcagcgcaaaagatg

SEQ ID NO: 64656 - DNA, 103 bp, Artificial Sequence
  Synthetic Polynucleotide
taatacgactcactatagggttttccattcttcgataacggatggtttaaaacagaggagattaaacatgccgttatcgaacctggcggcagcgcaaaagatg

SEQ ID NO: 64657 - DNA, 103 bp, Artificial Sequence
  Synthetic Polynucleotide
taatacgactcactatagggagattttttccattcttcgataacggatggaacagaggagaccatccatgatcgaagaaaacctggcggcagcgcaaaagatg

SEQ ID NO: 64658 - DNA, 103 bp, Artificial Sequence
  Synthetic Polynucleotide
taatacgactcactatagggtggtgagattttttccattcttcgataacgaacagaggagacgttatatgagaatggaaaacctggcggcagcgcaaaagatg

SEQ ID NO: 64659 - DNA, 103 bp, Artificial Sequence
  Synthetic Polynucleotide
taatacgactcactatagggaagaacccggtatgacacttttaaagtggaaacagaggagatccactatgaaagtgtcaaacctggcggcagcgcaaaagatg

SEQ ID NO: 64660 - DNA, 103 bp, Artificial Sequence
  Synthetic Polynucleotide
taatacgactcactatagggttatatggtgagattttttccattcttcgaaacagaggagatcgaagatgggaaaaaataacctggcggcagcgcaaaagatg

SEQ ID NO: 64661 - DNA, 103 bp, Artificial Sequence
  Synthetic Polynucleotide
taatacgactcactataggggtggcttatatggtgagattttttccattcaacagaggagagaatggatgaaatctcacaacctggcggcagcgcaaaagatg

SEQ ID NO: 64662 - DNA, 103 bp, Artificial Sequence
  Synthetic Polynucleotide
taatacgactcactatagggcctacgtggcttatatggtgagattttttcaacagaggagagaaaaaatgtcaccatataacctggcggcagcgcaaaagatg

SEQ ID NO: 64663 - DNA, 103 bp, Artificial Sequence
  Synthetic Polynucleotide
taatacgactcactatagggtaactcctacgtggcttatatggtgagattaacagaggagaaatctcatgatataagccaacctggcggcagcgcaaaagatg

SEQ ID NO: 64664 - DNA, 103 bp, Artificial Sequence
  Synthetic Polynucleotide
taatacgactcactatagggtgtgataactcctacgtggcttatatggtgaacagaggagacaccatatgagccacgtaaacctggcggcagcgcaaaagatg

SEQ ID NO: 64665 - DNA, 103 bp, Artificial Sequence
  Synthetic Polynucleotide
taatacgactcactatagggttgcatgtgataactcctacgtggcttataaacagaggagatataagatgcgtaggagtaacctggcggcagcgcaaaagatg

SEQ ID NO: 64666 - DNA, 103 bp, Artificial Sequence
  Synthetic Polynucleotide
taatacgactcactatagggatgccttgcatgtgataactcctacgtggcaacagaggagagccacgatggagttatcaaacctggcggcagcgcaaaagatg

SEQ ID NO: 64667 - DNA, 103 bp, Artificial Sequence
  Synthetic Polynucleotide
taatacgactcactatagggaccaaatgccttgcatgtgataactcctacaacagaggagagtaggaatgatcacatgcaacctggcggcagcgcaaaagatg

SEQ ID NO: 64668 - DNA, 103 bp, Artificial Sequence
  Synthetic Polynucleotide
taatacgactcactatagggtatagaccaaatgccttgcatgtgataactaacagaggagaagttatatgatgcaaggcaacctggcggcagcgcaaaagatg

SEQ ID NO: 64669 - DNA, 103 bp, Artificial Sequence
  Synthetic Polynucleotide
taatacgactcactatagggatttgtatagaccaaatgccttgcatgtgaaacagaggagatcacatatgaggcatttgaacctggcggcagcgcaaaagatg

SEQ ID NO: 64670 - DNA, 103 bp, Artificial Sequence
  Synthetic Polynucleotide
taatacgactcactatagggataaaaagaacccggtatgacacttttaaaaacagaggagatttaaaatggtcataccgaacctggcggcagcgcaaaagatg

SEQ ID NO: 64671 - DNA, 103 bp, Artificial Sequence
  Synthetic Polynucleotide
taatacgactcactatagggaatggatttgtatagaccaaatgccttgcaaacagaggagatgcaagatgtttggtctaaacctggcggcagcgcaaaagatg

SEQ ID NO: 64672 - DNA, 103 bp, Artificial Sequence
  Synthetic Polynucleotide
taatacgactcactataggggtattaatggatttgtatagaccaaatgccaacagaggagaggcattatgtctatacaaaacctggcggcagcgcaaaagatg

SEQ ID NO: 64673 - DNA, 103 bp, Artificial Sequence
  Synthetic Polynucleotide
taatacgactcactatagggattccgtattaatggatttgtatagaccaaaacagaggagattggtcatgacaaatccaaacctggcggcagcgcaaaagatg

SEQ ID NO: 64674 - DNA, 103 bp, Artificial Sequence
  Synthetic Polynucleotide
taatacgactcactatagggtctatattccgtattaatggatttgtatagaacagaggagactatacatgtccattaataacctggcggcagcgcaaaagatg

SEQ ID NO: 64675 - DNA, 103 bp, Artificial Sequence
  Synthetic Polynucleotide
taatacgactcactatagggaagaatctatattccgtattaatggatttgaacagaggagacaaatcatgtaatacggaaacctggcggcagcgcaaaagatg

SEQ ID NO: 64676 - DNA, 103 bp, Artificial Sequence
  Synthetic Polynucleotide
taatacgactcactatagggttaccaagaatctatattccgtattaatggaacagaggagaccattaatgcggaatataaacctggcggcagcgcaaaagatg

SEQ ID NO: 64677 - DNA, 103 bp, Artificial Sequence
  Synthetic Polynucleotide
taatacgactcactatagggattaattaccaagaatctatattccgtattaacagaggagaaatacgatgtatagattcaacctggcggcagcgcaaaagatg

SEQ ID NO: 64678 - DNA, 103 bp, Artificial Sequence
  Synthetic Polynucleotide
taatacgactcactatagggaatctattaattaccaagaatctatattccaacagaggagaggaataatgattcttggtaacctggcggcagcgcaaaagatg

SEQ ID NO: 64679 - DNA, 103 bp, Artificial Sequence
  Synthetic Polynucleotide
taatacgactcactatagggcacccaatctattaattaccaagaatctataacagaggagaatagatatgtggtaattaaacctggcggcagcgcaaaagatg

SEQ ID NO: 64680 - DNA, 103 bp, Artificial Sequence
  Synthetic Polynucleotide
taatacgactcactatagggatctacacccaatctattaattaccaagaaaacagaggagattcttgatgattaatagaaacctggcggcagcgcaaaagatg

SEQ ID NO: 64681 - DNA, 103 bp, Artificial Sequence
  Synthetic Polynucleotide
taatacgactcactatagggctcagatcatctgttaaagctgttaatggcaacagaggagagccattatgagctttaacaacctggcggcagcgcaaaagatg

SEQ ID NO: 64682 - DNA, 103 bp, Artificial Sequence
  Synthetic Polynucleotide
taatacgactcactatagggaaaaaataaaaagaacccggtatgacacttaacagaggagaaagtgtatgaccgggttcaacctggcggcagcgcaaaagatg

SEQ ID NO: 64683 - DNA, 103 bp, Artificial Sequence
  Synthetic Polynucleotide
taatacgactcactatagggtctagatctacacccaatctattaattaccaacagaggagaggtaatatgtagattgggaacctggcggcagcgcaaaagatg

SEQ ID NO: 64684 - DNA, 103 bp, Artificial Sequence
  Synthetic Polynucleotide
taatacgactcactatagggccgcatctagatctacacccaatctattaaaacagaggagattaataatgtgggtgtagaacctggcggcagcgcaaaagatg

SEQ ID NO: 64685 - DNA, 103 bp, Artificial Sequence
  Synthetic Polynucleotide
taatacgactcactataggggatcaccgcatctagatctacacccaatctaacagaggagaagattgatggtagatctaaacctggcggcagcgcaaaagatg

SEQ ID NO: 64686 - DNA, 103 bp, Artificial Sequence
  Synthetic Polynucleotide
taatacgactcactataggggccctgatcaccgcatctagatctacacccaacagaggagagggtgtatgtctagatgcaacctggcggcagcgcaaaagatg

SEQ ID NO: 64687 - DNA, 103 bp, Artificial Sequence
  Synthetic Polynucleotide
taatacgactcactatagggtgttagccctgatcaccgcatctagatctaaacagaggagatagatcatgatgcggtgaaacctggcggcagcgcaaaagatg

SEQ ID NO: 64688 - DNA, 103 bp, Artificial Sequence
  Synthetic Polynucleotide
taatacgactcactatagggattattgttagccctgatcaccgcatctagaacagaggagactagatatggtgatcaggaacctggcggcagcgcaaaagatg

SEQ ID NO: 64689 - DNA, 103 bp, Artificial Sequence
  Synthetic Polynucleotide
taatacgactcactatagggagtctattattgttagccctgatcaccgcaaacagaggagatgcggtatgcagggctaaaacctggcggcagcgcaaaagatg

SEQ ID NO: 64690 - DNA, 103 bp, Artificial Sequence
  Synthetic Polynucleotide
taatacgactcactatagggtcggtagtctattattgttagccctgatcaaacagaggagatgatcaatgctaacaataaacctggcggcagcgcaaaagatg

SEQ ID NO: 64691 - DNA, 103 bp, Artificial Sequence
  Synthetic Polynucleotide
taatacgactcactatagggtcttttcggtagtctattattgttagccctaacagaggagaagggctatgaataatagaaacctggcggcagcgcaaaagatg

SEQ ID NO: 64692 - DNA, 103 bp, Artificial Sequence
  Synthetic Polynucleotide
taatacgactcactatagggaccgatcttttcggtagtctattattgttaaacagaggagataacaaatgtagactaccaacctggcggcagcgcaaaagatg

SEQ ID NO: 64693 - DNA, 103 bp, Artificial Sequence
  Synthetic Polynucleotide
taatacgactcactataggggtttaaaaaaataaaaagaacccggtatgaaacagaggagatcatacatggttctttttaacctggcggcagcgcaaaagatg

SEQ ID NO: 64694 - DNA, 103 bp, Artificial Sequence
  Synthetic Polynucleotide
taatacgactcactatagggacatcaccgatcttttcggtagtctattataacagaggagaataataatgtaccgaaaaaacctggcggcagcgcaaaagatg

SEQ ID NO: 64695 - DNA, 103 bp, Artificial Sequence
  Synthetic Polynucleotide
taatacgactcactatagggtactaacatcaccgatcttttcggtagtctaacagaggagaagactaatgaaaagatcgaacctggcggcagcgcaaaagatg

SEQ ID NO: 64696 - DNA, 103 bp, Artificial Sequence
  Synthetic Polynucleotide
taatacgactcactatagggattcctactaacatcaccgatcttttcggtaacagaggagaaccgaaatgatcggtgataacctggcggcagcgcaaaagatg

SEQ ID NO: 64697 - DNA, 103 bp, Artificial Sequence
  Synthetic Polynucleotide
taatacgactcactatagggtttctattcctactaacatcaccgatctttaacagaggagaaaagatatgtgatgttagaacctggcggcagcgcaaaagatg

SEQ ID NO: 64698 - DNA, 103 bp, Artificial Sequence
  Synthetic Polynucleotide
taatacgactcactatagggcaagatttctattcctactaacatcaccgaaacagaggagatcggtgatgttagtaggaaacctggcggcagcgcaaaagatg

SEQ ID NO: 64699 - DNA, 103 bp, Artificial Sequence
  Synthetic Polynucleotide
taatacgactcactataggggtattcaagatttctattcctactaacatcaacagaggagagatgttatgaggaatagaaacctggcggcagcgcaaaagatg

SEQ ID NO: 64700 - DNA, 103 bp, Artificial Sequence
  Synthetic Polynucleotide
taatacgactcactataggggtatggtattcaagatttctattcctactaaacagaggagatagtagatgtagaaatctaacctggcggcagcgcaaaagatg

SEQ ID NO: 64701 - DNA, 103 bp, Artificial Sequence
  Synthetic Polynucleotide
taatacgactcactatagggaaattgtatggtattcaagatttctattccaacagaggagaggaataatgatcttgaataacctggcggcagcgcaaaagatg

SEQ ID NO: 64702 - DNA, 103 bp, Artificial Sequence
  Synthetic Polynucleotide
taatacgactcactatagggtgcataaattgtatggtattcaagatttctaacagaggagaagaaatatggaataccataacctggcggcagcgcaaaagatg

SEQ ID NO: 64703 - DNA, 103 bp, Artificial Sequence
  Synthetic Polynucleotide
taatacgactcactataggggctcgtgcataaattgtatggtattcaagaaacagaggagatcttgaatgccatacaataacctggcggcagcgcaaaagatg

SEQ ID NO: 64704 - DNA, 103 bp, Artificial Sequence
  Synthetic Polynucleotide
taatacgactcactataggggatctgtttaaaaaaataaaaagaacccggaacagaggagaccgggtatgttttattttaacctggcggcagcgcaaaagatg

SEQ ID NO: 64705 - DNA, 103 bp, Artificial Sequence
  Synthetic Polynucleotide
taatacgactcactatagggtccttgctcgtgcataaattgtatggtattaacagaggagaaataccatgcaatttatgaacctggcggcagcgcaaaagatg

SEQ ID NO: 64706 - DNA, 103 bp, Artificial Sequence
  Synthetic Polynucleotide
taatacgactcactataggggaatatccttgctcgtgcataaattgtatgaacagaggagacatacaatgtatgcacgaaacctggcggcagcgcaaaagatg

SEQ ID NO: 64707 - DNA, 103 bp, Artificial Sequence
  Synthetic Polynucleotide
taatacgactcactatagggcatgagaatatccttgctcgtgcataaattaacagaggagaaatttaatgacgagcaagaacctggcggcagcgcaaaagatg

SEQ ID NO: 64708 - DNA, 103 bp, Artificial Sequence
  Synthetic Polynucleotide
taatacgactcactatagggatttccatgagaatatccttgctcgtgcataacagaggagaatgcacatgcaaggatataacctggcggcagcgcaaaagatg

SEQ ID NO: 64709 - DNA, 103 bp, Artificial Sequence
  Synthetic Polynucleotide
taatacgactcactatagggttaatatttccatgagaatatccttgctcgaacagaggagacgagcaatgatattctcaaacctggcggcagcgcaaaagatg

SEQ ID NO: 64710 - DNA, 103 bp, Artificial Sequence
  Synthetic Polynucleotide
taatacgactcactatagggtcgctttaatatttccatgagaatatccttaacagaggagaaaggatatgctcatggaaaacctggcggcagcgcaaaagatg

SEQ ID NO: 64711 - DNA, 103 bp, Artificial Sequence
  Synthetic Polynucleotide
taatacgactcactatagggattgctcgctttaatatttccatgagaataaacagaggagatattctatgggaaatattaacctggcggcagcgcaaaagatg

SEQ ID NO: 64712 - DNA, 103 bp, Artificial Sequence
  Synthetic Polynucleotide
taatacgactcactatagggactatattgctcgctttaatatttccatgaaacagaggagatcatggatgtattaaagcaacctggcggcagcgcaaaagatg

SEQ ID NO: 64713 - DNA, 103 bp, Artificial Sequence
  Synthetic Polynucleotide
taatacgactcactatagggccaaaactatattgctcgctttaatatttcaacagaggagagaaataatgaagcgagcaaacctggcggcagcgcaaaagatg

SEQ ID NO: 64714 - DNA, 103 bp, Artificial Sequence
  Synthetic Polynucleotide
taatacgactcactatagggttgatccaaaactatattgctcgctttaataacagaggagaattaaaatgagcaatataaacctggcggcagcgcaaaagatg

SEQ ID NO: 64715 - DNA, 103 bp, Artificial Sequence
  Synthetic Polynucleotide
taatacgactcactatagggccattgatctgtttaaaaaaataaaaagaaaacagaggagattctttatgtttttttaaaacctggcggcagcgcaaaagatg

SEQ ID NO: 64716 - DNA, 103 bp, Artificial Sequence
  Synthetic Polynucleotide
taatacgactcactatagggtccatttgatccaaaactatattgctcgctaacagaggagaagcgagatgtatagttttaacctggcggcagcgcaaaagatg

SEQ ID NO: 64717 - DNA, 103 bp, Artificial Sequence
  Synthetic Polynucleotide
taatacgactcactatagggtcttatccatttgatccaaaactatattgcaacagaggagagcaataatgttttggatcaacctggcggcagcgcaaaagatg

SEQ ID NO: 64718 - DNA, 103 bp, Artificial Sequence
  Synthetic Polynucleotide
taatacgactcactatagggtttattcttatccatttgatccaaaactataacagaggagaatagttatggatcaaatgaacctggcggcagcgcaaaagatg

SEQ ID NO: 64719 - DNA, 103 bp, Artificial Sequence
  Synthetic Polynucleotide
taatacgactcactatagggtataatttattcttatccatttgatccaaaaacagaggagatttggaatgaatggataaaacctggcggcagcgcaaaagatg

SEQ ID NO: 64720 - DNA, 103 bp, Artificial Sequence
  Synthetic Polynucleotide
taatacgactcactatagggctagatataatttattcttatccatttgataacagaggagaatcaaaatgataagaataaacctggcggcagcgcaaaagatg

SEQ ID NO: 64721 - DNA, 103 bp, Artificial Sequence
  Synthetic Polynucleotide
taatacgactcactatagggatccactagatataatttattcttatccataacagaggagaatggatatgaataaattaaacctggcggcagcgcaaaagatg

SEQ ID NO: 64722 - DNA, 103 bp, Artificial Sequence
  Synthetic Polynucleotide
taatacgactcactatagggccgtaatccactagatataatttattcttaaacagaggagataagaaatgattatatctaacctggcggcagcgcaaaagatg

SEQ ID NO: 64723 - DNA, 103 bp, Artificial Sequence
  Synthetic Polynucleotide
taatacgactcactatagggccaatccgtaatccactagatataatttataacagaggagaataaatatgatctagtggaacctggcggcagcgcaaaagatg

SEQ ID NO: 64724 - DNA, 103 bp, Artificial Sequence
  Synthetic Polynucleotide
taatacgactcactatagggagaaaccaatccgtaatccactagatataaaacagaggagattatatatggtggattacaacctggcggcagcgcaaaagatg

SEQ ID NO: 64725 - DNA, 103 bp, Artificial Sequence
  Synthetic Polynucleotide
taatacgactcactatagggaatttagaaaccaatccgtaatccactagaaacagaggagatctagtatgttacggattaacctggcggcagcgcaaaagatg

SEQ ID NO: 64726 - DNA, 103 bp, Artificial Sequence
  Synthetic Polynucleotide
taatacgactcactatagggtcacaccattgatctgtttaaaaaaataaaaacagaggagatttattatgttaaacagaaacctggcggcagcgcaaaagatg

SEQ ID NO: 64727 - DNA, 103 bp, Artificial Sequence
  Synthetic Polynucleotide
taatacgactcactatagggacatgaatttagaaaccaatccgtaatccaaacagaggagatggattatggattggtttaacctggcggcagcgcaaaagatg

SEQ ID NO: 64728 - DNA, 103 bp, Artificial Sequence
  Synthetic Polynucleotide
taatacgactcactataggggttagacatgaatttagaaaccaatccgtaaacagaggagatacggaatggtttctaaaaacctggcggcagcgcaaaagatg

SEQ ID NO: 64729 - DNA, 103 bp, Artificial Sequence
  Synthetic Polynucleotide
taatacgactcactatagggtcgccgttagacatgaatttagaaaccaataacagaggagaattggtatgtaaattcataacctggcggcagcgcaaaagatg

SEQ ID NO: 64730 - DNA, 103 bp, Artificial Sequence
  Synthetic Polynucleotide
taatacgactcactatagggcatgttcgccgttagacatgaatttagaaaaacagaggagatttctaatgtcatgtctaaacctggcggcagcgcaaaagatg

SEQ ID NO: 64731 - DNA, 103 bp, Artificial Sequence
  Synthetic Polynucleotide
taatacgactcactatagggtggaacatgttcgccgttagacatgaatttaacagaggagaaaattcatgtctaacggcaacctggcggcagcgcaaaagatg

SEQ ID NO: 64732 - DNA, 103 bp, Artificial Sequence
  Synthetic Polynucleotide
taatacgactcactatagggataaatggaacatgttcgccgttagacatgaacagaggagacatgtcatgcggcgaacaaacctggcggcagcgcaaaagatg

SEQ ID NO: 64733 - DNA, 103 bp, Artificial Sequence
  Synthetic Polynucleotide
taatacgactcactatagggttcttataaatggaacatgttcgccgttagaacagaggagactaacgatgaacatgttcaacctggcggcagcgcaaaagatg

SEQ ID NO: 64734 - DNA, 103 bp, Artificial Sequence
  Synthetic Polynucleotide
taatacgactcactatagggtggatttcttataaatggaacatgttcgccaacagaggagaggcgaaatggttccatttaacctggcggcagcgcaaaagatg

SEQ ID NO: 64735 - DNA, 103 bp, Artificial Sequence
  Synthetic Polynucleotide
taatacgactcactatagggttatttggatttcttataaatggaacatgtaacagaggagaacatgtatgatttataagaacctggcggcagcgcaaaagatg

SEQ ID NO: 64736 - DNA, 103 bp, Artificial Sequence
  Synthetic Polynucleotide
taatacgactcactatagggccattttatttggatttcttataaatggaaaacagaggagattccatatgtaagaaatcaacctggcggcagcgcaaaagatg

SEQ ID NO: 64737 - DNA, 103 bp, Artificial Sequence
  Synthetic Polynucleotide
taatacgactcactatagggcaacatcacaccattgatctgtttaaaaaaaacagaggagattttttatgcagatcaataacctggcggcagcgcaaaagatg

SEQ ID NO: 64738 - DNA, 103 bp, Artificial Sequence
  Synthetic Polynucleotide
taatacgactcactatagggattatccattttatttggatttcttataaaaacagaggagatttataatgaatccaaataacctggcggcagcgcaaaagatg

SEQ ID NO: 64739 - DNA, 103 bp, Artificial Sequence
  Synthetic Polynucleotide
taatacgactcactataggggtaccattatccattttatttggatttcttaacagaggagaaagaaaatgaaataaaataacctggcggcagcgcaaaagatg

SEQ ID NO: 64740 - DNA, 103 bp, Artificial Sequence
  Synthetic Polynucleotide
taatacgactcactatagggctagagtaccattatccattttatttggataacagaggagaatccaaatgaaatggataaacctggcggcagcgcaaaagatg

SEQ ID NO: 64741 - DNA, 103 bp, Artificial Sequence
  Synthetic Polynucleotide
taatacgactcactatagggaaattctagagtaccattatccattttattaacagaggagaaataaaatggataatggtaacctggcggcagcgcaaaagatg

SEQ ID NO: 64742 - DNA, 103 bp, Artificial Sequence
  Synthetic Polynucleotide
taatacgactcactatagggggtgtaaattctagagtaccattatccattaacagaggagaaatggaatgtggtactctaacctggcggcagcgcaaaagatg

SEQ ID NO: 64743 - DNA, 103 bp, Artificial Sequence
  Synthetic Polynucleotide
taatacgactcactatagggctataggtgtaaattctagagtaccattataacagaggagaataatgatgctctagaataacctggcggcagcgcaaaagatg

SEQ ID NO: 64744 - DNA, 103 bp, Artificial Sequence
  Synthetic Polynucleotide
taatacgactcactatagggtgaatctataggtgtaaattctagagtaccaacagaggagaggtactatggaatttacaaacctggcggcagcgcaaaagatg

SEQ ID NO: 64745 - DNA, 103 bp, Artificial Sequence
  Synthetic Polynucleotide
taatacgactcactatagggttatgtgaatctataggtgtaaattctagaaacagaggagatctagaatgtacacctataacctggcggcagcgcaaaagatg

SEQ ID NO: 64746 - DNA, 103 bp, Artificial Sequence
  Synthetic Polynucleotide
taatacgactcactatagggatcctttatgtgaatctataggtgtaaattaacagaggagaaatttaatgctatagattaacctggcggcagcgcaaaagatg

SEQ ID NO: 64747 - DNA, 103 bp, Artificial Sequence
  Synthetic Polynucleotide
taatacgactcactatagggaacgtatcctttatgtgaatctataggtgtaacagaggagaacacctatggattcacataacctggcggcagcgcaaaagatg

SEQ ID NO: 64748 - DNA, 103 bp, Artificial Sequence
  Synthetic Polynucleotide
taatacgactcactatagggctaatcaacatcacaccattgatctgtttaaacagaggagataaacaatgcaatggtgtaacctggcggcagcgcaaaagatg

SEQ ID NO: 64749 - DNA, 103 bp, Artificial Sequence
  Synthetic Polynucleotide
taatacgactcactataggggatacaacgtatcctttatgtgaatctataaacagaggagatatagaatgacataaaggaacctggcggcagcgcaaaagatg

SEQ ID NO: 64750 - DNA, 103 bp, Artificial Sequence
  Synthetic Polynucleotide
taatacgactcactataggggtctcgatacaacgtatcctttatgtgaataacagaggagaattcacatgaaggatacgaacctggcggcagcgcaaaagatg

SEQ ID NO: 64751 - DNA, 103 bp, Artificial Sequence
  Synthetic Polynucleotide
taatacgactcactatagggtccacgtctcgatacaacgtatcctttatgaacagaggagacataaaatgtacgttgtaaacctggcggcagcgcaaaagatg

SEQ ID NO: 64752 - DNA, 103 bp, Artificial Sequence
  Synthetic Polynucleotide
taatacgactcactatagggagatctccacgtctcgatacaacgtatcctaacagaggagaaggataatgtgtatcgagaacctggcggcagcgcaaaagatg

SEQ ID NO: 64753 - DNA, 103 bp, Artificial Sequence
  Synthetic Polynucleotide
taatacgactcactatagggtttctagatctccacgtctcgatacaacgtaacagaggagaacgttgatgcgagacgtgaacctggcggcagcgcaaaagatg

SEQ ID NO: 64754 - DNA, 103 bp, Artificial Sequence
  Synthetic Polynucleotide
taatacgactcactatagggaagtgtttctagatctccacgtctcgatacaacagaggagagtatcgatgcgtggagataacctggcggcagcgcaaaagatg

SEQ ID NO: 64755 - DNA, 103 bp, Artificial Sequence
  Synthetic Polynucleotide
taatacgactcactatagggtatccaagtgtttctagatctccacgtctcaacagaggagagagacgatgagatctagaaacctggcggcagcgcaaaagatg

SEQ ID NO: 64756 - DNA, 103 bp, Artificial Sequence
  Synthetic Polynucleotide
taatacgactcactatagggtacaatatccaagtgtttctagatctccacaacagaggagagtggagatgtagaaacacaacctggcggcagcgcaaaagatg

SEQ ID NO: 64757 - DNA, 103 bp, Artificial Sequence
  Synthetic Polynucleotide
taatacgactcactatagggaatcatacaatatccaagtgtttctagatcaacagaggagagatctaatgacacttggaaacctggcggcagcgcaaaagatg

SEQ ID NO: 64758 - DNA, 103 bp, Artificial Sequence
  Synthetic Polynucleotide
taatacgactcactatagggcatctaatcatacaatatccaagtgtttctaacagaggagaagaaacatgtggatattgaacctggcggcagcgcaaaagatg

SEQ ID NO: 64759 - DNA, 103 bp, Artificial Sequence
  Synthetic Polynucleotide
taatacgactcactatagggaagacctaatcaacatcacaccattgatctaacagaggagaagatcaatggtgtgatgtaacctggcggcagcgcaaaagatg

SEQ ID NO: 64760 - DNA, 103 bp, Artificial Sequence
  Synthetic Polynucleotide
taatacgactcactatagggccaaccatctaatcatacaatatccaagtgaacagaggagacacttgatgattgtatgaaacctggcggcagcgcaaaagatg

SEQ ID NO: 64761 - DNA, 103 bp, Artificial Sequence
  Synthetic Polynucleotide
taatacgactcactatagggacctcccaaccatctaatcatacaatatccaacagaggagaggatatatgatgattagaaacctggcggcagcgcaaaagatg

SEQ ID NO: 64762 - DNA, 103 bp, Artificial Sequence
  Synthetic Polynucleotide
taatacgactcactatagggaagatacctcccaaccatctaatcatacaaaacagaggagattgtatatgtagatggttaacctggcggcagcgcaaaagatg

SEQ ID NO: 64763 - DNA, 103 bp, Artificial Sequence
  Synthetic Polynucleotide
taatacgactcactatagggatggcaagatacctcccaaccatctaatcaaacagaggagatgattaatgggttgggagaacctggcggcagcgcaaaagatg

SEQ ID NO: 64764 - DNA, 103 bp, Artificial Sequence
  Synthetic Polynucleotide
taatacgactcactatagggagtccatggcaagatacctcccaaccatctaacagaggagaagatggatgggaggtatcaacctggcggcagcgcaaaagatg

SEQ ID NO: 64765 - DNA, 103 bp, Artificial Sequence
  Synthetic Polynucleotide
taatacgactcactatagggatcttagtccatggcaagatacctcccaacaacagaggagagttgggatgtatcttgccaacctggcggcagcgcaaaagatg

SEQ ID NO: 64766 - DNA, 103 bp, Artificial Sequence
  Synthetic Polynucleotide
taatacgactcactatagggcagctatcttagtccatggcaagatacctcaacagaggagagaggtaatgtgccatggaaacctggcggcagcgcaaaagatg

SEQ ID NO: 64767 - DNA, 103 bp, Artificial Sequence
  Synthetic Polynucleotide
taatacgactcactatagggtgtttcagctatcttagtccatggcaagataacagaggagaatcttgatgtggactaagaacctggcggcagcgcaaaagatg

SEQ ID NO: 64768 - DNA, 103 bp, Artificial Sequence
  Synthetic Polynucleotide
taatacgactcactatagggttctttgtttcagctatcttagtccatggcaacagaggagagccatgatgtaagatagcaacctggcggcagcgcaaaagatg

SEQ ID NO: 64769 - DNA, 103 bp, Artificial Sequence
  Synthetic Polynucleotide
taatacgactcactatagggcgcaattctttgtttcagctatcttagtccaacagaggagaggactaatgtagctgaaaaacctggcggcagcgcaaaagatg

SEQ ID NO: 64770 - DNA, 103 bp, Artificial Sequence
  Synthetic Polynucleotide
taatacgactcactatagggcgtaaaagacctaatcaacatcacaccattaacagaggagaaatggtatgatgttgattaacctggcggcagcgcaaaagatg

SEQ ID NO: 64771 - DNA, 103 bp, Artificial Sequence
  Synthetic Polynucleotide
taatacgactcactatagggtaatgcgcaattctttgtttcagctatcttaacagaggagaaagataatggaaacaaagaacctggcggcagcgcaaaagatg

SEQ ID NO: 64772 - DNA, 103 bp, Artificial Sequence
  Synthetic Polynucleotide
taatacgactcactatagggcttactaatgcgcaattctttgtttcagctaacagaggagaagctgaatgaaagaattgaacctggcggcagcgcaaaagatg

SEQ ID NO: 64773 - DNA, 103 bp, Artificial Sequence
  Synthetic Polynucleotide
taatacgactcactatagggtagcacttactaatgcgcaattctttgtttaacagaggagaaaacaaatgattgcgcataacctggcggcagcgcaaaagatg

SEQ ID NO: 64774 - DNA, 103 bp, Artificial Sequence
  Synthetic Polynucleotide
taatacgactcactatagggttttgtagcacttactaatgcgcaattcttaacagaggagaaagaatatggcattagtaaacctggcggcagcgcaaaagatg

SEQ ID NO: 64775 - DNA, 103 bp, Artificial Sequence
  Synthetic Polynucleotide
taatacgactcactatagggttctgttttgtagcacttactaatgcgcaaaacagaggagattgcgcatgagtaagtgcaacctggcggcagcgcaaaagatg

SEQ ID NO: 64776 - DNA, 103 bp, Artificial Sequence
  Synthetic Polynucleotide
taatacgactcactatagggcatatttctgttttgtagcacttactaatgaacagaggagacattagatggtgctacaaaacctggcggcagcgcaaaagatg

SEQ ID NO: 64777 - DNA, 103 bp, Artificial Sequence
  Synthetic Polynucleotide
taatacgactcactataggggttcacatatttctgttttgtagcacttacaacagaggagagtaagtatgacaaaacagaacctggcggcagcgcaaaagatg

SEQ ID NO: 64778 - DNA, 103 bp, Artificial Sequence
  Synthetic Polynucleotide
taatacgactcactataggggtattgttcacatatttctgttttgtagcaaacagaggagatgctacatgacagaaataaacctggcggcagcgcaaaagatg

SEQ ID NO: 64779 - DNA, 103 bp, Artificial Sequence
  Synthetic Polynucleotide
taatacgactcactatagggtcgtagtattgttcacatatttctgttttgaacagaggagacaaaacatgaatatgtgaaacctggcggcagcgcaaaagatg

SEQ ID NO: 64780 - DNA, 103 bp, Artificial Sequence
  Synthetic Polynucleotide
taatacgactcactatagggcaaagtcgtagtattgttcacatatttctgaacagaggagacagaaaatggtgaacaataacctggcggcagcgcaaaagatg

SEQ ID NO: 64781 - DNA, 103 bp, Artificial Sequence
  Synthetic Polynucleotide
taatacgactcactatagggaaattcgtaaaagacctaatcaacatcacaaacagaggagatgtgatatggattaggtcaacctggcggcagcgcaaaagatg

SEQ ID NO: 64782 - DNA, 103 bp, Artificial Sequence
  Synthetic Polynucleotide
taatacgactcactatagggattaacaaagtcgtagtattgttcacatataacagaggagaatatgtatgcaatactacaacctggcggcagcgcaaaagatg

SEQ ID NO: 64783 - DNA, 103 bp, Artificial Sequence
  Synthetic Polynucleotide
taatacgactcactatagggtggtcattaacaaagtcgtagtattgttcaaacagaggagatgaacaatgctacgacttaacctggcggcagcgcaaaagatg

SEQ ID NO: 64784 - DNA, 103 bp, Artificial Sequence
  Synthetic Polynucleotide
taatacgactcactatagggcaaactggtcattaacaaagtcgtagtattaacagaggagaaatactatgactttgttaaacctggcggcagcgcaaaagatg

SEQ ID NO: 64785 - DNA, 103 bp, Artificial Sequence
  Synthetic Polynucleotide
taatacgactcactatagggtattgcaaactggtcattaacaaagtcgtaaacagaggagatacgacatggttaatgacaacctggcggcagcgcaaaagatg

SEQ ID NO: 64786 - DNA, 103 bp, Artificial Sequence
  Synthetic Polynucleotide
taatacgactcactataggggcgcatattgcaaactggtcattaacaaagaacagaggagactttgtatgtgaccagttaacctggcggcagcgcaaaagatg

SEQ ID NO: 64787 - DNA, 103 bp, Artificial Sequence
  Synthetic Polynucleotide
taatacgactcactatagggtctaggcgcatattgcaaactggtcattaaaacagaggagattaatgatgagtttgcaaaacctggcggcagcgcaaaagatg

SEQ ID NO: 64788 - DNA, 103 bp, Artificial Sequence
  Synthetic Polynucleotide
taatacgactcactatagggaattctctaggcgcatattgcaaactggtcaacagaggagagaccagatggcaatatgcaacctggcggcagcgcaaaagatg

SEQ ID NO: 64789 - DNA, 103 bp, Artificial Sequence
  Synthetic Polynucleotide
taatacgactcactataggggcagcaattctctaggcgcatattgcaaacaacagaggagagtttgcatgatgcgcctaaacctggcggcagcgcaaaagatg

SEQ ID NO: 64790 - DNA, 103 bp, Artificial Sequence
  Synthetic Polynucleotide
taatacgactcactatagggatattgcagcaattctctaggcgcatattgaacagaggagacaatatatgcctagagaaaacctggcggcagcgcaaaagatg

SEQ ID NO: 64791 - DNA, 103 bp, Artificial Sequence
  Synthetic Polynucleotide
taatacgactcactataggggtaatatattgcagcaattctctaggcgcaaacagaggagatgcgccatgagaattgctaacctggcggcagcgcaaaagatg

SEQ ID NO: 64792 - DNA, 103 bp, Artificial Sequence
  Synthetic Polynucleotide
taatacgactcactatagggtattactcagatcatctgttaaagctgttaaacagaggagataacagatgtaacagatgaacctggcggcagcgcaaaagatg

SEQ ID NO: 64793 - DNA, 103 bp, Artificial Sequence
  Synthetic Polynucleotide
taatacgactcactatagggatatcaaattcgtaaaagacctaatcaacaaacagaggagatgttgaatgggtcttttaaacctggcggcagcgcaaaagatg

SEQ ID NO: 64794 - DNA, 103 bp, Artificial Sequence
  Synthetic Polynucleotide
taatacgactcactatagggccatggtaatatattgcagcaattctctagaacagaggagactagagatgtgctgcaataacctggcggcagcgcaaaagatg

SEQ ID NO: 64795 - DNA, 103 bp, Artificial Sequence
  Synthetic Polynucleotide
taatacgactcactataggggtttaccatggtaatatattgcagcaattcaacagaggagagaattgatgcaatatattaacctggcggcagcgcaaaagatg

SEQ ID NO: 64796 - DNA, 103 bp, Artificial Sequence
  Synthetic Polynucleotide
taatacgactcactatagggaaagagtttaccatggtaatatattgcagcaacagaggagagctgcaatgtattaccataacctggcggcagcgcaaaagatg

SEQ ID NO: 64797 - DNA, 103 bp, Artificial Sequence
  Synthetic Polynucleotide
taatacgactcactatagggatgtcaaagagtttaccatggtaatatattaacagaggagaaatataatgccatggtaaaacctggcggcagcgcaaaagatg

SEQ ID NO: 64798 - DNA, 103 bp, Artificial Sequence
  Synthetic Polynucleotide
taatacgactcactatagggaaaatatgtcaaagagtttaccatggtaataacagaggagaattaccatggtaaactctaacctggcggcagcgcaaaagatg

SEQ ID NO: 64799 - DNA, 103 bp, Artificial Sequence
  Synthetic Polynucleotide
taatacgactcactatagggtcctcaaaatatgtcaaagagtttaccatgaacagaggagacatggtatgctctttgacaacctggcggcagcgcaaaagatg

SEQ ID NO: 64800 - DNA, 103 bp, Artificial Sequence
  Synthetic Polynucleotide
taatacgactcactatagggtgggttcctcaaaatatgtcaaagagtttaaacagaggagataaactatgtgacatattaacctggcggcagcgcaaaagatg

SEQ ID NO: 64801 - DNA, 103 bp, Artificial Sequence
  Synthetic Polynucleotide
taatacgactcactataggggtaattgggttcctcaaaatatgtcaaagaaacagaggagatctttgatgtattttgagaacctggcggcagcgcaaaagatg

SEQ ID NO: 64802 - DNA, 103 bp, Artificial Sequence
  Synthetic Polynucleotide
taatacgactcactatagggttatcgtaattgggttcctcaaaatatgtcaacagaggagagacataatgtgaggaaccaacctggcggcagcgcaaaagatg

SEQ ID NO: 64803 - DNA, 103 bp, Artificial Sequence
  Synthetic Polynucleotide
taatacgactcactataggggaaacttatcgtaattgggttcctcaaaataacagaggagaattttgatgaacccaattaacctggcggcagcgcaaaagatg

SEQ ID NO: 64804 - DNA, 103 bp, Artificial Sequence
  Synthetic Polynucleotide
taatacgactcactatagggattttatatcaaattcgtaaaagacctaataacagaggagaattaggatgtttacgaataacctggcggcagcgcaaaagatg

SEQ ID NO: 64805 - DNA, 103 bp, Artificial Sequence
  Synthetic Polynucleotide
taatacgactcactataggggtgccgaaacttatcgtaattgggttcctcaacagaggagagaggaaatgaattacgataacctggcggcagcgcaaaagatg

SEQ ID NO: 64806 - DNA, 103 bp, Artificial Sequence
  Synthetic Polynucleotide
taatacgactcactatagggaatatgtgccgaaacttatcgtaattgggtaacagaggagaacccaaatgcgataagttaacctggcggcagcgcaaaagatg

SEQ ID NO: 64807 - DNA, 103 bp, Artificial Sequence
  Synthetic Polynucleotide
taatacgactcactataggggcattaatatgtgccgaaacttatcgtaataacagaggagaattacgatgagtttcggcaacctggcggcagcgcaaaagatg

SEQ ID NO: 64808 - DNA, 103 bp, Artificial Sequence
  Synthetic Polynucleotide
taatacgactcactatagggaccctgcattaatatgtgccgaaacttatcaacagaggagagataagatgcggcacataaacctggcggcagcgcaaaagatg

SEQ ID NO: 64809 - DNA, 103 bp, Artificial Sequence
  Synthetic Polynucleotide
taatacgactcactatagggtatgcaccctgcattaatatgtgccgaaacaacagaggagagtttcgatgcatattaataacctggcggcagcgcaaaagatg

SEQ ID NO: 64810 - DNA, 103 bp, Artificial Sequence
  Synthetic Polynucleotide
taatacgactcactatagggaataatatgcaccctgcattaatatgtgccaacagaggagaggcacaatgtaatgcaggaacctggcggcagcgcaaaagatg

SEQ ID NO: 64811 - DNA, 103 bp, Artificial Sequence
  Synthetic Polynucleotide
taatacgactcactatagggcacttaataatatgcaccctgcattaatataacagaggagaatattaatgcagggtgcaaacctggcggcagcgcaaaagatg

SEQ ID NO: 64812 - DNA, 103 bp, Artificial Sequence
  Synthetic Polynucleotide
taatacgactcactatagggcctcacacttaataatatgcaccctgcattaacagaggagaaatgcaatgtgcatattaaacctggcggcagcgcaaaagatg

SEQ ID NO: 64813 - DNA, 103 bp, Artificial Sequence
  Synthetic Polynucleotide
taatacgactcactatagggcaaaacctcacacttaataatatgcaccctaacagaggagaagggtgatgattattaagaacctggcggcagcgcaaaagatg

SEQ ID NO: 64814 - DNA, 103 bp, Artificial Sequence
  Synthetic Polynucleotide
taatacgactcactatagggcaaaccaaaacctcacacttaataatatgcaacagaggagagcatatatgtaagtgtgaaacctggcggcagcgcaaaagatg

SEQ ID NO: 64815 - DNA, 103 bp, Artificial Sequence
  Synthetic Polynucleotide
taatacgactcactatagggacgctattttatatcaaattcgtaaaagacaacagaggagagtctttatggaatttgataacctggcggcagcgcaaaagatg

SEQ ID NO: 64816 - DNA, 103 bp, Artificial Sequence
  Synthetic Polynucleotide
taatacgactcactatagggtacatcaaaccaaaacctcacacttaataaaacagaggagattattaatggtgaggtttaacctggcggcagcgcaaaagatg

SEQ ID NO: 64817 - DNA, 103 bp, Artificial Sequence
  Synthetic Polynucleotide
taatacgactcactatagggaattttacatcaaaccaaaacctcacacttaacagaggagaaagtgtatggttttggttaacctggcggcagcgcaaaagatg

SEQ ID NO: 64818 - DNA, 103 bp, Artificial Sequence
  Synthetic Polynucleotide
taatacgactcactatagggacaaaaattttacatcaaaccaaaacctcaaacagaggagatgaggtatgggtttgatgaacctggcggcagcgcaaaagatg

SEQ ID NO: 64819 - DNA, 103 bp, Artificial Sequence
  Synthetic Polynucleotide
taatacgactcactatagggtatcaacaaaaattttacatcaaaccaaaaaacagaggagattttggatggatgtaaaaaacctggcggcagcgcaaaagatg

SEQ ID NO: 64820 - DNA, 103 bp, Artificial Sequence
  Synthetic Polynucleotide
taatacgactcactatagggatttttatcaacaaaaattttacatcaaacaacagaggagagtttgaatgaaaatttttaacctggcggcagcgcaaaagatg

SEQ ID NO: 64821 - DNA, 103 bp, Artificial Sequence
  Synthetic Polynucleotide
taatacgactcactatagggttttaatttttatcaacaaaaattttacataacagaggagaatgtaaatgttttgttgaaacctggcggcagcgcaaaagatg

SEQ ID NO: 64822 - DNA, 103 bp, Artificial Sequence
  Synthetic Polynucleotide
taatacgactcactatagggttattttttaatttttatcaacaaaaatttaacagaggagaaaatttatgttgataaaaaacctggcggcagcgcaaaagatg

SEQ ID NO: 64823 - DNA, 103 bp, Artificial Sequence
  Synthetic Polynucleotide
taatacgactcactatagggttaagttattttttaatttttatcaacaaaaacagaggagatttgttatgaaaaattaaaacctggcggcagcgcaaaagatg

SEQ ID NO: 64824 - DNA, 103 bp, Artificial Sequence
  Synthetic Polynucleotide
taatacgactcactatagggataaattaagttattttttaatttttatcaaacagaggagatgataaatgttaaaaaataacctggcggcagcgcaaaagatg

SEQ ID NO: 64825 - DNA, 103 bp, Artificial Sequence
  Synthetic Polynucleotide
taatacgactcactatagggcaataataaattaagttattttttaattttaacagaggagaaaaattatgaaataacttaacctggcggcagcgcaaaagatg

SEQ ID NO: 64826 - DNA, 103 bp, Artificial Sequence
  Synthetic Polynucleotide
taatacgactcactatagggtgtgaacgctattttatatcaaattcgtaaaacagaggagattacgaatgtgatataaaaacctggcggcagcgcaaaagatg

SEQ ID NO: 64827 - DNA, 103 bp, Artificial Sequence
  Synthetic Polynucleotide
taatacgactcactataggggagatcaataataaattaagttattttttaaacagaggagataaaaaatgacttaatttaacctggcggcagcgcaaaagatg

SEQ ID NO: 64828 - DNA, 103 bp, Artificial Sequence
  Synthetic Polynucleotide
taatacgactcactatagggcacacgagatcaataataaattaagttattaacagaggagaaataacatgatttattataacctggcggcagcgcaaaagatg

SEQ ID NO: 64829 - DNA, 103 bp, Artificial Sequence
  Synthetic Polynucleotide
taatacgactcactatagggttgtacacacgagatcaataataaattaagaacagaggagacttaatatgttattgatcaacctggcggcagcgcaaaagatg

SEQ ID NO: 64830 - DNA, 103 bp, Artificial Sequence
  Synthetic Polynucleotide
taatacgactcactatagggttcggttgtacacacgagatcaataataaaaacagaggagatttattatggatctcgtgaacctggcggcagcgcaaaagatg

SEQ ID NO: 64831 - DNA, 103 bp, Artificial Sequence
  Synthetic Polynucleotide
taatacgactcactatagggatgatttcggttgtacacacgagatcaataaacagaggagatattgaatgcgtgtgtacaacctggcggcagcgcaaaagatg

SEQ ID NO: 64832 - DNA, 103 bp, Artificial Sequence
  Synthetic Polynucleotide
taatacgactcactatagggtcgccatgatttcggttgtacacacgagataacagaggagaatctcgatggtacaaccgaacctggcggcagcgcaaaagatg

SEQ ID NO: 64833 - DNA, 103 bp, Artificial Sequence
  Synthetic Polynucleotide
taatacgactcactatagggaaaaatcgccatgatttcggttgtacacacaacagaggagagtgtgtatgaccgaaatcaacctggcggcagcgcaaaagatg

SEQ ID NO: 64834 - DNA, 103 bp, Artificial Sequence
  Synthetic Polynucleotide
taatacgactcactatagggtgtgtaaaaatcgccatgatttcggttgtaaacagaggagatacaacatgaatcatggcaacctggcggcagcgcaaaagatg

SEQ ID NO: 64835 - DNA, 103 bp, Artificial Sequence
  Synthetic Polynucleotide
taatacgactcactatagggacgtgtgtgtaaaaatcgccatgatttcggaacagaggagaccgaaaatgtggcgatttaacctggcggcagcgcaaaagatg

SEQ ID NO: 64836 - DNA, 103 bp, Artificial Sequence
  Synthetic Polynucleotide
taatacgactcactatagggccaagacgtgtgtgtaaaaatcgccatgataacagaggagaatcatgatgatttttacaaacctggcggcagcgcaaaagatg

SEQ ID NO: 64837 - DNA, 103 bp, Artificial Sequence
  Synthetic Polynucleotide
taatacgactcactatagggggatatgtgaacgctattttatatcaaattaacagaggagaaatttgatgtaaaatagcaacctggcggcagcgcaaaagatg

SEQ ID NO: 64838 - DNA, 103 bp, Artificial Sequence
  Synthetic Polynucleotide
taatacgactcactatagggacccgccaagacgtgtgtgtaaaaatcgccaacagaggagaggcgatatgtacacacacaacctggcggcagcgcaaaagatg

SEQ ID NO: 64839 - DNA, 103 bp, Artificial Sequence
  Synthetic Polynucleotide
taatacgactcactataggggtcgtacccgccaagacgtgtgtgtaaaaaaacagaggagatttttaatgacacgtcttaacctggcggcagcgcaaaagatg

SEQ ID NO: 64840 - DNA, 103 bp, Artificial Sequence
  Synthetic Polynucleotide
taatacgactcactatagggttctcgtcgtacccgccaagacgtgtgtgtaacagaggagaacacacatgtcttggcggaacctggcggcagcgcaaaagatg

SEQ ID NO: 64841 - DNA, 103 bp, Artificial Sequence
  Synthetic Polynucleotide
taatacgactcactatagggaaagattctcgtcgtacccgccaagacgtgaacagaggagacacgtcatggcgggtacgaacctggcggcagcgcaaaagatg

SEQ ID NO: 64842 - DNA, 103 bp, Artificial Sequence
  Synthetic Polynucleotide
taatacgactcactatagggggtataaagattctcgtcgtacccgccaagaacagaggagacttggcatgtacgacgagaacctggcggcagcgcaaaagatg

SEQ ID NO: 64843 - DNA, 103 bp, Artificial Sequence
  Synthetic Polynucleotide
taatacgactcactatagggggaaaggtataaagattctcgtcgtacccgaacagaggagacgggtaatgcgagaatctaacctggcggcagcgcaaaagatg

SEQ ID NO: 64844 - DNA, 103 bp, Artificial Sequence
  Synthetic Polynucleotide
taatacgactcactatagggttccaggaaaggtataaagattctcgtcgtaacagaggagaacgacgatgatctttataaacctggcggcagcgcaaaagatg

SEQ ID NO: 64845 - DNA, 103 bp, Artificial Sequence
  Synthetic Polynucleotide
taatacgactcactatagggtgatattccaggaaaggtataaagattctcaacagaggagagagaatatgtatacctttaacctggcggcagcgcaaaagatg

SEQ ID NO: 64846 - DNA, 103 bp, Artificial Sequence
  Synthetic Polynucleotide
taatacgactcactataggggttaatgatattccaggaaaggtataaagaaacagaggagatctttaatgctttcctggaacctggcggcagcgcaaaagatg

SEQ ID NO: 64847 - DNA, 103 bp, Artificial Sequence
  Synthetic Polynucleotide
taatacgactcactatagggcaacagttaatgatattccaggaaaggtataacagaggagaatacctatgctggaatataacctggcggcagcgcaaaagatg

SEQ ID NO: 64848 - DNA, 103 bp, Artificial Sequence
  Synthetic Polynucleotide
taatacgactcactatagggatggaggatatgtgaacgctattttatatcaacagaggagagatataatgtagcgttcaaacctggcggcagcgcaaaagatg

SEQ ID NO: 64849 - DNA, 103 bp, Artificial Sequence
  Synthetic Polynucleotide
taatacgactcactatagggattggcaacagttaatgatattccaggaaaaacagaggagatttcctatgatatcattaaacctggcggcagcgcaaaagatg

SEQ ID NO: 64850 - DNA, 103 bp, Artificial Sequence
  Synthetic Polynucleotide
taatacgactcactatagggacatcattggcaacagttaatgatattccaaacagaggagatggaatatgattaactgtaacctggcggcagcgcaaaagatg

SEQ ID NO: 64851 - DNA, 103 bp, Artificial Sequence
  Synthetic Polynucleotide
taatacgactcactatagggtcctaacatcattggcaacagttaatgataaacagaggagatatcatatgctgttgccaaacctggcggcagcgcaaaagatg

SEQ ID NO: 64852 - DNA, 103 bp, Artificial Sequence
  Synthetic Polynucleotide
taatacgactcactatagggatatttcctaacatcattggcaacagttaaaacagaggagattaactatggccaatgataacctggcggcagcgcaaaagatg

SEQ ID NO: 64853 - DNA, 103 bp, Artificial Sequence
  Synthetic Polynucleotide
taatacgactcactatagggacagaatatttcctaacatcattggcaacaaacagaggagatgttgcatgtgatgttagaacctggcggcagcgcaaaagatg

SEQ ID NO: 64854 - DNA, 103 bp, Artificial Sequence
  Synthetic Polynucleotide
taatacgactcactatagggacacaacagaatatttcctaacatcattggaacagaggagaccaatgatgttaggaaataacctggcggcagcgcaaaagatg

SEQ ID NO: 64855 - DNA, 103 bp, Artificial Sequence
  Synthetic Polynucleotide
taatacgactcactatagggaactgacacaacagaatatttcctaacatcaacagaggagagatgttatgaaatattctaacctggcggcagcgcaaaagatg

SEQ ID NO: 64856 - DNA, 103 bp, Artificial Sequence
  Synthetic Polynucleotide
taatacgactcactatagggttataaactgacacaacagaatatttcctaaacagaggagataggaaatgttctgttgtaacctggcggcagcgcaaaagatg

SEQ ID NO: 64857 - DNA, 103 bp, Artificial Sequence
  Synthetic Polynucleotide
taatacgactcactatagggtgttattataaactgacacaacagaatattaacagaggagaaatattatgttgtgtcagaacctggcggcagcgcaaaagatg

SEQ ID NO: 64858 - DNA, 103 bp, Artificial Sequence
  Synthetic Polynucleotide
taatacgactcactatagggatacttgttattataaactgacacaacagaaacagaggagatctgttatgtcagtttataacctggcggcagcgcaaaagatg

SEQ ID NO: 64859 - DNA, 103 bp, Artificial Sequence
  Synthetic Polynucleotide
taatacgactcactatagggccattatggaggatatgtgaacgctattttaacagaggagaaaaataatgttcacatataacctggcggcagcgcaaaagatg

SEQ ID NO: 64860 - DNA, 103 bp, Artificial Sequence
  Synthetic Polynucleotide
taatacgactcactatagggatgtcatacttgttattataaactgacacaaacagaggagatgtgtcatgttataataaaacctggcggcagcgcaaaagatg

SEQ ID NO: 64861 - DNA, 103 bp, Artificial Sequence
  Synthetic Polynucleotide
taatacgactcactatagggttacaatgtcatacttgttattataaactgaacagaggagacagtttatgataacaagtaacctggcggcagcgcaaaagatg

SEQ ID NO: 64862 - DNA, 103 bp, Artificial Sequence
  Synthetic Polynucleotide
taatacgactcactatagggttcttttacaatgtcatacttgttattataaacagaggagatataatatgaagtatgacaacctggcggcagcgcaaaagatg

SEQ ID NO: 64863 - DNA, 103 bp, Artificial Sequence
  Synthetic Polynucleotide
taatacgactcactatagggtatatttcttttacaatgtcatacttgttaaacagaggagataacaaatgtgacattgtaacctggcggcagcgcaaaagatg

SEQ ID NO: 64864 - DNA, 103 bp, Artificial Sequence
  Synthetic Polynucleotide
taatacgactcactatagggccacatatatttcttttacaatgtcatactaacagaggagaagtatgatgttgtaaaagaacctggcggcagcgcaaaagatg

SEQ ID NO: 64865 - DNA, 103 bp, Artificial Sequence
  Synthetic Polynucleotide
taatacgactcactatagggtaacaccacatatatttcttttacaatgtcaacagaggagagacattatgaaagaaataaacctggcggcagcgcaaaagatg

SEQ ID NO: 64866 - DNA, 103 bp, Artificial Sequence
  Synthetic Polynucleotide
taatacgactcactatagggaactgtaacaccacatatatttcttttacaaacagaggagatgtaaaatgaatatatgtaacctggcggcagcgcaaaagatg

SEQ ID NO: 64867 - DNA, 103 bp, Artificial Sequence
  Synthetic Polynucleotide
taatacgactcactatagggcacctaactgtaacaccacatatatttcttaacagaggagaaagaaaatgatgtggtgtaacctggcggcagcgcaaaagatg

SEQ ID NO: 64868 - DNA, 103 bp, Artificial Sequence
  Synthetic Polynucleotide
taatacgactcactatagggttgttcacctaactgtaacaccacatatataacagaggagaatatatatggtgttacagaacctggcggcagcgcaaaagatg

SEQ ID NO: 64869 - DNA, 103 bp, Artificial Sequence
  Synthetic Polynucleotide
taatacgactcactatagggatctcttgttcacctaactgtaacaccacaaacagaggagatgtggtatgacagttaggaacctggcggcagcgcaaaagatg

SEQ ID NO: 64870 - DNA, 103 bp, Artificial Sequence
  Synthetic Polynucleotide
taatacgactcactatagggattgaccattatggaggatatgtgaacgctaacagaggagaagcgttatgatatcctccaacctggcggcagcgcaaaagatg

SEQ ID NO: 64871 - DNA, 103 bp, Artificial Sequence
  Synthetic Polynucleotide
taatacgactcactatagggaatatatctcttgttcacctaactgtaacaaacagaggagatgttacatgtaggtgaacaacctggcggcagcgcaaaagatg

SEQ ID NO: 64872 - DNA, 103 bp, Artificial Sequence
  Synthetic Polynucleotide
taatacgactcactataggggctccaatatatctcttgttcacctaactgaacagaggagacagttaatggaacaagagaacctggcggcagcgcaaaagatg

SEQ ID NO: 64873 - DNA, 103 bp, Artificial Sequence
  Synthetic Polynucleotide
taatacgactcactataggggcaatgctccaatatatctcttgttcacctaacagaggagaaggtgaatgagagatataaacctggcggcagcgcaaaagatg

SEQ ID NO: 64874 - DNA, 103 bp, Artificial Sequence
  Synthetic Polynucleotide
taatacgactcactatagggatgcagcaatgctccaatatatctcttgttaacagaggagaaacaagatgtatattggaaacctggcggcagcgcaaaagatg

SEQ ID NO: 64875 - DNA, 103 bp, Artificial Sequence
  Synthetic Polynucleotide
taatacgactcactatagggaacatatgcagcaatgctccaatatatctcaacagaggagagagataatgtggagcattaacctggcggcagcgcaaaagatg

SEQ ID NO: 64876 - DNA, 103 bp, Artificial Sequence
  Synthetic Polynucleotide
taatacgactcactatagggactcaaacatatgcagcaatgctccaatataacagaggagaatattgatgcattgctgcaacctggcggcagcgcaaaagatg

SEQ ID NO: 64877 - DNA, 103 bp, Artificial Sequence
  Synthetic Polynucleotide
taatacgactcactatagggattgcactcaaacatatgcagcaatgctccaacagaggagaggagcaatgctgcatatgaacctggcggcagcgcaaaagatg

SEQ ID NO: 64878 - DNA, 103 bp, Artificial Sequence
  Synthetic Polynucleotide
taatacgactcactatagggtattcattgcactcaaacatatgcagcaataacagaggagaattgctatgtatgtttgaaacctggcggcagcgcaaaagatg

SEQ ID NO: 64879 - DNA, 103 bp, Artificial Sequence
  Synthetic Polynucleotide
taatacgactcactataggggtagatattcattgcactcaaacatatgcaaacagaggagatgcataatgttgagtgcaaacctggcggcagcgcaaaagatg

SEQ ID NO: 64880 - DNA, 103 bp, Artificial Sequence
  Synthetic Polynucleotide
taatacgactcactatagggaatttgtagatattcattgcactcaaacataacagaggagaatgtttatgtgcaatgaaaacctggcggcagcgcaaaagatg

SEQ ID NO: 64881 - DNA, 103 bp, Artificial Sequence
  Synthetic Polynucleotide
taatacgactcactatagggtggcgattgaccattatggaggatatgtgaaacagaggagatcacatatgctccataataacctggcggcagcgcaaaagatg

SEQ ID NO: 64882 - DNA, 103 bp, Artificial Sequence
  Synthetic Polynucleotide
taatacgactcactatagggtctccaatttgtagatattcattgcactcaaacagaggagatgagtgatgtgaatatctaacctggcggcagcgcaaaagatg

SEQ ID NO: 64883 - DNA, 103 bp, Artificial Sequence
  Synthetic Polynucleotide
taatacgactcactatagggttggatctccaatttgtagatattcattgcaacagaggagagcaatgatgatctacaaaaacctggcggcagcgcaaaagatg

SEQ ID NO: 64884 - DNA, 103 bp, Artificial Sequence
  Synthetic Polynucleotide
taatacgactcactatagggatggattggatctccaatttgtagatattcaacagaggagagaatatatgcaaattggaaacctggcggcagcgcaaaagatg

SEQ ID NO: 64885 - DNA, 103 bp, Artificial Sequence
  Synthetic Polynucleotide
taatacgactcactatagggtgatcatggattggatctccaatttgtagaaacagaggagatctacaatgtggagatccaacctggcggcagcgcaaaagatg

SEQ ID NO: 64886 - DNA, 103 bp, Artificial Sequence
  Synthetic Polynucleotide
taatacgactcactatagggcttcttgatcatggattggatctccaatttaacagaggagaaaattgatgatccaatccaacctggcggcagcgcaaaagatg

SEQ ID NO: 64887 - DNA, 103 bp, Artificial Sequence
  Synthetic Polynucleotide
taatacgactcactatagggatttccttcttgatcatggattggatctccaacagaggagaggagatatgatccatgataacctggcggcagcgcaaaagatg

SEQ ID NO: 64888 - DNA, 103 bp, Artificial Sequence
  Synthetic Polynucleotide
taatacgactcactatagggatttgatttccttcttgatcatggattggaaacagaggagatccaatatgtgatcaagaaacctggcggcagcgcaaaagatg

SEQ ID NO: 64889 - DNA, 103 bp, Artificial Sequence
  Synthetic Polynucleotide
taatacgactcactatagggtagagatttgatttccttcttgatcatggaaacagaggagatccatgatgaagaaggaaaacctggcggcagcgcaaaagatg

SEQ ID NO: 64890 - DNA, 103 bp, Artificial Sequence
  Synthetic Polynucleotide
taatacgactcactataggggacgatagagatttgatttccttcttgatcaacagaggagagatcaaatgggaaatcaaaacctggcggcagcgcaaaagatg

SEQ ID NO: 64891 - DNA, 103 bp, Artificial Sequence
  Synthetic Polynucleotide
taatacgactcactatagggtatgtgacgatagagatttgatttccttctaacagaggagaagaaggatgtcaaatctcaacctggcggcagcgcaaaagatg

SEQ ID NO: 64892 - DNA, 103 bp, Artificial Sequence
  Synthetic Polynucleotide
taatacgactcactatagggacaaatggcgattgaccattatggaggataaacagaggagatatcctatgtaatggtcaaacctggcggcagcgcaaaagatg

SEQ ID NO: 64893 - DNA, 103 bp, Artificial Sequence
  Synthetic Polynucleotide
taatacgactcactatagggagcgatatgtgacgatagagatttgatttcaacagaggagagaaatcatgtctctatcgaacctggcggcagcgcaaaagatg

SEQ ID NO: 64894 - DNA, 103 bp, Artificial Sequence
  Synthetic Polynucleotide
taatacgactcactatagggtttgtagcgatatgtgacgatagagatttgaacagaggagacaaatcatgatcgtcacaaacctggcggcagcgcaaaagatg

SEQ ID NO: 64895 - DNA, 103 bp, Artificial Sequence
  Synthetic Polynucleotide
taatacgactcactataggggtagttttgtagcgatatgtgacgatagagaacagaggagactctatatgcacatatcgaacctggcggcagcgcaaaagatg

SEQ ID NO: 64896 - DNA, 103 bp, Artificial Sequence
  Synthetic Polynucleotide
taatacgactcactataggggcatagtagttttgtagcgatatgtgacgaaacagaggagatcgtcaatgatcgctacaaacctggcggcagcgcaaaagatg

SEQ ID NO: 64897 - DNA, 103 bp, Artificial Sequence
  Synthetic Polynucleotide
taatacgactcactatagggttagagcatagtagttttgtagcgatatgtaacagaggagaacatatatgtacaaaactaacctggcggcagcgcaaaagatg

SEQ ID NO: 64898 - DNA, 103 bp, Artificial Sequence
  Synthetic Polynucleotide
taatacgactcactatagggtccgcttagagcatagtagttttgtagcgaaacagaggagatcgctaatgaactactataacctggcggcagcgcaaaagatg

SEQ ID NO: 64899 - DNA, 103 bp, Artificial Sequence
  Synthetic Polynucleotide
taatacgactcactatagggccgattccgcttagagcatagtagttttgtaacagaggagaacaaaaatgctatgctctaacctggcggcagcgcaaaagatg

SEQ ID NO: 64900 - DNA, 103 bp, Artificial Sequence
  Synthetic Polynucleotide
taatacgactcactatagggtgtacccgattccgcttagagcatagtagtaacagaggagaactactatgctctaagcgaacctggcggcagcgcaaaagatg

SEQ ID NO: 64901 - DNA, 103 bp, Artificial Sequence
  Synthetic Polynucleotide
taatacgactcactatagggacttttgtacccgattccgcttagagcataaacagaggagatatgctatgagcggaatcaacctggcggcagcgcaaaagatg

SEQ ID NO: 64902 - DNA, 103 bp, Artificial Sequence
  Synthetic Polynucleotide
taatacgactcactatagggtctagacttttgtacccgattccgcttagaaacagaggagatctaagatgaatcgggtaaacctggcggcagcgcaaaagatg

SEQ ID NO: 64903 - DNA, 103 bp, Artificial Sequence
  Synthetic Polynucleotide
taatacgactcactataggggaggatattactcagatcatctgttaaagcaacagaggagagctttaatggatgatctgaacctggcggcagcgcaaaagatg

SEQ ID NO: 64904 - DNA, 103 bp, Artificial Sequence
  Synthetic Polynucleotide
taatacgactcactatagggtacgaacaaatggcgattgaccattatggaaacagaggagatccataatggtcaatcgcaacctggcggcagcgcaaaagatg

SEQ ID NO: 64905 - DNA, 103 bp, Artificial Sequence
  Synthetic Polynucleotide
taatacgactcactatagggacaagtctagacttttgtacccgattccgcaacagaggagagcggaaatgggtacaaaaaacctggcggcagcgcaaaagatg

SEQ ID NO: 64906 - DNA, 103 bp, Artificial Sequence
  Synthetic Polynucleotide
taatacgactcactatagggcaaacacaagtctagacttttgtacccgataacagaggagaatcgggatgaaaagtctaaacctggcggcagcgcaaaagatg

SEQ ID NO: 64907 - DNA, 103 bp, Artificial Sequence
  Synthetic Polynucleotide
taatacgactcactatagggccttccaaacacaagtctagacttttgtacaacagaggagagtacaaatgtctagacttaacctggcggcagcgcaaaagatg

SEQ ID NO: 64908 - DNA, 103 bp, Artificial Sequence
  Synthetic Polynucleotide
taatacgactcactatagggctactccttccaaacacaagtctagactttaacagaggagaaaagtcatgacttgtgttaacctggcggcagcgcaaaagatg

SEQ ID NO: 64909 - DNA, 103 bp, Artificial Sequence
  Synthetic Polynucleotide
taatacgactcactatagggaatccctactccttccaaacacaagtctagaacagaggagactagacatgtgtttggaaaacctggcggcagcgcaaaagatg

SEQ ID NO: 64910 - DNA, 103 bp, Artificial Sequence
  Synthetic Polynucleotide
taatacgactcactatagggtgatgaatccctactccttccaaacacaagaacagaggagacttgtgatgggaaggagtaacctggcggcagcgcaaaagatg

SEQ ID NO: 64911 - DNA, 103 bp, Artificial Sequence
  Synthetic Polynucleotide
taatacgactcactatagggcgtgatgatgaatccctactccttccaaacaacagaggagagtttggatggagtagggaaacctggcggcagcgcaaaagatg

SEQ ID NO: 64912 - DNA, 103 bp, Artificial Sequence
  Synthetic Polynucleotide
taatacgactcactatagggaagtacgtgatgatgaatccctactccttcaacagaggagagaaggaatggggattcataacctggcggcagcgcaaaagatg

SEQ ID NO: 64913 - DNA, 103 bp, Artificial Sequence
  Synthetic Polynucleotide
taatacgactcactataggggtttcaagtacgtgatgatgaatccctactaacagaggagaagtaggatgtcatcatcaaacctggcggcagcgcaaaagatg

SEQ ID NO: 64914 - DNA, 103 bp, Artificial Sequence
  Synthetic Polynucleotide
taatacgactcactatagggttcctgtttcaagtacgtgatgatgaatccaacagaggagaggattcatgatcacgtacaacctggcggcagcgcaaaagatg

SEQ ID NO: 64915 - DNA, 103 bp, Artificial Sequence
  Synthetic Polynucleotide
taatacgactcactatagggtgacatacgaacaaatggcgattgaccattaacagaggagaaatggtatgtcgccatttaacctggcggcagcgcaaaagatg

SEQ ID NO: 64916 - DNA, 103 bp, Artificial Sequence
  Synthetic Polynucleotide
taatacgactcactatagggagcgtttcctgtttcaagtacgtgatgatgaacagaggagacatcatatggtacttgaaaacctggcggcagcgcaaaagatg

SEQ ID NO: 64917 - DNA, 103 bp, Artificial Sequence
  Synthetic Polynucleotide
taatacgactcactatagggtatacagcgtttcctgtttcaagtacgtgaaacagaggagatcacgtatgtgaaacaggaacctggcggcagcgcaaaagatg

SEQ ID NO: 64918 - DNA, 103 bp, Artificial Sequence
  Synthetic Polynucleotide
taatacgactcactatagggttccatatacagcgtttcctgtttcaagtaaacagaggagatacttgatgcaggaaacgaacctggcggcagcgcaaaagatg

SEQ ID NO: 64919 - DNA, 103 bp, Artificial Sequence
  Synthetic Polynucleotide
taatacgactcactatagggaacttttccatatacagcgtttcctgtttcaacagaggagagaaacaatgaacgctgtaaacctggcggcagcgcaaaagatg

SEQ ID NO: 64920 - DNA, 103 bp, Artificial Sequence
  Synthetic Polynucleotide
taatacgactcactatagggtgttgaacttttccatatacagcgtttcctaacagaggagaaggaaaatgtgtatatggaacctggcggcagcgcaaaagatg

SEQ ID NO: 64921 - DNA, 103 bp, Artificial Sequence
  Synthetic Polynucleotide
taatacgactcactatagggaatcatgttgaacttttccatatacagcgtaacagaggagaacgctgatgatggaaaagaacctggcggcagcgcaaaagatg

SEQ ID NO: 64922 - DNA, 103 bp, Artificial Sequence
  Synthetic Polynucleotide
taatacgactcactatagggagaataatcatgttgaacttttccatatacaacagaggagagtatatatgaaagttcaaaacctggcggcagcgcaaaagatg

SEQ ID NO: 64923 - DNA, 103 bp, Artificial Sequence
  Synthetic Polynucleotide
taatacgactcactatagggatagtagaataatcatgttgaacttttccaaacagaggagatggaaaatgtcaacatgaaacctggcggcagcgcaaaagatg

SEQ ID NO: 64924 - DNA, 103 bp, Artificial Sequence
  Synthetic Polynucleotide
taatacgactcactatagggctttgatagtagaataatcatgttgaacttaacagaggagaaagttcatgatgattattaacctggcggcagcgcaaaagatg

SEQ ID NO: 64925 - DNA, 103 bp, Artificial Sequence
  Synthetic Polynucleotide
taatacgactcactatagggcttctctttgatagtagaataatcatgttgaacagaggagacaacatatgtattctactaacctggcggcagcgcaaaagatg

SEQ ID NO: 64926 - DNA, 103 bp, Artificial Sequence
  Synthetic Polynucleotide
taatacgactcactatagggatttatgacatacgaacaaatggcgattgaaacagaggagatcaatcatgatttgttcgaacctggcggcagcgcaaaagatg

SEQ ID NO: 64927 - DNA, 103 bp, Artificial Sequence
  Synthetic Polynucleotide
taatacgactcactatagggttggccttctctttgatagtagaataatcaaacagaggagatgattaatgtactatcaaaacctggcggcagcgcaaaagatg

SEQ ID NO: 64928 - DNA, 103 bp, Artificial Sequence
  Synthetic Polynucleotide
taatacgactcactatagggtttctttggccttctctttgatagtagaataacagaggagaattctaatgtcaaagagaaacctggcggcagcgcaaaagatg

SEQ ID NO: 64929 - DNA, 103 bp, Artificial Sequence
  Synthetic Polynucleotide
taatacgactcactatagggactcatttctttggccttctctttgatagtaacagaggagaactatcatggagaaggccaacctggcggcagcgcaaaagatg

SEQ ID NO: 64930 - DNA, 103 bp, Artificial Sequence
  Synthetic Polynucleotide
taatacgactcactatagggagtgcactcatttctttggccttctctttgaacagaggagacaaagaatgggccaaagaaacctggcggcagcgcaaaagatg

SEQ ID NO: 64931 - DNA, 103 bp, Artificial Sequence
  Synthetic Polynucleotide
taatacgactcactataggggactaagtgcactcatttctttggccttctaacagaggagaagaaggatgaagaaatgaaacctggcggcagcgcaaaagatg

SEQ ID NO: 64932 - DNA, 103 bp, Artificial Sequence
  Synthetic Polynucleotide
taatacgactcactatagggtcctggactaagtgcactcatttctttggcaacagaggagagccaaaatgatgagtgcaaacctggcggcagcgcaaaagatg

SEQ ID NO: 64933 - DNA, 103 bp, Artificial Sequence
  Synthetic Polynucleotide
taatacgactcactatagggataggtcctggactaagtgcactcatttctaacagaggagaagaaatatgtgcacttagaacctggcggcagcgcaaaagatg

SEQ ID NO: 64934 - DNA, 103 bp, Artificial Sequence
  Synthetic Polynucleotide
taatacgactcactatagggcaattataggtcctggactaagtgcactcaaacagaggagatgagtgatgttagtccagaacctggcggcagcgcaaaagatg

SEQ ID NO: 64935 - DNA, 103 bp, Artificial Sequence
  Synthetic Polynucleotide
taatacgactcactataggggtaatcaattataggtcctggactaagtgcaacagaggagagcacttatgccaggacctaacctggcggcagcgcaaaagatg

SEQ ID NO: 64936 - DNA, 103 bp, Artificial Sequence
  Synthetic Polynucleotide
taatacgactcactatagggacgtggtaatcaattataggtcctggactaaacagaggagatagtccatgacctataataacctggcggcagcgcaaaagatg

SEQ ID NO: 64937 - DNA, 103 bp, Artificial Sequence
  Synthetic Polynucleotide
taatacgactcactatagggaaagaatttatgacatacgaacaaatggcgaacagaggagacgccatatgttcgtatgtaacctggcggcagcgcaaaagatg

SEQ ID NO: 64938 - DNA, 103 bp, Artificial Sequence
  Synthetic Polynucleotide
taatacgactcactatagggtccagacgtggtaatcaattataggtcctgaacagaggagacaggacatgtaattgattaacctggcggcagcgcaaaagatg

SEQ ID NO: 64939 - DNA, 103 bp, Artificial Sequence
  Synthetic Polynucleotide
taatacgactcactatagggtcctatccagacgtggtaatcaattataggaacagaggagacctataatggattaccacaacctggcggcagcgcaaaagatg

SEQ ID NO: 64940 - DNA, 103 bp, Artificial Sequence
  Synthetic Polynucleotide
taatacgactcactatagggcaatctcctatccagacgtggtaatcaattaacagaggagaaattgaatgccacgtctgaacctggcggcagcgcaaaagatg

SEQ ID NO: 64941 - DNA, 103 bp, Artificial Sequence
  Synthetic Polynucleotide
taatacgactcactatagggcaatacaatctcctatccagacgtggtaataacagaggagaattaccatgtctggatagaacctggcggcagcgcaaaagatg

SEQ ID NO: 64942 - DNA, 103 bp, Artificial Sequence
  Synthetic Polynucleotide
taatacgactcactatagggtttaccaatacaatctcctatccagacgtgaacagaggagacacgtcatgataggagataacctggcggcagcgcaaaagatg

SEQ ID NO: 64943 - DNA, 103 bp, Artificial Sequence
  Synthetic Polynucleotide
taatacgactcactataggggtaactttaccaatacaatctcctatccagaacagaggagactggatatgagattgtataacctggcggcagcgcaaaagatg

SEQ ID NO: 64944 - DNA, 103 bp, Artificial Sequence
  Synthetic Polynucleotide
taatacgactcactatagggcagcagtaactttaccaatacaatctcctaaacagaggagataggagatggtattggtaaacctggcggcagcgcaaaagatg

SEQ ID NO: 64945 - DNA, 103 bp, Artificial Sequence
  Synthetic Polynucleotide
taatacgactcactataggggtctacagcagtaactttaccaatacaatcaacagaggagagattgtatgggtaaagttaacctggcggcagcgcaaaagatg

SEQ ID NO: 64946 - DNA, 103 bp, Artificial Sequence
  Synthetic Polynucleotide
taatacgactcactatagggtgtacgtctacagcagtaactttaccaataaacagaggagatattggatgagttactgcaacctggcggcagcgcaaaagatg

SEQ ID NO: 64947 - DNA, 103 bp, Artificial Sequence
  Synthetic Polynucleotide
taatacgactcactatagggttccatgtacgtctacagcagtaactttacaacagaggagagtaaagatgctgctgtagaacctggcggcagcgcaaaagatg

SEQ ID NO: 64948 - DNA, 103 bp, Artificial Sequence
  Synthetic Polynucleotide
taatacgactcactatagggtaattaaagaatttatgacatacgaacaaaaacagaggagatttgttatgatgtcataaaacctggcggcagcgcaaaagatg

SEQ ID NO: 64949 - DNA, 103 bp, Artificial Sequence
  Synthetic Polynucleotide
taatacgactcactatagggttcctttccatgtacgtctacagcagtaacaacagaggagagttactatggtagacgtaaacctggcggcagcgcaaaagatg

SEQ ID NO: 64950 - DNA, 103 bp, Artificial Sequence
  Synthetic Polynucleotide
taatacgactcactatagggataatttcctttccatgtacgtctacagcaaacagaggagatgctgtatgcgtacatggaacctggcggcagcgcaaaagatg

SEQ ID NO: 64951 - DNA, 103 bp, Artificial Sequence
  Synthetic Polynucleotide
taatacgactcactatagggttctcataatttcctttccatgtacgtctaaacagaggagatagacgatgatggaaaggaacctggcggcagcgcaaaagatg

SEQ ID NO: 64952 - DNA, 103 bp, Artificial Sequence
  Synthetic Polynucleotide
taatacgactcactatagggtcacattctcataatttcctttccatgtacaacagaggagagtacatatgaaggaaattaacctggcggcagcgcaaaagatg

SEQ ID NO: 64953 - DNA, 103 bp, Artificial Sequence
  Synthetic Polynucleotide
taatacgactcactatagggttgaatcacattctcataatttcctttccaaacagaggagatggaaaatgaattatgagaacctggcggcagcgcaaaagatg

SEQ ID NO: 64954 - DNA, 103 bp, Artificial Sequence
  Synthetic Polynucleotide
taatacgactcactatagggcctttttgaatcacattctcataatttcctaacagaggagaaggaaaatgtgagaatgtaacctggcggcagcgcaaaagatg

SEQ ID NO: 64955 - DNA, 103 bp, Artificial Sequence
  Synthetic Polynucleotide
taatacgactcactatagggcgcaccctttttgaatcacattctcataataacagaggagaattatgatgatgtgattcaacctggcggcagcgcaaaagatg

SEQ ID NO: 64956 - DNA, 103 bp, Artificial Sequence
  Synthetic Polynucleotide
taatacgactcactatagggagtaccgcaccctttttgaatcacattctcaacagaggagagagaatatgattcaaaaaaacctggcggcagcgcaaaagatg

SEQ ID NO: 64957 - DNA, 103 bp, Artificial Sequence
  Synthetic Polynucleotide
taatacgactcactatagggtctgtagtaccgcaccctttttgaatcacaaacagaggagatgtgatatgaaaagggtgaacctggcggcagcgcaaaagatg

SEQ ID NO: 64958 - DNA, 103 bp, Artificial Sequence
  Synthetic Polynucleotide
taatacgactcactatagggtggtatctgtagtaccgcaccctttttgaaaacagaggagattcaaaatgggtgcggtaaacctggcggcagcgcaaaagatg

SEQ ID NO: 64959 - DNA, 103 bp, Artificial Sequence
  Synthetic Polynucleotide
taatacgactcactatagggccatataattaaagaatttatgacatacgaaacagaggagatcgtatatgataaattctaacctggcggcagcgcaaaagatg

SEQ ID NO: 64960 - DNA, 103 bp, Artificial Sequence
  Synthetic Polynucleotide
taatacgactcactatagggagatttggtatctgtagtaccgcaccctttaacagaggagaaaagggatgggtactacaaacctggcggcagcgcaaaagatg

SEQ ID NO: 64961 - DNA, 103 bp, Artificial Sequence
  Synthetic Polynucleotide
taatacgactcactatagggttaccagatttggtatctgtagtaccgcacaacagaggagagtgcggatgtacagatacaacctggcggcagcgcaaaagatg

SEQ ID NO: 64962 - DNA, 103 bp, Artificial Sequence
  Synthetic Polynucleotide
taatacgactcactatagggaacttttaccagatttggtatctgtagtacaacagaggagagtactaatgataccaaataacctggcggcagcgcaaaagatg

SEQ ID NO: 64963 - DNA, 103 bp, Artificial Sequence
  Synthetic Polynucleotide
taatacgactcactatagggagtttaacttttaccagatttggtatctgtaacagaggagaacagatatgaaatctggtaacctggcggcagcgcaaaagatg

SEQ ID NO: 64964 - DNA, 103 bp, Artificial Sequence
  Synthetic Polynucleotide
taatacgactcactatagggccccaagtttaacttttaccagatttggtaaacagaggagataccaaatgtggtaaaagaacctggcggcagcgcaaaagatg

SEQ ID NO: 64965 - DNA, 103 bp, Artificial Sequence
  Synthetic Polynucleotide
taatacgactcactatagggattatccccaagtttaacttttaccagattaacagaggagaaatctgatgaaagttaaaaacctggcggcagcgcaaaagatg

SEQ ID NO: 64966 - DNA, 103 bp, Artificial Sequence
  Synthetic Polynucleotide
taatacgactcactataggggtatcattatccccaagtttaacttttaccaacagaggagaggtaaaatgtaaacttggaacctggcggcagcgcaaaagatg

SEQ ID NO: 64967 - DNA, 103 bp, Artificial Sequence
  Synthetic Polynucleotide
taatacgactcactatagggtttctgtatcattatccccaagtttaacttaacagaggagaaagttaatgttggggataaacctggcggcagcgcaaaagatg

SEQ ID NO: 64968 - DNA, 103 bp, Artificial Sequence
  Synthetic Polynucleotide
taatacgactcactatagggaagattttctgtatcattatccccaagtttaacagaggagaaaacttatggataatgataacctggcggcagcgcaaaagatg

SEQ ID NO: 64969 - DNA, 103 bp, Artificial Sequence
  Synthetic Polynucleotide
taatacgactcactataggggtggaaagattttctgtatcattatccccaaacagaggagatggggaatgtgatacagaaacctggcggcagcgcaaaagatg

SEQ ID NO: 64970 - DNA, 103 bp, Artificial Sequence
  Synthetic Polynucleotide
taatacgactcactatagggcagtgccatataattaaagaatttatgacaaacagaggagatgtcatatgttctttaataacctggcggcagcgcaaaagatg

SEQ ID NO: 64971 - DNA, 103 bp, Artificial Sequence
  Synthetic Polynucleotide
taatacgactcactatagggtggtagtggaaagattttctgtatcattataacagaggagaataatgatgcagaaaatcaacctggcggcagcgcaaaagatg

SEQ ID NO: 64972 - DNA, 103 bp, Artificial Sequence
  Synthetic Polynucleotide
taatacgactcactatagggtgatatggtagtggaaagattttctgtatcaacagaggagagatacaatgaatctttccaacctggcggcagcgcaaaagatg

SEQ ID NO: 64973 - DNA, 103 bp, Artificial Sequence
  Synthetic Polynucleotide
taatacgactcactatagggagagctgatatggtagtggaaagattttctaacagaggagaagaaaaatgttccactacaacctggcggcagcgcaaaagatg

SEQ ID NO: 64974 - DNA, 103 bp, Artificial Sequence
  Synthetic Polynucleotide
taatacgactcactatagggtcaggagagctgatatggtagtggaaagataacagaggagaatctttatgctaccatataacctggcggcagcgcaaaagatg

SEQ ID NO: 64975 - DNA, 103 bp, Artificial Sequence
  Synthetic Polynucleotide
taatacgactcactatagggggaattcaggagagctgatatggtagtggaaacagaggagatccactatgatatcagctaacctggcggcagcgcaaaagatg

SEQ ID NO: 64976 - DNA, 103 bp, Artificial Sequence
  Synthetic Polynucleotide
taatacgactcactatagggccgccggaattcaggagagctgatatggtaaacagaggagataccatatgagctctcctaacctggcggcagcgcaaaagatg

SEQ ID NO: 64977 - DNA, 103 bp, Artificial Sequence
  Synthetic Polynucleotide
taatacgactcactatagggtaccgccgccggaattcaggagagctgataaacagaggagatatcagatgtcctgaattaacctggcggcagcgcaaaagatg

SEQ ID NO: 64978 - DNA, 103 bp, Artificial Sequence
  Synthetic Polynucleotide
taatacgactcactataggggatggtaccgccgccggaattcaggagagcaacagaggagagctctcatgaattccggcaacctggcggcagcgcaaaagatg

SEQ ID NO: 64979 - DNA, 103 bp, Artificial Sequence
  Synthetic Polynucleotide
taatacgactcactatagggaccttgatggtaccgccgccggaattcaggaacagaggagacctgaaatgcggcggcggaacctggcggcagcgcaaaagatg

SEQ ID NO: 64980 - DNA, 103 bp, Artificial Sequence
  Synthetic Polynucleotide
taatacgactcactatagggaggttaccttgatggtaccgccgccggaataacagaggagaattccgatggcggtaccaaacctggcggcagcgcaaaagatg

SEQ ID NO: 64981 - DNA, 103 bp, Artificial Sequence
  Synthetic Polynucleotide
taatacgactcactatagggatacacagtgccatataattaaagaatttaaacagaggagataaattatgtaattatataacctggcggcagcgcaaaagatg

SEQ ID NO: 64982 - DNA, 103 bp, Artificial Sequence
  Synthetic Polynucleotide
taatacgactcactatagggctaagaggttaccttgatggtaccgccgccaacagaggagaggcggcatgaccatcaagaacctggcggcagcgcaaaagatg

SEQ ID NO: 64983 - DNA, 103 bp, Artificial Sequence
  Synthetic Polynucleotide
taatacgactcactatagggtcttcctaagaggttaccttgatggtaccgaacagaggagacggtacatgcaaggtaacaacctggcggcagcgcaaaagatg

SEQ ID NO: 64984 - DNA, 103 bp, Artificial Sequence
  Synthetic Polynucleotide
taatacgactcactatagggcgcgatcttcctaagaggttaccttgatggaacagaggagaccatcaatgtaacctcttaacctggcggcagcgcaaaagatg

SEQ ID NO: 64985 - DNA, 103 bp, Artificial Sequence
  Synthetic Polynucleotide
taatacgactcactatagggattaacgcgatcttcctaagaggttaccttaacagaggagaaaggtaatgtcttaggaaaacctggcggcagcgcaaaagatg

SEQ ID NO: 64986 - DNA, 103 bp, Artificial Sequence
  Synthetic Polynucleotide
taatacgactcactatagggacatgattaacgcgatcttcctaagaggttaacagaggagaaacctcatgggaagatcgaacctggcggcagcgcaaaagatg

SEQ ID NO: 64987 - DNA, 103 bp, Artificial Sequence
  Synthetic Polynucleotide
taatacgactcactatagggtgagtacatgattaacgcgatcttcctaagaacagaggagacttaggatgatcgcgttaaacctggcggcagcgcaaaagatg

SEQ ID NO: 64988 - DNA, 103 bp, Artificial Sequence
  Synthetic Polynucleotide
taatacgactcactatagggttttatgagtacatgattaacgcgatcttcaacagaggagagaagatatggttaatcataacctggcggcagcgcaaaagatg

SEQ ID NO: 64989 - DNA, 103 bp, Artificial Sequence
  Synthetic Polynucleotide
taatacgactcactatagggaatcgttttatgagtacatgattaacgcgaaacagaggagatcgcgtatgtcatgtactaacctggcggcagcgcaaaagatg

SEQ ID NO: 64990 - DNA, 103 bp, Artificial Sequence
  Synthetic Polynucleotide
taatacgactcactatagggattccaatcgttttatgagtacatgattaaaacagaggagattaatcatgtactcataaaacctggcggcagcgcaaaagatg

SEQ ID NO: 64991 - DNA, 103 bp, Artificial Sequence
  Synthetic Polynucleotide
taatacgactcactatagggtatagattccaatcgttttatgagtacatgaacagaggagacatgtaatgataaaacgaaacctggcggcagcgcaaaagatg

SEQ ID NO: 64992 - DNA, 103 bp, Artificial Sequence
  Synthetic Polynucleotide
taatacgactcactatagggaaataatacacagtgccatataattaaagaaacagaggagatctttaatgatatggcacaacctggcggcagcgcaaaagatg

SEQ ID NO: 64993 - DNA, 103 bp, Artificial Sequence
  Synthetic Polynucleotide
taatacgactcactatagggtggcgtatagattccaatcgttttatgagtaacagaggagaactcatatgacgattggaaacctggcggcagcgcaaaagatg

SEQ ID NO: 64994 - DNA, 103 bp, Artificial Sequence
  Synthetic Polynucleotide
taatacgactcactatagggacatatggcgtatagattccaatcgttttaaacagaggagataaaacatgtggaatctaaacctggcggcagcgcaaaagatg

SEQ ID NO: 64995 - DNA, 103 bp, Artificial Sequence
  Synthetic Polynucleotide
taatacgactcactatagggagaccacatatggcgtatagattccaatcgaacagaggagacgattgatgtctatacgcaacctggcggcagcgcaaaagatg

SEQ ID NO: 64996 - DNA, 103 bp, Artificial Sequence
  Synthetic Polynucleotide
taatacgactcactatagggtagacagaccacatatggcgtatagattccaacagaggagaggaatcatgacgccatataacctggcggcagcgcaaaagatg

SEQ ID NO: 64997 - DNA, 103 bp, Artificial Sequence
  Synthetic Polynucleotide
taatacgactcactataggggatcatagacagaccacatatggcgtatagaacagaggagactatacatgatatgtggtaacctggcggcagcgcaaaagatg

SEQ ID NO: 64998 - DNA, 103 bp, Artificial Sequence
  Synthetic Polynucleotide
taatacgactcactatagggaaaacgatcatagacagaccacatatggcgaacagaggagacgccatatgtggtctgtcaacctggcggcagcgcaaaagatg

SEQ ID NO: 64999 - DNA, 103 bp, Artificial Sequence
  Synthetic Polynucleotide
taatacgactcactatagggatattaaaacgatcatagacagaccacataaacagaggagatatgtgatgtgtctatgaaacctggcggcagcgcaaaagatg

SEQ ID NO: 65000 - DNA, 103 bp, Artificial Sequence
  Synthetic Polynucleotide
taatacgactcactatagggtcacaatattaaaacgatcatagacagaccaacagaggagaggtctgatgatgatcgttaacctggcggcagcgcaaaagatg

SEQ ID NO: 65001 - DNA, 103 bp, Artificial Sequence
  Synthetic Polynucleotide
taatacgactcactatagggaccattcacaatattaaaacgatcatagacaacagaggagagtctatatgcgttttaataacctggcggcagcgcaaaagatg

SEQ ID NO: 65002 - DNA, 103 bp, Artificial Sequence
  Synthetic Polynucleotide
taatacgactcactatagggtctttaccattcacaatattaaaacgatcaaacagaggagatgatcgatgtaatattgtaacctggcggcagcgcaaaagatg

SEQ ID NO: 65003 - DNA, 103 bp, Artificial Sequence
  Synthetic Polynucleotide
taatacgactcactataggggaactaaataatacacagtgccatataattaacagaggagaaattatatggcactgtgtaacctggcggcagcgcaaaagatg

SEQ ID NO: 65004 - DNA, 103 bp, Artificial Sequence
  Synthetic Polynucleotide
taatacgactcactatagggagcattctttaccattcacaatattaaaacaacagaggagagttttaatgttgtgaatgaacctggcggcagcgcaaaagatg

SEQ ID NO: 65005 - DNA, 103 bp, Artificial Sequence
  Synthetic Polynucleotide
taatacgactcactatagggataacagcattctttaccattcacaatattaacagaggagaaatattatgaatggtaaaaacctggcggcagcgcaaaagatg

SEQ ID NO: 65006 - DNA, 103 bp, Artificial Sequence
  Synthetic Polynucleotide
taatacgactcactatagggtgtatataacagcattctttaccattcacaaacagaggagatgtgaaatgtaaagaatgaacctggcggcagcgcaaaagatg

SEQ ID NO: 65007 - DNA, 103 bp, Artificial Sequence
  Synthetic Polynucleotide
taatacgactcactataggggaagatgtatataacagcattctttaccataacagaggagaatggtaatgaatgctgttaacctggcggcagcgcaaaagatg

SEQ ID NO: 65008 - DNA, 103 bp, Artificial Sequence
  Synthetic Polynucleotide
taatacgactcactatagggtgaatgaagatgtatataacagcattctttaacagaggagaaaagaaatgtgttatataaacctggcggcagcgcaaaagatg

SEQ ID NO: 65009 - DNA, 103 bp, Artificial Sequence
  Synthetic Polynucleotide
taatacgactcactatagggttagatgaatgaagatgtatataacagcataacagaggagaatgctgatgtatacatctaacctggcggcagcgcaaaagatg

SEQ ID NO: 65010 - DNA, 103 bp, Artificial Sequence
  Synthetic Polynucleotide
taatacgactcactatagggtctgattagatgaatgaagatgtatataacaacagaggagagttataatgatcttcattaacctggcggcagcgcaaaagatg

SEQ ID NO: 65011 - DNA, 103 bp, Artificial Sequence
  Synthetic Polynucleotide
taatacgactcactatagggaagattctgattagatgaatgaagatgtataacagaggagaatacatatgcattcatctaacctggcggcagcgcaaaagatg

SEQ ID NO: 65012 - DNA, 103 bp, Artificial Sequence
  Synthetic Polynucleotide
taatacgactcactatagggggcataagattctgattagatgaatgaagaaacagaggagatcttcaatgatctaatcaaacctggcggcagcgcaaaagatg

SEQ ID NO: 65013 - DNA, 103 bp, Artificial Sequence
  Synthetic Polynucleotide
taatacgactcactatagggtactaggcataagattctgattagatgaataacagaggagaattcatatgatcagaatcaacctggcggcagcgcaaaagatg

SEQ ID NO: 65014 - DNA, 103 bp, Artificial Sequence
  Synthetic Polynucleotide
taatacgactcactatagggtaatagaggatattactcagatcatctgttaacagaggagaaacagaatgtctgagtaaaacctggcggcagcgcaaaagatg

SEQ ID NO: 65015 - DNA, 103 bp, Artificial Sequence
  Synthetic Polynucleotide
taatacgactcactatagggaggatgaactaaataatacacagtgccataaacagaggagatatggcatggtgtattataacctggcggcagcgcaaaagatg

SEQ ID NO: 65016 - DNA, 103 bp, Artificial Sequence
  Synthetic Polynucleotide
taatacgactcactatagggtacagtactaggcataagattctgattagaaacagaggagatctaatatgaatcttatgaacctggcggcagcgcaaaagatg

SEQ ID NO: 65017 - DNA, 103 bp, Artificial Sequence
  Synthetic Polynucleotide
taatacgactcactataggggtttttacagtactaggcataagattctgaaacagaggagatcagaaatgtatgcctagaacctggcggcagcgcaaaagatg

SEQ ID NO: 65018 - DNA, 103 bp, Artificial Sequence
  Synthetic Polynucleotide
taatacgactcactatagggaattggtttttacagtactaggcataagataacagaggagaatcttaatgctagtactgaacctggcggcagcgcaaaagatg

SEQ ID NO: 65019 - DNA, 103 bp, Artificial Sequence
  Synthetic Polynucleotide
taatacgactcactatagggatacaaattggtttttacagtactaggcataacagaggagaatgcctatgactgtaaaaaacctggcggcagcgcaaaagatg

SEQ ID NO: 65020 - DNA, 103 bp, Artificial Sequence
  Synthetic Polynucleotide
taatacgactcactatagggcacatatacaaattggtttttacagtactaaacagaggagatagtacatgaaaaaccaaaacctggcggcagcgcaaaagatg

SEQ ID NO: 65021 - DNA, 103 bp, Artificial Sequence
  Synthetic Polynucleotide
taatacgactcactatagggtagatcacatatacaaattggtttttacagaacagaggagactgtaaatgccaatttgtaacctggcggcagcgcaaaagatg

SEQ ID NO: 65022 - DNA, 103 bp, Artificial Sequence
  Synthetic Polynucleotide
taatacgactcactatagggtgtcatagatcacatatacaaattggttttaacagaggagaaaaaccatgttgtatatgaacctggcggcagcgcaaaagatg

SEQ ID NO: 65023 - DNA, 103 bp, Artificial Sequence
  Synthetic Polynucleotide
taatacgactcactatagggcatgatgtcatagatcacatatacaaattgaacagaggagacaatttatgtatgtgatcaacctggcggcagcgcaaaagatg

SEQ ID NO: 65024 - DNA, 103 bp, Artificial Sequence
  Synthetic Polynucleotide
taatacgactcactatagggggatgcatgatgtcatagatcacatatacaaacagaggagatgtataatggatctatgaaacctggcggcagcgcaaaagatg

SEQ ID NO: 65025 - DNA, 103 bp, Artificial Sequence
  Synthetic Polynucleotide
taatacgactcactatagggcatttggatgcatgatgtcatagatcacataacagaggagaatgtgaatgatgacatcaaacctggcggcagcgcaaaagatg

SEQ ID NO: 65026 - DNA, 103 bp, Artificial Sequence
  Synthetic Polynucleotide
taatacgactcactataggggaacaaggatgaactaaataatacacagtgaacagaggagacactgtatgttatttagtaacctggcggcagcgcaaaagatg

SEQ ID NO: 65027 - DNA, 103 bp, Artificial Sequence
  Synthetic Polynucleotide
taatacgactcactatagggagatccatttggatgcatgatgtcatagataacagaggagaatctatatgatcatgcataacctggcggcagcgcaaaagatg

SEQ ID NO: 65028 - DNA, 103 bp, Artificial Sequence
  Synthetic Polynucleotide
taatacgactcactatagggttatgagatccatttggatgcatgatgtcaaacagaggagatgacatatggcatccaaaaacctggcggcagcgcaaaagatg

SEQ ID NO: 65029 - DNA, 103 bp, Artificial Sequence
  Synthetic Polynucleotide
taatacgactcactatagggagcagttatgagatccatttggatgcatgaaacagaggagatcatgcatgcaaatggataacctggcggcagcgcaaaagatg

SEQ ID NO: 65030 - DNA, 103 bp, Artificial Sequence
  Synthetic Polynucleotide
taatacgactcactatagggtctagagcagttatgagatccatttggatgaacagaggagacatccaatgggatctcataacctggcggcagcgcaaaagatg

SEQ ID NO: 65031 - DNA, 103 bp, Artificial Sequence
  Synthetic Polynucleotide
taatacgactcactataggggataatctagagcagttatgagatccatttaacagaggagaaaatggatgtcataactgaacctggcggcagcgcaaaagatg

SEQ ID NO: 65032 - DNA, 103 bp, Artificial Sequence
  Synthetic Polynucleotide
taatacgactcactatagggactaagataatctagagcagttatgagatcaacagaggagagatctcatgactgctctaaacctggcggcagcgcaaaagatg

SEQ ID NO: 65033 - DNA, 103 bp, Artificial Sequence
  Synthetic Polynucleotide
taatacgactcactatagggagttcactaagataatctagagcagttatgaacagaggagacataacatgtctagattaaacctggcggcagcgcaaaagatg

SEQ ID NO: 65034 - DNA, 103 bp, Artificial Sequence
  Synthetic Polynucleotide
taatacgactcactatagggccttaagttcactaagataatctagagcagaacagaggagactgctcatgattatcttaaacctggcggcagcgcaaaagatg

SEQ ID NO: 65035 - DNA, 103 bp, Artificial Sequence
  Synthetic Polynucleotide
taatacgactcactatagggtgattccttaagttcactaagataatctagaacagaggagactagatatgcttagtgaaaacctggcggcagcgcaaaagatg

SEQ ID NO: 65036 - DNA, 103 bp, Artificial Sequence
  Synthetic Polynucleotide
taatacgactcactatagggccacttgattccttaagttcactaagataaaacagaggagattatctatgtgaacttaaaacctggcggcagcgcaaaagatg

SEQ ID NO: 65037 - DNA, 103 bp, Artificial Sequence
  Synthetic Polynucleotide
taatacgactcactatagggatgatgaacaaggatgaactaaataatacaaacagaggagatgtattatgtagttcatcaacctggcggcagcgcaaaagatg

SEQ ID NO: 65038 - DNA, 103 bp, Artificial Sequence
  Synthetic Polynucleotide
taatacgactcactatagggtttatccacttgattccttaagttcactaaaacagaggagattagtgatgttaaggaataacctggcggcagcgcaaaagatg

SEQ ID NO: 65039 - DNA, 103 bp, Artificial Sequence
  Synthetic Polynucleotide
taatacgactcactataggggggactttatccacttgattccttaagttcaacagaggagagaacttatggaatcaagtaacctggcggcagcgcaaaagatg

SEQ ID NO: 65040 - DNA, 103 bp, Artificial Sequence
  Synthetic Polynucleotide
taatacgactcactatagggggtttgggactttatccacttgattccttaaacagaggagataaggaatgaagtggataaacctggcggcagcgcaaaagatg

SEQ ID NO: 65041 - DNA, 103 bp, Artificial Sequence
  Synthetic Polynucleotide
taatacgactcactatagggattctggtttgggactttatccacttgattaacagaggagaaatcaaatggataaagtcaacctggcggcagcgcaaaagatg

SEQ ID NO: 65042 - DNA, 103 bp, Artificial Sequence
  Synthetic Polynucleotide
taatacgactcactataggggggcaattctggtttgggactttatccactaacagaggagaagtggaatgagtcccaaaaacctggcggcagcgcaaaagatg

SEQ ID NO: 65043 - DNA, 103 bp, Artificial Sequence
  Synthetic Polynucleotide
taatacgactcactatagggaatttgggcaattctggtttgggactttataacagaggagaataaagatgcaaaccagaaacctggcggcagcgcaaaagatg

SEQ ID NO: 65044 - DNA, 103 bp, Artificial Sequence
  Synthetic Polynucleotide
taatacgactcactatagggaatcgaatttgggcaattctggtttgggacaacagaggagagtcccaatgcagaattgcaacctggcggcagcgcaaaagatg

SEQ ID NO: 65045 - DNA, 103 bp, Artificial Sequence
  Synthetic Polynucleotide
taatacgactcactatagggtgggtaatcgaatttgggcaattctggtttaacagaggagaaaaccaatgttgcccaaaaacctggcggcagcgcaaaagatg

SEQ ID NO: 65046 - DNA, 103 bp, Artificial Sequence
  Synthetic Polynucleotide
taatacgactcactatagggccatctgggtaatcgaatttgggcaattctaacagaggagaagaattatgcaaattcgaaacctggcggcagcgcaaaagatg

SEQ ID NO: 65047 - DNA, 103 bp, Artificial Sequence
  Synthetic Polynucleotide
taatacgactcactataggggcactccatctgggtaatcgaatttgggcaaacagaggagatgcccaatgtcgattaccaacctggcggcagcgcaaaagatg

SEQ ID NO: 65048 - DNA, 103 bp, Artificial Sequence
  Synthetic Polynucleotide
taatacgactcactatagggtcctaatgatgaacaaggatgaactaaataaacagaggagatatttaatgcatccttgtaacctggcggcagcgcaaaagatg

SEQ ID NO: 65049 - DNA, 103 bp, Artificial Sequence
  Synthetic Polynucleotide
taatacgactcactataggggtcttgcactccatctgggtaatcgaatttaacagaggagaaaattcatgtacccagataacctggcggcagcgcaaaagatg

SEQ ID NO: 65050 - DNA, 103 bp, Artificial Sequence
  Synthetic Polynucleotide
taatacgactcactatagggccattgtcttgcactccatctgggtaatcgaacagaggagacgattaatgagatggagtaacctggcggcagcgcaaaagatg

SEQ ID NO: 65051 - DNA, 103 bp, Artificial Sequence
  Synthetic Polynucleotide
taatacgactcactatagggttgatccattgtcttgcactccatctgggtaacagaggagaacccagatggagtgcaagaacctggcggcagcgcaaaagatg

SEQ ID NO: 65052 - DNA, 103 bp, Artificial Sequence
  Synthetic Polynucleotide
taatacgactcactatagggctcaattgatccattgtcttgcactccatcaacagaggagagatggaatgcaagacaataacctggcggcagcgcaaaagatg

SEQ ID NO: 65053 - DNA, 103 bp, Artificial Sequence
  Synthetic Polynucleotide
taatacgactcactatagggaatctctcaattgatccattgtcttgcactaacagaggagaagtgcaatgcaatggatcaacctggcggcagcgcaaaagatg

SEQ ID NO: 65054 - DNA, 103 bp, Artificial Sequence
  Synthetic Polynucleotide
taatacgactcactatagggctgcaaatctctcaattgatccattgtcttaacagaggagaaagacaatggatcaattgaacctggcggcagcgcaaaagatg

SEQ ID NO: 65055 - DNA, 103 bp, Artificial Sequence
  Synthetic Polynucleotide
taatacgactcactatagggctcttctgcaaatctctcaattgatccattaacagaggagaaatggaatgattgagagaaacctggcggcagcgcaaaagatg

SEQ ID NO: 65056 - DNA, 103 bp, Artificial Sequence
  Synthetic Polynucleotide
taatacgactcactatagggaagaactcttctgcaaatctctcaattgataacagaggagaatcaatatggagatttgcaacctggcggcagcgcaaaagatg

SEQ ID NO: 65057 - DNA, 103 bp, Artificial Sequence
  Synthetic Polynucleotide
taatacgactcactatagggtattgaagaactcttctgcaaatctctcaaaacagaggagattgagaatgttgcagaagaacctggcggcagcgcaaaagatg

SEQ ID NO: 65058 - DNA, 103 bp, Artificial Sequence
  Synthetic Polynucleotide
taatacgactcactatagggtgatctattgaagaactcttctgcaaatctaacagaggagaagatttatggaagagttcaacctggcggcagcgcaaaagatg

SEQ ID NO: 65059 - DNA, 103 bp, Artificial Sequence
  Synthetic Polynucleotide
taatacgactcactatagggtagattcctaatgatgaacaaggatgaactaacagaggagaagttcaatgttgttcatcaacctggcggcagcgcaaaagatg

SEQ ID NO: 65060 - DNA, 103 bp, Artificial Sequence
  Synthetic Polynucleotide
taatacgactcactatagggagttctgatctattgaagaactcttctgcaaacagaggagatgcagaatggttcttcaaaacctggcggcagcgcaaaagatg

SEQ ID NO: 65061 - DNA, 103 bp, Artificial Sequence
  Synthetic Polynucleotide
taatacgactcactatagggcctgaagttctgatctattgaagaactcttaacagaggagaaagagtatgtcaatagataacctggcggcagcgcaaaagatg

SEQ ID NO: 65062 - DNA, 103 bp, Artificial Sequence
  Synthetic Polynucleotide
taatacgactcactatagggacccgcctgaagttctgatctattgaagaaaacagaggagattcttcatgagatcagaaaacctggcggcagcgcaaaagatg

SEQ ID NO: 65063 - DNA, 103 bp, Artificial Sequence
  Synthetic Polynucleotide
taatacgactcactataggggattcacccgcctgaagttctgatctattgaacagaggagacaatagatgagaacttcaaacctggcggcagcgcaaaagatg

SEQ ID NO: 65064 - DNA, 103 bp, Artificial Sequence
  Synthetic Polynucleotide
taatacgactcactatagggtgactgattcacccgcctgaagttctgatcaacagaggagagatcagatgttcaggcggaacctggcggcagcgcaaaagatg

SEQ ID NO: 65065 - DNA, 103 bp, Artificial Sequence
  Synthetic Polynucleotide
taatacgactcactataggggaatttgactgattcacccgcctgaagttcaacagaggagagaacttatggcgggtgaaaacctggcggcagcgcaaaagatg

SEQ ID NO: 65066 - DNA, 103 bp, Artificial Sequence
  Synthetic Polynucleotide
taatacgactcactatagggttaccgaatttgactgattcacccgcctgaaacagaggagatcaggcatgtgaatcagtaacctggcggcagcgcaaaagatg

SEQ ID NO: 65067 - DNA, 103 bp, Artificial Sequence
  Synthetic Polynucleotide
taatacgactcactatagggcggaattaccgaatttgactgattcacccgaacagaggagacgggtgatgcagtcaaataacctggcggcagcgcaaaagatg

SEQ ID NO: 65068 - DNA, 103 bp, Artificial Sequence
  Synthetic Polynucleotide
taatacgactcactatagggattaacggaattaccgaatttgactgattcaacagaggagagaatcaatgaaattcggtaacctggcggcagcgcaaaagatg

SEQ ID NO: 65069 - DNA, 103 bp, Artificial Sequence
  Synthetic Polynucleotide
taatacgactcactatagggttaatattaacggaattaccgaatttgactaacagaggagaagtcaaatgcggtaattcaacctggcggcagcgcaaaagatg

SEQ ID NO: 65070 - DNA, 103 bp, Artificial Sequence
  Synthetic Polynucleotide
taatacgactcactatagggttggatagattcctaatgatgaacaaggataacagaggagaatccttatgcatcattagaacctggcggcagcgcaaaagatg

SEQ ID NO: 65071 - DNA, 103 bp, Artificial Sequence
  Synthetic Polynucleotide
taatacgactcactatagggtatttttaatattaacggaattaccgaattaacagaggagaaattcgatgattccgttaaacctggcggcagcgcaaaagatg

SEQ ID NO: 65072 - DNA, 103 bp, Artificial Sequence
  Synthetic Polynucleotide
taatacgactcactatagggagatgtatttttaatattaacggaattaccaacagaggagaggtaatatggttaatattaacctggcggcagcgcaaaagatg

SEQ ID NO: 65073 - DNA, 103 bp, Artificial Sequence
  Synthetic Polynucleotide
taatacgactcactataggggaaacagatgtatttttaatattaacggaaaacagaggagattccgtatgtattaaaaaaacctggcggcagcgcaaaagatg

SEQ ID NO: 65074 - DNA, 103 bp, Artificial Sequence
  Synthetic Polynucleotide
taatacgactcactatagggtagctgaaacagatgtatttttaatattaaaacagaggagattaataatgaaaatacataacctggcggcagcgcaaaagatg

SEQ ID NO: 65075 - DNA, 103 bp, Artificial Sequence
  Synthetic Polynucleotide
taatacgactcactatagggttgcttagctgaaacagatgtatttttaataacagaggagaattaaaatgacatctgttaacctggcggcagcgcaaaagatg

SEQ ID NO: 65076 - DNA, 103 bp, Artificial Sequence
  Synthetic Polynucleotide
taatacgactcactatagggcttagttgcttagctgaaacagatgtatttaacagaggagaaaatacatgtgtttcagcaacctggcggcagcgcaaaagatg

SEQ ID NO: 65077 - DNA, 103 bp, Artificial Sequence
  Synthetic Polynucleotide
taatacgactcactataggggtgttcttagttgcttagctgaaacagatgaacagaggagacatctgatgcagctaagcaacctggcggcagcgcaaaagatg

SEQ ID NO: 65078 - DNA, 103 bp, Artificial Sequence
  Synthetic Polynucleotide
taatacgactcactatagggtatacgtgttcttagttgcttagctgaaacaacagaggagagtttcaatgaagcaactaaacctggcggcagcgcaaaagatg

SEQ ID NO: 65079 - DNA, 103 bp, Artificial Sequence
  Synthetic Polynucleotide
taatacgactcactatagggtgccgtatacgtgttcttagttgcttagctaacagaggagaagctaaatgactaagaacaacctggcggcagcgcaaaagatg

SEQ ID NO: 65080 - DNA, 103 bp, Artificial Sequence
  Synthetic Polynucleotide
taatacgactcactataggggctgttgccgtatacgtgttcttagttgctaacagaggagaagcaacatggaacacgtaaacctggcggcagcgcaaaagatg

SEQ ID NO: 65081 - DNA, 103 bp, Artificial Sequence
  Synthetic Polynucleotide
taatacgactcactatagggccatattggatagattcctaatgatgaacaaacagaggagatgttcaatgttaggaatcaacctggcggcagcgcaaaagatg

SEQ ID NO: 65082 - DNA, 103 bp, Artificial Sequence
  Synthetic Polynucleotide
taatacgactcactataggggggaagctgttgccgtatacgtgttcttagaacagaggagactaagaatgcgtatacggaacctggcggcagcgcaaaagatg

SEQ ID NO: 65083 - DNA, 103 bp, Artificial Sequence
  Synthetic Polynucleotide
taatacgactcactatagggatagagggaagctgttgccgtatacgtgttaacagaggagaaacacgatgacggcaacaaacctggcggcagcgcaaaagatg

SEQ ID NO: 65084 - DNA, 103 bp, Artificial Sequence
  Synthetic Polynucleotide
taatacgactcactatagggagagtatagagggaagctgttgccgtatacaacagaggagagtatacatgaacagcttcaacctggcggcagcgcaaaagatg

SEQ ID NO: 65085 - DNA, 103 bp, Artificial Sequence
  Synthetic Polynucleotide
taatacgactcactatagggagatgagagtatagagggaagctgttgccgaacagaggagacggcaaatgcttccctctaacctggcggcagcgcaaaagatg

SEQ ID NO: 65086 - DNA, 103 bp, Artificial Sequence
  Synthetic Polynucleotide
taatacgactcactataggggcaaaagatgagagtatagagggaagctgtaacagaggagaacagctatgctctatactaacctggcggcagcgcaaaagatg

SEQ ID NO: 65087 - DNA, 103 bp, Artificial Sequence
  Synthetic Polynucleotide
taatacgactcactatagggtgttggcaaaagatgagagtatagagggaaaacagaggagattccctatgtactctcataacctggcggcagcgcaaaagatg

SEQ ID NO: 65088 - DNA, 103 bp, Artificial Sequence
  Synthetic Polynucleotide
taatacgactcactatagggctctgtgttggcaaaagatgagagtatagaaacagaggagatctataatgtcatcttttaacctggcggcagcgcaaaagatg

SEQ ID NO: 65089 - DNA, 103 bp, Artificial Sequence
  Synthetic Polynucleotide
taatacgactcactatagggccaccctctgtgttggcaaaagatgagagtaacagaggagaactctcatgttttgccaaaacctggcggcagcgcaaaagatg

SEQ ID NO: 65090 - DNA, 103 bp, Artificial Sequence
  Synthetic Polynucleotide
taatacgactcactatagggaatatccaccctctgtgttggcaaaagatgaacagaggagacatcttatgccaacacagaacctggcggcagcgcaaaagatg

SEQ ID NO: 65091 - DNA, 103 bp, Artificial Sequence
  Synthetic Polynucleotide
taatacgactcactataggggaacaaatatccaccctctgtgttggcaaaaacagaggagatttgccatgacagagggtaacctggcggcagcgcaaaagatg

SEQ ID NO: 65092 - DNA, 103 bp, Artificial Sequence
  Synthetic Polynucleotide
taatacgactcactatagggaattgccatattggatagattcctaatgataacagaggagaatcattatgaatctatccaacctggcggcagcgcaaaagatg

SEQ ID NO: 65093 - DNA, 103 bp, Artificial Sequence
  Synthetic Polynucleotide
taatacgactcactatagggccaatgaacaaatatccaccctctgtgttgaacagaggagacaacacatggggtggataaacctggcggcagcgcaaaagatg

SEQ ID NO: 65094 - DNA, 103 bp, Artificial Sequence
  Synthetic Polynucleotide
taatacgactcactatagggccaatccaatgaacaaatatccaccctctgaacagaggagacagaggatggatatttgtaacctggcggcagcgcaaaagatg

SEQ ID NO: 65095 - DNA, 103 bp, Artificial Sequence
  Synthetic Polynucleotide
taatacgactcactatagggattatccaatccaatgaacaaatatccaccaacagaggagaggtggaatgttgttcattaacctggcggcagcgcaaaagatg

SEQ ID NO: 65096 - DNA, 103 bp, Artificial Sequence
  Synthetic Polynucleotide
taatacgactcactataggggtattattatccaatccaatgaacaaatataacagaggagaatatttatgcattggattaacctggcggcagcgcaaaagatg

SEQ ID NO: 65097 - DNA, 103 bp, Artificial Sequence
  Synthetic Polynucleotide
taatacgactcactatagggtgtgtgtattattatccaatccaatgaacaaacagaggagatgttcaatggattggataaacctggcggcagcgcaaaagatg

SEQ ID NO: 65098 - DNA, 103 bp, Artificial Sequence
  Synthetic Polynucleotide
taatacgactcactatagggtactttgtgtgtattattatccaatccaataacagaggagaattggaatggataataataacctggcggcagcgcaaaagatg

SEQ ID NO: 65099 - DNA, 103 bp, Artificial Sequence
  Synthetic Polynucleotide
taatacgactcactatagggccaattactttgtgtgtattattatccaataacagaggagaattggaatgtaatacacaaacctggcggcagcgcaaaagatg

SEQ ID NO: 65100 - DNA, 103 bp, Artificial Sequence
  Synthetic Polynucleotide
taatacgactcactatagggtgaatccaattactttgtgtgtattattataacagaggagaataataatgcacacaaagaacctggcggcagcgcaaaagatg

SEQ ID NO: 65101 - DNA, 103 bp, Artificial Sequence
  Synthetic Polynucleotide
taatacgactcactatagggcgccatgaatccaattactttgtgtgtattaacagaggagaaatacaatgaaagtaattaacctggcggcagcgcaaaagatg

SEQ ID NO: 65102 - DNA, 103 bp, Artificial Sequence
  Synthetic Polynucleotide
taatacgactcactatagggtgtcccgccatgaatccaattactttgtgtaacagaggagaacacaaatgaattggattaacctggcggcagcgcaaaagatg

SEQ ID NO: 65103 - DNA, 103 bp, Artificial Sequence
  Synthetic Polynucleotide
taatacgactcactatagggagtataattgccatattggatagattcctaaacagaggagataggaaatgatccaatataacctggcggcagcgcaaaagatg

SEQ ID NO: 65104 - DNA, 103 bp, Artificial Sequence
  Synthetic Polynucleotide
taatacgactcactatagggagtcgtgtcccgccatgaatccaattacttaacagaggagaaagtaaatggattcatggaacctggcggcagcgcaaaagatg

SEQ ID NO: 65105 - DNA, 103 bp, Artificial Sequence
  Synthetic Polynucleotide
taatacgactcactatagggaatgcagtcgtgtcccgccatgaatccaataacagaggagaattggaatgatggcgggaaacctggcggcagcgcaaaagatg

SEQ ID NO: 65106 - DNA, 103 bp, Artificial Sequence
  Synthetic Polynucleotide
taatacgactcactatagggagtttaatgcagtcgtgtcccgccatgaataacagaggagaattcatatggggacacgaaacctggcggcagcgcaaaagatg

SEQ ID NO: 65107 - DNA, 103 bp, Artificial Sequence
  Synthetic Polynucleotide
taatacgactcactatagggctatcagtttaatgcagtcgtgtcccgccaaacagaggagatggcggatgacgactgcaaacctggcggcagcgcaaaagatg

SEQ ID NO: 65108 - DNA, 103 bp, Artificial Sequence
  Synthetic Polynucleotide
taatacgactcactatagggattctctatcagtttaatgcagtcgtgtccaacagaggagaggacacatgtgcattaaaaacctggcggcagcgcaaaagatg

SEQ ID NO: 65109 - DNA, 103 bp, Artificial Sequence
  Synthetic Polynucleotide
taatacgactcactatagggatctcattctctatcagtttaatgcagtcgaacagaggagacgactgatgtaaactgataacctggcggcagcgcaaaagatg

SEQ ID NO: 65110 - DNA, 103 bp, Artificial Sequence
  Synthetic Polynucleotide
taatacgactcactatagggtttctatctcattctctatcagtttaatgcaacagaggagagcattaatgtgatagagaaacctggcggcagcgcaaaagatg

SEQ ID NO: 65111 - DNA, 103 bp, Artificial Sequence
  Synthetic Polynucleotide
taatacgactcactatagggacacttttctatctcattctctatcagtttaacagaggagaaaactgatggagaatgagaacctggcggcagcgcaaaagatg

SEQ ID NO: 65112 - DNA, 103 bp, Artificial Sequence
  Synthetic Polynucleotide
taatacgactcactatagggctaatacacttttctatctcattctctatcaacagaggagagatagaatgtgagatagaaacctggcggcagcgcaaaagatg

SEQ ID NO: 65113 - DNA, 103 bp, Artificial Sequence
  Synthetic Polynucleotide
taatacgactcactataggggtcgtctaatacacttttctatctcattctaacagaggagaagaatgatgtagaaaagtaacctggcggcagcgcaaaagatg

SEQ ID NO: 65114 - DNA, 103 bp, Artificial Sequence
  Synthetic Polynucleotide
taatacgactcactataggggttctagtataattgccatattggatagataacagaggagaatctatatgatatggcaaaacctggcggcagcgcaaaagatg

SEQ ID NO: 65115 - DNA, 103 bp, Artificial Sequence
  Synthetic Polynucleotide
taatacgactcactatagggcatgagtcgtctaatacacttttctatctcaacagaggagagagataatgaagtgtattaacctggcggcagcgcaaaagatg

SEQ ID NO: 65116 - DNA, 103 bp, Artificial Sequence
  Synthetic Polynucleotide
taatacgactcactatagggtacaacatgagtcgtctaatacacttttctaacagaggagaagaaaaatgtattagacgaacctggcggcagcgcaaaagatg

SEQ ID NO: 65117 - DNA, 103 bp, Artificial Sequence
  Synthetic Polynucleotide
taatacgactcactatagggaaatgtacaacatgagtcgtctaatacactaacagaggagaagtgtaatggacgactcaaacctggcggcagcgcaaaagatg

SEQ ID NO: 65118 - DNA, 103 bp, Artificial Sequence
  Synthetic Polynucleotide
taatacgactcactatagggcacagaaatgtacaacatgagtcgtctaataacagaggagaattagaatgctcatgttgaacctggcggcagcgcaaaagatg

SEQ ID NO: 65119 - DNA, 103 bp, Artificial Sequence
  Synthetic Polynucleotide
taatacgactcactatagggtttctcacagaaatgtacaacatgagtcgtaacagaggagaacgactatggttgtacataacctggcggcagcgcaaaagatg

SEQ ID NO: 65120 - DNA, 103 bp, Artificial Sequence
  Synthetic Polynucleotide
taatacgactcactatagggctctttttctcacagaaatgtacaacatgaaacagaggagatcatgtatgacatttctgaacctggcggcagcgcaaaagatg

SEQ ID NO: 65121 - DNA, 103 bp, Artificial Sequence
  Synthetic Polynucleotide
taatacgactcactatagggatatcctctttttctcacagaaatgtacaaaacagaggagattgtacatgtctgtgagaaacctggcggcagcgcaaaagatg

SEQ ID NO: 65122 - DNA, 103 bp, Artificial Sequence
  Synthetic Polynucleotide
taatacgactcactatagggatttgatatcctctttttctcacagaaatgaacagaggagacatttcatggagaaaaagaacctggcggcagcgcaaaagatg

SEQ ID NO: 65123 - DNA, 103 bp, Artificial Sequence
  Synthetic Polynucleotide
taatacgactcactatagggtgcgtatttgatatcctctttttctcacagaacagaggagactgtgaatgaaagaggataacctggcggcagcgcaaaagatg

SEQ ID NO: 65124 - DNA, 103 bp, Artificial Sequence
  Synthetic Polynucleotide
taatacgactcactatagggctatatgcgtatttgatatcctctttttctaacagaggagaagaaaaatgggatatcaaaacctggcggcagcgcaaaagatg

SEQ ID NO: 65125 - DNA, 103 bp, Artificial Sequence
  Synthetic Polynucleotide
taatacgactcactatagggggatgaagatgtgacgtacaaaaaaataaaaacagaggagatttattatgttgtacgtcaacctggcggcagcgcaaaagatg

SEQ ID NO: 65126 - DNA, 103 bp, Artificial Sequence
  Synthetic Polynucleotide
taatacgactcactatagggatgtataatagaggatattactcagatcataacagaggagaatgatcatggtaatatccaacctggcggcagcgcaaaagatg

SEQ ID NO: 65127 - DNA, 103 bp, Artificial Sequence
  Synthetic Polynucleotide
taatacgactcactatagggttatagttctagtataattgccatattggaaacagaggagatccaatatggcaattataaacctggcggcagcgcaaaagatg

SEQ ID NO: 65128 - DNA, 103 bp, Artificial Sequence
  Synthetic Polynucleotide
taatacgactcactatagggtgaatctatatgcgtatttgatatcctcttaacagaggagaaagaggatgtcaaatacgaacctggcggcagcgcaaaagatg

SEQ ID NO: 65129 - DNA, 103 bp, Artificial Sequence
  Synthetic Polynucleotide
taatacgactcactatagggcttgatgaatctatatgcgtatttgatatcaacagaggagagatatcatgtacgcatataacctggcggcagcgcaaaagatg

SEQ ID NO: 65130 - DNA, 103 bp, Artificial Sequence
  Synthetic Polynucleotide
taatacgactcactatagggtataccttgatgaatctatatgcgtatttgaacagaggagacaaataatgatatagattaacctggcggcagcgcaaaagatg

SEQ ID NO: 65131 - DNA, 103 bp, Artificial Sequence
  Synthetic Polynucleotide
taatacgactcactataggggtttatataccttgatgaatctatatgcgtaacagaggagaacgcatatggattcatcaaacctggcggcagcgcaaaagatg

SEQ ID NO: 65132 - DNA, 103 bp, Artificial Sequence
  Synthetic Polynucleotide
taatacgactcactatagggcccaggtttatataccttgatgaatctataaacagaggagatatagaatgatcaaggtaaacctggcggcagcgcaaaagatg

SEQ ID NO: 65133 - DNA, 103 bp, Artificial Sequence
  Synthetic Polynucleotide
taatacgactcactatagggtcctccccaggtttatataccttgatgaataacagaggagaattcatatgggtatataaaacctggcggcagcgcaaaagatg

SEQ ID NO: 65134 - DNA, 103 bp, Artificial Sequence
  Synthetic Polynucleotide
taatacgactcactatagggtagtctcctccccaggtttatataccttgaaacagaggagatcaaggatgataaacctgaacctggcggcagcgcaaaagatg

SEQ ID NO: 65135 - DNA, 103 bp, Artificial Sequence
  Synthetic Polynucleotide
taatacgactcactatagggcgaggtagtctcctccccaggtttatatacaacagaggagagtatatatgcctggggagaacctggcggcagcgcaaaagatg

SEQ ID NO: 65136 - DNA, 103 bp, Artificial Sequence
  Synthetic Polynucleotide
taatacgactcactatagggtatgtcgaggtagtctcctccccaggtttaaacagaggagataaaccatgggaggagacaacctggcggcagcgcaaaagatg

SEQ ID NO: 65137 - DNA, 103 bp, Artificial Sequence
  Synthetic Polynucleotide
taatacgactcactatagggacacgtatgtcgaggtagtctcctccccagaacagaggagactggggatgagactacctaacctggcggcagcgcaaaagatg

SEQ ID NO: 65138 - DNA, 103 bp, Artificial Sequence
  Synthetic Polynucleotide
taatacgactcactatagggcacacttatagttctagtataattgccataaacagaggagatatggcatgtatactagaaacctggcggcagcgcaaaagatg

SEQ ID NO: 65139 - DNA, 103 bp, Artificial Sequence
  Synthetic Polynucleotide
taatacgactcactatagggagcgcacacgtatgtcgaggtagtctcctcaacagaggagagaggagatgacctcgacaaacctggcggcagcgcaaaagatg

SEQ ID NO: 65140 - DNA, 103 bp, Artificial Sequence
  Synthetic Polynucleotide
taatacgactcactatagggttgatagcgcacacgtatgtcgaggtagtcaacagaggagagactacatggacatacgtaacctggcggcagcgcaaaagatg

SEQ ID NO: 65141 - DNA, 103 bp, Artificial Sequence
  Synthetic Polynucleotide
taatacgactcactatagggccactttgatagcgcacacgtatgtcgaggaacagaggagacctcgaatgacgtgtgcgaacctggcggcagcgcaaaagatg

SEQ ID NO: 65142 - DNA, 103 bp, Artificial Sequence
  Synthetic Polynucleotide
taatacgactcactatagggtctttccactttgatagcgcacacgtatgtaacagaggagaacatacatgtgcgctatcaacctggcggcagcgcaaaagatg

SEQ ID NO: 65143 - DNA, 103 bp, Artificial Sequence
  Synthetic Polynucleotide
taatacgactcactatagggcaacatctttccactttgatagcgcacacgaacagaggagacgtgtgatgtatcaaagtaacctggcggcagcgcaaaagatg

SEQ ID NO: 65144 - DNA, 103 bp, Artificial Sequence
  Synthetic Polynucleotide
taatacgactcactatagggcacagcaacatctttccactttgatagcgcaacagaggagagcgctaatgaagtggaaaaacctggcggcagcgcaaaagatg

SEQ ID NO: 65145 - DNA, 103 bp, Artificial Sequence
  Synthetic Polynucleotide
taatacgactcactatagggcacagcacagcaacatctttccactttgataacagaggagaatcaaaatggaaagatgtaacctggcggcagcgcaaaagatg

SEQ ID NO: 65146 - DNA, 103 bp, Artificial Sequence
  Synthetic Polynucleotide
taatacgactcactataggggtaaacacagcacagcaacatctttccactaacagaggagaagtggaatgatgttgctgaacctggcggcagcgcaaaagatg

SEQ ID NO: 65147 - DNA, 103 bp, Artificial Sequence
  Synthetic Polynucleotide
taatacgactcactatagggaatctgtaaacacagcacagcaacatctttaacagaggagaaaagatatggctgtgctgaacctggcggcagcgcaaaagatg

SEQ ID NO: 65148 - DNA, 103 bp, Artificial Sequence
  Synthetic Polynucleotide
taatacgactcactatagggtggccaatctgtaaacacagcacagcaacaaacagaggagatgttgcatggctgtgtttaacctggcggcagcgcaaaagatg

SEQ ID NO: 65149 - DNA, 103 bp, Artificial Sequence
  Synthetic Polynucleotide
taatacgactcactatagggtacaacacacttatagttctagtataattgaacagaggagacaattaatgtagaactataacctggcggcagcgcaaaagatg

SEQ ID NO: 65150 - DNA, 103 bp, Artificial Sequence
  Synthetic Polynucleotide
taatacgactcactataggggattctggccaatctgtaaacacagcacagaacagaggagactgtgcatggtttacagaaacctggcggcagcgcaaaagatg

SEQ ID NO: 65151 - DNA, 103 bp, Artificial Sequence
  Synthetic Polynucleotide
taatacgactcactatagggaccatgattctggccaatctgtaaacacagaacagaggagactgtgtatgcagattggcaacctggcggcagcgcaaaagatg

SEQ ID NO: 65152 - DNA, 103 bp, Artificial Sequence
  Synthetic Polynucleotide
taatacgactcactatagggcatataccatgattctggccaatctgtaaaaacagaggagatttacaatgtggccagaaaacctggcggcagcgcaaaagatg

SEQ ID NO: 65153 - DNA, 103 bp, Artificial Sequence
  Synthetic Polynucleotide
taatacgactcactataggggtatccatataccatgattctggccaatctaacagaggagaagattgatgagaatcatgaacctggcggcagcgcaaaagatg

SEQ ID NO: 65154 - DNA, 103 bp, Artificial Sequence
  Synthetic Polynucleotide
taatacgactcactatagggcactagtatccatataccatgattctggccaacagaggagaggccagatgcatggtataaacctggcggcagcgcaaaagatg

SEQ ID NO: 65155 - DNA, 103 bp, Artificial Sequence
  Synthetic Polynucleotide
taatacgactcactataggggataccactagtatccatataccatgattcaacagaggagagaatcaatgtatatggataacctggcggcagcgcaaaagatg

SEQ ID NO: 65156 - DNA, 103 bp, Artificial Sequence
  Synthetic Polynucleotide
taatacgactcactatagggttcttgataccactagtatccatataccataacagaggagaatggtaatgggatactagaacctggcggcagcgcaaaagatg

SEQ ID NO: 65157 - DNA, 103 bp, Artificial Sequence
  Synthetic Polynucleotide
taatacgactcactatagggaatacttcttgataccactagtatccatataacagaggagaatatggatgctagtggtaaacctggcggcagcgcaaaagatg

SEQ ID NO: 65158 - DNA, 103 bp, Artificial Sequence
  Synthetic Polynucleotide
taatacgactcactatagggtggagaatacttcttgataccactagtatcaacagaggagagatactatgggtatcaagaacctggcggcagcgcaaaagatg

SEQ ID NO: 65159 - DNA, 103 bp, Artificial Sequence
  Synthetic Polynucleotide
taatacgactcactatagggtcatctggagaatacttcttgataccactaaacagaggagatagtggatgcaagaagtaaacctggcggcagcgcaaaagatg

SEQ ID NO: 65160 - DNA, 103 bp, Artificial Sequence
  Synthetic Polynucleotide
taatacgactcactataggggtgtttacaacacacttatagttctagtataacagaggagaatactaatgctataagtgaacctggcggcagcgcaaaagatg

SEQ ID NO: 65161 - DNA, 103 bp, Artificial Sequence
  Synthetic Polynucleotide
taatacgactcactatagggcccattcatctggagaatacttcttgatacaacagaggagagtatcaatgagtattctcaacctggcggcagcgcaaaagatg

SEQ ID NO: 65162 - DNA, 103 bp, Artificial Sequence
  Synthetic Polynucleotide
taatacgactcactatagggtgacacccattcatctggagaatacttcttaacagaggagaaagaagatgtctccagataacctggcggcagcgcaaaagatg

SEQ ID NO: 65163 - DNA, 103 bp, Artificial Sequence
  Synthetic Polynucleotide
taatacgactcactatagggatagatgacacccattcatctggagaatacaacagaggagagtattcatgagatgaatgaacctggcggcagcgcaaaagatg

SEQ ID NO: 65164 - DNA, 103 bp, Artificial Sequence
  Synthetic Polynucleotide
taatacgactcactatagggattttatagatgacacccattcatctggagaacagaggagactccagatgaatgggtgtaacctggcggcagcgcaaaagatg

SEQ ID NO: 65165 - DNA, 103 bp, Artificial Sequence
  Synthetic Polynucleotide
taatacgactcactatagggttaaaattttatagatgacacccattcatcaacagaggagagatgaaatggtgtcatctaacctggcggcagcgcaaaagatg

SEQ ID NO: 65166 - DNA, 103 bp, Artificial Sequence
  Synthetic Polynucleotide
taatacgactcactatagggcttaattaaaattttatagatgacacccataacagaggagaatgggtatgatctataaaaacctggcggcagcgcaaaagatg

SEQ ID NO: 65167 - DNA, 103 bp, Artificial Sequence
  Synthetic Polynucleotide
taatacgactcactatagggtagttcttaattaaaattttatagatgacaaacagaggagatgtcatatgtaaaattttaacctggcggcagcgcaaaagatg

SEQ ID NO: 65168 - DNA, 103 bp, Artificial Sequence
  Synthetic Polynucleotide
taatacgactcactatagggctctatagttcttaattaaaattttatagaaacagaggagatctataatgttttaattaaacctggcggcagcgcaaaagatg

SEQ ID NO: 65169 - DNA, 103 bp, Artificial Sequence
  Synthetic Polynucleotide
taatacgactcactatagggttgttctctatagttcttaattaaaattttaacagaggagaaaaattatgattaagaacaacctggcggcagcgcaaaagatg

SEQ ID NO: 65170 - DNA, 103 bp, Artificial Sequence
  Synthetic Polynucleotide
taatacgactcactatagggattatttgttctctatagttcttaattaaaaacagaggagatttaatatggaactatagaacctggcggcagcgcaaaagatg

SEQ ID NO: 65171 - DNA, 103 bp, Artificial Sequence
  Synthetic Polynucleotide
taatacgactcactatagggaatatgtgtttacaacacacttatagttctaacagaggagaagaactatgagtgtgttgaacctggcggcagcgcaaaagatg

SEQ ID NO: 65172 - DNA, 103 bp, Artificial Sequence
  Synthetic Polynucleotide
taatacgactcactatagggaacctattatttgttctctatagttcttaaaacagaggagattaagaatgatagagaacaacctggcggcagcgcaaaagatg

SEQ ID NO: 65173 - DNA, 103 bp, Artificial Sequence
  Synthetic Polynucleotide
taatacgactcactatagggattacaacctattatttgttctctatagttaacagaggagaaactatatggaacaaataaacctggcggcagcgcaaaagatg

SEQ ID NO: 65174 - DNA, 103 bp, Artificial Sequence
  Synthetic Polynucleotide
taatacgactcactatagggtatgtattacaacctattatttgttctctaaacagaggagatagagaatgaataataggaacctggcggcagcgcaaaagatg

SEQ ID NO: 65175 - DNA, 103 bp, Artificial Sequence
  Synthetic Polynucleotide
taatacgactcactataggggtctatatgtattacaacctattatttgttaacagaggagaaacaaaatgtaggttgtaaacctggcggcagcgcaaaagatg

SEQ ID NO: 65176 - DNA, 103 bp, Artificial Sequence
  Synthetic Polynucleotide
taatacgactcactatagggttattgtctatatgtattacaacctattataacagaggagaataataatgtgtaatacaaacctggcggcagcgcaaaagatg

SEQ ID NO: 65177 - DNA, 103 bp, Artificial Sequence
  Synthetic Polynucleotide
taatacgactcactataggggttagttattgtctatatgtattacaacctaacagaggagaaggttgatgtacatatagaacctggcggcagcgcaaaagatg

SEQ ID NO: 65178 - DNA, 103 bp, Artificial Sequence
  Synthetic Polynucleotide
taatacgactcactatagggtaattgttagttattgtctatatgtattacaacagaggagagtaataatgatagacaataacctggcggcagcgcaaaagatg

SEQ ID NO: 65179 - DNA, 103 bp, Artificial Sequence
  Synthetic Polynucleotide
taatacgactcactatagggctaattaattgttagttattgtctatatgtaacagaggagaacatatatgcaataactaaacctggcggcagcgcaaaagatg

SEQ ID NO: 65180 - DNA, 103 bp, Artificial Sequence
  Synthetic Polynucleotide
taatacgactcactatagggagttactaattaattgttagttattgtctaaacagaggagatagacaatgactaacaataacctggcggcagcgcaaaagatg

SEQ ID NO: 65181 - DNA, 103 bp, Artificial Sequence
  Synthetic Polynucleotide
taatacgactcactatagggataacagttactaattaattgttagttattaacagaggagaaataacatgcaattaattaacctggcggcagcgcaaaagatg

SEQ ID NO: 65182 - DNA, 103 bp, Artificial Sequence
  Synthetic Polynucleotide
taatacgactcactatagggacatcaatatgtgtttacaacacacttataaacagaggagatataagatggttgtaaacaacctggcggcagcgcaaaagatg

SEQ ID NO: 65183 - DNA, 103 bp, Artificial Sequence
  Synthetic Polynucleotide
taatacgactcactatagggaagagataacagttactaattaattgttagaacagaggagactaacaatgaattagtaaaacctggcggcagcgcaaaagatg

SEQ ID NO: 65184 - DNA, 103 bp, Artificial Sequence
  Synthetic Polynucleotide
taatacgactcactatagggttaaaaagagataacagttactaattaattaacagaggagaaattaaatggtaactgttaacctggcggcagcgcaaaagatg

SEQ ID NO: 65185 - DNA, 103 bp, Artificial Sequence
  Synthetic Polynucleotide
taatacgactcactataggggttagttaaaaagagataacagttactaataacagaggagaattagtatgtgttatctcaacctggcggcagcgcaaaagatg

SEQ ID NO: 65186 - DNA, 103 bp, Artificial Sequence
  Synthetic Polynucleotide
taatacgactcactatagggtaagagttagttaaaaagagataacagttaaacagaggagataactgatgtctctttttaacctggcggcagcgcaaaagatg

SEQ ID NO: 65187 - DNA, 103 bp, Artificial Sequence
  Synthetic Polynucleotide
taatacgactcactataggggtatataagagttagttaaaaagagataacaacagaggagagttatcatgttttaactaaacctggcggcagcgcaaaagatg

SEQ ID NO: 65188 - DNA, 103 bp, Artificial Sequence
  Synthetic Polynucleotide
taatacgactcactatagggaataggtatataagagttagttaaaaagagaacagaggagactctttatgactaactctaacctggcggcagcgcaaaagatg

SEQ ID NO: 65189 - DNA, 103 bp, Artificial Sequence
  Synthetic Polynucleotide
taatacgactcactataggggtattaataggtatataagagttagttaaaaacagaggagatttaacatgctcttatataacctggcggcagcgcaaaagatg

SEQ ID NO: 65190 - DNA, 103 bp, Artificial Sequence
  Synthetic Polynucleotide
taatacgactcactatagggacgatgtattaataggtatataagagttagaacagaggagactaactatgatatacctaaacctggcggcagcgcaaaagatg

SEQ ID NO: 65191 - DNA, 103 bp, Artificial Sequence
  Synthetic Polynucleotide
taatacgactcactatagggataatacgatgtattaataggtatataagaaacagaggagatcttatatgcctattaataacctggcggcagcgcaaaagatg

SEQ ID NO: 65192 - DNA, 103 bp, Artificial Sequence
  Synthetic Polynucleotide
taatacgactcactataggggaactataatacgatgtattaataggtataaacagaggagatataccatgtaatacatcaacctggcggcagcgcaaaagatg

SEQ ID NO: 65193 - DNA, 103 bp, Artificial Sequence
  Synthetic Polynucleotide
taatacgactcactatagggcagacacatcaatatgtgtttacaacacacaacagaggagagtgtgtatgaaacacataaacctggcggcagcgcaaaagatg

SEQ ID NO: 65194 - DNA, 103 bp, Artificial Sequence
  Synthetic Polynucleotide
taatacgactcactatagggattaagaactataatacgatgtattaatagaacagaggagactattaatgcatcgtattaacctggcggcagcgcaaaagatg

SEQ ID NO: 65195 - DNA, 103 bp, Artificial Sequence
  Synthetic Polynucleotide
taatacgactcactatagggcaatgattaagaactataatacgatgtattaacagaggagaaatacaatgtattatagtaacctggcggcagcgcaaaagatg

SEQ ID NO: 65196 - DNA, 103 bp, Artificial Sequence
  Synthetic Polynucleotide
taatacgactcactatagggtgaatcaatgattaagaactataatacgataacagaggagaatcgtaatgtagttcttaaacctggcggcagcgcaaaagatg

SEQ ID NO: 65197 - DNA, 103 bp, Artificial Sequence
  Synthetic Polynucleotide
taatacgactcactatagggataagtgaatcaatgattaagaactataataacagaggagaattataatgcttaatcataacctggcggcagcgcaaaagatg

SEQ ID NO: 65198 - DNA, 103 bp, Artificial Sequence
  Synthetic Polynucleotide
taatacgactcactatagggaaacaataagtgaatcaatgattaagaactaacagaggagaagttctatgtcattgattaacctggcggcagcgcaaaagatg

SEQ ID NO: 65199 - DNA, 103 bp, Artificial Sequence
  Synthetic Polynucleotide
taatacgactcactatagggtattaaaacaataagtgaatcaatgattaaaacagaggagattaatcatggattcacttaacctggcggcagcgcaaaagatg

SEQ ID NO: 65200 - DNA, 103 bp, Artificial Sequence
  Synthetic Polynucleotide
taatacgactcactatagggtagtttattaaaacaataagtgaatcaatgaacagaggagacattgaatgacttattgtaacctggcggcagcgcaaaagatg

SEQ ID NO: 65201 - DNA, 103 bp, Artificial Sequence
  Synthetic Polynucleotide
taatacgactcactatagggaatgttagtttattaaaacaataagtgaataacagaggagaattcacatgttgttttaaaacctggcggcagcgcaaaagatg

SEQ ID NO: 65202 - DNA, 103 bp, Artificial Sequence
  Synthetic Polynucleotide
taatacgactcactatagggttaacaatgttagtttattaaaacaataagaacagaggagacttattatgttaataaacaacctggcggcagcgcaaaagatg

SEQ ID NO: 65203 - DNA, 103 bp, Artificial Sequence
  Synthetic Polynucleotide
taatacgactcactatagggttcaattaacaatgttagtttattaaaacaaacagaggagatgttttatgaaactaacaaacctggcggcagcgcaaaagatg

SEQ ID NO: 65204 - DNA, 103 bp, Artificial Sequence
  Synthetic Polynucleotide
taatacgactcactatagggataaacagacacatcaatatgtgtttacaaaacagaggagattgtaaatgcatattgataacctggcggcagcgcaaaagatg

SEQ ID NO: 65205 - DNA, 103 bp, Artificial Sequence
  Synthetic Polynucleotide
taatacgactcactatagggcccttttcaattaacaatgttagtttattaaacagaggagataataaatgaacattgttaacctggcggcagcgcaaaagatg

SEQ ID NO: 65206 - DNA, 103 bp, Artificial Sequence
  Synthetic Polynucleotide
taatacgactcactataggggttatcccttttcaattaacaatgttagttaacagaggagaaactaaatgtgttaattgaacctggcggcagcgcaaaagatg

SEQ ID NO: 65207 - DNA, 103 bp, Artificial Sequence
  Synthetic Polynucleotide
taatacgactcactatagggaacatgttatcccttttcaattaacaatgtaacagaggagaacattgatgattgaaaagaacctggcggcagcgcaaaagatg

SEQ ID NO: 65208 - DNA, 103 bp, Artificial Sequence
  Synthetic Polynucleotide
taatacgactcactatagggtctataacatgttatcccttttcaattaacaacagaggagagttaatatgaaagggataaacctggcggcagcgcaaaagatg

SEQ ID NO: 65209 - DNA, 103 bp, Artificial Sequence
  Synthetic Polynucleotide
taatacgactcactatagggtatattctataacatgttatcccttttcaaaacagaggagattgaaaatggataacatgaacctggcggcagcgcaaaagatg

SEQ ID NO: 65210 - DNA, 103 bp, Artificial Sequence
  Synthetic Polynucleotide
taatacgactcactatagggtaatttatattctataacatgttatcccttaacagaggagaaagggaatgcatgttataaacctggcggcagcgcaaaagatg

SEQ ID NO: 65211 - DNA, 103 bp, Artificial Sequence
  Synthetic Polynucleotide
taatacgactcactatagggatatataatttatattctataacatgttataacagaggagaataacaatgtatagaataaacctggcggcagcgcaaaagatg

SEQ ID NO: 65212 - DNA, 103 bp, Artificial Sequence
  Synthetic Polynucleotide
taatacgactcactatagggaatccatatataatttatattctataacataacagaggagaatgttaatgaatataaataacctggcggcagcgcaaaagatg

SEQ ID NO: 65213 - DNA, 103 bp, Artificial Sequence
  Synthetic Polynucleotide
taatacgactcactatagggaaaaaaatccatatataatttatattctataacagaggagaatagaaatgaaattatataacctggcggcagcgcaaaagatg

SEQ ID NO: 65214 - DNA, 103 bp, Artificial Sequence
  Synthetic Polynucleotide
taatacgactcactatagggtttttaaaaaaatccatatataatttatataacagaggagaatataaatgatatatggaaacctggcggcagcgcaaaagatg

SEQ ID NO: 65215 - DNA, 103 bp, Artificial Sequence
  Synthetic Polynucleotide
taatacgactcactatagggattgtataaacagacacatcaatatgtgttaacagaggagaaacacaatgtgatgtgtcaacctggcggcagcgcaaaagatg

SEQ ID NO: 65216 - DNA, 103 bp, Artificial Sequence
  Synthetic Polynucleotide
taatacgactcactatagggtttcctttttaaaaaaatccatatataattaacagaggagaaattatatgtggatttttaacctggcggcagcgcaaaagatg

SEQ ID NO: 65217 - DNA, 103 bp, Artificial Sequence
  Synthetic Polynucleotide
taatacgactcactatagggaagtatttcctttttaaaaaaatccatataaacagaggagatatatgatgttttttaaaaacctggcggcagcgcaaaagatg

SEQ ID NO: 65218 - DNA, 103 bp, Artificial Sequence
  Synthetic Polynucleotide
taatacgactcactatagggcagtcaagtatttcctttttaaaaaaatccaacagaggagaggatttatgtaaaaaggaaacctggcggcagcgcaaaagatg

SEQ ID NO: 65219 - DNA, 103 bp, Artificial Sequence
  Synthetic Polynucleotide
taatacgactcactatagggtactccagtcaagtatttcctttttaaaaaaacagaggagatttttaatgaggaaatacaacctggcggcagcgcaaaagatg

SEQ ID NO: 65220 - DNA, 103 bp, Artificial Sequence
  Synthetic Polynucleotide
taatacgactcactatagggatatatactccagtcaagtatttcctttttaacagaggagaaaaaagatgatacttgacaacctggcggcagcgcaaaagatg

SEQ ID NO: 65221 - DNA, 103 bp, Artificial Sequence
  Synthetic Polynucleotide
taatacgactcactataggggataaatatatactccagtcaagtatttccaacagaggagaggaaatatgtgactggagaacctggcggcagcgcaaaagatg

SEQ ID NO: 65222 - DNA, 103 bp, Artificial Sequence
  Synthetic Polynucleotide
taatacgactcactataggggaagagataaatatatactccagtcaagtaaacagaggagatacttgatgggagtatataacctggcggcagcgcaaaagatg

SEQ ID NO: 65223 - DNA, 103 bp, Artificial Sequence
  Synthetic Polynucleotide
taatacgactcactatagggataatgaagagataaatatatactccagtcaacagaggagagactggatgatatatttaaacctggcggcagcgcaaaagatg

SEQ ID NO: 65224 - DNA, 103 bp, Artificial Sequence
  Synthetic Polynucleotide
taatacgactcactataggggctatataatgaagagataaatatatactcaacagaggagagagtatatgtttatctctaacctggcggcagcgcaaaagatg

SEQ ID NO: 65225 - DNA, 103 bp, Artificial Sequence
  Synthetic Polynucleotide
taatacgactcactatagggcatgtgctatataatgaagagataaatataaacagaggagatatattatgctcttcattaacctggcggcagcgcaaaagatg

SEQ ID NO: 65226 - DNA, 103 bp, Artificial Sequence
  Synthetic Polynucleotide
taatacgactcactatagggcattaattgtataaacagacacatcaatataacagaggagaatattgatgtgtctgtttaacctggcggcagcgcaaaagatg

SEQ ID NO: 65227 - DNA, 103 bp, Artificial Sequence
  Synthetic Polynucleotide
taatacgactcactatagggacacgcatgtgctatataatgaagagataaaacagaggagattatctatgcattatataaacctggcggcagcgcaaaagatg

SEQ ID NO: 65228 - DNA, 103 bp, Artificial Sequence
  Synthetic Polynucleotide
taatacgactcactatagggttggaacacgcatgtgctatataatgaagaaacagaggagatcttcaatgtatagcacaaacctggcggcagcgcaaaagatg

SEQ ID NO: 65229 - DNA, 103 bp, Artificial Sequence
  Synthetic Polynucleotide
taatacgactcactatagggaagaattggaacacgcatgtgctatataataacagaggagaattataatgcacatgcgtaacctggcggcagcgcaaaagatg

SEQ ID NO: 65230 - DNA, 103 bp, Artificial Sequence
  Synthetic Polynucleotide
taatacgactcactatagggtgtggaagaattggaacacgcatgtgctataacagaggagaatagcaatggcgtgttccaacctggcggcagcgcaaaagatg

SEQ ID NO: 65231 - DNA, 103 bp, Artificial Sequence
  Synthetic Polynucleotide
taatacgactcactatagggtgggatgtggaagaattggaacacgcatgtaacagaggagaacatgcatgttccaattcaacctggcggcagcgcaaaagatg

SEQ ID NO: 65232 - DNA, 103 bp, Artificial Sequence
  Synthetic Polynucleotide
taatacgactcactatagggttatatgggatgtggaagaattggaacacgaacagaggagacgtgttatgattcttccaaacctggcggcagcgcaaaagatg

SEQ ID NO: 65233 - DNA, 103 bp, Artificial Sequence
  Synthetic Polynucleotide
taatacgactcactatagggctgtattatatgggatgtggaagaattggaaacagaggagatccaatatgtccacatccaacctggcggcagcgcaaaagatg

SEQ ID NO: 65234 - DNA, 103 bp, Artificial Sequence
  Synthetic Polynucleotide
taatacgactcactatagggtattcctgtattatatgggatgtggaagaaaacagaggagattcttcatgatcccatataacctggcggcagcgcaaaagatg

SEQ ID NO: 65235 - DNA, 103 bp, Artificial Sequence
  Synthetic Polynucleotide
taatacgactcactataggggattatattcctgtattatatgggatgtggaacagaggagaccacatatgatataatacaacctggcggcagcgcaaaagatg

SEQ ID NO: 65236 - DNA, 103 bp, Artificial Sequence
  Synthetic Polynucleotide
taatacgactcactatagggaataagattatattcctgtattatatgggaaacagaggagatcccatatgatacaggaaaacctggcggcagcgcaaaagatg

SEQ ID NO: 65237 - DNA, 103 bp, Artificial Sequence
  Synthetic Polynucleotide
taatacgactcactatagggattaaatgtataatagaggatattactcagaacagaggagactgagtatgatcctctataacctggcggcagcgcaaaagatg

SEQ ID NO: 65238 - DNA, 103 bp, Artificial Sequence
  Synthetic Polynucleotide
taatacgactcactatagggaatatcattaattgtataaacagacacatcaacagaggagagatgtgatggtttatacaaacctggcggcagcgcaaaagatg

SEQ ID NO: 65239 - DNA, 103 bp, Artificial Sequence
  Synthetic Polynucleotide
taatacgactcactataggggttcgaataagattatattcctgtattataaacagaggagatataatatgggaatataaaacctggcggcagcgcaaaagatg

SEQ ID NO: 65240 - DNA, 103 bp, Artificial Sequence
  Synthetic Polynucleotide
taatacgactcactatagggtgtatgttcgaataagattatattcctgtaaacagaggagatacaggatgataatcttaaacctggcggcagcgcaaaagatg

SEQ ID NO: 65241 - DNA, 103 bp, Artificial Sequence
  Synthetic Polynucleotide
taatacgactcactatagggttttttgtatgttcgaataagattatattcaacagaggagagaatatatgcttattcgaaacctggcggcagcgcaaaagatg

SEQ ID NO: 65242 - DNA, 103 bp, Artificial Sequence
  Synthetic Polynucleotide
taatacgactcactatagggtccacttttttgtatgttcgaataagattaaacagaggagataatctatgtcgaacataaacctggcggcagcgcaaaagatg

SEQ ID NO: 65243 - DNA, 103 bp, Artificial Sequence
  Synthetic Polynucleotide
taatacgactcactatagggttttatccacttttttgtatgttcgaataaaacagaggagattattcatgcatacaaaaaacctggcggcagcgcaaaagatg

SEQ ID NO: 65244 - DNA, 103 bp, Artificial Sequence
  Synthetic Polynucleotide
taatacgactcactatagggtattgttttatccacttttttgtatgttcgaacagaggagacgaacaatgaaaaaagtgaacctggcggcagcgcaaaagatg

SEQ ID NO: 65245 - DNA, 103 bp, Artificial Sequence
  Synthetic Polynucleotide
taatacgactcactatagggtcaactattgttttatccacttttttgtataacagaggagaatacaaatgagtggataaaacctggcggcagcgcaaaagatg

SEQ ID NO: 65246 - DNA, 103 bp, Artificial Sequence
  Synthetic Polynucleotide
taatacgactcactatagggaaaaatcaactattgttttatccactttttaacagaggagaaaaaagatgataaaacaaaacctggcggcagcgcaaaagatg

SEQ ID NO: 65247 - DNA, 103 bp, Artificial Sequence
  Synthetic Polynucleotide
taatacgactcactatagggagataaaaaatcaactattgttttatccacaacagaggagagtggatatgacaatagttaacctggcggcagcgcaaaagatg

SEQ ID NO: 65248 - DNA, 103 bp, Artificial Sequence
  Synthetic Polynucleotide
taatacgactcactatagggcacctagataaaaaatcaactattgttttaaacagaggagataaaacatgagttgatttaacctggcggcagcgcaaaagatg

SEQ ID NO: 65249 - DNA, 103 bp, Artificial Sequence
  Synthetic Polynucleotide
taatacgactcactatagggatccaaatatcattaattgtataaacagacaacagaggagagtctgtatgtacaattaaaacctggcggcagcgcaaaagatg

SEQ ID NO: 65250 - DNA, 103 bp, Artificial Sequence
  Synthetic Polynucleotide
taatacgactcactatagggttggccacctagataaaaaatcaactattgaacagaggagacaatagatgattttttataacctggcggcagcgcaaaagatg

SEQ ID NO: 65251 - DNA, 103 bp, Artificial Sequence
  Synthetic Polynucleotide
taatacgactcactatagggtaaatttggccacctagataaaaaatcaacaacagaggagagttgatatgttatctaggaacctggcggcagcgcaaaagatg

SEQ ID NO: 65252 - DNA, 103 bp, Artificial Sequence
  Synthetic Polynucleotide
taatacgactcactatagggtggaataaatttggccacctagataaaaaaaacagaggagattttttatgtaggtggccaacctggcggcagcgcaaaagatg

SEQ ID NO: 65253 - DNA, 103 bp, Artificial Sequence
  Synthetic Polynucleotide
taatacgactcactatagggaaatatggaataaatttggccacctagataaacagaggagatatctaatgggccaaattaacctggcggcagcgcaaaagatg

SEQ ID NO: 65254 - DNA, 103 bp, Artificial Sequence
  Synthetic Polynucleotide
taatacgactcactatagggttctaaaatatggaataaatttggccacctaacagaggagaaggtggatgaatttattcaacctggcggcagcgcaaaagatg

SEQ ID NO: 65255 - DNA, 103 bp, Artificial Sequence
  Synthetic Polynucleotide
taatacgactcactatagggccatattctaaaatatggaataaatttggcaacagaggagagccaaaatgattccatataacctggcggcagcgcaaaagatg

SEQ ID NO: 65256 - DNA, 103 bp, Artificial Sequence
  Synthetic Polynucleotide
taatacgactcactatagggtttccccatattctaaaatatggaataaataacagaggagaatttatatgatattttagaacctggcggcagcgcaaaagatg

SEQ ID NO: 65257 - DNA, 103 bp, Artificial Sequence
  Synthetic Polynucleotide
taatacgactcactatagggaatattttccccatattctaaaatatggaaaacagaggagattccatatgttagaatataacctggcggcagcgcaaaagatg

SEQ ID NO: 65258 - DNA, 103 bp, Artificial Sequence
  Synthetic Polynucleotide
taatacgactcactatagggtgtagaatattttccccatattctaaaataaacagaggagatattttatgatatggggaaacctggcggcagcgcaaaagatg

SEQ ID NO: 65259 - DNA, 103 bp, Artificial Sequence
  Synthetic Polynucleotide
taatacgactcactatagggaaatatgtagaatattttccccatattctaaacagaggagatagaatatggggaaaataaacctggcggcagcgcaaaagatg

SEQ ID NO: 65260 - DNA, 103 bp, Artificial Sequence
  Synthetic Polynucleotide
taatacgactcactatagggcatggatccaaatatcattaattgtataaaaacagaggagatttataatgttaatgataaacctggcggcagcgcaaaagatg

SEQ ID NO: 65261 - DNA, 103 bp, Artificial Sequence
  Synthetic Polynucleotide
taatacgactcactatagggagaataaatatgtagaatattttccccataaacagaggagatatgggatgaatattctaaacctggcggcagcgcaaaagatg

SEQ ID NO: 65262 - DNA, 103 bp, Artificial Sequence
  Synthetic Polynucleotide
taatacgactcactatagggtccatagaataaatatgtagaatattttccaacagaggagaggaaaaatgtctacatataacctggcggcagcgcaaaagatg

SEQ ID NO: 65263 - DNA, 103 bp, Artificial Sequence
  Synthetic Polynucleotide
taatacgactcactatagggcatcatccatagaataaatatgtagaatataacagaggagaatattcatgatatttattaacctggcggcagcgcaaaagatg

SEQ ID NO: 65264 - DNA, 103 bp, Artificial Sequence
  Synthetic Polynucleotide
taatacgactcactatagggattagcatcatccatagaataaatatgtagaacagaggagactacatatgtattctatgaacctggcggcagcgcaaaagatg

SEQ ID NO: 65265 - DNA, 103 bp, Artificial Sequence
  Synthetic Polynucleotide
taatacgactcactatagggttcgtattagcatcatccatagaataaataaacagaggagatatttaatgtatggatgaaacctggcggcagcgcaaaagatg

SEQ ID NO: 65266 - DNA, 103 bp, Artificial Sequence
  Synthetic Polynucleotide
taatacgactcactatagggtaatattcgtattagcatcatccatagaataacagaggagaattctaatgatgatgctaaacctggcggcagcgcaaaagatg

SEQ ID NO: 65267 - DNA, 103 bp, Artificial Sequence
  Synthetic Polynucleotide
taatacgactcactatagggaattataatattcgtattagcatcatccataacagaggagaatggatatggctaatacgaacctggcggcagcgcaaaagatg

SEQ ID NO: 65268 - DNA, 103 bp, Artificial Sequence
  Synthetic Polynucleotide
taatacgactcactatagggaaaaaaattataatattcgtattagcatcaaacagaggagatgatgcatgtacgaatataacctggcggcagcgcaaaagatg

SEQ ID NO: 65269 - DNA, 103 bp, Artificial Sequence
  Synthetic Polynucleotide
taatacgactcactatagggctagaaaaaaaattataatattcgtattagaacagaggagactaataatgatattataaaacctggcggcagcgcaaaagatg

SEQ ID NO: 65270 - DNA, 103 bp, Artificial Sequence
  Synthetic Polynucleotide
taatacgactcactataggggttatctagaaaaaaaattataatattcgtaacagaggagaacgaatatgataatttttaacctggcggcagcgcaaaagatg

SEQ ID NO: 65271 - DNA, 103 bp, Artificial Sequence
  Synthetic Polynucleotide
taatacgactcactatagggagtagcatggatccaaatatcattaattgtaacagaggagaacaattatggatatttggaacctggcggcagcgcaaaagatg

SEQ ID NO: 65272 - DNA, 103 bp, Artificial Sequence
  Synthetic Polynucleotide
taatacgactcactatagggaatacgttatctagaaaaaaaattataataaacagaggagatattatatgtttttttctaacctggcggcagcgcaaaagatg

SEQ ID NO: 65273 - DNA, 103 bp, Artificial Sequence
  Synthetic Polynucleotide
taatacgactcactatagggtatttaatacgttatctagaaaaaaaattaaacagaggagataatttatgttctagataaacctggcggcagcgcaaaagatg

SEQ ID NO: 65274 - DNA, 103 bp, Artificial Sequence
  Synthetic Polynucleotide
taatacgactcactatagggattaatatttaatacgttatctagaaaaaaaacagaggagattttttatggataacgtaaacctggcggcagcgcaaaagatg

SEQ ID NO: 65275 - DNA, 103 bp, Artificial Sequence
  Synthetic Polynucleotide
taatacgactcactatagggttcttattaatatttaatacgttatctagaaacagaggagatctagaatgcgtattaaaaacctggcggcagcgcaaaagatg

SEQ ID NO: 65276 - DNA, 103 bp, Artificial Sequence
  Synthetic Polynucleotide
taatacgactcactatagggacccgttcttattaatatttaatacgttataacagaggagaataacgatgtaaatattaaacctggcggcagcgcaaaagatg

SEQ ID NO: 65277 - DNA, 103 bp, Artificial Sequence
  Synthetic Polynucleotide
taatacgactcactatagggaaatgacccgttcttattaatatttaatacaacagaggagagtattaatgattaataagaacctggcggcagcgcaaaagatg

SEQ ID NO: 65278 - DNA, 103 bp, Artificial Sequence
  Synthetic Polynucleotide
taatacgactcactatagggtgtataaatgacccgttcttattaatatttaacagaggagaaaatatatgtaagaacggaacctggcggcagcgcaaaagatg

SEQ ID NO: 65279 - DNA, 103 bp, Artificial Sequence
  Synthetic Polynucleotide
taatacgactcactataggggattgtgtataaatgacccgttcttattaaaacagaggagattaataatgacgggtcataacctggcggcagcgcaaaagatg

SEQ ID NO: 65280 - DNA, 103 bp, Artificial Sequence
  Synthetic Polynucleotide
taatacgactcactatagggcccgagattgtgtataaatgacccgttcttaacagaggagaaagaacatgtcatttataaacctggcggcagcgcaaaagatg

SEQ ID NO: 65281 - DNA, 103 bp, Artificial Sequence
  Synthetic Polynucleotide
taatacgactcactataggggataacccgagattgtgtataaatgacccgaacagaggagacgggtcatgtatacacaaaacctggcggcagcgcaaaagatg

SEQ ID NO: 65282 - DNA, 103 bp, Artificial Sequence
  Synthetic Polynucleotide
taatacgactcactatagggaaggtagtagcatggatccaaatatcattaaacagaggagataatgaatgttggatccaaacctggcggcagcgcaaaagatg

SEQ ID NO: 65283 - DNA, 103 bp, Artificial Sequence
  Synthetic Polynucleotide
taatacgactcactatagggatgatgataacccgagattgtgtataaatgaacagaggagacatttaatgacaatctcgaacctggcggcagcgcaaaagatg

SEQ ID NO: 65284 - DNA, 103 bp, Artificial Sequence
  Synthetic Polynucleotide
taatacgactcactatagggaatggatgatgataacccgagattgtgtataacagaggagaatacacatgctcgggttaaacctggcggcagcgcaaaagatg

SEQ ID NO: 65285 - DNA, 103 bp, Artificial Sequence
  Synthetic Polynucleotide
taatacgactcactatagggatattaatggatgatgataacccgagattgaacagaggagacaatctatggttatcatcaacctggcggcagcgcaaaagatg

SEQ ID NO: 65286 - DNA, 103 bp, Artificial Sequence
  Synthetic Polynucleotide
taatacgactcactatagggcttttatattaatggatgatgataacccgaaacagaggagatcgggtatgcatcatccaaacctggcggcagcgcaaaagatg

SEQ ID NO: 65287 - DNA, 103 bp, Artificial Sequence
  Synthetic Polynucleotide
taatacgactcactatagggatattcttttatattaatggatgatgataaaacagaggagattatcaatgtccattaataacctggcggcagcgcaaaagatg

SEQ ID NO: 65288 - DNA, 103 bp, Artificial Sequence
  Synthetic Polynucleotide
taatacgactcactatagggtatacatattcttttatattaatggatgataacagaggagaatcatcatgtaatataaaaacctggcggcagcgcaaaagatg

SEQ ID NO: 65289 - DNA, 103 bp, Artificial Sequence
  Synthetic Polynucleotide
taatacgactcactatagggattgatatacatattcttttatattaatggaacagaggagaccattaatgtaaaagaataacctggcggcagcgcaaaagatg

SEQ ID NO: 65290 - DNA, 103 bp, Artificial Sequence
  Synthetic Polynucleotide
taatacgactcactatagggaactaattgatatacatattcttttatattaacagaggagaaatataatggaatatgtaaacctggcggcagcgcaaaagatg

SEQ ID NO: 65291 - DNA, 103 bp, Artificial Sequence
  Synthetic Polynucleotide
taatacgactcactatagggttattaactaattgatatacatattcttttaacagaggagaaaaagaatgtgtatatcaaacctggcggcagcgcaaaagatg

SEQ ID NO: 65292 - DNA, 103 bp, Artificial Sequence
  Synthetic Polynucleotide
taatacgactcactataggggatcattattaactaattgatatacatattaacagaggagaaatatgatgatcaattagaacctggcggcagcgcaaaagatg

SEQ ID NO: 65293 - DNA, 103 bp, Artificial Sequence
  Synthetic Polynucleotide
taatacgactcactatagggacccgaaggtagtagcatggatccaaatataacagaggagaatatttatgtccatgctaaacctggcggcagcgcaaaagatg

SEQ ID NO: 65294 - DNA, 103 bp, Artificial Sequence
  Synthetic Polynucleotide
taatacgactcactatagggtagatgatcattattaactaattgatatacaacagaggagagtatatatgttagttaataacctggcggcagcgcaaaagatg

SEQ ID NO: 65295 - DNA, 103 bp, Artificial Sequence
  Synthetic Polynucleotide
taatacgactcactatagggttatctagatgatcattattaactaattgaaacagaggagatcaattatgtaataatgaaacctggcggcagcgcaaaagatg

SEQ ID NO: 65296 - DNA, 103 bp, Artificial Sequence
  Synthetic Polynucleotide
taatacgactcactatagggtcccattatctagatgatcattattaactaaacagaggagatagttaatgatgatcatcaacctggcggcagcgcaaaagatg

SEQ ID NO: 65297 - DNA, 103 bp, Artificial Sequence
  Synthetic Polynucleotide
taatacgactcactatagggtcttatcccattatctagatgatcattattaacagaggagaaataatatgcatctagataacctggcggcagcgcaaaagatg

SEQ ID NO: 65298 - DNA, 103 bp, Artificial Sequence
  Synthetic Polynucleotide
taatacgactcactatagggattagtcttatcccattatctagatgatcaaacagaggagatgatcaatgagataatggaacctggcggcagcgcaaaagatg

SEQ ID NO: 65299 - DNA, 103 bp, Artificial Sequence
  Synthetic Polynucleotide
taatacgactcactatagggcaagcattagtcttatcccattatctagataacagaggagaatctagatgatgggataaaacctggcggcagcgcaaaagatg

SEQ ID NO: 65300 - DNA, 103 bp, Artificial Sequence
  Synthetic Polynucleotide
taatacgactcactatagggattttcaagcattagtcttatcccattatcaacagaggagagataatatgataagactaaacctggcggcagcgcaaaagatg

SEQ ID NO: 65301 - DNA, 103 bp, Artificial Sequence
  Synthetic Polynucleotide
taatacgactcactatagggcgtccattttcaagcattagtcttatcccaaacagaggagatgggatatgactaatgctaacctggcggcagcgcaaaagatg

SEQ ID NO: 65302 - DNA, 103 bp, Artificial Sequence
  Synthetic Polynucleotide
taatacgactcactatagggttctacgtccattttcaagcattagtcttaaacagaggagataagacatgtgcttgaaaaacctggcggcagcgcaaaagatg

SEQ ID NO: 65303 - DNA, 103 bp, Artificial Sequence
  Synthetic Polynucleotide
taatacgactcactatagggtcttgttctacgtccattttcaagcattagaacagaggagactaatgatggaaaatggaaacctggcggcagcgcaaaagatg

SEQ ID NO: 65304 - DNA, 103 bp, Artificial Sequence
  Synthetic Polynucleotide
taatacgactcactatagggattttacccgaaggtagtagcatggatccaaacagaggagatggatcatggctactaccaacctggcggcagcgcaaaagatg

SEQ ID NO: 65305 - DNA, 103 bp, Artificial Sequence
  Synthetic Polynucleotide
taatacgactcactatagggaaatgtcttgttctacgtccattttcaagcaacagaggagagcttgaatgtggacgtagaacctggcggcagcgcaaaagatg

SEQ ID NO: 65306 - DNA, 103 bp, Artificial Sequence
  Synthetic Polynucleotide
taatacgactcactatagggataaaaaatgtcttgttctacgtccattttaacagaggagaaaaatgatggtagaacaaaacctggcggcagcgcaaaagatg

SEQ ID NO: 65307 - DNA, 103 bp, Artificial Sequence
  Synthetic Polynucleotide
taatacgactcactatagggataggataaaaaatgtcttgttctacgtccaacagaggagaggacgtatgacaagacataacctggcggcagcgcaaaagatg

SEQ ID NO: 65308 - DNA, 103 bp, Artificial Sequence
  Synthetic Polynucleotide
taatacgactcactatagggaatatataggataaaaaatgtcttgttctaaacagaggagatagaacatgacattttttaacctggcggcagcgcaaaagatg

SEQ ID NO: 65309 - DNA, 103 bp, Artificial Sequence
  Synthetic Polynucleotide
taatacgactcactatagggtatctaatatataggataaaaaatgtcttgaacagaggagacaagacatgttttatcctaacctggcggcagcgcaaaagatg

SEQ ID NO: 65310 - DNA, 103 bp, Artificial Sequence
  Synthetic Polynucleotide
taatacgactcactatagggaactgtatctaatatataggataaaaaatgaacagaggagacattttatgtcctatataaacctggcggcagcgcaaaagatg

SEQ ID NO: 65311 - DNA, 103 bp, Artificial Sequence
  Synthetic Polynucleotide
taatacgactcactatagggatattaactgtatctaatatataggataaaaacagaggagatttatcatgtatattagaaacctggcggcagcgcaaaagatg

SEQ ID NO: 65312 - DNA, 103 bp, Artificial Sequence
  Synthetic Polynucleotide
taatacgactcactatagggtatagatattaactgtatctaatatataggaacagaggagacctataatgtagatacagaacctggcggcagcgcaaaagatg

SEQ ID NO: 65313 - DNA, 103 bp, Artificial Sequence
  Synthetic Polynucleotide
taatacgactcactatagggacatatatagatattaactgtatctaatataacagaggagaatattaatgacagttaataacctggcggcagcgcaaaagatg

SEQ ID NO: 65314 - DNA, 103 bp, Artificial Sequence
  Synthetic Polynucleotide
taatacgactcactatagggaaaatacatatatagatattaactgtatctaacagaggagaagatacatgtaatatctaaacctggcggcagcgcaaaagatg

SEQ ID NO: 65315 - DNA, 103 bp, Artificial Sequence
  Synthetic Polynucleotide
taatacgactcactatagggctccaattttacccgaaggtagtagcatggaacagaggagaccatgcatgtaccttcggaacctggcggcagcgcaaaagatg

SEQ ID NO: 65316 - DNA, 103 bp, Artificial Sequence
  Synthetic Polynucleotide
taatacgactcactatagggttattaaaatacatatatagatattaactgaacagaggagacagttaatgtctatatataacctggcggcagcgcaaaagatg

SEQ ID NO: 65317 - DNA, 103 bp, Artificial Sequence
  Synthetic Polynucleotide
taatacgactcactatagggatgatttattaaaatacatatatagatattaacagaggagaaatatcatgatatgtattaacctggcggcagcgcaaaagatg

SEQ ID NO: 65318 - DNA, 103 bp, Artificial Sequence
  Synthetic Polynucleotide
taatacgactcactatagggaatccatgatttattaaaatacatatatagaacagaggagactatatatgtattttaataacctggcggcagcgcaaaagatg

SEQ ID NO: 65319 - DNA, 103 bp, Artificial Sequence
  Synthetic Polynucleotide
taatacgactcactatagggtgtaaaatccatgatttattaaaatacataaacagaggagatatgtaatgtaataaatcaacctggcggcagcgcaaaagatg

SEQ ID NO: 65320 - DNA, 103 bp, Artificial Sequence
  Synthetic Polynucleotide
taatacgactcactatagggatctatgtaaaatccatgatttattaaaataacagaggagaattttaatgaatcatggaaacctggcggcagcgcaaaagatg

SEQ ID NO: 65321 - DNA, 103 bp, Artificial Sequence
  Synthetic Polynucleotide
taatacgactcactatagggacagcatctatgtaaaatccatgatttattaacagaggagaaataaaatgtggattttaaacctggcggcagcgcaaaagatg

SEQ ID NO: 65322 - DNA, 103 bp, Artificial Sequence
  Synthetic Polynucleotide
taatacgactcactatagggtgtccacagcatctatgtaaaatccatgataacagaggagaatcatgatgtttacatagaacctggcggcagcgcaaaagatg

SEQ ID NO: 65323 - DNA, 103 bp, Artificial Sequence
  Synthetic Polynucleotide
taatacgactcactataggggtaactgtccacagcatctatgtaaaatccaacagaggagaggatttatgatagatgctaacctggcggcagcgcaaaagatg

SEQ ID NO: 65324 - DNA, 103 bp, Artificial Sequence
  Synthetic Polynucleotide
taatacgactcactatagggcaaccgtaactgtccacagcatctatgtaaaacagaggagattacatatgtgctgtggaaacctggcggcagcgcaaaagatg

SEQ ID NO: 65325 - DNA, 103 bp, Artificial Sequence
  Synthetic Polynucleotide
taatacgactcactatagggatgtacaaccgtaactgtccacagcatctaaacagaggagatagatgatgtggacagttaacctggcggcagcgcaaaagatg

SEQ ID NO: 65326 - DNA, 103 bp, Artificial Sequence
  Synthetic Polynucleotide
taatacgactcactatagggcgattctccaattttacccgaaggtagtagaacagaggagactactaatgtcgggtaaaaacctggcggcagcgcaaaagatg

SEQ ID NO: 65327 - DNA, 103 bp, Artificial Sequence
  Synthetic Polynucleotide
taatacgactcactatagggtaataatgtacaaccgtaactgtccacagcaacagaggagagctgtgatgagttacggtaacctggcggcagcgcaaaagatg

SEQ ID NO: 65328 - DNA, 103 bp, Artificial Sequence
  Synthetic Polynucleotide
taatacgactcactatagggctatgtaataatgtacaaccgtaactgtccaacagaggagaggacagatgcggttgtacaacctggcggcagcgcaaaagatg

SEQ ID NO: 65329 - DNA, 103 bp, Artificial Sequence
  Synthetic Polynucleotide
taatacgactcactatagggtacatctatgtaataatgtacaaccgtaacaacagaggagagttacgatggtacattataacctggcggcagcgcaaaagatg

SEQ ID NO: 65330 - DNA, 103 bp, Artificial Sequence
  Synthetic Polynucleotide
taatacgactcactatagggatatatacatctatgtaataatgtacaaccaacagaggagaggttgtatgttattacataacctggcggcagcgcaaaagatg

SEQ ID NO: 65331 - DNA, 103 bp, Artificial Sequence
  Synthetic Polynucleotide
taatacgactcactatagggtagtgatatatacatctatgtaataatgtaaacagaggagatacattatgacatagatgaacctggcggcagcgcaaaagatg

SEQ ID NO: 65332 - DNA, 103 bp, Artificial Sequence
  Synthetic Polynucleotide
taatacgactcactatagggtcttatagtgatatatacatctatgtaataaacagaggagatattacatggatgtatataacctggcggcagcgcaaaagatg

SEQ ID NO: 65333 - DNA, 103 bp, Artificial Sequence
  Synthetic Polynucleotide
taatacgactcactatagggtgatttcttatagtgatatatacatctatgaacagaggagacatagaatgatatatcacaacctggcggcagcgcaaaagatg

SEQ ID NO: 65334 - DNA, 103 bp, Artificial Sequence
  Synthetic Polynucleotide
taatacgactcactataggggattctgatttcttatagtgatatatacataacagaggagaatgtatatgtcactataaaacctggcggcagcgcaaaagatg

SEQ ID NO: 65335 - DNA, 103 bp, Artificial Sequence
  Synthetic Polynucleotide
taatacgactcactatagggattctgattctgatttcttatagtgatataaacagaggagatatatcatgataagaaataacctggcggcagcgcaaaagatg

SEQ ID NO: 65336 - DNA, 103 bp, Artificial Sequence
  Synthetic Polynucleotide
taatacgactcactataggggtatgattctgattctgatttcttatagtgaacagaggagacactatatgaaatcagaaaacctggcggcagcgcaaaagatg

SEQ ID NO: 65337 - DNA, 103 bp, Artificial Sequence
  Synthetic Polynucleotide
taatacgactcactataggggtatacgattctccaattttacccgaaggtaacagaggagaaccttcatgtaaaattggaacctggcggcagcgcaaaagatg

SEQ ID NO: 65338 - DNA, 103 bp, Artificial Sequence
  Synthetic Polynucleotide
taatacgactcactatagggtcattgtatgattctgattctgatttcttaaacagaggagataagaaatgagaatcagaaacctggcggcagcgcaaaagatg

SEQ ID NO: 65339 - DNA, 103 bp, Artificial Sequence
  Synthetic Polynucleotide
taatacgactcactatagggttaattcattgtatgattctgattctgattaacagaggagaaatcagatgcagaatcataacctggcggcagcgcaaaagatg

SEQ ID NO: 65340 - DNA, 103 bp, Artificial Sequence
  Synthetic Polynucleotide
taatacgactcactatagggtttaattaattcattgtatgattctgattcaacagaggagagaatcaatgtcatacaataacctggcggcagcgcaaaagatg

SEQ ID NO: 65341 - DNA, 103 bp, Artificial Sequence
  Synthetic Polynucleotide
taatacgactcactatagggaatattttaattaattcattgtatgattctaacagaggagaagaatcatgcaatgaattaacctggcggcagcgcaaaagatg

SEQ ID NO: 65342 - DNA, 103 bp, Artificial Sequence
  Synthetic Polynucleotide
taatacgactcactatagggttaacaatattttaattaattcattgtatgaacagaggagacatacaatgaattaattaaacctggcggcagcgcaaaagatg

SEQ ID NO: 65343 - DNA, 103 bp, Artificial Sequence
  Synthetic Polynucleotide
taatacgactcactatagggattatttaacaatattttaattaattcattaacagaggagaaatgaaatgattaaaataaacctggcggcagcgcaaaagatg

SEQ ID NO: 65344 - DNA, 103 bp, Artificial Sequence
  Synthetic Polynucleotide
taatacgactcactataggggatccattatttaacaatattttaattaataacagaggagaattaatatgaatattgttaacctggcggcagcgcaaaagatg

SEQ ID NO: 65345 - DNA, 103 bp, Artificial Sequence
  Synthetic Polynucleotide
taatacgactcactatagggcatctgatccattatttaacaatattttaaaacagaggagattaaaaatgtgttaaataaacctggcggcagcgcaaaagatg

SEQ ID NO: 65346 - DNA, 103 bp, Artificial Sequence
  Synthetic Polynucleotide
taatacgactcactatagggatctacatctgatccattatttaacaatataacagaggagaatattgatgaataatggaaacctggcggcagcgcaaaagatg

SEQ ID NO: 65347 - DNA, 103 bp, Artificial Sequence
  Synthetic Polynucleotide
taatacgactcactatagggtttttatctacatctgatccattatttaacaacagaggagagttaaaatgtggatcagaaacctggcggcagcgcaaaagatg

SEQ ID NO: 65348 - DNA, 103 bp, Artificial Sequence
  Synthetic Polynucleotide
taatacgactcactatagggtgaacattaaatgtataatagaggatattaaacagaggagataatatatgctattatacaacctggcggcagcgcaaaagatg

SEQ ID NO: 65349 - DNA, 103 bp, Artificial Sequence
  Synthetic Polynucleotide
taatacgactcactatagggaaatggtatacgattctccaattttacccgaacagaggagacgggtaatgttggagaataacctggcggcagcgcaaaagatg

SEQ ID NO: 65350 - DNA, 103 bp, Artificial Sequence
  Synthetic Polynucleotide
taatacgactcactatagggtatcttttttatctacatctgatccattataacagaggagaataatgatgcagatgtagaacctggcggcagcgcaaaagatg

SEQ ID NO: 65351 - DNA, 103 bp, Artificial Sequence
  Synthetic Polynucleotide
taatacgactcactatagggatgcgtatcttttttatctacatctgatccaacagaggagaggatcaatggtagataaaaacctggcggcagcgcaaaagatg

SEQ ID NO: 65352 - DNA, 103 bp, Artificial Sequence
  Synthetic Polynucleotide
taatacgactcactatagggtttccatgcgtatcttttttatctacatctaacagaggagaagatgtatgtaaaaaagaaacctggcggcagcgcaaaagatg

SEQ ID NO: 65353 - DNA, 103 bp, Artificial Sequence
  Synthetic Polynucleotide
taatacgactcactataggggcgtgtttccatgcgtatcttttttatctaaacagaggagatagataatgaagatacgcaacctggcggcagcgcaaaagatg

SEQ ID NO: 65354 - DNA, 103 bp, Artificial Sequence
  Synthetic Polynucleotide
taatacgactcactatagggaaatggcgtgtttccatgcgtatcttttttaacagaggagaaaaaaaatgacgcatggaaacctggcggcagcgcaaaagatg

SEQ ID NO: 65355 - DNA, 103 bp, Artificial Sequence
  Synthetic Polynucleotide
taatacgactcactatagggaggataaatggcgtgtttccatgcgtatctaacagaggagaagatacatgtggaaacacaacctggcggcagcgcaaaagatg

SEQ ID NO: 65356 - DNA, 103 bp, Artificial Sequence
  Synthetic Polynucleotide
taatacgactcactatagggataataggataaatggcgtgtttccatgcgaacagaggagacgcatgatgacacgccataacctggcggcagcgcaaaagatg

SEQ ID NO: 65357 - DNA, 103 bp, Artificial Sequence
  Synthetic Polynucleotide
taatacgactcactatagggtttacataataggataaatggcgtgtttccaacagaggagaggaaacatgccatttatcaacctggcggcagcgcaaaagatg

SEQ ID NO: 65358 - DNA, 103 bp, Artificial Sequence
  Synthetic Polynucleotide
taatacgactcactatagggtcgtgtttacataataggataaatggcgtgaacagaggagacacgccatgtatcctattaacctggcggcagcgcaaaagatg

SEQ ID NO: 65359 - DNA, 103 bp, Artificial Sequence
  Synthetic Polynucleotide
taatacgactcactatagggctatatcgtgtttacataataggataaatgaacagaggagacatttaatgtattatgtaaacctggcggcagcgcaaaagatg

SEQ ID NO: 65360 - DNA, 103 bp, Artificial Sequence
  Synthetic Polynucleotide
taatacgactcactatagggactagaaatggtatacgattctccaattttaacagaggagaaaaattatggaatcgtataacctggcggcagcgcaaaagatg

SEQ ID NO: 65361 - DNA, 103 bp, Artificial Sequence
  Synthetic Polynucleotide
taatacgactcactataggggttgtctatatcgtgtttacataataggataacagaggagaatcctaatgtgtaaacacaacctggcggcagcgcaaaagatg

SEQ ID NO: 65362 - DNA, 103 bp, Artificial Sequence
  Synthetic Polynucleotide
taatacgactcactatagggtctacgttgtctatatcgtgtttacataataacagaggagaattatgatgacacgatataacctggcggcagcgcaaaagatg

SEQ ID NO: 65363 - DNA, 103 bp, Artificial Sequence
  Synthetic Polynucleotide
taatacgactcactatagggacaattctacgttgtctatatcgtgtttacaacagaggagagtaaacatgatatagacaaacctggcggcagcgcaaaagatg

SEQ ID NO: 65364 - DNA, 103 bp, Artificial Sequence
  Synthetic Polynucleotide
taatacgactcactatagggctcaaacaattctacgttgtctatatcgtgaacagaggagacacgatatggacaacgtaaacctggcggcagcgcaaaagatg

SEQ ID NO: 65365 - DNA, 103 bp, Artificial Sequence
  Synthetic Polynucleotide
taatacgactcactatagggcatatctcaaacaattctacgttgtctataaacagaggagatatagaatgcgtagaattaacctggcggcagcgcaaaagatg

SEQ ID NO: 65366 - DNA, 103 bp, Artificial Sequence
  Synthetic Polynucleotide
taatacgactcactatagggctaaacatatctcaaacaattctacgttgtaacagaggagaacaacgatgaattgtttgaacctggcggcagcgcaaaagatg

SEQ ID NO: 65367 - DNA, 103 bp, Artificial Sequence
  Synthetic Polynucleotide
taatacgactcactatagggattctctaaacatatctcaaacaattctacaacagaggagagtagaaatgtttgagataaacctggcggcagcgcaaaagatg

SEQ ID NO: 65368 - DNA, 103 bp, Artificial Sequence
  Synthetic Polynucleotide
taatacgactcactatagggttagcattctctaaacatatctcaaacaataacagaggagaattgttatggatatgtttaacctggcggcagcgcaaaagatg

SEQ ID NO: 65369 - DNA, 103 bp, Artificial Sequence
  Synthetic Polynucleotide
taatacgactcactatagggctatattagcattctctaaacatatctcaaaacagaggagattgagaatggtttagagaaacctggcggcagcgcaaaagatg

SEQ ID NO: 65370 - DNA, 103 bp, Artificial Sequence
  Synthetic Polynucleotide
taatacgactcactatagggagagtctatattagcattctctaaacatataacagaggagaatatgtatggagaatgctaacctggcggcagcgcaaaagatg

SEQ ID NO: 65371 - DNA, 103 bp, Artificial Sequence
  Synthetic Polynucleotide
taatacgactcactatagggaaagtactagaaatggtatacgattctccaaacagaggagatggagaatggtataccataacctggcggcagcgcaaaagatg

SEQ ID NO: 65372 - DNA, 103 bp, Artificial Sequence
  Synthetic Polynucleotide
taatacgactcactatagggtctacagagtctatattagcattctctaaaaacagaggagatttagaatgtgctaatataacctggcggcagcgcaaaagatg

SEQ ID NO: 65373 - DNA, 103 bp, Artificial Sequence
  Synthetic Polynucleotide
taatacgactcactatagggtaaagtctacagagtctatattagcattctaacagaggagaagaatgatgatatagactaacctggcggcagcgcaaaagatg

SEQ ID NO: 65374 - DNA, 103 bp, Artificial Sequence
  Synthetic Polynucleotide
taatacgactcactatagggtccattaaagtctacagagtctatattagcaacagaggagagctaatatggactctgtaaacctggcggcagcgcaaaagatg

SEQ ID NO: 65375 - DNA, 103 bp, Artificial Sequence
  Synthetic Polynucleotide
taatacgactcactataggggtatatccattaaagtctacagagtctataaacagaggagatatagaatgtgtagacttaacctggcggcagcgcaaaagatg

SEQ ID NO: 65376 - DNA, 103 bp, Artificial Sequence
  Synthetic Polynucleotide
taatacgactcactataggggaggtgtatatccattaaagtctacagagtaacagaggagaactctgatgactttaatgaacctggcggcagcgcaaaagatg

SEQ ID NO: 65377 - DNA, 103 bp, Artificial Sequence
  Synthetic Polynucleotide
taatacgactcactatagggatgaagaggtgtatatccattaaagtctacaacagaggagagtagacatgaatggatataacctggcggcagcgcaaaagatg

SEQ ID NO: 65378 - DNA, 103 bp, Artificial Sequence
  Synthetic Polynucleotide
taatacgactcactatagggacataatgaagaggtgtatatccattaaagaacagaggagactttaaatgatatacaccaacctggcggcagcgcaaaagatg

SEQ ID NO: 65379 - DNA, 103 bp, Artificial Sequence
  Synthetic Polynucleotide
taatacgactcactatagggatgagacataatgaagaggtgtatatccataacagaggagaatggatatgcacctcttcaacctggcggcagcgcaaaagatg

SEQ ID NO: 65380 - DNA, 103 bp, Artificial Sequence
  Synthetic Polynucleotide
taatacgactcactataggggcgacatgagacataatgaagaggtgtataaacagaggagatatacaatgcttcattataacctggcggcagcgcaaaagatg

SEQ ID NO: 65381 - DNA, 103 bp, Artificial Sequence
  Synthetic Polynucleotide
taatacgactcactatagggttattgcgacatgagacataatgaagaggtaacagaggagaacctctatgttatgtctcaacctggcggcagcgcaaaagatg

SEQ ID NO: 65382 - DNA, 103 bp, Artificial Sequence
  Synthetic Polynucleotide
taatacgactcactatagggaacctaaagtactagaaatggtatacgattaacagaggagaaatcgtatgccatttctaaacctggcggcagcgcaaaagatg

SEQ ID NO: 65383 - DNA, 103 bp, Artificial Sequence
  Synthetic Polynucleotide
taatacgactcactatagggcatatttattgcgacatgagacataatgaaaacagaggagattcattatgtctcatgtcaacctggcggcagcgcaaaagatg

SEQ ID NO: 65384 - DNA, 103 bp, Artificial Sequence
  Synthetic Polynucleotide
taatacgactcactatagggaaaatcatatttattgcgacatgagacataaacagaggagatatgtcatgtgtcgcaataacctggcggcagcgcaaaagatg

SEQ ID NO: 65385 - DNA, 103 bp, Artificial Sequence
  Synthetic Polynucleotide
taatacgactcactatagggtttacaaaatcatatttattgcgacatgagaacagaggagactcatgatgcaataaataaacctggcggcagcgcaaaagatg

SEQ ID NO: 65386 - DNA, 103 bp, Artificial Sequence
  Synthetic Polynucleotide
taatacgactcactatagggatgactttacaaaatcatatttattgcgacaacagaggagagtcgcaatgaatatgattaacctggcggcagcgcaaaagatg

SEQ ID NO: 65387 - DNA, 103 bp, Artificial Sequence
  Synthetic Polynucleotide
taatacgactcactatagggaattaatgactttacaaaatcatatttattaacagaggagaaataaaatggattttgtaaacctggcggcagcgcaaaagatg

SEQ ID NO: 65388 - DNA, 103 bp, Artificial Sequence
  Synthetic Polynucleotide
taatacgactcactatagggttagaaattaatgactttacaaaatcatataacagaggagaatatgaatgtgtaaagtcaacctggcggcagcgcaaaagatg

SEQ ID NO: 65389 - DNA, 103 bp, Artificial Sequence
  Synthetic Polynucleotide
taatacgactcactatagggctcctttagaaattaatgactttacaaaataacagaggagaattttgatgagtcattaaaacctggcggcagcgcaaaagatg

SEQ ID NO: 65390 - DNA, 103 bp, Artificial Sequence
  Synthetic Polynucleotide
taatacgactcactatagggatttgctcctttagaaattaatgactttacaacagaggagagtaaagatgttaatttctaacctggcggcagcgcaaaagatg

SEQ ID NO: 65391 - DNA, 103 bp, Artificial Sequence
  Synthetic Polynucleotide
taatacgactcactatagggttaacatttgctcctttagaaattaatgacaacagaggagagtcattatgttctaaaggaacctggcggcagcgcaaaagatg

SEQ ID NO: 65392 - DNA, 103 bp, Artificial Sequence
  Synthetic Polynucleotide
taatacgactcactataggggcgtattaacatttgctcctttagaaattaaacagaggagataatttatgaaggagcaaaacctggcggcagcgcaaaagatg

SEQ ID NO: 65393 - DNA, 103 bp, Artificial Sequence
  Synthetic Polynucleotide
taatacgactcactatagggcaatgaacctaaagtactagaaatggtataaacagaggagatataccatgtctagtactaacctggcggcagcgcaaaagatg

SEQ ID NO: 65394 - DNA, 103 bp, Artificial Sequence
  Synthetic Polynucleotide
taatacgactcactatagggattacgcgtattaacatttgctcctttagaaacagaggagatctaaaatggcaaatgttaacctggcggcagcgcaaaagatg

SEQ ID NO: 65395 - DNA, 103 bp, Artificial Sequence
  Synthetic Polynucleotide
taatacgactcactatagggaatctattacgcgtattaacatttgctcctaacagaggagaaggagcatgtgttaatacaacctggcggcagcgcaaaagatg

SEQ ID NO: 65396 - DNA, 103 bp, Artificial Sequence
  Synthetic Polynucleotide
taatacgactcactatagggttccgaatctattacgcgtattaacatttgaacagaggagacaaatgatgatacgcgtaaacctggcggcagcgcaaaagatg

SEQ ID NO: 65397 - DNA, 103 bp, Artificial Sequence
  Synthetic Polynucleotide
taatacgactcactatagggagtagttccgaatctattacgcgtattaacaacagaggagagttaatatgcgtaatagaaacctggcggcagcgcaaaagatg

SEQ ID NO: 65398 - DNA, 103 bp, Artificial Sequence
  Synthetic Polynucleotide
taatacgactcactatagggaatggagtagttccgaatctattacgcgtaaacagaggagatacgcgatgtagattcggaacctggcggcagcgcaaaagatg

SEQ ID NO: 65399 - DNA, 103 bp, Artificial Sequence
  Synthetic Polynucleotide
taatacgactcactatagggaataaaatggagtagttccgaatctattacaacagaggagagtaataatgtcggaactaaacctggcggcagcgcaaaagatg

SEQ ID NO: 65400 - DNA, 103 bp, Artificial Sequence
  Synthetic Polynucleotide
taatacgactcactatagggtccacaataaaatggagtagttccgaatctaacagaggagaagattcatgactactccaaacctggcggcagcgcaaaagatg

SEQ ID NO: 65401 - DNA, 103 bp, Artificial Sequence
  Synthetic Polynucleotide
taatacgactcactatagggataattccacaataaaatggagtagttccgaacagaggagacggaacatgtccattttaaacctggcggcagcgcaaaagatg

SEQ ID NO: 65402 - DNA, 103 bp, Artificial Sequence
  Synthetic Polynucleotide
taatacgactcactatagggcgtgtataattccacaataaaatggagtagaacagaggagactactcatgtttattgtgaacctggcggcagcgcaaaagatg

SEQ ID NO: 65403 - DNA, 103 bp, Artificial Sequence
  Synthetic Polynucleotide
taatacgactcactataggggataccgtgtataattccacaataaaatggaacagaggagaccatttatgtgtggaattaacctggcggcagcgcaaaagatg

SEQ ID NO: 65404 - DNA, 103 bp, Artificial Sequence
  Synthetic Polynucleotide
taatacgactcactataggggataacaatgaacctaaagtactagaaatgaacagaggagacatttcatgtactttaggaacctggcggcagcgcaaaagatg

SEQ ID NO: 65405 - DNA, 103 bp, Artificial Sequence
  Synthetic Polynucleotide
taatacgactcactatagggagcgagataccgtgtataattccacaataaaacagaggagattattgatgaattatacaaacctggcggcagcgcaaaagatg

SEQ ID NO: 65406 - DNA, 103 bp, Artificial Sequence
  Synthetic Polynucleotide
taatacgactcactatagggttataagcgagataccgtgtataattccacaacagaggagagtggaaatgtacacggtaaacctggcggcagcgcaaaagatg

SEQ ID NO: 65407 - DNA, 103 bp, Artificial Sequence
  Synthetic Polynucleotide
taatacgactcactatagggtagttttataagcgagataccgtgtataataacagaggagaattataatgggtatctcgaacctggcggcagcgcaaaagatg

SEQ ID NO: 65408 - DNA, 103 bp, Artificial Sequence
  Synthetic Polynucleotide
taatacgactcactatagggaaatatagttttataagcgagataccgtgtaacagaggagaacacggatgctcgcttataacctggcggcagcgcaaaagatg

SEQ ID NO: 65409 - DNA, 103 bp, Artificial Sequence
  Synthetic Polynucleotide
taatacgactcactatagggattccaaatatagttttataagcgagatacaacagaggagagtatctatgttataaaacaacctggcggcagcgcaaaagatg

SEQ ID NO: 65410 - DNA, 103 bp, Artificial Sequence
  Synthetic Polynucleotide
taatacgactcactataggggtctgattccaaatatagttttataagcgaaacagaggagatcgcttatgaaactatataacctggcggcagcgcaaaagatg

SEQ ID NO: 65411 - DNA, 103 bp, Artificial Sequence
  Synthetic Polynucleotide
taatacgactcactatagggtctgtgtctgattccaaatatagttttataaacagaggagatataaaatgatatttggaaacctggcggcagcgcaaaagatg

SEQ ID NO: 65412 - DNA, 103 bp, Artificial Sequence
  Synthetic Polynucleotide
taatacgactcactatagggctaactctgtgtctgattccaaatatagttaacagaggagaaactatatgtggaatcagaacctggcggcagcgcaaaagatg

SEQ ID NO: 65413 - DNA, 103 bp, Artificial Sequence
  Synthetic Polynucleotide
taatacgactcactatagggtatttctaactctgtgtctgattccaaataaacagaggagatatttgatgtcagacacaaacctggcggcagcgcaaaagatg

SEQ ID NO: 65414 - DNA, 103 bp, Artificial Sequence
  Synthetic Polynucleotide
taatacgactcactatagggttatctatttctaactctgtgtctgattccaacagaggagaggaatcatgcacagagttaacctggcggcagcgcaaaagatg

SEQ ID NO: 65415 - DNA, 103 bp, Artificial Sequence
  Synthetic Polynucleotide
taatacgactcactatagggcaatggataacaatgaacctaaagtactagaacagaggagactagtaatgtaggttcataacctggcggcagcgcaaaagatg

SEQ ID NO: 65416 - DNA, 103 bp, Artificial Sequence
  Synthetic Polynucleotide
taatacgactcactataggggttcattatctatttctaactctgtgtctgaacagaggagacagacaatgagttagaaaaacctggcggcagcgcaaaagatg

SEQ ID NO: 65417 - DNA, 103 bp, Artificial Sequence
  Synthetic Polynucleotide
taatacgactcactatagggtatatgttcattatctatttctaactctgtaacagaggagaacagagatggaaatagataacctggcggcagcgcaaaagatg

SEQ ID NO: 65418 - DNA, 103 bp, Artificial Sequence
  Synthetic Polynucleotide
taatacgactcactatagggcgaactatatgttcattatctatttctaacaacagaggagagttagaatgagataatgaaacctggcggcagcgcaaaagatg

SEQ ID NO: 65419 - DNA, 103 bp, Artificial Sequence
  Synthetic Polynucleotide
taatacgactcactatagggaatgacgaactatatgttcattatctatttaacagaggagaaaatagatgatgaacataaacctggcggcagcgcaaaagatg

SEQ ID NO: 65420 - DNA, 103 bp, Artificial Sequence
  Synthetic Polynucleotide
taatacgactcactatagggtattaaatgacgaactatatgttcattatcaacagaggagagataatatgcatatagttaacctggcggcagcgcaaaagatg

SEQ ID NO: 65421 - DNA, 103 bp, Artificial Sequence
  Synthetic Polynucleotide
taatacgactcactatagggaaaattattaaatgacgaactatatgttcaaacagaggagatgaacaatgagttcgtcaaacctggcggcagcgcaaaagatg

SEQ ID NO: 65422 - DNA, 103 bp, Artificial Sequence
  Synthetic Polynucleotide
taatacgactcactatagggcatcaaaaattattaaatgacgaactatataacagaggagaatatagatggtcatttaaaacctggcggcagcgcaaaagatg

SEQ ID NO: 65423 - DNA, 103 bp, Artificial Sequence
  Synthetic Polynucleotide
taatacgactcactatagggaacggcatcaaaaattattaaatgacgaacaacagaggagagttcgtatgttaataattaacctggcggcagcgcaaaagatg

SEQ ID NO: 65424 - DNA, 103 bp, Artificial Sequence
  Synthetic Polynucleotide
taatacgactcactataggggattcaacggcatcaaaaattattaaatgaaacagaggagatcatttatgaatttttgaaacctggcggcagcgcaaaagatg

SEQ ID NO: 65425 - DNA, 103 bp, Artificial Sequence
  Synthetic Polynucleotide
taatacgactcactatagggctaaagattcaacggcatcaaaaattattaaacagaggagataataaatgttgatgccgaacctggcggcagcgcaaaagatg

SEQ ID NO: 65426 - DNA, 103 bp, Artificial Sequence
  Synthetic Polynucleotide
taatacgactcactatagggctctacaatggataacaatgaacctaaagtaacagaggagaactttaatgtcattgttaaacctggcggcagcgcaaaagatg

SEQ ID NO: 65427 - DNA, 103 bp, Artificial Sequence
  Synthetic Polynucleotide
taatacgactcactatagggataatctaaagattcaacggcatcaaaaataacagaggagaatttttatggccgttgaaaacctggcggcagcgcaaaagatg

SEQ ID NO: 65428 - DNA, 103 bp, Artificial Sequence
  Synthetic Polynucleotide
taatacgactcactatagggaatagataatctaaagattcaacggcatcaaacagaggagatgatgcatgtgaatctttaacctggcggcagcgcaaaagatg

SEQ ID NO: 65429 - DNA, 103 bp, Artificial Sequence
  Synthetic Polynucleotide
taatacgactcactatagggtaaataatagataatctaaagattcaacggaacagaggagaccgttgatgctttagattaacctggcggcagcgcaaaagatg

SEQ ID NO: 65430 - DNA, 103 bp, Artificial Sequence
  Synthetic Polynucleotide
taatacgactcactatagggtcctctaaataatagataatctaaagattcaacagaggagagaatctatggattatctaaacctggcggcagcgcaaaagatg

SEQ ID NO: 65431 - DNA, 103 bp, Artificial Sequence
  Synthetic Polynucleotide
taatacgactcactatagggataactcctctaaataatagataatctaaaaacagaggagatttagaatgtctattattaacctggcggcagcgcaaaagatg

SEQ ID NO: 65432 - DNA, 103 bp, Artificial Sequence
  Synthetic Polynucleotide
taatacgactcactatagggtatcaataactcctctaaataatagataataacagaggagaattatcatgtatttagagaacctggcggcagcgcaaaagatg

SEQ ID NO: 65433 - DNA, 103 bp, Artificial Sequence
  Synthetic Polynucleotide
taatacgactcactataggggttaatatcaataactcctctaaataatagaacagaggagactattaatgagaggagttaacctggcggcagcgcaaaagatg

SEQ ID NO: 65434 - DNA, 103 bp, Artificial Sequence
  Synthetic Polynucleotide
taatacgactcactatagggcgatagttaatatcaataactcctctaaataacagaggagaatttagatgagttattgaaacctggcggcagcgcaaaagatg

SEQ ID NO: 65435 - DNA, 103 bp, Artificial Sequence
  Synthetic Polynucleotide
taatacgactcactatagggtagtacgatagttaatatcaataactcctcaacagaggagagaggagatgttgatattaaacctggcggcagcgcaaaagatg

SEQ ID NO: 65436 - DNA, 103 bp, Artificial Sequence
  Synthetic Polynucleotide
taatacgactcactataggggtatatagtacgatagttaatatcaataacaacagaggagagttattatgattaactataacctggcggcagcgcaaaagatg

SEQ ID NO: 65437 - DNA, 103 bp, Artificial Sequence
  Synthetic Polynucleotide
taatacgactcactatagggtcatcctctacaatggataacaatgaacctaacagaggagaaggttcatggttatccataacctggcggcagcgcaaaagatg

SEQ ID NO: 65438 - DNA, 103 bp, Artificial Sequence
  Synthetic Polynucleotide
taatacgactcactatagggtcgttgtatatagtacgatagttaatatcaaacagaggagatgatatatgctatcgtacaacctggcggcagcgcaaaagatg

SEQ ID NO: 65439 - DNA, 103 bp, Artificial Sequence
  Synthetic Polynucleotide
taatacgactcactatagggatgtttcgttgtatatagtacgatagttaaaacagaggagattaactatggtactatataacctggcggcagcgcaaaagatg

SEQ ID NO: 65440 - DNA, 103 bp, Artificial Sequence
  Synthetic Polynucleotide
taatacgactcactatagggaatagatgtttcgttgtatatagtacgataaacagaggagatatcgtatgatatacaacaacctggcggcagcgcaaaagatg

SEQ ID NO: 65441 - DNA, 103 bp, Artificial Sequence
  Synthetic Polynucleotide
taatacgactcactatagggtcgtaaatagatgtttcgttgtatatagtaaacagaggagatactatatgcaacgaaacaacctggcggcagcgcaaaagatg

SEQ ID NO: 65442 - DNA, 103 bp, Artificial Sequence
  Synthetic Polynucleotide
taatacgactcactatagggcagcgtcgtaaatagatgtttcgttgtataaacagaggagatatacaatgaaacatctaaacctggcggcagcgcaaaagatg

SEQ ID NO: 65443 - DNA, 103 bp, Artificial Sequence
  Synthetic Polynucleotide
taatacgactcactatagggactaacagcgtcgtaaatagatgtttcgttaacagaggagaaacgaaatgtctatttacaacctggcggcagcgcaaaagatg

SEQ ID NO: 65444 - DNA, 103 bp, Artificial Sequence
  Synthetic Polynucleotide
taatacgactcactatagggttataactaacagcgtcgtaaatagatgttaacagaggagaaacatcatgttacgacgcaacctggcggcagcgcaaaagatg

SEQ ID NO: 65445 - DNA, 103 bp, Artificial Sequence
  Synthetic Polynucleotide
taatacgactcactatagggacgcattataactaacagcgtcgtaaatagaacagaggagactatttatgacgctgttaaacctggcggcagcgcaaaagatg

SEQ ID NO: 65446 - DNA, 103 bp, Artificial Sequence
  Synthetic Polynucleotide
taatacgactcactatagggattatacgcattataactaacagcgtcgtaaacagaggagatacgacatggttagttataacctggcggcagcgcaaaagatg

SEQ ID NO: 65447 - DNA, 103 bp, Artificial Sequence
  Synthetic Polynucleotide
taatacgactcactatagggaacatattatacgcattataactaacagcgaacagaggagacgctgtatgttataatgcaacctggcggcagcgcaaaagatg

SEQ ID NO: 65448 - DNA, 103 bp, Artificial Sequence
  Synthetic Polynucleotide
taatacgactcactataggggcatgtcatcctctacaatggataacaatgaacagaggagacattgtatgccattgtagaacctggcggcagcgcaaaagatg

SEQ ID NO: 65449 - DNA, 103 bp, Artificial Sequence
  Synthetic Polynucleotide
taatacgactcactatagggagaccaacatattatacgcattataactaaaacagaggagattagttatgatgcgtataaacctggcggcagcgcaaaagatg

SEQ ID NO: 65450 - DNA, 103 bp, Artificial Sequence
  Synthetic Polynucleotide
taatacgactcactatagggtagatagaccaacatattatacgcattataaacagaggagatataatatgtataatatgaacctggcggcagcgcaaaagatg

SEQ ID NO: 65451 - DNA, 103 bp, Artificial Sequence
  Synthetic Polynucleotide
taatacgactcactatagggtttaatagatagaccaacatattatacgcaaacagaggagatgcgtaatgtatgttggtaacctggcggcagcgcaaaagatg

SEQ ID NO: 65452 - DNA, 103 bp, Artificial Sequence
  Synthetic Polynucleotide
taatacgactcactatagggttctgtttaatagatagaccaacatattataacagaggagaataataatgtggtctatcaacctggcggcagcgcaaaagatg

SEQ ID NO: 65453 - DNA, 103 bp, Artificial Sequence
  Synthetic Polynucleotide
taatacgactcactatagggaccatttctgtttaatagatagaccaacataacagaggagaatgttgatgtatctattaaacctggcggcagcgcaaaagatg

SEQ ID NO: 65454 - DNA, 103 bp, Artificial Sequence
  Synthetic Polynucleotide
taatacgactcactatagggaaatcaccatttctgtttaatagatagaccaacagaggagaggtctaatgattaaacagaacctggcggcagcgcaaaagatg

SEQ ID NO: 65455 - DNA, 103 bp, Artificial Sequence
  Synthetic Polynucleotide
taatacgactcactatagggtctcaaaatcaccatttctgtttaatagataacagaggagaatctatatgacagaaatgaacctggcggcagcgcaaaagatg

SEQ ID NO: 65456 - DNA, 103 bp, Artificial Sequence
  Synthetic Polynucleotide
taatacgactcactatagggaatcgtctcaaaatcaccatttctgtttaaaacagaggagattaaacatgaatggtgataacctggcggcagcgcaaaagatg

SEQ ID NO: 65457 - DNA, 103 bp, Artificial Sequence
  Synthetic Polynucleotide
taatacgactcactataggggtagtaatcgtctcaaaatcaccatttctgaacagaggagacagaaaatgtgattttgaaacctggcggcagcgcaaaagatg

SEQ ID NO: 65458 - DNA, 103 bp, Artificial Sequence
  Synthetic Polynucleotide
taatacgactcactatagggcactagtagtaatcgtctcaaaatcaccataacagaggagaatggtgatgttgagacgaaacctggcggcagcgcaaaagatg

SEQ ID NO: 65459 - DNA, 103 bp, Artificial Sequence
  Synthetic Polynucleotide
taatacgactcactataggggaccgtgaacattaaatgtataatagaggaaacagaggagatcctctatgatacatttaaacctggcggcagcgcaaaagatg

SEQ ID NO: 65460 - DNA, 103 bp, Artificial Sequence
  Synthetic Polynucleotide
taatacgactcactatagggttcgagcatgtcatcctctacaatggataaaacagaggagattatccatggtagaggataacctggcggcagcgcaaaagatg

SEQ ID NO: 65461 - DNA, 103 bp, Artificial Sequence
  Synthetic Polynucleotide
taatacgactcactatagggacatccactagtagtaatcgtctcaaaatcaacagaggagagattttatgacgattactaacctggcggcagcgcaaaagatg

SEQ ID NO: 65462 - DNA, 103 bp, Artificial Sequence
  Synthetic Polynucleotide
taatacgactcactatagggcatgtacatccactagtagtaatcgtctcaaacagaggagatgagacatgtactactagaacctggcggcagcgcaaaagatg

SEQ ID NO: 65463 - DNA, 103 bp, Artificial Sequence
  Synthetic Polynucleotide
taatacgactcactatagggaaatacatgtacatccactagtagtaatcgaacagaggagacgattaatgctagtggataacctggcggcagcgcaaaagatg

SEQ ID NO: 65464 - DNA, 103 bp, Artificial Sequence
  Synthetic Polynucleotide
taatacgactcactatagggtttcgaaatacatgtacatccactagtagtaacagaggagaactactatgggatgtacaaacctggcggcagcgcaaaagatg

SEQ ID NO: 65465 - DNA, 103 bp, Artificial Sequence
  Synthetic Polynucleotide
taatacgactcactatagggactgctttcgaaatacatgtacatccactaaacagaggagatagtggatgtacatgtataacctggcggcagcgcaaaagatg

SEQ ID NO: 65466 - DNA, 103 bp, Artificial Sequence
  Synthetic Polynucleotide
taatacgactcactatagggtcgcaactgctttcgaaatacatgtacatcaacagaggagagatgtaatggtatttcgaaacctggcggcagcgcaaaagatg

SEQ ID NO: 65467 - DNA, 103 bp, Artificial Sequence
  Synthetic Polynucleotide
taatacgactcactataggggttgttcgcaactgctttcgaaatacatgtaacagaggagaacatgtatgtcgaaagcaaacctggcggcagcgcaaaagatg

SEQ ID NO: 65468 - DNA, 103 bp, Artificial Sequence
  Synthetic Polynucleotide
taatacgactcactatagggttgttgttgttcgcaactgctttcgaaataaacagaggagatatttcatgagcagttgcaacctggcggcagcgcaaaagatg

SEQ ID NO: 65469 - DNA, 103 bp, Artificial Sequence
  Synthetic Polynucleotide
taatacgactcactatagggttattttgttgttgttcgcaactgctttcgaacagaggagacgaaagatgttgcgaacaaacctggcggcagcgcaaaagatg

SEQ ID NO: 65470 - DNA, 103 bp, Artificial Sequence
  Synthetic Polynucleotide
taatacgactcactatagggcattattattttgttgttgttcgcaactgcaacagaggagagcagttatgaacaacaacaacctggcggcagcgcaaaagatg

SEQ ID NO: 65471 - DNA, 103 bp, Artificial Sequence
  Synthetic Polynucleotide
taatacgactcactatagggtatgattcgagcatgtcatcctctacaatgaacagaggagacattgtatgggatgacataacctggcggcagcgcaaaagatg

SEQ ID NO: 65472 - DNA, 103 bp, Artificial Sequence
  Synthetic Polynucleotide
taatacgactcactatagggacttccattattattttgttgttgttcgcaaacagaggagatgcgaaatgcaacaaaataacctggcggcagcgcaaaagatg

SEQ ID NO: 65473 - DNA, 103 bp, Artificial Sequence
  Synthetic Polynucleotide
taatacgactcactatagggatagtacttccattattattttgttgttgtaacagaggagaacaacaatgaaataataaaacctggcggcagcgcaaaagatg

SEQ ID NO: 65474 - DNA, 103 bp, Artificial Sequence
  Synthetic Polynucleotide
taatacgactcactatagggagacaatagtacttccattattattttgttaacagaggagaaacaaaatgataatggaaaacctggcggcagcgcaaaagatg

SEQ ID NO: 65475 - DNA, 103 bp, Artificial Sequence
  Synthetic Polynucleotide
taatacgactcactatagggtgtttagacaatagtacttccattattattaacagaggagaaataatatgggaagtactaacctggcggcagcgcaaaagatg

SEQ ID NO: 65476 - DNA, 103 bp, Artificial Sequence
  Synthetic Polynucleotide
taatacgactcactatagggatggttgtttagacaatagtacttccattaaacagaggagataatggatgtactattgtaacctggcggcagcgcaaaagatg

SEQ ID NO: 65477 - DNA, 103 bp, Artificial Sequence
  Synthetic Polynucleotide
taatacgactcactatagggcaaagatggttgtttagacaatagtacttcaacagaggagagaagtaatgttgtctaaaaacctggcggcagcgcaaaagatg

SEQ ID NO: 65478 - DNA, 103 bp, Artificial Sequence
  Synthetic Polynucleotide
taatacgactcactatagggattttcaaagatggttgtttagacaatagtaacagaggagaactattatgtaaacaaccaacctggcggcagcgcaaaagatg

SEQ ID NO: 65479 - DNA, 103 bp, Artificial Sequence
  Synthetic Polynucleotide
taatacgactcactatagggtcataattttcaaagatggttgtttagacaaacagaggagatgtctaatgaaccatcttaacctggcggcagcgcaaaagatg

SEQ ID NO: 65480 - DNA, 103 bp, Artificial Sequence
  Synthetic Polynucleotide
taatacgactcactatagggcagtatcataattttcaaagatggttgtttaacagaggagaaaacaaatgtctttgaaaaacctggcggcagcgcaaaagatg

SEQ ID NO: 65481 - DNA, 103 bp, Artificial Sequence
  Synthetic Polynucleotide
taatacgactcactatagggatagacagtatcataattttcaaagatggtaacagaggagaaccatcatggaaaattataacctggcggcagcgcaaaagatg

SEQ ID NO: 65482 - DNA, 103 bp, Artificial Sequence
  Synthetic Polynucleotide
taatacgactcactatagggttttgtatgattcgagcatgtcatcctctaaacagaggagatagaggatgacatgctcgaacctggcggcagcgcaaaagatg

SEQ ID NO: 65483 - DNA, 103 bp, Artificial Sequence
  Synthetic Polynucleotide
taatacgactcactatagggctattatagacagtatcataattttcaaagaacagaggagactttgaatgttatgatacaacctggcggcagcgcaaaagatg

SEQ ID NO: 65484 - DNA, 103 bp, Artificial Sequence
  Synthetic Polynucleotide
taatacgactcactatagggaattgctattatagacagtatcataattttaacagaggagaaaaattatgatactgtctaacctggcggcagcgcaaaagatg

SEQ ID NO: 65485 - DNA, 103 bp, Artificial Sequence
  Synthetic Polynucleotide
taatacgactcactatagggttagtaattgctattatagacagtatcataaacagaggagatatgatatggtctataataacctggcggcagcgcaaaagatg

SEQ ID NO: 65486 - DNA, 103 bp, Artificial Sequence
  Synthetic Polynucleotide
taatacgactcactatagggtatgtttagtaattgctattatagacagtaaacagaggagatactgtatgtaatagcaaaacctggcggcagcgcaaaagatg

SEQ ID NO: 65487 - DNA, 103 bp, Artificial Sequence
  Synthetic Polynucleotide
taatacgactcactatagggttgtttatgtttagtaattgctattatagaaacagaggagatctataatggcaattactaacctggcggcagcgcaaaagatg

SEQ ID NO: 65488 - DNA, 103 bp, Artificial Sequence
  Synthetic Polynucleotide
taatacgactcactatagggttatgttgtttatgtttagtaattgctattaacagaggagaaatagcatgtactaaacaaacctggcggcagcgcaaaagatg

SEQ ID NO: 65489 - DNA, 103 bp, Artificial Sequence
  Synthetic Polynucleotide
taatacgactcactatagggttgtattatgttgtttatgtttagtaattgaacagaggagacaattaatgaacataaacaacctggcggcagcgcaaaagatg

SEQ ID NO: 65490 - DNA, 103 bp, Artificial Sequence
  Synthetic Polynucleotide
taatacgactcactatagggtaaatttgtattatgttgtttatgtttagtaacagaggagaactaaaatgaaacaacataacctggcggcagcgcaaaagatg

SEQ ID NO: 65491 - DNA, 103 bp, Artificial Sequence
  Synthetic Polynucleotide
taatacgactcactatagggtttaataaatttgtattatgttgtttatgtaacagaggagaacataaatgacataatacaacctggcggcagcgcaaaagatg

SEQ ID NO: 65492 - DNA, 103 bp, Artificial Sequence
  Synthetic Polynucleotide
taatacgactcactatagggacatttttaataaatttgtattatgttgttaacagaggagaaacaacatgatacaaattaacctggcggcagcgcaaaagatg

SEQ ID NO: 65493 - DNA, 103 bp, Artificial Sequence
  Synthetic Polynucleotide
taatacgactcactatagggtatatttttgtatgattcgagcatgtcatcaacagaggagagatgacatgctcgaatcaaacctggcggcagcgcaaaagatg

SEQ ID NO: 65494 - DNA, 103 bp, Artificial Sequence
  Synthetic Polynucleotide
taatacgactcactatagggtatacacatttttaataaatttgtattatgaacagaggagacataatatgaatttattaaacctggcggcagcgcaaaagatg

SEQ ID NO: 65495 - DNA, 103 bp, Artificial Sequence
  Synthetic Polynucleotide
taatacgactcactatagggtattttatacacatttttaataaatttgtaaacagaggagatacaaaatgattaaaaataacctggcggcagcgcaaaagatg

SEQ ID NO: 65496 - DNA, 103 bp, Artificial Sequence
  Synthetic Polynucleotide
taatacgactcactatagggcagtatattttatacacatttttaataaataacagaggagaatttatatgaaatgtgtaaacctggcggcagcgcaaaagatg

SEQ ID NO: 65497 - DNA, 103 bp, Artificial Sequence
  Synthetic Polynucleotide
taatacgactcactatagggacacgcagtatattttatacacatttttaaaacagaggagattaaaaatgtgtataaaaaacctggcggcagcgcaaaagatg

SEQ ID NO: 65498 - DNA, 103 bp, Artificial Sequence
  Synthetic Polynucleotide
taatacgactcactataggggtcatacacgcagtatattttatacacattaacagaggagaaatgtgatgaaaatatacaacctggcggcagcgcaaaagatg

SEQ ID NO: 65499 - DNA, 103 bp, Artificial Sequence
  Synthetic Polynucleotide
taatacgactcactatagggaatctgtcatacacgcagtatattttatacaacagaggagagtataaatgatactgcgtaacctggcggcagcgcaaaagatg

SEQ ID NO: 65500 - DNA, 103 bp, Artificial Sequence
  Synthetic Polynucleotide
taatacgactcactatagggatcataatctgtcatacacgcagtatatttaacagaggagaaaatatatggcgtgtatgaacctggcggcagcgcaaaagatg

SEQ ID NO: 65501 - DNA, 103 bp, Artificial Sequence
  Synthetic Polynucleotide
taatacgactcactatagggagagtatcataatctgtcatacacgcagtaaacagaggagatactgcatgtatgacagaaacctggcggcagcgcaaaagatg

SEQ ID NO: 65502 - DNA, 103 bp, Artificial Sequence
  Synthetic Polynucleotide
taatacgactcactatagggctataagagtatcataatctgtcatacacgaacagaggagacgtgtaatgcagattatgaacctggcggcagcgcaaaagatg

SEQ ID NO: 65503 - DNA, 103 bp, Artificial Sequence
  Synthetic Polynucleotide
taatacgactcactatagggtacatctataagagtatcataatctgtcataacagaggagaatgacaatgtatgatactaacctggcggcagcgcaaaagatg

SEQ ID NO: 65504 - DNA, 103 bp, Artificial Sequence
  Synthetic Polynucleotide
taatacgactcactatagggaataatatatttttgtatgattcgagcatgaacagaggagacatgctatgatcatacaaaacctggcggcagcgcaaaagatg

SEQ ID NO: 65505 - DNA, 103 bp, Artificial Sequence
  Synthetic Polynucleotide
taatacgactcactataggggactgtacatctataagagtatcataatctaacagaggagaagattaatgtactcttataacctggcggcagcgcaaaagatg

SEQ ID NO: 65506 - DNA, 103 bp, Artificial Sequence
  Synthetic Polynucleotide
taatacgactcactataggggtaacgactgtacatctataagagtatcataacagaggagaatgataatgttatagatgaacctggcggcagcgcaaaagatg

SEQ ID NO: 65507 - DNA, 103 bp, Artificial Sequence
  Synthetic Polynucleotide
taatacgactcactatagggttgctgtaacgactgtacatctataagagtaacagaggagaactcttatggatgtacagaacctggcggcagcgcaaaagatg

SEQ ID NO: 65508 - DNA, 103 bp, Artificial Sequence
  Synthetic Polynucleotide
taatacgactcactatagggttatattgctgtaacgactgtacatctataaacagaggagatatagaatgacagtcgttaacctggcggcagcgcaaaagatg

SEQ ID NO: 65509 - DNA, 103 bp, Artificial Sequence
  Synthetic Polynucleotide
taatacgactcactatagggaccatttatattgctgtaacgactgtacataacagaggagaatgtacatgcgttacagcaacctggcggcagcgcaaaagatg

SEQ ID NO: 65510 - DNA, 103 bp, Artificial Sequence
  Synthetic Polynucleotide
taatacgactcactatagggaatataccatttatattgctgtaacgactgaacagaggagacagtcgatgcagcaatataacctggcggcagcgcaaaagatg

SEQ ID NO: 65511 - DNA, 103 bp, Artificial Sequence
  Synthetic Polynucleotide
taatacgactcactatagggtttaaaatataccatttatattgctgtaacaacagaggagagttacaatgatataaatgaacctggcggcagcgcaaaagatg

SEQ ID NO: 65512 - DNA, 103 bp, Artificial Sequence
  Synthetic Polynucleotide
taatacgactcactatagggaacattttaaaatataccatttatattgctaacagaggagaagcaatatgaatggtataaacctggcggcagcgcaaaagatg

SEQ ID NO: 65513 - DNA, 103 bp, Artificial Sequence
  Synthetic Polynucleotide
taatacgactcactatagggatcgaaacattttaaaatataccatttataaacagaggagatataaaatgtatattttaaacctggcggcagcgcaaaagatg

SEQ ID NO: 65514 - DNA, 103 bp, Artificial Sequence
  Synthetic Polynucleotide
taatacgactcactatagggatttcatcgaaacattttaaaatataccataacagaggagaatggtaatgtttaaaatgaacctggcggcagcgcaaaagatg

SEQ ID NO: 65515 - DNA, 103 bp, Artificial Sequence
  Synthetic Polynucleotide
taatacgactcactatagggataaaaataatatatttttgtatgattcgaaacagaggagatcgaatatgacaaaaataaacctggcggcagcgcaaaagatg

SEQ ID NO: 65516 - DNA, 103 bp, Artificial Sequence
  Synthetic Polynucleotide
taatacgactcactatagggtatctatttcatcgaaacattttaaaatataacagaggagaatatttatgaatgtttcgaacctggcggcagcgcaaaagatg

SEQ ID NO: 65517 - DNA, 103 bp, Artificial Sequence
  Synthetic Polynucleotide
taatacgactcactatagggcatgatatctatttcatcgaaacattttaaaacagaggagattaaaaatgttcgatgaaaacctggcggcagcgcaaaagatg

SEQ ID NO: 65518 - DNA, 103 bp, Artificial Sequence
  Synthetic Polynucleotide
taatacgactcactatagggctcttcatgatatctatttcatcgaaacataacagaggagaatgtttatgtgaaatagaaacctggcggcagcgcaaaagatg

SEQ ID NO: 65519 - DNA, 103 bp, Artificial Sequence
  Synthetic Polynucleotide
taatacgactcactatagggaacatctcttcatgatatctatttcatcgaaacagaggagatcgatgatgtagatatcaaacctggcggcagcgcaaaagatg

SEQ ID NO: 65520 - DNA, 103 bp, Artificial Sequence
  Synthetic Polynucleotide
taatacgactcactatagggtatataacatctcttcatgatatctatttcaacagaggagagaaataatgatcatgaagaacctggcggcagcgcaaaagatg

SEQ ID NO: 65521 - DNA, 103 bp, Artificial Sequence
  Synthetic Polynucleotide
taatacgactcactatagggttttttatataacatctcttcatgatatctaacagaggagaagatatatggaagagatgaacctggcggcagcgcaaaagatg

SEQ ID NO: 65522 - DNA, 103 bp, Artificial Sequence
  Synthetic Polynucleotide
taatacgactcactatagggttttattttttatataacatctcttcatgaaacagaggagatcatgaatggatgttataaacctggcggcagcgcaaaagatg

SEQ ID NO: 65523 - DNA, 103 bp, Artificial Sequence
  Synthetic Polynucleotide
taatacgactcactatagggtacagttttattttttatataacatctcttaacagaggagaaagagaatgtatataaaaaacctggcggcagcgcaaaagatg

SEQ ID NO: 65524 - DNA, 103 bp, Artificial Sequence
  Synthetic Polynucleotide
taatacgactcactatagggtggaatacagttttattttttatataacataacagaggagaatgttaatgaaaaaataaaacctggcggcagcgcaaaagatg

SEQ ID NO: 65525 - DNA, 103 bp, Artificial Sequence
  Synthetic Polynucleotide
taatacgactcactatagggctaattggaatacagttttattttttatataacagaggagaatataaatgataaaactgaacctggcggcagcgcaaaagatg

SEQ ID NO: 65526 - DNA, 103 bp, Artificial Sequence
  Synthetic Polynucleotide
taatacgactcactatagggataacataaaaataatatatttttgtatgaaacagaggagatcatacatgaatatattaaacctggcggcagcgcaaaagatg

SEQ ID NO: 65527 - DNA, 103 bp, Artificial Sequence
  Synthetic Polynucleotide
taatacgactcactatagggaaaaactaattggaatacagttttatttttaacagaggagaaaaaatatgactgtattcaacctggcggcagcgcaaaagatg

SEQ ID NO: 65528 - DNA, 103 bp, Artificial Sequence
  Synthetic Polynucleotide
taatacgactcactataggggtacaaaaaactaattggaatacagttttaaacagaggagataaaacatgattccaattaacctggcggcagcgcaaaagatg

SEQ ID NO: 65529 - DNA, 103 bp, Artificial Sequence
  Synthetic Polynucleotide
taatacgactcactatagggctttagtacaaaaaactaattggaatacagaacagaggagactgtatatgaattagtttaacctggcggcagcgcaaaagatg

SEQ ID NO: 65530 - DNA, 103 bp, Artificial Sequence
  Synthetic Polynucleotide
taatacgactcactatagggaatgtctttagtacaaaaaactaattggaaaacagaggagattccaaatggttttttgtaacctggcggcagcgcaaaagatg

SEQ ID NO: 65531 - DNA, 103 bp, Artificial Sequence
  Synthetic Polynucleotide
taatacgactcactataggggtattaatgtctttagtacaaaaaactaataacagaggagaattagtatgttgtactaaaacctggcggcagcgcaaaagatg

SEQ ID NO: 65532 - DNA, 103 bp, Artificial Sequence
  Synthetic Polynucleotide
taatacgactcactatagggttaaagtattaatgtctttagtacaaaaaaaacagaggagattttttatgctaaagacaaacctggcggcagcgcaaaagatg

SEQ ID NO: 65533 - DNA, 103 bp, Artificial Sequence
  Synthetic Polynucleotide
taatacgactcactatagggtctcattaaagtattaatgtctttagtacaaacagaggagatgtactatggacattaataacctggcggcagcgcaaaagatg

SEQ ID NO: 65534 - DNA, 103 bp, Artificial Sequence
  Synthetic Polynucleotide
taatacgactcactatagggccgtatctcattaaagtattaatgtctttaaacagaggagataaagaatgtaatactttaacctggcggcagcgcaaaagatg

SEQ ID NO: 65535 - DNA, 103 bp, Artificial Sequence
  Synthetic Polynucleotide
taatacgactcactataggggtctgccgtatctcattaaagtattaatgtaacagaggagaacattaatgctttaatgaaacctggcggcagcgcaaaagatg

SEQ ID NO: 65536 - DNA, 103 bp, Artificial Sequence
  Synthetic Polynucleotide
taatacgactcactatagggaggatgtctgccgtatctcattaaagtattaacagaggagaaatactatgatgagatacaacctggcggcagcgcaaaagatg

SEQ ID NO: 65537 - DNA, 103 bp, Artificial Sequence
  Synthetic Polynucleotide
taatacgactcactatagggacaaaataacataaaaataatatatttttgaacagaggagacaaaaaatgattatttttaacctggcggcagcgcaaaagatg

SEQ ID NO: 65538 - DNA, 103 bp, Artificial Sequence
  Synthetic Polynucleotide
taatacgactcactatagggaaagaaggatgtctgccgtatctcattaaaaacagaggagatttaatatgatacggcagaacctggcggcagcgcaaaagatg

SEQ ID NO: 65539 - DNA, 103 bp, Artificial Sequence
  Synthetic Polynucleotide
taatacgactcactatagggtaacgaaagaaggatgtctgccgtatctcaaacagaggagatgagatatggcagacatcaacctggcggcagcgcaaaagatg

SEQ ID NO: 65540 - DNA, 103 bp, Artificial Sequence
  Synthetic Polynucleotide
taatacgactcactatagggatatttaacgaaagaaggatgtctgccgtaaacagaggagatacggcatgcatccttctaacctggcggcagcgcaaaagatg

SEQ ID NO: 65541 - DNA, 103 bp, Artificial Sequence
  Synthetic Polynucleotide
taatacgactcactatagggctagtatatttaacgaaagaaggatgtctgaacagaggagacagacaatgttctttcgtaacctggcggcagcgcaaaagatg

SEQ ID NO: 65542 - DNA, 103 bp, Artificial Sequence
  Synthetic Polynucleotide
taatacgactcactatagggcgagactagtatatttaacgaaagaaggataacagaggagaatccttatgtcgttaaataacctggcggcagcgcaaaagatg

SEQ ID NO: 65543 - DNA, 103 bp, Artificial Sequence
  Synthetic Polynucleotide
taatacgactcactatagggtacgtcgagactagtatatttaacgaaagaaacagaggagatctttcatgaaatatactaacctggcggcagcgcaaaagatg

SEQ ID NO: 65544 - DNA, 103 bp, Artificial Sequence
  Synthetic Polynucleotide
taatacgactcactatagggccgtatacgtcgagactagtatatttaacgaacagaggagacgttaaatgtactagtctaacctggcggcagcgcaaaagatg

SEQ ID NO: 65545 - DNA, 103 bp, Artificial Sequence
  Synthetic Polynucleotide
taatacgactcactataggggacttccgtatacgtcgagactagtatattaacagaggagaaatataatggtctcgacgaacctggcggcagcgcaaaagatg

SEQ ID NO: 65546 - DNA, 103 bp, Artificial Sequence
  Synthetic Polynucleotide
taatacgactcactatagggtacacgacttccgtatacgtcgagactagtaacagaggagaactagtatggacgtatacaacctggcggcagcgcaaaagatg

SEQ ID NO: 65547 - DNA, 103 bp, Artificial Sequence
  Synthetic Polynucleotide
taatacgactcactatagggttacgtacacgacttccgtatacgtcgagaaacagaggagatctcgaatgatacggaagaacctggcggcagcgcaaaagatg

SEQ ID NO: 65548 - DNA, 103 bp, Artificial Sequence
  Synthetic Polynucleotide
taatacgactcactatagggttttaacaaaataacataaaaataatatataacagaggagaatatatatgttttatgttaacctggcggcagcgcaaaagatg

SEQ ID NO: 65549 - DNA, 103 bp, Artificial Sequence
  Synthetic Polynucleotide
taatacgactcactatagggtgatattacgtacacgacttccgtatacgtaacagaggagaacgtatatggaagtcgtgaacctggcggcagcgcaaaagatg

SEQ ID NO: 65550 - DNA, 103 bp, Artificial Sequence
  Synthetic Polynucleotide
taatacgactcactatagggtgctatgatattacgtacacgacttccgtaaacagaggagatacggaatgcgtgtacgtaacctggcggcagcgcaaaagatg

SEQ ID NO: 65551 - DNA, 103 bp, Artificial Sequence
  Synthetic Polynucleotide
taatacgactcactatagggatagatgctatgatattacgtacacgacttaacagaggagaaagtcgatgacgtaatataacctggcggcagcgcaaaagatg

SEQ ID NO: 65552 - DNA, 103 bp, Artificial Sequence
  Synthetic Polynucleotide
taatacgactcactatagggatctaatagatgctatgatattacgtacacaacagaggagagtgtacatgatatcatagaacctggcggcagcgcaaaagatg

SEQ ID NO: 65553 - DNA, 103 bp, Artificial Sequence
  Synthetic Polynucleotide
taatacgactcactatagggacgatatctaatagatgctatgatattacgaacagaggagacgtaatatgatagcatctaacctggcggcagcgcaaaagatg

SEQ ID NO: 65554 - DNA, 103 bp, Artificial Sequence
  Synthetic Polynucleotide
taatacgactcactatagggctctgacgatatctaatagatgctatgataaacagaggagatatcatatgatctattagaacctggcggcagcgcaaaagatg

SEQ ID NO: 65555 - DNA, 103 bp, Artificial Sequence
  Synthetic Polynucleotide
taatacgactcactatagggttaatctctgacgatatctaatagatgctaaacagaggagatagcatatgttagatatcaacctggcggcagcgcaaaagatg

SEQ ID NO: 65556 - DNA, 103 bp, Artificial Sequence
  Synthetic Polynucleotide
taatacgactcactatagggactaattaatctctgacgatatctaatagaaacagaggagatctattatgtatcgtcagaacctggcggcagcgcaaaagatg

SEQ ID NO: 65557 - DNA, 103 bp, Artificial Sequence
  Synthetic Polynucleotide
taatacgactcactatagggaatagactaattaatctctgacgatatctaaacagaggagatagataatgtcagagattaacctggcggcagcgcaaaagatg

SEQ ID NO: 65558 - DNA, 103 bp, Artificial Sequence
  Synthetic Polynucleotide
taatacgactcactatagggtggataatagactaattaatctctgacgataacagaggagaatcgtcatggattaattaaacctggcggcagcgcaaaagatg

SEQ ID NO: 65559 - DNA, 103 bp, Artificial Sequence
  Synthetic Polynucleotide
taatacgactcactatagggattatttttaacaaaataacataaaaataaaacagaggagattatttatgtgttattttaacctggcggcagcgcaaaagatg

SEQ ID NO: 65560 - DNA, 103 bp, Artificial Sequence
  Synthetic Polynucleotide
taatacgactcactatagggcttcttggataatagactaattaatctctgaacagaggagacagagaatgattagtctaaacctggcggcagcgcaaaagatg

SEQ ID NO: 65561 - DNA, 103 bp, Artificial Sequence
  Synthetic Polynucleotide
taatacgactcactatagggtccagcttcttggataatagactaattaataacagaggagaattaatatgtctattatcaacctggcggcagcgcaaaagatg

SEQ ID NO: 65562 - DNA, 103 bp, Artificial Sequence
  Synthetic Polynucleotide
taatacgactcactatagggccacatccagcttcttggataatagactaaaacagaggagattagtcatgtatccaagaaacctggcggcagcgcaaaagatg

SEQ ID NO: 65563 - DNA, 103 bp, Artificial Sequence
  Synthetic Polynucleotide
taatacgactcactatagggatctcccacatccagcttcttggataatagaacagaggagactattaatgaagaagctgaacctggcggcagcgcaaaagatg

SEQ ID NO: 65564 - DNA, 103 bp, Artificial Sequence
  Synthetic Polynucleotide
taatacgactcactatagggcatttatctcccacatccagcttcttggataacagaggagaatccaaatggctggatgtaacctggcggcagcgcaaaagatg

SEQ ID NO: 65565 - DNA, 103 bp, Artificial Sequence
  Synthetic Polynucleotide
taatacgactcactatagggatgcccatttatctcccacatccagcttctaacagaggagaagaagcatgatgtgggagaacctggcggcagcgcaaaagatg

SEQ ID NO: 65566 - DNA, 103 bp, Artificial Sequence
  Synthetic Polynucleotide
taatacgactcactatagggaaaacatgcccatttatctcccacatccagaacagaggagactggatatgggagataaaaacctggcggcagcgcaaaagatg

SEQ ID NO: 65567 - DNA, 103 bp, Artificial Sequence
  Synthetic Polynucleotide
taatacgactcactatagggttaggaaaacatgcccatttatctcccacaaacagaggagatgtgggatgtaaatgggcaacctggcggcagcgcaaaagatg

SEQ ID NO: 65568 - DNA, 103 bp, Artificial Sequence
  Synthetic Polynucleotide
taatacgactcactatagggtttcgttaggaaaacatgcccatttatctcaacagaggagagagataatggggcatgttaacctggcggcagcgcaaaagatg

SEQ ID NO: 65569 - DNA, 103 bp, Artificial Sequence
  Synthetic Polynucleotide
taatacgactcactatagggttttatttcgttaggaaaacatgcccatttaacagaggagaaaatggatgtgttttcctaacctggcggcagcgcaaaagatg

SEQ ID NO: 65570 - DNA, 103 bp, Artificial Sequence
  Synthetic Polynucleotide
taatacgactcactatagggactaagaccgtgaacattaaatgtataataaacagaggagatattatatgtttaatgttaacctggcggcagcgcaaaagatg

SEQ ID NO: 65571 - DNA, 103 bp, Artificial Sequence
  Synthetic Polynucleotide
taatacgactcactatagggcgatgattatttttaacaaaataacataaaaacagaggagatttatgatgttttgttaaaacctggcggcagcgcaaaagatg

SEQ ID NO: 65572 - DNA, 103 bp, Artificial Sequence
  Synthetic Polynucleotide
taatacgactcactatagggttatattttatttcgttaggaaaacatgccaacagaggagaggcatgatgtcctaacgaaacctggcggcagcgcaaaagatg

SEQ ID NO: 65573 - DNA, 103 bp, Artificial Sequence
  Synthetic Polynucleotide
taatacgactcactatagggatattttatattttatttcgttaggaaaacaacagaggagagttttcatgacgaaataaaacctggcggcagcgcaaaagatg

SEQ ID NO: 65574 - DNA, 103 bp, Artificial Sequence
  Synthetic Polynucleotide
taatacgactcactatagggttccaatattttatattttatttcgttaggaacagaggagacctaacatgataaaatataacctggcggcagcgcaaaagatg

SEQ ID NO: 65575 - DNA, 103 bp, Artificial Sequence
  Synthetic Polynucleotide
taatacgactcactatagggaagttttccaatattttatattttatttcgaacagaggagacgaaatatgatataaaataacctggcggcagcgcaaaagatg

SEQ ID NO: 65576 - DNA, 103 bp, Artificial Sequence
  Synthetic Polynucleotide
taatacgactcactatagggcgttaaagttttccaatattttatattttaaacagaggagataaaatatgaaatattggaacctggcggcagcgcaaaagatg

SEQ ID NO: 65577 - DNA, 103 bp, Artificial Sequence
  Synthetic Polynucleotide
taatacgactcactataggggttatcgttaaagttttccaatattttataaacagaggagatataaaatgttggaaaacaacctggcggcagcgcaaaagatg

SEQ ID NO: 65578 - DNA, 103 bp, Artificial Sequence
  Synthetic Polynucleotide
taatacgactcactatagggagttcgttatcgttaaagttttccaatattaacagaggagaaatattatgaaactttaaaacctggcggcagcgcaaaagatg

SEQ ID NO: 65579 - DNA, 103 bp, Artificial Sequence
  Synthetic Polynucleotide
taatacgactcactatagggtcgatagttcgttatcgttaaagttttccaaacagaggagatggaaaatgttaacgataaacctggcggcagcgcaaaagatg

SEQ ID NO: 65580 - DNA, 103 bp, Artificial Sequence
  Synthetic Polynucleotide
taatacgactcactatagggatatgtcgatagttcgttatcgttaaagttaacagaggagaaactttatggataacgaaaacctggcggcagcgcaaaagatg

SEQ ID NO: 65581 - DNA, 103 bp, Artificial Sequence
  Synthetic Polynucleotide
taatacgactcactatagggtttagatatgtcgatagttcgttatcgttaaacagaggagataacgaatgcgaactatcaacctggcggcagcgcaaaagatg

SEQ ID NO: 65582 - DNA, 103 bp, Artificial Sequence
  Synthetic Polynucleotide
taatacgactcactataggggtattcgatgattatttttaacaaaataacaacagaggagagttattatgttaaaaataaacctggcggcagcgcaaaagatg

SEQ ID NO: 65583 - DNA, 103 bp, Artificial Sequence
  Synthetic Polynucleotide
taatacgactcactatagggagatttttagatatgtcgatagttcgttataacagaggagaataacgatgtatcgacataacctggcggcagcgcaaaagatg

SEQ ID NO: 65584 - DNA, 103 bp, Artificial Sequence
  Synthetic Polynucleotide
taatacgactcactatagggttataagatttttagatatgtcgatagttcaacagaggagagaactaatgacatatctaaacctggcggcagcgcaaaagatg

SEQ ID NO: 65585 - DNA, 103 bp, Artificial Sequence
  Synthetic Polynucleotide
taatacgactcactatagggagtgtttataagatttttagatatgtcgataacagaggagaatcgacatgtctaaaaataacctggcggcagcgcaaaagatg

SEQ ID NO: 65586 - DNA, 103 bp, Artificial Sequence
  Synthetic Polynucleotide
taatacgactcactatagggttaatagtgtttataagatttttagatatgaacagaggagacatatcatgaaatcttataacctggcggcagcgcaaaagatg

SEQ ID NO: 65587 - DNA, 103 bp, Artificial Sequence
  Synthetic Polynucleotide
taatacgactcactatagggatattttaatagtgtttataagatttttagaacagaggagactaaaaatgttataaacaaacctggcggcagcgcaaaagatg

SEQ ID NO: 65588 - DNA, 103 bp, Artificial Sequence
  Synthetic Polynucleotide
taatacgactcactataggggttttatattttaatagtgtttataagattaacagaggagaaatcttatgaacactattaacctggcggcagcgcaaaagatg

SEQ ID NO: 65589 - DNA, 103 bp, Artificial Sequence
  Synthetic Polynucleotide
taatacgactcactatagggcttaggttttatattttaatagtgtttataaacagaggagatataaaatgtattaaaataacctggcggcagcgcaaaagatg

SEQ ID NO: 65590 - DNA, 103 bp, Artificial Sequence
  Synthetic Polynucleotide
taatacgactcactatagggtcctacttaggttttatattttaatagtgtaacagaggagaacactaatgaaatataaaaacctggcggcagcgcaaaagatg

SEQ ID NO: 65591 - DNA, 103 bp, Artificial Sequence
  Synthetic Polynucleotide
taatacgactcactatagggttttatcctacttaggttttatattttaataacagaggagaattaaaatgtaaaacctaaacctggcggcagcgcaaaagatg

SEQ ID NO: 65592 - DNA, 103 bp, Artificial Sequence
  Synthetic Polynucleotide
taatacgactcactatagggatgtgttttatcctacttaggttttatattaacagaggagaaatataatgcctaagtagaacctggcggcagcgcaaaagatg

SEQ ID NO: 65593 - DNA, 103 bp, Artificial Sequence
  Synthetic Polynucleotide
taatacgactcactatagggacaaagtattcgatgattatttttaacaaaaacagaggagatttgttatgaataatcataacctggcggcagcgcaaaagatg

SEQ ID NO: 65594 - DNA, 103 bp, Artificial Sequence
  Synthetic Polynucleotide
taatacgactcactatagggatgtaatgtgttttatcctacttaggttttaacagaggagaaaaaccatggtaggataaaacctggcggcagcgcaaaagatg

SEQ ID NO: 65595 - DNA, 103 bp, Artificial Sequence
  Synthetic Polynucleotide
taatacgactcactatagggcaatgatgtaatgtgttttatcctacttagaacagaggagactaagtatgataaaacacaacctggcggcagcgcaaaagatg

SEQ ID NO: 65596 - DNA, 103 bp, Artificial Sequence
  Synthetic Polynucleotide
taatacgactcactatagggggaaacaatgatgtaatgtgttttatcctaaacagaggagataggatatgacacattacaacctggcggcagcgcaaaagatg

SEQ ID NO: 65597 - DNA, 103 bp, Artificial Sequence
  Synthetic Polynucleotide
taatacgactcactatagggtaaaaggaaacaatgatgtaatgtgttttaaacagaggagataaaacatgttacatcataacctggcggcagcgcaaaagatg

SEQ ID NO: 65598 - DNA, 103 bp, Artificial Sequence
  Synthetic Polynucleotide
taatacgactcactatagggagcaataaaaggaaacaatgatgtaatgtgaacagaggagacacattatgtcattgtttaacctggcggcagcgcaaaagatg

SEQ ID NO: 65599 - DNA, 103 bp, Artificial Sequence
  Synthetic Polynucleotide
taatacgactcactatagggtgttaagcaataaaaggaaacaatgatgtaaacagaggagatacatcatggtttcctttaacctggcggcagcgcaaaagatg

SEQ ID NO: 65600 - DNA, 103 bp, Artificial Sequence
  Synthetic Polynucleotide
taatacgactcactatagggtacactgttaagcaataaaaggaaacaatgaacagaggagacattgtatgcttttattgaacctggcggcagcgcaaaagatg

SEQ ID NO: 65601 - DNA, 103 bp, Artificial Sequence
  Synthetic Polynucleotide
taatacgactcactatagggtagtatacactgttaagcaataaaaggaaaaacagaggagatttcctatgattgcttaaaacctggcggcagcgcaaaagatg

SEQ ID NO: 65602 - DNA, 103 bp, Artificial Sequence
  Synthetic Polynucleotide
taatacgactcactatagggaaaaatagtatacactgttaagcaataaaaaacagaggagattttatatgttaacagtgaacctggcggcagcgcaaaagatg

SEQ ID NO: 65603 - DNA, 103 bp, Artificial Sequence
  Synthetic Polynucleotide
taatacgactcactataggggtgttaaaaatagtatacactgttaagcaaaacagaggagattgcttatgagtgtatacaacctggcggcagcgcaaaagatg

SEQ ID NO: 65604 - DNA, 103 bp, Artificial Sequence
  Synthetic Polynucleotide
taatacgactcactatagggatcttacaaagtattcgatgattatttttaaacagaggagataaaaaatgtcatcgaataacctggcggcagcgcaaaagatg

SEQ ID NO: 65605 - DNA, 103 bp, Artificial Sequence
  Synthetic Polynucleotide
taatacgactcactatagggtatgagtgttaaaaatagtatacactgttaaacagaggagataacagatgatactatttaacctggcggcagcgcaaaagatg

SEQ ID NO: 65606 - DNA, 103 bp, Artificial Sequence
  Synthetic Polynucleotide
taatacgactcactatagggttatttatgagtgttaaaaatagtatacacaacagaggagagtgtatatgatttttaacaacctggcggcagcgcaaaagatg

SEQ ID NO: 65607 - DNA, 103 bp, Artificial Sequence
  Synthetic Polynucleotide
taatacgactcactatagggcatttttatttatgagtgttaaaaatagtaaacagaggagatactatatgtaacactcaaacctggcggcagcgcaaaagatg

SEQ ID NO: 65608 - DNA, 103 bp, Artificial Sequence
  Synthetic Polynucleotide
taatacgactcactataggggttttcatttttatttatgagtgttaaaaaaacagaggagatttttaatgctcataaataacctggcggcagcgcaaaagatg

SEQ ID NO: 65609 - DNA, 103 bp, Artificial Sequence
  Synthetic Polynucleotide
taatacgactcactatagggaaatcgttttcatttttatttatgagtgttaacagaggagaaacactatgaaataaaaaaacctggcggcagcgcaaaagatg

SEQ ID NO: 65610 - DNA, 103 bp, Artificial Sequence
  Synthetic Polynucleotide
taatacgactcactatagggaacggaaatcgttttcatttttatttatgaaacagaggagatcataaatgaaaatgaaaaacctggcggcagcgcaaaagatg

SEQ ID NO: 65611 - DNA, 103 bp, Artificial Sequence
  Synthetic Polynucleotide
taatacgactcactataggggtaacaacggaaatcgttttcatttttattaacagaggagaaataaaatggaaaacgataacctggcggcagcgcaaaagatg

SEQ ID NO: 65612 - DNA, 103 bp, Artificial Sequence
  Synthetic Polynucleotide
taatacgactcactatagggacaacgtaacaacggaaatcgttttcatttaacagaggagaaaatgaatgcgatttccgaacctggcggcagcgcaaaagatg

SEQ ID NO: 65613 - DNA, 103 bp, Artificial Sequence
  Synthetic Polynucleotide
taatacgactcactataggggcataacaacgtaacaacggaaatcgttttaacagaggagaaaaacgatgtccgttgttaacctggcggcagcgcaaaagatg

SEQ ID NO: 65614 - DNA, 103 bp, Artificial Sequence
  Synthetic Polynucleotide
taatacgactcactatagggagtacgcataacaacgtaacaacggaaatcaacagaggagagatttcatgtgttacgttaacctggcggcagcgcaaaagatg

SEQ ID NO: 65615 - DNA, 103 bp, Artificial Sequence
  Synthetic Polynucleotide
taatacgactcactatagggggagtatcttacaaagtattcgatgattataacagaggagaataatcatggaatactttaacctggcggcagcgcaaaagatg

SEQ ID NO: 65616 - DNA, 103 bp, Artificial Sequence
  Synthetic Polynucleotide
taatacgactcactatagggcaggtagtacgcataacaacgtaacaacggaacagaggagaccgttgatgcgttgttataacctggcggcagcgcaaaagatg

SEQ ID NO: 65617 - DNA, 103 bp, Artificial Sequence
  Synthetic Polynucleotide
taatacgactcactatagggaaccgcaggtagtacgcataacaacgtaacaacagaggagagttacgatgttatgcgtaaacctggcggcagcgcaaaagatg

SEQ ID NO: 65618 - DNA, 103 bp, Artificial Sequence
  Synthetic Polynucleotide
taatacgactcactatagggtaaacaaccgcaggtagtacgcataacaacaacagaggagagttgttatgcgtactaccaacctggcggcagcgcaaaagatg

SEQ ID NO: 65619 - DNA, 103 bp, Artificial Sequence
  Synthetic Polynucleotide
taatacgactcactatagggttgaataaacaaccgcaggtagtacgcataaacagaggagatatgcgatgtacctgcggaacctggcggcagcgcaaaagatg

SEQ ID NO: 65620 - DNA, 103 bp, Artificial Sequence
  Synthetic Polynucleotide
taatacgactcactatagggacatgttgaataaacaaccgcaggtagtacaacagaggagagtactaatggcggttgttaacctggcggcagcgcaaaagatg

SEQ ID NO: 65621 - DNA, 103 bp, Artificial Sequence
  Synthetic Polynucleotide
taatacgactcactatagggacagtacatgttgaataaacaaccgcaggtaacagaggagaacctgcatgtgtttattcaacctggcggcagcgcaaaagatg

SEQ ID NO: 65622 - DNA, 103 bp, Artificial Sequence
  Synthetic Polynucleotide
taatacgactcactatagggtgggtacagtacatgttgaataaacaaccgaacagaggagacggttgatgattcaacataacctggcggcagcgcaaaagatg

SEQ ID NO: 65623 - DNA, 103 bp, Artificial Sequence
  Synthetic Polynucleotide
taatacgactcactatagggcatagtgggtacagtacatgttgaataaacaacagaggagagtttatatgacatgtactaacctggcggcagcgcaaaagatg

SEQ ID NO: 65624 - DNA, 103 bp, Artificial Sequence
  Synthetic Polynucleotide
taatacgactcactatagggttattcatagtgggtacagtacatgttgaaaacagaggagattcaacatgtactgtaccaacctggcggcagcgcaaaagatg

SEQ ID NO: 65625 - DNA, 103 bp, Artificial Sequence
  Synthetic Polynucleotide
taatacgactcactatagggtagcgttattcatagtgggtacagtacatgaacagaggagacatgtaatgtacccactaaacctggcggcagcgcaaaagatg

SEQ ID NO: 65626 - DNA, 103 bp, Artificial Sequence
  Synthetic Polynucleotide
taatacgactcactatagggatgaaggagtatcttacaaagtattcgatgaacagaggagacatcgaatgctttgtaagaacctggcggcagcgcaaaagatg

SEQ ID NO: 65627 - DNA, 103 bp, Artificial Sequence
  Synthetic Polynucleotide
taatacgactcactatagggtaatttagcgttattcatagtgggtacagtaacagaggagaactgtaatgactatgaataacctggcggcagcgcaaaagatg

SEQ ID NO: 65628 - DNA, 103 bp, Artificial Sequence
  Synthetic Polynucleotide
taatacgactcactataggggacgttaatttagcgttattcatagtgggtaacagaggagaacccacatggaataacgcaacctggcggcagcgcaaaagatg

SEQ ID NO: 65629 - DNA, 103 bp, Artificial Sequence
  Synthetic Polynucleotide
taatacgactcactatagggcggtagacgttaatttagcgttattcatagaacagaggagactatgaatgacgctaaataacctggcggcagcgcaaaagatg

SEQ ID NO: 65630 - DNA, 103 bp, Artificial Sequence
  Synthetic Polynucleotide
taatacgactcactatagggtgtttcggtagacgttaatttagcgttattaacagaggagaaataacatgaaattaacgaacctggcggcagcgcaaaagatg

SEQ ID NO: 65631 - DNA, 103 bp, Artificial Sequence
  Synthetic Polynucleotide
taatacgactcactatagggaacgatgtttcggtagacgttaatttagcgaacagaggagacgctaaatgaacgtctacaacctggcggcagcgcaaaagatg

SEQ ID NO: 65632 - DNA, 103 bp, Artificial Sequence
  Synthetic Polynucleotide
taatacgactcactatagggcattaaacgatgtttcggtagacgttaattaacagaggagaaattaaatgctaccgaaaaacctggcggcagcgcaaaagatg

SEQ ID NO: 65633 - DNA, 103 bp, Artificial Sequence
  Synthetic Polynucleotide
taatacgactcactatagggtttatcattaaacgatgtttcggtagacgtaacagaggagaacgtctatggaaacatcgaacctggcggcagcgcaaaagatg

SEQ ID NO: 65634 - DNA, 103 bp, Artificial Sequence
  Synthetic Polynucleotide
taatacgactcactatagggttttgtttatcattaaacgatgtttcggtaaacagaggagataccgaatgatcgtttaaaacctggcggcagcgcaaaagatg

SEQ ID NO: 65635 - DNA, 103 bp, Artificial Sequence
  Synthetic Polynucleotide
taatacgactcactatagggtaactttttgtttatcattaaacgatgtttaacagaggagaaaacatatgttaatgataaacctggcggcagcgcaaaagatg

SEQ ID NO: 65636 - DNA, 103 bp, Artificial Sequence
  Synthetic Polynucleotide
taatacgactcactatagggaaatgtaactttttgtttatcattaaacgaaacagaggagatcgtttatggataaacaaaacctggcggcagcgcaaaagatg

SEQ ID NO: 65637 - DNA, 103 bp, Artificial Sequence
  Synthetic Polynucleotide
taatacgactcactatagggtgttcatgaaggagtatcttacaaagtattaacagaggagaaatactatgtaagatactaacctggcggcagcgcaaaagatg

SEQ ID NO: 65638 - DNA, 103 bp, Artificial Sequence
  Synthetic Polynucleotide
taatacgactcactatagggcatgtaaatgtaactttttgtttatcattaaacagaggagataatgaatgacaaaaagtaacctggcggcagcgcaaaagatg

SEQ ID NO: 65639 - DNA, 103 bp, Artificial Sequence
  Synthetic Polynucleotide
taatacgactcactatagggaatcacatgtaaatgtaactttttgtttataacagaggagaataaacatgaagttacataacctggcggcagcgcaaaagatg

SEQ ID NO: 65640 - DNA, 103 bp, Artificial Sequence
  Synthetic Polynucleotide
taatacgactcactatagggtcccgaatcacatgtaaatgtaactttttgaacagaggagacaaaaaatgacatttacaaacctggcggcagcgcaaaagatg

SEQ ID NO: 65641 - DNA, 103 bp, Artificial Sequence
  Synthetic Polynucleotide
taatacgactcactatagggtaatatcccgaatcacatgtaaatgtaactaacagaggagaagttacatgtacatgtgaaacctggcggcagcgcaaaagatg

SEQ ID NO: 65642 - DNA, 103 bp, Artificial Sequence
  Synthetic Polynucleotide
taatacgactcactatagggaagaataatatcccgaatcacatgtaaatgaacagaggagacatttaatggtgattcggaacctggcggcagcgcaaaagatg

SEQ ID NO: 65643 - DNA, 103 bp, Artificial Sequence
  Synthetic Polynucleotide
taatacgactcactatagggatccaaagaataatatcccgaatcacatgtaacagaggagaacatgtatgtcgggatataacctggcggcagcgcaaaagatg

SEQ ID NO: 65644 - DNA, 103 bp, Artificial Sequence
  Synthetic Polynucleotide
taatacgactcactatagggtttggatccaaagaataatatcccgaatcaaacagaggagatgattcatgatattattcaacctggcggcagcgcaaaagatg

SEQ ID NO: 65645 - DNA, 103 bp, Artificial Sequence
  Synthetic Polynucleotide
taatacgactcactatagggcagcatttggatccaaagaataatatcccgaacagaggagacgggatatgattctttggaacctggcggcagcgcaaaagatg

SEQ ID NO: 65646 - DNA, 103 bp, Artificial Sequence
  Synthetic Polynucleotide
taatacgactcactatagggacagacagcatttggatccaaagaataataaacagaggagatattatatgttggatccaaacctggcggcagcgcaaaagatg

SEQ ID NO: 65647 - DNA, 103 bp, Artificial Sequence
  Synthetic Polynucleotide
taatacgactcactataggggtttcacagacagcatttggatccaaagaaaacagaggagattctttatgtccaaatgcaacctggcggcagcgcaaaagatg

SEQ ID NO: 65648 - DNA, 103 bp, Artificial Sequence
  Synthetic Polynucleotide
taatacgactcactataggggattatgttcatgaaggagtatcttacaaaaacagaggagatttgtaatgtactccttcaacctggcggcagcgcaaaagatg

SEQ ID NO: 65649 - DNA, 103 bp, Artificial Sequence
  Synthetic Polynucleotide
taatacgactcactatagggtatctgtttcacagacagcatttggatccaaacagaggagatggatcatgatgctgtctaacctggcggcagcgcaaaagatg

SEQ ID NO: 65650 - DNA, 103 bp, Artificial Sequence
  Synthetic Polynucleotide
taatacgactcactatagggccatttatctgtttcacagacagcatttggaacagaggagaccaaatatggtctgtgaaaacctggcggcagcgcaaaagatg

SEQ ID NO: 65651 - DNA, 103 bp, Artificial Sequence
  Synthetic Polynucleotide
taatacgactcactatagggtatttccatttatctgtttcacagacagcaaacagaggagatgctgtatgtgaaacagaaacctggcggcagcgcaaaagatg

SEQ ID NO: 65652 - DNA, 103 bp, Artificial Sequence
  Synthetic Polynucleotide
taatacgactcactatagggtttcgtatttccatttatctgtttcacagaaacagaggagatctgtgatgcagataaataacctggcggcagcgcaaaagatg

SEQ ID NO: 65653 - DNA, 103 bp, Artificial Sequence
  Synthetic Polynucleotide
taatacgactcactatagggtggattttcgtatttccatttatctgtttcaacagaggagagaaacaatgaaatggaaaaacctggcggcagcgcaaaagatg

SEQ ID NO: 65654 - DNA, 103 bp, Artificial Sequence
  Synthetic Polynucleotide
taatacgactcactatagggttacatggattttcgtatttccatttatctaacagaggagaagataaatggaaatacgaaacctggcggcagcgcaaaagatg

SEQ ID NO: 65655 - DNA, 103 bp, Artificial Sequence
  Synthetic Polynucleotide
taatacgactcactatagggtttttttacatggattttcgtatttccattaacagaggagaaatggaatgacgaaaatcaacctggcggcagcgcaaaagatg

SEQ ID NO: 65656 - DNA, 103 bp, Artificial Sequence
  Synthetic Polynucleotide
taatacgactcactatagggacacatttttttacatggattttcgtatttaacagaggagaaaatacatgaatccatgtaacctggcggcagcgcaaaagatg

SEQ ID NO: 65657 - DNA, 103 bp, Artificial Sequence
  Synthetic Polynucleotide
taatacgactcactatagggactgtacacatttttttacatggattttcgaacagaggagacgaaaaatgatgtaaaaaaacctggcggcagcgcaaaagatg

SEQ ID NO: 65658 - DNA, 103 bp, Artificial Sequence
  Synthetic Polynucleotide
taatacgactcactatagggcagaaactgtacacatttttttacatggataacagaggagaatccatatgaaaaaatgtaacctggcggcagcgcaaaagatg

SEQ ID NO: 65659 - DNA, 103 bp, Artificial Sequence
  Synthetic Polynucleotide
taatacgactcactatagggtaactgattatgttcatgaaggagtatcttaacagaggagaaagataatgcttcatgaaaacctggcggcagcgcaaaagatg

SEQ ID NO: 65660 - DNA, 103 bp, Artificial Sequence
  Synthetic Polynucleotide
taatacgactcactatagggataatcagaaactgtacacatttttttacaaacagaggagatgtaaaatgatgtgtacaaacctggcggcagcgcaaaagatg

SEQ ID NO: 65661 - DNA, 103 bp, Artificial Sequence
  Synthetic Polynucleotide
taatacgactcactataggggagacataatcagaaactgtacacatttttaacagaggagaaaaaatatgtacagtttcaacctggcggcagcgcaaaagatg

SEQ ID NO: 65662 - DNA, 103 bp, Artificial Sequence
  Synthetic Polynucleotide
taatacgactcactataggggttcagagacataatcagaaactgtacacaaacagaggagatgtgtaatgtttctgattaacctggcggcagcgcaaaagatg

SEQ ID NO: 65663 - DNA, 103 bp, Artificial Sequence
  Synthetic Polynucleotide
taatacgactcactatagggatatagttcagagacataatcagaaactgtaacagaggagaacagttatggattatgtcaacctggcggcagcgcaaaagatg

SEQ ID NO: 65664 - DNA, 103 bp, Artificial Sequence
  Synthetic Polynucleotide
taatacgactcactatagggttattatatagttcagagacataatcagaaaacagaggagattctgaatgtgtctctgaaacctggcggcagcgcaaaagatg

SEQ ID NO: 65665 - DNA, 103 bp, Artificial Sequence
  Synthetic Polynucleotide
taatacgactcactataggggcggtttattatatagttcagagacataataacagaggagaattatgatgctgaactataacctggcggcagcgcaaaagatg

SEQ ID NO: 65666 - DNA, 103 bp, Artificial Sequence
  Synthetic Polynucleotide
taatacgactcactataggggtatagcggtttattatatagttcagagacaacagaggagagtctctatgctatataataacctggcggcagcgcaaaagatg

SEQ ID NO: 65667 - DNA, 103 bp, Artificial Sequence
  Synthetic Polynucleotide
taatacgactcactatagggacttcgtatagcggtttattatatagttcaaacagaggagatgaactatgtaataaaccaacctggcggcagcgcaaaagatg

SEQ ID NO: 65668 - DNA, 103 bp, Artificial Sequence
  Synthetic Polynucleotide
taatacgactcactatagggcatttacttcgtatagcggtttattatataaacagaggagatatataatgaaccgctataacctggcggcagcgcaaaagatg

SEQ ID NO: 65669 - DNA, 103 bp, Artificial Sequence
  Synthetic Polynucleotide
taatacgactcactataggggatggcatttacttcgtatagcggtttattaacagaggagaaataaaatgctatacgaaaacctggcggcagcgcaaaagatg

SEQ ID NO: 65670 - DNA, 103 bp, Artificial Sequence
  Synthetic Polynucleotide
taatacgactcactatagggttttgtaactgattatgttcatgaaggagtaacagaggagaactcctatgtgaacataaaacctggcggcagcgcaaaagatg

SEQ ID NO: 65671 - DNA, 103 bp, Artificial Sequence
  Synthetic Polynucleotide
taatacgactcactataggggttatgatggcatttacttcgtatagcggtaacagaggagaaccgctatgcgaagtaaaaacctggcggcagcgcaaaagatg

SEQ ID NO: 65672 - DNA, 103 bp, Artificial Sequence
  Synthetic Polynucleotide
taatacgactcactatagggttagtgttatgatggcatttacttcgtataaacagaggagatatacgatgtaaatgccaaacctggcggcagcgcaaaagatg

SEQ ID NO: 65673 - DNA, 103 bp, Artificial Sequence
  Synthetic Polynucleotide
taatacgactcactatagggacaaattagtgttatgatggcatttacttcaacagaggagagaagtaatggccatcataaacctggcggcagcgcaaaagatg

SEQ ID NO: 65674 - DNA, 103 bp, Artificial Sequence
  Synthetic Polynucleotide
taatacgactcactatagggtctttacaaattagtgttatgatggcatttaacagaggagaaaatgcatgcataacactaacctggcggcagcgcaaaagatg

SEQ ID NO: 65675 - DNA, 103 bp, Artificial Sequence
  Synthetic Polynucleotide
taatacgactcactatagggtttcgtctttacaaattagtgttatgatggaacagaggagaccatcaatgcactaatttaacctggcggcagcgcaaaagatg

SEQ ID NO: 65676 - DNA, 103 bp, Artificial Sequence
  Synthetic Polynucleotide
taatacgactcactatagggttttgtttcgtctttacaaattagtgttataacagaggagaataacaatgatttgtaaaaacctggcggcagcgcaaaagatg

SEQ ID NO: 65677 - DNA, 103 bp, Artificial Sequence
  Synthetic Polynucleotide
taatacgactcactatagggaaatattttgtttcgtctttacaaattagtaacagaggagaactaatatgtaaagacgaaacctggcggcagcgcaaaagatg

SEQ ID NO: 65678 - DNA, 103 bp, Artificial Sequence
  Synthetic Polynucleotide
taatacgactcactatagggaacgaaaatattttgtttcgtctttacaaaaacagaggagatttgtaatgacgaaacaaaacctggcggcagcgcaaaagatg

SEQ ID NO: 65679 - DNA, 103 bp, Artificial Sequence
  Synthetic Polynucleotide
taatacgactcactatagggttcacaacgaaaatattttgtttcgtctttaacagaggagaaaagacatgacaaaatataacctggcggcagcgcaaaagatg

SEQ ID NO: 65680 - DNA, 103 bp, Artificial Sequence
  Synthetic Polynucleotide
taatacgactcactatagggttttcttcacaacgaaaatattttgtttcgaacagaggagacgaaacatgatattttcgaacctggcggcagcgcaaaagatg

SEQ ID NO: 65681 - DNA, 103 bp, Artificial Sequence
  Synthetic Polynucleotide
taatacgactcactatagggaaaatactaagaccgtgaacattaaatgtaaacagaggagatacattatgtgttcacggaacctggcggcagcgcaaaagatg

SEQ ID NO: 65682 - DNA, 103 bp, Artificial Sequence
  Synthetic Polynucleotide
taatacgactcactatagggaaacgttttgtaactgattatgttcatgaaaacagaggagattcatgatgataatcagtaacctggcggcagcgcaaaagatg

SEQ ID NO: 65683 - DNA, 103 bp, Artificial Sequence
  Synthetic Polynucleotide
taatacgactcactatagggcatttttttcttcacaacgaaaatattttgaacagaggagacaaaatatgttcgttgtgaacctggcggcagcgcaaaagatg

SEQ ID NO: 65684 - DNA, 103 bp, Artificial Sequence
  Synthetic Polynucleotide
taatacgactcactatagggatttccatttttttcttcacaacgaaaataaacagaggagatattttatgtgtgaagaaaacctggcggcagcgcaaaagatg

SEQ ID NO: 65685 - DNA, 103 bp, Artificial Sequence
  Synthetic Polynucleotide
taatacgactcactataggggaagtatttccatttttttcttcacaacgaaacagaggagatcgttgatgagaaaaaaaaacctggcggcagcgcaaaagatg

SEQ ID NO: 65686 - DNA, 103 bp, Artificial Sequence
  Synthetic Polynucleotide
taatacgactcactatagggtccaagaagtatttccatttttttcttcacaacagaggagagtgaagatgaaaatggaaaacctggcggcagcgcaaaagatg

SEQ ID NO: 65687 - DNA, 103 bp, Artificial Sequence
  Synthetic Polynucleotide
taatacgactcactatagggatcattccaagaagtatttccatttttttcaacagaggagagaaaaaatgggaaatactaacctggcggcagcgcaaaagatg

SEQ ID NO: 65688 - DNA, 103 bp, Artificial Sequence
  Synthetic Polynucleotide
taatacgactcactatagggacagtatcattccaagaagtatttccatttaacagaggagaaaatggatgtacttcttgaacctggcggcagcgcaaaagatg

SEQ ID NO: 65689 - DNA, 103 bp, Artificial Sequence
  Synthetic Polynucleotide
taatacgactcactatagggacgtaacagtatcattccaagaagtatttcaacagaggagagaaataatgcttggaatgaacctggcggcagcgcaaaagatg

SEQ ID NO: 65690 - DNA, 103 bp, Artificial Sequence
  Synthetic Polynucleotide
taatacgactcactatagggaggacacgtaacagtatcattccaagaagtaacagaggagaacttctatgaatgatactaacctggcggcagcgcaaaagatg

SEQ ID NO: 65691 - DNA, 103 bp, Artificial Sequence
  Synthetic Polynucleotide
taatacgactcactataggggcattaggacacgtaacagtatcattccaaaacagaggagattggaaatgtactgttacaacctggcggcagcgcaaaagatg

SEQ ID NO: 65692 - DNA, 103 bp, Artificial Sequence
  Synthetic Polynucleotide
taatacgactcactatagggattccgcattaggacacgtaacagtatcataacagaggagaatgataatgttacgtgtcaacctggcggcagcgcaaaagatg

SEQ ID NO: 65693 - DNA, 103 bp, Artificial Sequence
  Synthetic Polynucleotide
taatacgactcactatagggcatataaacgttttgtaactgattatgttcaacagaggagagaacatatgcagttacaaaacctggcggcagcgcaaaagatg

SEQ ID NO: 65694 - DNA, 103 bp, Artificial Sequence
  Synthetic Polynucleotide
taatacgactcactatagggttgacattccgcattaggacacgtaacagtaacagaggagaactgttatgtgtcctaataacctggcggcagcgcaaaagatg

SEQ ID NO: 65695 - DNA, 103 bp, Artificial Sequence
  Synthetic Polynucleotide
taatacgactcactatagggagagattgacattccgcattaggacacgtaaacagaggagatacgtgatgtaatgcggaaacctggcggcagcgcaaaagatg

SEQ ID NO: 65696 - DNA, 103 bp, Artificial Sequence
  Synthetic Polynucleotide
taatacgactcactatagggattgaagagattgacattccgcattaggacaacagaggagagtcctaatgcggaatgtcaacctggcggcagcgcaaaagatg

SEQ ID NO: 65697 - DNA, 103 bp, Artificial Sequence
  Synthetic Polynucleotide
taatacgactcactatagggatctaattgaagagattgacattccgcattaacagaggagaaatgcgatgtgtcaatctaacctggcggcagcgcaaaagatg

SEQ ID NO: 65698 - DNA, 103 bp, Artificial Sequence
  Synthetic Polynucleotide
taatacgactcactatagggccgtgatctaattgaagagattgacattccaacagaggagaggaatgatgatctcttcaaacctggcggcagcgcaaaagatg

SEQ ID NO: 65699 - DNA, 103 bp, Artificial Sequence
  Synthetic Polynucleotide
taatacgactcactatagggacgatccgtgatctaattgaagagattgacaacagaggagagtcaatatgttcaattagaacctggcggcagcgcaaaagatg

SEQ ID NO: 65700 - DNA, 103 bp, Artificial Sequence
  Synthetic Polynucleotide
taatacgactcactatagggttgacacgatccgtgatctaattgaagagaaacagaggagatctcttatgttagatcacaacctggcggcagcgcaaaagatg

SEQ ID NO: 65701 - DNA, 103 bp, Artificial Sequence
  Synthetic Polynucleotide
taatacgactcactatagggactggttgacacgatccgtgatctaattgaaacagaggagatcaattatgtcacggatcaacctggcggcagcgcaaaagatg

SEQ ID NO: 65702 - DNA, 103 bp, Artificial Sequence
  Synthetic Polynucleotide
taatacgactcactatagggctttaactggttgacacgatccgtgatctaaacagaggagatagatcatggatcgtgtcaacctggcggcagcgcaaaagatg

SEQ ID NO: 65703 - DNA, 103 bp, Artificial Sequence
  Synthetic Polynucleotide
taatacgactcactatagggtttttctttaactggttgacacgatccgtgaacagaggagacacggaatgtgtcaaccaaacctggcggcagcgcaaaagatg

SEQ ID NO: 65704 - DNA, 103 bp, Artificial Sequence
  Synthetic Polynucleotide
taatacgactcactatagggtacttcatataaacgttttgtaactgattaaacagaggagataatcaatgacaaaacgtaacctggcggcagcgcaaaagatg

SEQ ID NO: 65705 - DNA, 103 bp, Artificial Sequence
  Synthetic Polynucleotide
taatacgactcactataggggagtatttttctttaactggttgacacgataacagaggagaatcgtgatgaccagttaaaacctggcggcagcgcaaaagatg

SEQ ID NO: 65706 - DNA, 103 bp, Artificial Sequence
  Synthetic Polynucleotide
taatacgactcactatagggcaaatgagtatttttctttaactggttgacaacagaggagagtcaacatgttaaagaaaaacctggcggcagcgcaaaagatg

SEQ ID NO: 65707 - DNA, 103 bp, Artificial Sequence
  Synthetic Polynucleotide
taatacgactcactatagggttccccaaatgagtatttttctttaactggaacagaggagaccagttatggaaaaatacaacctggcggcagcgcaaaagatg

SEQ ID NO: 65708 - DNA, 103 bp, Artificial Sequence
  Synthetic Polynucleotide
taatacgactcactatagggatatgttccccaaatgagtatttttctttaaacagaggagataaagaatgatactcattaacctggcggcagcgcaaaagatg

SEQ ID NO: 65709 - DNA, 103 bp, Artificial Sequence
  Synthetic Polynucleotide
taatacgactcactatagggtagttatatgttccccaaatgagtatttttaacagaggagaaaaaatatgcatttggggaacctggcggcagcgcaaaagatg

SEQ ID NO: 65710 - DNA, 103 bp, Artificial Sequence
  Synthetic Polynucleotide
taatacgactcactataggggttgatagttatatgttccccaaatgagtaaacagaggagatactcaatgggggaacataacctggcggcagcgcaaaagatg

SEQ ID NO: 65711 - DNA, 103 bp, Artificial Sequence
  Synthetic Polynucleotide
taatacgactcactatagggtcacagttgatagttatatgttccccaaataacagaggagaatttggatgacatataacaacctggcggcagcgcaaaagatg

SEQ ID NO: 65712 - DNA, 103 bp, Artificial Sequence
  Synthetic Polynucleotide
taatacgactcactatagggcaacatcacagttgatagttatatgttcccaacagaggagagggaacatgtaactatcaaacctggcggcagcgcaaaagatg

SEQ ID NO: 65713 - DNA, 103 bp, Artificial Sequence
  Synthetic Polynucleotide
taatacgactcactatagggatatccaacatcacagttgatagttatatgaacagaggagacatataatgatcaactgtaacctggcggcagcgcaaaagatg

SEQ ID NO: 65714 - DNA, 103 bp, Artificial Sequence
  Synthetic Polynucleotide
taatacgactcactatagggacctcatatccaacatcacagttgatagttaacagaggagaaactatatgctgtgatgtaacctggcggcagcgcaaaagatg

SEQ ID NO: 65715 - DNA, 103 bp, Artificial Sequence
  Synthetic Polynucleotide
taatacgactcactatagggtactttacttcatataaacgttttgtaactaacagaggagaagttacatgacgtttataaacctggcggcagcgcaaaagatg

SEQ ID NO: 65716 - DNA, 103 bp, Artificial Sequence
  Synthetic Polynucleotide
taatacgactcactatagggcaataacctcatatccaacatcacagttgaaacagaggagatcaactatgatgttggataacctggcggcagcgcaaaagatg

SEQ ID NO: 65717 - DNA, 103 bp, Artificial Sequence
  Synthetic Polynucleotide
taatacgactcactatagggagcaccaataacctcatatccaacatcacaaacagaggagatgtgatatgggatatgagaacctggcggcagcgcaaaagatg

SEQ ID NO: 65718 - DNA, 103 bp, Artificial Sequence
  Synthetic Polynucleotide
taatacgactcactatagggtacgaagcaccaataacctcatatccaacaaacagaggagatgttggatgtgaggttataacctggcggcagcgcaaaagatg

SEQ ID NO: 65719 - DNA, 103 bp, Artificial Sequence
  Synthetic Polynucleotide
taatacgactcactatagggttatgtacgaagcaccaataacctcatatcaacagaggagagatatgatgttattggtgaacctggcggcagcgcaaaagatg

SEQ ID NO: 65720 - DNA, 103 bp, Artificial Sequence
  Synthetic Polynucleotide
taatacgactcactatagggacaagttatgtacgaagcaccaataacctcaacagaggagagaggttatgggtgcttcgaacctggcggcagcgcaaaagatg

SEQ ID NO: 65721 - DNA, 103 bp, Artificial Sequence
  Synthetic Polynucleotide
taatacgactcactataggggctgtacaagttatgtacgaagcaccaataaacagaggagatattggatgttcgtacataacctggcggcagcgcaaaagatg

SEQ ID NO: 65722 - DNA, 103 bp, Artificial Sequence
  Synthetic Polynucleotide
taatacgactcactatagggaattagctgtacaagttatgtacgaagcacaacagaggagagtgcttatgacataacttaacctggcggcagcgcaaaagatg

SEQ ID NO: 65723 - DNA, 103 bp, Artificial Sequence
  Synthetic Polynucleotide
taatacgactcactatagggccaagaattagctgtacaagttatgtacgaaacagaggagatcgtacatgacttgtacaaacctggcggcagcgcaaaagatg

SEQ ID NO: 65724 - DNA, 103 bp, Artificial Sequence
  Synthetic Polynucleotide
taatacgactcactatagggacattccaagaattagctgtacaagttatgaacagaggagacataacatgtacagctaaaacctggcggcagcgcaaaagatg

SEQ ID NO: 65725 - DNA, 103 bp, Artificial Sequence
  Synthetic Polynucleotide
taatacgactcactataggggaataacattccaagaattagctgtacaagaacagaggagacttgtaatgctaattcttaacctggcggcagcgcaaaagatg

SEQ ID NO: 65726 - DNA, 103 bp, Artificial Sequence
  Synthetic Polynucleotide
taatacgactcactataggggtagatactttacttcatataaacgttttgaacagaggagacaaaacatgtatatgaagaacctggcggcagcgcaaaagatg

SEQ ID NO: 65727 - DNA, 103 bp, Artificial Sequence
  Synthetic Polynucleotide
taatacgactcactatagggtgatggaataacattccaagaattagctgtaacagaggagaacagctatgtcttggaataacctggcggcagcgcaaaagatg

SEQ ID NO: 65728 - DNA, 103 bp, Artificial Sequence
  Synthetic Polynucleotide
taatacgactcactatagggtgacatgatggaataacattccaagaattaaacagaggagataattcatggaatgttataacctggcggcagcgcaaaagatg

SEQ ID NO: 65729 - DNA, 103 bp, Artificial Sequence
  Synthetic Polynucleotide
taatacgactcactatagggtttgttgacatgatggaataacattccaagaacagaggagacttggaatgttattccataacctggcggcagcgcaaaagatg

SEQ ID NO: 65730 - DNA, 103 bp, Artificial Sequence
  Synthetic Polynucleotide
taatacgactcactatagggacatttttgttgacatgatggaataacattaacagaggagaaatgttatgccatcatgtaacctggcggcagcgcaaaagatg

SEQ ID NO: 65731 - DNA, 103 bp, Artificial Sequence
  Synthetic Polynucleotide
taatacgactcactatagggatatcacatttttgttgacatgatggaataaacagaggagatattccatgatgtcaacaaacctggcggcagcgcaaaagatg

SEQ ID NO: 65732 - DNA, 103 bp, Artificial Sequence
  Synthetic Polynucleotide
taatacgactcactatagggacggtatatcacatttttgttgacatgatgaacagaggagacatcatatgaacaaaaataacctggcggcagcgcaaaagatg

SEQ ID NO: 65733 - DNA, 103 bp, Artificial Sequence
  Synthetic Polynucleotide
taatacgactcactatagggtagagacggtatatcacatttttgttgacaaacagaggagatgtcaaatgaaatgtgataacctggcggcagcgcaaaagatg

SEQ ID NO: 65734 - DNA, 103 bp, Artificial Sequence
  Synthetic Polynucleotide
taatacgactcactatagggttagatagagacggtatatcacatttttgtaacagaggagaacaaaaatgtgatataccaacctggcggcagcgcaaaagatg

SEQ ID NO: 65735 - DNA, 103 bp, Artificial Sequence
  Synthetic Polynucleotide
taatacgactcactatagggatccattagatagagacggtatatcacattaacagaggagaaatgtgatgtaccgtctcaacctggcggcagcgcaaaagatg

SEQ ID NO: 65736 - DNA, 103 bp, Artificial Sequence
  Synthetic Polynucleotide
taatacgactcactatagggaattaatccattagatagagacggtatatcaacagaggagagatataatgtctctatctaacctggcggcagcgcaaaagatg

SEQ ID NO: 65737 - DNA, 103 bp, Artificial Sequence
  Synthetic Polynucleotide
taatacgactcactatagggaaatcgtagatactttacttcatataaacgaacagaggagacgtttaatggaagtaaagaacctggcggcagcgcaaaagatg

SEQ ID NO: 65738 - DNA, 103 bp, Artificial Sequence
  Synthetic Polynucleotide
taatacgactcactatagggccggaaattaatccattagatagagacggtaacagaggagaaccgtcatgatctaatggaacctggcggcagcgcaaaagatg

SEQ ID NO: 65739 - DNA, 103 bp, Artificial Sequence
  Synthetic Polynucleotide
taatacgactcactatagggtagatccggaaattaatccattagatagagaacagaggagactctatatgatggattaaaacctggcggcagcgcaaaagatg

SEQ ID NO: 65740 - DNA, 103 bp, Artificial Sequence
  Synthetic Polynucleotide
taatacgactcactatagggaaatgtagatccggaaattaatccattagaaacagaggagatctaatatgttaatttccaacctggcggcagcgcaaaagatg

SEQ ID NO: 65741 - DNA, 103 bp, Artificial Sequence
  Synthetic Polynucleotide
taatacgactcactatagggatagaaaatgtagatccggaaattaatccaaacagaggagatggattatgttccggatcaacctggcggcagcgcaaaagatg

SEQ ID NO: 65742 - DNA, 103 bp, Artificial Sequence
  Synthetic Polynucleotide
taatacgactcactatagggcaccgatagaaaatgtagatccggaaattaaacagaggagataatttatggatctacataacctggcggcagcgcaaaagatg

SEQ ID NO: 65743 - DNA, 103 bp, Artificial Sequence
  Synthetic Polynucleotide
taatacgactcactatagggaacgccaccgatagaaaatgtagatccggaaacagaggagatccggaatgacattttctaacctggcggcagcgcaaaagatg

SEQ ID NO: 65744 - DNA, 103 bp, Artificial Sequence
  Synthetic Polynucleotide
taatacgactcactatagggtgtataacgccaccgatagaaaatgtagataacagaggagaatctacatgttctatcggaacctggcggcagcgcaaaagatg

SEQ ID NO: 65745 - DNA, 103 bp, Artificial Sequence
  Synthetic Polynucleotide
taatacgactcactatagggtaagatgtataacgccaccgatagaaaatgaacagaggagacattttatgtcggtggcgaacctggcggcagcgcaaaagatg

SEQ ID NO: 65746 - DNA, 103 bp, Artificial Sequence
  Synthetic Polynucleotide
taatacgactcactatagggacaactaagatgtataacgccaccgatagaaacagaggagatctatcatgggcgttataaacctggcggcagcgcaaaagatg

SEQ ID NO: 65747 - DNA, 103 bp, Artificial Sequence
  Synthetic Polynucleotide
taatacgactcactatagggcttttacaactaagatgtataacgccaccgaacagaggagacggtggatgtatacatctaacctggcggcagcgcaaaagatg

SEQ ID NO: 65748 - DNA, 103 bp, Artificial Sequence
  Synthetic Polynucleotide
taatacgactcactatagggtgtaaaaatcgtagatactttacttcatataacagaggagaatatgaatgaaagtatctaacctggcggcagcgcaaaagatg

SEQ ID NO: 65749 - DNA, 103 bp, Artificial Sequence
  Synthetic Polynucleotide
taatacgactcactatagggaaccacttttacaactaagatgtataacgcaacagaggagagcgttaatgatcttagttaacctggcggcagcgcaaaagatg

SEQ ID NO: 65750 - DNA, 103 bp, Artificial Sequence
  Synthetic Polynucleotide
taatacgactcactatagggtataaaaccacttttacaactaagatgtataacagaggagaatacatatgagttgtaaaaacctggcggcagcgcaaaagatg

SEQ ID NO: 65751 - DNA, 103 bp, Artificial Sequence
  Synthetic Polynucleotide
taatacgactcactataggggttagtataaaaccacttttacaactaagaaacagaggagatcttagatgtaaaagtggaacctggcggcagcgcaaaagatg

SEQ ID NO: 65752 - DNA, 103 bp, Artificial Sequence
  Synthetic Polynucleotide
taatacgactcactatagggatcccgttagtataaaaccacttttacaacaacagaggagagttgtaatggtggttttaaacctggcggcagcgcaaaagatg

SEQ ID NO: 65753 - DNA, 103 bp, Artificial Sequence
  Synthetic Polynucleotide
taatacgactcactatagggtggagatcccgttagtataaaaccacttttaacagaggagaaaaagtatgtttatactaaacctggcggcagcgcaaaagatg

SEQ ID NO: 65754 - DNA, 103 bp, Artificial Sequence
  Synthetic Polynucleotide
taatacgactcactataggggatgatggagatcccgttagtataaaaccaaacagaggagatggtttatgactaacgggaacctggcggcagcgcaaaagatg

SEQ ID NO: 65755 - DNA, 103 bp, Artificial Sequence
  Synthetic Polynucleotide
taatacgactcactatagggatgtggatgatggagatcccgttagtataaaacagaggagattatacatgcgggatctcaacctggcggcagcgcaaaagatg

SEQ ID NO: 65756 - DNA, 103 bp, Artificial Sequence
  Synthetic Polynucleotide
taatacgactcactataggggatacatgtggatgatggagatcccgttagaacagaggagactaacgatgtctccatcaaacctggcggcagcgcaaaagatg

SEQ ID NO: 65757 - DNA, 103 bp, Artificial Sequence
  Synthetic Polynucleotide
taatacgactcactatagggccgtcgatacatgtggatgatggagatcccaacagaggagagggatcatgatcatccacaacctggcggcagcgcaaaagatg

SEQ ID NO: 65758 - DNA, 103 bp, Artificial Sequence
  Synthetic Polynucleotide
taatacgactcactatagggatttaccgtcgatacatgtggatgatggagaacagaggagactccatatgccacatgtaaacctggcggcagcgcaaaagatg

SEQ ID NO: 65759 - DNA, 103 bp, Artificial Sequence
  Synthetic Polynucleotide
taatacgactcactatagggacttttgtaaaaatcgtagatactttacttaacagaggagaaagtaaatgatctacgataacctggcggcagcgcaaaagatg

SEQ ID NO: 65760 - DNA, 103 bp, Artificial Sequence
  Synthetic Polynucleotide
taatacgactcactatagggattccatttaccgtcgatacatgtggatgaaacagaggagatcatccatgtgtatcgacaacctggcggcagcgcaaaagatg

SEQ ID NO: 65761 - DNA, 103 bp, Artificial Sequence
  Synthetic Polynucleotide
taatacgactcactatagggacgggattccatttaccgtcgatacatgtgaacagaggagacacatgatgcgacggtaaaacctggcggcagcgcaaaagatg

SEQ ID NO: 65762 - DNA, 103 bp, Artificial Sequence
  Synthetic Polynucleotide
taatacgactcactatagggggagtacgggattccatttaccgtcgatacaacagaggagagtatcgatggtaaatggaaacctggcggcagcgcaaaagatg

SEQ ID NO: 65763 - DNA, 103 bp, Artificial Sequence
  Synthetic Polynucleotide
taatacgactcactatagggtattgggagtacgggattccatttaccgtcaacagaggagagacggtatgtggaatcccaacctggcggcagcgcaaaagatg

SEQ ID NO: 65764 - DNA, 103 bp, Artificial Sequence
  Synthetic Polynucleotide
taatacgactcactatagggatacatattgggagtacgggattccatttaaacagaggagataaatgatgtcccgtactaacctggcggcagcgcaaaagatg

SEQ ID NO: 65765 - DNA, 103 bp, Artificial Sequence
  Synthetic Polynucleotide
taatacgactcactatagggatcgtatacatattgggagtacgggattccaacagaggagaggaatcatgtactcccaaaacctggcggcagcgcaaaagatg

SEQ ID NO: 65766 - DNA, 103 bp, Artificial Sequence
  Synthetic Polynucleotide
taatacgactcactataggggttagatcgtatacatattgggagtacgggaacagaggagacccgtaatgccaatatgtaacctggcggcagcgcaaaagatg

SEQ ID NO: 65767 - DNA, 103 bp, Artificial Sequence
  Synthetic Polynucleotide
taatacgactcactatagggtcttcgttagatcgtatacatattgggagtaacagaggagaactcccatgatgtatacgaacctggcggcagcgcaaaagatg

SEQ ID NO: 65768 - DNA, 103 bp, Artificial Sequence
  Synthetic Polynucleotide
taatacgactcactatagggcaaattcttcgttagatcgtatacatattgaacagaggagacaatatatgtacgatctaaacctggcggcagcgcaaaagatg

SEQ ID NO: 65769 - DNA, 103 bp, Artificial Sequence
  Synthetic Polynucleotide
taatacgactcactatagggtggatcaaattcttcgttagatcgtatacaaacagaggagatgtataatgtctaacgaaaacctggcggcagcgcaaaagatg

SEQ ID NO: 65770 - DNA, 103 bp, Artificial Sequence
  Synthetic Polynucleotide
taatacgactcactatagggtccggacttttgtaaaaatcgtagatacttaacagaggagaaagtatatgcgatttttaaacctggcggcagcgcaaaagatg

SEQ ID NO: 65771 - DNA, 103 bp, Artificial Sequence
  Synthetic Polynucleotide
taatacgactcactatagggtccactggatcaaattcttcgttagatcgtaacagaggagaacgatcatgcgaagaattaacctggcggcagcgcaaaagatg

SEQ ID NO: 65772 - DNA, 103 bp, Artificial Sequence
  Synthetic Polynucleotide
taatacgactcactatagggcatcctccactggatcaaattcttcgttagaacagaggagactaacgatgaatttgatcaacctggcggcagcgcaaaagatg

SEQ ID NO: 65773 - DNA, 103 bp, Artificial Sequence
  Synthetic Polynucleotide
taatacgactcactataggggggaccatcctccactggatcaaattcttcaacagaggagagaagaaatggatccagtgaacctggcggcagcgcaaaagatg

SEQ ID NO: 65774 - DNA, 103 bp, Artificial Sequence
  Synthetic Polynucleotide
taatacgactcactatagggtcatcgggaccatcctccactggatcaaataacagaggagaatttgaatgagtggaggaaacctggcggcagcgcaaaagatg

SEQ ID NO: 65775 - DNA, 103 bp, Artificial Sequence
  Synthetic Polynucleotide
taatacgactcactatagggtctcatcatcgggaccatcctccactggataacagaggagaatccagatgaggatggtcaacctggcggcagcgcaaaagatg

SEQ ID NO: 65776 - DNA, 103 bp, Artificial Sequence
  Synthetic Polynucleotide
taatacgactcactatagggatctgtctcatcatcgggaccatcctccacaacagaggagagtggagatgggtcccgataacctggcggcagcgcaaaagatg

SEQ ID NO: 65777 - DNA, 103 bp, Artificial Sequence
  Synthetic Polynucleotide
taatacgactcactatagggctcagatctgtctcatcatcgggaccatccaacagaggagaggatggatgcgatgatgaaacctggcggcagcgcaaaagatg

SEQ ID NO: 65778 - DNA, 103 bp, Artificial Sequence
  Synthetic Polynucleotide
taatacgactcactataggggtttgctcagatctgtctcatcatcgggacaacagaggagagtcccgatgatgagacagaacctggcggcagcgcaaaagatg

SEQ ID NO: 65779 - DNA, 103 bp, Artificial Sequence
  Synthetic Polynucleotide
taatacgactcactatagggtgagagtttgctcagatctgtctcatcatcaacagaggagagatgatatgacagatctgaacctggcggcagcgcaaaagatg

SEQ ID NO: 65780 - DNA, 103 bp, Artificial Sequence
  Synthetic Polynucleotide
taatacgactcactatagggtcttttgagagtttgctcagatctgtctcaaacagaggagatgagacatgtctgagcaaaacctggcggcagcgcaaaagatg

SEQ ID NO: 65781 - DNA, 103 bp, Artificial Sequence
  Synthetic Polynucleotide
taatacgactcactatagggatgcatccggacttttgtaaaaatcgtagaaacagaggagatctacgatgtttacaaaaaacctggcggcagcgcaaaagatg

SEQ ID NO: 65782 - DNA, 103 bp, Artificial Sequence
  Synthetic Polynucleotide
taatacgactcactatagggcaacgtcttttgagagtttgctcagatctgaacagaggagacagatcatggcaaactctaacctggcggcagcgcaaaagatg

SEQ ID NO: 65783 - DNA, 103 bp, Artificial Sequence
  Synthetic Polynucleotide
taatacgactcactatagggttgtacaacgtcttttgagagtttgctcagaacagaggagactgagcatgctctcaaaaaacctggcggcagcgcaaaagatg

SEQ ID NO: 65784 - DNA, 103 bp, Artificial Sequence
  Synthetic Polynucleotide
taatacgactcactatagggtcatattgtacaacgtcttttgagagtttgaacagaggagacaaactatgaaaagacgtaacctggcggcagcgcaaaagatg

SEQ ID NO: 65785 - DNA, 103 bp, Artificial Sequence
  Synthetic Polynucleotide
taatacgactcactatagggcttgttcatattgtacaacgtcttttgagaaacagaggagatctcaaatgacgttgtacaacctggcggcagcgcaaaagatg

SEQ ID NO: 65786 - DNA, 103 bp, Artificial Sequence
  Synthetic Polynucleotide
taatacgactcactatagggtatttcttgttcatattgtacaacgtctttaacagaggagaaaagacatggtacaatataacctggcggcagcgcaaaagatg

SEQ ID NO: 65787 - DNA, 103 bp, Artificial Sequence
  Synthetic Polynucleotide
taatacgactcactataggggattctatttcttgttcatattgtacaacgaacagaggagacgttgtatgatatgaacaaacctggcggcagcgcaaaagatg

SEQ ID NO: 65788 - DNA, 103 bp, Artificial Sequence
  Synthetic Polynucleotide
taatacgactcactatagggctaacgattctatttcttgttcatattgtaaacagaggagatacaatatgaacaagaaaaacctggcggcagcgcaaaagatg

SEQ ID NO: 65789 - DNA, 103 bp, Artificial Sequence
  Synthetic Polynucleotide
taatacgactcactatagggtgcttctaacgattctatttcttgttcataaacagaggagatatgaaatggaaatagaaaacctggcggcagcgcaaaagatg

SEQ ID NO: 65790 - DNA, 103 bp, Artificial Sequence
  Synthetic Polynucleotide
taatacgactcactatagggtaagttgcttctaacgattctatttcttgtaacagaggagaacaagaatgagaatcgttaacctggcggcagcgcaaaagatg

SEQ ID NO: 65791 - DNA, 103 bp, Artificial Sequence
  Synthetic Polynucleotide
taatacgactcactatagggtatgataagttgcttctaacgattctatttaacagaggagaaaatagatgcgttagaagaacctggcggcagcgcaaaagatg

SEQ ID NO: 65792 - DNA, 103 bp, Artificial Sequence
  Synthetic Polynucleotide
taatacgactcactatagggatctaaaaatactaagaccgtgaacattaaaacagaggagattaatgatgacggtcttaaacctggcggcagcgcaaaagatg

SEQ ID NO: 65793 - DNA, 103 bp, Artificial Sequence
  Synthetic Polynucleotide
taatacgactcactatagggtacttatgcatccggacttttgtaaaaatcaacagaggagagattttatgaaaagtccgaacctggcggcagcgcaaaagatg

SEQ ID NO: 65794 - DNA, 103 bp, Artificial Sequence
  Synthetic Polynucleotide
taatacgactcactataggggattatatgataagttgcttctaacgattcaacagaggagagaatcgatggaagcaactaacctggcggcagcgcaaaagatg

SEQ ID NO: 65795 - DNA, 103 bp, Artificial Sequence
  Synthetic Polynucleotide
taatacgactcactatagggactatgattatatgataagttgcttctaacaacagaggagagttagaatgaacttatcaaacctggcggcagcgcaaaagatg

SEQ ID NO: 65796 - DNA, 103 bp, Artificial Sequence
  Synthetic Polynucleotide
taatacgactcactatagggacgctactatgattatatgataagttgcttaacagaggagaaagcaaatgatcatataaaacctggcggcagcgcaaaagatg

SEQ ID NO: 65797 - DNA, 103 bp, Artificial Sequence
  Synthetic Polynucleotide
taatacgactcactatagggtgtcaacgctactatgattatatgataagtaacagaggagaacttatatgataatcataaacctggcggcagcgcaaaagatg

SEQ ID NO: 65798 - DNA, 103 bp, Artificial Sequence
  Synthetic Polynucleotide
taatacgactcactatagggataattgtcaacgctactatgattatatgaaacagaggagatcatatatgcatagtagcaacctggcggcagcgcaaaagatg

SEQ ID NO: 65799 - DNA, 103 bp, Artificial Sequence
  Synthetic Polynucleotide
taatacgactcactatagggcgcccataattgtcaacgctactatgattaaacagaggagataatcaatgtagcgttgaaacctggcggcagcgcaaaagatg

SEQ ID NO: 65800 - DNA, 103 bp, Artificial Sequence
  Synthetic Polynucleotide
taatacgactcactatagggtatgacgcccataattgtcaacgctactataacagaggagaatagtaatgttgacaattaacctggcggcagcgcaaaagatg

SEQ ID NO: 65801 - DNA, 103 bp, Artificial Sequence
  Synthetic Polynucleotide
taatacgactcactatagggaaaaatatgacgcccataattgtcaacgctaacagaggagaagcgttatgaattatgggaacctggcggcagcgcaaaagatg

SEQ ID NO: 65802 - DNA, 103 bp, Artificial Sequence
  Synthetic Polynucleotide
taatacgactcactatagggagattaaaaatatgacgcccataattgtcaaacagaggagatgacaaatgtgggcgtcaaacctggcggcagcgcaaaagatg

SEQ ID NO: 65803 - DNA, 103 bp, Artificial Sequence
  Synthetic Polynucleotide
taatacgactcactatagggaacggagattaaaaatatgacgcccataataacagaggagaattatgatggtcatatttaacctggcggcagcgcaaaagatg

SEQ ID NO: 65804 - DNA, 103 bp, Artificial Sequence
  Synthetic Polynucleotide
taatacgactcactatagggctttgtacttatgcatccggacttttgtaaaacagaggagattacaaatgtccggatgcaacctggcggcagcgcaaaagatg

SEQ ID NO: 65805 - DNA, 103 bp, Artificial Sequence
  Synthetic Polynucleotide
taatacgactcactatagggactataacggagattaaaaatatgacgcccaacagaggagagggcgtatgatttttaataacctggcggcagcgcaaaagatg

SEQ ID NO: 65806 - DNA, 103 bp, Artificial Sequence
  Synthetic Polynucleotide
taatacgactcactatagggctaatactataacggagattaaaaatatgaaacagaggagatcatatatgtaatctccgaacctggcggcagcgcaaaagatg

SEQ ID NO: 65807 - DNA, 103 bp, Artificial Sequence
  Synthetic Polynucleotide
taatacgactcactatagggacaaactaatactataacggagattaaaaaaacagaggagatttttaatgtccgttataaacctggcggcagcgcaaaagatg

SEQ ID NO: 65808 - DNA, 103 bp, Artificial Sequence
  Synthetic Polynucleotide
taatacgactcactatagggcaggaacaaactaatactataacggagattaacagaggagaaatctcatgtatagtattaacctggcggcagcgcaaaagatg

SEQ ID NO: 65809 - DNA, 103 bp, Artificial Sequence
  Synthetic Polynucleotide
taatacgactcactatagggtgttacaggaacaaactaatactataacggaacagaggagaccgttaatgtattagtttaacctggcggcagcgcaaaagatg

SEQ ID NO: 65810 - DNA, 103 bp, Artificial Sequence
  Synthetic Polynucleotide
taatacgactcactatagggatttttgttacaggaacaaactaatactataacagaggagaatagtaatggtttgttccaacctggcggcagcgcaaaagatg

SEQ ID NO: 65811 - DNA, 103 bp, Artificial Sequence
  Synthetic Polynucleotide
taatacgactcactatagggtcattatttttgttacaggaacaaactaataacagaggagaattagtatgttcctgtaaaacctggcggcagcgcaaaagatg

SEQ ID NO: 65812 - DNA, 103 bp, Artificial Sequence
  Synthetic Polynucleotide
taatacgactcactatagggattggtcattatttttgttacaggaacaaaaacagaggagatttgttatggtaacaaaaaacctggcggcagcgcaaaagatg

SEQ ID NO: 65813 - DNA, 103 bp, Artificial Sequence
  Synthetic Polynucleotide
taatacgactcactatagggcttatattggtcattatttttgttacaggaaacagaggagatcctgtatgaaaaataataacctggcggcagcgcaaaagatg

SEQ ID NO: 65814 - DNA, 103 bp, Artificial Sequence
  Synthetic Polynucleotide
taatacgactcactatagggtggaacttatattggtcattatttttgttaaacagaggagataacaaatgtaatgaccaaacctggcggcagcgcaaaagatg

SEQ ID NO: 65815 - DNA, 103 bp, Artificial Sequence
  Synthetic Polynucleotide
taatacgactcactataggggcgtactttgtacttatgcatccggactttaacagaggagaaaagtcatgatgcataagaacctggcggcagcgcaaaagatg

SEQ ID NO: 65816 - DNA, 103 bp, Artificial Sequence
  Synthetic Polynucleotide
taatacgactcactatagggatttatggaacttatattggtcattattttaacagaggagaaaaataatgaccaatataaacctggcggcagcgcaaaagatg

SEQ ID NO: 65817 - DNA, 103 bp, Artificial Sequence
  Synthetic Polynucleotide
taatacgactcactatagggcaacaatttatggaacttatattggtcattaacagaggagaaatgacatgtataagttcaacctggcggcagcgcaaaagatg

SEQ ID NO: 65818 - DNA, 103 bp, Artificial Sequence
  Synthetic Polynucleotide
taatacgactcactatagggcacagcaacaatttatggaacttatattggaacagaggagaccaataatggttccataaaacctggcggcagcgcaaaagatg

SEQ ID NO: 65819 - DNA, 103 bp, Artificial Sequence
  Synthetic Polynucleotide
taatacgactcactatagggatattcacagcaacaatttatggaacttataacagaggagaataagtatgataaattgtaacctggcggcagcgcaaaagatg

SEQ ID NO: 65820 - DNA, 103 bp, Artificial Sequence
  Synthetic Polynucleotide
taatacgactcactataggggatttatattcacagcaacaatttatggaaaacagaggagattccatatgttgttgctgaacctggcggcagcgcaaaagatg

SEQ ID NO: 65821 - DNA, 103 bp, Artificial Sequence
  Synthetic Polynucleotide
taatacgactcactatagggtaacggatttatattcacagcaacaatttaaacagaggagataaattatggctgtgaataacctggcggcagcgcaaaagatg

SEQ ID NO: 65822 - DNA, 103 bp, Artificial Sequence
  Synthetic Polynucleotide
taatacgactcactatagggtattttaacggatttatattcacagcaacaaacagaggagatgttgcatggaatataaaaacctggcggcagcgcaaaagatg

SEQ ID NO: 65823 - DNA, 103 bp, Artificial Sequence
  Synthetic Polynucleotide
taatacgactcactatagggtttattattttaacggatttatattcacagaacagaggagactgtgaatgtaaatccgtaacctggcggcagcgcaaaagatg

SEQ ID NO: 65824 - DNA, 103 bp, Artificial Sequence
  Synthetic Polynucleotide
taatacgactcactatagggaattatttattattttaacggatttatattaacagaggagaaatataatgccgttaaaaaacctggcggcagcgcaaaagatg

SEQ ID NO: 65825 - DNA, 103 bp, Artificial Sequence
  Synthetic Polynucleotide
taatacgactcactatagggttattaattatttattattttaacggatttaacagaggagaaaatccatgaaaataataaacctggcggcagcgcaaaagatg

SEQ ID NO: 65826 - DNA, 103 bp, Artificial Sequence
  Synthetic Polynucleotide
taatacgactcactatagggttatcgcgtactttgtacttatgcatccggaacagaggagaccggatatgtaagtacaaaacctggcggcagcgcaaaagatg

SEQ ID NO: 65827 - DNA, 103 bp, Artificial Sequence
  Synthetic Polynucleotide
taatacgactcactataggggttcgttattaattatttattattttaacgaacagaggagacgttaaatgaataaataaaacctggcggcagcgcaaaagatg

SEQ ID NO: 65828 - DNA, 103 bp, Artificial Sequence
  Synthetic Polynucleotide
taatacgactcactatagggtacttgttcgttattaattatttattatttaacagaggagaaaataaatgataattaataacctggcggcagcgcaaaagatg

SEQ ID NO: 65829 - DNA, 103 bp, Artificial Sequence
  Synthetic Polynucleotide
taatacgactcactatagggtttgatacttgttcgttattaattatttataacagaggagaataaatatgtaataacgaaacctggcggcagcgcaaaagatg

SEQ ID NO: 65830 - DNA, 103 bp, Artificial Sequence
  Synthetic Polynucleotide
taatacgactcactatagggaatcttttgatacttgttcgttattaattaaacagaggagataattaatgacgaacaagaacctggcggcagcgcaaaagatg

SEQ ID NO: 65831 - DNA, 103 bp, Artificial Sequence
  Synthetic Polynucleotide
taatacgactcactatagggtctttaatcttttgatacttgttcgttattaacagaggagaaataacatgcaagtatcaaacctggcggcagcgcaaaagatg

SEQ ID NO: 65832 - DNA, 103 bp, Artificial Sequence
  Synthetic Polynucleotide
taatacgactcactatagggataattctttaatcttttgatacttgttcgaacagaggagacgaacaatgatcaaaagaaacctggcggcagcgcaaaagatg

SEQ ID NO: 65833 - DNA, 103 bp, Artificial Sequence
  Synthetic Polynucleotide
taatacgactcactatagggtagctataattctttaatcttttgatacttaacagaggagaaagtatatgaagattaaaaacctggcggcagcgcaaaagatg

SEQ ID NO: 65834 - DNA, 103 bp, Artificial Sequence
  Synthetic Polynucleotide
taatacgactcactatagggaattctagctataattctttaatcttttgaaacagaggagatcaaaaatgtaaagaattaacctggcggcagcgcaaaagatg

SEQ ID NO: 65835 - DNA, 103 bp, Artificial Sequence
  Synthetic Polynucleotide
taatacgactcactatagggcaattaattctagctataattctttaatctaacagaggagaagattaatgaattatagcaacctggcggcagcgcaaaagatg

SEQ ID NO: 65836 - DNA, 103 bp, Artificial Sequence
  Synthetic Polynucleotide
taatacgactcactatagggcatctcaattaattctagctataattctttaacagaggagaaaagaaatgtagctagaaaacctggcggcagcgcaaaagatg

SEQ ID NO: 65837 - DNA, 103 bp, Artificial Sequence
  Synthetic Polynucleotide
taatacgactcactatagggtccgtttatcgcgtactttgtacttatgcaaacagaggagatgcataatgacaaagtacaacctggcggcagcgcaaaagatg

SEQ ID NO: 65838 - DNA, 103 bp, Artificial Sequence
  Synthetic Polynucleotide
taatacgactcactataggggaagacatctcaattaattctagctataataacagaggagaattataatgagaattaataacctggcggcagcgcaaaagatg

SEQ ID NO: 65839 - DNA, 103 bp, Artificial Sequence
  Synthetic Polynucleotide
taatacgactcactatagggctgaagaagacatctcaattaattctagctaacagaggagaagctagatgtaattgagaaacctggcggcagcgcaaaagatg

SEQ ID NO: 65840 - DNA, 103 bp, Artificial Sequence
  Synthetic Polynucleotide
taatacgactcactatagggatccactgaagaagacatctcaattaattcaacagaggagagaattaatggagatgtctaacctggcggcagcgcaaaagatg

SEQ ID NO: 65841 - DNA, 103 bp, Artificial Sequence
  Synthetic Polynucleotide
taatacgactcactatagggtcaacatccactgaagaagacatctcaattaacagaggagaaattgaatggtcttcttcaacctggcggcagcgcaaaagatg

SEQ ID NO: 65842 - DNA, 103 bp, Artificial Sequence
  Synthetic Polynucleotide
taatacgactcactatagggagatatcaacatccactgaagaagacatctaacagaggagaagatgtatgcttcagtggaacctggcggcagcgcaaaagatg

SEQ ID NO: 65843 - DNA, 103 bp, Artificial Sequence
  Synthetic Polynucleotide
taatacgactcactatagggatcgtagatatcaacatccactgaagaagaaacagaggagatcttctatggtggatgttaacctggcggcagcgcaaaagatg

SEQ ID NO: 65844 - DNA, 103 bp, Artificial Sequence
  Synthetic Polynucleotide
taatacgactcactataggggcagcatcgtagatatcaacatccactgaaaacagaggagattcagtatgtgttgatataacctggcggcagcgcaaaagatg

SEQ ID NO: 65845 - DNA, 103 bp, Artificial Sequence
  Synthetic Polynucleotide
taatacgactcactatagggctctggcagcatcgtagatatcaacatccaaacagaggagatggatgatgatatctacgaacctggcggcagcgcaaaagatg

SEQ ID NO: 65846 - DNA, 103 bp, Artificial Sequence
  Synthetic Polynucleotide
taatacgactcactatagggaaatactctggcagcatcgtagatatcaacaacagaggagagttgatatgtacgatgctaacctggcggcagcgcaaaagatg

SEQ ID NO: 65847 - DNA, 103 bp, Artificial Sequence
  Synthetic Polynucleotide
taatacgactcactatagggagtaaaaatactctggcagcatcgtagataaacagaggagatatctaatgtgctgccagaacctggcggcagcgcaaaagatg

SEQ ID NO: 65848 - DNA, 103 bp, Artificial Sequence
  Synthetic Polynucleotide
taatacgactcactatagggattattccgtttatcgcgtactttgtacttaacagaggagaaagtacatggtacgcgataacctggcggcagcgcaaaagatg

SEQ ID NO: 65849 - DNA, 103 bp, Artificial Sequence
  Synthetic Polynucleotide
taatacgactcactataggggcctaagtaaaaatactctggcagcatcgtaacagaggagaacgatgatgccagagtataacctggcggcagcgcaaaagatg

SEQ ID NO: 65850 - DNA, 103 bp, Artificial Sequence
  Synthetic Polynucleotide
taatacgactcactatagggatagtgcctaagtaaaaatactctggcagcaacagaggagagctgccatggtatttttaaacctggcggcagcgcaaaagatg

SEQ ID NO: 65851 - DNA, 103 bp, Artificial Sequence
  Synthetic Polynucleotide
taatacgactcactatagggttataatagtgcctaagtaaaaatactctgaacagaggagacagagtatgtttacttagaacctggcggcagcgcaaaagatg

SEQ ID NO: 65852 - DNA, 103 bp, Artificial Sequence
  Synthetic Polynucleotide
taatacgactcactatagggtcttgttataatagtgcctaagtaaaaataaacagaggagatattttatgttaggcactaacctggcggcagcgcaaaagatg

SEQ ID NO: 65853 - DNA, 103 bp, Artificial Sequence
  Synthetic Polynucleotide
taatacgactcactatagggaaatctcttgttataatagtgcctaagtaaaacagaggagattacttatgcactattataacctggcggcagcgcaaaagatg

SEQ ID NO: 65854 - DNA, 103 bp, Artificial Sequence
  Synthetic Polynucleotide
taatacgactcactatagggacaataaatctcttgttataatagtgcctaaacagaggagataggcaatgttataacaaaacctggcggcagcgcaaaagatg

SEQ ID NO: 65855 - DNA, 103 bp, Artificial Sequence
  Synthetic Polynucleotide
taatacgactcactatagggcatacacaataaatctcttgttataatagtaacagaggagaactattatgacaagagataacctggcggcagcgcaaaagatg

SEQ ID NO: 65856 - DNA, 103 bp, Artificial Sequence
  Synthetic Polynucleotide
taatacgactcactatagggtcttccatacacaataaatctcttgttataaacagaggagatataacatgagatttattaacctggcggcagcgcaaaagatg

SEQ ID NO: 65857 - DNA, 103 bp, Artificial Sequence
  Synthetic Polynucleotide
taatacgactcactatagggttacttcttccatacacaataaatctcttgaacagaggagacaagagatgtattgtgtaaacctggcggcagcgcaaaagatg

SEQ ID NO: 65858 - DNA, 103 bp, Artificial Sequence
  Synthetic Polynucleotide
taatacgactcactatagggtatggttacttcttccatacacaataaatcaacagaggagagatttaatgtgtatggaaaacctggcggcagcgcaaaagatg

SEQ ID NO: 65859 - DNA, 103 bp, Artificial Sequence
  Synthetic Polynucleotide
taatacgactcactatagggctattattattccgtttatcgcgtactttgaacagaggagacaaagtatgcgataaacgaacctggcggcagcgcaaaagatg

SEQ ID NO: 65860 - DNA, 103 bp, Artificial Sequence
  Synthetic Polynucleotide
taatacgactcactatagggtgtaatatggttacttcttccatacacaataacagaggagaattgtgatgggaagaagtaacctggcggcagcgcaaaagatg

SEQ ID NO: 65861 - DNA, 103 bp, Artificial Sequence
  Synthetic Polynucleotide
taatacgactcactatagggtattatgtaatatggttacttcttccatacaacagaggagagtatggatgaagtaaccaaacctggcggcagcgcaaaagatg

SEQ ID NO: 65862 - DNA, 103 bp, Artificial Sequence
  Synthetic Polynucleotide
taatacgactcactataggggtatatattatgtaatatggttacttcttcaacagaggagagaagaaatgaccatattaaacctggcggcagcgcaaaagatg

SEQ ID NO: 65863 - DNA, 103 bp, Artificial Sequence
  Synthetic Polynucleotide
taatacgactcactatagggagcctgtatatattatgtaatatggttactaacagaggagaagtaacatgattacataaaacctggcggcagcgcaaaagatg

SEQ ID NO: 65864 - DNA, 103 bp, Artificial Sequence
  Synthetic Polynucleotide
taatacgactcactatagggtaaatagcctgtatatattatgtaatatggaacagaggagaccatatatgataatatataacctggcggcagcgcaaaagatg

SEQ ID NO: 65865 - DNA, 103 bp, Artificial Sequence
  Synthetic Polynucleotide
taatacgactcactatagggtcttgtaaatagcctgtatatattatgtaaaacagaggagattacatatgatatacaggaacctggcggcagcgcaaaagatg

SEQ ID NO: 65866 - DNA, 103 bp, Artificial Sequence
  Synthetic Polynucleotide
taatacgactcactataggggcgcatcttgtaaatagcctgtatatattaaacagaggagataatatatgcaggctattaacctggcggcagcgcaaaagatg

SEQ ID NO: 65867 - DNA, 103 bp, Artificial Sequence
  Synthetic Polynucleotide
taatacgactcactataggggtacggcgcatcttgtaaatagcctgtataaacagaggagatatacaatgtatttacaaaacctggcggcagcgcaaaagatg

SEQ ID NO: 65868 - DNA, 103 bp, Artificial Sequence
  Synthetic Polynucleotide
taatacgactcactataggggaacggtacggcgcatcttgtaaatagcctaacagaggagaaggctaatgacaagatgcaacctggcggcagcgcaaaagatg

SEQ ID NO: 65869 - DNA, 103 bp, Artificial Sequence
  Synthetic Polynucleotide
taatacgactcactatagggtcatcgaacggtacggcgcatcttgtaaataacagaggagaatttacatgatgcgccgtaacctggcggcagcgcaaaagatg

SEQ ID NO: 65870 - DNA, 103 bp, Artificial Sequence
  Synthetic Polynucleotide
taatacgactcactatagggtaaatctattattattccgtttatcgcgtaaacagaggagatacgcgatgaacggaataaacctggcggcagcgcaaaagatg

SEQ ID NO: 65871 - DNA, 103 bp, Artificial Sequence
  Synthetic Polynucleotide
taatacgactcactatagggctatatcatcgaacggtacggcgcatcttgaacagaggagacaagatatgccgtaccgtaacctggcggcagcgcaaaagatg

SEQ ID NO: 65872 - DNA, 103 bp, Artificial Sequence
  Synthetic Polynucleotide
taatacgactcactatagggacgtactatatcatcgaacggtacggcgcaaacagaggagatgcgccatgccgttcgataacctggcggcagcgcaaaagatg

SEQ ID NO: 65873 - DNA, 103 bp, Artificial Sequence
  Synthetic Polynucleotide
taatacgactcactatagggatagtacgtactatatcatcgaacggtacgaacagaggagacgtaccatgcgatgatataacctggcggcagcgcaaaagatg

SEQ ID NO: 65874 - DNA, 103 bp, Artificial Sequence
  Synthetic Polynucleotide
taatacgactcactatagggttggcatagtacgtactatatcatcgaacgaacagaggagacgttcgatgatatagtacaacctggcggcagcgcaaaagatg

SEQ ID NO: 65875 - DNA, 103 bp, Artificial Sequence
  Synthetic Polynucleotide
taatacgactcactatagggttcatttggcatagtacgtactatatcatcaacagaggagagatgatatggtacgtactaacctggcggcagcgcaaaagatg

SEQ ID NO: 65876 - DNA, 103 bp, Artificial Sequence
  Synthetic Polynucleotide
taatacgactcactatagggcgtgattcatttggcatagtacgtactataaacagaggagatatagtatgtactatgccaacctggcggcagcgcaaaagatg

SEQ ID NO: 65877 - DNA, 103 bp, Artificial Sequence
  Synthetic Polynucleotide
taatacgactcactatagggaaacacgtgattcatttggcatagtacgtaaacagaggagatacgtaatgtgccaaatgaacctggcggcagcgcaaaagatg

SEQ ID NO: 65878 - DNA, 103 bp, Artificial Sequence
  Synthetic Polynucleotide
taatacgactcactatagggttgttaaacacgtgattcatttggcatagtaacagaggagaactatgatgaatgaatcaaacctggcggcagcgcaaaagatg

SEQ ID NO: 65879 - DNA, 103 bp, Artificial Sequence
  Synthetic Polynucleotide
taatacgactcactatagggacccattgttaaacacgtgattcatttggcaacagaggagagccaaaatgatcacgtgtaacctggcggcagcgcaaaagatg

SEQ ID NO: 65880 - DNA, 103 bp, Artificial Sequence
  Synthetic Polynucleotide
taatacgactcactatagggctatcacccattgttaaacacgtgattcataacagaggagaatgaatatggtgtttaacaacctggcggcagcgcaaaagatg

SEQ ID NO: 65881 - DNA, 103 bp, Artificial Sequence
  Synthetic Polynucleotide
taatacgactcactatagggctagataaatctattattattccgtttatcaacagaggagagataaaatgaataataataacctggcggcagcgcaaaagatg

SEQ ID NO: 65882 - DNA, 103 bp, Artificial Sequence
  Synthetic Polynucleotide
taatacgactcactatagggtgtatctatcacccattgttaaacacgtgaaacagaggagatcacgtatgtaacaatggaacctggcggcagcgcaaaagatg

SEQ ID NO: 65883 - DNA, 103 bp, Artificial Sequence
  Synthetic Polynucleotide
taatacgactcactatagggttaagtgtatctatcacccattgttaaacaaacagaggagatgtttaatgatgggtgataacctggcggcagcgcaaaagatg

SEQ ID NO: 65884 - DNA, 103 bp, Artificial Sequence
  Synthetic Polynucleotide
taatacgactcactatagggtgccattaagtgtatctatcacccattgttaacagaggagaaacaatatgtgatagataaacctggcggcagcgcaaaagatg

SEQ ID NO: 65885 - DNA, 103 bp, Artificial Sequence
  Synthetic Polynucleotide
taatacgactcactatagggcattatgccattaagtgtatctatcacccaaacagaggagatgggtgatggatacacttaacctggcggcagcgcaaaagatg

SEQ ID NO: 65886 - DNA, 103 bp, Artificial Sequence
  Synthetic Polynucleotide
taatacgactcactatagggttcatcattatgccattaagtgtatctatcaacagaggagagatagaatgacttaatggaacctggcggcagcgcaaaagatg

SEQ ID NO: 65887 - DNA, 103 bp, Artificial Sequence
  Synthetic Polynucleotide
taatacgactcactataggggttcattcatcattatgccattaagtgtataacagaggagaatacacatgatggcataaaacctggcggcagcgcaaaagatg

SEQ ID NO: 65888 - DNA, 103 bp, Artificial Sequence
  Synthetic Polynucleotide
taatacgactcactatagggattgtgttcattcatcattatgccattaagaacagaggagacttaatatgataatgatgaacctggcggcagcgcaaaagatg

SEQ ID NO: 65889 - DNA, 103 bp, Artificial Sequence
  Synthetic Polynucleotide
taatacgactcactataggggcaacattgtgttcattcatcattatgccaaacagaggagatggcatatggatgaatgaaacctggcggcagcgcaaaagatg

SEQ ID NO: 65890 - DNA, 103 bp, Artificial Sequence
  Synthetic Polynucleotide
taatacgactcactatagggacacagcaacattgtgttcattcatcattaaacagaggagataatgaatgatgaacacaaacctggcggcagcgcaaaagatg

SEQ ID NO: 65891 - DNA, 103 bp, Artificial Sequence
  Synthetic Polynucleotide
taatacgactcactatagggtacctacacagcaacattgtgttcattcataacagaggagaatgaatatgcacaatgttaacctggcggcagcgcaaaagatg

SEQ ID NO: 65892 - DNA, 103 bp, Artificial Sequence
  Synthetic Polynucleotide
taatacgactcactatagggataaactagataaatctattattattccgtaacagaggagaacggaaatgtaatagattaacctggcggcagcgcaaaagatg

SEQ ID NO: 65893 - DNA, 103 bp, Artificial Sequence
  Synthetic Polynucleotide
taatacgactcactatagggtccggtacctacacagcaacattgtgttcaaacagaggagatgaacaatgtgttgctgtaacctggcggcagcgcaaaagatg

SEQ ID NO: 65894 - DNA, 103 bp, Artificial Sequence
  Synthetic Polynucleotide
taatacgactcactatagggagtagtccggtacctacacagcaacattgtaacagaggagaacaatgatgctgtgtaggaacctggcggcagcgcaaaagatg

SEQ ID NO: 65895 - DNA, 103 bp, Artificial Sequence
  Synthetic Polynucleotide
taatacgactcactatagggtgaacagtagtccggtacctacacagcaacaacagaggagagttgctatgtaggtaccgaacctggcggcagcgcaaaagatg

SEQ ID NO: 65896 - DNA, 103 bp, Artificial Sequence
  Synthetic Polynucleotide
taatacgactcactatagggttccatgaacagtagtccggtacctacacaaacagaggagatgtgtaatgaccggactaaacctggcggcagcgcaaaagatg

SEQ ID NO: 65897 - DNA, 103 bp, Artificial Sequence
  Synthetic Polynucleotide
taatacgactcactatagggaacatttccatgaacagtagtccggtacctaacagaggagaaggtacatgactactgttaacctggcggcagcgcaaaagatg

SEQ ID NO: 65898 - DNA, 103 bp, Artificial Sequence
  Synthetic Polynucleotide
taatacgactcactatagggcgaaaaacatttccatgaacagtagtccggaacagaggagaccggacatgtgttcatggaacctggcggcagcgcaaaagatg

SEQ ID NO: 65899 - DNA, 103 bp, Artificial Sequence
  Synthetic Polynucleotide
taatacgactcactatagggataatcgaaaaacatttccatgaacagtagaacagaggagactactgatgatggaaatgaacctggcggcagcgcaaaagatg

SEQ ID NO: 65900 - DNA, 103 bp, Artificial Sequence
  Synthetic Polynucleotide
taatacgactcactatagggttattataatcgaaaaacatttccatgaacaacagaggagagttcatatgaatgtttttaacctggcggcagcgcaaaagatg

SEQ ID NO: 65901 - DNA, 103 bp, Artificial Sequence
  Synthetic Polynucleotide
taatacgactcactatagggtatttttattataatcgaaaaacatttccaaacagaggagatggaaaatgttttcgattaacctggcggcagcgcaaaagatg

SEQ ID NO: 65902 - DNA, 103 bp, Artificial Sequence
  Synthetic Polynucleotide
taatacgactcactatagggggaattatttttattataatcgaaaaacataacagaggagaatgtttatggattataataacctggcggcagcgcaaaagatg

SEQ ID NO: 65903 - DNA, 103 bp, Artificial Sequence
  Synthetic Polynucleotide
taatacgactcactatagggttgatatctaaaaatactaagaccgtgaacaacagaggagagttcacatgcttagtattaacctggcggcagcgcaaaagatg

SEQ ID NO: 65904 - DNA, 103 bp, Artificial Sequence
  Synthetic Polynucleotide
taatacgactcactatagggaaaagataaactagataaatctattattataacagaggagaataataatggatttatctaacctggcggcagcgcaaaagatg

SEQ ID NO: 65905 - DNA, 103 bp, Artificial Sequence
  Synthetic Polynucleotide
taatacgactcactatagggtttttggaattatttttattataatcgaaaaacagaggagatttcgaatgtaataaaaaaacctggcggcagcgcaaaagatg

SEQ ID NO: 65906 - DNA, 103 bp, Artificial Sequence
  Synthetic Polynucleotide
taatacgactcactatagggtgctatttttggaattatttttattataataacagaggagaattataatgaaaataattaacctggcggcagcgcaaaagatg

SEQ ID NO: 65907 - DNA, 103 bp, Artificial Sequence
  Synthetic Polynucleotide
taatacgactcactataggggatgatgctatttttggaattatttttattaacagaggagaaataaaatgaattccaaaaacctggcggcagcgcaaaagatg

SEQ ID NO: 65908 - DNA, 103 bp, Artificial Sequence
  Synthetic Polynucleotide
taatacgactcactatagggtagttgatgatgctatttttggaattatttaacagaggagaaaataaatgcaaaaatagaacctggcggcagcgcaaaagatg

SEQ ID NO: 65909 - DNA, 103 bp, Artificial Sequence
  Synthetic Polynucleotide
taatacgactcactatagggtacattagttgatgatgctatttttggaataacagaggagaattccaatgatagcatcaaacctggcggcagcgcaaaagatg

SEQ ID NO: 65910 - DNA, 103 bp, Artificial Sequence
  Synthetic Polynucleotide
taatacgactcactatagggtgtcatacattagttgatgatgctatttttaacagaggagaaaaaatatgatcatcaacaacctggcggcagcgcaaaagatg

SEQ ID NO: 65911 - DNA, 103 bp, Artificial Sequence
  Synthetic Polynucleotide
taatacgactcactatagggaattatgtcatacattagttgatgatgctaaacagaggagatagcatatgcaactaatgaacctggcggcagcgcaaaagatg

SEQ ID NO: 65912 - DNA, 103 bp, Artificial Sequence
  Synthetic Polynucleotide
taatacgactcactatagggctattaattatgtcatacattagttgatgaaacagaggagatcatcaatgaatgtatgaaacctggcggcagcgcaaaagatg

SEQ ID NO: 65913 - DNA, 103 bp, Artificial Sequence
  Synthetic Polynucleotide
taatacgactcactatagggatacgctattaattatgtcatacattagttaacagaggagaaactaaatgatgacataaaacctggcggcagcgcaaaagatg

SEQ ID NO: 65914 - DNA, 103 bp, Artificial Sequence
  Synthetic Polynucleotide
taatacgactcactatagggtatggatacgctattaattatgtcatacataacagaggagaatgtatatgataattaataacctggcggcagcgcaaaagatg

SEQ ID NO: 65915 - DNA, 103 bp, Artificial Sequence
  Synthetic Polynucleotide
taatacgactcactatagggatagaaaaagataaactagataaatctattaacagaggagaaatagaatgatctagtttaacctggcggcagcgcaaaagatg

SEQ ID NO: 65916 - DNA, 103 bp, Artificial Sequence
  Synthetic Polynucleotide
taatacgactcactatagggagaattatggatacgctattaattatgtcaaacagaggagatgacatatgtaatagcgtaacctggcggcagcgcaaaagatg

SEQ ID NO: 65917 - DNA, 103 bp, Artificial Sequence
  Synthetic Polynucleotide
taatacgactcactatagggtagctagaattatggatacgctattaattaaacagaggagataattaatggcgtatccaaacctggcggcagcgcaaaagatg

SEQ ID NO: 65918 - DNA, 103 bp, Artificial Sequence
  Synthetic Polynucleotide
taatacgactcactatagggctcattagctagaattatggatacgctattaacagaggagaaatagcatgtccataattaacctggcggcagcgcaaaagatg

SEQ ID NO: 65919 - DNA, 103 bp, Artificial Sequence
  Synthetic Polynucleotide
taatacgactcactatagggtatctctcattagctagaattatggatacgaacagaggagacgtatcatgaattctagcaacctggcggcagcgcaaaagatg

SEQ ID NO: 65920 - DNA, 103 bp, Artificial Sequence
  Synthetic Polynucleotide
taatacgactcactatagggttctatatctctcattagctagaattatggaacagaggagaccataaatgtagctaatgaacctggcggcagcgcaaaagatg

SEQ ID NO: 65921 - DNA, 103 bp, Artificial Sequence
  Synthetic Polynucleotide
taatacgactcactatagggcgcgcttctatatctctcattagctagaataacagaggagaattctaatgaatgagagaaacctggcggcagcgcaaaagatg

SEQ ID NO: 65922 - DNA, 103 bp, Artificial Sequence
  Synthetic Polynucleotide
taatacgactcactatagggttaaacgcgcttctatatctctcattagctaacagaggagaagctaaatggagatatagaacctggcggcagcgcaaaagatg

SEQ ID NO: 65923 - DNA, 103 bp, Artificial Sequence
  Synthetic Polynucleotide
taatacgactcactatagggtgtcgttaaacgcgcttctatatctctcataacagaggagaatgagaatgatagaagcgaacctggcggcagcgcaaaagatg

SEQ ID NO: 65924 - DNA, 103 bp, Artificial Sequence
  Synthetic Polynucleotide
taatacgactcactatagggtccattgtcgttaaacgcgcttctatatctaacagaggagaagatatatgagcgcgtttaacctggcggcagcgcaaaagatg

SEQ ID NO: 65925 - DNA, 103 bp, Artificial Sequence
  Synthetic Polynucleotide
taatacgactcactatagggtatattccattgtcgttaaacgcgcttctaaacagaggagatagaagatggtttaacgaaacctggcggcagcgcaaaagatg

SEQ ID NO: 65926 - DNA, 103 bp, Artificial Sequence
  Synthetic Polynucleotide
taatacgactcactatagggaagcgatagaaaaagataaactagataaataacagaggagaatttatatggtttatcttaacctggcggcagcgcaaaagatg

SEQ ID NO: 65927 - DNA, 103 bp, Artificial Sequence
  Synthetic Polynucleotide
taatacgactcactatagggggatgtatattccattgtcgttaaacgcgcaacagaggagagcgcgtatgacgacaatgaacctggcggcagcgcaaaagatg

SEQ ID NO: 65928 - DNA, 103 bp, Artificial Sequence
  Synthetic Polynucleotide
taatacgactcactatagggtctacggatgtatattccattgtcgttaaaaacagaggagatttaacatgaatggaataaacctggcggcagcgcaaaagatg

SEQ ID NO: 65929 - DNA, 103 bp, Artificial Sequence
  Synthetic Polynucleotide
taatacgactcactatagggatagttctacggatgtatattccattgtcgaacagaggagacgacaaatgaatatacataacctggcggcagcgcaaaagatg

SEQ ID NO: 65930 - DNA, 103 bp, Artificial Sequence
  Synthetic Polynucleotide
taatacgactcactatagggcaatcatagttctacggatgtatattccataacagaggagaatggaaatgacatccgtaaacctggcggcagcgcaaaagatg

SEQ ID NO: 65931 - DNA, 103 bp, Artificial Sequence
  Synthetic Polynucleotide
taatacgactcactatagggcttgtcaatcatagttctacggatgtatataacagaggagaatatacatgcgtagaactaacctggcggcagcgcaaaagatg

SEQ ID NO: 65932 - DNA, 103 bp, Artificial Sequence
  Synthetic Polynucleotide
taatacgactcactatagggtacaacttgtcaatcatagttctacggatgaacagaggagacatccgatgaactatgataacctggcggcagcgcaaaagatg

SEQ ID NO: 65933 - DNA, 103 bp, Artificial Sequence
  Synthetic Polynucleotide
taatacgactcactatagggatccgtacaacttgtcaatcatagttctacaacagaggagagtagaaatgtgattgacaaacctggcggcagcgcaaaagatg

SEQ ID NO: 65934 - DNA, 103 bp, Artificial Sequence
  Synthetic Polynucleotide
taatacgactcactatagggtgcgtatccgtacaacttgtcaatcatagtaacagaggagaactatgatggacaagttgaacctggcggcagcgcaaaagatg

SEQ ID NO: 65935 - DNA, 103 bp, Artificial Sequence
  Synthetic Polynucleotide
taatacgactcactatagggagagatgcgtatccgtacaacttgtcaatcaacagaggagagattgaatggttgtacggaacctggcggcagcgcaaaagatg

SEQ ID NO: 65936 - DNA, 103 bp, Artificial Sequence
  Synthetic Polynucleotide
taatacgactcactatagggtagttagagatgcgtatccgtacaacttgtaacagaggagaacaagtatgacggatacgaacctggcggcagcgcaaaagatg

SEQ ID NO: 65937 - DNA, 103 bp, Artificial Sequence
  Synthetic Polynucleotide
taatacgactcactatagggtatgaaagcgatagaaaaagataaactagaaacagaggagatctagtatgtctttttctaacctggcggcagcgcaaaagatg

SEQ ID NO: 65938 - DNA, 103 bp, Artificial Sequence
  Synthetic Polynucleotide
taatacgactcactatagggaatagtagttagagatgcgtatccgtacaaaacagaggagattgtacatgtacgcatctaacctggcggcagcgcaaaagatg

SEQ ID NO: 65939 - DNA, 103 bp, Artificial Sequence
  Synthetic Polynucleotide
taatacgactcactatagggcgtgcaatagtagttagagatgcgtatccgaacagaggagacggataatgatctctaacaacctggcggcagcgcaaaagatg

SEQ ID NO: 65940 - DNA, 103 bp, Artificial Sequence
  Synthetic Polynucleotide
taatacgactcactataggggcgatcgtgcaatagtagttagagatgcgtaacagaggagaacgcatatgtaactactaaacctggcggcagcgcaaaagatg

SEQ ID NO: 65941 - DNA, 103 bp, Artificial Sequence
  Synthetic Polynucleotide
taatacgactcactatagggctccagcgatcgtgcaatagtagttagagaaacagaggagatctctaatgactattgcaaacctggcggcagcgcaaaagatg

SEQ ID NO: 65942 - DNA, 103 bp, Artificial Sequence
  Synthetic Polynucleotide
taatacgactcactatagggaacacctccagcgatcgtgcaatagtagttaacagaggagaaactacatgtgcacgatcaacctggcggcagcgcaaaagatg

SEQ ID NO: 65943 - DNA, 103 bp, Artificial Sequence
  Synthetic Polynucleotide
taatacgactcactatagggtaacaaacacctccagcgatcgtgcaatagaacagaggagactattgatggatcgctggaacctggcggcagcgcaaaagatg

SEQ ID NO: 65944 - DNA, 103 bp, Artificial Sequence
  Synthetic Polynucleotide
taatacgactcactataggggataataacaaacacctccagcgatcgtgcaacagaggagagcacgaatgctggaggtgaacctggcggcagcgcaaaagatg

SEQ ID NO: 65945 - DNA, 103 bp, Artificial Sequence
  Synthetic Polynucleotide
taatacgactcactatagggcaacagataataacaaacacctccagcgataacagaggagaatcgctatgggtgtttgtaacctggcggcagcgcaaaagatg

SEQ ID NO: 65946 - DNA, 103 bp, Artificial Sequence
  Synthetic Polynucleotide
taatacgactcactatagggtgcatcaacagataataacaaacacctccaaacagaggagatggaggatgttgttattaaacctggcggcagcgcaaaagatg

SEQ ID NO: 65947 - DNA, 103 bp, Artificial Sequence
  Synthetic Polynucleotide
taatacgactcactatagggctagatgcatcaacagataataacaaacacaacagaggagagtgtttatgattatctgtaacctggcggcagcgcaaaagatg

SEQ ID NO: 65948 - DNA, 103 bp, Artificial Sequence
  Synthetic Polynucleotide
taatacgactcactatagggctaactatgaaagcgatagaaaaagataaaaacagaggagatttatcatgttctatcgcaacctggcggcagcgcaaaagatg

SEQ ID NO: 65949 - DNA, 103 bp, Artificial Sequence
  Synthetic Polynucleotide
taatacgactcactatagggactaactagatgcatcaacagataataacaaacagaggagatgttatatgctgttgatgaacctggcggcagcgcaaaagatg

SEQ ID NO: 65950 - DNA, 103 bp, Artificial Sequence
  Synthetic Polynucleotide
taatacgactcactatagggtacaaactaactagatgcatcaacagataaaacagaggagattatctatggatgcatctaacctggcggcagcgcaaaagatg

SEQ ID NO: 65951 - DNA, 103 bp, Artificial Sequence
  Synthetic Polynucleotide
taatacgactcactatagggatttatacaaactaactagatgcatcaacaaacagaggagatgttgaatgatctagttaaacctggcggcagcgcaaaagatg

SEQ ID NO: 65952 - DNA, 103 bp, Artificial Sequence
  Synthetic Polynucleotide
taatacgactcactatagggtaattatttatacaaactaactagatgcataacagaggagaatgcatatggttagtttgaacctggcggcagcgcaaaagatg

SEQ ID NO: 65953 - DNA, 103 bp, Artificial Sequence
  Synthetic Polynucleotide
taatacgactcactatagggtgaaataattatttatacaaactaactagaaacagaggagatctagtatgtttgtataaaacctggcggcagcgcaaaagatg

SEQ ID NO: 65954 - DNA, 103 bp, Artificial Sequence
  Synthetic Polynucleotide
taatacgactcactatagggtatattgaaataattatttatacaaactaaaacagaggagattagttatgataaataataacctggcggcagcgcaaaagatg

SEQ ID NO: 65955 - DNA, 103 bp, Artificial Sequence
  Synthetic Polynucleotide
taatacgactcactatagggactagtatattgaaataattatttatacaaaacagaggagattgtatatgtaattatttaacctggcggcagcgcaaaagatg

SEQ ID NO: 65956 - DNA, 103 bp, Artificial Sequence
  Synthetic Polynucleotide
taatacgactcactatagggttttaactagtatattgaaataattatttaaacagaggagataaataatgatttcaataaacctggcggcagcgcaaaagatg

SEQ ID NO: 65957 - DNA, 103 bp, Artificial Sequence
  Synthetic Polynucleotide
taatacgactcactatagggtaaaattttaactagtatattgaaataattaacagaggagaaattatatgaatatactaaacctggcggcagcgcaaaagatg

SEQ ID NO: 65958 - DNA, 103 bp, Artificial Sequence
  Synthetic Polynucleotide
taatacgactcactatagggaatcttaaaattttaactagtatattgaaaaacagaggagatttcaaatgactagttaaaacctggcggcagcgcaaaagatg

SEQ ID NO: 65959 - DNA, 103 bp, Artificial Sequence
  Synthetic Polynucleotide
taatacgactcactatagggtgtatctaactatgaaagcgatagaaaaagaacagaggagactttttatgtcgctttcaaacctggcggcagcgcaaaagatg

SEQ ID NO: 65960 - DNA, 103 bp, Artificial Sequence
  Synthetic Polynucleotide
taatacgactcactatagggtttaaaatcttaaaattttaactagtatataacagaggagaatatacatgttaaaatttaacctggcggcagcgcaaaagatg

SEQ ID NO: 65961 - DNA, 103 bp, Artificial Sequence
  Synthetic Polynucleotide
taatacgactcactatagggatacatttaaaatcttaaaattttaactagaacagaggagactagttatgattttaagaaacctggcggcagcgcaaaagatg

SEQ ID NO: 65962 - DNA, 103 bp, Artificial Sequence
  Synthetic Polynucleotide
taatacgactcactatagggtttttatacatttaaaatcttaaaattttaaacagaggagataaaatatgaagattttaaacctggcggcagcgcaaaagatg

SEQ ID NO: 65963 - DNA, 103 bp, Artificial Sequence
  Synthetic Polynucleotide
taatacgactcactatagggattagtttttatacatttaaaatcttaaaaaacagaggagattttaaatgtttaaatgtaacctggcggcagcgcaaaagatg

SEQ ID NO: 65964 - DNA, 103 bp, Artificial Sequence
  Synthetic Polynucleotide
taatacgactcactatagggacgttattagtttttatacatttaaaatctaacagaggagaagatttatgatgtataaaaacctggcggcagcgcaaaagatg

SEQ ID NO: 65965 - DNA, 103 bp, Artificial Sequence
  Synthetic Polynucleotide
taatacgactcactatagggtaaaaacgttattagtttttatacatttaaaacagaggagattaaatatgtaaaaactaaacctggcggcagcgcaaaagatg

SEQ ID NO: 65966 - DNA, 103 bp, Artificial Sequence
  Synthetic Polynucleotide
taatacgactcactatagggacaaataaaaacgttattagtttttatacaaacagaggagatgtataatgactaataacaacctggcggcagcgcaaaagatg

SEQ ID NO: 65967 - DNA, 103 bp, Artificial Sequence
  Synthetic Polynucleotide
taatacgactcactatagggctattacaaataaaaacgttattagtttttaacagaggagaaaaaacatgtaacgttttaacctggcggcagcgcaaaagatg

SEQ ID NO: 65968 - DNA, 103 bp, Artificial Sequence
  Synthetic Polynucleotide
taatacgactcactatagggtgcacctattacaaataaaaacgttattagaacagaggagactaataatgtttttatttaacctggcggcagcgcaaaagatg

SEQ ID NO: 65969 - DNA, 103 bp, Artificial Sequence
  Synthetic Polynucleotide
taatacgactcactataggggctattgcacctattacaaataaaaacgttaacagaggagaaacgttatgatttgtaataacctggcggcagcgcaaaagatg

SEQ ID NO: 65970 - DNA, 103 bp, Artificial Sequence
  Synthetic Polynucleotide
taatacgactcactataggggactatgtatctaactatgaaagcgatagaaacagaggagatctatcatgttcatagttaacctggcggcagcgcaaaagatg

SEQ ID NO: 65971 - DNA, 103 bp, Artificial Sequence
  Synthetic Polynucleotide
taatacgactcactatagggagaatgctattgcacctattacaaataaaaaacagaggagattttatatgtaataggtgaacctggcggcagcgcaaaagatg

SEQ ID NO: 65972 - DNA, 103 bp, Artificial Sequence
  Synthetic Polynucleotide
taatacgactcactatagggcgaatagaatgctattgcacctattacaaaaacagaggagatttgtaatgggtgcaataaacctggcggcagcgcaaaagatg

SEQ ID NO: 65973 - DNA, 103 bp, Artificial Sequence
  Synthetic Polynucleotide
taatacgactcactatagggttattcgaatagaatgctattgcacctattaacagaggagaaataggatgaatagcattaacctggcggcagcgcaaaagatg

SEQ ID NO: 65974 - DNA, 103 bp, Artificial Sequence
  Synthetic Polynucleotide
taatacgactcactatagggactcattattcgaatagaatgctattgcacaacagaggagagtgcaaatgcattctattaacctggcggcagcgcaaaagatg

SEQ ID NO: 65975 - DNA, 103 bp, Artificial Sequence
  Synthetic Polynucleotide
taatacgactcactatagggagtatactcattattcgaatagaatgctataacagaggagaatagcaatgtattcgaataacctggcggcagcgcaaaagatg

SEQ ID NO: 65976 - DNA, 103 bp, Artificial Sequence
  Synthetic Polynucleotide
taatacgactcactatagggaacggagtatactcattattcgaatagaataacagaggagaattctaatggaataatgaaacctggcggcagcgcaaaagatg

SEQ ID NO: 65977 - DNA, 103 bp, Artificial Sequence
  Synthetic Polynucleotide
taatacgactcactatagggtattaaacggagtatactcattattcgaataacagaggagaattcgaatgatgagtataaacctggcggcagcgcaaaagatg

SEQ ID NO: 65978 - DNA, 103 bp, Artificial Sequence
  Synthetic Polynucleotide
taatacgactcactatagggaagtttattaaacggagtatactcattattaacagaggagaaataatatgtatactccgaacctggcggcagcgcaaaagatg

SEQ ID NO: 65979 - DNA, 103 bp, Artificial Sequence
  Synthetic Polynucleotide
taatacgactcactatagggacactaagtttattaaacggagtatactcaaacagaggagatgagtaatgtccgtttaaaacctggcggcagcgcaaaagatg

SEQ ID NO: 65980 - DNA, 103 bp, Artificial Sequence
  Synthetic Polynucleotide
taatacgactcactataggggttttacactaagtttattaaacggagtataacagaggagaatactcatgttaataaacaacctggcggcagcgcaaaagatg

SEQ ID NO: 65981 - DNA, 103 bp, Artificial Sequence
  Synthetic Polynucleotide
taatacgactcactatagggtccgagactatgtatctaactatgaaagcgaacagaggagacgctttatgagttagataaacctggcggcagcgcaaaagatg

SEQ ID NO: 65982 - DNA, 103 bp, Artificial Sequence
  Synthetic Polynucleotide
taatacgactcactatagggatatagttttacactaagtttattaaacggaacagaggagaccgtttatgaaacttagtaacctggcggcagcgcaaaagatg

SEQ ID NO: 65983 - DNA, 103 bp, Artificial Sequence
  Synthetic Polynucleotide
taatacgactcactatagggtctatatatagttttacactaagtttattaaacagaggagataataaatgtagtgtaaaaacctggcggcagcgcaaaagatg

SEQ ID NO: 65984 - DNA, 103 bp, Artificial Sequence
  Synthetic Polynucleotide
taatacgactcactatagggctccatctatatatagttttacactaagttaacagaggagaaacttaatgtaaaactataacctggcggcagcgcaaaagatg

SEQ ID NO: 65985 - DNA, 103 bp, Artificial Sequence
  Synthetic Polynucleotide
taatacgactcactatagggatctactccatctatatatagttttacactaacagaggagaagtgtaatgctatatataaacctggcggcagcgcaaaagatg

SEQ ID NO: 65986 - DNA, 103 bp, Artificial Sequence
  Synthetic Polynucleotide
taatacgactcactatagggatattatctactccatctatatatagttttaacagaggagaaaaactatgtatagatggaacctggcggcagcgcaaaagatg

SEQ ID NO: 65987 - DNA, 103 bp, Artificial Sequence
  Synthetic Polynucleotide
taatacgactcactatagggtttctatattatctactccatctatatataaacagaggagatatataatgatggagtagaacctggcggcagcgcaaaagatg

SEQ ID NO: 65988 - DNA, 103 bp, Artificial Sequence
  Synthetic Polynucleotide
taatacgactcactatagggtgaattttctatattatctactccatctataacagaggagaatagatatggtagataataacctggcggcagcgcaaaagatg

SEQ ID NO: 65989 - DNA, 103 bp, Artificial Sequence
  Synthetic Polynucleotide
taatacgactcactataggggtatatgaattttctatattatctactccaaacagaggagatggagtatgtaatatagaaacctggcggcagcgcaaaagatg

SEQ ID NO: 65990 - DNA, 103 bp, Artificial Sequence
  Synthetic Polynucleotide
taatacgactcactatagggtatcagtatatgaattttctatattatctaaacagaggagatagataatgtagaaaattaacctggcggcagcgcaaaagatg

SEQ ID NO: 65991 - DNA, 103 bp, Artificial Sequence
  Synthetic Polynucleotide
taatacgactcactatagggattattatcagtatatgaattttctatattaacagaggagaaatataatgaattcatataacctggcggcagcgcaaaagatg

SEQ ID NO: 65992 - DNA, 103 bp, Artificial Sequence
  Synthetic Polynucleotide
taatacgactcactatagggcgacttccgagactatgtatctaactatgaaacagaggagatcatagatggatacatagaacctggcggcagcgcaaaagatg

SEQ ID NO: 65993 - DNA, 103 bp, Artificial Sequence
  Synthetic Polynucleotide
taatacgactcactatagggaattcattattatcagtatatgaattttctaacagaggagaagaaaaatgatatactgaaacctggcggcagcgcaaaagatg

SEQ ID NO: 65994 - DNA, 103 bp, Artificial Sequence
  Synthetic Polynucleotide
taatacgactcactatagggacactaattcattattatcagtatatgaataacagaggagaattcatatgctgataataaacctggcggcagcgcaaaagatg

SEQ ID NO: 65995 - DNA, 103 bp, Artificial Sequence
  Synthetic Polynucleotide
taatacgactcactatagggaattaacactaattcattattatcagtataaacagaggagatatactatgaataatgaaaacctggcggcagcgcaaaagatg

SEQ ID NO: 65996 - DNA, 103 bp, Artificial Sequence
  Synthetic Polynucleotide
taatacgactcactatagggttaaaaattaacactaattcattattatcaaacagaggagatgataaatgtgaattagtaacctggcggcagcgcaaaagatg

SEQ ID NO: 65997 - DNA, 103 bp, Artificial Sequence
  Synthetic Polynucleotide
taatacgactcactatagggactctttaaaaattaacactaattcattataacagaggagaataatgatgtagtgttaaaacctggcggcagcgcaaaagatg

SEQ ID NO: 65998 - DNA, 103 bp, Artificial Sequence
  Synthetic Polynucleotide
taatacgactcactatagggtgtgtactctttaaaaattaacactaattcaacagaggagagaattaatgttaatttttaacctggcggcagcgcaaaagatg

SEQ ID NO: 65999 - DNA, 103 bp, Artificial Sequence
  Synthetic Polynucleotide
taatacgactcactataggggaaactgtgtactctttaaaaattaacactaacagaggagaagtgttatgttttaaagaaacctggcggcagcgcaaaagatg

SEQ ID NO: 66000 - DNA, 103 bp, Artificial Sequence
  Synthetic Polynucleotide
taatacgactcactatagggtaatagaaactgtgtactctttaaaaattaaacagaggagataatttatgaagagtacaaacctggcggcagcgcaaaagatg

SEQ ID NO: 66001 - DNA, 103 bp, Artificial Sequence
  Synthetic Polynucleotide
taatacgactcactatagggtgtaataatagaaactgtgtactctttaaaaacagaggagatttaaaatgtacacagttaacctggcggcagcgcaaaagatg

SEQ ID NO: 66002 - DNA, 103 bp, Artificial Sequence
  Synthetic Polynucleotide
taatacgactcactataggggactctgtaataatagaaactgtgtactctaacagaggagaagagtaatgagtttctataacctggcggcagcgcaaaagatg

SEQ ID NO: 66003 - DNA, 103 bp, Artificial Sequence
  Synthetic Polynucleotide
taatacgactcactatagggtaatccgacttccgagactatgtatctaacaacagaggagagttagaatgatagtctcgaacctggcggcagcgcaaaagatg

SEQ ID NO: 66004 - DNA, 103 bp, Artificial Sequence
  Synthetic Polynucleotide
taatacgactcactatagggcgtatgactctgtaataatagaaactgtgtaacagaggagaacacagatgctattattaaacctggcggcagcgcaaaagatg

SEQ ID NO: 66005 - DNA, 103 bp, Artificial Sequence
  Synthetic Polynucleotide
taatacgactcactataggggacgtcgtatgactctgtaataatagaaacaacagaggagagtttctatgattacagagaacctggcggcagcgcaaaagatg

SEQ ID NO: 66006 - DNA, 103 bp, Artificial Sequence
  Synthetic Polynucleotide
taatacgactcactatagggaatccgacgtcgtatgactctgtaataataaacagaggagatattatatgagagtcataaacctggcggcagcgcaaaagatg

SEQ ID NO: 66007 - DNA, 103 bp, Artificial Sequence
  Synthetic Polynucleotide
taatacgactcactatagggaatcaaatccgacgtcgtatgactctgtaaaacagaggagattacagatgcatacgacgaacctggcggcagcgcaaaagatg

SEQ ID NO: 66008 - DNA, 103 bp, Artificial Sequence
  Synthetic Polynucleotide
taatacgactcactatagggtatggaatcaaatccgacgtcgtatgactcaacagaggagagagtcaatggacgtcggaaacctggcggcagcgcaaaagatg

SEQ ID NO: 66009 - DNA, 103 bp, Artificial Sequence
  Synthetic Polynucleotide
taatacgactcactatagggatatctatggaatcaaatccgacgtcgtataacagaggagaatacgaatgcggatttgaaacctggcggcagcgcaaaagatg

SEQ ID NO: 66010 - DNA, 103 bp, Artificial Sequence
  Synthetic Polynucleotide
taatacgactcactatagggcatctatatctatggaatcaaatccgacgtaacagaggagaacgtcgatgttgattccaaacctggcggcagcgcaaaagatg

SEQ ID NO: 66011 - DNA, 103 bp, Artificial Sequence
  Synthetic Polynucleotide
taatacgactcactatagggtataacatctatatctatggaatcaaatccaacagaggagaggatttatgtccatagataacctggcggcagcgcaaaagatg

SEQ ID NO: 66012 - DNA, 103 bp, Artificial Sequence
  Synthetic Polynucleotide
taatacgactcactatagggtcgtttataacatctatatctatggaatcaaacagaggagatgattcatgagatatagaaacctggcggcagcgcaaaagatg

SEQ ID NO: 66013 - DNA, 103 bp, Artificial Sequence
  Synthetic Polynucleotide
taatacgactcactatagggtatagtcgtttataacatctatatctatggaacagaggagaccatagatgtagatgttaaacctggcggcagcgcaaaagatg

SEQ ID NO: 66014 - DNA, 103 bp, Artificial Sequence
  Synthetic Polynucleotide
taatacgactcactatagggtacaattgatatctaaaaatactaagaccgaacagaggagacggtctatgtatttttagaacctggcggcagcgcaaaagatg

SEQ ID NO: 66015 - DNA, 103 bp, Artificial Sequence
  Synthetic Polynucleotide
taatacgactcactatagggttacataatccgacttccgagactatgtataacagaggagaatacatatgctcggaagtaacctggcggcagcgcaaaagatg

SEQ ID NO: 66016 - DNA, 103 bp, Artificial Sequence
  Synthetic Polynucleotide
taatacgactcactatagggaattttatagtcgtttataacatctatatcaacagaggagagatataatggttataaacaacctggcggcagcgcaaaagatg

SEQ ID NO: 66017 - DNA, 103 bp, Artificial Sequence
  Synthetic Polynucleotide
taatacgactcactatagggtcaataattttatagtcgtttataacatctaacagaggagaagatgtatgaaacgactaaacctggcggcagcgcaaaagatg

SEQ ID NO: 66018 - DNA, 103 bp, Artificial Sequence
  Synthetic Polynucleotide
taatacgactcactatagggacatatcaataattttatagtcgtttataaaacagaggagattataaatgactataaaaaacctggcggcagcgcaaaagatg

SEQ ID NO: 66019 - DNA, 103 bp, Artificial Sequence
  Synthetic Polynucleotide
taatacgactcactatagggagtatacatatcaataattttatagtcgttaacagaggagaaacgacatgaaaattattaacctggcggcagcgcaaaagatg

SEQ ID NO: 66020 - DNA, 103 bp, Artificial Sequence
  Synthetic Polynucleotide
taatacgactcactatagggtcaatagtatacatatcaataattttatagaacagaggagactataaatgtattgatataacctggcggcagcgcaaaagatg

SEQ ID NO: 66021 - DNA, 103 bp, Artificial Sequence
  Synthetic Polynucleotide
taatacgactcactatagggacgagtcaatagtatacatatcaataatttaacagaggagaaaattaatgatatgtataaacctggcggcagcgcaaaagatg

SEQ ID NO: 66022 - DNA, 103 bp, Artificial Sequence
  Synthetic Polynucleotide
taatacgactcactatagggagtagacgagtcaatagtatacatatcaataacagaggagaattgatatgtatactattaacctggcggcagcgcaaaagatg

SEQ ID NO: 66023 - DNA, 103 bp, Artificial Sequence
  Synthetic Polynucleotide
taatacgactcactatagggtaaatagtagacgagtcaatagtatacataaacagaggagatatgtaatgtattgactcaacctggcggcagcgcaaaagatg

SEQ ID NO: 66024 - DNA, 103 bp, Artificial Sequence
  Synthetic Polynucleotide
taatacgactcactatagggtgcattaaatagtagacgagtcaatagtataacagaggagaatactaatgactcgtctaaacctggcggcagcgcaaaagatg

SEQ ID NO: 66025 - DNA, 103 bp, Artificial Sequence
  Synthetic Polynucleotide
taatacgactcactatagggtcctttgcattaaatagtagacgagtcaataacagaggagaattgacatgtctactattaacctggcggcagcgcaaaagatg

SEQ ID NO: 66026 - DNA, 103 bp, Artificial Sequence
  Synthetic Polynucleotide
taatacgactcactatagggtgatgttacataatccgacttccgagactaaacagaggagatagtctatgaagtcggataacctggcggcagcgcaaaagatg

SEQ ID NO: 66027 - DNA, 103 bp, Artificial Sequence
  Synthetic Polynucleotide
taatacgactcactataggggtgtgtcctttgcattaaatagtagacgagaacagaggagactcgtcatgtatttaatgaacctggcggcagcgcaaaagatg

SEQ ID NO: 66028 - DNA, 103 bp, Artificial Sequence
  Synthetic Polynucleotide
taatacgactcactatagggtacatgtgtgtcctttgcattaaatagtagaacagaggagactactaatgaatgcaaagaacctggcggcagcgcaaaagatg

SEQ ID NO: 66029 - DNA, 103 bp, Artificial Sequence
  Synthetic Polynucleotide
taatacgactcactatagggtattctacatgtgtgtcctttgcattaaataacagaggagaatttaaatgaaaggacacaacctggcggcagcgcaaaagatg

SEQ ID NO: 66030 - DNA, 103 bp, Artificial Sequence
  Synthetic Polynucleotide
taatacgactcactataggggtagatattctacatgtgtgtcctttgcataacagaggagaatgcaaatgacacacatgaacctggcggcagcgcaaaagatg

SEQ ID NO: 66031 - DNA, 103 bp, Artificial Sequence
  Synthetic Polynucleotide
taatacgactcactatagggatttggtagatattctacatgtgtgtccttaacagaggagaaaggacatgcatgtagaaaacctggcggcagcgcaaaagatg

SEQ ID NO: 66032 - DNA, 103 bp, Artificial Sequence
  Synthetic Polynucleotide
taatacgactcactatagggtgataatttggtagatattctacatgtgtgaacagaggagacacacaatgagaatatctaacctggcggcagcgcaaaagatg

SEQ ID NO: 66033 - DNA, 103 bp, Artificial Sequence
  Synthetic Polynucleotide
taatacgactcactatagggtggcatgataatttggtagatattctacataacagaggagaatgtagatgatctaccaaaacctggcggcagcgcaaaagatg

SEQ ID NO: 66034 - DNA, 103 bp, Artificial Sequence
  Synthetic Polynucleotide
taatacgactcactatagggcataatggcatgataatttggtagatattcaacagaggagagaatatatgccaaattataacctggcggcagcgcaaaagatg

SEQ ID NO: 66035 - DNA, 103 bp, Artificial Sequence
  Synthetic Polynucleotide
taatacgactcactatagggtttatcataatggcatgataatttggtagaaacagaggagatctaccatgttatcatgcaacctggcggcagcgcaaaagatg

SEQ ID NO: 66036 - DNA, 103 bp, Artificial Sequence
  Synthetic Polynucleotide
taatacgactcactataggggggtgtttatcataatggcatgataatttgaacagaggagacaaattatgatgccattaaacctggcggcagcgcaaaagatg

SEQ ID NO: 66037 - DNA, 103 bp, Artificial Sequence
  Synthetic Polynucleotide
taatacgactcactataggggaagttgatgttacataatccgacttccgaaacagaggagatcggaaatgggattatgtaacctggcggcagcgcaaaagatg

SEQ ID NO: 66038 - DNA, 103 bp, Artificial Sequence
  Synthetic Polynucleotide
taatacgactcactatagggtataagggtgtttatcataatggcatgataaacagaggagatatcatatgattatgataaacctggcggcagcgcaaaagatg

SEQ ID NO: 66039 - DNA, 103 bp, Artificial Sequence
  Synthetic Polynucleotide
taatacgactcactataggggtgaatataagggtgtttatcataatggcaaacagaggagatgccatatggataaacacaacctggcggcagcgcaaaagatg

SEQ ID NO: 66040 - DNA, 103 bp, Artificial Sequence
  Synthetic Polynucleotide
taatacgactcactatagggtatttgtgaatataagggtgtttatcataaaacagaggagattatgaatgacacccttaaacctggcggcagcgcaaaagatg

SEQ ID NO: 66041 - DNA, 103 bp, Artificial Sequence
  Synthetic Polynucleotide
taatacgactcactatagggccttatatttgtgaatataagggtgtttataacagaggagaataaacatgcttatattcaacctggcggcagcgcaaaagatg

SEQ ID NO: 66042 - DNA, 103 bp, Artificial Sequence
  Synthetic Polynucleotide
taatacgactcactatagggatcacccttatatttgtgaatataagggtgaacagaggagacaccctatgattcacaaaaacctggcggcagcgcaaaagatg

SEQ ID NO: 66043 - DNA, 103 bp, Artificial Sequence
  Synthetic Polynucleotide
taatacgactcactatagggcgcttatcacccttatatttgtgaatataaaacagaggagattatatatgcaaatataaaacctggcggcagcgcaaaagatg

SEQ ID NO: 66044 - DNA, 103 bp, Artificial Sequence
  Synthetic Polynucleotide
taatacgactcactatagggattgtcgcttatcacccttatatttgtgaaaacagaggagattcacaatgataagggtgaacctggcggcagcgcaaaagatg

SEQ ID NO: 66045 - DNA, 103 bp, Artificial Sequence
  Synthetic Polynucleotide
taatacgactcactatagggagaatattgtcgcttatcacccttatatttaacagaggagaaaatatatgggtgataagaacctggcggcagcgcaaaagatg

SEQ ID NO: 66046 - DNA, 103 bp, Artificial Sequence
  Synthetic Polynucleotide
taatacgactcactataggggtaatagaatattgtcgcttatcacccttaaacagaggagataagggatgtaagcgacaaacctggcggcagcgcaaaagatg

SEQ ID NO: 66047 - DNA, 103 bp, Artificial Sequence
  Synthetic Polynucleotide
taatacgactcactatagggttgtagtaatagaatattgtcgcttatcacaacagaggagagtgataatggacaatattaacctggcggcagcgcaaaagatg

SEQ ID NO: 66048 - DNA, 103 bp, Artificial Sequence
  Synthetic Polynucleotide
taatacgactcactatagggttatcgaagttgatgttacataatccgactaacagaggagaagtcggatgatgtaacataacctggcggcagcgcaaaagatg

SEQ ID NO: 66049 - DNA, 103 bp, Artificial Sequence
  Synthetic Polynucleotide
taatacgactcactatagggtccctttgtagtaatagaatattgtcgcttaacagaggagaaagcgaatgtattctattaacctggcggcagcgcaaaagatg

SEQ ID NO: 66050 - DNA, 103 bp, Artificial Sequence
  Synthetic Polynucleotide
taatacgactcactatagggcattttccctttgtagtaatagaatattgtaacagaggagaacaataatgtattactacaacctggcggcagcgcaaaagatg

SEQ ID NO: 66051 - DNA, 103 bp, Artificial Sequence
  Synthetic Polynucleotide
taatacgactcactatagggtatagcattttccctttgtagtaatagaataacagaggagaattctaatgctacaaaggaacctggcggcagcgcaaaagatg

SEQ ID NO: 66052 - DNA, 103 bp, Artificial Sequence
  Synthetic Polynucleotide
taatacgactcactatagggtcctttatagcattttccctttgtagtaataacagaggagaattactatgaagggaaaaaacctggcggcagcgcaaaagatg

SEQ ID NO: 66053 - DNA, 103 bp, Artificial Sequence
  Synthetic Polynucleotide
taatacgactcactatagggtttattcctttatagcattttccctttgtaaacagaggagatacaaaatgaaaatgctaaacctggcggcagcgcaaaagatg

SEQ ID NO: 66054 - DNA, 103 bp, Artificial Sequence
  Synthetic Polynucleotide
taatacgactcactatagggcatattttattcctttatagcattttccctaacagaggagaagggaaatggctataaagaacctggcggcagcgcaaaagatg

SEQ ID NO: 66055 - DNA, 103 bp, Artificial Sequence
  Synthetic Polynucleotide
taatacgactcactatagggtatttcatattttattcctttatagcatttaacagaggagaaaatgcatgaaaggaataaacctggcggcagcgcaaaagatg

SEQ ID NO: 66056 - DNA, 103 bp, Artificial Sequence
  Synthetic Polynucleotide
taatacgactcactataggggtacttatttcatattttattcctttatagaacagaggagactataaatgaataaaataaacctggcggcagcgcaaaagatg

SEQ ID NO: 66057 - DNA, 103 bp, Artificial Sequence
  Synthetic Polynucleotide
taatacgactcactatagggtcattgtacttatttcatattttattccttaacagaggagaaaggaaatgaatatgaaaaacctggcggcagcgcaaaagatg

SEQ ID NO: 66058 - DNA, 103 bp, Artificial Sequence
  Synthetic Polynucleotide
taatacgactcactatagggatcgttcattgtacttatttcatattttataacagaggagaataaaaatggaaataagtaacctggcggcagcgcaaaagatg

SEQ ID NO: 66059 - DNA, 103 bp, Artificial Sequence
  Synthetic Polynucleotide
taatacgactcactatagggtaattttatcgaagttgatgttacataatcaacagaggagagattatatgacatcaactaacctggcggcagcgcaaaagatg

SEQ ID NO: 66060 - DNA, 103 bp, Artificial Sequence
  Synthetic Polynucleotide
taatacgactcactatagggatattatcgttcattgtacttatttcatataacagaggagaatatgaatgaagtacaataacctggcggcagcgcaaaagatg

SEQ ID NO: 66061 - DNA, 103 bp, Artificial Sequence
  Synthetic Polynucleotide
taatacgactcactatagggatagaatattatcgttcattgtacttatttaacagaggagaaaataaatgcaatgaacgaacctggcggcagcgcaaaagatg

SEQ ID NO: 66062 - DNA, 103 bp, Artificial Sequence
  Synthetic Polynucleotide
taatacgactcactatagggtctcaatagaatattatcgttcattgtactaacagaggagaagtacaatgaacgataataacctggcggcagcgcaaaagatg

SEQ ID NO: 66063 - DNA, 103 bp, Artificial Sequence
  Synthetic Polynucleotide
taatacgactcactatagggtgttgtctcaatagaatattatcgttcattaacagaggagaaatgaaatgtaatattctaacctggcggcagcgcaaaagatg

SEQ ID NO: 66064 - DNA, 103 bp, Artificial Sequence
  Synthetic Polynucleotide
taatacgactcactataggggagtatgttgtctcaatagaatattatcgtaacagaggagaacgataatgttctattgaaacctggcggcagcgcaaaagatg

SEQ ID NO: 66065 - DNA, 103 bp, Artificial Sequence
  Synthetic Polynucleotide
taatacgactcactatagggtttaagagtatgttgtctcaatagaatattaacagaggagaaatattatgttgagacaaaacctggcggcagcgcaaaagatg

SEQ ID NO: 66066 - DNA, 103 bp, Artificial Sequence
  Synthetic Polynucleotide
taatacgactcactatagggccaattttaagagtatgttgtctcaatagaaacagaggagatctattatgacaacatacaacctggcggcagcgcaaaagatg

SEQ ID NO: 66067 - DNA, 103 bp, Artificial Sequence
  Synthetic Polynucleotide
taatacgactcactatagggtagatccaattttaagagtatgttgtctcaaacagaggagatgagacatgatactcttaaacctggcggcagcgcaaaagatg

SEQ ID NO: 66068 - DNA, 103 bp, Artificial Sequence
  Synthetic Polynucleotide
taatacgactcactatagggattagtagatccaattttaagagtatgttgaacagaggagacaacatatgcttaaaattaacctggcggcagcgcaaaagatg

SEQ ID NO: 66069 - DNA, 103 bp, Artificial Sequence
  Synthetic Polynucleotide
taatacgactcactatagggaatatattagtagatccaattttaagagtaaacagaggagatactctatgaattggatcaacctggcggcagcgcaaaagatg

SEQ ID NO: 66070 - DNA, 103 bp, Artificial Sequence
  Synthetic Polynucleotide
taatacgactcactatagggcccagtaattttatcgaagttgatgttacaaacagaggagatgtaacatgaacttcgataacctggcggcagcgcaaaagatg

SEQ ID NO: 66071 - DNA, 103 bp, Artificial Sequence
  Synthetic Polynucleotide
taatacgactcactatagggtatcgaatatattagtagatccaattttaaaacagaggagattaaaaatggatctactaaacctggcggcagcgcaaaagatg

SEQ ID NO: 66072 - DNA, 103 bp, Artificial Sequence
  Synthetic Polynucleotide
taatacgactcactatagggataactatcgaatatattagtagatccaataacagaggagaattggaatgactaatataaacctggcggcagcgcaaaagatg

SEQ ID NO: 66073 - DNA, 103 bp, Artificial Sequence
  Synthetic Polynucleotide
taatacgactcactatagggtgtccataactatcgaatatattagtagataacagaggagaatctacatgtatattcgaaacctggcggcagcgcaaaagatg

SEQ ID NO: 66074 - DNA, 103 bp, Artificial Sequence
  Synthetic Polynucleotide
taatacgactcactatagggtactatgtccataactatcgaatatattagaacagaggagactaataatgtcgatagttaacctggcggcagcgcaaaagatg

SEQ ID NO: 66075 - DNA, 103 bp, Artificial Sequence
  Synthetic Polynucleotide
taatacgactcactatagggtgtattactatgtccataactatcgaatataacagaggagaatattcatgagttatggaaacctggcggcagcgcaaaagatg

SEQ ID NO: 66076 - DNA, 103 bp, Artificial Sequence
  Synthetic Polynucleotide
taatacgactcactatagggtaatatgtattactatgtccataactatcgaacagaggagacgatagatgtggacatagaacctggcggcagcgcaaaagatg

SEQ ID NO: 66077 - DNA, 103 bp, Artificial Sequence
  Synthetic Polynucleotide
taatacgactcactatagggttgaataatatgtattactatgtccataacaacagaggagagttatgatgatagtaataaacctggcggcagcgcaaaagatg

SEQ ID NO: 66078 - DNA, 103 bp, Artificial Sequence
  Synthetic Polynucleotide
taatacgactcactatagggatattttgaataatatgtattactatgtccaacagaggagaggacatatgaatacatataacctggcggcagcgcaaaagatg

SEQ ID NO: 66079 - DNA, 103 bp, Artificial Sequence
  Synthetic Polynucleotide
taatacgactcactatagggagaccatattttgaataatatgtattactaaacagaggagatagtaaatgatattattcaacctggcggcagcgcaaaagatg

SEQ ID NO: 66080 - DNA, 103 bp, Artificial Sequence
  Synthetic Polynucleotide
taatacgactcactatagggtttaaagaccatattttgaataatatgtataacagaggagaatacatatgattcaaaataacctggcggcagcgcaaaagatg

SEQ ID NO: 66081 - DNA, 103 bp, Artificial Sequence
  Synthetic Polynucleotide
taatacgactcactatagggaataacccagtaattttatcgaagttgatgaacagaggagacatcaaatgcgataaaataacctggcggcagcgcaaaagatg

SEQ ID NO: 66082 - DNA, 103 bp, Artificial Sequence
  Synthetic Polynucleotide
taatacgactcactatagggaaatttttaaagaccatattttgaataataaacagaggagatattatatgaaatatggtaacctggcggcagcgcaaaagatg

SEQ ID NO: 66083 - DNA, 103 bp, Artificial Sequence
  Synthetic Polynucleotide
taatacgactcactatagggattttaaatttttaaagaccatattttgaaaacagaggagattcaaaatgtggtctttaaacctggcggcagcgcaaaagatg

SEQ ID NO: 66084 - DNA, 103 bp, Artificial Sequence
  Synthetic Polynucleotide
taatacgactcactatagggaatatattttaaatttttaaagaccatattaacagaggagaaatatgatgtttaaaaataacctggcggcagcgcaaaagatg

SEQ ID NO: 66085 - DNA, 103 bp, Artificial Sequence
  Synthetic Polynucleotide
taatacgactcactataggggtgataatatattttaaatttttaaagaccaacagaggagaggtcttatgaaatttaaaaacctggcggcagcgcaaaagatg

SEQ ID NO: 66086 - DNA, 103 bp, Artificial Sequence
  Synthetic Polynucleotide
taatacgactcactatagggttgaagtgataatatattttaaatttttaaaacagaggagattaaaaatgtaaaatataaacctggcggcagcgcaaaagatg

SEQ ID NO: 66087 - DNA, 103 bp, Artificial Sequence
  Synthetic Polynucleotide
taatacgactcactatagggtgtcgttgaagtgataatatattttaaattaacagaggagaaatttaatgtatattatcaacctggcggcagcgcaaaagatg

SEQ ID NO: 66088 - DNA, 103 bp, Artificial Sequence
  Synthetic Polynucleotide
taatacgactcactatagggactattgtcgttgaagtgataatatattttaacagaggagaaaaataatgtatcacttcaacctggcggcagcgcaaaagatg

SEQ ID NO: 66089 - DNA, 103 bp, Artificial Sequence
  Synthetic Polynucleotide
taatacgactcactatagggatttgactattgtcgttgaagtgataatataacagaggagaatattaatgcttcaacgaaacctggcggcagcgcaaaagatg

SEQ ID NO: 66090 - DNA, 103 bp, Artificial Sequence
  Synthetic Polynucleotide
taatacgactcactatagggctgttatttgactattgtcgttgaagtgataacagaggagaatcactatgacgacaataaacctggcggcagcgcaaaagatg

SEQ ID NO: 66091 - DNA, 103 bp, Artificial Sequence
  Synthetic Polynucleotide
taatacgactcactatagggattggctgttatttgactattgtcgttgaaaacagaggagattcaacatgaatagtcaaaacctggcggcagcgcaaaagatg

SEQ ID NO: 66092 - DNA, 103 bp, Artificial Sequence
  Synthetic Polynucleotide
taatacgactcactataggggactaaataacccagtaattttatcgaagtaacagaggagaacttcgatgaaattactgaacctggcggcagcgcaaaagatg

SEQ ID NO: 66093 - DNA, 103 bp, Artificial Sequence
  Synthetic Polynucleotide
taatacgactcactatagggctcatattggctgttatttgactattgtcgaacagaggagacgacaaatgtcaaataacaacctggcggcagcgcaaaagatg

SEQ ID NO: 66094 - DNA, 103 bp, Artificial Sequence
  Synthetic Polynucleotide
taatacgactcactatagggcagatctcatattggctgttatttgactataacagaggagaatagtcatgtaacagccaaacctggcggcagcgcaaaagatg

SEQ ID NO: 66095 - DNA, 103 bp, Artificial Sequence
  Synthetic Polynucleotide
taatacgactcactatagggcattacagatctcatattggctgttatttgaacagaggagacaaataatggccaatatgaacctggcggcagcgcaaaagatg

SEQ ID NO: 66096 - DNA, 103 bp, Artificial Sequence
  Synthetic Polynucleotide
taatacgactcactataggggttagcattacagatctcatattggctgttaacagaggagaaacagcatgtatgagatcaacctggcggcagcgcaaaagatg

SEQ ID NO: 66097 - DNA, 103 bp, Artificial Sequence
  Synthetic Polynucleotide
taatacgactcactatagggaaactgttagcattacagatctcatattggaacagaggagaccaataatggatctgtaaaacctggcggcagcgcaaaagatg

SEQ ID NO: 66098 - DNA, 103 bp, Artificial Sequence
  Synthetic Polynucleotide
taatacgactcactatagggtagcaaaactgttagcattacagatctcataacagaggagaatgagaatggtaatgctaaacctggcggcagcgcaaaagatg

SEQ ID NO: 66099 - DNA, 103 bp, Artificial Sequence
  Synthetic Polynucleotide
taatacgactcactatagggttaattagcaaaactgttagcattacagataacagaggagaatctgtatggctaacagtaacctggcggcagcgcaaaagatg

SEQ ID NO: 66100 - DNA, 103 bp, Artificial Sequence
  Synthetic Polynucleotide
taatacgactcactatagggtgctattaattagcaaaactgttagcattaaacagaggagataatgcatgcagttttgcaacctggcggcagcgcaaaagatg

SEQ ID NO: 66101 - DNA, 103 bp, Artificial Sequence
  Synthetic Polynucleotide
taatacgactcactatagggatttatgctattaattagcaaaactgttagaacagaggagactaacaatgttgctaattaacctggcggcagcgcaaaagatg

SEQ ID NO: 66102 - DNA, 103 bp, Artificial Sequence
  Synthetic Polynucleotide
taatacgactcactataggggtagcatttatgctattaattagcaaaactaacagaggagaagttttatgaattaatagaacctggcggcagcgcaaaagatg

SEQ ID NO: 66103 - DNA, 103 bp, Artificial Sequence
  Synthetic Polynucleotide
taatacgactcactatagggcgtaagactaaataacccagtaattttatcaacagaggagagataaaatgactgggttaaacctggcggcagcgcaaaagatg

SEQ ID NO: 66104 - DNA, 103 bp, Artificial Sequence
  Synthetic Polynucleotide
taatacgactcactatagggttatcgtagcatttatgctattaattagcaaacagaggagatgctaaatgatagcataaaacctggcggcagcgcaaaagatg

SEQ ID NO: 66105 - DNA, 103 bp, Artificial Sequence
  Synthetic Polynucleotide
taatacgactcactataggggctagttatcgtagcatttatgctattaataacagaggagaattaatatgataaatgctaacctggcggcagcgcaaaagatg

SEQ ID NO: 66106 - DNA, 103 bp, Artificial Sequence
  Synthetic Polynucleotide
taatacgactcactatagggttatagctagttatcgtagcatttatgctaaacagaggagatagcatatgtgctacgataacctggcggcagcgcaaaagatg

SEQ ID NO: 66107 - DNA, 103 bp, Artificial Sequence
  Synthetic Polynucleotide
taatacgactcactatagggcgaatttatagctagttatcgtagcatttaaacagaggagataaatgatgcgataactaaacctggcggcagcgcaaaagatg

SEQ ID NO: 66108 - DNA, 103 bp, Artificial Sequence
  Synthetic Polynucleotide
taatacgactcactatagggggattcgaatttatagctagttatcgtagcaacagaggagagctacgatgactagctataacctggcggcagcgcaaaagatg

SEQ ID NO: 66109 - DNA, 103 bp, Artificial Sequence
  Synthetic Polynucleotide
taatacgactcactatagggttgacggattcgaatttatagctagttatcaacagaggagagataacatgctataaattaacctggcggcagcgcaaaagatg

SEQ ID NO: 66110 - DNA, 103 bp, Artificial Sequence
  Synthetic Polynucleotide
taatacgactcactatagggcaaaattgacggattcgaatttatagctagaacagaggagactagctatgaattcgaataacctggcggcagcgcaaaagatg

SEQ ID NO: 66111 - DNA, 103 bp, Artificial Sequence
  Synthetic Polynucleotide
taatacgactcactatagggggaatcaaaattgacggattcgaatttataaacagaggagatataaaatggaatccgtcaacctggcggcagcgcaaaagatg

SEQ ID NO: 66112 - DNA, 103 bp, Artificial Sequence
  Synthetic Polynucleotide
taatacgactcactatagggattttggaatcaaaattgacggattcgaataacagaggagaattcgaatgcgtcaatttaacctggcggcagcgcaaaagatg

SEQ ID NO: 66113 - DNA, 103 bp, Artificial Sequence
  Synthetic Polynucleotide
taatacgactcactatagggattcaattttggaatcaaaattgacggattaacagaggagaaatccgatgattttgattaacctggcggcagcgcaaaagatg

SEQ ID NO: 66114 - DNA, 103 bp, Artificial Sequence
  Synthetic Polynucleotide
taatacgactcactataggggaatgcgtaagactaaataacccagtaattaacagaggagaaattacatggttatttagaacctggcggcagcgcaaaagatg

SEQ ID NO: 66115 - DNA, 103 bp, Artificial Sequence
  Synthetic Polynucleotide
taatacgactcactatagggagtccattcaattttggaatcaaaattgacaacagaggagagtcaatatggattccaaaaacctggcggcagcgcaaaagatg

SEQ ID NO: 66116 - DNA, 103 bp, Artificial Sequence
  Synthetic Polynucleotide
taatacgactcactatagggtcgccagtccattcaattttggaatcaaaaaacagaggagattttgaatgcaaaattgaaacctggcggcagcgcaaaagatg

SEQ ID NO: 66117 - DNA, 103 bp, Artificial Sequence
  Synthetic Polynucleotide
taatacgactcactataggggaccatcgccagtccattcaattttggaataacagaggagaattccaatgttgaatggaaacctggcggcagcgcaaaagatg

SEQ ID NO: 66118 - DNA, 103 bp, Artificial Sequence
  Synthetic Polynucleotide
taatacgactcactataggggtatagaccatcgccagtccattcaattttaacagaggagaaaaattatgtggactggcaacctggcggcagcgcaaaagatg

SEQ ID NO: 66119 - DNA, 103 bp, Artificial Sequence
  Synthetic Polynucleotide
taatacgactcactatagggatattgtatagaccatcgccagtccattcaaacagaggagatgaatgatgtggcgatggaacctggcggcagcgcaaaagatg

SEQ ID NO: 66120 - DNA, 103 bp, Artificial Sequence
  Synthetic Polynucleotide
taatacgactcactataggggggatatattgtatagaccatcgccagtccaacagaggagaggactgatgatggtctataacctggcggcagcgcaaaagatg

SEQ ID NO: 66121 - DNA, 103 bp, Artificial Sequence
  Synthetic Polynucleotide
taatacgactcactatagggtttaagggatatattgtatagaccatcgccaacagaggagaggcgatatgctatacaataacctggcggcagcgcaaaagatg

SEQ ID NO: 66122 - DNA, 103 bp, Artificial Sequence
  Synthetic Polynucleotide
taatacgactcactatagggtaatttttaagggatatattgtatagaccaaacagaggagatggtctatgcaatatatcaacctggcggcagcgcaaaagatg

SEQ ID NO: 66123 - DNA, 103 bp, Artificial Sequence
  Synthetic Polynucleotide
taatacgactcactatagggtcccataatttttaagggatatattgtataaacagaggagatatacaatgtatcccttaaacctggcggcagcgcaaaagatg

SEQ ID NO: 66124 - DNA, 103 bp, Artificial Sequence
  Synthetic Polynucleotide
taatacgactcactatagggctttatcccataatttttaagggatatattaacagaggagaaatataatgcttaaaaataacctggcggcagcgcaaaagatg

SEQ ID NO: 66125 - DNA, 103 bp, Artificial Sequence
  Synthetic Polynucleotide
taatacgactcactatagggtaaattacaattgatatctaaaaatactaaaacagaggagattagtaatgttagatatcaacctggcggcagcgcaaaagatg

SEQ ID NO: 66126 - DNA, 103 bp, Artificial Sequence
  Synthetic Polynucleotide
taatacgactcactatagggtgagtgaatgcgtaagactaaataacccagaacagaggagactgggtatgttagtcttaaacctggcggcagcgcaaaagatg

SEQ ID NO: 66127 - DNA, 103 bp, Artificial Sequence
  Synthetic Polynucleotide
taatacgactcactatagggcacgtctttatcccataatttttaagggataacagaggagaatccctatgaaattatggaacctggcggcagcgcaaaagatg

SEQ ID NO: 66128 - DNA, 103 bp, Artificial Sequence
  Synthetic Polynucleotide
taatacgactcactatagggtttgccacgtctttatcccataatttttaaaacagaggagattaaaaatgatgggataaaacctggcggcagcgcaaaagatg

SEQ ID NO: 66129 - DNA, 103 bp, Artificial Sequence
  Synthetic Polynucleotide
taatacgactcactatagggcattgtttgccacgtctttatcccataattaacagaggagaaattatatgataaagacgaacctggcggcagcgcaaaagatg

SEQ ID NO: 66130 - DNA, 103 bp, Artificial Sequence
  Synthetic Polynucleotide
taatacgactcactataggggtatacattgtttgccacgtctttatcccaaacagaggagatgggatatggacgtggcaaacctggcggcagcgcaaaagatg

SEQ ID NO: 66131 - DNA, 103 bp, Artificial Sequence
  Synthetic Polynucleotide
taatacgactcactatagggcatttgtatacattgtttgccacgtctttaaacagaggagataaagaatgggcaaacaaaacctggcggcagcgcaaaagatg

SEQ ID NO: 66132 - DNA, 103 bp, Artificial Sequence
  Synthetic Polynucleotide
taatacgactcactatagggtggtacatttgtatacattgtttgccacgtaacagaggagaacgtggatgacaatgtataacctggcggcagcgcaaaagatg

SEQ ID NO: 66133 - DNA, 103 bp, Artificial Sequence
  Synthetic Polynucleotide
taatacgactcactatagggccttctggtacatttgtatacattgtttgcaacagaggagagcaaacatggtatacaaaaacctggcggcagcgcaaaagatg

SEQ ID NO: 66134 - DNA, 103 bp, Artificial Sequence
  Synthetic Polynucleotide
taatacgactcactatagggatgttccttctggtacatttgtatacattgaacagaggagacaatgtatgcaaatgtacaacctggcggcagcgcaaaagatg

SEQ ID NO: 66135 - DNA, 103 bp, Artificial Sequence
  Synthetic Polynucleotide
taatacgactcactataggggtcgtatgttccttctggtacatttgtataaacagaggagatatacaatggtaccagaaaacctggcggcagcgcaaaagatg

SEQ ID NO: 66136 - DNA, 103 bp, Artificial Sequence
  Synthetic Polynucleotide
taatacgactcactataggggatatgtcgtatgttccttctggtacatttaacagaggagaaaatgtatgagaaggaacaacctggcggcagcgcaaaagatg

SEQ ID NO: 66137 - DNA, 103 bp, Artificial Sequence
  Synthetic Polynucleotide
taatacgactcactatagggatgtatgagtgaatgcgtaagactaaataaaacagaggagattatttatgcttacgcataacctggcggcagcgcaaaagatg

SEQ ID NO: 66138 - DNA, 103 bp, Artificial Sequence
  Synthetic Polynucleotide
taatacgactcactatagggatccggatatgtcgtatgttccttctggtaaacagaggagataccagatggaacatacgaacctggcggcagcgcaaaagatg

SEQ ID NO: 66139 - DNA, 103 bp, Artificial Sequence
  Synthetic Polynucleotide
taatacgactcactatagggtggaaatccggatatgtcgtatgttccttcaacagaggagagaaggaatgtacgacataaacctggcggcagcgcaaaagatg

SEQ ID NO: 66140 - DNA, 103 bp, Artificial Sequence
  Synthetic Polynucleotide
taatacgactcactatagggttctttggaaatccggatatgtcgtatgttaacagaggagaaacataatgcatatccggaacctggcggcagcgcaaaagatg

SEQ ID NO: 66141 - DNA, 103 bp, Artificial Sequence
  Synthetic Polynucleotide
taatacgactcactatagggaatcattctttggaaatccggatatgtcgtaacagaggagaacgacaatgccggatttcaacctggcggcagcgcaaaagatg

SEQ ID NO: 66142 - DNA, 103 bp, Artificial Sequence
  Synthetic Polynucleotide
taatacgactcactatagggtacgaaatcattctttggaaatccggatataacagaggagaatatccatgtttccaaagaacctggcggcagcgcaaaagatg

SEQ ID NO: 66143 - DNA, 103 bp, Artificial Sequence
  Synthetic Polynucleotide
taatacgactcactatagggaaagatacgaaatcattctttggaaatccgaacagaggagacggattatgaaagaatgaaacctggcggcagcgcaaaagatg

SEQ ID NO: 66144 - DNA, 103 bp, Artificial Sequence
  Synthetic Polynucleotide
taatacgactcactatagggcccagaaagatacgaaatcattctttggaaaacagaggagattccaaatgatgatttcgaacctggcggcagcgcaaaagatg

SEQ ID NO: 66145 - DNA, 103 bp, Artificial Sequence
  Synthetic Polynucleotide
taatacgactcactatagggtttaacccagaaagatacgaaatcattcttaacagaggagaaagaatatgttcgtatctaacctggcggcagcgcaaaagatg

SEQ ID NO: 66146 - DNA, 103 bp, Artificial Sequence
  Synthetic Polynucleotide
taatacgactcactatagggtcaaatttaacccagaaagatacgaaatcaaacagaggagatgatttatgatctttctgaacctggcggcagcgcaaaagatg

SEQ ID NO: 66147 - DNA, 103 bp, Artificial Sequence
  Synthetic Polynucleotide
taatacgactcactatagggcttgttcaaatttaacccagaaagatacgaaacagaggagatcgtatatgtctgggttaaacctggcggcagcgcaaaagatg

SEQ ID NO: 66148 - DNA, 103 bp, Artificial Sequence
  Synthetic Polynucleotide
taatacgactcactatagggaatacatgtatgagtgaatgcgtaagactaaacagaggagatagtctatggcattcactaacctggcggcagcgcaaaagatg

SEQ ID NO: 66149 - DNA, 103 bp, Artificial Sequence
  Synthetic Polynucleotide
taatacgactcactataggggtcaccttgttcaaatttaacccagaaagaaacagaggagatctttcatggttaaatttaacctggcggcagcgcaaaagatg

SEQ ID NO: 66150 - DNA, 103 bp, Artificial Sequence
  Synthetic Polynucleotide
taatacgactcactatagggttatagtcaccttgttcaaatttaacccagaacagaggagactgggtatgatttgaacaaacctggcggcagcgcaaaagatg

SEQ ID NO: 66151 - DNA, 103 bp, Artificial Sequence
  Synthetic Polynucleotide
taatacgactcactatagggccactttatagtcaccttgttcaaatttaaaacagaggagattaaatatgaacaaggtgaacctggcggcagcgcaaaagatg

SEQ ID NO: 66152 - DNA, 103 bp, Artificial Sequence
  Synthetic Polynucleotide
taatacgactcactatagggctcttccactttatagtcaccttgttcaaaaacagaggagatttgaaatgggtgactataacctggcggcagcgcaaaagatg

SEQ ID NO: 66153 - DNA, 103 bp, Artificial Sequence
  Synthetic Polynucleotide
taatacgactcactatagggcaatactcttccactttatagtcaccttgtaacagaggagaacaaggatgctataaagtaacctggcggcagcgcaaaagatg

SEQ ID NO: 66154 - DNA, 103 bp, Artificial Sequence
  Synthetic Polynucleotide
taatacgactcactatagggctgtacaatactcttccactttatagtcacaacagaggagagtgactatgaagtggaagaacctggcggcagcgcaaaagatg

SEQ ID NO: 66155 - DNA, 103 bp, Artificial Sequence
  Synthetic Polynucleotide
taatacgactcactatagggtagtcctgtacaatactcttccactttataaacagaggagatataaaatggaagagtataacctggcggcagcgcaaaagatg

SEQ ID NO: 66156 - DNA, 103 bp, Artificial Sequence
  Synthetic Polynucleotide
taatacgactcactatagggatgcatagtcctgtacaatactcttccactaacagaggagaagtggaatggtattgtacaacctggcggcagcgcaaaagatg

SEQ ID NO: 66157 - DNA, 103 bp, Artificial Sequence
  Synthetic Polynucleotide
taatacgactcactatagggcttcgatgcatagtcctgtacaatactcttaacagaggagaaagagtatggtacaggacaacctggcggcagcgcaaaagatg

SEQ ID NO: 66158 - DNA, 103 bp, Artificial Sequence
  Synthetic Polynucleotide
taatacgactcactatagggttttacttcgatgcatagtcctgtacaataaacagaggagatattgtatgggactatgcaacctggcggcagcgcaaaagatg

SEQ ID NO: 66159 - DNA, 103 bp, Artificial Sequence
  Synthetic Polynucleotide
taatacgactcactatagggacggtaatacatgtatgagtgaatgcgtaaaacagaggagattacgcatgcactcatacaacctggcggcagcgcaaaagatg

SEQ ID NO: 66160 - DNA, 103 bp, Artificial Sequence
  Synthetic Polynucleotide
taatacgactcactatagggccgatttttacttcgatgcatagtcctgtaaacagaggagatacaggatgatgcatcgaaacctggcggcagcgcaaaagatg

SEQ ID NO: 66161 - DNA, 103 bp, Artificial Sequence
  Synthetic Polynucleotide
taatacgactcactataggggtggtccgatttttacttcgatgcatagtcaacagaggagagactatatgtcgaagtaaaacctggcggcagcgcaaaagatg

SEQ ID NO: 66162 - DNA, 103 bp, Artificial Sequence
  Synthetic Polynucleotide
taatacgactcactatagggagttggtggtccgatttttacttcgatgcaaacagaggagatgcatcatggtaaaaatcaacctggcggcagcgcaaaagatg

SEQ ID NO: 66163 - DNA, 103 bp, Artificial Sequence
  Synthetic Polynucleotide
taatacgactcactataggggttacagttggtggtccgatttttacttcgaacagaggagacgaagtatgaatcggaccaacctggcggcagcgcaaaagatg

SEQ ID NO: 66164 - DNA, 103 bp, Artificial Sequence
  Synthetic Polynucleotide
taatacgactcactatagggtcaatgttacagttggtggtccgatttttaaacagaggagataaaaaatggaccaccaaaacctggcggcagcgcaaaagatg

SEQ ID NO: 66165 - DNA, 103 bp, Artificial Sequence
  Synthetic Polynucleotide
taatacgactcactatagggttcagtcaatgttacagttggtggtccgataacagaggagaatcggaatgccaactgtaaacctggcggcagcgcaaaagatg

SEQ ID NO: 66166 - DNA, 103 bp, Artificial Sequence
  Synthetic Polynucleotide
taatacgactcactatagggtcgtattcagtcaatgttacagttggtggtaacagaggagaaccaccatgtgtaacattaacctggcggcagcgcaaaagatg

SEQ ID NO: 66167 - DNA, 103 bp, Artificial Sequence
  Synthetic Polynucleotide
taatacgactcactatagggggccgtcgtattcagtcaatgttacagttgaacagaggagacaactgatgcattgactgaacctggcggcagcgcaaaagatg

SEQ ID NO: 66168 - DNA, 103 bp, Artificial Sequence
  Synthetic Polynucleotide
taatacgactcactataggggatatggccgtcgtattcagtcaatgttacaacagaggagagtaacaatgactgaatacaacctggcggcagcgcaaaagatg

SEQ ID NO: 66169 - DNA, 103 bp, Artificial Sequence
  Synthetic Polynucleotide
taatacgactcactatagggaaattgatatggccgtcgtattcagtcaataacagaggagaattgacatgatacgacggaacctggcggcagcgcaaaagatg

SEQ ID NO: 66170 - DNA, 103 bp, Artificial Sequence
  Synthetic Polynucleotide
taatacgactcactatagggagttaacggtaatacatgtatgagtgaatgaacagaggagacattcaatgatacatgtaaacctggcggcagcgcaaaagatg

SEQ ID NO: 66171 - DNA, 103 bp, Artificial Sequence
  Synthetic Polynucleotide
taatacgactcactatagggtgtacaaattgatatggccgtcgtattcagaacagaggagactgaatatgacggccataaacctggcggcagcgcaaaagatg

SEQ ID NO: 66172 - DNA, 103 bp, Artificial Sequence
  Synthetic Polynucleotide
taatacgactcactatagggctcgatgtacaaattgatatggccgtcgtaaacagaggagatacgacatgcatatcaataacctggcggcagcgcaaaagatg

SEQ ID NO: 66173 - DNA, 103 bp, Artificial Sequence
  Synthetic Polynucleotide
taatacgactcactatagggggatgctcgatgtacaaattgatatggccgaacagaggagacggccaatgcaatttgtaaacctggcggcagcgcaaaagatg

SEQ ID NO: 66174 - DNA, 103 bp, Artificial Sequence
  Synthetic Polynucleotide
taatacgactcactatagggcatacggatgctcgatgtacaaattgatataacagaggagaatatcaatgtgtacatcgaacctggcggcagcgcaaaagatg

SEQ ID NO: 66175 - DNA, 103 bp, Artificial Sequence
  Synthetic Polynucleotide
taatacgactcactatagggagtggcatacggatgctcgatgtacaaattaacagaggagaaatttgatgatcgagcataacctggcggcagcgcaaaagatg

SEQ ID NO: 66176 - DNA, 103 bp, Artificial Sequence
  Synthetic Polynucleotide
taatacgactcactatagggcctctagtggcatacggatgctcgatgtacaacagaggagagtacatatggcatccgtaaacctggcggcagcgcaaaagatg

SEQ ID NO: 66177 - DNA, 103 bp, Artificial Sequence
  Synthetic Polynucleotide
taatacgactcactatagggtgctacctctagtggcatacggatgctcgaaacagaggagatcgagcatgcgtatgccaaacctggcggcagcgcaaaagatg

SEQ ID NO: 66178 - DNA, 103 bp, Artificial Sequence
  Synthetic Polynucleotide
taatacgactcactatagggcttcttgctacctctagtggcatacggatgaacagaggagacatccgatggccactagaaacctggcggcagcgcaaaagatg

SEQ ID NO: 66179 - DNA, 103 bp, Artificial Sequence
  Synthetic Polynucleotide
taatacgactcactatagggggaatcttcttgctacctctagtggcatacaacagaggagagtatgcatgtagaggtagaacctggcggcagcgcaaaagatg

SEQ ID NO: 66180 - DNA, 103 bp, Artificial Sequence
  Synthetic Polynucleotide
taatacgactcactatagggaaataggaatcttcttgctacctctagtggaacagaggagaccactaatggtagcaagaaacctggcggcagcgcaaaagatg

SEQ ID NO: 66181 - DNA, 103 bp, Artificial Sequence
  Synthetic Polynucleotide
taatacgactcactatagggtctgtagttaacggtaatacatgtatgagtaacagaggagaactcatatgtgtattaccaacctggcggcagcgcaaaagatg

SEQ ID NO: 66182 - DNA, 103 bp, Artificial Sequence
  Synthetic Polynucleotide
taatacgactcactatagggtttgtaaataggaatcttcttgctacctctaacagaggagaagaggtatgaagaagattaacctggcggcagcgcaaaagatg

SEQ ID NO: 66183 - DNA, 103 bp, Artificial Sequence
  Synthetic Polynucleotide
taatacgactcactatagggttacgtttgtaaataggaatcttcttgctaaacagaggagatagcaaatggattcctataacctggcggcagcgcaaaagatg

SEQ ID NO: 66184 - DNA, 103 bp, Artificial Sequence
  Synthetic Polynucleotide
taatacgactcactatagggtgtcattacgtttgtaaataggaatcttctaacagaggagaagaagaatgctatttacaaacctggcggcagcgcaaaagatg

SEQ ID NO: 66185 - DNA, 103 bp, Artificial Sequence
  Synthetic Polynucleotide
taatacgactcactatagggacacatgtcattacgtttgtaaataggaataacagaggagaattcctatgtacaaacgtaacctggcggcagcgcaaaagatg

SEQ ID NO: 66186 - DNA, 103 bp, Artificial Sequence
  Synthetic Polynucleotide
taatacgactcactatagggatatcacacatgtcattacgtttgtaaataaacagaggagatatttaatgacgtaatgaaacctggcggcagcgcaaaagatg

SEQ ID NO: 66187 - DNA, 103 bp, Artificial Sequence
  Synthetic Polynucleotide
taatacgactcactatagggagtagatatcacacatgtcattacgtttgtaacagaggagaacaaacatgatgacatgtaacctggcggcagcgcaaaagatg

SEQ ID NO: 66188 - DNA, 103 bp, Artificial Sequence
  Synthetic Polynucleotide
taatacgactcactatagggcaacaagtagatatcacacatgtcattacgaacagaggagacgtaatatgatgtgtgataacctggcggcagcgcaaaagatg

SEQ ID NO: 66189 - DNA, 103 bp, Artificial Sequence
  Synthetic Polynucleotide
taatacgactcactataggggtatacaacaagtagatatcacacatgtcaaacagaggagatgacatatgtgatatctaaacctggcggcagcgcaaaagatg

SEQ ID NO: 66190 - DNA, 103 bp, Artificial Sequence
  Synthetic Polynucleotide
taatacgactcactatagggtagccgtatacaacaagtagatatcacacaaacagaggagatgtgtgatgtctacttgtaacctggcggcagcgcaaaagatg

SEQ ID NO: 66191 - DNA, 103 bp, Artificial Sequence
  Synthetic Polynucleotide
taatacgactcactataggggaagttagccgtatacaacaagtagatatcaacagaggagagatatcatgttgttgtataacctggcggcagcgcaaaagatg

SEQ ID NO: 66192 - DNA, 103 bp, Artificial Sequence
  Synthetic Polynucleotide
taatacgactcactatagggtagactctgtagttaacggtaatacatgtaaacagaggagatacatgatgtaccgttaaaacctggcggcagcgcaaaagatg

SEQ ID NO: 66193 - DNA, 103 bp, Artificial Sequence
  Synthetic Polynucleotide
taatacgactcactatagggaatgtgaagttagccgtatacaacaagtagaacagaggagactacttatggtatacggcaacctggcggcagcgcaaaagatg

SEQ ID NO: 66194 - DNA, 103 bp, Artificial Sequence
  Synthetic Polynucleotide
taatacgactcactatagggctccgaatgtgaagttagccgtatacaacaaacagaggagatgttgtatgcggctaactaacctggcggcagcgcaaaagatg

SEQ ID NO: 66195 - DNA, 103 bp, Artificial Sequence
  Synthetic Polynucleotide
taatacgactcactatagggagaatctccgaatgtgaagttagccgtataaacagaggagatatacgatgaacttcacaaacctggcggcagcgcaaaagatg

SEQ ID NO: 66196 - DNA, 103 bp, Artificial Sequence
  Synthetic Polynucleotide
taatacgactcactatagggtcttcagaatctccgaatgtgaagttagccaacagaggagaggctaaatgcacattcggaacctggcggcagcgcaaaagatg

SEQ ID NO: 66197 - DNA, 103 bp, Artificial Sequence
  Synthetic Polynucleotide
taatacgactcactatagggctggttcttcagaatctccgaatgtgaagtaacagaggagaacttcaatgtcggagattaacctggcggcagcgcaaaagatg

SEQ ID NO: 66198 - DNA, 103 bp, Artificial Sequence
  Synthetic Polynucleotide
taatacgactcactatagggtgttactggttcttcagaatctccgaatgtaacagaggagaacattcatggattctgaaaacctggcggcagcgcaaaagatg

SEQ ID NO: 66199 - DNA, 103 bp, Artificial Sequence
  Synthetic Polynucleotide
taatacgactcactatagggttatatgttactggttcttcagaatctccgaacagaggagacggagaatgtgaagaaccaacctggcggcagcgcaaaagatg

SEQ ID NO: 66200 - DNA, 103 bp, Artificial Sequence
  Synthetic Polynucleotide
taatacgactcactatagggcaatattatatgttactggttcttcagaataacagaggagaattctgatgaaccagtaaaacctggcggcagcgcaaaagatg

SEQ ID NO: 66201 - DNA, 103 bp, Artificial Sequence
  Synthetic Polynucleotide
taatacgactcactataggggtcatcaatattatatgttactggttcttcaacagaggagagaagaaatggtaacatataacctggcggcagcgcaaaagatg

SEQ ID NO: 66202 - DNA, 103 bp, Artificial Sequence
  Synthetic Polynucleotide
taatacgactcactatagggtcgtagtcatcaatattatatgttactggtaacagaggagaaccagtatgatataatataacctggcggcagcgcaaaagatg

SEQ ID NO: 66203 - DNA, 103 bp, Artificial Sequence
  Synthetic Polynucleotide
taatacgactcactatagggtagtgtagactctgtagttaacggtaatacaacagaggagagtattaatgttaactacaaacctggcggcagcgcaaaagatg

SEQ ID NO: 66204 - DNA, 103 bp, Artificial Sequence
  Synthetic Polynucleotide
taatacgactcactatagggtacaatcgtagtcatcaatattatatgttaaacagaggagataacatatgatattgatgaacctggcggcagcgcaaaagatg

SEQ ID NO: 66205 - DNA, 103 bp, Artificial Sequence
  Synthetic Polynucleotide
taatacgactcactatagggagacgtacaatcgtagtcatcaatattataaacagaggagatataatatggatgactacaacctggcggcagcgcaaaagatg

SEQ ID NO: 66206 - DNA, 103 bp, Artificial Sequence
  Synthetic Polynucleotide
taatacgactcactatagggcctgtagacgtacaatcgtagtcatcaataaacagaggagatattgaatgctacgattgaacctggcggcagcgcaaaagatg

SEQ ID NO: 66207 - DNA, 103 bp, Artificial Sequence
  Synthetic Polynucleotide
taatacgactcactatagggtgcaacctgtagacgtacaatcgtagtcataacagaggagaatgactatgattgtacgtaacctggcggcagcgcaaaagatg

SEQ ID NO: 66208 - DNA, 103 bp, Artificial Sequence
  Synthetic Polynucleotide
taatacgactcactatagggtatgctgcaacctgtagacgtacaatcgtaaacagaggagatacgatatgacgtctacaaacctggcggcagcgcaaaagatg

SEQ ID NO: 66209 - DNA, 103 bp, Artificial Sequence
  Synthetic Polynucleotide
taatacgactcactatagggaagtctatgctgcaacctgtagacgtacaaaacagaggagattgtacatgtacaggttgaacctggcggcagcgcaaaagatg

SEQ ID NO: 66210 - DNA, 103 bp, Artificial Sequence
  Synthetic Polynucleotide
taatacgactcactatagggtggcaaagtctatgctgcaacctgtagacgaacagaggagacgtctaatggttgcagcaaacctggcggcagcgcaaaagatg

SEQ ID NO: 66211 - DNA, 103 bp, Artificial Sequence
  Synthetic Polynucleotide
taatacgactcactatagggtgttgtggcaaagtctatgctgcaacctgtaacagaggagaacaggtatgagcatagacaacctggcggcagcgcaaaagatg

SEQ ID NO: 66212 - DNA, 103 bp, Artificial Sequence
  Synthetic Polynucleotide
taatacgactcactatagggttttctgttgtggcaaagtctatgctgcaaaacagaggagattgcagatgagactttgcaacctggcggcagcgcaaaagatg

SEQ ID NO: 66213 - DNA, 103 bp, Artificial Sequence
  Synthetic Polynucleotide
taatacgactcactatagggacactttttctgttgtggcaaagtctatgcaacagaggagagcatagatgttgccacaaaacctggcggcagcgcaaaagatg

SEQ ID NO: 66214 - DNA, 103 bp, Artificial Sequence
  Synthetic Polynucleotide
taatacgactcactatagggcattttagtgtagactctgtagttaacggtaacagaggagaaccgttatgtacagagtcaacctggcggcagcgcaaaagatg

SEQ ID NO: 66215 - DNA, 103 bp, Artificial Sequence
  Synthetic Polynucleotide
taatacgactcactatagggcacgcacactttttctgttgtggcaaagtcaacagaggagagactttatgacaacagaaaacctggcggcagcgcaaaagatg

SEQ ID NO: 66216 - DNA, 103 bp, Artificial Sequence
  Synthetic Polynucleotide
taatacgactcactataggggccgtcacgcacactttttctgttgtggcaaacagaggagatgccacatgagaaaaagtaacctggcggcagcgcaaaagatg

SEQ ID NO: 66217 - DNA, 103 bp, Artificial Sequence
  Synthetic Polynucleotide
taatacgactcactatagggcctgcgccgtcacgcacactttttctgttgaacagaggagacaacagatgaagtgtgcgaacctggcggcagcgcaaaagatg

SEQ ID NO: 66218 - DNA, 103 bp, Artificial Sequence
  Synthetic Polynucleotide
taatacgactcactatagggggctccctgcgccgtcacgcacactttttcaacagaggagagaaaaaatgtgcgtgacgaacctggcggcagcgcaaaagatg

SEQ ID NO: 66219 - DNA, 103 bp, Artificial Sequence
  Synthetic Polynucleotide
taatacgactcactatagggtctgtggctccctgcgccgtcacgcacactaacagaggagaagtgtgatggacggcgcaaacctggcggcagcgcaaaagatg

SEQ ID NO: 66220 - DNA, 103 bp, Artificial Sequence
  Synthetic Polynucleotide
taatacgactcactatagggatccttctgtggctccctgcgccgtcacgcaacagaggagagcgtgaatgcgcagggagaacctggcggcagcgcaaaagatg

SEQ ID NO: 66221 - DNA, 103 bp, Artificial Sequence
  Synthetic Polynucleotide
taatacgactcactatagggtagaaatccttctgtggctccctgcgccgtaacagaggagaacggcgatgggagccacaaacctggcggcagcgcaaaagatg

SEQ ID NO: 66222 - DNA, 103 bp, Artificial Sequence
  Synthetic Polynucleotide
taatacgactcactatagggttttctagaaatccttctgtggctccctgcaacagaggagagcagggatgcacagaaggaacctggcggcagcgcaaaagatg

SEQ ID NO: 66223 - DNA, 103 bp, Artificial Sequence
  Synthetic Polynucleotide
taatacgactcactatagggtaattttttctagaaatccttctgtggctcaacagaggagagagccaatgaaggatttcaacctggcggcagcgcaaaagatg

SEQ ID NO: 66224 - DNA, 103 bp, Artificial Sequence
  Synthetic Polynucleotide
taatacgactcactatagggtggagtaattttttctagaaatccttctgtaacagaggagaacagaaatgtttctagaaaacctggcggcagcgcaaaagatg

SEQ ID NO: 66225 - DNA, 103 bp, Artificial Sequence
  Synthetic Polynucleotide
taatacgactcactatagggttaatcattttagtgtagactctgtagttaaacagaggagataactaatgagtctacacaacctggcggcagcgcaaaagatg

SEQ ID NO: 66226 - DNA, 103 bp, Artificial Sequence
  Synthetic Polynucleotide
taatacgactcactatagggctccatggagtaattttttctagaaatcctaacagaggagaaggattatgagaaaaaataacctggcggcagcgcaaaagatg

SEQ ID NO: 66227 - DNA, 103 bp, Artificial Sequence
  Synthetic Polynucleotide
taatacgactcactatagggccgaactccatggagtaattttttctagaaaacagaggagattctagatgaaattactcaacctggcggcagcgcaaaagatg

SEQ ID NO: 66228 - DNA, 103 bp, Artificial Sequence
  Synthetic Polynucleotide
taatacgactcactatagggtacttccgaactccatggagtaattttttcaacagaggagagaaaaaatgactccatggaacctggcggcagcgcaaaagatg

SEQ ID NO: 66229 - DNA, 103 bp, Artificial Sequence
  Synthetic Polynucleotide
taatacgactcactatagggagacatacttccgaactccatggagtaattaacagaggagaaattacatgatggagttcaacctggcggcagcgcaaaagatg

SEQ ID NO: 66230 - DNA, 103 bp, Artificial Sequence
  Synthetic Polynucleotide
taatacgactcactataggggtgtcagacatacttccgaactccatggagaacagaggagactccatatggttcggaagaacctggcggcagcgcaaaagatg

SEQ ID NO: 66231 - DNA, 103 bp, Artificial Sequence
  Synthetic Polynucleotide
taatacgactcactatagggcttaggtgtcagacatacttccgaactccaaacagaggagatggagtatggaagtatgtaacctggcggcagcgcaaaagatg

SEQ ID NO: 66232 - DNA, 103 bp, Artificial Sequence
  Synthetic Polynucleotide
taatacgactcactatagggttcttcttaggtgtcagacatacttccgaaaacagaggagattcggaatgatgtctgacaacctggcggcagcgcaaaagatg

SEQ ID NO: 66233 - DNA, 103 bp, Artificial Sequence
  Synthetic Polynucleotide
taatacgactcactatagggatacattcttcttaggtgtcagacatacttaacagaggagaaagtatatgtgacacctaaacctggcggcagcgcaaaagatg

SEQ ID NO: 66234 - DNA, 103 bp, Artificial Sequence
  Synthetic Polynucleotide
taatacgactcactatagggtgtaaatacattcttcttaggtgtcagacaaacagaggagatgtctgatgcctaagaagaacctggcggcagcgcaaaagatg

SEQ ID NO: 66235 - DNA, 103 bp, Artificial Sequence
  Synthetic Polynucleotide
taatacgactcactataggggcgcatgtaaatacattcttcttaggtgtcaacagaggagagacaccatggaagaatgtaacctggcggcagcgcaaaagatg

SEQ ID NO: 66236 - DNA, 103 bp, Artificial Sequence
  Synthetic Polynucleotide
taatacgactcactatagggctactggatgaagatgtgacgtacaaaaaaaacagaggagattttttatgcgtcacatcaacctggcggcagcgcaaaagatg

SEQ ID NO: 66237 - DNA, 103 bp, Artificial Sequence
  Synthetic Polynucleotide
taatacgactcactataggggggtgtaaattacaattgatatctaaaaataacagaggagaatttttatgtatcaattgaacctggcggcagcgcaaaagatg

SEQ ID NO: 66238 - DNA, 103 bp, Artificial Sequence
  Synthetic Polynucleotide
taatacgactcactatagggattgtttaatcattttagtgtagactctgtaacagaggagaacagagatgacactaaaaaacctggcggcagcgcaaaagatg

SEQ ID NO: 66239 - DNA, 103 bp, Artificial Sequence
  Synthetic Polynucleotide
taatacgactcactatagggtaatagcgcatgtaaatacattcttcttagaacagaggagactaagaatgatgtatttaaacctggcggcagcgcaaaagatg

SEQ ID NO: 66240 - DNA, 103 bp, Artificial Sequence
  Synthetic Polynucleotide
taatacgactcactatagggggatctaatagcgcatgtaaatacattcttaacagaggagaaagaatatgtttacatgcaacctggcggcagcgcaaaagatg

SEQ ID NO: 66241 - DNA, 103 bp, Artificial Sequence
  Synthetic Polynucleotide
taatacgactcactatagggtccttggatctaatagcgcatgtaaatacaaacagaggagatgtattatgatgcgctataacctggcggcagcgcaaaagatg

SEQ ID NO: 66242 - DNA, 103 bp, Artificial Sequence
  Synthetic Polynucleotide
taatacgactcactatagggcatcttccttggatctaatagcgcatgtaaaacagaggagattacatatgctattagataacctggcggcagcgcaaaagatg

SEQ ID NO: 66243 - DNA, 103 bp, Artificial Sequence
  Synthetic Polynucleotide
taatacgactcactatagggggatacatcttccttggatctaatagcgcaaacagaggagatgcgctatgagatccaagaacctggcggcagcgcaaaagatg

SEQ ID NO: 66244 - DNA, 103 bp, Artificial Sequence
  Synthetic Polynucleotide
taatacgactcactatagggaaattggatacatcttccttggatctaataaacagaggagatattagatgcaaggaagaaacctggcggcagcgcaaaagatg

SEQ ID NO: 66245 - DNA, 103 bp, Artificial Sequence
  Synthetic Polynucleotide
taatacgactcactatagggccttgaaattggatacatcttccttggatcaacagaggagagatccaatgaagatgtataacctggcggcagcgcaaaagatg

SEQ ID NO: 66246 - DNA, 103 bp, Artificial Sequence
  Synthetic Polynucleotide
taatacgactcactatagggtttgtccttgaaattggatacatcttccttaacagaggagaaaggaaatggtatccaataacctggcggcagcgcaaaagatg

SEQ ID NO: 66247 - DNA, 103 bp, Artificial Sequence
  Synthetic Polynucleotide
taatacgactcactataggggtcattttgtccttgaaattggatacatctaacagaggagaagatgtatgcaatttcaaaacctggcggcagcgcaaaagatg

SEQ ID NO: 66248 - DNA, 103 bp, Artificial Sequence
  Synthetic Polynucleotide
taatacgactcactatagggctctggtcattttgtccttgaaattggataaacagaggagatatccaatgtcaaggacaaacctggcggcagcgcaaaagatg

SEQ ID NO: 66249 - DNA, 103 bp, Artificial Sequence
  Synthetic Polynucleotide
taatacgactcactatagggtatctattgtttaatcattttagtgtagacaacagaggagagtctacatgaaaatgattaacctggcggcagcgcaaaagatg

SEQ ID NO: 66250 - DNA, 103 bp, Artificial Sequence
  Synthetic Polynucleotide
taatacgactcactataggggataactctggtcattttgtccttgaaattaacagaggagaaatttcatggacaaaatgaacctggcggcagcgcaaaagatg

SEQ ID NO: 66251 - DNA, 103 bp, Artificial Sequence
  Synthetic Polynucleotide
taatacgactcactatagggctcttgataactctggtcattttgtccttgaacagaggagacaaggaatgaatgaccagaacctggcggcagcgcaaaagatg

SEQ ID NO: 66252 - DNA, 103 bp, Artificial Sequence
  Synthetic Polynucleotide
taatacgactcactatagggattttctcttgataactctggtcattttgtaacagaggagaacaaaaatgccagagttaaacctggcggcagcgcaaaagatg

SEQ ID NO: 66253 - DNA, 103 bp, Artificial Sequence
  Synthetic Polynucleotide
taatacgactcactatagggattaaattttctcttgataactctggtcataacagaggagaatgaccatggttatcaagaacctggcggcagcgcaaaagatg

SEQ ID NO: 66254 - DNA, 103 bp, Artificial Sequence
  Synthetic Polynucleotide
taatacgactcactatagggtgtttattaaattttctcttgataactctgaacagaggagacagagtatgcaagagaaaaacctggcggcagcgcaaaagatg

SEQ ID NO: 66255 - DNA, 103 bp, Artificial Sequence
  Synthetic Polynucleotide
taatacgactcactataggggagactgtttattaaattttctcttgataaaacagaggagattatcaatggaaaatttaaacctggcggcagcgcaaaagatg

SEQ ID NO: 66256 - DNA, 103 bp, Artificial Sequence
  Synthetic Polynucleotide
taatacgactcactatagggattttgagactgtttattaaattttctcttaacagaggagaaagagaatgtttaataaaaacctggcggcagcgcaaaagatg

SEQ ID NO: 66257 - DNA, 103 bp, Artificial Sequence
  Synthetic Polynucleotide
taatacgactcactatagggatataattttgagactgtttattaaattttaacagaggagaaaaattatgtaaacagtcaacctggcggcagcgcaaaagatg

SEQ ID NO: 66258 - DNA, 103 bp, Artificial Sequence
  Synthetic Polynucleotide
taatacgactcactatagggtggtcatataattttgagactgtttattaaaacagaggagattaataatgagtctcaaaaacctggcggcagcgcaaaagatg

SEQ ID NO: 66259 - DNA, 103 bp, Artificial Sequence
  Synthetic Polynucleotide
taatacgactcactatagggaaatttggtcatataattttgagactgtttaacagaggagaaaacagatgcaaaattataacctggcggcagcgcaaaagatg

SEQ ID NO: 66260 - DNA, 103 bp, Artificial Sequence
  Synthetic Polynucleotide
taatacgactcactatagggtagactatctattgtttaatcattttagtgaacagaggagacactaaatggattaaacaaacctggcggcagcgcaaaagatg

SEQ ID NO: 66261 - DNA, 103 bp, Artificial Sequence
  Synthetic Polynucleotide
taatacgactcactatagggccgagaaatttggtcatataattttgagacaacagaggagagtctcaatgttatatgacaacctggcggcagcgcaaaagatg

SEQ ID NO: 66262 - DNA, 103 bp, Artificial Sequence
  Synthetic Polynucleotide
taatacgactcactatagggtagtaccgagaaatttggtcatataattttaacagaggagaaaaattatgtgaccaaataacctggcggcagcgcaaaagatg

SEQ ID NO: 66263 - DNA, 103 bp, Artificial Sequence
  Synthetic Polynucleotide
taatacgactcactatagggagccgtagtaccgagaaatttggtcatataaacagaggagatatatgatgaaatttctcaacctggcggcagcgcaaaagatg

SEQ ID NO: 66264 - DNA, 103 bp, Artificial Sequence
  Synthetic Polynucleotide
taatacgactcactatagggtcattagccgtagtaccgagaaatttggtcaacagaggagagaccaaatgtctcggtacaacctggcggcagcgcaaaagatg

SEQ ID NO: 66265 - DNA, 103 bp, Artificial Sequence
  Synthetic Polynucleotide
taatacgactcactatagggtaacatcattagccgtagtaccgagaaattaacagaggagaaatttcatggtactacggaacctggcggcagcgcaaaagatg

SEQ ID NO: 66266 - DNA, 103 bp, Artificial Sequence
  Synthetic Polynucleotide
taatacgactcactatagggggtagtaacatcattagccgtagtaccgagaacagaggagactcggtatgacggctaataacctggcggcagcgcaaaagatg

SEQ ID NO: 66267 - DNA, 103 bp, Artificial Sequence
  Synthetic Polynucleotide
taatacgactcactatagggatcacggtagtaacatcattagccgtagtaaacagaggagatactacatgtaatgatgtaacctggcggcagcgcaaaagatg

SEQ ID NO: 66268 - DNA, 103 bp, Artificial Sequence
  Synthetic Polynucleotide
taatacgactcactatagggtgctaatcacggtagtaacatcattagccgaacagaggagacggctaatgatgttactaaacctggcggcagcgcaaaagatg

SEQ ID NO: 66269 - DNA, 103 bp, Artificial Sequence
  Synthetic Polynucleotide
taatacgactcactatagggtagcatgctaatcacggtagtaacatcattaacagaggagaaatgatatgactaccgtgaacctggcggcagcgcaaaagatg

SEQ ID NO: 66270 - DNA, 103 bp, Artificial Sequence
  Synthetic Polynucleotide
taatacgactcactatagggtaatctagcatgctaatcacggtagtaacaaacagaggagatgttacatgcgtgattagaacctggcggcagcgcaaaagatg

SEQ ID NO: 66271 - DNA, 103 bp, Artificial Sequence
  Synthetic Polynucleotide
taatacgactcactatagggaatggtagactatctattgtttaatcatttaacagaggagaaaatgaatgaacaatagaaacctggcggcagcgcaaaagatg

SEQ ID NO: 66272 - DNA, 103 bp, Artificial Sequence
  Synthetic Polynucleotide
taatacgactcactatagggatatttaatctagcatgctaatcacggtagaacagaggagactaccgatgttagcatgcaacctggcggcagcgcaaaagatg

SEQ ID NO: 66273 - DNA, 103 bp, Artificial Sequence
  Synthetic Polynucleotide
taatacgactcactatagggccaaaatatttaatctagcatgctaatcacaacagaggagagtgattatgatgctagataacctggcggcagcgcaaaagatg

SEQ ID NO: 66274 - DNA, 103 bp, Artificial Sequence
  Synthetic Polynucleotide
taatacgactcactatagggtttgcccaaaatatttaatctagcatgctaaacagaggagatagcatatgagattaaataacctggcggcagcgcaaaagatg

SEQ ID NO: 66275 - DNA, 103 bp, Artificial Sequence
  Synthetic Polynucleotide
taatacgactcactatagggttagatttgcccaaaatatttaatctagcaaacagaggagatgctagatgaaatattttaacctggcggcagcgcaaaagatg

SEQ ID NO: 66276 - DNA, 103 bp, Artificial Sequence
  Synthetic Polynucleotide
taatacgactcactatagggaatatttagatttgcccaaaatatttaatcaacagaggagagattaaatgttttgggcaaacctggcggcagcgcaaaagatg

SEQ ID NO: 66277 - DNA, 103 bp, Artificial Sequence
  Synthetic Polynucleotide
taatacgactcactatagggtaaaaaatatttagatttgcccaaaatattaacagaggagaaatattatgggcaaatctaacctggcggcagcgcaaaagatg

SEQ ID NO: 66278 - DNA, 103 bp, Artificial Sequence
  Synthetic Polynucleotide
taatacgactcactatagggttttataaaaaatatttagatttgcccaaaaacagaggagatttgggatgatctaaataaacctggcggcagcgcaaaagatg

SEQ ID NO: 66279 - DNA, 103 bp, Artificial Sequence
  Synthetic Polynucleotide
taatacgactcactatagggttaatttttataaaaaatatttagatttgcaacagaggagagcaaatatgaatatttttaacctggcggcagcgcaaaagatg

SEQ ID NO: 66280 - DNA, 103 bp, Artificial Sequence
  Synthetic Polynucleotide
taatacgactcactatagggattttttaatttttataaaaaatatttagaaacagaggagatctaaaatgtttttataaaacctggcggcagcgcaaaagatg

SEQ ID NO: 66281 - DNA, 103 bp, Artificial Sequence
  Synthetic Polynucleotide
taatacgactcactatagggaagtgattttttaatttttataaaaaatataacagaggagaatatttatgataaaaattaacctggcggcagcgcaaaagatg

SEQ ID NO: 66282 - DNA, 103 bp, Artificial Sequence
  Synthetic Polynucleotide
taatacgactcactataggggaaacaatggtagactatctattgtttaataacagaggagaattaaaatgtagatagtcaacctggcggcagcgcaaaagatg

SEQ ID NO: 66283 - DNA, 103 bp, Artificial Sequence
  Synthetic Polynucleotide
taatacgactcactatagggaacgaaagtgattttttaatttttataaaaaacagaggagattttatatgaattaaaaaaacctggcggcagcgcaaaagatg

SEQ ID NO: 66284 - DNA, 103 bp, Artificial Sequence
  Synthetic Polynucleotide
taatacgactcactatagggtcgataacgaaagtgattttttaatttttaaacagaggagataaaaaatgaaaaatcacaacctggcggcagcgcaaaagatg

SEQ ID NO: 66285 - DNA, 103 bp, Artificial Sequence
  Synthetic Polynucleotide
taatacgactcactatagggagttatcgataacgaaagtgattttttaataacagaggagaattaaaatgtcactttcgaacctggcggcagcgcaaaagatg

SEQ ID NO: 66286 - DNA, 103 bp, Artificial Sequence
  Synthetic Polynucleotide
taatacgactcactatagggtctcgagttatcgataacgaaagtgattttaacagaggagaaaaatcatgttcgttatcaacctggcggcagcgcaaaagatg

SEQ ID NO: 66287 - DNA, 103 bp, Artificial Sequence
  Synthetic Polynucleotide
taatacgactcactatagggcatgttctcgagttatcgataacgaaagtgaacagaggagacactttatgtatcgataaaacctggcggcagcgcaaaagatg

SEQ ID NO: 66288 - DNA, 103 bp, Artificial Sequence
  Synthetic Polynucleotide
taatacgactcactatagggtaacccatgttctcgagttatcgataacgaaacagaggagatcgttaatgataactcgaaacctggcggcagcgcaaaagatg

SEQ ID NO: 66289 - DNA, 103 bp, Artificial Sequence
  Synthetic Polynucleotide
taatacgactcactatagggatatgtaacccatgttctcgagttatcgataacagaggagaatcgatatgtcgagaacaaacctggcggcagcgcaaaagatg

SEQ ID NO: 66290 - DNA, 103 bp, Artificial Sequence
  Synthetic Polynucleotide
taatacgactcactatagggtgttgatatgtaacccatgttctcgagttaaacagaggagataactcatgaacatgggtaacctggcggcagcgcaaaagatg

SEQ ID NO: 66291 - DNA, 103 bp, Artificial Sequence
  Synthetic Polynucleotide
taatacgactcactatagggtaatatgttgatatgtaacccatgttctcgaacagaggagacgagaaatggggttacataacctggcggcagcgcaaaagatg

SEQ ID NO: 66292 - DNA, 103 bp, Artificial Sequence
  Synthetic Polynucleotide
taatacgactcactatagggaacattaatatgttgatatgtaacccatgtaacagaggagaacatggatgacatatcaaaacctggcggcagcgcaaaagatg

SEQ ID NO: 66293 - DNA, 103 bp, Artificial Sequence
  Synthetic Polynucleotide
taatacgactcactatagggaatacgaaacaatggtagactatctattgtaacagaggagaacaataatgagtctaccaaacctggcggcagcgcaaaagatg

SEQ ID NO: 66294 - DNA, 103 bp, Artificial Sequence
  Synthetic Polynucleotide
taatacgactcactatagggccaccaacattaatatgttgatatgtaaccaacagaggagaggttacatgtcaacatataacctggcggcagcgcaaaagatg

SEQ ID NO: 66295 - DNA, 103 bp, Artificial Sequence
  Synthetic Polynucleotide
taatacgactcactatagggcaatgccaccaacattaatatgttgatatgaacagaggagacatatcatgatattaatgaacctggcggcagcgcaaaagatg

SEQ ID NO: 66296 - DNA, 103 bp, Artificial Sequence
  Synthetic Polynucleotide
taatacgactcactatagggttagacaatgccaccaacattaatatgttgaacagaggagacaacatatgaatgttggtaacctggcggcagcgcaaaagatg

SEQ ID NO: 66297 - DNA, 103 bp, Artificial Sequence
  Synthetic Polynucleotide
taatacgactcactatagggctgttttagacaatgccaccaacattaataaacagaggagatattaaatgtggtggcataacctggcggcagcgcaaaagatg

SEQ ID NO: 66298 - DNA, 103 bp, Artificial Sequence
  Synthetic Polynucleotide
taatacgactcactatagggcgtgactgttttagacaatgccaccaacataacagaggagaatgttgatggcattgtctaacctggcggcagcgcaaaagatg

SEQ ID NO: 66299 - DNA, 103 bp, Artificial Sequence
  Synthetic Polynucleotide
taatacgactcactataggggatatcgtgactgttttagacaatgccaccaacagaggagaggtggcatggtctaaaacaacctggcggcagcgcaaaagatg

SEQ ID NO: 66300 - DNA, 103 bp, Artificial Sequence
  Synthetic Polynucleotide
taatacgactcactatagggtaagagatatcgtgactgttttagacaatgaacagaggagacattgtatgaaacagtcaaacctggcggcagcgcaaaagatg

SEQ ID NO: 66301 - DNA, 103 bp, Artificial Sequence
  Synthetic Polynucleotide
taatacgactcactataggggcatttaagagatatcgtgactgttttagaaacagaggagatctaaaatggtcacgataaacctggcggcagcgcaaaagatg

SEQ ID NO: 66302 - DNA, 103 bp, Artificial Sequence
  Synthetic Polynucleotide
taatacgactcactatagggctgtagcatttaagagatatcgtgactgttaacagaggagaaacagtatggatatctctaacctggcggcagcgcaaaagatg

SEQ ID NO: 66303 - DNA, 103 bp, Artificial Sequence
  Synthetic Polynucleotide
taatacgactcactatagggcctttctgtagcatttaagagatatcgtgaaacagaggagatcacgaatgctcttaaataacctggcggcagcgcaaaagatg

SEQ ID NO: 66304 - DNA, 103 bp, Artificial Sequence
  Synthetic Polynucleotide
taatacgactcactatagggatctgaatacgaaacaatggtagactatctaacagaggagaagatagatgaccattgttaacctggcggcagcgcaaaagatg

SEQ ID NO: 66305 - DNA, 103 bp, Artificial Sequence
  Synthetic Polynucleotide
taatacgactcactatagggtcctacctttctgtagcatttaagagatataacagaggagaatatctatgaaatgctacaacctggcggcagcgcaaaagatg

SEQ ID NO: 66306 - DNA, 103 bp, Artificial Sequence
  Synthetic Polynucleotide
taatacgactcactatagggtaaaatcctacctttctgtagcatttaagaaacagaggagatcttaaatgctacagaaaaacctggcggcagcgcaaaagatg

SEQ ID NO: 66307 - DNA, 103 bp, Artificial Sequence
  Synthetic Polynucleotide
taatacgactcactataggggattataaaatcctacctttctgtagcattaacagaggagaaatgctatggaaaggtagaacctggcggcagcgcaaaagatg

SEQ ID NO: 66308 - DNA, 103 bp, Artificial Sequence
  Synthetic Polynucleotide
taatacgactcactatagggataaagattataaaatcctacctttctgtaaacagaggagatacagaatggtaggatttaacctggcggcagcgcaaaagatg

SEQ ID NO: 66309 - DNA, 103 bp, Artificial Sequence
  Synthetic Polynucleotide
taatacgactcactataggggatccataaagattataaaatcctacctttaacagaggagaaaaggtatgattttataaaacctggcggcagcgcaaaagatg

SEQ ID NO: 66310 - DNA, 103 bp, Artificial Sequence
  Synthetic Polynucleotide
taatacgactcactatagggcattagatccataaagattataaaatcctaaacagaggagataggatatgataatctttaacctggcggcagcgcaaaagatg

SEQ ID NO: 66311 - DNA, 103 bp, Artificial Sequence
  Synthetic Polynucleotide
taatacgactcactataggggctatcattagatccataaagattataaaaaacagaggagattttatatgctttatggaaacctggcggcagcgcaaaagatg

SEQ ID NO: 66312 - DNA, 103 bp, Artificial Sequence
  Synthetic Polynucleotide
taatacgactcactatagggtgctcgctatcattagatccataaagattaaacagaggagataatctatgtggatctaaaacctggcggcagcgcaaaagatg

SEQ ID NO: 66313 - DNA, 103 bp, Artificial Sequence
  Synthetic Polynucleotide
taatacgactcactatagggtttcctgctcgctatcattagatccataaaaacagaggagatttatgatgctaatgataaacctggcggcagcgcaaaagatg

SEQ ID NO: 66314 - DNA, 103 bp, Artificial Sequence
  Synthetic Polynucleotide
taatacgactcactatagggataattttcctgctcgctatcattagatccaacagaggagaggatctatggatagcgagaacctggcggcagcgcaaaagatg

SEQ ID NO: 66315 - DNA, 103 bp, Artificial Sequence
  Synthetic Polynucleotide
taatacgactcactataggggtactatctgaatacgaaacaatggtagacaacagaggagagtctacatgtgtttcgtaaacctggcggcagcgcaaaagatg

SEQ ID NO: 66316 - DNA, 103 bp, Artificial Sequence
  Synthetic Polynucleotide
taatacgactcactatagggggagaataattttcctgctcgctatcattaaacagaggagataatgaatgcgagcaggaaacctggcggcagcgcaaaagatg

SEQ ID NO: 66317 - DNA, 103 bp, Artificial Sequence
  Synthetic Polynucleotide
taatacgactcactatagggatacaggagaataattttcctgctcgctataacagaggagaatagcgatgaggaaaattaacctggcggcagcgcaaaagatg

SEQ ID NO: 66318 - DNA, 103 bp, Artificial Sequence
  Synthetic Polynucleotide
taatacgactcactatagggaacagatacaggagaataattttcctgctcaacagaggagagagcagatgaattattctaacctggcggcagcgcaaaagatg

SEQ ID NO: 66319 - DNA, 103 bp, Artificial Sequence
  Synthetic Polynucleotide
taatacgactcactataggggttttaacagatacaggagaataattttccaacagaggagaggaaaaatgttctcctgtaacctggcggcagcgcaaaagatg

SEQ ID NO: 66320 - DNA, 103 bp, Artificial Sequence
  Synthetic Polynucleotide
taatacgactcactatagggtcgtagttttaacagatacaggagaataataacagaggagaattattatgctgtatctgaacctggcggcagcgcaaaagatg

SEQ ID NO: 66321 - DNA, 103 bp, Artificial Sequence
  Synthetic Polynucleotide
taatacgactcactataggggataatcgtagttttaacagatacaggagaaacagaggagatctcctatgtctgttaaaaacctggcggcagcgcaaaagatg

SEQ ID NO: 66322 - DNA, 103 bp, Artificial Sequence
  Synthetic Polynucleotide
taatacgactcactatagggtaatagataatcgtagttttaacagatacaaacagaggagatgtatcatgtaaaactacaacctggcggcagcgcaaaagatg

SEQ ID NO: 66323 - DNA, 103 bp, Artificial Sequence
  Synthetic Polynucleotide
taatacgactcactataggggtctttaatagataatcgtagttttaacagaacagaggagactgttaatgctacgattaaacctggcggcagcgcaaaagatg

SEQ ID NO: 66324 - DNA, 103 bp, Artificial Sequence
  Synthetic Polynucleotide
taatacgactcactatagggtctctgtctttaatagataatcgtagttttaacagaggagaaaaactatgattatctataacctggcggcagcgcaaaagatg

SEQ ID NO: 66325 - DNA, 103 bp, Artificial Sequence
  Synthetic Polynucleotide
taatacgactcactatagggtagtatctctgtctttaatagataatcgtaaacagaggagatacgatatgctattaaagaacctggcggcagcgcaaaagatg

SEQ ID NO: 66326 - DNA, 103 bp, Artificial Sequence
  Synthetic Polynucleotide
taatacgactcactatagggacgctgtactatctgaatacgaaacaatggaacagaggagaccattgatgcgtattcagaacctggcggcagcgcaaaagatg

SEQ ID NO: 66327 - DNA, 103 bp, Artificial Sequence
  Synthetic Polynucleotide
taatacgactcactatagggatatttagtatctctgtctttaatagataaaacagaggagattatctatgaaagacagaaacctggcggcagcgcaaaagatg

SEQ ID NO: 66328 - DNA, 103 bp, Artificial Sequence
  Synthetic Polynucleotide
taatacgactcactatagggtgtctatatttagtatctctgtctttaataaacagaggagatattaaatgcagagatacaacctggcggcagcgcaaaagatg

SEQ ID NO: 66329 - DNA, 103 bp, Artificial Sequence
  Synthetic Polynucleotide
taatacgactcactataggggttattgtctatatttagtatctctgtcttaacagaggagaaagacaatgatactaaataacctggcggcagcgcaaaagatg

SEQ ID NO: 66330 - DNA, 103 bp, Artificial Sequence
  Synthetic Polynucleotide
taatacgactcactatagggggtatgttattgtctatatttagtatctctaacagaggagaagagatatgaaatatagaaacctggcggcagcgcaaaagatg

SEQ ID NO: 66331 - DNA, 103 bp, Artificial Sequence
  Synthetic Polynucleotide
taatacgactcactatagggtccatggtatgttattgtctatatttagtaaacagaggagatactaaatgtagacaataaacctggcggcagcgcaaaagatg

SEQ ID NO: 66332 - DNA, 103 bp, Artificial Sequence
  Synthetic Polynucleotide
taatacgactcactatagggatttttccatggtatgttattgtctatattaacagaggagaaatataatgaataacataaacctggcggcagcgcaaaagatg

SEQ ID NO: 66333 - DNA, 103 bp, Artificial Sequence
  Synthetic Polynucleotide
taatacgactcactataggggtaatatttttccatggtatgttattgtctaacagaggagaagacaaatgcataccatgaacctggcggcagcgcaaaagatg

SEQ ID NO: 66334 - DNA, 103 bp, Artificial Sequence
  Synthetic Polynucleotide
taatacgactcactatagggaatctgtaatatttttccatggtatgttataacagaggagaataacaatgcatggaaaaaacctggcggcagcgcaaaagatg

SEQ ID NO: 66335 - DNA, 103 bp, Artificial Sequence
  Synthetic Polynucleotide
taatacgactcactatagggaataaaatctgtaatatttttccatggtataacagaggagaataccaatgaaaaatattaacctggcggcagcgcaaaagatg

SEQ ID NO: 66336 - DNA, 103 bp, Artificial Sequence
  Synthetic Polynucleotide
taatacgactcactatagggagtttaataaaatctgtaatatttttccataacagaggagaatggaaatgtattacagaaacctggcggcagcgcaaaagatg

SEQ ID NO: 66337 - DNA, 103 bp, Artificial Sequence
  Synthetic Polynucleotide
taatacgactcactataggggtactacgctgtactatctgaatacgaaacaacagaggagagtttcgatgtcagatagtaacctggcggcagcgcaaaagatg

SEQ ID NO: 66338 - DNA, 103 bp, Artificial Sequence
  Synthetic Polynucleotide
taatacgactcactatagggaaaagagtttaataaaatctgtaatattttaacagaggagaaaaataatgcagattttaaacctggcggcagcgcaaaagatg

SEQ ID NO: 66339 - DNA, 103 bp, Artificial Sequence
  Synthetic Polynucleotide
taatacgactcactatagggtctataaaagagtttaataaaatctgtaataacagaggagaattacaatgtttattaaaaacctggcggcagcgcaaaagatg

SEQ ID NO: 66340 - DNA, 103 bp, Artificial Sequence
  Synthetic Polynucleotide
taatacgactcactatagggatttctctataaaagagtttaataaaatctaacagaggagaagatttatgtaaactcttaacctggcggcagcgcaaaagatg

SEQ ID NO: 66341 - DNA, 103 bp, Artificial Sequence
  Synthetic Polynucleotide
taatacgactcactatagggattacatttctctataaaagagtttaataaaacagaggagattattaatgtcttttataaacctggcggcagcgcaaaagatg

SEQ ID NO: 66342 - DNA, 103 bp, Artificial Sequence
  Synthetic Polynucleotide
taatacgactcactatagggcaattattacatttctctataaaagagtttaacagaggagaaaactcatgtatagagaaaacctggcggcagcgcaaaagatg

SEQ ID NO: 66343 - DNA, 103 bp, Artificial Sequence
  Synthetic Polynucleotide
taatacgactcactatagggttgagcaattattacatttctctataaaagaacagaggagacttttaatgagaaatgtaaacctggcggcagcgcaaaagatg

SEQ ID NO: 66344 - DNA, 103 bp, Artificial Sequence
  Synthetic Polynucleotide
taatacgactcactatagggattatttgagcaattattacatttctctataacagaggagaatagagatgtgtaataataacctggcggcagcgcaaaagatg

SEQ ID NO: 66345 - DNA, 103 bp, Artificial Sequence
  Synthetic Polynucleotide
taatacgactcactatagggatagtattatttgagcaattattacatttcaacagaggagagaaatgatgtaattgctcaacctggcggcagcgcaaaagatg

SEQ ID NO: 66346 - DNA, 103 bp, Artificial Sequence
  Synthetic Polynucleotide
taatacgactcactatagggtgtatatagtattatttgagcaattattacaacagaggagagtaataatggctcaaataaacctggcggcagcgcaaaagatg

SEQ ID NO: 66347 - DNA, 103 bp, Artificial Sequence
  Synthetic Polynucleotide
taatacgactcactataggggatattgtatatagtattatttgagcaattaacagaggagaaattgcatgaataatactaacctggcggcagcgcaaaagatg

SEQ ID NO: 66348 - DNA, 103 bp, Artificial Sequence
  Synthetic Polynucleotide
taatacgactcactatagggaatatgggtgtaaattacaattgatatctaaacagaggagatagataatgattgtaattaacctggcggcagcgcaaaagatg

SEQ ID NO: 66349 - DNA, 103 bp, Artificial Sequence
  Synthetic Polynucleotide
taatacgactcactataggggccatgtactacgctgtactatctgaatacaacagaggagagtattcatgtagtacagcaacctggcggcagcgcaaaagatg

SEQ ID NO: 66350 - DNA, 103 bp, Artificial Sequence
  Synthetic Polynucleotide
taatacgactcactatagggatagtgatattgtatatagtattatttgagaacagaggagactcaaaatgtactatataaacctggcggcagcgcaaaagatg

SEQ ID NO: 66351 - DNA, 103 bp, Artificial Sequence
  Synthetic Polynucleotide
taatacgactcactatagggactttatagtgatattgtatatagtattataacagaggagaataataatgtatacaataaacctggcggcagcgcaaaagatg

SEQ ID NO: 66352 - DNA, 103 bp, Artificial Sequence
  Synthetic Polynucleotide
taatacgactcactatagggccaagactttatagtgatattgtatatagtaacagaggagaactataatgaatatcactaacctggcggcagcgcaaaagatg

SEQ ID NO: 66353 - DNA, 103 bp, Artificial Sequence
  Synthetic Polynucleotide
taatacgactcactatagggttagtccaagactttatagtgatattgtataacagaggagaatacaaatgcactataaaaacctggcggcagcgcaaaagatg

SEQ ID NO: 66354 - DNA, 103 bp, Artificial Sequence
  Synthetic Polynucleotide
taatacgactcactatagggtataattagtccaagactttatagtgatataacagaggagaatatcaatgtaaagtcttaacctggcggcagcgcaaaagatg

SEQ ID NO: 66355 - DNA, 103 bp, Artificial Sequence
  Synthetic Polynucleotide
taatacgactcactatagggcaaagtataattagtccaagactttatagtaacagaggagaactataatgtcttggactaacctggcggcagcgcaaaagatg

SEQ ID NO: 66356 - DNA, 103 bp, Artificial Sequence
  Synthetic Polynucleotide
taatacgactcactatagggtttaccaaagtataattagtccaagactttaacagaggagaaaagtcatggactaattaaacctggcggcagcgcaaaagatg

SEQ ID NO: 66357 - DNA, 103 bp, Artificial Sequence
  Synthetic Polynucleotide
taatacgactcactatagggtaacatttaccaaagtataattagtccaagaacagaggagacttggaatgattatacttaacctggcggcagcgcaaaagatg

SEQ ID NO: 66358 - DNA, 103 bp, Artificial Sequence
  Synthetic Polynucleotide
taatacgactcactatagggagttgtaacatttaccaaagtataattagtaacagaggagaactaatatgactttggtaaacctggcggcagcgcaaaagatg

SEQ ID NO: 66359 - DNA, 103 bp, Artificial Sequence
  Synthetic Polynucleotide
taatacgactcactatagggttgtcagttgtaacatttaccaaagtataaaacagaggagattatacatgggtaaatgtaacctggcggcagcgcaaaagatg

SEQ ID NO: 66360 - DNA, 103 bp, Artificial Sequence
  Synthetic Polynucleotide
taatacgactcactatagggaagatgccatgtactacgctgtactatctgaacagaggagacagataatgcagcgtagtaacctggcggcagcgcaaaagatg

SEQ ID NO: 66361 - DNA, 103 bp, Artificial Sequence
  Synthetic Polynucleotide
taatacgactcactatagggcactattgtcagttgtaacatttaccaaagaacagaggagactttggatgatgttacaaaacctggcggcagcgcaaaagatg

SEQ ID NO: 66362 - DNA, 103 bp, Artificial Sequence
  Synthetic Polynucleotide
taatacgactcactataggggtagacactattgtcagttgtaacatttacaacagaggagagtaaatatgacaactgacaacctggcggcagcgcaaaagatg

SEQ ID NO: 66363 - DNA, 103 bp, Artificial Sequence
  Synthetic Polynucleotide
taatacgactcactatagggtttaagtagacactattgtcagttgtaacaaacagaggagatgttacatgtgacaatagaacctggcggcagcgcaaaagatg

SEQ ID NO: 66364 - DNA, 103 bp, Artificial Sequence
  Synthetic Polynucleotide
taatacgactcactatagggatacatttaagtagacactattgtcagttgaacagaggagacaactgatgatagtgtctaacctggcggcagcgcaaaagatg

SEQ ID NO: 66365 - DNA, 103 bp, Artificial Sequence
  Synthetic Polynucleotide
taatacgactcactatagggactagatacatttaagtagacactattgtcaacagaggagagacaatatggtctacttaaacctggcggcagcgcaaaagatg

SEQ ID NO: 66366 - DNA, 103 bp, Artificial Sequence
  Synthetic Polynucleotide
taatacgactcactatagggatatcactagatacatttaagtagacactaaacagaggagatagtgtatgcttaaatgtaacctggcggcagcgcaaaagatg

SEQ ID NO: 66367 - DNA, 103 bp, Artificial Sequence
  Synthetic Polynucleotide
taatacgactcactatagggtcacgatatcactagatacatttaagtagaaacagaggagatctactatgatgtatctaaacctggcggcagcgcaaaagatg

SEQ ID NO: 66368 - DNA, 103 bp, Artificial Sequence
  Synthetic Polynucleotide
taatacgactcactatagggattgatcacgatatcactagatacatttaaaacagaggagattaaatatgtctagtgataacctggcggcagcgcaaaagatg

SEQ ID NO: 66369 - DNA, 103 bp, Artificial Sequence
  Synthetic Polynucleotide
taatacgactcactataggggttttattgatcacgatatcactagatacaaacagaggagatgtatcatgtgatatcgtaacctggcggcagcgcaaaagatg

SEQ ID NO: 66370 - DNA, 103 bp, Artificial Sequence
  Synthetic Polynucleotide
taatacgactcactatagggttcctgttttattgatcacgatatcactagaacagaggagactagtgatgtcgtgatcaaacctggcggcagcgcaaaagatg

SEQ ID NO: 66371 - DNA, 103 bp, Artificial Sequence
  Synthetic Polynucleotide
taatacgactcactatagggttgtgaagatgccatgtactacgctgtactaacagaggagaagtacaatgtagtacatgaacctggcggcagcgcaaaagatg

SEQ ID NO: 66372 - DNA, 103 bp, Artificial Sequence
  Synthetic Polynucleotide
taatacgactcactatagggaatatttcctgttttattgatcacgatatcaacagaggagagatatcatgatcaataaaaacctggcggcagcgcaaaagatg

SEQ ID NO: 66373 - DNA, 103 bp, Artificial Sequence
  Synthetic Polynucleotide
taatacgactcactataggggtagtaatatttcctgttttattgatcacgaacagaggagacgtgatatgtaaaacaggaacctggcggcagcgcaaaagatg

SEQ ID NO: 66374 - DNA, 103 bp, Artificial Sequence
  Synthetic Polynucleotide
taatacgactcactatagggtgaatgtagtaatatttcctgttttattgaaacagaggagatcaataatgcaggaaataaacctggcggcagcgcaaaagatg

SEQ ID NO: 66375 - DNA, 103 bp, Artificial Sequence
  Synthetic Polynucleotide
taatacgactcactatagggattaatgaatgtagtaatatttcctgttttaacagaggagaaaaacaatgaatattactaacctggcggcagcgcaaaagatg

SEQ ID NO: 66376 - DNA, 103 bp, Artificial Sequence
  Synthetic Polynucleotide
taatacgactcactataggggtattattaatgaatgtagtaatatttcctaacagaggagaaggaaaatgtactacattaacctggcggcagcgcaaaagatg

SEQ ID NO: 66377 - DNA, 103 bp, Artificial Sequence
  Synthetic Polynucleotide
taatacgactcactatagggtaactgtattattaatgaatgtagtaatataacagaggagaatattaatgcattcattaaacctggcggcagcgcaaaagatg

SEQ ID NO: 66378 - DNA, 103 bp, Artificial Sequence
  Synthetic Polynucleotide
taatacgactcactatagggaccattaactgtattattaatgaatgtagtaacagaggagaactacaatgattaataataacctggcggcagcgcaaaagatg

SEQ ID NO: 66379 - DNA, 103 bp, Artificial Sequence
  Synthetic Polynucleotide
taatacgactcactatagggaaattaccattaactgtattattaatgaataacagaggagaattcatatgtaatacagtaacctggcggcagcgcaaaagatg

SEQ ID NO: 66380 - DNA, 103 bp, Artificial Sequence
  Synthetic Polynucleotide
taatacgactcactatagggtcgataaattaccattaactgtattattaaaacagaggagattaataatgcagttaatgaacctggcggcagcgcaaaagatg

SEQ ID NO: 66381 - DNA, 103 bp, Artificial Sequence
  Synthetic Polynucleotide
taatacgactcactatagggactaatcgataaattaccattaactgtattaacagaggagaaatacaatgaatggtaataacctggcggcagcgcaaaagatg

SEQ ID NO: 66382 - DNA, 103 bp, Artificial Sequence
  Synthetic Polynucleotide
taatacgactcactatagggataatttgtgaagatgccatgtactacgctaacagaggagaagcgtaatgcatggcatcaacctggcggcagcgcaaaagatg

SEQ ID NO: 66383 - DNA, 103 bp, Artificial Sequence
  Synthetic Polynucleotide
taatacgactcactatagggttaagactaatcgataaattaccattaactaacagaggagaagttaaatgtaatttatcaacctggcggcagcgcaaaagatg

SEQ ID NO: 66384 - DNA, 103 bp, Artificial Sequence
  Synthetic Polynucleotide
taatacgactcactatagggtatcattaagactaatcgataaattaccataacagaggagaatggtaatgtatcgattaaacctggcggcagcgcaaaagatg

SEQ ID NO: 66385 - DNA, 103 bp, Artificial Sequence
  Synthetic Polynucleotide
taatacgactcactatagggtagtgtatcattaagactaatcgataaattaacagaggagaaatttaatgattagtcttaacctggcggcagcgcaaaagatg

SEQ ID NO: 66386 - DNA, 103 bp, Artificial Sequence
  Synthetic Polynucleotide
taatacgactcactatagggatacttagtgtatcattaagactaatcgataacagaggagaatcgatatgtcttaatgaaacctggcggcagcgcaaaagatg

SEQ ID NO: 66387 - DNA, 103 bp, Artificial Sequence
  Synthetic Polynucleotide
taatacgactcactatagggtgtatatacttagtgtatcattaagactaaaacagaggagattagtcatgatgatacacaacctggcggcagcgcaaaagatg

SEQ ID NO: 66388 - DNA, 103 bp, Artificial Sequence
  Synthetic Polynucleotide
taatacgactcactatagggttctgtgtatatacttagtgtatcattaagaacagaggagacttaatatgacactaagtaacctggcggcagcgcaaaagatg

SEQ ID NO: 66389 - DNA, 103 bp, Artificial Sequence
  Synthetic Polynucleotide
taatacgactcactatagggtctgattctgtgtatatacttagtgtatcaaacagaggagatgatacatgaagtatataaacctggcggcagcgcaaaagatg

SEQ ID NO: 66390 - DNA, 103 bp, Artificial Sequence
  Synthetic Polynucleotide
taatacgactcactatagggcaggttctgattctgtgtatatacttagtgaacagaggagacactaaatgtatacacagaacctggcggcagcgcaaaagatg

SEQ ID NO: 66391 - DNA, 103 bp, Artificial Sequence
  Synthetic Polynucleotide
taatacgactcactatagggaaacacaggttctgattctgtgtatatactaacagaggagaagtataatgacagaatcaaacctggcggcagcgcaaaagatg

SEQ ID NO: 66392 - DNA, 103 bp, Artificial Sequence
  Synthetic Polynucleotide
taatacgactcactatagggactataaacacaggttctgattctgtgtataacagaggagaatacacatgatcagaaccaacctggcggcagcgcaaaagatg

SEQ ID NO: 66393 - DNA, 103 bp, Artificial Sequence
  Synthetic Polynucleotide
taatacgactcactatagggatgatataatttgtgaagatgccatgtactaacagaggagaagtacaatgcatcttcacaacctggcggcagcgcaaaagatg

SEQ ID NO: 66394 - DNA, 103 bp, Artificial Sequence
  Synthetic Polynucleotide
taatacgactcactataggggatccactataaacacaggttctgattctgaacagaggagacagaatatgaacctgtgtaacctggcggcagcgcaaaagatg

SEQ ID NO: 66395 - DNA, 103 bp, Artificial Sequence
  Synthetic Polynucleotide
taatacgactcactataggggaatggatccactataaacacaggttctgaaacagaggagatcagaaatggtgtttataaacctggcggcagcgcaaaagatg

SEQ ID NO: 66396 - DNA, 103 bp, Artificial Sequence
  Synthetic Polynucleotide
taatacgactcactataggggtaatgaatggatccactataaacacaggtaacagaggagaacctgtatgtatagtggaaacctggcggcagcgcaaaagatg

SEQ ID NO: 66397 - DNA, 103 bp, Artificial Sequence
  Synthetic Polynucleotide
taatacgactcactatagggcaagagtaatgaatggatccactataaacaaacagaggagatgtttaatgtggatccataacctggcggcagcgcaaaagatg

SEQ ID NO: 66398 - DNA, 103 bp, Artificial Sequence
  Synthetic Polynucleotide
taatacgactcactatagggtttatcaagagtaatgaatggatccactataacagaggagaatagtgatgccattcattaacctggcggcagcgcaaaagatg

SEQ ID NO: 66399 - DNA, 103 bp, Artificial Sequence
  Synthetic Polynucleotide
taatacgactcactatagggtacaatttatcaagagtaatgaatggatccaacagaggagaggatccatgcattactctaacctggcggcagcgcaaaagatg

SEQ ID NO: 66400 - DNA, 103 bp, Artificial Sequence
  Synthetic Polynucleotide
taatacgactcactatagggagttgtacaatttatcaagagtaatgaatgaacagaggagacattcaatgctcttgataaacctggcggcagcgcaaaagatg

SEQ ID NO: 66401 - DNA, 103 bp, Artificial Sequence
  Synthetic Polynucleotide
taatacgactcactatagggcgaacagttgtacaatttatcaagagtaataacagaggagaattactatggataaattgaacctggcggcagcgcaaaagatg

SEQ ID NO: 66402 - DNA, 103 bp, Artificial Sequence
  Synthetic Polynucleotide
taatacgactcactataggggagaacgaacagttgtacaatttatcaagaaacagaggagatcttgaatgattgtacaaaacctggcggcagcgcaaaagatg

SEQ ID NO: 66403 - DNA, 103 bp, Artificial Sequence
  Synthetic Polynucleotide
taatacgactcactataggggtttggagaacgaacagttgtacaatttataacagaggagaataaatatgacaactgttaacctggcggcagcgcaaaagatg

SEQ ID NO: 66404 - DNA, 103 bp, Artificial Sequence
  Synthetic Polynucleotide
taatacgactcactatagggagacaatgatataatttgtgaagatgccataacagaggagaatggcaatgtcacaaattaacctggcggcagcgcaaaagatg

SEQ ID NO: 66405 - DNA, 103 bp, Artificial Sequence
  Synthetic Polynucleotide
taatacgactcactataggggattggtttggagaacgaacagttgtacaaaacagaggagattgtacatgtgttcgttcaacctggcggcagcgcaaaagatg

SEQ ID NO: 66406 - DNA, 103 bp, Artificial Sequence
  Synthetic Polynucleotide
taatacgactcactatagggtaattgattggtttggagaacgaacagttgaacagaggagacaactgatggttctccaaaacctggcggcagcgcaaaagatg

SEQ ID NO: 66407 - DNA, 103 bp, Artificial Sequence
  Synthetic Polynucleotide
taatacgactcactatagggttacataattgattggtttggagaacgaacaacagaggagagttcgtatgccaaaccaaaacctggcggcagcgcaaaagatg

SEQ ID NO: 66408 - DNA, 103 bp, Artificial Sequence
  Synthetic Polynucleotide
taatacgactcactataggggatatttacataattgattggtttggagaaaacagaggagattctccatgccaatcaataacctggcggcagcgcaaaagatg

SEQ ID NO: 66409 - DNA, 103 bp, Artificial Sequence
  Synthetic Polynucleotide
taatacgactcactatagggttaaagatatttacataattgattggtttgaacagaggagacaaaccatgcaattatgtaacctggcggcagcgcaaaagatg

SEQ ID NO: 66410 - DNA, 103 bp, Artificial Sequence
  Synthetic Polynucleotide
taatacgactcactatagggctgtattaaagatatttacataattgattgaacagaggagacaatcaatgatgtaaataaacctggcggcagcgcaaaagatg

SEQ ID NO: 66411 - DNA, 103 bp, Artificial Sequence
  Synthetic Polynucleotide
taatacgactcactatagggaaactctgtattaaagatatttacataattaacagaggagaaattatatgaatatctttaacctggcggcagcgcaaaagatg

SEQ ID NO: 66412 - DNA, 103 bp, Artificial Sequence
  Synthetic Polynucleotide
taatacgactcactataggggtattaaactctgtattaaagatatttacaaacagaggagatgtaaaatgctttaatacaacctggcggcagcgcaaaagatg

SEQ ID NO: 66413 - DNA, 103 bp, Artificial Sequence
  Synthetic Polynucleotide
taatacgactcactatagggtattagtattaaactctgtattaaagatataacagaggagaatatctatgatacagagtaacctggcggcagcgcaaaagatg

SEQ ID NO: 66414 - DNA, 103 bp, Artificial Sequence
  Synthetic Polynucleotide
taatacgactcactatagggattagtattagtattaaactctgtattaaaaacagaggagatttaatatggagtttaataacctggcggcagcgcaaaagatg

SEQ ID NO: 66415 - DNA, 103 bp, Artificial Sequence
  Synthetic Polynucleotide
taatacgactcactatagggctattagacaatgatataatttgtgaagataacagaggagaatcttcatgaattatatcaacctggcggcagcgcaaaagatg

SEQ ID NO: 66416 - DNA, 103 bp, Artificial Sequence
  Synthetic Polynucleotide
taatacgactcactatagggttagtattagtattagtattaaactctgtaaacagaggagatacagaatgtaatactaaaacctggcggcagcgcaaaagatg

SEQ ID NO: 66417 - DNA, 103 bp, Artificial Sequence
  Synthetic Polynucleotide
taatacgactcactatagggtagtattagtattagtattagtattaaactaacagaggagaagtttaatgctaatactaaacctggcggcagcgcaaaagatg

SEQ ID NO: 66418 - DNA, 103 bp, Artificial Sequence
  Synthetic Polynucleotide
taatacgactcactatagggagtattagtattagtattagtattagtattaacagaggagaaatactatgactaatactaacctggcggcagcgcaaaagatg

SEQ ID NO: 66419 - DNA, 103 bp, Artificial Sequence
  Synthetic Polynucleotide
taatacgactcactataggggtattagtattagtattagtattagtattaaacagaggagataatacatgtactaatacaacctggcggcagcgcaaaagatg

SEQ ID NO: 66420 - DNA, 103 bp, Artificial Sequence
  Synthetic Polynucleotide
taatacgactcactatagggtattagtattagtattagtattagtattagaacagaggagactaataatgatactaataaacctggcggcagcgcaaaagatg

SEQ ID NO: 66421 - DNA, 103 bp, Artificial Sequence
  Synthetic Polynucleotide
taatacgactcactatagggattagtattagtattagtattagtattagtaacagaggagaactaatatgaatactaataacctggcggcagcgcaaaagatg

SEQ ID NO: 66422 - DNA, 103 bp, Artificial Sequence
  Synthetic Polynucleotide
taatacgactcactataggggtagtattagtattagtattagtattagtaaacagaggagatactaaatgtaatactaaaacctggcggcagcgcaaaagatg

SEQ ID NO: 66423 - DNA, 103 bp, Artificial Sequence
  Synthetic Polynucleotide
taatacgactcactatagggaagtagtagtattagtattagtattagtataacagaggagaatactaatgctaatactaaacctggcggcagcgcaaaagatg

SEQ ID NO: 66424 - DNA, 103 bp, Artificial Sequence
  Synthetic Polynucleotide
taatacgactcactatagggcttacaagtagtagtattagtattagtattaacagaggagaaatactatgactaatactaacctggcggcagcgcaaaagatg

SEQ ID NO: 66425 - DNA, 103 bp, Artificial Sequence
  Synthetic Polynucleotide
taatacgactcactatagggtcattcttacaagtagtagtattagtattaaacagaggagataatacatgtactactacaacctggcggcagcgcaaaagatg

SEQ ID NO: 66426 - DNA, 103 bp, Artificial Sequence
  Synthetic Polynucleotide
taatacgactcactatagggaatatctattagacaatgatataatttgtgaacagaggagacacaaaatgtatcattgtaacctggcggcagcgcaaaagatg

SEQ ID NO: 66427 - DNA, 103 bp, Artificial Sequence
  Synthetic Polynucleotide
taatacgactcactatagggcagtctcattcttacaagtagtagtattagaacagaggagactaataatgctacttgtaaacctggcggcagcgcaaaagatg

SEQ ID NO: 66428 - DNA, 103 bp, Artificial Sequence
  Synthetic Polynucleotide
taatacgactcactataggggtagtcagtctcattcttacaagtagtagtaacagaggagaactactatgtgtaagaataacctggcggcagcgcaaaagatg

SEQ ID NO: 66429 - DNA, 103 bp, Artificial Sequence
  Synthetic Polynucleotide
taatacgactcactatagggggtgtgtagtcagtctcattcttacaagtaaacagaggagatacttgatggaatgagacaacctggcggcagcgcaaaagatg

SEQ ID NO: 66430 - DNA, 103 bp, Artificial Sequence
  Synthetic Polynucleotide
taatacgactcactatagggccattggtgtgtagtcagtctcattcttacaacagaggagagtaagaatgagactgactaacctggcggcagcgcaaaagatg

SEQ ID NO: 66431 - DNA, 103 bp, Artificial Sequence
  Synthetic Polynucleotide
taatacgactcactatagggaatgtccattggtgtgtagtcagtctcattaacagaggagaaatgagatggactacacaaacctggcggcagcgcaaaagatg

SEQ ID NO: 66432 - DNA, 103 bp, Artificial Sequence
  Synthetic Polynucleotide
taatacgactcactatagggtaagaaatgtccattggtgtgtagtcagtcaacagaggagagactgaatgcacaccaataacctggcggcagcgcaaaagatg

SEQ ID NO: 66433 - DNA, 103 bp, Artificial Sequence
  Synthetic Polynucleotide
taatacgactcactatagggtaacataagaaatgtccattggtgtgtagtaacagaggagaactacaatgcaatggacaaacctggcggcagcgcaaaagatg

SEQ ID NO: 66434 - DNA, 103 bp, Artificial Sequence
  Synthetic Polynucleotide
taatacgactcactatagggattaataacataagaaatgtccattggtgtaacagaggagaacaccaatggacatttctaacctggcggcagcgcaaaagatg

SEQ ID NO: 66435 - DNA, 103 bp, Artificial Sequence
  Synthetic Polynucleotide
taatacgactcactatagggttgtcattaataacataagaaatgtccattaacagaggagaaatggaatgttcttatgtaacctggcggcagcgcaaaagatg

SEQ ID NO: 66436 - DNA, 103 bp, Artificial Sequence
  Synthetic Polynucleotide
taatacgactcactatagggttatattgtcattaataacataagaaatgtaacagaggagaacatttatgatgttattaaacctggcggcagcgcaaaagatg

SEQ ID NO: 66437 - DNA, 103 bp, Artificial Sequence
  Synthetic Polynucleotide
taatacgactcactatagggcatcaaatatctattagacaatgatataataacagaggagaattataatgttgtctaataacctggcggcagcgcaaaagatg

SEQ ID NO: 66438 - DNA, 103 bp, Artificial Sequence
  Synthetic Polynucleotide
taatacgactcactataggggaatgttatattgtcattaataacataagaaacagaggagatcttatatgattaatgacaacctggcggcagcgcaaaagatg

SEQ ID NO: 66439 - DNA, 103 bp, Artificial Sequence
  Synthetic Polynucleotide
taatacgactcactatagggctaatgaatgttatattgtcattaataacaaacagaggagatgttatatgtgacaatataacctggcggcagcgcaaaagatg

SEQ ID NO: 66440 - DNA, 103 bp, Artificial Sequence
  Synthetic Polynucleotide
taatacgactcactatagggtattactaatgaatgttatattgtcattaaaacagaggagattaatgatgatataacataacctggcggcagcgcaaaagatg

SEQ ID NO: 66441 - DNA, 103 bp, Artificial Sequence
  Synthetic Polynucleotide
taatacgactcactatagggtgtgatattactaatgaatgttatattgtcaacagaggagagacaatatgacattcattaacctggcggcagcgcaaaagatg

SEQ ID NO: 66442 - DNA, 103 bp, Artificial Sequence
  Synthetic Polynucleotide
taatacgactcactatagggcttgatgtgatattactaatgaatgttataaacagaggagatataacatgcattagtaaaacctggcggcagcgcaaaagatg

SEQ ID NO: 66443 - DNA, 103 bp, Artificial Sequence
  Synthetic Polynucleotide
taatacgactcactatagggttgtacttgatgtgatattactaatgaatgaacagaggagacattcaatggtaatatcaaacctggcggcagcgcaaaagatg

SEQ ID NO: 66444 - DNA, 103 bp, Artificial Sequence
  Synthetic Polynucleotide
taatacgactcactatagggatattttgtacttgatgtgatattactaataacagaggagaattagtatgatcacatcaaacctggcggcagcgcaaaagatg

SEQ ID NO: 66445 - DNA, 103 bp, Artificial Sequence
  Synthetic Polynucleotide
taatacgactcactatagggttgatatattttgtacttgatgtgatattaaacagaggagataatatatgatcaagtacaacctggcggcagcgcaaaagatg

SEQ ID NO: 66446 - DNA, 103 bp, Artificial Sequence
  Synthetic Polynucleotide
taatacgactcactatagggatgagttgatatattttgtacttgatgtgaaacagaggagatcacatatggtacaaaataacctggcggcagcgcaaaagatg

SEQ ID NO: 66447 - DNA, 103 bp, Artificial Sequence
  Synthetic Polynucleotide
taatacgactcactatagggtacacatgagttgatatattttgtacttgaaacagaggagatcaagtatgaaatatatcaacctggcggcagcgcaaaagatg

SEQ ID NO: 66448 - DNA, 103 bp, Artificial Sequence
  Synthetic Polynucleotide
taatacgactcactatagggagatgcatcaaatatctattagacaatgataacagaggagaatcattatgtaatagataaacctggcggcagcgcaaaagatg

SEQ ID NO: 66449 - DNA, 103 bp, Artificial Sequence
  Synthetic Polynucleotide
taatacgactcactataggggaatttacacatgagttgatatattttgtaaacagaggagatacaaaatgtatcaactcaacctggcggcagcgcaaaagatg

SEQ ID NO: 66450 - DNA, 103 bp, Artificial Sequence
  Synthetic Polynucleotide
taatacgactcactataggggtgacgaatttacacatgagttgatatattaacagaggagaaatataatgactcatgtgaacctggcggcagcgcaaaagatg

SEQ ID NO: 66451 - DNA, 103 bp, Artificial Sequence
  Synthetic Polynucleotide
taatacgactcactatagggactcagtgacgaatttacacatgagttgataacagaggagaatcaacatgtgtgtaaataacctggcggcagcgcaaaagatg

SEQ ID NO: 66452 - DNA, 103 bp, Artificial Sequence
  Synthetic Polynucleotide
taatacgactcactatagggtgtaaactcagtgacgaatttacacatgagaacagaggagactcatgatgaaattcgtcaacctggcggcagcgcaaaagatg

SEQ ID NO: 66453 - DNA, 103 bp, Artificial Sequence
  Synthetic Polynucleotide
taatacgactcactatagggctatctgtaaactcagtgacgaatttacacaacagaggagagtgtaaatgcgtcactgaaacctggcggcagcgcaaaagatg

SEQ ID NO: 66454 - DNA, 103 bp, Artificial Sequence
  Synthetic Polynucleotide
taatacgactcactatagggaaccgctatctgtaaactcagtgacgaattaacagaggagaaattcgatgctgagtttaaacctggcggcagcgcaaaagatg

SEQ ID NO: 66455 - DNA, 103 bp, Artificial Sequence
  Synthetic Polynucleotide
taatacgactcactatagggctgacaaccgctatctgtaaactcagtgacaacagaggagagtcactatgtttacagataacctggcggcagcgcaaaagatg

SEQ ID NO: 66456 - DNA, 103 bp, Artificial Sequence
  Synthetic Polynucleotide
taatacgactcactataggggtattctgacaaccgctatctgtaaactcaaacagaggagatgagttatgagatagcggaacctggcggcagcgcaaaagatg

SEQ ID NO: 66457 - DNA, 103 bp, Artificial Sequence
  Synthetic Polynucleotide
taatacgactcactatagggtactggtattctgacaaccgctatctgtaaaacagaggagattacagatggcggttgtcaacctggcggcagcgcaaaagatg

SEQ ID NO: 66458 - DNA, 103 bp, Artificial Sequence
  Synthetic Polynucleotide
taatacgactcactatagggaacaatactggtattctgacaaccgctatcaacagaggagagatagcatgtgtcagaataacctggcggcagcgcaaaagatg

SEQ ID NO: 66459 - DNA, 103 bp, Artificial Sequence
  Synthetic Polynucleotide
taatacgactcactatagggagtagaatatgggtgtaaattacaattgataacagaggagaatcaatatgaatttacacaacctggcggcagcgcaaaagatg

SEQ ID NO: 66460 - DNA, 103 bp, Artificial Sequence
  Synthetic Polynucleotide
taatacgactcactatagggccataagatgcatcaaatatctattagacaaacagaggagatgtctaatggatatttgaaacctggcggcagcgcaaaagatg

SEQ ID NO: 66461 - DNA, 103 bp, Artificial Sequence
  Synthetic Polynucleotide
taatacgactcactatagggtattaaacaatactggtattctgacaaccgaacagaggagacggttgatggaataccagaacctggcggcagcgcaaaagatg

SEQ ID NO: 66462 - DNA, 103 bp, Artificial Sequence
  Synthetic Polynucleotide
taatacgactcactatagggtgttttattaaacaatactggtattctgacaacagaggagagtcagaatgccagtattgaacctggcggcagcgcaaaagatg

SEQ ID NO: 66463 - DNA, 103 bp, Artificial Sequence
  Synthetic Polynucleotide
taatacgactcactatagggtccattgttttattaaacaatactggtattaacagaggagaaataccatgattgtttaaaacctggcggcagcgcaaaagatg

SEQ ID NO: 66464 - DNA, 103 bp, Artificial Sequence
  Synthetic Polynucleotide
taatacgactcactatagggattgttccattgttttattaaacaatactgaacagaggagacagtatatgttaataaaaaacctggcggcagcgcaaaagatg

SEQ ID NO: 66465 - DNA, 103 bp, Artificial Sequence
  Synthetic Polynucleotide
taatacgactcactatagggacctaattgttccattgttttattaaacaaaacagaggagattgtttatgaaaacaatgaacctggcggcagcgcaaaagatg

SEQ ID NO: 66466 - DNA, 103 bp, Artificial Sequence
  Synthetic Polynucleotide
taatacgactcactataggggtaatacctaattgttccattgttttattaaacagaggagataataaatgaatggaacaaacctggcggcagcgcaaaagatg

SEQ ID NO: 66467 - DNA, 103 bp, Artificial Sequence
  Synthetic Polynucleotide
taatacgactcactatagggctagagtaatacctaattgttccattgtttaacagaggagaaaacaaatgaacaattagaacctggcggcagcgcaaaagatg

SEQ ID NO: 66468 - DNA, 103 bp, Artificial Sequence
  Synthetic Polynucleotide
taatacgactcactatagggagatcctagagtaatacctaattgttccataacagaggagaatggaaatgttaggtattaacctggcggcagcgcaaaagatg

SEQ ID NO: 66469 - DNA, 103 bp, Artificial Sequence
  Synthetic Polynucleotide
taatacgactcactatagggaaatcagatcctagagtaatacctaattgtaacagaggagaacaattatgtattactctaacctggcggcagcgcaaaagatg

SEQ ID NO: 66470 - DNA, 103 bp, Artificial Sequence
  Synthetic Polynucleotide
taatacgactcactatagggcttccaaatcagatcctagagtaatacctaaacagaggagataggtaatgctctaggataacctggcggcagcgcaaaagatg

SEQ ID NO: 66471 - DNA, 103 bp, Artificial Sequence
  Synthetic Polynucleotide
taatacgactcactataggggggatccataagatgcatcaaatatctattaacagaggagaaatagaatgttgatgcataacctggcggcagcgcaaaagatg

SEQ ID NO: 66472 - DNA, 103 bp, Artificial Sequence
  Synthetic Polynucleotide
taatacgactcactatagggatacgcttccaaatcagatcctagagtaataacagaggagaattactatgggatctgataacctggcggcagcgcaaaagatg

SEQ ID NO: 66473 - DNA, 103 bp, Artificial Sequence
  Synthetic Polynucleotide
taatacgactcactatagggatgaaatacgcttccaaatcagatcctagaaacagaggagatctaggatgtgatttggaaacctggcggcagcgcaaaagatg

SEQ ID NO: 66474 - DNA, 103 bp, Artificial Sequence
  Synthetic Polynucleotide
taatacgactcactatagggtacacatgaaatacgcttccaaatcagatcaacagaggagagatctgatgtggaagcgtaacctggcggcagcgcaaaagatg

SEQ ID NO: 66475 - DNA, 103 bp, Artificial Sequence
  Synthetic Polynucleotide
taatacgactcactatagggtaacttacacatgaaatacgcttccaaatcaacagaggagagatttgatggcgtatttcaacctggcggcagcgcaaaagatg

SEQ ID NO: 66476 - DNA, 103 bp, Artificial Sequence
  Synthetic Polynucleotide
taatacgactcactatagggtcctgtaacttacacatgaaatacgcttccaacagaggagaggaagcatgtttcatgtgaacctggcggcagcgcaaaagatg

SEQ ID NO: 66477 - DNA, 103 bp, Artificial Sequence
  Synthetic Polynucleotide
taatacgactcactatagggtaagttcctgtaacttacacatgaaatacgaacagaggagacgtattatgtgtgtaagtaacctggcggcagcgcaaaagatg

SEQ ID NO: 66478 - DNA, 103 bp, Artificial Sequence
  Synthetic Polynucleotide
taatacgactcactatagggacaattaagttcctgtaacttacacatgaaaacagaggagattcatgatgaagttacagaacctggcggcagcgcaaaagatg

SEQ ID NO: 66479 - DNA, 103 bp, Artificial Sequence
  Synthetic Polynucleotide
taatacgactcactataggggcgtcacaattaagttcctgtaacttacacaacagaggagagtgtaaatgacaggaactaacctggcggcagcgcaaaagatg

SEQ ID NO: 66480 - DNA, 103 bp, Artificial Sequence
  Synthetic Polynucleotide
taatacgactcactatagggtactcgcgtcacaattaagttcctgtaactaacagaggagaagttacatgaacttaattaacctggcggcagcgcaaaagatg

SEQ ID NO: 66481 - DNA, 103 bp, Artificial Sequence
  Synthetic Polynucleotide
taatacgactcactataggggagaatactcgcgtcacaattaagttcctgaacagaggagacaggaaatgaattgtgacaacctggcggcagcgcaaaagatg

SEQ ID NO: 66482 - DNA, 103 bp, Artificial Sequence
  Synthetic Polynucleotide
taatacgactcactataggggaagtgggatccataagatgcatcaaatataacagaggagaatatttatggcatcttataacctggcggcagcgcaaaagatg

SEQ ID NO: 66483 - DNA, 103 bp, Artificial Sequence
  Synthetic Polynucleotide
taatacgactcactatagggttcaagagaatactcgcgtcacaattaagtaacagaggagaacttaaatgtgacgcgagaacctggcggcagcgcaaaagatg

SEQ ID NO: 66484 - DNA, 103 bp, Artificial Sequence
  Synthetic Polynucleotide
taatacgactcactatagggccttgttcaagagaatactcgcgtcacaataacagaggagaattgtgatgcgagtattcaacctggcggcagcgcaaaagatg

SEQ ID NO: 66485 - DNA, 103 bp, Artificial Sequence
  Synthetic Polynucleotide
taatacgactcactatagggtgatgccttgttcaagagaatactcgcgtcaacagaggagagacgcgatgattctcttgaacctggcggcagcgcaaaagatg

SEQ ID NO: 66486 - DNA, 103 bp, Artificial Sequence
  Synthetic Polynucleotide
taatacgactcactatagggttttttgatgccttgttcaagagaatactcaacagaggagagagtatatgcttgaacaaaacctggcggcagcgcaaaagatg

SEQ ID NO: 66487 - DNA, 103 bp, Artificial Sequence
  Synthetic Polynucleotide
taatacgactcactatagggttacattttttgatgccttgttcaagagaaaacagaggagattctctatgacaaggcataacctggcggcagcgcaaaagatg

SEQ ID NO: 66488 - DNA, 103 bp, Artificial Sequence
  Synthetic Polynucleotide
taatacgactcactatagggatccattacattttttgatgccttgttcaaaacagaggagattgaacatggcatcaaaaaacctggcggcagcgcaaaagatg

SEQ ID NO: 66489 - DNA, 103 bp, Artificial Sequence
  Synthetic Polynucleotide
taatacgactcactatagggtgtctatccattacattttttgatgccttgaacagaggagacaaggcatgaaaaaatgtaacctggcggcagcgcaaaagatg

SEQ ID NO: 66490 - DNA, 103 bp, Artificial Sequence
  Synthetic Polynucleotide
taatacgactcactatagggataattgtctatccattacattttttgatgaacagaggagacatcaaatgatgtaatggaacctggcggcagcgcaaaagatg

SEQ ID NO: 66491 - DNA, 103 bp, Artificial Sequence
  Synthetic Polynucleotide
taatacgactcactatagggttttgataattgtctatccattacatttttaacagaggagaaaaaatatgatggatagaaacctggcggcagcgcaaaagatg

SEQ ID NO: 66492 - DNA, 103 bp, Artificial Sequence
  Synthetic Polynucleotide
taatacgactcactatagggggagtttttgataattgtctatccattacaaacagaggagatgtaatatgtagacaattaacctggcggcagcgcaaaagatg

SEQ ID NO: 66493 - DNA, 103 bp, Artificial Sequence
  Synthetic Polynucleotide
taatacgactcactatagggctgtcgaagtgggatccataagatgcatcaaacagaggagatgatgcatgttatggatcaacctggcggcagcgcaaaagatg

SEQ ID NO: 66494 - DNA, 103 bp, Artificial Sequence
  Synthetic Polynucleotide
taatacgactcactatagggtcgttggagtttttgataattgtctatccaaacagaggagatggataatgaattatcaaaacctggcggcagcgcaaaagatg

SEQ ID NO: 66495 - DNA, 103 bp, Artificial Sequence
  Synthetic Polynucleotide
taatacgactcactatagggttatctcgttggagtttttgataattgtctaacagaggagaagacaaatgtcaaaaactaacctggcggcagcgcaaaagatg

SEQ ID NO: 66496 - DNA, 103 bp, Artificial Sequence
  Synthetic Polynucleotide
taatacgactcactatagggctcttttatctcgttggagtttttgataataacagaggagaattatcatgaactccaacaacctggcggcagcgcaaaagatg

SEQ ID NO: 66497 - DNA, 103 bp, Artificial Sequence
  Synthetic Polynucleotide
taatacgactcactatagggtggatctcttttatctcgttggagtttttgaacagaggagacaaaaaatgcaacgagataacctggcggcagcgcaaaagatg

SEQ ID NO: 66498 - DNA, 103 bp, Artificial Sequence
  Synthetic Polynucleotide
taatacgactcactatagggctcagtggatctcttttatctcgttggagtaacagaggagaactccaatgagataaaagaacctggcggcagcgcaaaagatg

SEQ ID NO: 66499 - DNA, 103 bp, Artificial Sequence
  Synthetic Polynucleotide
taatacgactcactataggggtcatctcagtggatctcttttatctcgttaacagaggagaaacgagatgaaagagatcaacctggcggcagcgcaaaagatg

SEQ ID NO: 66500 - DNA, 103 bp, Artificial Sequence
  Synthetic Polynucleotide
taatacgactcactatagggttccagtcatctcagtggatctcttttatcaacagaggagagataaaatggatccactgaacctggcggcagcgcaaaagatg

SEQ ID NO: 66501 - DNA, 103 bp, Artificial Sequence
  Synthetic Polynucleotide
taatacgactcactataggggtgatttccagtcatctcagtggatctcttaacagaggagaaagagaatgactgagatgaacctggcggcagcgcaaaagatg

SEQ ID NO: 66502 - DNA, 103 bp, Artificial Sequence
  Synthetic Polynucleotide
taatacgactcactatagggcagaagtgatttccagtcatctcagtggataacagaggagaatccacatggatgactggaacctggcggcagcgcaaaagatg

SEQ ID NO: 66503 - DNA, 103 bp, Artificial Sequence
  Synthetic Polynucleotide
taatacgactcactataggggtagacagaagtgatttccagtcatctcagaacagaggagactgagaatgctggaaatcaacctggcggcagcgcaaaagatg

SEQ ID NO: 66504 - DNA, 103 bp, Artificial Sequence
  Synthetic Polynucleotide
taatacgactcactataggggatggctgtcgaagtgggatccataagatgaacagaggagacatcttatggatcccactaacctggcggcagcgcaaaagatg

SEQ ID NO: 66505 - DNA, 103 bp, Artificial Sequence
  Synthetic Polynucleotide
taatacgactcactatagggcttatgtagacagaagtgatttccagtcataacagaggagaatgactatgaatcacttcaacctggcggcagcgcaaaagatg

SEQ ID NO: 66506 - DNA, 103 bp, Artificial Sequence
  Synthetic Polynucleotide
taatacgactcactatagggtgattcttatgtagacagaagtgatttccaaacagaggagatggaaaatgcttctgtctaacctggcggcagcgcaaaagatg

SEQ ID NO: 66507 - DNA, 103 bp, Artificial Sequence
  Synthetic Polynucleotide
taatacgactcactatagggtagcttgattcttatgtagacagaagtgataacagaggagaatcactatggtctacataaacctggcggcagcgcaaaagatg

SEQ ID NO: 66508 - DNA, 103 bp, Artificial Sequence
  Synthetic Polynucleotide
taatacgactcactatagggcagcctagcttgattcttatgtagacagaaaacagaggagattctgtatgcataagaataacctggcggcagcgcaaaagatg

SEQ ID NO: 66509 - DNA, 103 bp, Artificial Sequence
  Synthetic Polynucleotide
taatacgactcactataggggtttccagcctagcttgattcttatgtagaaacagaggagatctacaatggaatcaagcaacctggcggcagcgcaaaagatg

SEQ ID NO: 66510 - DNA, 103 bp, Artificial Sequence
  Synthetic Polynucleotide
taatacgactcactatagggaaatagtttccagcctagcttgattcttataacagaggagaataagaatgaagctaggcaacctggcggcagcgcaaaagatg

SEQ ID NO: 66511 - DNA, 103 bp, Artificial Sequence
  Synthetic Polynucleotide
taatacgactcactatagggttcgtaaatagtttccagcctagcttgattaacagaggagaaatcaaatgaggctggaaaacctggcggcagcgcaaaagatg

SEQ ID NO: 66512 - DNA, 103 bp, Artificial Sequence
  Synthetic Polynucleotide
taatacgactcactatagggatagtttcgtaaatagtttccagcctagctaacagaggagaagctagatgggaaactataacctggcggcagcgcaaaagatg

SEQ ID NO: 66513 - DNA, 103 bp, Artificial Sequence
  Synthetic Polynucleotide
taatacgactcactatagggttttgatagtttcgtaaatagtttccagccaacagaggagaggctggatgctatttacgaacctggcggcagcgcaaaagatg

SEQ ID NO: 66514 - DNA, 103 bp, Artificial Sequence
  Synthetic Polynucleotide
taatacgactcactatagggctgcattttgatagtttcgtaaatagtttcaacagaggagagaaactatgtacgaaactaacctggcggcagcgcaaaagatg

SEQ ID NO: 66515 - DNA, 103 bp, Artificial Sequence
  Synthetic Polynucleotide
taatacgactcactatagggtttaagatggctgtcgaagtgggatccataaacagaggagatatggaatgcacttcgacaacctggcggcagcgcaaaagatg

SEQ ID NO: 66516 - DNA, 103 bp, Artificial Sequence
  Synthetic Polynucleotide
taatacgactcactataggggtaccctgcattttgatagtttcgtaaataaacagaggagatatttaatgaactatcaaaacctggcggcagcgcaaaagatg

SEQ ID NO: 66517 - DNA, 103 bp, Artificial Sequence
  Synthetic Polynucleotide
taatacgactcactatagggttgttgtaccctgcattttgatagtttcgtaacagaggagaacgaaaatgtcaaaatgcaacctggcggcagcgcaaaagatg

SEQ ID NO: 66518 - DNA, 103 bp, Artificial Sequence
  Synthetic Polynucleotide
taatacgactcactatagggattgtttgttgtaccctgcattttgatagtaacagaggagaactatcatgatgcagggtaacctggcggcagcgcaaaagatg

SEQ ID NO: 66519 - DNA, 103 bp, Artificial Sequence
  Synthetic Polynucleotide
taatacgactcactatagggtcattattgtttgttgtaccctgcattttgaacagaggagacaaaatatggggtacaacaacctggcggcagcgcaaaagatg

SEQ ID NO: 66520 - DNA, 103 bp, Artificial Sequence
  Synthetic Polynucleotide
taatacgactcactatagggttccgtcattattgtttgttgtaccctgcaaacagaggagatgcaggatgcaacaaacaaacctggcggcagcgcaaaagatg

SEQ ID NO: 66521 - DNA, 103 bp, Artificial Sequence
  Synthetic Polynucleotide
taatacgactcactatagggtttacttccgtcattattgtttgttgtaccaacagaggagaggtacaatgaacaataataacctggcggcagcgcaaaagatg

SEQ ID NO: 66522 - DNA, 103 bp, Artificial Sequence
  Synthetic Polynucleotide
taatacgactcactataggggttcgtttacttccgtcattattgtttgttaacagaggagaaacaaaatgtaatgacggaacctggcggcagcgcaaaagatg

SEQ ID NO: 66523 - DNA, 103 bp, Artificial Sequence
  Synthetic Polynucleotide
taatacgactcactataggggagacgttcgtttacttccgtcattattgtaacagaggagaacaataatgacggaagtaaacctggcggcagcgcaaaagatg

SEQ ID NO: 66524 - DNA, 103 bp, Artificial Sequence
  Synthetic Polynucleotide
taatacgactcactatagggtattggagacgttcgtttacttccgtcattaacagaggagaaatgacatgagtaaacgaaacctggcggcagcgcaaaagatg

SEQ ID NO: 66525 - DNA, 103 bp, Artificial Sequence
  Synthetic Polynucleotide
taatacgactcactatagggtcatatattggagacgttcgtttacttccgaacagaggagacggaagatgacgaacgtcaacctggcggcagcgcaaaagatg

SEQ ID NO: 66526 - DNA, 103 bp, Artificial Sequence
  Synthetic Polynucleotide
taatacgactcactatagggccgattttaagatggctgtcgaagtgggataacagaggagaatcccaatgcgacagccaaacctggcggcagcgcaaaagatg

SEQ ID NO: 66527 - DNA, 103 bp, Artificial Sequence
  Synthetic Polynucleotide
taatacgactcactatagggcgttatcatatattggagacgttcgtttacaacagaggagagtaaacatgcgtctccaaaacctggcggcagcgcaaaagatg

SEQ ID NO: 66528 - DNA, 103 bp, Artificial Sequence
  Synthetic Polynucleotide
taatacgactcactataggggccaacgttatcatatattggagacgttcgaacagaggagacgaacgatgccaatatataacctggcggcagcgcaaaagatg

SEQ ID NO: 66529 - DNA, 103 bp, Artificial Sequence
  Synthetic Polynucleotide
taatacgactcactataggggtattgccaacgttatcatatattggagacaacagaggagagtctccatgatatgataaaacctggcggcagcgcaaaagatg

SEQ ID NO: 66530 - DNA, 103 bp, Artificial Sequence
  Synthetic Polynucleotide
taatacgactcactatagggccttagtattgccaacgttatcatatattgaacagaggagacaatatatgataacgttgaacctggcggcagcgcaaaagatg

SEQ ID NO: 66531 - DNA, 103 bp, Artificial Sequence
  Synthetic Polynucleotide
taatacgactcactatagggtgaatccttagtattgccaacgttatcataaacagaggagatatgatatggttggcaataacctggcggcagcgcaaaagatg

SEQ ID NO: 66532 - DNA, 103 bp, Artificial Sequence
  Synthetic Polynucleotide
taatacgactcactataggggtcaatgaatccttagtattgccaacgttaaacagaggagataacgtatgcaatactaaaacctggcggcagcgcaaaagatg

SEQ ID NO: 66533 - DNA, 103 bp, Artificial Sequence
  Synthetic Polynucleotide
taatacgactcactatagggcatatgtcaatgaatccttagtattgccaaaacagaggagattggcaatgctaaggattaacctggcggcagcgcaaaagatg

SEQ ID NO: 66534 - DNA, 103 bp, Artificial Sequence
  Synthetic Polynucleotide
taatacgactcactatagggatttacatatgtcaatgaatccttagtattaacagaggagaaatactatggattcattgaacctggcggcagcgcaaaagatg

SEQ ID NO: 66535 - DNA, 103 bp, Artificial Sequence
  Synthetic Polynucleotide
taatacgactcactatagggttaatatttacatatgtcaatgaatccttaaacagaggagataaggaatgattgacataaacctggcggcagcgcaaaagatg

SEQ ID NO: 66536 - DNA, 103 bp, Artificial Sequence
  Synthetic Polynucleotide
taatacgactcactatagggctttattaatatttacatatgtcaatgaataacagaggagaattcatatgcatatgtaaaacctggcggcagcgcaaaagatg

SEQ ID NO: 66537 - DNA, 103 bp, Artificial Sequence
  Synthetic Polynucleotide
taatacgactcactatagggttctaccgattttaagatggctgtcgaagtaacagaggagaacttcgatggccatcttaaacctggcggcagcgcaaaagatg

SEQ ID NO: 66538 - DNA, 103 bp, Artificial Sequence
  Synthetic Polynucleotide
taatacgactcactatagggatatactttattaatatttacatatgtcaaaacagaggagattgacaatggtaaatattaacctggcggcagcgcaaaagatg

SEQ ID NO: 66539 - DNA, 103 bp, Artificial Sequence
  Synthetic Polynucleotide
taatacgactcactatagggctcatatatactttattaatatttacatataacagaggagaatatgtatgtattaataaaacctggcggcagcgcaaaagatg

SEQ ID NO: 66540 - DNA, 103 bp, Artificial Sequence
  Synthetic Polynucleotide
taatacgactcactatagggtgtatctcatatatactttattaatatttaaacagaggagataaataatgataaagtataacctggcggcagcgcaaaagatg

SEQ ID NO: 66541 - DNA, 103 bp, Artificial Sequence
  Synthetic Polynucleotide
taatacgactcactatagggaaacgtgtatctcatatatactttattaataacagaggagaattaatatggtatatatgaacctggcggcagcgcaaaagatg

SEQ ID NO: 66542 - DNA, 103 bp, Artificial Sequence
  Synthetic Polynucleotide
taatacgactcactatagggtatcaaaacgtgtatctcatatatactttaaacagaggagataaagtatgtatgagataaacctggcggcagcgcaaaagatg

SEQ ID NO: 66543 - DNA, 103 bp, Artificial Sequence
  Synthetic Polynucleotide
taatacgactcactatagggatgactatcaaaacgtgtatctcatatataaacagaggagatatataatggatacacgtaacctggcggcagcgcaaaagatg

SEQ ID NO: 66544 - DNA, 103 bp, Artificial Sequence
  Synthetic Polynucleotide
taatacgactcactatagggttaggatgactatcaaaacgtgtatctcataacagaggagaatgagaatgacgttttgaaacctggcggcagcgcaaaagatg

SEQ ID NO: 66545 - DNA, 103 bp, Artificial Sequence
  Synthetic Polynucleotide
taatacgactcactatagggtacgattaggatgactatcaaaacgtgtataacagaggagaatacacatgttgatagtcaacctggcggcagcgcaaaagatg

SEQ ID NO: 66546 - DNA, 103 bp, Artificial Sequence
  Synthetic Polynucleotide
taatacgactcactatagggtccgatacgattaggatgactatcaaaacgaacagaggagacgttttatgagtcatcctaacctggcggcagcgcaaaagatg

SEQ ID NO: 66547 - DNA, 103 bp, Artificial Sequence
  Synthetic Polynucleotide
taatacgactcactatagggcgtactccgatacgattaggatgactatcaaacagaggagatgatagatgtcctaatcgaacctggcggcagcgcaaaagatg

SEQ ID NO: 66548 - DNA, 103 bp, Artificial Sequence
  Synthetic Polynucleotide
taatacgactcactatagggtatgattctaccgattttaagatggctgtcaacagaggagagacagcatgcttaaaatcaacctggcggcagcgcaaaagatg

SEQ ID NO: 66549 - DNA, 103 bp, Artificial Sequence
  Synthetic Polynucleotide
taatacgactcactatagggatctccgtactccgatacgattaggatgacaacagaggagagtcatcatgatcgtatcgaacctggcggcagcgcaaaagatg

SEQ ID NO: 66550 - DNA, 103 bp, Artificial Sequence
  Synthetic Polynucleotide
taatacgactcactatagggtgatgatctccgtactccgatacgattaggaacagaggagacctaatatgatcggagtaaacctggcggcagcgcaaaagatg

SEQ ID NO: 66551 - DNA, 103 bp, Artificial Sequence
  Synthetic Polynucleotide
taatacgactcactataggggaacttgatgatctccgtactccgatacgaaacagaggagatcgtatatgagtacggagaacctggcggcagcgcaaaagatg

SEQ ID NO: 66552 - DNA, 103 bp, Artificial Sequence
  Synthetic Polynucleotide
taatacgactcactatagggatgatgaacttgatgatctccgtactccgaaacagaggagatcggagatgggagatcataacctggcggcagcgcaaaagatg

SEQ ID NO: 66553 - DNA, 103 bp, Artificial Sequence
  Synthetic Polynucleotide
taatacgactcactatagggatcggatgatgaacttgatgatctccgtacaacagaggagagtacggatgtcatcaagtaacctggcggcagcgcaaaagatg

SEQ ID NO: 66554 - DNA, 103 bp, Artificial Sequence
  Synthetic Polynucleotide
taatacgactcactatagggataatatcggatgatgaacttgatgatctcaacagaggagagagatcatgaagttcatcaacctggcggcagcgcaaaagatg

SEQ ID NO: 66555 - DNA, 103 bp, Artificial Sequence
  Synthetic Polynucleotide
taatacgactcactatagggttacaataatatcggatgatgaacttgatgaacagaggagacatcaaatgcatcatccgaacctggcggcagcgcaaaagatg

SEQ ID NO: 66556 - DNA, 103 bp, Artificial Sequence
  Synthetic Polynucleotide
taatacgactcactatagggtgtggttacaataatatcggatgatgaactaacagaggagaagttcaatgtccgatattaacctggcggcagcgcaaaagatg

SEQ ID NO: 66557 - DNA, 103 bp, Artificial Sequence
  Synthetic Polynucleotide
taatacgactcactatagggtgcattgtggttacaataatatcggatgataacagaggagaatcatcatgtattattgtaacctggcggcagcgcaaaagatg

SEQ ID NO: 66558 - DNA, 103 bp, Artificial Sequence
  Synthetic Polynucleotide
taatacgactcactataggggccaatgcattgtggttacaataatatcggaacagaggagaccgataatgttgtaaccaaacctggcggcagcgcaaaagatg

SEQ ID NO: 66559 - DNA, 103 bp, Artificial Sequence
  Synthetic Polynucleotide
taatacgactcactatagggagcaatatgattctaccgattttaagatggaacagaggagaccatctatgaatcggtagaacctggcggcagcgcaaaagatg

SEQ ID NO: 66560 - DNA, 103 bp, Artificial Sequence
  Synthetic Polynucleotide
taatacgactcactatagggttgatgccaatgcattgtggttacaataataacagaggagaattattatgaccacaatgaacctggcggcagcgcaaaagatg

SEQ ID NO: 66561 - DNA, 103 bp, Artificial Sequence
  Synthetic Polynucleotide
taatacgactcactatagggttcttttgatgccaatgcattgtggttacaaacagaggagatgtaacatgaatgcattgaacctggcggcagcgcaaaagatg

SEQ ID NO: 66562 - DNA, 103 bp, Artificial Sequence
  Synthetic Polynucleotide
taatacgactcactatagggctatcttcttttgatgccaatgcattgtggaacagaggagaccacaaatgattggcatcaacctggcggcagcgcaaaagatg

SEQ ID NO: 66563 - DNA, 103 bp, Artificial Sequence
  Synthetic Polynucleotide
taatacgactcactatagggttcatctatcttcttttgatgccaatgcataacagaggagaatgcatatgcatcaaaagaacctggcggcagcgcaaaagatg

SEQ ID NO: 66564 - DNA, 103 bp, Artificial Sequence
  Synthetic Polynucleotide
taatacgactcactataggggtcagttcatctatcttcttttgatgccaaaacagaggagattggcaatgaaagaagataacctggcggcagcgcaaaagatg

SEQ ID NO: 66565 - DNA, 103 bp, Artificial Sequence
  Synthetic Polynucleotide
taatacgactcactatagggtatatgtcagttcatctatcttcttttgataacagaggagaatcaaaatgagatagatgaacctggcggcagcgcaaaagatg

SEQ ID NO: 66566 - DNA, 103 bp, Artificial Sequence
  Synthetic Polynucleotide
taatacgactcactatagggttcgctatatgtcagttcatctatcttcttaacagaggagaaagaagatggatgaactgaacctggcggcagcgcaaaagatg

SEQ ID NO: 66567 - DNA, 103 bp, Artificial Sequence
  Synthetic Polynucleotide
taatacgactcactatagggttatattcgctatatgtcagttcatctatcaacagaggagagatagaatgactgacataaacctggcggcagcgcaaaagatg

SEQ ID NO: 66568 - DNA, 103 bp, Artificial Sequence
  Synthetic Polynucleotide
taatacgactcactatagggtctccttatattcgctatatgtcagttcataacagaggagaatgaacatgcatatagcgaacctggcggcagcgcaaaagatg

SEQ ID NO: 66569 - DNA, 103 bp, Artificial Sequence
  Synthetic Polynucleotide
taatacgactcactatagggttggatctccttatattcgctatatgtcagaacagaggagactgacaatgagcgaatataacctggcggcagcgcaaaagatg

SEQ ID NO: 66570 - DNA, 103 bp, Artificial Sequence
  Synthetic Polynucleotide
taatacgactcactatagggaagggagtagaatatgggtgtaaattacaaaacagaggagattgtaaatgacacccataaacctggcggcagcgcaaaagatg

SEQ ID NO: 66571 - DNA, 103 bp, Artificial Sequence
  Synthetic Polynucleotide
taatacgactcactatagggaggaaagcaatatgattctaccgattttaaaacagaggagattaaaaatggtagaatcaaacctggcggcagcgcaaaagatg

SEQ ID NO: 66572 - DNA, 103 bp, Artificial Sequence
  Synthetic Polynucleotide
taatacgactcactatagggtagtgttggatctccttatattcgctatataacagaggagaatatagatgatataaggaaacctggcggcagcgcaaaagatg

SEQ ID NO: 66573 - DNA, 103 bp, Artificial Sequence
  Synthetic Polynucleotide
taatacgactcactatagggcctaatagtgttggatctccttatattcgcaacagaggagagcgaatatgaggagatccaacctggcggcagcgcaaaagatg

SEQ ID NO: 66574 - DNA, 103 bp, Artificial Sequence
  Synthetic Polynucleotide
taatacgactcactatagggtttctcctaatagtgttggatctccttataaacagaggagatataagatgatccaacacaacctggcggcagcgcaaaagatg

SEQ ID NO: 66575 - DNA, 103 bp, Artificial Sequence
  Synthetic Polynucleotide
taatacgactcactatagggcctgctttctcctaatagtgttggatctccaacagaggagaggagatatgacactattaaacctggcggcagcgcaaaagatg

SEQ ID NO: 66576 - DNA, 103 bp, Artificial Sequence
  Synthetic Polynucleotide
taatacgactcactatagggtatgacctgctttctcctaatagtgttggaaacagaggagatccaacatgattaggagaaacctggcggcagcgcaaaagatg

SEQ ID NO: 66577 - DNA, 103 bp, Artificial Sequence
  Synthetic Polynucleotide
taatacgactcactatagggttccatatgacctgctttctcctaatagtgaacagaggagacactatatggagaaagcaaacctggcggcagcgcaaaagatg

SEQ ID NO: 66578 - DNA, 103 bp, Artificial Sequence
  Synthetic Polynucleotide
taatacgactcactatagggacatcttccatatgacctgctttctcctaaaacagaggagattaggaatgagcaggtcaaacctggcggcagcgcaaaagatg

SEQ ID NO: 66579 - DNA, 103 bp, Artificial Sequence
  Synthetic Polynucleotide
taatacgactcactatagggcttgaacatcttccatatgacctgctttctaacagaggagaagaaagatggtcatatggaacctggcggcagcgcaaaagatg

SEQ ID NO: 66580 - DNA, 103 bp, Artificial Sequence
  Synthetic Polynucleotide
taatacgactcactatagggaacagcttgaacatcttccatatgacctgcaacagaggagagcaggtatgatggaagataacctggcggcagcgcaaaagatg

SEQ ID NO: 66581 - DNA, 103 bp, Artificial Sequence
  Synthetic Polynucleotide
taatacgactcactatagggatattaacagcttgaacatcttccatatgaaacagaggagatcatatatgagatgttcaaacctggcggcagcgcaaaagatg

SEQ ID NO: 66582 - DNA, 103 bp, Artificial Sequence
  Synthetic Polynucleotide
taatacgactcactataggggataaaggaaagcaatatgattctaccgataacagaggagaatcggtatgatcatattgaacctggcggcagcgcaaaagatg

SEQ ID NO: 66583 - DNA, 103 bp, Artificial Sequence
  Synthetic Polynucleotide
taatacgactcactataggggattgatattaacagcttgaacatcttccaaacagaggagatggaagatgttcaagctgaacctggcggcagcgcaaaagatg

SEQ ID NO: 66584 - DNA, 103 bp, Artificial Sequence
  Synthetic Polynucleotide
taatacgactcactatagggatcgagattgatattaacagcttgaacatcaacagaggagagatgttatggctgttaataacctggcggcagcgcaaaagatg

SEQ ID NO: 66585 - DNA, 103 bp, Artificial Sequence
  Synthetic Polynucleotide
taatacgactcactatagggcgtttatcgagattgatattaacagcttgaaacagaggagatcaagcatgtaatatcaaaacctggcggcagcgcaaaagatg

SEQ ID NO: 66586 - DNA, 103 bp, Artificial Sequence
  Synthetic Polynucleotide
taatacgactcactataggggttcacgtttatcgagattgatattaacagaacagaggagactgttaatgtcaatctcgaacctggcggcagcgcaaaagatg

SEQ ID NO: 66587 - DNA, 103 bp, Artificial Sequence
  Synthetic Polynucleotide
taatacgactcactatagggagcctgttcacgtttatcgagattgatattaacagaggagaaatatcatgctcgataaaaacctggcggcagcgcaaaagatg

SEQ ID NO: 66588 - DNA, 103 bp, Artificial Sequence
  Synthetic Polynucleotide
taatacgactcactatagggccgacagcctgttcacgtttatcgagattgaacagaggagacaatctatgtaaacgtgaaacctggcggcagcgcaaaagatg

SEQ ID NO: 66589 - DNA, 103 bp, Artificial Sequence
  Synthetic Polynucleotide
taatacgactcactatagggtggctccgacagcctgttcacgtttatcgaaacagaggagatcgataatggtgaacaggaacctggcggcagcgcaaaagatg

SEQ ID NO: 66590 - DNA, 103 bp, Artificial Sequence
  Synthetic Polynucleotide
taatacgactcactatagggaactgtggctccgacagcctgttcacgtttaacagaggagaaaacgtatgcaggctgtcaacctggcggcagcgcaaaagatg

SEQ ID NO: 66591 - DNA, 103 bp, Artificial Sequence
  Synthetic Polynucleotide
taatacgactcactatagggctcgaaactgtggctccgacagcctgttcaaacagaggagatgaacaatgtgtcggagcaacctggcggcagcgcaaaagatg

SEQ ID NO: 66592 - DNA, 103 bp, Artificial Sequence
  Synthetic Polynucleotide
taatacgactcactatagggctcgtctcgaaactgtggctccgacagcctaacagaggagaaggctgatggagccacagaacctggcggcagcgcaaaagatg

SEQ ID NO: 66593 - DNA, 103 bp, Artificial Sequence
  Synthetic Polynucleotide
taatacgactcactatagggttaatgataaaggaaagcaatatgattctaaacagaggagatagaatatgattgctttcaacctggcggcagcgcaaaagatg

SEQ ID NO: 66594 - DNA, 103 bp, Artificial Sequence
  Synthetic Polynucleotide
taatacgactcactatagggatctcctcgtctcgaaactgtggctccgacaacagaggagagtcggaatgacagtttcgaacctggcggcagcgcaaaagatg

SEQ ID NO: 66595 - DNA, 103 bp, Artificial Sequence
  Synthetic Polynucleotide
taatacgactcactatagggtctaaatctcctcgtctcgaaactgtggctaacagaggagaagccacatgttcgagacgaacctggcggcagcgcaaaagatg

SEQ ID NO: 66596 - DNA, 103 bp, Artificial Sequence
  Synthetic Polynucleotide
taatacgactcactatagggacatttctaaatctcctcgtctcgaaactgaacagaggagacagtttatggacgaggagaacctggcggcagcgcaaaagatg

SEQ ID NO: 66597 - DNA, 103 bp, Artificial Sequence
  Synthetic Polynucleotide
taatacgactcactatagggtcccaacatttctaaatctcctcgtctcgaaacagaggagatcgagaatgggagatttaaacctggcggcagcgcaaaagatg

SEQ ID NO: 66598 - DNA, 103 bp, Artificial Sequence
  Synthetic Polynucleotide
taatacgactcactatagggaataatcccaacatttctaaatctcctcgtaacagaggagaacgaggatgtttagaaataacctggcggcagcgcaaaagatg

SEQ ID NO: 66599 - DNA, 103 bp, Artificial Sequence
  Synthetic Polynucleotide
taatacgactcactatagggcatgcaataatcccaacatttctaaatctcaacagaggagagagattatgaaatgttggaacctggcggcagcgcaaaagatg

SEQ ID NO: 66600 - DNA, 103 bp, Artificial Sequence
  Synthetic Polynucleotide
taatacgactcactatagggtctatcatgcaataatcccaacatttctaaaacagaggagattagaaatgttgggattaaacctggcggcagcgcaaaagatg

SEQ ID NO: 66601 - DNA, 103 bp, Artificial Sequence
  Synthetic Polynucleotide
taatacgactcactatagggaccattctatcatgcaataatcccaacattaacagaggagaaatgttatgattattgcaaacctggcggcagcgcaaaagatg

SEQ ID NO: 66602 - DNA, 103 bp, Artificial Sequence
  Synthetic Polynucleotide
taatacgactcactatagggactgaaccattctatcatgcaataatcccaaacagaggagatgggatatgtgcatgataaacctggcggcagcgcaaaagatg

SEQ ID NO: 66603 - DNA, 103 bp, Artificial Sequence
  Synthetic Polynucleotide
taatacgactcactatagggttgccactgaaccattctatcatgcaataaaacagaggagattattgatggatagaatgaacctggcggcagcgcaaaagatg

SEQ ID NO: 66604 - DNA, 103 bp, Artificial Sequence
  Synthetic Polynucleotide
taatacgactcactatagggaattattaatgataaaggaaagcaatatgaaacagaggagatcatatatgtttcctttaaacctggcggcagcgcaaaagatg

SEQ ID NO: 66605 - DNA, 103 bp, Artificial Sequence
  Synthetic Polynucleotide
taatacgactcactataggggaagtttgccactgaaccattctatcatgcaacagaggagagcatgaatgaatggttcaaacctggcggcagcgcaaaagatg

SEQ ID NO: 66606 - DNA, 103 bp, Artificial Sequence
  Synthetic Polynucleotide
taatacgactcactatagggccatggaagtttgccactgaaccattctataacagaggagaatagaaatgttcagtggcaacctggcggcagcgcaaaagatg

SEQ ID NO: 66607 - DNA, 103 bp, Artificial Sequence
  Synthetic Polynucleotide
taatacgactcactatagggtttttccatggaagtttgccactgaaccataacagaggagaatggttatgtggcaaactaacctggcggcagcgcaaaagatg

SEQ ID NO: 66608 - DNA, 103 bp, Artificial Sequence
  Synthetic Polynucleotide
taatacgactcactatagggttttgtttttccatggaagtttgccactgaaacagaggagatcagtgatgaacttccataacctggcggcagcgcaaaagatg

SEQ ID NO: 66609 - DNA, 103 bp, Artificial Sequence
  Synthetic Polynucleotide
taatacgactcactatagggactacttttgtttttccatggaagtttgccaacagaggagaggcaaaatgccatggaaaaacctggcggcagcgcaaaagatg

SEQ ID NO: 66610 - DNA, 103 bp, Artificial Sequence
  Synthetic Polynucleotide
taatacgactcactataggggctatactacttttgtttttccatggaagtaacagaggagaacttccatggaaaaacaaaacctggcggcagcgcaaaagatg

SEQ ID NO: 66611 - DNA, 103 bp, Artificial Sequence
  Synthetic Polynucleotide
taatacgactcactataggggtattgctatactacttttgtttttccatgaacagaggagacatggaatgacaaaagtaaacctggcggcagcgcaaaagatg

SEQ ID NO: 66612 - DNA, 103 bp, Artificial Sequence
  Synthetic Polynucleotide
taatacgactcactatagggctgttgtattgctatactacttttgtttttaacagaggagaaaaaacatgagtagtataaacctggcggcagcgcaaaagatg

SEQ ID NO: 66613 - DNA, 103 bp, Artificial Sequence
  Synthetic Polynucleotide
taatacgactcactatagggcttttctgttgtattgctatactacttttgaacagaggagacaaaagatgtatagcaataacctggcggcagcgcaaaagatg

SEQ ID NO: 66614 - DNA, 103 bp, Artificial Sequence
  Synthetic Polynucleotide
taatacgactcactatagggattctcttttctgttgtattgctatactacaacagaggagagtagtaatgcaatacaacaacctggcggcagcgcaaaagatg

SEQ ID NO: 66615 - DNA, 103 bp, Artificial Sequence
  Synthetic Polynucleotide
taatacgactcactatagggctagaaattattaatgataaaggaaagcaaaacagaggagattgcttatgtttatcattaacctggcggcagcgcaaaagatg

SEQ ID NO: 66616 - DNA, 103 bp, Artificial Sequence
  Synthetic Polynucleotide
taatacgactcactatagggtttatattctcttttctgttgtattgctataacagaggagaatagcaatgcaacagaaaaacctggcggcagcgcaaaagatg

SEQ ID NO: 66617 - DNA, 103 bp, Artificial Sequence
  Synthetic Polynucleotide
taatacgactcactatagggaattttttatattctcttttctgttgtattaacagaggagaaatacaatggaaaagagaaacctggcggcagcgcaaaagatg

SEQ ID NO: 66618 - DNA, 103 bp, Artificial Sequence
  Synthetic Polynucleotide
taatacgactcactatagggctataaattttttatattctcttttctgttaacagaggagaaacagaatggagaatataaacctggcggcagcgcaaaagatg

SEQ ID NO: 66619 - DNA, 103 bp, Artificial Sequence
  Synthetic Polynucleotide
taatacgactcactatagggagtagctataaattttttatattctcttttaacagaggagaaaaagaatgtataaaaaaaacctggcggcagcgcaaaagatg

SEQ ID NO: 66620 - DNA, 103 bp, Artificial Sequence
  Synthetic Polynucleotide
taatacgactcactatagggaagaaagtagctataaattttttatattctaacagaggagaagaataatgaaaatttataacctggcggcagcgcaaaagatg

SEQ ID NO: 66621 - DNA, 103 bp, Artificial Sequence
  Synthetic Polynucleotide
taatacgactcactatagggcctcaaagaaagtagctataaattttttataacagaggagaataaaaatgttatagctaaacctggcggcagcgcaaaagatg

SEQ ID NO: 66622 - DNA, 103 bp, Artificial Sequence
  Synthetic Polynucleotide
taatacgactcactatagggacagtcctcaaagaaagtagctataaatttaacagaggagaaaatttatggctactttcaacctggcggcagcgcaaaagatg

SEQ ID NO: 66623 - DNA, 103 bp, Artificial Sequence
  Synthetic Polynucleotide
taatacgactcactatagggggaaaacagtcctcaaagaaagtagctataaacagaggagatatagcatgtttctttgaaacctggcggcagcgcaaaagatg

SEQ ID NO: 66624 - DNA, 103 bp, Artificial Sequence
  Synthetic Polynucleotide
taatacgactcactatagggcttccggaaaacagtcctcaaagaaagtagaacagaggagactacttatgttgaggactaacctggcggcagcgcaaaagatg

SEQ ID NO: 66625 - DNA, 103 bp, Artificial Sequence
  Synthetic Polynucleotide
taatacgactcactatagggatttccttccggaaaacagtcctcaaagaaaacagaggagattctttatggactgttttaacctggcggcagcgcaaaagatg

SEQ ID NO: 66626 - DNA, 103 bp, Artificial Sequence
  Synthetic Polynucleotide
taatacgactcactatagggatattctagaaattattaatgataaaggaaaacagaggagattccttatgcattaataaaacctggcggcagcgcaaaagatg

SEQ ID NO: 66627 - DNA, 103 bp, Artificial Sequence
  Synthetic Polynucleotide
taatacgactcactatagggggtttatttccttccggaaaacagtcctcaaacagaggagatgaggaatgttttccggaaacctggcggcagcgcaaaagatg

SEQ ID NO: 66628 - DNA, 103 bp, Artificial Sequence
  Synthetic Polynucleotide
taatacgactcactatagggccaaaggtttatttccttccggaaaacagtaacagaggagaactgttatgcggaaggaaaacctggcggcagcgcaaaagatg

SEQ ID NO: 66629 - DNA, 103 bp, Artificial Sequence
  Synthetic Polynucleotide
taatacgactcactatagggtaattccaaaggtttatttccttccggaaaaacagaggagatttccgatgggaaataaaaacctggcggcagcgcaaaagatg

SEQ ID NO: 66630 - DNA, 103 bp, Artificial Sequence
  Synthetic Polynucleotide
taatacgactcactatagggtatactaattccaaaggtttatttccttccaacagaggagaggaaggatgtaaacctttaacctggcggcagcgcaaaagatg

SEQ ID NO: 66631 - DNA, 103 bp, Artificial Sequence
  Synthetic Polynucleotide
taatacgactcactatagggacgtgtatactaattccaaaggtttatttcaacagaggagagaaataatgctttggaataacctggcggcagcgcaaaagatg

SEQ ID NO: 66632 - DNA, 103 bp, Artificial Sequence
  Synthetic Polynucleotide
taatacgactcactatagggatctaacgtgtatactaattccaaaggtttaacagaggagaaaacctatggaattagtaaacctggcggcagcgcaaaagatg

SEQ ID NO: 66633 - DNA, 103 bp, Artificial Sequence
  Synthetic Polynucleotide
taatacgactcactataggggaataatctaacgtgtatactaattccaaaaacagaggagatttggaatgagtatacacaacctggcggcagcgcaaaagatg

SEQ ID NO: 66634 - DNA, 103 bp, Artificial Sequence
  Synthetic Polynucleotide
taatacgactcactatagggtttgagaataatctaacgtgtatactaattaacagaggagaaattagatgacacgttagaacctggcggcagcgcaaaagatg

SEQ ID NO: 66635 - DNA, 103 bp, Artificial Sequence
  Synthetic Polynucleotide
taatacgactcactatagggaggagtttgagaataatctaacgtgtatacaacagaggagagtatacatgttagattataacctggcggcagcgcaaaagatg

SEQ ID NO: 66636 - DNA, 103 bp, Artificial Sequence
  Synthetic Polynucleotide
taatacgactcactatagggtaattaggagtttgagaataatctaacgtgaacagaggagacacgttatgttattctcaaacctggcggcagcgcaaaagatg

SEQ ID NO: 66637 - DNA, 103 bp, Artificial Sequence
  Synthetic Polynucleotide
taatacgactcactatagggagatgatattctagaaattattaatgataaaacagaggagattatcaatgataatttctaacctggcggcagcgcaaaagatg

SEQ ID NO: 66638 - DNA, 103 bp, Artificial Sequence
  Synthetic Polynucleotide
taatacgactcactatagggtttcataattaggagtttgagaataatctaaacagaggagatagattatgctcaaactcaacctggcggcagcgcaaaagatg

SEQ ID NO: 66639 - DNA, 103 bp, Artificial Sequence
  Synthetic Polynucleotide
taatacgactcactatagggtagtctttcataattaggagtttgagaataaacagaggagatattctatgactcctaataacctggcggcagcgcaaaagatg

SEQ ID NO: 66640 - DNA, 103 bp, Artificial Sequence
  Synthetic Polynucleotide
taatacgactcactatagggctacgtagtctttcataattaggagtttgaaacagaggagatcaaacatgtaattatgaaacctggcggcagcgcaaaagatg

SEQ ID NO: 66641 - DNA, 103 bp, Artificial Sequence
  Synthetic Polynucleotide
taatacgactcactatagggctagtctacgtagtctttcataattaggagaacagaggagactcctaatgatgaaagacaacctggcggcagcgcaaaagatg

SEQ ID NO: 66642 - DNA, 103 bp, Artificial Sequence
  Synthetic Polynucleotide
taatacgactcactatagggacagtctagtctacgtagtctttcataattaacagaggagaaattatatgagactacgtaacctggcggcagcgcaaaagatg

SEQ ID NO: 66643 - DNA, 103 bp, Artificial Sequence
  Synthetic Polynucleotide
taatacgactcactatagggtataaacagtctagtctacgtagtctttcaaacagaggagatgaaagatgacgtagactaacctggcggcagcgcaaaagatg

SEQ ID NO: 66644 - DNA, 103 bp, Artificial Sequence
  Synthetic Polynucleotide
taatacgactcactatagggtcttgtataaacagtctagtctacgtagtcaacagaggagagactacatggactagactaacctggcggcagcgcaaaagatg

SEQ ID NO: 66645 - DNA, 103 bp, Artificial Sequence
  Synthetic Polynucleotide
taatacgactcactatagggttcaatcttgtataaacagtctagtctacgaacagaggagacgtagaatggactgtttaaacctggcggcagcgcaaaagatg

SEQ ID NO: 66646 - DNA, 103 bp, Artificial Sequence
  Synthetic Polynucleotide
taatacgactcactatagggataatttcaatcttgtataaacagtctagtaacagaggagaactagaatgtttatacaaaacctggcggcagcgcaaaagatg

SEQ ID NO: 66647 - DNA, 103 bp, Artificial Sequence
  Synthetic Polynucleotide
taatacgactcactatagggagaatataatttcaatcttgtataaacagtaacagaggagaactgttatgacaagattgaacctggcggcagcgcaaaagatg

SEQ ID NO: 66648 - DNA, 103 bp, Artificial Sequence
  Synthetic Polynucleotide
taatacgactcactataggggatagagatgatattctagaaattattaataacagaggagaattaatatgttctagaataacctggcggcagcgcaaaagatg

SEQ ID NO: 66649 - DNA, 103 bp, Artificial Sequence
  Synthetic Polynucleotide
taatacgactcactatagggaaaaaagaatataatttcaatcttgtataaaacagaggagattatacatgattgaaattaacctggcggcagcgcaaaagatg

SEQ ID NO: 66650 - DNA, 103 bp, Artificial Sequence
  Synthetic Polynucleotide
taatacgactcactatagggtctataaaaaagaatataatttcaatcttgaacagaggagacaagatatgaattatattaacctggcggcagcgcaaaagatg

SEQ ID NO: 66651 - DNA, 103 bp, Artificial Sequence
  Synthetic Polynucleotide
taatacgactcactatagggcacgctctataaaaaagaatataatttcaaaacagaggagattgaaaatgtattcttttaacctggcggcagcgcaaaagatg

SEQ ID NO: 66652 - DNA, 103 bp, Artificial Sequence
  Synthetic Polynucleotide
taatacgactcactatagggcatcacacgctctataaaaaagaatataataacagaggagaattataatgttttttataaacctggcggcagcgcaaaagatg

SEQ ID NO: 66653 - DNA, 103 bp, Artificial Sequence
  Synthetic Polynucleotide
taatacgactcactatagggcgtaacatcacacgctctataaaaaagaataacagaggagaattcttatgtatagagcgaacctggcggcagcgcaaaagatg

SEQ ID NO: 66654 - DNA, 103 bp, Artificial Sequence
  Synthetic Polynucleotide
taatacgactcactatagggatatccgtaacatcacacgctctataaaaaaacagaggagatttttaatgagcgtgtgaaacctggcggcagcgcaaaagatg

SEQ ID NO: 66655 - DNA, 103 bp, Artificial Sequence
  Synthetic Polynucleotide
taatacgactcactatagggattagatatccgtaacatcacacgctctataacagaggagaatagagatggtgatgttaaacctggcggcagcgcaaaagatg

SEQ ID NO: 66656 - DNA, 103 bp, Artificial Sequence
  Synthetic Polynucleotide
taatacgactcactatagggatattattagatatccgtaacatcacacgcaacagaggagagcgtgtatggttacggataacctggcggcagcgcaaaagatg

SEQ ID NO: 66657 - DNA, 103 bp, Artificial Sequence
  Synthetic Polynucleotide
taatacgactcactataggggtctaatattattagatatccgtaacatcaaacagaggagatgatgtatgggatatctaaacctggcggcagcgcaaaagatg

SEQ ID NO: 66658 - DNA, 103 bp, Artificial Sequence
  Synthetic Polynucleotide
taatacgactcactatagggagatagtctaatattattagatatccgtaaaacagaggagattacggatgtctaataataacctggcggcagcgcaaaagatg

SEQ ID NO: 66659 - DNA, 103 bp, Artificial Sequence
  Synthetic Polynucleotide
taatacgactcactatagggtttatgatagagatgatattctagaaattaaacagaggagataatttatggaatatcataacctggcggcagcgcaaaagatg

SEQ ID NO: 66660 - DNA, 103 bp, Artificial Sequence
  Synthetic Polynucleotide
taatacgactcactataggggtcagagatagtctaatattattagatatcaacagaggagagatatcatgtaatattagaacctggcggcagcgcaaaagatg

SEQ ID NO: 66661 - DNA, 103 bp, Artificial Sequence
  Synthetic Polynucleotide
taatacgactcactataggggtagtgtcagagatagtctaatattattagaacagaggagactaataatgttagactataacctggcggcagcgcaaaagatg

SEQ ID NO: 66662 - DNA, 103 bp, Artificial Sequence
  Synthetic Polynucleotide
taatacgactcactataggggtcgtgtagtgtcagagatagtctaatattaacagaggagaaatattatgctatctctgaacctggcggcagcgcaaaagatg

SEQ ID NO: 66663 - DNA, 103 bp, Artificial Sequence
  Synthetic Polynucleotide
taatacgactcactatagggatttggtcgtgtagtgtcagagatagtctaaacagaggagatagactatgtctgacactaacctggcggcagcgcaaaagatg

SEQ ID NO: 66664 - DNA, 103 bp, Artificial Sequence
  Synthetic Polynucleotide
taatacgactcactatagggaatcgatttggtcgtgtagtgtcagagataaacagaggagatatctcatgcactacacgaacctggcggcagcgcaaaagatg

SEQ ID NO: 66665 - DNA, 103 bp, Artificial Sequence
  Synthetic Polynucleotide
taatacgactcactatagggatagtaatcgatttggtcgtgtagtgtcagaacagaggagactgacaatgcacgaccaaaacctggcggcagcgcaaaagatg

SEQ ID NO: 66666 - DNA, 103 bp, Artificial Sequence
  Synthetic Polynucleotide
taatacgactcactatagggtatccatagtaatcgatttggtcgtgtagtaacagaggagaactacaatgccaaatcgaaacctggcggcagcgcaaaagatg

SEQ ID NO: 66667 - DNA, 103 bp, Artificial Sequence
  Synthetic Polynucleotide
taatacgactcactataggggaagatatccatagtaatcgatttggtcgtaacagaggagaacgaccatgtcgattactaacctggcggcagcgcaaaagatg

SEQ ID NO: 66668 - DNA, 103 bp, Artificial Sequence
  Synthetic Polynucleotide
taatacgactcactatagggtccctgaagatatccatagtaatcgatttgaacagaggagacaaatcatgtactatggaaacctggcggcagcgcaaaagatg

SEQ ID NO: 66669 - DNA, 103 bp, Artificial Sequence
  Synthetic Polynucleotide
taatacgactcactatagggcgatttccctgaagatatccatagtaatcgaacagaggagacgattaatgtggatatctaacctggcggcagcgcaaaagatg

SEQ ID NO: 66670 - DNA, 103 bp, Artificial Sequence
  Synthetic Polynucleotide
taatacgactcactatagggtatcttttatgatagagatgatattctagaaacagaggagatctagaatgtcatctctaaacctggcggcagcgcaaaagatg

SEQ ID NO: 66671 - DNA, 103 bp, Artificial Sequence
  Synthetic Polynucleotide
taatacgactcactatagggagatgcgatttccctgaagatatccatagtaacagaggagaactatgatgatcttcaggaacctggcggcagcgcaaaagatg

SEQ ID NO: 66672 - DNA, 103 bp, Artificial Sequence
  Synthetic Polynucleotide
taatacgactcactataggggtagaagatgcgatttccctgaagatatccaacagaggagaggatatatgcagggaaataacctggcggcagcgcaaaagatg

SEQ ID NO: 66673 - DNA, 103 bp, Artificial Sequence
  Synthetic Polynucleotide
taatacgactcactatagggctttcgtagaagatgcgatttccctgaagaaacagaggagatcttcaatgaaatcgcataacctggcggcagcgcaaaagatg

SEQ ID NO: 66674 - DNA, 103 bp, Artificial Sequence
  Synthetic Polynucleotide
taatacgactcactatagggctctcctttcgtagaagatgcgatttccctaacagaggagaagggaaatggcatcttctaacctggcggcagcgcaaaagatg

SEQ ID NO: 66675 - DNA, 103 bp, Artificial Sequence
  Synthetic Polynucleotide
taatacgactcactatagggacattctctcctttcgtagaagatgcgattaacagaggagaaatcgcatgttctacgaaaacctggcggcagcgcaaaagatg

SEQ ID NO: 66676 - DNA, 103 bp, Artificial Sequence
  Synthetic Polynucleotide
taatacgactcactatagggtgaatacattctctcctttcgtagaagatgaacagaggagacatcttatgcgaaaggagaacctggcggcagcgcaaaagatg

SEQ ID NO: 66677 - DNA, 103 bp, Artificial Sequence
  Synthetic Polynucleotide
taatacgactcactatagggagaaatgaatacattctctcctttcgtagaaacagaggagatctacgatgggagagaataacctggcggcagcgcaaaagatg

SEQ ID NO: 66678 - DNA, 103 bp, Artificial Sequence
  Synthetic Polynucleotide
taatacgactcactataggggctggagaaatgaatacattctctcctttcaacagaggagagaaaggatggaatgtattaacctggcggcagcgcaaaagatg

SEQ ID NO: 66679 - DNA, 103 bp, Artificial Sequence
  Synthetic Polynucleotide
taatacgactcactatagggttgtcgctggagaaatgaatacattctctcaacagaggagagagagaatgtattcatttaacctggcggcagcgcaaaagatg

SEQ ID NO: 66680 - DNA, 103 bp, Artificial Sequence
  Synthetic Polynucleotide
taatacgactcactatagggcgagattgtcgctggagaaatgaatacattaacagaggagaaatgtaatgatttctccaaacctggcggcagcgcaaaagatg

SEQ ID NO: 66681 - DNA, 103 bp, Artificial Sequence
  Synthetic Polynucleotide
taatacgactcactatagggtacacaagggagtagaatatgggtgtaaataacagaggagaatttacatgcatattctaaacctggcggcagcgcaaaagatg

SEQ ID NO: 66682 - DNA, 103 bp, Artificial Sequence
  Synthetic Polynucleotide
taatacgactcactatagggatttgtatcttttatgatagagatgatattaacagaggagaaatatcatgtctatcataaacctggcggcagcgcaaaagatg

SEQ ID NO: 66683 - DNA, 103 bp, Artificial Sequence
  Synthetic Polynucleotide
taatacgactcactatagggactgacgagattgtcgctggagaaatgaataacagaggagaattcatatgtccagcgacaacctggcggcagcgcaaaagatg

SEQ ID NO: 66684 - DNA, 103 bp, Artificial Sequence
  Synthetic Polynucleotide
taatacgactcactatagggtcaatactgacgagattgtcgctggagaaaaacagaggagatttctcatgcgacaatctaacctggcggcagcgcaaaagatg

SEQ ID NO: 66685 - DNA, 103 bp, Artificial Sequence
  Synthetic Polynucleotide
taatacgactcactatagggtattgtcaatactgacgagattgtcgctggaacagaggagaccagcgatgatctcgtcaaacctggcggcagcgcaaaagatg

SEQ ID NO: 66686 - DNA, 103 bp, Artificial Sequence
  Synthetic Polynucleotide
taatacgactcactatagggtacagtattgtcaatactgacgagattgtcaacagaggagagacaatatggtcagtattaacctggcggcagcgcaaaagatg

SEQ ID NO: 66687 - DNA, 103 bp, Artificial Sequence
  Synthetic Polynucleotide
taatacgactcactatagggcataatacagtattgtcaatactgacgagaaacagaggagatctcgtatgtattgacaaaacctggcggcagcgcaaaagatg

SEQ ID NO: 66688 - DNA, 103 bp, Artificial Sequence
  Synthetic Polynucleotide
taatacgactcactatagggagctccataatacagtattgtcaatactgaaacagaggagatcagtaatgacaatactgaacctggcggcagcgcaaaagatg

SEQ ID NO: 66689 - DNA, 103 bp, Artificial Sequence
  Synthetic Polynucleotide
taatacgactcactatagggccattagctccataatacagtattgtcaataacagaggagaattgacatgactgtattaaacctggcggcagcgcaaaagatg

SEQ ID NO: 66690 - DNA, 103 bp, Artificial Sequence
  Synthetic Polynucleotide
taatacgactcactatagggtggatccattagctccataatacagtattgaacagaggagacaatacatgattatggagaacctggcggcagcgcaaaagatg

SEQ ID NO: 66691 - DNA, 103 bp, Artificial Sequence
  Synthetic Polynucleotide
taatacgactcactatagggagcagtggatccattagctccataatacagaacagaggagactgtatatgggagctaataacctggcggcagcgcaaaagatg

SEQ ID NO: 66692 - DNA, 103 bp, Artificial Sequence
  Synthetic Polynucleotide
taatacgactcactatagggtgttcagcagtggatccattagctccataaaacagaggagattatggatgtaatggatcaacctggcggcagcgcaaaagatg

SEQ ID NO: 66693 - DNA, 103 bp, Artificial Sequence
  Synthetic Polynucleotide
taatacgactcactatagggttaatatttgtatcttttatgatagagatgaacagaggagacatctcatgcataaaagaaacctggcggcagcgcaaaagatg

SEQ ID NO: 66694 - DNA, 103 bp, Artificial Sequence
  Synthetic Polynucleotide
taatacgactcactatagggataactgttcagcagtggatccattagctcaacagaggagagagctaatggatccactgaacctggcggcagcgcaaaagatg

SEQ ID NO: 66695 - DNA, 103 bp, Artificial Sequence
  Synthetic Polynucleotide
taatacgactcactatagggttttgataactgttcagcagtggatccattaacagaggagaaatggaatgactgctgaaaacctggcggcagcgcaaaagatg

SEQ ID NO: 66696 - DNA, 103 bp, Artificial Sequence
  Synthetic Polynucleotide
taatacgactcactatagggacatattttgataactgttcagcagtggataacagaggagaatccacatgtgaacagttaacctggcggcagcgcaaaagatg

SEQ ID NO: 66697 - DNA, 103 bp, Artificial Sequence
  Synthetic Polynucleotide
taatacgactcactatagggtttctacatattttgataactgttcagcagaacagaggagactgctgatgagttatcaaaacctggcggcagcgcaaaagatg

SEQ ID NO: 66698 - DNA, 103 bp, Artificial Sequence
  Synthetic Polynucleotide
taatacgactcactatagggctccttttctacatattttgataactgttcaacagaggagagaacagatgtcaaaatataacctggcggcagcgcaaaagatg

SEQ ID NO: 66699 - DNA, 103 bp, Artificial Sequence
  Synthetic Polynucleotide
taatacgactcactataggggtctcctccttttctacatattttgataacaacagaggagagttatcatgatatgtagaaacctggcggcagcgcaaaagatg

SEQ ID NO: 66700 - DNA, 103 bp, Artificial Sequence
  Synthetic Polynucleotide
taatacgactcactatagggccatggtctcctccttttctacatattttgaacagaggagacaaaatatgtagaaaaggaacctggcggcagcgcaaaagatg

SEQ ID NO: 66701 - DNA, 103 bp, Artificial Sequence
  Synthetic Polynucleotide
taatacgactcactatagggtttatccatggtctcctccttttctacataaacagaggagatatgtaatgaaggaggagaacctggcggcagcgcaaaagatg

SEQ ID NO: 66702 - DNA, 103 bp, Artificial Sequence
  Synthetic Polynucleotide
taatacgactcactatagggctaactttatccatggtctcctccttttctaacagaggagaagaaaaatgggagaccataacctggcggcagcgcaaaagatg

SEQ ID NO: 66703 - DNA, 103 bp, Artificial Sequence
  Synthetic Polynucleotide
taatacgactcactataggggagcgctaactttatccatggtctcctcctaacagaggagaaggaggatgccatggataaacctggcggcagcgcaaaagatg

SEQ ID NO: 66704 - DNA, 103 bp, Artificial Sequence
  Synthetic Polynucleotide
taatacgactcactatagggaacagttaatatttgtatcttttatgatagaacagaggagactatcaatgaagatacaaaacctggcggcagcgcaaaagatg

SEQ ID NO: 66705 - DNA, 103 bp, Artificial Sequence
  Synthetic Polynucleotide
taatacgactcactatagggattctgagcgctaactttatccatggtctcaacagaggagagagaccatggataaagttaacctggcggcagcgcaaaagatg

SEQ ID NO: 66706 - DNA, 103 bp, Artificial Sequence
  Synthetic Polynucleotide
taatacgactcactataggggagatattctgagcgctaactttatccatgaacagaggagacatggaatgagttagcgcaacctggcggcagcgcaaaagatg

SEQ ID NO: 66707 - DNA, 103 bp, Artificial Sequence
  Synthetic Polynucleotide
taatacgactcactatagggtgaatgagatattctgagcgctaactttataacagaggagaataaagatggcgctcagaaacctggcggcagcgcaaaagatg

SEQ ID NO: 66708 - DNA, 103 bp, Artificial Sequence
  Synthetic Polynucleotide
taatacgactcactatagggggatttgaatgagatattctgagcgctaacaacagaggagagttagcatgcagaatatcaacctggcggcagcgcaaaagatg

SEQ ID NO: 66709 - DNA, 103 bp, Artificial Sequence
  Synthetic Polynucleotide
taatacgactcactatagggttcatggatttgaatgagatattctgagcgaacagaggagacgctcaatgtatctcattaacctggcggcagcgcaaaagatg

SEQ ID NO: 66710 - DNA, 103 bp, Artificial Sequence
  Synthetic Polynucleotide
taatacgactcactatagggctttattcatggatttgaatgagatattctaacagaggagaagaataatgcattcaaataacctggcggcagcgcaaaagatg

SEQ ID NO: 66711 - DNA, 103 bp, Artificial Sequence
  Synthetic Polynucleotide
taatacgactcactatagggatatactttattcatggatttgaatgagataacagaggagaatctcaatgaaatccatgaacctggcggcagcgcaaaagatg

SEQ ID NO: 66712 - DNA, 103 bp, Artificial Sequence
  Synthetic Polynucleotide
taatacgactcactatagggcgcccatatactttattcatggatttgaataacagaggagaattcaaatgcatgaataaaacctggcggcagcgcaaaagatg

SEQ ID NO: 66713 - DNA, 103 bp, Artificial Sequence
  Synthetic Polynucleotide
taatacgactcactatagggaatatcgcccatatactttattcatggattaacagaggagaaatccaatgataaagtataacctggcggcagcgcaaaagatg

SEQ ID NO: 66714 - DNA, 103 bp, Artificial Sequence
  Synthetic Polynucleotide
taatacgactcactatagggggcagaatatcgcccatatactttattcataacagaggagaatgaatatggtatatgggaacctggcggcagcgcaaaagatg

SEQ ID NO: 66715 - DNA, 103 bp, Artificial Sequence
  Synthetic Polynucleotide
taatacgactcactataggggatcaaacagttaatatttgtatcttttataacagaggagaataaaaatgacaaatattaacctggcggcagcgcaaaagatg

SEQ ID NO: 66716 - DNA, 103 bp, Artificial Sequence
  Synthetic Polynucleotide
taatacgactcactatagggaacacggcagaatatcgcccatatactttaaacagaggagataaagtatgtgggcgataaacctggcggcagcgcaaaagatg

SEQ ID NO: 66717 - DNA, 103 bp, Artificial Sequence
  Synthetic Polynucleotide
taatacgactcactatagggttttaaacacggcagaatatcgcccatataaacagaggagatatatgatggatattctgaacctggcggcagcgcaaaagatg

SEQ ID NO: 66718 - DNA, 103 bp, Artificial Sequence
  Synthetic Polynucleotide
taatacgactcactatagggggaatttttaaacacggcagaatatcgcccaacagaggagagggcgaatgtctgccgtgaacctggcggcagcgcaaaagatg

SEQ ID NO: 66719 - DNA, 103 bp, Artificial Sequence
  Synthetic Polynucleotide
taatacgactcactatagggaaaaaggaatttttaaacacggcagaatataacagaggagaatattcatgcgtgtttaaaacctggcggcagcgcaaaagatg

SEQ ID NO: 66720 - DNA, 103 bp, Artificial Sequence
  Synthetic Polynucleotide
taatacgactcactatagggttcccaaaaaggaatttttaaacacggcagaacagaggagactgccgatgttaaaaattaacctggcggcagcgcaaaagatg

SEQ ID NO: 66721 - DNA, 103 bp, Artificial Sequence
  Synthetic Polynucleotide
taatacgactcactatagggaatttttcccaaaaaggaatttttaaacacaacagaggagagtgtttatgaattcctttaacctggcggcagcgcaaaagatg

SEQ ID NO: 66722 - DNA, 103 bp, Artificial Sequence
  Synthetic Polynucleotide
taatacgactcactatagggtcgccaatttttcccaaaaaggaatttttaaacagaggagataaaaaatgctttttgggaacctggcggcagcgcaaaagatg

SEQ ID NO: 66723 - DNA, 103 bp, Artificial Sequence
  Synthetic Polynucleotide
taatacgactcactatagggaattatcgccaatttttcccaaaaaggaataacagaggagaattcctatgtgggaaaaaaacctggcggcagcgcaaaagatg

SEQ ID NO: 66724 - DNA, 103 bp, Artificial Sequence
  Synthetic Polynucleotide
taatacgactcactatagggttggaaattatcgccaatttttcccaaaaaaacagaggagatttttgatgaaaattggcaacctggcggcagcgcaaaagatg

SEQ ID NO: 66725 - DNA, 103 bp, Artificial Sequence
  Synthetic Polynucleotide
taatacgactcactatagggacagtttggaaattatcgccaatttttcccaacagaggagagggaaaatgtggcgataaaacctggcggcagcgcaaaagatg

SEQ ID NO: 66726 - DNA, 103 bp, Artificial Sequence
  Synthetic Polynucleotide
taatacgactcactatagggttacggatcaaacagttaatatttgtatctaacagaggagaagatacatgtattaactgaacctggcggcagcgcaaaagatg

SEQ ID NO: 66727 - DNA, 103 bp, Artificial Sequence
  Synthetic Polynucleotide
taatacgactcactatagggagtcaacagtttggaaattatcgccaatttaacagaggagaaaattgatgataatttccaacctggcggcagcgcaaaagatg

SEQ ID NO: 66728 - DNA, 103 bp, Artificial Sequence
  Synthetic Polynucleotide
taatacgactcactatagggagtgaagtcaacagtttggaaattatcgccaacagaggagaggcgatatgttccaaactaacctggcggcagcgcaaaagatg

SEQ ID NO: 66729 - DNA, 103 bp, Artificial Sequence
  Synthetic Polynucleotide
taatacgactcactatagggcaatcagtgaagtcaacagtttggaaattaaacagaggagataatttatgaactgttgaaacctggcggcagcgcaaaagatg

SEQ ID NO: 66730 - DNA, 103 bp, Artificial Sequence
  Synthetic Polynucleotide
taatacgactcactatagggtgcgacaatcagtgaagtcaacagtttggaaacagaggagatccaaaatgttgacttcaaacctggcggcagcgcaaaagatg

SEQ ID NO: 66731 - DNA, 103 bp, Artificial Sequence
  Synthetic Polynucleotide
taatacgactcactatagggtatagtgcgacaatcagtgaagtcaacagtaacagaggagaactgttatgttcactgataacctggcggcagcgcaaaagatg

SEQ ID NO: 66732 - DNA, 103 bp, Artificial Sequence
  Synthetic Polynucleotide
taatacgactcactataggggcatctatagtgcgacaatcagtgaagtcaaacagaggagatgacttatgtgattgtcgaacctggcggcagcgcaaaagatg

SEQ ID NO: 66733 - DNA, 103 bp, Artificial Sequence
  Synthetic Polynucleotide
taatacgactcactatagggtgatagcatctatagtgcgacaatcagtgaaacagaggagatcactgatggtcgcactaaacctggcggcagcgcaaaagatg

SEQ ID NO: 66734 - DNA, 103 bp, Artificial Sequence
  Synthetic Polynucleotide
taatacgactcactatagggcttattgatagcatctatagtgcgacaatcaacagaggagagattgtatgactatagataacctggcggcagcgcaaaagatg

SEQ ID NO: 66735 - DNA, 103 bp, Artificial Sequence
  Synthetic Polynucleotide
taatacgactcactatagggacacacttattgatagcatctatagtgcgaaacagaggagatcgcacatgagatgctataacctggcggcagcgcaaaagatg

SEQ ID NO: 66736 - DNA, 103 bp, Artificial Sequence
  Synthetic Polynucleotide
taatacgactcactatagggcatcaacacacttattgatagcatctatagaacagaggagactatagatgctatcaataaacctggcggcagcgcaaaagatg

SEQ ID NO: 66737 - DNA, 103 bp, Artificial Sequence
  Synthetic Polynucleotide
taatacgactcactatagggtgttattacggatcaaacagttaatatttgaacagaggagacaaataatgactgtttgaaacctggcggcagcgcaaaagatg

SEQ ID NO: 66738 - DNA, 103 bp, Artificial Sequence
  Synthetic Polynucleotide
taatacgactcactatagggaaagacatcaacacacttattgatagcatcaacagaggagagatgctatgaataagtgtaacctggcggcagcgcaaaagatg

SEQ ID NO: 66739 - DNA, 103 bp, Artificial Sequence
  Synthetic Polynucleotide
taatacgactcactatagggtcagtaaagacatcaacacacttattgataaacagaggagatatcaaatggtgtgttgaaacctggcggcagcgcaaaagatg

SEQ ID NO: 66740 - DNA, 103 bp, Artificial Sequence
  Synthetic Polynucleotide
taatacgactcactatagggtcccctcagtaaagacatcaacacacttataacagaggagaataagtatgttgatgtctaacctggcggcagcgcaaaagatg

SEQ ID NO: 66741 - DNA, 103 bp, Artificial Sequence
  Synthetic Polynucleotide
taatacgactcactataggggattttcccctcagtaaagacatcaacacaaacagaggagatgtgttatggtctttactaacctggcggcagcgcaaaagatg

SEQ ID NO: 66742 - DNA, 103 bp, Artificial Sequence
  Synthetic Polynucleotide
taatacgactcactatagggggattgattttcccctcagtaaagacatcaaacagaggagatgatgtatgtactgagggaacctggcggcagcgcaaaagatg

SEQ ID NO: 66743 - DNA, 103 bp, Artificial Sequence
  Synthetic Polynucleotide
taatacgactcactatagggatagtggattgattttcccctcagtaaagaaacagaggagatctttaatgaggggaaaaaacctggcggcagcgcaaaagatg

SEQ ID NO: 66744 - DNA, 103 bp, Artificial Sequence
  Synthetic Polynucleotide
taatacgactcactatagggagtcaatagtggattgattttcccctcagtaacagaggagaactgagatgaaaatcaataacctggcggcagcgcaaaagatg

SEQ ID NO: 66745 - DNA, 103 bp, Artificial Sequence
  Synthetic Polynucleotide
taatacgactcactatagggtgttcagtcaatagtggattgattttccccaacagaggagaggggaaatgcaatccactaacctggcggcagcgcaaaagatg

SEQ ID NO: 66746 - DNA, 103 bp, Artificial Sequence
  Synthetic Polynucleotide
taatacgactcactatagggacaattgttcagtcaatagtggattgatttaacagaggagaaaatcaatgcactattgaaacctggcggcagcgcaaaagatg

SEQ ID NO: 66747 - DNA, 103 bp, Artificial Sequence
  Synthetic Polynucleotide
taatacgactcactataggggggagacaattgttcagtcaatagtggattaacagaggagaaatccaatgttgactgaaaacctggcggcagcgcaaaagatg

SEQ ID NO: 66748 - DNA, 103 bp, Artificial Sequence
  Synthetic Polynucleotide
taatacgactcactatagggagtaatgttattacggatcaaacagttaataacagaggagaattaacatgttgatccgtaacctggcggcagcgcaaaagatg

SEQ ID NO: 66749 - DNA, 103 bp, Artificial Sequence
  Synthetic Polynucleotide
taatacgactcactataggggtattgggagacaattgttcagtcaatagtaacagaggagaactattatgtgaacaattaacctggcggcagcgcaaaagatg

SEQ ID NO: 66750 - DNA, 103 bp, Artificial Sequence
  Synthetic Polynucleotide
taatacgactcactataggggacaggtattgggagacaattgttcagtcaaacagaggagatgactgatgaattgtctcaacctggcggcagcgcaaaagatg

SEQ ID NO: 66751 - DNA, 103 bp, Artificial Sequence
  Synthetic Polynucleotide
taatacgactcactatagggtaggagacaggtattgggagacaattgttcaacagaggagagaacaaatgtctcccaataacctggcggcagcgcaaaagatg

SEQ ID NO: 66752 - DNA, 103 bp, Artificial Sequence
  Synthetic Polynucleotide
taatacgactcactatagggattgctaggagacaggtattgggagacaataacagaggagaattgtcatgcaatacctgaacctggcggcagcgcaaaagatg

SEQ ID NO: 66753 - DNA, 103 bp, Artificial Sequence
  Synthetic Polynucleotide
taatacgactcactatagggcactaattgctaggagacaggtattgggagaacagaggagactcccaatgcctgtctccaacctggcggcagcgcaaaagatg

SEQ ID NO: 66754 - DNA, 103 bp, Artificial Sequence
  Synthetic Polynucleotide
taatacgactcactatagggtacggcactaattgctaggagacaggtattaacagaggagaaataccatgctcctagcaaacctggcggcagcgcaaaagatg

SEQ ID NO: 66755 - DNA, 103 bp, Artificial Sequence
  Synthetic Polynucleotide
taatacgactcactatagggaagtatacggcactaattgctaggagacagaacagaggagactgtctatgagcaattagaacctggcggcagcgcaaaagatg

SEQ ID NO: 66756 - DNA, 103 bp, Artificial Sequence
  Synthetic Polynucleotide
taatacgactcactatagggctttaaagtatacggcactaattgctaggaaacagaggagatcctagatgttagtgccgaacctggcggcagcgcaaaagatg

SEQ ID NO: 66757 - DNA, 103 bp, Artificial Sequence
  Synthetic Polynucleotide
taatacgactcactatagggttttgctttaaagtatacggcactaattgcaacagaggagagcaattatggccgtatacaacctggcggcagcgcaaaagatg

SEQ ID NO: 66758 - DNA, 103 bp, Artificial Sequence
  Synthetic Polynucleotide
taatacgactcactatagggaaccattttgctttaaagtatacggcactaaacagaggagatagtgcatgatactttaaaacctggcggcagcgcaaaagatg

SEQ ID NO: 66759 - DNA, 103 bp, Artificial Sequence
  Synthetic Polynucleotide
taatacgactcactatagggcaactagtaatgttattacggatcaaacagaacagaggagactgtttatgccgtaataaaacctggcggcagcgcaaaagatg

SEQ ID NO: 66760 - DNA, 103 bp, Artificial Sequence
  Synthetic Polynucleotide
taatacgactcactataggggtatcaaccattttgctttaaagtatacggaacagaggagaccgtatatgttaaagcaaaacctggcggcagcgcaaaagatg

SEQ ID NO: 66761 - DNA, 103 bp, Artificial Sequence
  Synthetic Polynucleotide
taatacgactcactataggggaatggtatcaaccattttgctttaaagtaaacagaggagatactttatggcaaaatggaacctggcggcagcgcaaaagatg

SEQ ID NO: 66762 - DNA, 103 bp, Artificial Sequence
  Synthetic Polynucleotide
taatacgactcactatagggtttttgaatggtatcaaccattttgctttaaacagaggagataaagcatgatggttgataacctggcggcagcgcaaaagatg

SEQ ID NO: 66763 - DNA, 103 bp, Artificial Sequence
  Synthetic Polynucleotide
taatacgactcactatagggattcctttttgaatggtatcaaccattttgaacagaggagacaaaatatgtgataccataacctggcggcagcgcaaaagatg

SEQ ID NO: 66764 - DNA, 103 bp, Artificial Sequence
  Synthetic Polynucleotide
taatacgactcactatagggggtaaattcctttttgaatggtatcaaccaaacagaggagatggttgatgccattcaaaaacctggcggcagcgcaaaagatg

SEQ ID NO: 66765 - DNA, 103 bp, Artificial Sequence
  Synthetic Polynucleotide
taatacgactcactatagggtcactggtaaattcctttttgaatggtatcaacagaggagagataccatgcaaaaaggaaacctggcggcagcgcaaaagatg

SEQ ID NO: 66766 - DNA, 103 bp, Artificial Sequence
  Synthetic Polynucleotide
taatacgactcactataggggataatcactggtaaattcctttttgaatgaacagaggagacattcaatgaggaatttaaacctggcggcagcgcaaaagatg

SEQ ID NO: 66767 - DNA, 103 bp, Artificial Sequence
  Synthetic Polynucleotide
taatacgactcactatagggaaatggataatcactggtaaattcctttttaacagaggagaaaaaagatgtttaccagtaacctggcggcagcgcaaaagatg

SEQ ID NO: 66768 - DNA, 103 bp, Artificial Sequence
  Synthetic Polynucleotide
taatacgactcactatagggacgtaaaatggataatcactggtaaattccaacagaggagaggaattatgcagtgattaaacctggcggcagcgcaaaagatg

SEQ ID NO: 66769 - DNA, 103 bp, Artificial Sequence
  Synthetic Polynucleotide
taatacgactcactataggggtgatacgtaaaatggataatcactggtaaaacagaggagattaccaatgattatccataacctggcggcagcgcaaaagatg

SEQ ID NO: 66770 - DNA, 103 bp, Artificial Sequence
  Synthetic Polynucleotide
taatacgactcactataggggttatcaactagtaatgttattacggatcaaacagaggagatgatccatgataacattaaacctggcggcagcgcaaaagatg

SEQ ID NO: 66771 - DNA, 103 bp, Artificial Sequence
  Synthetic Polynucleotide
taatacgactcactatagggcgttggtgatacgtaaaatggataatcactaacagaggagaagtgatatgccattttacaacctggcggcagcgcaaaagatg

SEQ ID NO: 66772 - DNA, 103 bp, Artificial Sequence
  Synthetic Polynucleotide
taatacgactcactatagggatttccgttggtgatacgtaaaatggataaaacagaggagattatccatgttacgtatcaacctggcggcagcgcaaaagatg

SEQ ID NO: 66773 - DNA, 103 bp, Artificial Sequence
  Synthetic Polynucleotide
taatacgactcactatagggctaccatttccgttggtgatacgtaaaatgaacagaggagacattttatgtatcaccaaaacctggcggcagcgcaaaagatg

SEQ ID NO: 66774 - DNA, 103 bp, Artificial Sequence
  Synthetic Polynucleotide
taatacgactcactatagggtacgtctaccatttccgttggtgatacgtaaacagaggagatacgtaatgccaacggaaaacctggcggcagcgcaaaagatg

SEQ ID NO: 66775 - DNA, 103 bp, Artificial Sequence
  Synthetic Polynucleotide
taatacgactcactatagggatacttacgtctaccatttccgttggtgataacagaggagaatcaccatgggaaatggtaacctggcggcagcgcaaaagatg

SEQ ID NO: 66776 - DNA, 103 bp, Artificial Sequence
  Synthetic Polynucleotide
taatacgactcactatagggacatcatacttacgtctaccatttccgttgaacagaggagacaacggatgtggtagacgaacctggcggcagcgcaaaagatg

SEQ ID NO: 66777 - DNA, 103 bp, Artificial Sequence
  Synthetic Polynucleotide
taatacgactcactatagggcatagacatcatacttacgtctaccatttcaacagaggagagaaatgatggacgtaagtaacctggcggcagcgcaaaagatg

SEQ ID NO: 66778 - DNA, 103 bp, Artificial Sequence
  Synthetic Polynucleotide
taatacgactcactatagggccatacatagacatcatacttacgtctaccaacagaggagaggtagaatgaagtatgataacctggcggcagcgcaaaagatg

SEQ ID NO: 66779 - DNA, 103 bp, Artificial Sequence
  Synthetic Polynucleotide
taatacgactcactatagggactcaccatacatagacatcatacttacgtaacagaggagaacgtaaatgtgatgtctaaacctggcggcagcgcaaaagatg

SEQ ID NO: 66780 - DNA, 103 bp, Artificial Sequence
  Synthetic Polynucleotide
taatacgactcactatagggaaatgactcaccatacatagacatcatactaacagaggagaagtatgatgtctatgtataacctggcggcagcgcaaaagatg

SEQ ID NO: 66781 - DNA, 103 bp, Artificial Sequence
  Synthetic Polynucleotide
taatacgactcactatagggaaattgttatcaactagtaatgttattacgaacagaggagacgtaatatgattactagtaacctggcggcagcgcaaaagatg

SEQ ID NO: 66782 - DNA, 103 bp, Artificial Sequence
  Synthetic Polynucleotide
taatacgactcactatagggtaattaaatgactcaccatacatagacatcaacagaggagagatgtcatggtatggtgaaacctggcggcagcgcaaaagatg

SEQ ID NO: 66783 - DNA, 103 bp, Artificial Sequence
  Synthetic Polynucleotide
taatacgactcactatagggatgcgtaattaaatgactcaccatacatagaacagaggagactatgtatggtgagtcataacctggcggcagcgcaaaagatg

SEQ ID NO: 66784 - DNA, 103 bp, Artificial Sequence
  Synthetic Polynucleotide
taatacgactcactatagggtacagatgcgtaattaaatgactcaccataaacagaggagatatggtatgtcatttaataacctggcggcagcgcaaaagatg

SEQ ID NO: 66785 - DNA, 103 bp, Artificial Sequence
  Synthetic Polynucleotide
taatacgactcactatagggtcttttacagatgcgtaattaaatgactcaaacagaggagatgagtcatgtaattacgcaacctggcggcagcgcaaaagatg

SEQ ID NO: 66786 - DNA, 103 bp, Artificial Sequence
  Synthetic Polynucleotide
taatacgactcactatagggatgattcttttacagatgcgtaattaaatgaacagaggagacatttaatgacgcatctgaacctggcggcagcgcaaaagatg

SEQ ID NO: 66787 - DNA, 103 bp, Artificial Sequence
  Synthetic Polynucleotide
taatacgactcactatagggaccgaatgattcttttacagatgcgtaattaacagaggagaaattacatgtctgtaaaaaacctggcggcagcgcaaaagatg

SEQ ID NO: 66788 - DNA, 103 bp, Artificial Sequence
  Synthetic Polynucleotide
taatacgactcactatagggaagttaccgaatgattcttttacagatgcgaacagaggagacgcatcatgaaaagaatcaacctggcggcagcgcaaaagatg

SEQ ID NO: 66789 - DNA, 103 bp, Artificial Sequence
  Synthetic Polynucleotide
taatacgactcactatagggttgaaaagttaccgaatgattcttttacagaacagaggagactgtaaatgaatcattcgaacctggcggcagcgcaaaagatg

SEQ ID NO: 66790 - DNA, 103 bp, Artificial Sequence
  Synthetic Polynucleotide
taatacgactcactatagggtatgattgaaaagttaccgaatgattctttaacagaggagaaaagaaatgttcggtaacaacctggcggcagcgcaaaagatg

SEQ ID NO: 66791 - DNA, 103 bp, Artificial Sequence
  Synthetic Polynucleotide
taatacgactcactatagggagttctatgattgaaaagttaccgaatgataacagaggagaatcattatgtaacttttcaacctggcggcagcgcaaaagatg

SEQ ID NO: 66792 - DNA, 103 bp, Artificial Sequence
  Synthetic Polynucleotide
taatacgactcactatagggaacgttacacaagggagtagaatatgggtgaacagaggagacacccaatgtctactcccaacctggcggcagcgcaaaagatg

SEQ ID NO: 66793 - DNA, 103 bp, Artificial Sequence
  Synthetic Polynucleotide
taatacgactcactatagggttaacaaattgttatcaactagtaatgttaaacagaggagataacatatgtagttgataaacctggcggcagcgcaaaagatg

SEQ ID NO: 66794 - DNA, 103 bp, Artificial Sequence
  Synthetic Polynucleotide
taatacgactcactatagggatggcagttctatgattgaaaagttaccgaaacagaggagatcggtaatgtttcaatcaaacctggcggcagcgcaaaagatg

SEQ ID NO: 66795 - DNA, 103 bp, Artificial Sequence
  Synthetic Polynucleotide
taatacgactcactatagggaacatatggcagttctatgattgaaaagttaacagaggagaaactttatgatcatagaaaacctggcggcagcgcaaaagatg

SEQ ID NO: 66796 - DNA, 103 bp, Artificial Sequence
  Synthetic Polynucleotide
taatacgactcactatagggtttccaacatatggcagttctatgattgaaaacagaggagattcaatatgagaactgccaacctggcggcagcgcaaaagatg

SEQ ID NO: 66797 - DNA, 103 bp, Artificial Sequence
  Synthetic Polynucleotide
taatacgactcactatagggtagtatttccaacatatggcagttctatgaaacagaggagatcatagatgtgccatatgaacctggcggcagcgcaaaagatg

SEQ ID NO: 66798 - DNA, 103 bp, Artificial Sequence
  Synthetic Polynucleotide
taatacgactcactatagggcatactagtatttccaacatatggcagttcaacagaggagagaactgatgtatgttggaaacctggcggcagcgcaaaagatg

SEQ ID NO: 66799 - DNA, 103 bp, Artificial Sequence
  Synthetic Polynucleotide
taatacgactcactatagggaccatcatactagtatttccaacatatggcaacagaggagagccataatgtggaaatacaacctggcggcagcgcaaaagatg

SEQ ID NO: 66800 - DNA, 103 bp, Artificial Sequence
  Synthetic Polynucleotide
taatacgactcactataggggaatgaccatcatactagtatttccaacataacagaggagaatgttgatgatactagtaaacctggcggcagcgcaaaagatg

SEQ ID NO: 66801 - DNA, 103 bp, Artificial Sequence
  Synthetic Polynucleotide
taatacgactcactatagggtggaagaatgaccatcatactagtatttccaacagaggagaggaaatatgagtatgatgaacctggcggcagcgcaaaagatg

SEQ ID NO: 66802 - DNA, 103 bp, Artificial Sequence
  Synthetic Polynucleotide
taatacgactcactatagggttgtctggaagaatgaccatcatactagtaaacagaggagatactagatggatggtcataacctggcggcagcgcaaaagatg

SEQ ID NO: 66803 - DNA, 103 bp, Artificial Sequence
  Synthetic Polynucleotide
taatacgactcactatagggcaatcttgtctggaagaatgaccatcatacaacagaggagagtatgaatgtcattcttcaacctggcggcagcgcaaaagatg

SEQ ID NO: 66804 - DNA, 103 bp, Artificial Sequence
  Synthetic Polynucleotide
taatacgactcactatagggtcttattaacaaattgttatcaactagtaaaacagaggagattactaatggataacaataacctggcggcagcgcaaaagatg

SEQ ID NO: 66805 - DNA, 103 bp, Artificial Sequence
  Synthetic Polynucleotide
taatacgactcactatagggtccatcaatcttgtctggaagaatgaccataacagaggagaatggtcatgcttccagacaacctggcggcagcgcaaaagatg

SEQ ID NO: 66806 - DNA, 103 bp, Artificial Sequence
  Synthetic Polynucleotide
taatacgactcactatagggtctaatccatcaatcttgtctggaagaatgaacagaggagacattctatgagacaagataacctggcggcagcgcaaaagatg

SEQ ID NO: 66807 - DNA, 103 bp, Artificial Sequence
  Synthetic Polynucleotide
taatacgactcactatagggtggattctaatccatcaatcttgtctggaaaacagaggagattccagatgagattgatgaacctggcggcagcgcaaaagatg

SEQ ID NO: 66808 - DNA, 103 bp, Artificial Sequence
  Synthetic Polynucleotide
taatacgactcactatagggttttatggattctaatccatcaatcttgtcaacagaggagagacaagatggatggattaaacctggcggcagcgcaaaagatg

SEQ ID NO: 66809 - DNA, 103 bp, Artificial Sequence
  Synthetic Polynucleotide
taatacgactcactatagggttttgttttatggattctaatccatcaatcaacagaggagagattgaatgattagaatcaacctggcggcagcgcaaaagatg

SEQ ID NO: 66810 - DNA, 103 bp, Artificial Sequence
  Synthetic Polynucleotide
taatacgactcactatagggttagattttgttttatggattctaatccataacagaggagaatggatatgaatccataaaacctggcggcagcgcaaaagatg

SEQ ID NO: 66811 - DNA, 103 bp, Artificial Sequence
  Synthetic Polynucleotide
taatacgactcactatagggatctgttagattttgttttatggattctaaaacagaggagattagaaatgataaaacaaaacctggcggcagcgcaaaagatg

SEQ ID NO: 66812 - DNA, 103 bp, Artificial Sequence
  Synthetic Polynucleotide
taatacgactcactatagggtttgtatctgttagattttgttttatggataacagaggagaatccatatgacaaaatctaacctggcggcagcgcaaaagatg

SEQ ID NO: 66813 - DNA, 103 bp, Artificial Sequence
  Synthetic Polynucleotide
taatacgactcactatagggtaaaatttgtatctgttagattttgttttaaacagaggagataaaacatgatctaacagaacctggcggcagcgcaaaagatg

SEQ ID NO: 66814 - DNA, 103 bp, Artificial Sequence
  Synthetic Polynucleotide
taatacgactcactatagggtttcttaaaatttgtatctgttagattttgaacagaggagacaaaatatgacagatacaaacctggcggcagcgcaaaagatg

SEQ ID NO: 66815 - DNA, 103 bp, Artificial Sequence
  Synthetic Polynucleotide
taatacgactcactataggggcacatcttattaacaaattgttatcaactaacagaggagaagttgaatgcaatttgttaacctggcggcagcgcaaaagatg

SEQ ID NO: 66816 - DNA, 103 bp, Artificial Sequence
  Synthetic Polynucleotide
taatacgactcactatagggcaccatttcttaaaatttgtatctgttagaaacagaggagatctaacatgtacaaatttaacctggcggcagcgcaaaagatg

SEQ ID NO: 66817 - DNA, 103 bp, Artificial Sequence
  Synthetic Polynucleotide
taatacgactcactatagggagttacaccatttcttaaaatttgtatctgaacagaggagacagataatgattttaagaaacctggcggcagcgcaaaagatg

SEQ ID NO: 66818 - DNA, 103 bp, Artificial Sequence
  Synthetic Polynucleotide
taatacgactcactatagggcagagagttacaccatttcttaaaatttgtaacagaggagaacaaatatgaagaaatggaacctggcggcagcgcaaaagatg

SEQ ID NO: 66819 - DNA, 103 bp, Artificial Sequence
  Synthetic Polynucleotide
taatacgactcactataggggcttccagagagttacaccatttcttaaaaaacagaggagattttaaatgatggtgtaaaacctggcggcagcgcaaaagatg

SEQ ID NO: 66820 - DNA, 103 bp, Artificial Sequence
  Synthetic Polynucleotide
taatacgactcactatagggacgtagcttccagagagttacaccatttctaacagaggagaagaaatatggtaactctcaacctggcggcagcgcaaaagatg

SEQ ID NO: 66821 - DNA, 103 bp, Artificial Sequence
  Synthetic Polynucleotide
taatacgactcactataggggataaacgtagcttccagagagttacaccaaacagaggagatggtgtatgtctctggaaaacctggcggcagcgcaaaagatg

SEQ ID NO: 66822 - DNA, 103 bp, Artificial Sequence
  Synthetic Polynucleotide
taatacgactcactatagggacatcgataaacgtagcttccagagagttaaacagaggagataactcatgggaagctacaacctggcggcagcgcaaaagatg

SEQ ID NO: 66823 - DNA, 103 bp, Artificial Sequence
  Synthetic Polynucleotide
taatacgactcactatagggtgtgtacatcgataaacgtagcttccagagaacagaggagactctggatgctacgtttaaacctggcggcagcgcaaaagatg

SEQ ID NO: 66824 - DNA, 103 bp, Artificial Sequence
  Synthetic Polynucleotide
taatacgactcactataggggggaatgtgtacatcgataaacgtagcttcaacagaggagagaagctatgtttatcgataacctggcggcagcgcaaaagatg

SEQ ID NO: 66825 - DNA, 103 bp, Artificial Sequence
  Synthetic Polynucleotide
taatacgactcactatagggaacttgggaatgtgtacatcgataaacgtaaacagaggagatacgttatgcgatgtacaaacctggcggcagcgcaaaagatg

SEQ ID NO: 66826 - DNA, 103 bp, Artificial Sequence
  Synthetic Polynucleotide
taatacgactcactataggggcccagcacatcttattaacaaattgttataacagaggagaataacaatgtgttaataaaacctggcggcagcgcaaaagatg

SEQ ID NO: 66827 - DNA, 103 bp, Artificial Sequence
  Synthetic Polynucleotide
taatacgactcactatagggccttaaacttgggaatgtgtacatcgataaaacagaggagattatcgatgtacacattcaacctggcggcagcgcaaaagatg

SEQ ID NO: 66828 - DNA, 103 bp, Artificial Sequence
  Synthetic Polynucleotide
taatacgactcactatagggtgttaccttaaacttgggaatgtgtacatcaacagaggagagatgtaatgattcccaagaacctggcggcagcgcaaaagatg

SEQ ID NO: 66829 - DNA, 103 bp, Artificial Sequence
  Synthetic Polynucleotide
taatacgactcactataggggaacctgttaccttaaacttgggaatgtgtaacagaggagaacacatatgcaagtttaaaacctggcggcagcgcaaaagatg

SEQ ID NO: 66830 - DNA, 103 bp, Artificial Sequence
  Synthetic Polynucleotide
taatacgactcactatagggtatacgaacctgttaccttaaacttgggaaaacagaggagattcccaatgttaaggtaaaacctggcggcagcgcaaaagatg

SEQ ID NO: 66831 - DNA, 103 bp, Artificial Sequence
  Synthetic Polynucleotide
taatacgactcactatagggcagattatacgaacctgttaccttaaacttaacagaggagaaagtttatggtaacaggtaacctggcggcagcgcaaaagatg

SEQ ID NO: 66832 - DNA, 103 bp, Artificial Sequence
  Synthetic Polynucleotide
taatacgactcactatagggtccaccagattatacgaacctgttaccttaaacagaggagataaggtatgaggttcgtaaacctggcggcagcgcaaaagatg

SEQ ID NO: 66833 - DNA, 103 bp, Artificial Sequence
  Synthetic Polynucleotide
taatacgactcactataggggagtatccaccagattatacgaacctgttaaacagaggagataacagatgcgtataatcaacctggcggcagcgcaaaagatg

SEQ ID NO: 66834 - DNA, 103 bp, Artificial Sequence
  Synthetic Polynucleotide
taatacgactcactatagggtactagagtatccaccagattatacgaaccaacagaggagaggttcgatgaatctggtgaacctggcggcagcgcaaaagatg

SEQ ID NO: 66835 - DNA, 103 bp, Artificial Sequence
  Synthetic Polynucleotide
taatacgactcactatagggaactttactagagtatccaccagattatacaacagaggagagtataaatgggtggatacaacctggcggcagcgcaaaagatg

SEQ ID NO: 66836 - DNA, 103 bp, Artificial Sequence
  Synthetic Polynucleotide
taatacgactcactataggggtcccaactttactagagtatccaccagataacagaggagaatctggatgatactctagaacctggcggcagcgcaaaagatg

SEQ ID NO: 66837 - DNA, 103 bp, Artificial Sequence
  Synthetic Polynucleotide
taatacgactcactatagggattgagcccagcacatcttattaacaaattaacagaggagaaatttgatgataagatgtaacctggcggcagcgcaaaagatg

SEQ ID NO: 66838 - DNA, 103 bp, Artificial Sequence
  Synthetic Polynucleotide
taatacgactcactatagggtgtcagtcccaactttactagagtatccacaacagaggagagtggatatgctagtaaagaacctggcggcagcgcaaaagatg

SEQ ID NO: 66839 - DNA, 103 bp, Artificial Sequence
  Synthetic Polynucleotide
taatacgactcactatagggacatctgtcagtcccaactttactagagtaaacagaggagatactctatgaaagttgggaacctggcggcagcgcaaaagatg

SEQ ID NO: 66840 - DNA, 103 bp, Artificial Sequence
  Synthetic Polynucleotide
taatacgactcactatagggagaacacatctgtcagtcccaactttactaaacagaggagatagtaaatgtgggactgaaacctggcggcagcgcaaaagatg

SEQ ID NO: 66841 - DNA, 103 bp, Artificial Sequence
  Synthetic Polynucleotide
taatacgactcactatagggtgaatagaacacatctgtcagtcccaacttaacagaggagaaagttgatgctgacagataacctggcggcagcgcaaaagatg

SEQ ID NO: 66842 - DNA, 103 bp, Artificial Sequence
  Synthetic Polynucleotide
taatacgactcactatagggccagttgaatagaacacatctgtcagtcccaacagaggagagggactatgagatgtgttaacctggcggcagcgcaaaagatg

SEQ ID NO: 66843 - DNA, 103 bp, Artificial Sequence
  Synthetic Polynucleotide
taatacgactcactatagggaatcgccagttgaatagaacacatctgtcaaacagaggagatgacagatgtgttctattaacctggcggcagcgcaaaagatg

SEQ ID NO: 66844 - DNA, 103 bp, Artificial Sequence
  Synthetic Polynucleotide
taatacgactcactataggggctataatcgccagttgaatagaacacatcaacagaggagagatgtgatgtattcaactaacctggcggcagcgcaaaagatg

SEQ ID NO: 66845 - DNA, 103 bp, Artificial Sequence
  Synthetic Polynucleotide
taatacgactcactatagggatattgctataatcgccagttgaatagaacaacagaggagagttctaatgaactggcgaaacctggcggcagcgcaaaagatg

SEQ ID NO: 66846 - DNA, 103 bp, Artificial Sequence
  Synthetic Polynucleotide
taatacgactcactatagggtacacatattgctataatcgccagttgaataacagaggagaattcaaatggcgattataaacctggcggcagcgcaaaagatg

SEQ ID NO: 66847 - DNA, 103 bp, Artificial Sequence
  Synthetic Polynucleotide
taatacgactcactatagggtgaattacacatattgctataatcgccagtaacagaggagaactggcatgtatagcaataacctggcggcagcgcaaaagatg

SEQ ID NO: 66848 - DNA, 103 bp, Artificial Sequence
  Synthetic Polynucleotide
taatacgactcactatagggaagacattgagcccagcacatcttattaacaacagaggagagttaatatgatgtgctggaacctggcggcagcgcaaaagatg

SEQ ID NO: 66849 - DNA, 103 bp, Artificial Sequence
  Synthetic Polynucleotide
taatacgactcactatagggacatctgaattacacatattgctataatcgaacagaggagacgattaatgcaatatgtgaacctggcggcagcgcaaaagatg

SEQ ID NO: 66850 - DNA, 103 bp, Artificial Sequence
  Synthetic Polynucleotide
taatacgactcactatagggcactcacatctgaattacacatattgctataacagaggagaatagcaatgtgtgtaattaacctggcggcagcgcaaaagatg

SEQ ID NO: 66851 - DNA, 103 bp, Artificial Sequence
  Synthetic Polynucleotide
taatacgactcactataggggtcaacactcacatctgaattacacatattaacagaggagaaatatgatgaattcagataacctggcggcagcgcaaaagatg

SEQ ID NO: 66852 - DNA, 103 bp, Artificial Sequence
  Synthetic Polynucleotide
taatacgactcactatagggatagcgtcaacactcacatctgaattacacaacagaggagagtgtaaatgagatgtgagaacctggcggcagcgcaaaagatg

SEQ ID NO: 66853 - DNA, 103 bp, Artificial Sequence
  Synthetic Polynucleotide
taatacgactcactataggggaatcatagcgtcaacactcacatctgaataacagaggagaattcagatgtgagtgttgaacctggcggcagcgcaaaagatg

SEQ ID NO: 66854 - DNA, 103 bp, Artificial Sequence
  Synthetic Polynucleotide
taatacgactcactatagggtttgtgaatcatagcgtcaacactcacatcaacagaggagagatgtgatggttgacgctaacctggcggcagcgcaaaagatg

SEQ ID NO: 66855 - DNA, 103 bp, Artificial Sequence
  Synthetic Polynucleotide
taatacgactcactatagggtacgttttgtgaatcatagcgtcaacactcaacagaggagagagtgtatgcgctatgataacctggcggcagcgcaaaagatg

SEQ ID NO: 66856 - DNA, 103 bp, Artificial Sequence
  Synthetic Polynucleotide
taatacgactcactatagggctatatacgttttgtgaatcatagcgtcaaaacagaggagattgacgatgtgattcacaaacctggcggcagcgcaaaagatg

SEQ ID NO: 66857 - DNA, 103 bp, Artificial Sequence
  Synthetic Polynucleotide
taatacgactcactataggggacatctatatacgttttgtgaatcatagcaacagaggagagctatgatgcacaaaacgaacctggcggcagcgcaaaagatg

SEQ ID NO: 66858 - DNA, 103 bp, Artificial Sequence
  Synthetic Polynucleotide
taatacgactcactatagggtcattgacatctatatacgttttgtgaatcaacagaggagagattcaatgaacgtatataacctggcggcagcgcaaaagatg

SEQ ID NO: 66859 - DNA, 103 bp, Artificial Sequence
  Synthetic Polynucleotide
taatacgactcactatagggttattaagacattgagcccagcacatcttaaacagaggagataagatatgctgggctcaaacctggcggcagcgcaaaagatg

SEQ ID NO: 66860 - DNA, 103 bp, Artificial Sequence
  Synthetic Polynucleotide
taatacgactcactatagggactcttcattgacatctatatacgttttgtaacagaggagaacaaaaatgatatagatgaacctggcggcagcgcaaaagatg

SEQ ID NO: 66861 - DNA, 103 bp, Artificial Sequence
  Synthetic Polynucleotide
taatacgactcactatagggtgtgtactcttcattgacatctatatacgtaacagaggagaacgtatatggatgtcaataacctggcggcagcgcaaaagatg

SEQ ID NO: 66862 - DNA, 103 bp, Artificial Sequence
  Synthetic Polynucleotide
taatacgactcactataggggcttctgtgtactcttcattgacatctataaacagaggagatatagaatgcaatgaagaaacctggcggcagcgcaaaagatg

SEQ ID NO: 66863 - DNA, 103 bp, Artificial Sequence
  Synthetic Polynucleotide
taatacgactcactatagggcagctgcttctgtgtactcttcattgacataacagaggagaatgtcaatgaagagtacaaacctggcggcagcgcaaaagatg

SEQ ID NO: 66864 - DNA, 103 bp, Artificial Sequence
  Synthetic Polynucleotide
taatacgactcactatagggtgctgcagctgcttctgtgtactcttcattaacagaggagaaatgaaatgtacacagaaaacctggcggcagcgcaaaagatg

SEQ ID NO: 66865 - DNA, 103 bp, Artificial Sequence
  Synthetic Polynucleotide
taatacgactcactataggggaagttgctgcagctgcttctgtgtactctaacagaggagaagagtaatgagaagcagcaacctggcggcagcgcaaaagatg

SEQ ID NO: 66866 - DNA, 103 bp, Artificial Sequence
  Synthetic Polynucleotide
taatacgactcactataggggtacagaagttgctgcagctgcttctgtgtaacagaggagaacacagatgcagctgcagaacctggcggcagcgcaaaagatg

SEQ ID NO: 66867 - DNA, 103 bp, Artificial Sequence
  Synthetic Polynucleotide
taatacgactcactatagggcactagtacagaagttgctgcagctgcttcaacagaggagagaagcaatggcagcaactaacctggcggcagcgcaaaagatg

SEQ ID NO: 66868 - DNA, 103 bp, Artificial Sequence
  Synthetic Polynucleotide
taatacgactcactatagggtctgccactagtacagaagttgctgcagctaacagaggagaagctgcatgaacttctgtaacctggcggcagcgcaaaagatg

SEQ ID NO: 66869 - DNA, 103 bp, Artificial Sequence
  Synthetic Polynucleotide
taatacgactcactatagggcacagtctgccactagtacagaagttgctgaacagaggagacagcaaatgctgtactagaacctggcggcagcgcaaaagatg

SEQ ID NO: 66870 - DNA, 103 bp, Artificial Sequence
  Synthetic Polynucleotide
taatacgactcactatagggacttcttattaagacattgagcccagcacaaacagaggagatgtgctatgctcaatgtcaacctggcggcagcgcaaaagatg

SEQ ID NO: 66871 - DNA, 103 bp, Artificial Sequence
  Synthetic Polynucleotide
taatacgactcactatagggtgatgcacagtctgccactagtacagaagtaacagaggagaacttctatgctagtggcaaacctggcggcagcgcaaaagatg

SEQ ID NO: 66872 - DNA, 103 bp, Artificial Sequence
  Synthetic Polynucleotide
taatacgactcactatagggactgttgatgcacagtctgccactagtacaaacagaggagatgtactatgggcagactgaacctggcggcagcgcaaaagatg

SEQ ID NO: 66873 - DNA, 103 bp, Artificial Sequence
  Synthetic Polynucleotide
taatacgactcactatagggttgtaactgttgatgcacagtctgccactaaacagaggagatagtggatgactgtgcataacctggcggcagcgcaaaagatg

SEQ ID NO: 66874 - DNA, 103 bp, Artificial Sequence
  Synthetic Polynucleotide
taatacgactcactatagggctcatttgtaactgttgatgcacagtctgcaacagaggagagcagacatggcatcaacaaacctggcggcagcgcaaaagatg

SEQ ID NO: 66875 - DNA, 103 bp, Artificial Sequence
  Synthetic Polynucleotide
taatacgactcactatagggcagaactcatttgtaactgttgatgcacagaacagaggagactgtgcatgaacagttacaacctggcggcagcgcaaaagatg

SEQ ID NO: 66876 - DNA, 103 bp, Artificial Sequence
  Synthetic Polynucleotide
taatacgactcactatagggctgcacagaactcatttgtaactgttgatgaacagaggagacatcaaatgttacaaatgaacctggcggcagcgcaaaagatg

SEQ ID NO: 66877 - DNA, 103 bp, Artificial Sequence
  Synthetic Polynucleotide
taatacgactcactatagggatgatctgcacagaactcatttgtaactgtaacagaggagaacagttatgaatgagttcaacctggcggcagcgcaaaagatg

SEQ ID NO: 66878 - DNA, 103 bp, Artificial Sequence
  Synthetic Polynucleotide
taatacgactcactatagggaacggatgatctgcacagaactcatttgtaaacagaggagatacaaaatggttctgtgcaacctggcggcagcgcaaaagatg

SEQ ID NO: 66879 - DNA, 103 bp, Artificial Sequence
  Synthetic Polynucleotide
taatacgactcactatagggagatgaacggatgatctgcacagaactcataacagaggagaatgagtatggtgcagatcaacctggcggcagcgcaaaagatg

SEQ ID NO: 66880 - DNA, 103 bp, Artificial Sequence
  Synthetic Polynucleotide
taatacgactcactatagggcacatagatgaacggatgatctgcacagaaaacagaggagattctgtatggatcatccgaacctggcggcagcgcaaaagatg

SEQ ID NO: 66881 - DNA, 103 bp, Artificial Sequence
  Synthetic Polynucleotide
taatacgactcactatagggcttacacttcttattaagacattgagcccaaacagaggagatgggctatgtgtcttaataacctggcggcagcgcaaaagatg

SEQ ID NO: 66882 - DNA, 103 bp, Artificial Sequence
  Synthetic Polynucleotide
taatacgactcactatagggctaatcacatagatgaacggatgatctgcaaacagaggagatgcagaatgtccgttcataacctggcggcagcgcaaaagatg

SEQ ID NO: 66883 - DNA, 103 bp, Artificial Sequence
  Synthetic Polynucleotide
taatacgactcactatagggcatgcctaatcacatagatgaacggatgataacagaggagaatcatcatgtcatctatgaacctggcggcagcgcaaaagatg

SEQ ID NO: 66884 - DNA, 103 bp, Artificial Sequence
  Synthetic Polynucleotide
taatacgactcactatagggatcgacatgcctaatcacatagatgaacggaacagaggagaccgttcatgtatgtgattaacctggcggcagcgcaaaagatg

SEQ ID NO: 66885 - DNA, 103 bp, Artificial Sequence
  Synthetic Polynucleotide
taatacgactcactatagggttgccatcgacatgcctaatcacatagatgaacagaggagacatctaatggattaggcaaacctggcggcagcgcaaaagatg

SEQ ID NO: 66886 - DNA, 103 bp, Artificial Sequence
  Synthetic Polynucleotide
taatacgactcactataggggaattttgccatcgacatgcctaatcacataacagaggagaatgtgaatgggcatgtcgaacctggcggcagcgcaaaagatg

SEQ ID NO: 66887 - DNA, 103 bp, Artificial Sequence
  Synthetic Polynucleotide
taatacgactcactataggggaaaagaattttgccatcgacatgcctaataacagaggagaattaggatggtcgatggcaacctggcggcagcgcaaaagatg

SEQ ID NO: 66888 - DNA, 103 bp, Artificial Sequence
  Synthetic Polynucleotide
taatacgactcactatagggccaacgaaaagaattttgccatcgacatgcaacagaggagagcatgtatgtggcaaaataacctggcggcagcgcaaaagatg

SEQ ID NO: 66889 - DNA, 103 bp, Artificial Sequence
  Synthetic Polynucleotide
taatacgactcactatagggatctaccaacgaaaagaattttgccatcgaaacagaggagatcgatgatgaaattctttaacctggcggcagcgcaaaagatg

SEQ ID NO: 66890 - DNA, 103 bp, Artificial Sequence
  Synthetic Polynucleotide
taatacgactcactataggggcaatatctaccaacgaaaagaattttgccaacagaggagaggcaaaatgcttttcgttaacctggcggcagcgcaaaagatg

SEQ ID NO: 66891 - DNA, 103 bp, Artificial Sequence
  Synthetic Polynucleotide
taatacgactcactatagggggagagcaatatctaccaacgaaaagaattaacagaggagaaattctatgcgttggtagaacctggcggcagcgcaaaagatg

SEQ ID NO: 66892 - DNA, 103 bp, Artificial Sequence
  Synthetic Polynucleotide
taatacgactcactataggggtcctcttacacttcttattaagacattgaaacagaggagatcaatgatgtaataagaaaacctggcggcagcgcaaaagatg

SEQ ID NO: 66893 - DNA, 103 bp, Artificial Sequence
  Synthetic Polynucleotide
taatacgactcactatagggttgttggagagcaatatctaccaacgaaaaaacagaggagattttcgatggtagatattaacctggcggcagcgcaaaagatg

SEQ ID NO: 66894 - DNA, 103 bp, Artificial Sequence
  Synthetic Polynucleotide
taatacgactcactatagggattagttgttggagagcaatatctaccaacaacagaggagagttggtatgtattgctctaacctggcggcagcgcaaaagatg

SEQ ID NO: 66895 - DNA, 103 bp, Artificial Sequence
  Synthetic Polynucleotide
taatacgactcactataggggcttaattagttgttggagagcaatatctaaacagaggagatagataatgctctccaacaacctggcggcagcgcaaaagatg

SEQ ID NO: 66896 - DNA, 103 bp, Artificial Sequence
  Synthetic Polynucleotide
taatacgactcactatagggaatatgcttaattagttgttggagagcaataacagaggagaattgctatgcaacaactaaacctggcggcagcgcaaaagatg

SEQ ID NO: 66897 - DNA, 103 bp, Artificial Sequence
  Synthetic Polynucleotide
taatacgactcactatagggttaagaatatgcttaattagttgttggagaaacagaggagatctccaatgactaattaaaacctggcggcagcgcaaaagatg

SEQ ID NO: 66898 - DNA, 103 bp, Artificial Sequence
  Synthetic Polynucleotide
taatacgactcactatagggtaatattaagaatatgcttaattagttgttaacagaggagaaacaacatgttaagcataaacctggcggcagcgcaaaagatg

SEQ ID NO: 66899 - DNA, 103 bp, Artificial Sequence
  Synthetic Polynucleotide
taatacgactcactatagggtattctaatattaagaatatgcttaattagaacagaggagactaattatgcatattcttaacctggcggcagcgcaaaagatg

SEQ ID NO: 66900 - DNA, 103 bp, Artificial Sequence
  Synthetic Polynucleotide
taatacgactcactatagggtataatattctaatattaagaatatgcttaaacagaggagataagcaatgtcttaatataacctggcggcagcgcaaaagatg

SEQ ID NO: 66901 - DNA, 103 bp, Artificial Sequence
  Synthetic Polynucleotide
taatacgactcactatagggaactatataatattctaatattaagaatataacagaggagaatattcatgatattagaaaacctggcggcagcgcaaaagatg

SEQ ID NO: 66902 - DNA, 103 bp, Artificial Sequence
  Synthetic Polynucleotide
taatacgactcactatagggatcttaactatataatattctaatattaagaacagaggagacttaatatgagaatattaaacctggcggcagcgcaaaagatg

SEQ ID NO: 66903 - DNA, 103 bp, Artificial Sequence
  Synthetic Polynucleotide
taatacgactcactatagggtgtctaacgttacacaagggagtagaatataacagaggagaatattcatgtcccttgtgaacctggcggcagcgcaaaagatg

SEQ ID NO: 66904 - DNA, 103 bp, Artificial Sequence
  Synthetic Polynucleotide
taatacgactcactatagggagatagtcctcttacacttcttattaagacaacagaggagagtcttaatgagaagtgtaaacctggcggcagcgcaaaagatg

SEQ ID NO: 66905 - DNA, 103 bp, Artificial Sequence
  Synthetic Polynucleotide
taatacgactcactatagggaaaaaatcttaactatataatattctaataaacagaggagatattagatgattatatagaacctggcggcagcgcaaaagatg

SEQ ID NO: 66906 - DNA, 103 bp, Artificial Sequence
  Synthetic Polynucleotide
taatacgactcactatagggttttaaaaaaatcttaactatataatattcaacagaggagagaatatatgatagttaagaacctggcggcagcgcaaaagatg

SEQ ID NO: 66907 - DNA, 103 bp, Artificial Sequence
  Synthetic Polynucleotide
taatacgactcactatagggctattttttaaaaaaatcttaactatataaaacagaggagattatatatgtaagattttaacctggcggcagcgcaaaagatg

SEQ ID NO: 66908 - DNA, 103 bp, Artificial Sequence
  Synthetic Polynucleotide
taatacgactcactatagggtttttctattttttaaaaaaatcttaactaaacagaggagatagttaatgtttttttaaaacctggcggcagcgcaaaagatg

SEQ ID NO: 66909 - DNA, 103 bp, Artificial Sequence
  Synthetic Polynucleotide
taatacgactcactatagggcatgttttttctattttttaaaaaaatcttaacagaggagaaagattatgttaaaaaataacctggcggcagcgcaaaagatg

SEQ ID NO: 66910 - DNA, 103 bp, Artificial Sequence
  Synthetic Polynucleotide
taatacgactcactatagggtaccacatgttttttctattttttaaaaaaaacagaggagattttttatgaaatagaaaaacctggcggcagcgcaaaagatg

SEQ ID NO: 66911 - DNA, 103 bp, Artificial Sequence
  Synthetic Polynucleotide
taatacgactcactatagggactaataccacatgttttttctattttttaaacagaggagataaaaaatggaaaaaacaaacctggcggcagcgcaaaagatg

SEQ ID NO: 66912 - DNA, 103 bp, Artificial Sequence
  Synthetic Polynucleotide
taatacgactcactatagggcctgcactaataccacatgttttttctattaacagaggagaaatagaatgaacatgtggaacctggcggcagcgcaaaagatg

SEQ ID NO: 66913 - DNA, 103 bp, Artificial Sequence
  Synthetic Polynucleotide
taatacgactcactatagggaacgacctgcactaataccacatgttttttaacagaggagaaaaaaaatggtggtattaaacctggcggcagcgcaaaagatg

SEQ ID NO: 66914 - DNA, 103 bp, Artificial Sequence
  Synthetic Polynucleotide
taatacgactcactataggggaaataacgacctgcactaataccacatgtaacagaggagaacatgtatgattagtgcaaacctggcggcagcgcaaaagatg

SEQ ID NO: 66915 - DNA, 103 bp, Artificial Sequence
  Synthetic Polynucleotide
taatacgactcactatagggtttggagatagtcctcttacacttcttattaacagaggagaaataagatgtgtaagaggaacctggcggcagcgcaaaagatg

SEQ ID NO: 66916 - DNA, 103 bp, Artificial Sequence
  Synthetic Polynucleotide
taatacgactcactatagggtgggagaaataacgacctgcactaataccaaacagaggagatggtatatgtgcaggtcgaacctggcggcagcgcaaaagatg

SEQ ID NO: 66917 - DNA, 103 bp, Artificial Sequence
  Synthetic Polynucleotide
taatacgactcactatagggtgcaatgggagaaataacgacctgcactaaaacagaggagattagtgatggtcgttattaacctggcggcagcgcaaaagatg

SEQ ID NO: 66918 - DNA, 103 bp, Artificial Sequence
  Synthetic Polynucleotide
taatacgactcactatagggccaattgcaatgggagaaataacgacctgcaacagaggagagcaggtatgtatttctccaacctggcggcagcgcaaaagatg

SEQ ID NO: 66919 - DNA, 103 bp, Artificial Sequence
  Synthetic Polynucleotide
taatacgactcactatagggtcttaccaattgcaatgggagaaataacgaaacagaggagatcgttaatgctcccattgaacctggcggcagcgcaaaagatg

SEQ ID NO: 66920 - DNA, 103 bp, Artificial Sequence
  Synthetic Polynucleotide
taatacgactcactatagggcgtcatcttaccaattgcaatgggagaaataacagaggagaatttctatgattgcaattaacctggcggcagcgcaaaagatg

SEQ ID NO: 66921 - DNA, 103 bp, Artificial Sequence
  Synthetic Polynucleotide
taatacgactcactatagggttggccgtcatcttaccaattgcaatgggaaacagaggagatcccatatgaattggtaaaacctggcggcagcgcaaaagatg

SEQ ID NO: 66922 - DNA, 103 bp, Artificial Sequence
  Synthetic Polynucleotide
taatacgactcactatagggtaaagttggccgtcatcttaccaattgcaaaacagaggagattgcaaatggtaagatgaaacctggcggcagcgcaaaagatg

SEQ ID NO: 66923 - DNA, 103 bp, Artificial Sequence
  Synthetic Polynucleotide
taatacgactcactatagggggtactaaagttggccgtcatcttaccaataacagaggagaattggtatgatgacggccaacctggcggcagcgcaaaagatg

SEQ ID NO: 66924 - DNA, 103 bp, Artificial Sequence
  Synthetic Polynucleotide
taatacgactcactatagggacgtgggtactaaagttggccgtcatcttaaacagaggagataagatatgggccaacttaacctggcggcagcgcaaaagatg

SEQ ID NO: 66925 - DNA, 103 bp, Artificial Sequence
  Synthetic Polynucleotide
taatacgactcactatagggaaaagacgtgggtactaaagttggccgtcaaacagaggagatgacggatgactttagtaaacctggcggcagcgcaaaagatg

SEQ ID NO: 66926 - DNA, 103 bp, Artificial Sequence
  Synthetic Polynucleotide
taatacgactcactatagggacaaatttggagatagtcctcttacacttcaacagaggagagaagtgatggaggactataacctggcggcagcgcaaaagatg

SEQ ID NO: 66927 - DNA, 103 bp, Artificial Sequence
  Synthetic Polynucleotide
taatacgactcactatagggtggtgaaaagacgtgggtactaaagttggcaacagaggagagccaacatgagtacccacaacctggcggcagcgcaaaagatg

SEQ ID NO: 66928 - DNA, 103 bp, Artificial Sequence
  Synthetic Polynucleotide
taatacgactcactatagggtgctgtggtgaaaagacgtgggtactaaagaacagaggagactttagatgccacgtcttaacctggcggcagcgcaaaagatg

SEQ ID NO: 66929 - DNA, 103 bp, Artificial Sequence
  Synthetic Polynucleotide
taatacgactcactatagggcacagtgctgtggtgaaaagacgtgggtacaacagaggagagtacccatgtcttttcacaacctggcggcagcgcaaaagatg

SEQ ID NO: 66930 - DNA, 103 bp, Artificial Sequence
  Synthetic Polynucleotide
taatacgactcactatagggacatccacagtgctgtggtgaaaagacgtgaacagaggagacacgtcatgtcaccacagaacctggcggcagcgcaaaagatg

SEQ ID NO: 66931 - DNA, 103 bp, Artificial Sequence
  Synthetic Polynucleotide
taatacgactcactatagggctgtcacatccacagtgctgtggtgaaaagaacagaggagacttttcatgacagcactgaacctggcggcagcgcaaaagatg

SEQ ID NO: 66932 - DNA, 103 bp, Artificial Sequence
  Synthetic Polynucleotide
taatacgactcactatagggtcagtctgtcacatccacagtgctgtggtgaacagaggagacaccacatgactgtggataacctggcggcagcgcaaaagatg

SEQ ID NO: 66933 - DNA, 103 bp, Artificial Sequence
  Synthetic Polynucleotide
taatacgactcactatagggactggtcagtctgtcacatccacagtgctgaacagaggagacagcacatgggatgtgacaacctggcggcagcgcaaaagatg

SEQ ID NO: 66934 - DNA, 103 bp, Artificial Sequence
  Synthetic Polynucleotide
taatacgactcactatagggtcaatactggtcagtctgtcacatccacagaacagaggagactgtggatgtgacagactaacctggcggcagcgcaaaagatg

SEQ ID NO: 66935 - DNA, 103 bp, Artificial Sequence
  Synthetic Polynucleotide
taatacgactcactatagggcgtcatcaatactggtcagtctgtcacatcaacagaggagagatgtgatggactgaccaaacctggcggcagcgcaaaagatg

SEQ ID NO: 66936 - DNA, 103 bp, Artificial Sequence
  Synthetic Polynucleotide
taatacgactcactatagggtctgacgtcatcaatactggtcagtctgtcaacagaggagagacagaatgaccagtattaacctggcggcagcgcaaaagatg

SEQ ID NO: 66937 - DNA, 103 bp, Artificial Sequence
  Synthetic Polynucleotide
taatacgactcactatagggacaaaacaaatttggagatagtcctcttacaacagaggagagtaagaatgctatctccaaacctggcggcagcgcaaaagatg

SEQ ID NO: 66938 - DNA, 103 bp, Artificial Sequence
  Synthetic Polynucleotide
taatacgactcactatagggcattgtctgacgtcatcaatactggtcagtaacagaggagaactgacatgtattgatgaaacctggcggcagcgcaaaagatg

SEQ ID NO: 66939 - DNA, 103 bp, Artificial Sequence
  Synthetic Polynucleotide
taatacgactcactatagggtcaaacattgtctgacgtcatcaatactggaacagaggagaccagtaatgatgacgtcaaacctggcggcagcgcaaaagatg

SEQ ID NO: 66940 - DNA, 103 bp, Artificial Sequence
  Synthetic Polynucleotide
taatacgactcactatagggttcagtcaaacattgtctgacgtcatcaataacagaggagaattgatatggtcagacaaaacctggcggcagcgcaaaagatg

SEQ ID NO: 66941 - DNA, 103 bp, Artificial Sequence
  Synthetic Polynucleotide
taatacgactcactatagggatatattcagtcaaacattgtctgacgtcaaacagaggagatgacgtatgacaatgtttaacctggcggcagcgcaaaagatg

SEQ ID NO: 66942 - DNA, 103 bp, Artificial Sequence
  Synthetic Polynucleotide
taatacgactcactatagggaataaatatattcagtcaaacattgtctgaaacagaggagatcagacatggtttgactgaacctggcggcagcgcaaaagatg

SEQ ID NO: 66943 - DNA, 103 bp, Artificial Sequence
  Synthetic Polynucleotide
taatacgactcactatagggcgaccaataaatatattcagtcaaacattgaacagaggagacaatgtatgactgaatataacctggcggcagcgcaaaagatg

SEQ ID NO: 66944 - DNA, 103 bp, Artificial Sequence
  Synthetic Polynucleotide
taatacgactcactatagggtaggacgaccaataaatatattcagtcaaaaacagaggagatttgacatgatatatttaaacctggcggcagcgcaaaagatg

SEQ ID NO: 66945 - DNA, 103 bp, Artificial Sequence
  Synthetic Polynucleotide
taatacgactcactatagggatgcataggacgaccaataaatatattcagaacagaggagactgaatatgtttattggtaacctggcggcagcgcaaaagatg

SEQ ID NO: 66946 - DNA, 103 bp, Artificial Sequence
  Synthetic Polynucleotide
taatacgactcactataggggcggtatgcataggacgaccaataaatataaacagaggagatatattatgtggtcgtccaacctggcggcagcgcaaaagatg

SEQ ID NO: 66947 - DNA, 103 bp, Artificial Sequence
  Synthetic Polynucleotide
taatacgactcactatagggctgttgcggtatgcataggacgaccaataaaacagaggagattattgatggtcctatgcaacctggcggcagcgcaaaagatg

SEQ ID NO: 66948 - DNA, 103 bp, Artificial Sequence
  Synthetic Polynucleotide
taatacgactcactatagggaataaacaaaacaaatttggagatagtcctaacagaggagaaggactatgtccaaatttaacctggcggcagcgcaaaagatg

SEQ ID NO: 66949 - DNA, 103 bp, Artificial Sequence
  Synthetic Polynucleotide
taatacgactcactatagggattgcctgttgcggtatgcataggacgaccaacagaggagaggtcgtatgatgcataccaacctggcggcagcgcaaaagatg

SEQ ID NO: 66950 - DNA, 103 bp, Artificial Sequence
  Synthetic Polynucleotide
taatacgactcactatagggagcgcattgcctgttgcggtatgcataggaaacagaggagatcctatatgtaccgcaacaacctggcggcagcgcaaaagatg

SEQ ID NO: 66951 - DNA, 103 bp, Artificial Sequence
  Synthetic Polynucleotide
taatacgactcactatagggtgtccagcgcattgcctgttgcggtatgcaaacagaggagatgcataatgcaacaggcaaacctggcggcagcgcaaaagatg

SEQ ID NO: 66952 - DNA, 103 bp, Artificial Sequence
  Synthetic Polynucleotide
taatacgactcactatagggacaactgtccagcgcattgcctgttgcggtaacagaggagaaccgcaatgggcaatgcgaacctggcggcagcgcaaaagatg

SEQ ID NO: 66953 - DNA, 103 bp, Artificial Sequence
  Synthetic Polynucleotide
taatacgactcactatagggggaatacaactgtccagcgcattgcctgttaacagaggagaaacaggatgtgcgctggaaacctggcggcagcgcaaaagatg

SEQ ID NO: 66954 - DNA, 103 bp, Artificial Sequence
  Synthetic Polynucleotide
taatacgactcactatagggagtgtggaatacaactgtccagcgcattgcaacagaggagagcaatgatgtggacagttaacctggcggcagcgcaaaagatg

SEQ ID NO: 66955 - DNA, 103 bp, Artificial Sequence
  Synthetic Polynucleotide
taatacgactcactatagggagaggagtgtggaatacaactgtccagcgcaacagaggagagcgctgatgagttgtattaacctggcggcagcgcaaaagatg

SEQ ID NO: 66956 - DNA, 103 bp, Artificial Sequence
  Synthetic Polynucleotide
taatacgactcactatagggaaaagagaggagtgtggaatacaactgtccaacagaggagaggacagatgtattccacaaacctggcggcagcgcaaaagatg

SEQ ID NO: 66957 - DNA, 103 bp, Artificial Sequence
  Synthetic Polynucleotide
taatacgactcactatagggtctctaaaagagaggagtgtggaatacaacaacagaggagagttgtaatgcacactcctaacctggcggcagcgcaaaagatg

SEQ ID NO: 66958 - DNA, 103 bp, Artificial Sequence
  Synthetic Polynucleotide
taatacgactcactatagggcatcatctctaaaagagaggagtgtggaataacagaggagaattccaatgtcctctcttaacctggcggcagcgcaaaagatg

SEQ ID NO: 66959 - DNA, 103 bp, Artificial Sequence
  Synthetic Polynucleotide
taatacgactcactatagggatgttaataaacaaaacaaatttggagataaacagaggagatatctcatgatttgttttaacctggcggcagcgcaaaagatg

SEQ ID NO: 66960 - DNA, 103 bp, Artificial Sequence
  Synthetic Polynucleotide
taatacgactcactatagggttccgcatcatctctaaaagagaggagtgtaacagaggagaacactcatgtcttttagaaacctggcggcagcgcaaaagatg

SEQ ID NO: 66961 - DNA, 103 bp, Artificial Sequence
  Synthetic Polynucleotide
taatacgactcactatagggactgattccgcatcatctctaaaagagaggaacagaggagacctctcatgtagagatgaaacctggcggcagcgcaaaagatg

SEQ ID NO: 66962 - DNA, 103 bp, Artificial Sequence
  Synthetic Polynucleotide
taatacgactcactatagggtgaacactgattccgcatcatctctaaaagaacagaggagacttttaatgatgatgcggaacctggcggcagcgcaaaagatg

SEQ ID NO: 66963 - DNA, 103 bp, Artificial Sequence
  Synthetic Polynucleotide
taatacgactcactatagggatcgatgaacactgattccgcatcatctctaacagaggagaagagatatggcggaatcaaacctggcggcagcgcaaaagatg

SEQ ID NO: 66964 - DNA, 103 bp, Artificial Sequence
  Synthetic Polynucleotide
taatacgactcactatagggcgaacatcgatgaacactgattccgcatcaaacagaggagatgatgcatgatcagtgttaacctggcggcagcgcaaaagatg

SEQ ID NO: 66965 - DNA, 103 bp, Artificial Sequence
  Synthetic Polynucleotide
taatacgactcactataggggctcgcgaacatcgatgaacactgattccgaacagaggagacggaatatgtgttcatcgaacctggcggcagcgcaaaagatg

SEQ ID NO: 66966 - DNA, 103 bp, Artificial Sequence
  Synthetic Polynucleotide
taatacgactcactatagggcaccagctcgcgaacatcgatgaacactgaaacagaggagatcagtgatgatcgatgttaacctggcggcagcgcaaaagatg

SEQ ID NO: 66967 - DNA, 103 bp, Artificial Sequence
  Synthetic Polynucleotide
taatacgactcactatagggtttttcaccagctcgcgaacatcgatgaacaacagaggagagttcatatgtgttcgcgaaacctggcggcagcgcaaaagatg

SEQ ID NO: 66968 - DNA, 103 bp, Artificial Sequence
  Synthetic Polynucleotide
taatacgactcactataggggcatatttttcaccagctcgcgaacatcgaaacagaggagatcgatgatggcgagctggaacctggcggcagcgcaaaagatg

SEQ ID NO: 66969 - DNA, 103 bp, Artificial Sequence
  Synthetic Polynucleotide
taatacgactcactatagggccacggcatatttttcaccagctcgcgaacaacagaggagagttcgcatgctggtgaaaaacctggcggcagcgcaaaagatg

SEQ ID NO: 66970 - DNA, 103 bp, Artificial Sequence
  Synthetic Polynucleotide
taatacgactcactatagggaacggatgttaataaacaaaacaaatttggaacagaggagaccaaatatgttttgtttaaacctggcggcagcgcaaaagatg

SEQ ID NO: 66971 - DNA, 103 bp, Artificial Sequence
  Synthetic Polynucleotide
taatacgactcactatagggtcatcccacggcatatttttcaccagctcgaacagaggagacgagctatggaaaaatataacctggcggcagcgcaaaagatg

SEQ ID NO: 66972 - DNA, 103 bp, Artificial Sequence
  Synthetic Polynucleotide
taatacgactcactatagggtgacatcatcccacggcatatttttcaccaaacagaggagatggtgaatgatatgccgtaacctggcggcagcgcaaaagatg

SEQ ID NO: 66973 - DNA, 103 bp, Artificial Sequence
  Synthetic Polynucleotide
taatacgactcactatagggatctttgacatcatcccacggcatatttttaacagaggagaaaaaatatgccgtgggataacctggcggcagcgcaaaagatg

SEQ ID NO: 66974 - DNA, 103 bp, Artificial Sequence
  Synthetic Polynucleotide
taatacgactcactatagggacacaatctttgacatcatcccacggcataaacagaggagatatgccatgggatgatgtaacctggcggcagcgcaaaagatg

SEQ ID NO: 66975 - DNA, 103 bp, Artificial Sequence
  Synthetic Polynucleotide
taatacgactcactatagggtttctacacaatctttgacatcatcccacgaacagaggagacgtgggatgatgtcaaagaacctggcggcagcgcaaaagatg

SEQ ID NO: 66976 - DNA, 103 bp, Artificial Sequence
  Synthetic Polynucleotide
taatacgactcactataggggatgatttctacacaatctttgacatcatcaacagaggagagatgatatgaaagattgtaacctggcggcagcgcaaaagatg

SEQ ID NO: 66977 - DNA, 103 bp, Artificial Sequence
  Synthetic Polynucleotide
taatacgactcactatagggcaacggatgatttctacacaatctttgacaaacagaggagatgtcaaatgttgtgtagaaacctggcggcagcgcaaaagatg

SEQ ID NO: 66978 - DNA, 103 bp, Artificial Sequence
  Synthetic Polynucleotide
taatacgactcactatagggtataacaacggatgatttctacacaatcttaacagaggagaaagattatgtagaaatcaaacctggcggcagcgcaaaagatg

SEQ ID NO: 66979 - DNA, 103 bp, Artificial Sequence
  Synthetic Polynucleotide
taatacgactcactatagggcggtatataacaacggatgatttctacacaaacagaggagatgtgtaatgatcatccgtaacctggcggcagcgcaaaagatg

SEQ ID NO: 66980 - DNA, 103 bp, Artificial Sequence
  Synthetic Polynucleotide
taatacgactcactatagggtcatccggtatataacaacggatgatttctaacagaggagaagaaatatgccgttgttaaacctggcggcagcgcaaaagatg

SEQ ID NO: 66981 - DNA, 103 bp, Artificial Sequence
  Synthetic Polynucleotide
taatacgactcactatagggccatcaacggatgttaataaacaaaacaaaaacagaggagatttgttatgtttattaacaacctggcggcagcgcaaaagatg

SEQ ID NO: 66982 - DNA, 103 bp, Artificial Sequence
  Synthetic Polynucleotide
taatacgactcactatagggtttgctcatccggtatataacaacggatgaaacagaggagatcatccatggttatatacaacctggcggcagcgcaaaagatg

SEQ ID NO: 66983 - DNA, 103 bp, Artificial Sequence
  Synthetic Polynucleotide
taatacgactcactatagggggttttttgctcatccggtatataacaacgaacagaggagacgttgtatgataccggataacctggcggcagcgcaaaagatg

SEQ ID NO: 66984 - DNA, 103 bp, Artificial Sequence
  Synthetic Polynucleotide
taatacgactcactatagggctgatggttttttgctcatccggtatataaaacagaggagattatatatgggatgagcaaacctggcggcagcgcaaaagatg

SEQ ID NO: 66985 - DNA, 103 bp, Artificial Sequence
  Synthetic Polynucleotide
taatacgactcactatagggtctctctgatggttttttgctcatccggtaaacagaggagataccggatgagcaaaaaaaacctggcggcagcgcaaaagatg

SEQ ID NO: 66986 - DNA, 103 bp, Artificial Sequence
  Synthetic Polynucleotide
taatacgactcactatagggcgaaatctctctgatggttttttgctcatcaacagaggagagatgagatgaaaaccatcaacctggcggcagcgcaaaagatg

SEQ ID NO: 66987 - DNA, 103 bp, Artificial Sequence
  Synthetic Polynucleotide
taatacgactcactatagggatggccgaaatctctctgatggttttttgcaacagaggagagcaaaaatgcatcagagaaacctggcggcagcgcaaaagatg

SEQ ID NO: 66988 - DNA, 103 bp, Artificial Sequence
  Synthetic Polynucleotide
taatacgactcactatagggcgatgatggccgaaatctctctgatggtttaacagaggagaaaaccaatggagagatttaacctggcggcagcgcaaaagatg

SEQ ID NO: 66989 - DNA, 103 bp, Artificial Sequence
  Synthetic Polynucleotide
taatacgactcactatagggaagtccgatgatggccgaaatctctctgataacagaggagaatcagaatgatttcggccaacctggcggcagcgcaaaagatg

SEQ ID NO: 66990 - DNA, 103 bp, Artificial Sequence
  Synthetic Polynucleotide
taatacgactcactataggggcacaaagtccgatgatggccgaaatctctaacagaggagaagagatatgggccatcataacctggcggcagcgcaaaagatg

SEQ ID NO: 66991 - DNA, 103 bp, Artificial Sequence
  Synthetic Polynucleotide
taatacgactcactatagggcatatgcacaaagtccgatgatggccgaaaaacagaggagatttcggatgtcatcggacaacctggcggcagcgcaaaagatg

SEQ ID NO: 66992 - DNA, 103 bp, Artificial Sequence
  Synthetic Polynucleotide
taatacgactcactatagggtacttccatcaacggatgttaataaacaaaaacagaggagatttgttatgtaacatccgaacctggcggcagcgcaaaagatg

SEQ ID NO: 66993 - DNA, 103 bp, Artificial Sequence
  Synthetic Polynucleotide
taatacgactcactatagggagcagcatatgcacaaagtccgatgatggcaacagaggagagccatcatgggactttgtaacctggcggcagcgcaaaagatg

SEQ ID NO: 66994 - DNA, 103 bp, Artificial Sequence
  Synthetic Polynucleotide
taatacgactcactatagggtaagtagcagcatatgcacaaagtccgatgaacagaggagacatcggatgttgtgcataaacctggcggcagcgcaaaagatg

SEQ ID NO: 66995 - DNA, 103 bp, Artificial Sequence
  Synthetic Polynucleotide
taatacgactcactatagggcccagtaagtagcagcatatgcacaaagtcaacagaggagagactttatgcatatgctgaacctggcggcagcgcaaaagatg

SEQ ID NO: 66996 - DNA, 103 bp, Artificial Sequence
  Synthetic Polynucleotide
taatacgactcactataggggcctccccagtaagtagcagcatatgcacaaacagaggagatgtgcaatggctgctactaacctggcggcagcgcaaaagatg

SEQ ID NO: 66997 - DNA, 103 bp, Artificial Sequence
  Synthetic Polynucleotide
taatacgactcactatagggtcttcgcctccccagtaagtagcagcatataacagaggagaatatgcatgtacttactgaacctggcggcagcgcaaaagatg

SEQ ID NO: 66998 - DNA, 103 bp, Artificial Sequence
  Synthetic Polynucleotide
taatacgactcactataggggatggtcttcgcctccccagtaagtagcagaacagaggagactgctaatgactggggagaacctggcggcagcgcaaaagatg

SEQ ID NO: 66999 - DNA, 103 bp, Artificial Sequence
  Synthetic Polynucleotide
taatacgactcactatagggagtgggatggtcttcgcctccccagtaagtaacagaggagaacttacatgggaggcgaaaacctggcggcagcgcaaaagatg

SEQ ID NO: 67000 - DNA, 103 bp, Artificial Sequence
  Synthetic Polynucleotide
taatacgactcactatagggttactagtgggatggtcttcgcctccccagaacagaggagactggggatgcgaagaccaaacctggcggcagcgcaaaagatg

SEQ ID NO: 67001 - DNA, 103 bp, Artificial Sequence
  Synthetic Polynucleotide
taatacgactcactataggggactgttactagtgggatggtcttcgcctcaacagaggagagaggcgatgaccatcccaaacctggcggcagcgcaaaagatg

SEQ ID NO: 67002 - DNA, 103 bp, Artificial Sequence
  Synthetic Polynucleotide
taatacgactcactataggggttcagactgttactagtgggatggtcttcaacagaggagagaagacatgcccactagtaacctggcggcagcgcaaaagatg

SEQ ID NO: 67003 - DNA, 103 bp, Artificial Sequence
  Synthetic Polynucleotide
taatacgactcactatagggtcttttacttccatcaacggatgttaataaaacagaggagattattaatgtccgttgataacctggcggcagcgcaaaagatg

SEQ ID NO: 67004 - DNA, 103 bp, Artificial Sequence
  Synthetic Polynucleotide
taatacgactcactatagggaatgcgttcagactgttactagtgggatggaacagaggagaccatccatgtagtaacagaacctggcggcagcgcaaaagatg

SEQ ID NO: 67005 - DNA, 103 bp, Artificial Sequence
  Synthetic Polynucleotide
taatacgactcactatagggcaaacaatgcgttcagactgttactagtggaacagaggagaccactaatgacagtctgaaacctggcggcagcgcaaaagatg

SEQ ID NO: 67006 - DNA, 103 bp, Artificial Sequence
  Synthetic Polynucleotide
taatacgactcactatagggcatcacaaacaatgcgttcagactgttactaacagaggagaagtaacatgctgaacgcaaacctggcggcagcgcaaaagatg

SEQ ID NO: 67007 - DNA, 103 bp, Artificial Sequence
  Synthetic Polynucleotide
taatacgactcactatagggttaagcatcacaaacaatgcgttcagactgaacagaggagacagtctatgcgcattgttaacctggcggcagcgcaaaagatg

SEQ ID NO: 67008 - DNA, 103 bp, Artificial Sequence
  Synthetic Polynucleotide
taatacgactcactataggggcattttaagcatcacaaacaatgcgttcaaacagaggagatgaacgatgtgtttgtgaaacctggcggcagcgcaaaagatg

SEQ ID NO: 67009 - DNA, 103 bp, Artificial Sequence
  Synthetic Polynucleotide
taatacgactcactatagggattgagcattttaagcatcacaaacaatgcaacagaggagagcattgatggtgatgcttaacctggcggcagcgcaaaagatg

SEQ ID NO: 67010 - DNA, 103 bp, Artificial Sequence
  Synthetic Polynucleotide
taatacgactcactatagggacgtaattgagcattttaagcatcacaaacaacagaggagagtttgtatggcttaaaataacctggcggcagcgcaaaagatg

SEQ ID NO: 67011 - DNA, 103 bp, Artificial Sequence
  Synthetic Polynucleotide
taatacgactcactatagggaatccacgtaattgagcattttaagcatcaaacagaggagatgatgcatgaaatgctcaaacctggcggcagcgcaaaagatg

SEQ ID NO: 67012 - DNA, 103 bp, Artificial Sequence
  Synthetic Polynucleotide
taatacgactcactataggggttataatccacgtaattgagcattttaagaacagaggagacttaaaatgctcaattacaacctggcggcagcgcaaaagatg

SEQ ID NO: 67013 - DNA, 103 bp, Artificial Sequence
  Synthetic Polynucleotide
taatacgactcactatagggatgatgttataatccacgtaattgagcattaacagaggagaaatgctatgttacgtggaaacctggcggcagcgcaaaagatg

SEQ ID NO: 67014 - DNA, 103 bp, Artificial Sequence
  Synthetic Polynucleotide
taatacgactcactatagggtagaatgtctaacgttacacaagggagtagaacagaggagactactcatgtgtgtaacgaacctggcggcagcgcaaaagatg

SEQ ID NO: 67015 - DNA, 103 bp, Artificial Sequence
  Synthetic Polynucleotide
taatacgactcactatagggataaatcttttacttccatcaacggatgttaacagaggagaaacatcatgtgatggaagaacctggcggcagcgcaaaagatg

SEQ ID NO: 67016 - DNA, 103 bp, Artificial Sequence
  Synthetic Polynucleotide
taatacgactcactatagggggaatatgatgttataatccacgtaattgaaacagaggagatcaattatgtggattataaacctggcggcagcgcaaaagatg

SEQ ID NO: 67017 - DNA, 103 bp, Artificial Sequence
  Synthetic Polynucleotide
taatacgactcactatagggacgccggaatatgatgttataatccacgtaaacagaggagatacgtgatgtataacatcaacctggcggcagcgcaaaagatg

SEQ ID NO: 67018 - DNA, 103 bp, Artificial Sequence
  Synthetic Polynucleotide
taatacgactcactatagggttcatacgccggaatatgatgttataatccaacagaggagaggattaatgcatcatattaacctggcggcagcgcaaaagatg

SEQ ID NO: 67019 - DNA, 103 bp, Artificial Sequence
  Synthetic Polynucleotide
taatacgactcactataggggtcaattcatacgccggaatatgatgttataacagaggagaataacaatgtattccggcaacctggcggcagcgcaaaagatg

SEQ ID NO: 67020 - DNA, 103 bp, Artificial Sequence
  Synthetic Polynucleotide
taatacgactcactataggggaaatgtcaattcatacgccggaatatgataacagaggagaatcataatgcggcgtatgaacctggcggcagcgcaaaagatg

SEQ ID NO: 67021 - DNA, 103 bp, Artificial Sequence
  Synthetic Polynucleotide
taatacgactcactatagggagggagaaatgtcaattcatacgccggaataacagaggagaattccgatgtatgaattgaacctggcggcagcgcaaaagatg

SEQ ID NO: 67022 - DNA, 103 bp, Artificial Sequence
  Synthetic Polynucleotide
taatacgactcactataggggggaaagggagaaatgtcaattcatacgccaacagaggagaggcgtaatgattgacattaacctggcggcagcgcaaaagatg

SEQ ID NO: 67023 - DNA, 103 bp, Artificial Sequence
  Synthetic Polynucleotide
taatacgactcactatagggtttctgggaaagggagaaatgtcaattcataacagaggagaatgaatatgcatttctccaacctggcggcagcgcaaaagatg

SEQ ID NO: 67024 - DNA, 103 bp, Artificial Sequence
  Synthetic Polynucleotide
taatacgactcactataggggtttatttctgggaaagggagaaatgtcaaaacagaggagattgacaatgctccctttcaacctggcggcagcgcaaaagatg

SEQ ID NO: 67025 - DNA, 103 bp, Artificial Sequence
  Synthetic Polynucleotide
taatacgactcactatagggaaaaagtttatttctgggaaagggagaaataacagaggagaatttctatgtttcccagaaacctggcggcagcgcaaaagatg

SEQ ID NO: 67026 - DNA, 103 bp, Artificial Sequence
  Synthetic Polynucleotide
taatacgactcactatagggacattataaatcttttacttccatcaacggaacagaggagaccgttgatggaagtaaaaaacctggcggcagcgcaaaagatg

SEQ ID NO: 67027 - DNA, 103 bp, Artificial Sequence
  Synthetic Polynucleotide
taatacgactcactataggggggtaaaaaagtttatttctgggaaagggaaacagaggagatcccttatgcagaaataaaacctggcggcagcgcaaaagatg

SEQ ID NO: 67028 - DNA, 103 bp, Artificial Sequence
  Synthetic Polynucleotide
taatacgactcactatagggatagtgggtaaaaaagtttatttctgggaaaacagaggagattcccaatgataaactttaacctggcggcagcgcaaaagatg

SEQ ID NO: 67029 - DNA, 103 bp, Artificial Sequence
  Synthetic Polynucleotide
taatacgactcactatagggattttatagtgggtaaaaaagtttatttctaacagaggagaagaaatatgcttttttacaacctggcggcagcgcaaaagatg

SEQ ID NO: 67030 - DNA, 103 bp, Artificial Sequence
  Synthetic Polynucleotide
taatacgactcactatagggcttttattttatagtgggtaaaaaagtttaaacagaggagataaactatgttacccactaacctggcggcagcgcaaaagatg

SEQ ID NO: 67031 - DNA, 103 bp, Artificial Sequence
  Synthetic Polynucleotide
taatacgactcactatagggatactcttttattttatagtgggtaaaaaaaacagaggagattttttatgcactataaaaacctggcggcagcgcaaaagatg

SEQ ID NO: 67032 - DNA, 103 bp, Artificial Sequence
  Synthetic Polynucleotide
taatacgactcactataggggtagtatactcttttattttatagtgggtaaacagaggagatacccaatgtaaaataaaaacctggcggcagcgcaaaagatg

SEQ ID NO: 67033 - DNA, 103 bp, Artificial Sequence
  Synthetic Polynucleotide
taatacgactcactatagggaataggtagtatactcttttattttatagtaacagaggagaactataatgtaaaagagtaacctggcggcagcgcaaaagatg

SEQ ID NO: 67034 - DNA, 103 bp, Artificial Sequence
  Synthetic Polynucleotide
taatacgactcactatagggaatataataggtagtatactcttttattttaacagaggagaaaaataatggagtatactaacctggcggcagcgcaaaagatg

SEQ ID NO: 67035 - DNA, 103 bp, Artificial Sequence
  Synthetic Polynucleotide
taatacgactcactataggggaagaaatataataggtagtatactcttttaacagaggagaaaaagaatgtactacctaaacctggcggcagcgcaaaagatg

SEQ ID NO: 67036 - DNA, 103 bp, Artificial Sequence
  Synthetic Polynucleotide
taatacgactcactatagggtataggaagaaatataataggtagtatactaacagaggagaagtataatgcctattataaacctggcggcagcgcaaaagatg

SEQ ID NO: 67037 - DNA, 103 bp, Artificial Sequence
  Synthetic Polynucleotide
taatacgactcactatagggtgtagacattataaatcttttacttccatcaacagaggagagatggaatgaaaagatttaacctggcggcagcgcaaaagatg

SEQ ID NO: 67038 - DNA, 103 bp, Artificial Sequence
  Synthetic Polynucleotide
taatacgactcactatagggaaaaatataggaagaaatataataggtagtaacagaggagaactaccatgtatatttctaacctggcggcagcgcaaaagatg

SEQ ID NO: 67039 - DNA, 103 bp, Artificial Sequence
  Synthetic Polynucleotide
taatacgactcactataggggaataaaaaatataggaagaaatataatagaacagaggagactattaatgttcttcctaaacctggcggcagcgcaaaagatg

SEQ ID NO: 67040 - DNA, 103 bp, Artificial Sequence
  Synthetic Polynucleotide
taatacgactcactatagggatgaagaataaaaaatataggaagaaatataacagaggagaatatttatgcctatatttaacctggcggcagcgcaaaagatg

SEQ ID NO: 67041 - DNA, 103 bp, Artificial Sequence
  Synthetic Polynucleotide
taatacgactcactatagggaactaatgaagaataaaaaatataggaagaaacagaggagatcttccatgattttttataacctggcggcagcgcaaaagatg

SEQ ID NO: 67042 - DNA, 103 bp, Artificial Sequence
  Synthetic Polynucleotide
taatacgactcactataggggtcgtaactaatgaagaataaaaaatatagaacagaggagactatatatgttattcttcaacctggcggcagcgcaaaagatg

SEQ ID NO: 67043 - DNA, 103 bp, Artificial Sequence
  Synthetic Polynucleotide
taatacgactcactatagggtaaaagtcgtaactaatgaagaataaaaaaaacagaggagattttttatgcttcattagaacctggcggcagcgcaaaagatg

SEQ ID NO: 67044 - DNA, 103 bp, Artificial Sequence
  Synthetic Polynucleotide
taatacgactcactatagggtgtgttaaaagtcgtaactaatgaagaataaacagaggagatattctatgttagttacgaacctggcggcagcgcaaaagatg

SEQ ID NO: 67045 - DNA, 103 bp, Artificial Sequence
  Synthetic Polynucleotide
taatacgactcactatagggttaggtgtgttaaaagtcgtaactaatgaaaacagaggagattcattatgtacgactttaacctggcggcagcgcaaaagatg

SEQ ID NO: 67046 - DNA, 103 bp, Artificial Sequence
  Synthetic Polynucleotide
taatacgactcactatagggcacatttaggtgtgttaaaagtcgtaactaaacagaggagatagttaatgcttttaacaaacctggcggcagcgcaaaagatg

SEQ ID NO: 67047 - DNA, 103 bp, Artificial Sequence
  Synthetic Polynucleotide
taatacgactcactataggggtcgacacatttaggtgtgttaaaagtcgtaacagaggagaacgactatgaacacacctaacctggcggcagcgcaaaagatg

SEQ ID NO: 67048 - DNA, 103 bp, Artificial Sequence
  Synthetic Polynucleotide
taatacgactcactatagggaagaatgtagacattataaatcttttacttaacagaggagaaagtaaatgatttataataacctggcggcagcgcaaaagatg

SEQ ID NO: 67049 - DNA, 103 bp, Artificial Sequence
  Synthetic Polynucleotide
taatacgactcactatagggcctttgtcgacacatttaggtgtgttaaaaaacagaggagattttaaatgacctaaatgaacctggcggcagcgcaaaagatg

SEQ ID NO: 67050 - DNA, 103 bp, Artificial Sequence
  Synthetic Polynucleotide
taatacgactcactatagggattgccctttgtcgacacatttaggtgtgtaacagaggagaacacacatgaatgtgtcgaacctggcggcagcgcaaaagatg

SEQ ID NO: 67051 - DNA, 103 bp, Artificial Sequence
  Synthetic Polynucleotide
taatacgactcactatagggaaactattgccctttgtcgacacatttaggaacagaggagacctaaaatggtcgacaaaaacctggcggcagcgcaaaagatg

SEQ ID NO: 67052 - DNA, 103 bp, Artificial Sequence
  Synthetic Polynucleotide
taatacgactcactataggggacgcaaactattgccctttgtcgacacataacagaggagaatgtgtatgcaaagggcaaacctggcggcagcgcaaaagatg

SEQ ID NO: 67053 - DNA, 103 bp, Artificial Sequence
  Synthetic Polynucleotide
taatacgactcactatagggtgaatgacgcaaactattgccctttgtcgaaacagaggagatcgacaatgggcaatagtaacctggcggcagcgcaaaagatg

SEQ ID NO: 67054 - DNA, 103 bp, Artificial Sequence
  Synthetic Polynucleotide
taatacgactcactatagggctccatgaatgacgcaaactattgccctttaacagaggagaaaagggatgtagtttgcgaacctggcggcagcgcaaaagatg

SEQ ID NO: 67055 - DNA, 103 bp, Artificial Sequence
  Synthetic Polynucleotide
taatacgactcactatagggtctaactccatgaatgacgcaaactattgcaacagaggagagcaataatgtgcgtcattaacctggcggcagcgcaaaagatg

SEQ ID NO: 67056 - DNA, 103 bp, Artificial Sequence
  Synthetic Polynucleotide
taatacgactcactatagggcgttttctaactccatgaatgacgcaaactaacagaggagaagtttgatgcattcatggaacctggcggcagcgcaaaagatg

SEQ ID NO: 67057 - DNA, 103 bp, Artificial Sequence
  Synthetic Polynucleotide
taatacgactcactatagggtggctcgttttctaactccatgaatgacgcaacagaggagagcgtcaatgatggagttaaacctggcggcagcgcaaaagatg

SEQ ID NO: 67058 - DNA, 103 bp, Artificial Sequence
  Synthetic Polynucleotide
taatacgactcactatagggattactggctcgttttctaactccatgaataacagaggagaattcatatggttagaaaaaacctggcggcagcgcaaaagatg

SEQ ID NO: 67059 - DNA, 103 bp, Artificial Sequence
  Synthetic Polynucleotide
taatacgactcactatagggcagtcaagaatgtagacattataaatctttaacagaggagaaaagatatgtaatgtctaaacctggcggcagcgcaaaagatg

SEQ ID NO: 67060 - DNA, 103 bp, Artificial Sequence
  Synthetic Polynucleotide
taatacgactcactataggggtaagattactggctcgttttctaactccaaacagaggagatggagtatgaaaacgagcaacctggcggcagcgcaaaagatg

SEQ ID NO: 67061 - DNA, 103 bp, Artificial Sequence
  Synthetic Polynucleotide
taatacgactcactatagggacatggtaagattactggctcgttttctaaaacagaggagattagaaatggagccagtaaacctggcggcagcgcaaaagatg

SEQ ID NO: 67062 - DNA, 103 bp, Artificial Sequence
  Synthetic Polynucleotide
taatacgactcactatagggtgaggacatggtaagattactggctcgtttaacagaggagaaaacgaatgagtaatcttaacctggcggcagcgcaaaagatg

SEQ ID NO: 67063 - DNA, 103 bp, Artificial Sequence
  Synthetic Polynucleotide
taatacgactcactatagggttatttgaggacatggtaagattactggctaacagaggagaagccagatgtcttaccataacctggcggcagcgcaaaagatg

SEQ ID NO: 67064 - DNA, 103 bp, Artificial Sequence
  Synthetic Polynucleotide
taatacgactcactatagggagtatttatttgaggacatggtaagattacaacagaggagagtaatcatgccatgtcctaacctggcggcagcgcaaaagatg

SEQ ID NO: 67065 - DNA, 103 bp, Artificial Sequence
  Synthetic Polynucleotide
taatacgactcactataggggatagagtatttatttgaggacatggtaagaacagaggagacttaccatgtcctcaaataacctggcggcagcgcaaaagatg

SEQ ID NO: 67066 - DNA, 103 bp, Artificial Sequence
  Synthetic Polynucleotide
taatacgactcactatagggcaaacgatagagtatttatttgaggacatgaacagaggagacatgtcatgaaataaataaacctggcggcagcgcaaaagatg

SEQ ID NO: 67067 - DNA, 103 bp, Artificial Sequence
  Synthetic Polynucleotide
taatacgactcactatagggatatccaaacgatagagtatttatttgaggaacagaggagacctcaaatgaatactctaaacctggcggcagcgcaaaagatg

SEQ ID NO: 67068 - DNA, 103 bp, Artificial Sequence
  Synthetic Polynucleotide
taatacgactcactatagggatattatatccaaacgatagagtatttattaacagaggagaaataaaatgtctatcgttaacctggcggcagcgcaaaagatg

SEQ ID NO: 67069 - DNA, 103 bp, Artificial Sequence
  Synthetic Polynucleotide
taatacgactcactatagggctaatatattatatccaaacgatagagtataacagaggagaatactcatgcgtttggataacctggcggcagcgcaaaagatg

SEQ ID NO: 67070 - DNA, 103 bp, Artificial Sequence
  Synthetic Polynucleotide
taatacgactcactatagggtaaaacagtcaagaatgtagacattataaaaacagaggagatttataatgtctacattcaacctggcggcagcgcaaaagatg

SEQ ID NO: 67071 - DNA, 103 bp, Artificial Sequence
  Synthetic Polynucleotide
taatacgactcactatagggaatatctaatatattatatccaaacgatagaacagaggagactatcgatgggatataataacctggcggcagcgcaaaagatg

SEQ ID NO: 67072 - DNA, 103 bp, Artificial Sequence
  Synthetic Polynucleotide
taatacgactcactatagggcataaaatatctaatatattatatccaaacaacagaggagagtttggatgtaatatattaacctggcggcagcgcaaaagatg

SEQ ID NO: 67073 - DNA, 103 bp, Artificial Sequence
  Synthetic Polynucleotide
taatacgactcactatagggtttcccataaaatatctaatatattatatcaacagaggagagatataatgtattagataaacctggcggcagcgcaaaagatg

SEQ ID NO: 67074 - DNA, 103 bp, Artificial Sequence
  Synthetic Polynucleotide
taatacgactcactatagggctcgttttcccataaaatatctaatatattaacagaggagaaatataatggatattttaaacctggcggcagcgcaaaagatg

SEQ ID NO: 67075 - DNA, 103 bp, Artificial Sequence
  Synthetic Polynucleotide
taatacgactcactatagggcgcttctcgttttcccataaaatatctaataacagaggagaattagaatgtttatgggaaacctggcggcagcgcaaaagatg

SEQ ID NO: 67076 - DNA, 103 bp, Artificial Sequence
  Synthetic Polynucleotide
taatacgactcactatagggttatccgcttctcgttttcccataaaatataacagaggagaatatttatggggaaaacgaacctggcggcagcgcaaaagatg

SEQ ID NO: 67077 - DNA, 103 bp, Artificial Sequence
  Synthetic Polynucleotide
taatacgactcactatagggtatcattatccgcttctcgttttcccataaaacagaggagattatggatgaacgagaagaacctggcggcagcgcaaaagatg

SEQ ID NO: 67078 - DNA, 103 bp, Artificial Sequence
  Synthetic Polynucleotide
taatacgactcactatagggaattctatcattatccgcttctcgttttccaacagaggagaggaaaaatggaagcggataacctggcggcagcgcaaaagatg

SEQ ID NO: 67079 - DNA, 103 bp, Artificial Sequence
  Synthetic Polynucleotide
taatacgactcactatagggggtataattctatcattatccgcttctcgtaacagaggagaacgagaatgggataatgaaacctggcggcagcgcaaaagatg

SEQ ID NO: 67080 - DNA, 103 bp, Artificial Sequence
  Synthetic Polynucleotide
taatacgactcactatagggctattggtataattctatcattatccgcttaacagaggagaaagcggatgatgatagaaaacctggcggcagcgcaaaagatg

SEQ ID NO: 67081 - DNA, 103 bp, Artificial Sequence
  Synthetic Polynucleotide
taatacgactcactatagggtgctctaaaacagtcaagaatgtagacattaacagaggagaaatgtcatgattcttgacaacctggcggcagcgcaaaagatg

SEQ ID NO: 67082 - DNA, 103 bp, Artificial Sequence
  Synthetic Polynucleotide
taatacgactcactatagggattatctattggtataattctatcattatcaacagaggagagataatatgagaattataaacctggcggcagcgcaaaagatg

SEQ ID NO: 67083 - DNA, 103 bp, Artificial Sequence
  Synthetic Polynucleotide
taatacgactcactatagggttacaattatctattggtataattctatcaaacagaggagatgatagatgtataccaataacctggcggcagcgcaaaagatg

SEQ ID NO: 67084 - DNA, 103 bp, Artificial Sequence
  Synthetic Polynucleotide
taatacgactcactatagggtattgttacaattatctattggtataattcaacagaggagagaattaatgcaatagataaacctggcggcagcgcaaaagatg

SEQ ID NO: 67085 - DNA, 103 bp, Artificial Sequence
  Synthetic Polynucleotide
taatacgactcactatagggtagcatattgttacaattatctattggtataacagaggagaataccaatggataattgtaacctggcggcagcgcaaaagatg

SEQ ID NO: 67086 - DNA, 103 bp, Artificial Sequence
  Synthetic Polynucleotide
taatacgactcactatagggagaattagcatattgttacaattatctattaacagaggagaaatagaatgttgtaacaaaacctggcggcagcgcaaaagatg

SEQ ID NO: 67087 - DNA, 103 bp, Artificial Sequence
  Synthetic Polynucleotide
taatacgactcactatagggggttcagaattagcatattgttacaattataacagaggagaataattatgacaatatgcaacctggcggcagcgcaaaagatg

SEQ ID NO: 67088 - DNA, 103 bp, Artificial Sequence
  Synthetic Polynucleotide
taatacgactcactatagggtgtcgggttcagaattagcatattgttacaaacagaggagatgtaacatgatgctaattaacctggcggcagcgcaaaagatg

SEQ ID NO: 67089 - DNA, 103 bp, Artificial Sequence
  Synthetic Polynucleotide
taatacgactcactataggggattgtgtcgggttcagaattagcatattgaacagaggagacaatatatgaattctgaaaacctggcggcagcgcaaaagatg

SEQ ID NO: 67090 - DNA, 103 bp, Artificial Sequence
  Synthetic Polynucleotide
taatacgactcactatagggagtctgattgtgtcgggttcagaattagcaaacagaggagatgctaaatgtgaacccgaaacctggcggcagcgcaaaagatg

SEQ ID NO: 67091 - DNA, 103 bp, Artificial Sequence
  Synthetic Polynucleotide
taatacgactcactatagggaccagagtctgattgtgtcgggttcagaataacagaggagaattctgatgccgacacaaaacctggcggcagcgcaaaagatg

SEQ ID NO: 67092 - DNA, 103 bp, Artificial Sequence
  Synthetic Polynucleotide
taatacgactcactatagggttgtatgctctaaaacagtcaagaatgtagaacagaggagactacatatgtgactgtttaacctggcggcagcgcaaaagatg

SEQ ID NO: 67093 - DNA, 103 bp, Artificial Sequence
  Synthetic Polynucleotide
taatacgactcactatagggtaaataccagagtctgattgtgtcgggttcaacagaggagagaacccatgacaatcagaaacctggcggcagcgcaaaagatg

SEQ ID NO: 67094 - DNA, 103 bp, Artificial Sequence
  Synthetic Polynucleotide
taatacgactcactatagggacatataaataccagagtctgattgtgtcgaacagaggagacgacacatgcagactctgaacctggcggcagcgcaaaagatg

SEQ ID NO: 67095 - DNA, 103 bp, Artificial Sequence
  Synthetic Polynucleotide
taatacgactcactatagggaatgcacatataaataccagagtctgattgaacagaggagacaatcaatgtctggtattaacctggcggcagcgcaaaagatg

SEQ ID NO: 67096 - DNA, 103 bp, Artificial Sequence
  Synthetic Polynucleotide
taatacgactcactatagggttggtaatgcacatataaataccagagtctaacagaggagaagactcatgtatttatataacctggcggcagcgcaaaagatg

SEQ ID NO: 67097 - DNA, 103 bp, Artificial Sequence
  Synthetic Polynucleotide
taatacgactcactatagggcgttcttggtaatgcacatataaataccagaacagaggagactggtaatgatatgtgcaaacctggcggcagcgcaaaagatg

SEQ ID NO: 67098 - DNA, 103 bp, Artificial Sequence
  Synthetic Polynucleotide
taatacgactcactatagggggtctcgttcttggtaatgcacatataaataacagaggagaatttatatgtgcattaccaacctggcggcagcgcaaaagatg

SEQ ID NO: 67099 - DNA, 103 bp, Artificial Sequence
  Synthetic Polynucleotide
taatacgactcactatagggctgtaggtctcgttcttggtaatgcacataaacagaggagatatgtgatgtaccaagaaaacctggcggcagcgcaaaagatg

SEQ ID NO: 67100 - DNA, 103 bp, Artificial Sequence
  Synthetic Polynucleotide
taatacgactcactatagggtatcactgtaggtctcgttcttggtaatgcaacagaggagagcattaatgagaacgagaaacctggcggcagcgcaaaagatg

SEQ ID NO: 67101 - DNA, 103 bp, Artificial Sequence
  Synthetic Polynucleotide
taatacgactcactatagggcatcatatcactgtaggtctcgttcttggtaacagaggagaaccaagatggagacctacaacctggcggcagcgcaaaagatg

SEQ ID NO: 67102 - DNA, 103 bp, Artificial Sequence
  Synthetic Polynucleotide
taatacgactcactatagggaacgacatcatatcactgtaggtctcgttcaacagaggagagaacgaatgctacagtgaaacctggcggcagcgcaaaagatg

SEQ ID NO: 67103 - DNA, 103 bp, Artificial Sequence
  Synthetic Polynucleotide
taatacgactcactatagggccatattgtatgctctaaaacagtcaagaaaacagaggagattcttgatggttttagagaacctggcggcagcgcaaaagatg

SEQ ID NO: 67104 - DNA, 103 bp, Artificial Sequence
  Synthetic Polynucleotide
taatacgactcactatagggaatttaacgacatcatatcactgtaggtctaacagaggagaagacctatggtgatatgaaacctggcggcagcgcaaaagatg

SEQ ID NO: 67105 - DNA, 103 bp, Artificial Sequence
  Synthetic Polynucleotide
taatacgactcactatagggtgtcaaatttaacgacatcatatcactgtaaacagaggagatacagtatgatgatgtcgaacctggcggcagcgcaaaagatg

SEQ ID NO: 67106 - DNA, 103 bp, Artificial Sequence
  Synthetic Polynucleotide
taatacgactcactatagggacaattgtcaaatttaacgacatcatatcaaacagaggagatgatatatggtcgttaaaaacctggcggcagcgcaaaagatg

SEQ ID NO: 67107 - DNA, 103 bp, Artificial Sequence
  Synthetic Polynucleotide
taatacgactcactatagggcagacacaattgtcaaatttaacgacatcaaacagaggagatgatgtatgtaaatttgaaacctggcggcagcgcaaaagatg

SEQ ID NO: 67108 - DNA, 103 bp, Artificial Sequence
  Synthetic Polynucleotide
taatacgactcactatagggtgagacagacacaattgtcaaatttaacgaaacagaggagatcgttaatgttgacaattaacctggcggcagcgcaaaagatg

SEQ ID NO: 67109 - DNA, 103 bp, Artificial Sequence
  Synthetic Polynucleotide
taatacgactcactataggggattctgagacagacacaattgtcaaatttaacagaggagaaaatttatgaattgtgtcaacctggcggcagcgcaaaagatg

SEQ ID NO: 67110 - DNA, 103 bp, Artificial Sequence
  Synthetic Polynucleotide
taatacgactcactatagggtatttgattctgagacagacacaattgtcaaacagaggagatgacaaatgtgtctgtctaacctggcggcagcgcaaaagatg

SEQ ID NO: 67111 - DNA, 103 bp, Artificial Sequence
  Synthetic Polynucleotide
taatacgactcactatagggatctatatttgattctgagacagacacaataacagaggagaattgtgatggtctcagaaaacctggcggcagcgcaaaagatg

SEQ ID NO: 67112 - DNA, 103 bp, Artificial Sequence
  Synthetic Polynucleotide
taatacgactcactatagggataagatctatatttgattctgagacagacaacagaggagagtctgtatgagaatcaaaaacctggcggcagcgcaaaagatg

SEQ ID NO: 67113 - DNA, 103 bp, Artificial Sequence
  Synthetic Polynucleotide
taatacgactcactatagggactaaataagatctatatttgattctgagaaacagaggagatctcagatgcaaatatagaacctggcggcagcgcaaaagatg

SEQ ID NO: 67114 - DNA, 103 bp, Artificial Sequence
  Synthetic Polynucleotide
taatacgactcactatagggcctctccatattgtatgctctaaaacagtcaacagaggagagactgtatgagagcatacaacctggcggcagcgcaaaagatg

SEQ ID NO: 67115 - DNA, 103 bp, Artificial Sequence
  Synthetic Polynucleotide
taatacgactcactatagggtggatactaaataagatctatatttgattcaacagaggagagaatcaatgatagatcttaacctggcggcagcgcaaaagatg

SEQ ID NO: 67116 - DNA, 103 bp, Artificial Sequence
  Synthetic Polynucleotide
taatacgactcactatagggatttgtggatactaaataagatctatatttaacagaggagaaaatatatgtcttatttaaacctggcggcagcgcaaaagatg

SEQ ID NO: 67117 - DNA, 103 bp, Artificial Sequence
  Synthetic Polynucleotide
taatacgactcactatagggttactatttgtggatactaaataagatctaaacagaggagatagatcatgtttagtatcaacctggcggcagcgcaaaagatg

SEQ ID NO: 67118 - DNA, 103 bp, Artificial Sequence
  Synthetic Polynucleotide
taatacgactcactatagggctcatttactatttgtggatactaaataagaacagaggagacttattatgtatccacaaaacctggcggcagcgcaaaagatg

SEQ ID NO: 67119 - DNA, 103 bp, Artificial Sequence
  Synthetic Polynucleotide
taatacgactcactataggggatctctcatttactatttgtggatactaaaacagaggagattagtaatgacaaatagtaacctggcggcagcgcaaaagatg

SEQ ID NO: 67120 - DNA, 103 bp, Artificial Sequence
  Synthetic Polynucleotide
taatacgactcactatagggcagtagatctctcatttactatttgtggataacagaggagaatccacatgtagtaaatgaacctggcggcagcgcaaaagatg

SEQ ID NO: 67121 - DNA, 103 bp, Artificial Sequence
  Synthetic Polynucleotide
taatacgactcactatagggttcaccagtagatctctcatttactatttgaacagaggagacaaataatgaatgagagaaacctggcggcagcgcaaaagatg

SEQ ID NO: 67122 - DNA, 103 bp, Artificial Sequence
  Synthetic Polynucleotide
taatacgactcactatagggcacatttcaccagtagatctctcatttactaacagaggagaagtaaaatggagatctacaacctggcggcagcgcaaaagatg

SEQ ID NO: 67123 - DNA, 103 bp, Artificial Sequence
  Synthetic Polynucleotide
taatacgactcactatagggtgggtcacatttcaccagtagatctctcataacagaggagaatgagaatgctactggtgaacctggcggcagcgcaaaagatg

SEQ ID NO: 67124 - DNA, 103 bp, Artificial Sequence
  Synthetic Polynucleotide
taatacgactcactatagggattactgggtcacatttcaccagtagatctaacagaggagaagatctatgggtgaaatgaacctggcggcagcgcaaaagatg

SEQ ID NO: 67125 - DNA, 103 bp, Artificial Sequence
  Synthetic Polynucleotide
taatacgactcactatagggagatttagaatgtctaacgttacacaagggaacagaggagacccttgatgaacgttagaaacctggcggcagcgcaaaagatg

SEQ ID NO: 67126 - DNA, 103 bp, Artificial Sequence
  Synthetic Polynucleotide
taatacgactcactatagggatacacctctccatattgtatgctctaaaaaacagaggagattttagatgatacaatataacctggcggcagcgcaaaagatg

SEQ ID NO: 67127 - DNA, 103 bp, Artificial Sequence
  Synthetic Polynucleotide
taatacgactcactatagggaatgcattactgggtcacatttcaccagtaaacagaggagatactggatgaatgtgaccaacctggcggcagcgcaaaagatg

SEQ ID NO: 67128 - DNA, 103 bp, Artificial Sequence
  Synthetic Polynucleotide
taatacgactcactatagggcaataaatgcattactgggtcacatttcacaacagaggagagtgaaaatggacccagtaaacctggcggcagcgcaaaagatg

SEQ ID NO: 67129 - DNA, 103 bp, Artificial Sequence
  Synthetic Polynucleotide
taatacgactcactatagggactagcaataaatgcattactgggtcacataacagaggagaatgtgaatgagtaatgcaaacctggcggcagcgcaaaagatg

SEQ ID NO: 67130 - DNA, 103 bp, Artificial Sequence
  Synthetic Polynucleotide
taatacgactcactatagggatgttactagcaataaatgcattactgggtaacagaggagaacccagatgtgcatttataacctggcggcagcgcaaaagatg

SEQ ID NO: 67131 - DNA, 103 bp, Artificial Sequence
  Synthetic Polynucleotide
taatacgactcactatagggtgtttatgttactagcaataaatgcattacaacagaggagagtaatgatgttattgctaaacctggcggcagcgcaaaagatg

SEQ ID NO: 67132 - DNA, 103 bp, Artificial Sequence
  Synthetic Polynucleotide
taatacgactcactatagggatctgtgtttatgttactagcaataaatgcaacagaggagagcatttatggctagtaacaacctggcggcagcgcaaaagatg

SEQ ID NO: 67133 - DNA, 103 bp, Artificial Sequence
  Synthetic Polynucleotide
taatacgactcactatagggataatatctgtgtttatgttactagcaataaacagaggagatattgcatgtaacataaaaacctggcggcagcgcaaaagatg

SEQ ID NO: 67134 - DNA, 103 bp, Artificial Sequence
  Synthetic Polynucleotide
taatacgactcactatagggtccatataatatctgtgtttatgttactagaacagaggagactagtaatgtaaacacagaacctggcggcagcgcaaaagatg

SEQ ID NO: 67135 - DNA, 103 bp, Artificial Sequence
  Synthetic Polynucleotide
taatacgactcactatagggtccgctccatataatatctgtgtttatgttaacagaggagaaacataatgacagatattaacctggcggcagcgcaaaagatg

SEQ ID NO: 67136 - DNA, 103 bp, Artificial Sequence
  Synthetic Polynucleotide
taatacgactcactatagggtgatgtccgctccatataatatctgtgtttaacagaggagaaaacacatgtattatatgaacctggcggcagcgcaaaagatg

SEQ ID NO: 67137 - DNA, 103 bp, Artificial Sequence
  Synthetic Polynucleotide
taatacgactcactatagggtggaaatacacctctccatattgtatgctcaacagaggagagagcatatgatatggagaaacctggcggcagcgcaaaagatg

SEQ ID NO: 67138 - DNA, 103 bp, Artificial Sequence
  Synthetic Polynucleotide
taatacgactcactatagggggcgttgatgtccgctccatataatatctgaacagaggagacagataatgtatggagcgaacctggcggcagcgcaaaagatg

SEQ ID NO: 67139 - DNA, 103 bp, Artificial Sequence
  Synthetic Polynucleotide
taatacgactcactatagggtctaaggcgttgatgtccgctccatataataacagaggagaattataatgagcggacataacctggcggcagcgcaaaagatg

SEQ ID NO: 67140 - DNA, 103 bp, Artificial Sequence
  Synthetic Polynucleotide
taatacgactcactatagggttatttctaaggcgttgatgtccgctccataacagaggagaatggagatgacatcaacgaacctggcggcagcgcaaaagatg

SEQ ID NO: 67141 - DNA, 103 bp, Artificial Sequence
  Synthetic Polynucleotide
taatacgactcactataggggtctcttatttctaaggcgttgatgtccgcaacagaggagagcggacatgaacgccttaaacctggcggcagcgcaaaagatg

SEQ ID NO: 67142 - DNA, 103 bp, Artificial Sequence
  Synthetic Polynucleotide
taatacgactcactatagggtttaagtctcttatttctaaggcgttgatgaacagaggagacatcaaatgcttagaaataacctggcggcagcgcaaaagatg

SEQ ID NO: 67143 - DNA, 103 bp, Artificial Sequence
  Synthetic Polynucleotide
taatacgactcactatagggcgttgtttaagtctcttatttctaaggcgtaacagaggagaacgcctatgaaataagagaacctggcggcagcgcaaaagatg

SEQ ID NO: 67144 - DNA, 103 bp, Artificial Sequence
  Synthetic Polynucleotide
taatacgactcactataggggtgtccgttgtttaagtctcttatttctaaaacagaggagattagaaatgagagacttaaacctggcggcagcgcaaaagatg

SEQ ID NO: 67145 - DNA, 103 bp, Artificial Sequence
  Synthetic Polynucleotide
taatacgactcactatagggtccaggtgtccgttgtttaagtctcttattaacagaggagaaataagatgcttaaacaaaacctggcggcagcgcaaaagatg

SEQ ID NO: 67146 - DNA, 103 bp, Artificial Sequence
  Synthetic Polynucleotide
taatacgactcactatagggataattccaggtgtccgttgtttaagtctcaacagaggagagagactatgacaacggacaacctggcggcagcgcaaaagatg

SEQ ID NO: 67147 - DNA, 103 bp, Artificial Sequence
  Synthetic Polynucleotide
taatacgactcactatagggtggtaataattccaggtgtccgttgtttaaaacagaggagattaaacatgggacacctgaacctggcggcagcgcaaaagatg

SEQ ID NO: 67148 - DNA, 103 bp, Artificial Sequence
  Synthetic Polynucleotide
taatacgactcactatagggcatgatggaaatacacctctccatattgtaaacagaggagatacaatatggagaggtgtaacctggcggcagcgcaaaagatg

SEQ ID NO: 67149 - DNA, 103 bp, Artificial Sequence
  Synthetic Polynucleotide
taatacgactcactatagggttctatggtaataattccaggtgtccgttgaacagaggagacaacggatgcctggaattaacctggcggcagcgcaaaagatg

SEQ ID NO: 67150 - DNA, 103 bp, Artificial Sequence
  Synthetic Polynucleotide
taatacgactcactatagggacatcttctatggtaataattccaggtgtcaacagaggagagacaccatgaattattacaacctggcggcagcgcaaaagatg

SEQ ID NO: 67151 - DNA, 103 bp, Artificial Sequence
  Synthetic Polynucleotide
taatacgactcactatagggttctaacatcttctatggtaataattccagaacagaggagactggaaatgttaccatagaacctggcggcagcgcaaaagatg

SEQ ID NO: 67152 - DNA, 103 bp, Artificial Sequence
  Synthetic Polynucleotide
taatacgactcactatagggcatttttctaacatcttctatggtaataataacagaggagaattattatgatagaagataacctggcggcagcgcaaaagatg

SEQ ID NO: 67153 - DNA, 103 bp, Artificial Sequence
  Synthetic Polynucleotide
taatacgactcactatagggagcatcatttttctaacatcttctatggtaaacagaggagataccatatgagatgttagaacctggcggcagcgcaaaagatg

SEQ ID NO: 67154 - DNA, 103 bp, Artificial Sequence
  Synthetic Polynucleotide
taatacgactcactatagggtaaccagcatcatttttctaacatcttctaaacagaggagatagaagatgttagaaaaaaacctggcggcagcgcaaaagatg

SEQ ID NO: 67155 - DNA, 103 bp, Artificial Sequence
  Synthetic Polynucleotide
taatacgactcactatagggtgtaataaccagcatcatttttctaacatcaacagaggagagatgttatgaaaatgatgaacctggcggcagcgcaaaagatg

SEQ ID NO: 67156 - DNA, 103 bp, Artificial Sequence
  Synthetic Polynucleotide
taatacgactcactatagggacatgtgtaataaccagcatcatttttctaaacagaggagatagaaaatggatgctggtaacctggcggcagcgcaaaagatg

SEQ ID NO: 67157 - DNA, 103 bp, Artificial Sequence
  Synthetic Polynucleotide
taatacgactcactatagggaaaacacatgtgtaataaccagcatcatttaacagaggagaaaatgaatgtggttattaaacctggcggcagcgcaaaagatg

SEQ ID NO: 67158 - DNA, 103 bp, Artificial Sequence
  Synthetic Polynucleotide
taatacgactcactatagggatattaaaacacatgtgtaataaccagcataacagaggagaatgctgatgattacacataacctggcggcagcgcaaaagatg

SEQ ID NO: 67159 - DNA, 103 bp, Artificial Sequence
  Synthetic Polynucleotide
taatacgactcactatagggcagatcatgatggaaatacacctctccataaacagaggagatatggaatggtgtatttcaacctggcggcagcgcaaaagatg

SEQ ID NO: 67160 - DNA, 103 bp, Artificial Sequence
  Synthetic Polynucleotide
taatacgactcactatagggtatatatattaaaacacatgtgtaataaccaacagaggagaggttatatgacatgtgttaacctggcggcagcgcaaaagatg

SEQ ID NO: 67161 - DNA, 103 bp, Artificial Sequence
  Synthetic Polynucleotide
taatacgactcactatagggatatatatatatattaaaacacatgtgtaaaacagaggagattacacatgtgttttaataacctggcggcagcgcaaaagatg

SEQ ID NO: 67162 - DNA, 103 bp, Artificial Sequence
  Synthetic Polynucleotide
taatacgactcactatagggtatatatatatatatatattaaaacacatgaacagaggagacatgtgatgtaatatataaacctggcggcagcgcaaaagatg

SEQ ID NO: 67163 - DNA, 103 bp, Artificial Sequence
  Synthetic Polynucleotide
taatacgactcactatagggatatatatatatatatatatatattaaaacaacagaggagagttttaatgtatatatataacctggcggcagcgcaaaagatg

SEQ ID NO: 67164 - DNA, 103 bp, Artificial Sequence
  Synthetic Polynucleotide
taatacgactcactatagggtatatatatatatatatatatatatatattaacagaggagaaatataatgatatatataaacctggcggcagcgcaaaagatg

SEQ ID NO: 67165 - DNA, 103 bp, Artificial Sequence
  Synthetic Polynucleotide
taatacgactcactatagggtcccatatatatatatatatatatatatataacagaggagaatatatatgtatatatataacctggcggcagcgcaaaagatg

SEQ ID NO: 67166 - DNA, 103 bp, Artificial Sequence
  Synthetic Polynucleotide
taatacgactcactatagggtttactcccatatatatatatatatatataaacagaggagatatataatgatatatataaacctggcggcagcgcaaaagatg

SEQ ID NO: 67167 - DNA, 103 bp, Artificial Sequence
  Synthetic Polynucleotide
taatacgactcactatagggtatgctttactcccatatatatatatatataacagaggagaatatatatgtatatatggaacctggcggcagcgcaaaagatg

SEQ ID NO: 67168 - DNA, 103 bp, Artificial Sequence
  Synthetic Polynucleotide
taatacgactcactatagggcgttatatgctttactcccatatatatataaacagaggagatatataatgatgggagtaaacctggcggcagcgcaaaagatg

SEQ ID NO: 67169 - DNA, 103 bp, Artificial Sequence
  Synthetic Polynucleotide
taatacgactcactatagggggttacgttatatgctttactcccatatataacagaggagaatatatatgagtaaagcaaacctggcggcagcgcaaaagatg

SEQ ID NO: 67170 - DNA, 103 bp, Artificial Sequence
  Synthetic Polynucleotide
taatacgactcactatagggaaaaccagatcatgatggaaatacacctctaacagaggagaagaggtatgtttccatcaaacctggcggcagcgcaaaagatg

SEQ ID NO: 67171 - DNA, 103 bp, Artificial Sequence
  Synthetic Polynucleotide
taatacgactcactatagggattctggttacgttatatgctttactcccaaacagaggagatgggagatgagcatataaaacctggcggcagcgcaaaagatg

SEQ ID NO: 67172 - DNA, 103 bp, Artificial Sequence
  Synthetic Polynucleotide
taatacgactcactatagggttacaattctggttacgttatatgctttacaacagaggagagtaaagatgataacgtaaaacctggcggcagcgcaaaagatg

SEQ ID NO: 67173 - DNA, 103 bp, Artificial Sequence
  Synthetic Polynucleotide
taatacgactcactatagggtaattttacaattctggttacgttatatgcaacagaggagagcatatatggtaaccagaaacctggcggcagcgcaaaagatg

SEQ ID NO: 67174 - DNA, 103 bp, Artificial Sequence
  Synthetic Polynucleotide
taatacgactcactatagggacctctaattttacaattctggttacgttaaacagaggagataacgtatgcagaattgtaacctggcggcagcgcaaaagatg

SEQ ID NO: 67175 - DNA, 103 bp, Artificial Sequence
  Synthetic Polynucleotide
taatacgactcactatagggcccatacctctaattttacaattctggttaaacagaggagataaccaatgttgtaaaataacctggcggcagcgcaaaagatg

SEQ ID NO: 67176 - DNA, 103 bp, Artificial Sequence
  Synthetic Polynucleotide
taatacgactcactatagggtttatcccatacctctaattttacaattctaacagaggagaagaattatgaaattagagaacctggcggcagcgcaaaagatg

SEQ ID NO: 67177 - DNA, 103 bp, Artificial Sequence
  Synthetic Polynucleotide
taatacgactcactatagggattattttatcccatacctctaattttacaaacagaggagatgtaaaatgagaggtatgaacctggcggcagcgcaaaagatg

SEQ ID NO: 67178 - DNA, 103 bp, Artificial Sequence
  Synthetic Polynucleotide
taatacgactcactatagggaaggtattattttatcccatacctctaattaacagaggagaaattagatgtatgggataaacctggcggcagcgcaaaagatg

SEQ ID NO: 67179 - DNA, 103 bp, Artificial Sequence
  Synthetic Polynucleotide
taatacgactcactatagggagtagaaggtattattttatcccatacctcaacagaggagagaggtaatggataaaataaacctggcggcagcgcaaaagatg

SEQ ID NO: 67180 - DNA, 103 bp, Artificial Sequence
  Synthetic Polynucleotide
taatacgactcactatagggtgcatagtagaaggtattattttatcccataacagaggagaatgggaatgaataataccaacctggcggcagcgcaaaagatg

SEQ ID NO: 67181 - DNA, 103 bp, Artificial Sequence
  Synthetic Polynucleotide
taatacgactcactatagggccctcaaaaccagatcatgatggaaatacaaacagaggagatgtattatgatcatgatcaacctggcggcagcgcaaaagatg

SEQ ID NO: 67182 - DNA, 103 bp, Artificial Sequence
  Synthetic Polynucleotide
taatacgactcactataggggtaattgcatagtagaaggtattattttataacagaggagaataaaaatgtaccttctaaacctggcggcagcgcaaaagatg

SEQ ID NO: 67183 - DNA, 103 bp, Artificial Sequence
  Synthetic Polynucleotide
taatacgactcactatagggttttggtaattgcatagtagaaggtattataacagaggagaataataatgtctactatgaacctggcggcagcgcaaaagatg

SEQ ID NO: 67184 - DNA, 103 bp, Artificial Sequence
  Synthetic Polynucleotide
taatacgactcactatagggaggccttttggtaattgcatagtagaaggtaacagaggagaaccttcatgtatgcaattaacctggcggcagcgcaaaagatg

SEQ ID NO: 67185 - DNA, 103 bp, Artificial Sequence
  Synthetic Polynucleotide
taatacgactcactatagggttacaaggccttttggtaattgcatagtagaacagaggagactactaatgaattaccaaaacctggcggcagcgcaaaagatg

SEQ ID NO: 67186 - DNA, 103 bp, Artificial Sequence
  Synthetic Polynucleotide
taatacgactcactatagggtgaagttacaaggccttttggtaattgcataacagaggagaatgcaaatgccaaaaggcaacctggcggcagcgcaaaagatg

SEQ ID NO: 67187 - DNA, 103 bp, Artificial Sequence
  Synthetic Polynucleotide
taatacgactcactatagggcctagtgaagttacaaggccttttggtaataacagaggagaattaccatgaggccttgtaacctggcggcagcgcaaaagatg

SEQ ID NO: 67188 - DNA, 103 bp, Artificial Sequence
  Synthetic Polynucleotide
taatacgactcactatagggtactacctagtgaagttacaaggccttttgaacagaggagacaaaagatgttgtaacttaacctggcggcagcgcaaaagatg

SEQ ID NO: 67189 - DNA, 103 bp, Artificial Sequence
  Synthetic Polynucleotide
taatacgactcactatagggcaaattactacctagtgaagttacaaggccaacagaggagaggccttatgacttcactaaacctggcggcagcgcaaaagatg

SEQ ID NO: 67190 - DNA, 103 bp, Artificial Sequence
  Synthetic Polynucleotide
taatacgactcactatagggatagtcaaattactacctagtgaagttacaaacagaggagatgtaacatgactaggtagaacctggcggcagcgcaaaagatg

SEQ ID NO: 67191 - DNA, 103 bp, Artificial Sequence
  Synthetic Polynucleotide
taatacgactcactatagggacacaatagtcaaattactacctagtgaagaacagaggagacttcacatggtagtaattaacctggcggcagcgcaaaagatg

SEQ ID NO: 67192 - DNA, 103 bp, Artificial Sequence
  Synthetic Polynucleotide
taatacgactcactatagggttagcccctcaaaaccagatcatgatggaaaacagaggagattccatatggatctggttaacctggcggcagcgcaaaagatg

SEQ ID NO: 67193 - DNA, 103 bp, Artificial Sequence
  Synthetic Polynucleotide
taatacgactcactatagggtttacacacaatagtcaaattactacctagaacagaggagactaggtatgaatttgactaacctggcggcagcgcaaaagatg

SEQ ID NO: 67194 - DNA, 103 bp, Artificial Sequence
  Synthetic Polynucleotide
taatacgactcactataggggatactttacacacaatagtcaaattactaaacagaggagatagtaaatggactattgtaacctggcggcagcgcaaaagatg

SEQ ID NO: 67195 - DNA, 103 bp, Artificial Sequence
  Synthetic Polynucleotide
taatacgactcactatagggtcaacgatactttacacacaatagtcaaataacagaggagaatttgaatgttgtgtgtaaacctggcggcagcgcaaaagatg

SEQ ID NO: 67196 - DNA, 103 bp, Artificial Sequence
  Synthetic Polynucleotide
taatacgactcactatagggaggtctcaacgatactttacacacaatagtaacagaggagaactattatgtgtaaagtaaacctggcggcagcgcaaaagatg

SEQ ID NO: 67197 - DNA, 103 bp, Artificial Sequence
  Synthetic Polynucleotide
taatacgactcactataggggtgggaggtctcaacgatactttacacacaaacagaggagatgtgtgatgagtatcgttaacctggcggcagcgcaaaagatg

SEQ ID NO: 67198 - DNA, 103 bp, Artificial Sequence
  Synthetic Polynucleotide
taatacgactcactatagggccgttgtgggaggtctcaacgatactttacaacagaggagagtaaagatgcgttgagacaacctggcggcagcgcaaaagatg

SEQ ID NO: 67199 - DNA, 103 bp, Artificial Sequence
  Synthetic Polynucleotide
taatacgactcactatagggtgcatccgttgtgggaggtctcaacgatacaacagaggagagtatcgatgagacctcccaacctggcggcagcgcaaaagatg

SEQ ID NO: 67200 - DNA, 103 bp, Artificial Sequence
  Synthetic Polynucleotide
taatacgactcactatagggacatctgcatccgttgtgggaggtctcaacaacagaggagagttgagatgtcccacaacaacctggcggcagcgcaaaagatg

SEQ ID NO: 67201 - DNA, 103 bp, Artificial Sequence
  Synthetic Polynucleotide
taatacgactcactatagggaaaagacatctgcatccgttgtgggaggtcaacagaggagagacctcatgcaacggatgaacctggcggcagcgcaaaagatg

SEQ ID NO: 67202 - DNA, 103 bp, Artificial Sequence
  Synthetic Polynucleotide
taatacgactcactatagggtatccaaaagacatctgcatccgttgtgggaacagaggagacccacaatggatgcagataacctggcggcagcgcaaaagatg

SEQ ID NO: 67203 - DNA, 103 bp, Artificial Sequence
  Synthetic Polynucleotide
taatacgactcactatagggaggaattagcccctcaaaaccagatcatgaaacagaggagatcatgaatgggttttgagaacctggcggcagcgcaaaagatg

SEQ ID NO: 67204 - DNA, 103 bp, Artificial Sequence
  Synthetic Polynucleotide
taatacgactcactatagggttacttatccaaaagacatctgcatccgttaacagaggagaaacggaatgagatgtcttaacctggcggcagcgcaaaagatg

SEQ ID NO: 67205 - DNA, 103 bp, Artificial Sequence
  Synthetic Polynucleotide
taatacgactcactatagggtaccattacttatccaaaagacatctgcataacagaggagaatgcagatgtcttttggaaacctggcggcagcgcaaaagatg

SEQ ID NO: 67206 - DNA, 103 bp, Artificial Sequence
  Synthetic Polynucleotide
taatacgactcactatagggatacataccattacttatccaaaagacatcaacagaggagagatgtcatgtggataagtaacctggcggcagcgcaaaagatg

SEQ ID NO: 67207 - DNA, 103 bp, Artificial Sequence
  Synthetic Polynucleotide
taatacgactcactatagggtcgtaatacataccattacttatccaaaagaacagaggagacttttgatgaagtaatggaacctggcggcagcgcaaaagatg

SEQ ID NO: 67208 - DNA, 103 bp, Artificial Sequence
  Synthetic Polynucleotide
taatacgactcactatagggcttcttcgtaatacataccattacttatccaacagaggagaggataaatgatggtatgtaacctggcggcagcgcaaaagatg

SEQ ID NO: 67209 - DNA, 103 bp, Artificial Sequence
  Synthetic Polynucleotide
taatacgactcactatagggattgtcttcttcgtaatacataccattactaacagaggagaagtaatatgatgtattacaacctggcggcagcgcaaaagatg

SEQ ID NO: 67210 - DNA, 103 bp, Artificial Sequence
  Synthetic Polynucleotide
taatacgactcactatagggtcctcattgtcttcttcgtaatacataccaaacagaggagatggtatatgttacgaagaaacctggcggcagcgcaaaagatg

SEQ ID NO: 67211 - DNA, 103 bp, Artificial Sequence
  Synthetic Polynucleotide
taatacgactcactatagggctccgtcctcattgtcttcttcgtaatacaaacagaggagatgtattatgaagaagacaaacctggcggcagcgcaaaagatg

SEQ ID NO: 67212 - DNA, 103 bp, Artificial Sequence
  Synthetic Polynucleotide
taatacgactcactatagggaccgtctccgtcctcattgtcttcttcgtaaacagaggagatacgaaatggacaatgagaacctggcggcagcgcaaaagatg

SEQ ID NO: 67213 - DNA, 103 bp, Artificial Sequence
  Synthetic Polynucleotide
taatacgactcactatagggattctaccgtctccgtcctcattgtcttctaacagaggagaagaagaatgtgaggacggaacctggcggcagcgcaaaagatg

SEQ ID NO: 67214 - DNA, 103 bp, Artificial Sequence
  Synthetic Polynucleotide
taatacgactcactatagggaaactaggaattagcccctcaaaaccagataacagaggagaatctggatgtgaggggctaacctggcggcagcgcaaaagatg

SEQ ID NO: 67215 - DNA, 103 bp, Artificial Sequence
  Synthetic Polynucleotide
taatacgactcactatagggtacttattctaccgtctccgtcctcattgtaacagaggagaacaatgatgacggagacgaacctggcggcagcgcaaaagatg

SEQ ID NO: 67216 - DNA, 103 bp, Artificial Sequence
  Synthetic Polynucleotide
taatacgactcactatagggtgctatacttattctaccgtctccgtcctcaacagaggagagaggacatggacggtagaaacctggcggcagcgcaaaagatg

SEQ ID NO: 67217 - DNA, 103 bp, Artificial Sequence
  Synthetic Polynucleotide
taatacgactcactatagggttatttgctatacttattctaccgtctccgaacagaggagacggagaatgtagaataagaacctggcggcagcgcaaaagatg

SEQ ID NO: 67218 - DNA, 103 bp, Artificial Sequence
  Synthetic Polynucleotide
taatacgactcactatagggagattttatttgctatacttattctaccgtaacagaggagaacggtaatgtaagtatagaacctggcggcagcgcaaaagatg

SEQ ID NO: 67219 - DNA, 103 bp, Artificial Sequence
  Synthetic Polynucleotide
taatacgactcactatagggcgtatagattttatttgctatacttattctaacagaggagaagaataatgatagcaaataacctggcggcagcgcaaaagatg

SEQ ID NO: 67220 - DNA, 103 bp, Artificial Sequence
  Synthetic Polynucleotide
taatacgactcactatagggtcggtcgtatagattttatttgctatacttaacagaggagaaagtatatgaaataaaataacctggcggcagcgcaaaagatg

SEQ ID NO: 67221 - DNA, 103 bp, Artificial Sequence
  Synthetic Polynucleotide
taatacgactcactatagggtcttatcggtcgtatagattttatttgctaaacagaggagatagcaaatgaaatctataaacctggcggcagcgcaaaagatg

SEQ ID NO: 67222 - DNA, 103 bp, Artificial Sequence
  Synthetic Polynucleotide
taatacgactcactatagggacgtctcttatcggtcgtatagattttattaacagaggagaaataaaatgtatacgaccaacctggcggcagcgcaaaagatg

SEQ ID NO: 67223 - DNA, 103 bp, Artificial Sequence
  Synthetic Polynucleotide
taatacgactcactatagggataacacgtctcttatcggtcgtatagattaacagaggagaaatctaatggaccgataaaacctggcggcagcgcaaaagatg

SEQ ID NO: 67224 - DNA, 103 bp, Artificial Sequence
  Synthetic Polynucleotide
taatacgactcactatagggatgtaataacacgtctcttatcggtcgtataacagaggagaatacgaatgataagagacaacctggcggcagcgcaaaagatg

SEQ ID NO: 67225 - DNA, 103 bp, Artificial Sequence
  Synthetic Polynucleotide
taatacgactcactatagggtgatgaaactaggaattagcccctcaaaacaacagaggagagttttgatgggctaattcaacctggcggcagcgcaaaagatg

SEQ ID NO: 67226 - DNA, 103 bp, Artificial Sequence
  Synthetic Polynucleotide
taatacgactcactatagggtcacaatgtaataacacgtctcttatcggtaacagaggagaaccgatatgagacgtgttaacctggcggcagcgcaaaagatg

SEQ ID NO: 67227 - DNA, 103 bp, Artificial Sequence
  Synthetic Polynucleotide
taatacgactcactatagggtttaatcacaatgtaataacacgtctcttaaacagaggagataagagatgtgttattacaacctggcggcagcgcaaaagatg

SEQ ID NO: 67228 - DNA, 103 bp, Artificial Sequence
  Synthetic Polynucleotide
taatacgactcactatagggtaatgtttaatcacaatgtaataacacgtcaacagaggagagacgtgatgttacattgtaacctggcggcagcgcaaaagatg

SEQ ID NO: 67229 - DNA, 103 bp, Artificial Sequence
  Synthetic Polynucleotide
taatacgactcactatagggaggattaatgtttaatcacaatgtaataacaacagaggagagttattatgttgtgattaaacctggcggcagcgcaaaagatg

SEQ ID NO: 67230 - DNA, 103 bp, Artificial Sequence
  Synthetic Polynucleotide
taatacgactcactatagggttgacaggattaatgtttaatcacaatgtaaacagaggagatacattatgattaaacataacctggcggcagcgcaaaagatg

SEQ ID NO: 67231 - DNA, 103 bp, Artificial Sequence
  Synthetic Polynucleotide
taatacgactcactatagggtttccttgacaggattaatgtttaatcacaaacagaggagatgtgatatgacattaatcaacctggcggcagcgcaaaagatg

SEQ ID NO: 67232 - DNA, 103 bp, Artificial Sequence
  Synthetic Polynucleotide
taatacgactcactatagggatctttttccttgacaggattaatgtttaaaacagaggagattaaacatgaatcctgtcaacctggcggcagcgcaaaagatg

SEQ ID NO: 67233 - DNA, 103 bp, Artificial Sequence
  Synthetic Polynucleotide
taatacgactcactataggggtagcatctttttccttgacaggattaatgaacagaggagacattaaatgtgtcaaggaaacctggcggcagcgcaaaagatg

SEQ ID NO: 67234 - DNA, 103 bp, Artificial Sequence
  Synthetic Polynucleotide
taatacgactcactatagggacgctgtagcatctttttccttgacaggataacagaggagaatcctgatgaggaaaaagaacctggcggcagcgcaaaagatg

SEQ ID NO: 67235 - DNA, 103 bp, Artificial Sequence
  Synthetic Polynucleotide
taatacgactcactatagggagtaaacgctgtagcatctttttccttgacaacagaggagagtcaagatgaaagatgctaacctggcggcagcgcaaaagatg

SEQ ID NO: 67236 - DNA, 103 bp, Artificial Sequence
  Synthetic Polynucleotide
taatacgactcactatagggactatagatttagaatgtctaacgttacacaacagaggagagtgtaaatgtagacattcaacctggcggcagcgcaaaagatg

SEQ ID NO: 67237 - DNA, 103 bp, Artificial Sequence
  Synthetic Polynucleotide
taatacgactcactatagggatggatgatgaaactaggaattagcccctcaacagaggagagaggggatgattcctagtaacctggcggcagcgcaaaagatg

SEQ ID NO: 67238 - DNA, 103 bp, Artificial Sequence
  Synthetic Polynucleotide
taatacgactcactatagggggaatagtaaacgctgtagcatctttttccaacagaggagaggaaaaatgtgctacagcaacctggcggcagcgcaaaagatg

SEQ ID NO: 67239 - DNA, 103 bp, Artificial Sequence
  Synthetic Polynucleotide
taatacgactcactatagggtgctaggaatagtaaacgctgtagcatcttaacagaggagaaagatgatgcagcgtttaaacctggcggcagcgcaaaagatg

SEQ ID NO: 67240 - DNA, 103 bp, Artificial Sequence
  Synthetic Polynucleotide
taatacgactcactataggggctgatgctaggaatagtaaacgctgtagcaacagaggagagctacaatgtttactattaacctggcggcagcgcaaaagatg

SEQ ID NO: 67241 - DNA, 103 bp, Artificial Sequence
  Synthetic Polynucleotide
taatacgactcactataggggttttgctgatgctaggaatagtaaacgctaacagaggagaagcgttatgtattcctagaacctggcggcagcgcaaaagatg

SEQ ID NO: 67242 - DNA, 103 bp, Artificial Sequence
  Synthetic Polynucleotide
taatacgactcactatagggtaactgttttgctgatgctaggaatagtaaaacagaggagattactaatgctagcatcaaacctggcggcagcgcaaaagatg

SEQ ID NO: 67243 - DNA, 103 bp, Artificial Sequence
  Synthetic Polynucleotide
taatacgactcactatagggaatagtaactgttttgctgatgctaggaataacagaggagaattcctatgatcagcaaaaacctggcggcagcgcaaaagatg

SEQ ID NO: 67244 - DNA, 103 bp, Artificial Sequence
  Synthetic Polynucleotide
taatacgactcactatagggatactaatagtaactgttttgctgatgctaaacagaggagatagcatatgcaaaacagtaacctggcggcagcgcaaaagatg

SEQ ID NO: 67245 - DNA, 103 bp, Artificial Sequence
  Synthetic Polynucleotide
taatacgactcactatagggacattatactaatagtaactgttttgctgaaacagaggagatcagcaatgcagttactaaacctggcggcagcgcaaaagatg

SEQ ID NO: 67246 - DNA, 103 bp, Artificial Sequence
  Synthetic Polynucleotide
taatacgactcactatagggcaatcacattatactaatagtaactgttttaacagaggagaaaaacaatgactattagtaacctggcggcagcgcaaaagatg

SEQ ID NO: 67247 - DNA, 103 bp, Artificial Sequence
  Synthetic Polynucleotide
taatacgactcactatagggacatacaatcacattatactaatagtaactaacagaggagaagttacatgtagtataataacctggcggcagcgcaaaagatg

SEQ ID NO: 67248 - DNA, 103 bp, Artificial Sequence
  Synthetic Polynucleotide
taatacgactcactatagggatctcatggatgatgaaactaggaattagcaacagaggagagctaatatgtagtttcataacctggcggcagcgcaaaagatg

SEQ ID NO: 67249 - DNA, 103 bp, Artificial Sequence
  Synthetic Polynucleotide
taatacgactcactatagggtaacaacatacaatcacattatactaatagaacagaggagactattaatgtaatgtgataacctggcggcagcgcaaaagatg

SEQ ID NO: 67250 - DNA, 103 bp, Artificial Sequence
  Synthetic Polynucleotide
taatacgactcactatagggaaatgtaacaacatacaatcacattatactaacagaggagaagtataatgtgattgtataacctggcggcagcgcaaaagatg

SEQ ID NO: 67251 - DNA, 103 bp, Artificial Sequence
  Synthetic Polynucleotide
taatacgactcactatagggcatggaaatgtaacaacatacaatcacattaacagaggagaaatgtgatggtatgttgtaacctggcggcagcgcaaaagatg

SEQ ID NO: 67252 - DNA, 103 bp, Artificial Sequence
  Synthetic Polynucleotide
taatacgactcactatagggtttgacatggaaatgtaacaacatacaatcaacagaggagagattgtatgttgttacataacctggcggcagcgcaaaagatg

SEQ ID NO: 67253 - DNA, 103 bp, Artificial Sequence
  Synthetic Polynucleotide
taatacgactcactatagggctctatttgacatggaaatgtaacaacataaacagaggagatatgttatgacatttccaaacctggcggcagcgcaaaagatg

SEQ ID NO: 67254 - DNA, 103 bp, Artificial Sequence
  Synthetic Polynucleotide
taatacgactcactatagggataaactctatttgacatggaaatgtaacaaacagaggagatgttacatgtccatgtcaaacctggcggcagcgcaaaagatg

SEQ ID NO: 67255 - DNA, 103 bp, Artificial Sequence
  Synthetic Polynucleotide
taatacgactcactatagggtttttataaactctatttgacatggaaatgaacagaggagacatttcatggtcaaatagaacctggcggcagcgcaaaagatg

SEQ ID NO: 67256 - DNA, 103 bp, Artificial Sequence
  Synthetic Polynucleotide
taatacgactcactatagggaaaaatttttataaactctatttgacatggaacagaggagaccatgtatgatagagtttaacctggcggcagcgcaaaagatg

SEQ ID NO: 67257 - DNA, 103 bp, Artificial Sequence
  Synthetic Polynucleotide
taatacgactcactataggggtataaaaaatttttataaactctatttgaaacagaggagatcaaatatggtttataaaaacctggcggcagcgcaaaagatg

SEQ ID NO: 67258 - DNA, 103 bp, Artificial Sequence
  Synthetic Polynucleotide
taatacgactcactatagggataatgtataaaaaatttttataaactctaaacagaggagatagagtatgtaaaaatttaacctggcggcagcgcaaaagatg

SEQ ID NO: 67259 - DNA, 103 bp, Artificial Sequence
  Synthetic Polynucleotide
taatacgactcactatagggctacaatctcatggatgatgaaactaggaaaacagaggagattcctaatgtcatcatccaacctggcggcagcgcaaaagatg

SEQ ID NO: 67260 - DNA, 103 bp, Artificial Sequence
  Synthetic Polynucleotide
taatacgactcactatagggggaagataatgtataaaaaatttttataaaaacagaggagatttataatgattttttataacctggcggcagcgcaaaagatg

SEQ ID NO: 67261 - DNA, 103 bp, Artificial Sequence
  Synthetic Polynucleotide
taatacgactcactatagggttgttggaagataatgtataaaaaatttttaacagaggagaaaaaatatgttatacattaacctggcggcagcgcaaaagatg

SEQ ID NO: 67262 - DNA, 103 bp, Artificial Sequence
  Synthetic Polynucleotide
taatacgactcactatagggattgcttgttggaagataatgtataaaaaaaacagaggagattttttatgcattatcttaacctggcggcagcgcaaaagatg

SEQ ID NO: 67263 - DNA, 103 bp, Artificial Sequence
  Synthetic Polynucleotide
taatacgactcactatagggcgtcaattgcttgttggaagataatgtataaacagaggagatatacaatgtcttccaacaacctggcggcagcgcaaaagatg

SEQ ID NO: 67264 - DNA, 103 bp, Artificial Sequence
  Synthetic Polynucleotide
taatacgactcactatagggacgttcgtcaattgcttgttggaagataataacagaggagaattatcatgcaacaagcaaacctggcggcagcgcaaaagatg

SEQ ID NO: 67265 - DNA, 103 bp, Artificial Sequence
  Synthetic Polynucleotide
taatacgactcactataggggtaatacgttcgtcaattgcttgttggaagaacagaggagacttccaatgagcaattgaaacctggcggcagcgcaaaagatg

SEQ ID NO: 67266 - DNA, 103 bp, Artificial Sequence
  Synthetic Polynucleotide
taatacgactcactatagggtcatagtaatacgttcgtcaattgcttgttaacagaggagaaacaagatgttgacgaacaacctggcggcagcgcaaaagatg

SEQ ID NO: 67267 - DNA, 103 bp, Artificial Sequence
  Synthetic Polynucleotide
taatacgactcactataggggttaatcatagtaatacgttcgtcaattgcaacagaggagagcaattatggaacgtattaacctggcggcagcgcaaaagatg

SEQ ID NO: 67268 - DNA, 103 bp, Artificial Sequence
  Synthetic Polynucleotide
taatacgactcactatagggtgggagttaatcatagtaatacgttcgtcaaacagaggagatgacgaatgtattactataacctggcggcagcgcaaaagatg

SEQ ID NO: 67269 - DNA, 103 bp, Artificial Sequence
  Synthetic Polynucleotide
taatacgactcactatagggtatcgtgggagttaatcatagtaatacgttaacagaggagaaacgtaatgctatgattaaacctggcggcagcgcaaaagatg

SEQ ID NO: 67270 - DNA, 103 bp, Artificial Sequence
  Synthetic Polynucleotide
taatacgactcactatagggagcttctacaatctcatggatgatgaaactaacagaggagaagtttcatgatccatgagaacctggcggcagcgcaaaagatg

SEQ ID NO: 67271 - DNA, 103 bp, Artificial Sequence
  Synthetic Polynucleotide
taatacgactcactatagggcatagtatcgtgggagttaatcatagtaataacagaggagaattactatgattaactccaacctggcggcagcgcaaaagatg

SEQ ID NO: 67272 - DNA, 103 bp, Artificial Sequence
  Synthetic Polynucleotide
taatacgactcactatagggatatgcatagtatcgtgggagttaatcataaacagaggagatatgatatgctcccacgaaacctggcggcagcgcaaaagatg

SEQ ID NO: 67273 - DNA, 103 bp, Artificial Sequence
  Synthetic Polynucleotide
taatacgactcactatagggtaataatatgcatagtatcgtgggagttaaaacagaggagattaactatgacgatactaaacctggcggcagcgcaaaagatg

SEQ ID NO: 67274 - DNA, 103 bp, Artificial Sequence
  Synthetic Polynucleotide
taatacgactcactatagggatgattaataatatgcatagtatcgtgggaaacagaggagatcccacatgactatgcataacctggcggcagcgcaaaagatg

SEQ ID NO: 67275 - DNA, 103 bp, Artificial Sequence
  Synthetic Polynucleotide
taatacgactcactatagggagttaatgattaataatatgcatagtatcgaacagaggagacgatacatggcatattataacctggcggcagcgcaaaagatg

SEQ ID NO: 67276 - DNA, 103 bp, Artificial Sequence
  Synthetic Polynucleotide
taatacgactcactatagggctgcaagttaatgattaataatatgcatagaacagaggagactatgcatgttattaatcaacctggcggcagcgcaaaagatg

SEQ ID NO: 67277 - DNA, 103 bp, Artificial Sequence
  Synthetic Polynucleotide
taatacgactcactatagggatagtctgcaagttaatgattaataatatgaacagaggagacatattatgaatcattaaaacctggcggcagcgcaaaagatg

SEQ ID NO: 67278 - DNA, 103 bp, Artificial Sequence
  Synthetic Polynucleotide
taatacgactcactatagggtaggtatagtctgcaagttaatgattaataaacagaggagatattaaatgttaacttgcaacctggcggcagcgcaaaagatg

SEQ ID NO: 67279 - DNA, 103 bp, Artificial Sequence
  Synthetic Polynucleotide
taatacgactcactatagggagcactaggtatagtctgcaagttaatgataacagaggagaatcattatgttgcagactaacctggcggcagcgcaaaagatg

SEQ ID NO: 67280 - DNA, 103 bp, Artificial Sequence
  Synthetic Polynucleotide
taatacgactcactatagggaaaatagcactaggtatagtctgcaagttaaacagaggagataacttatggactataccaacctggcggcagcgcaaaagatg

SEQ ID NO: 67281 - DNA, 103 bp, Artificial Sequence
  Synthetic Polynucleotide
taatacgactcactatagggcccaaagcttctacaatctcatggatgatgaacagaggagacatcatatgtgagattgtaacctggcggcagcgcaaaagatg

SEQ ID NO: 67282 - DNA, 103 bp, Artificial Sequence
  Synthetic Polynucleotide
taatacgactcactatagggatgtcaaaatagcactaggtatagtctgcaaacagaggagatgcagaatgtacctagtgaacctggcggcagcgcaaaagatg

SEQ ID NO: 67283 - DNA, 103 bp, Artificial Sequence
  Synthetic Polynucleotide
taatacgactcactatagggcaagtatgtcaaaatagcactaggtatagtaacagaggagaactataatgagtgctattaacctggcggcagcgcaaaagatg

SEQ ID NO: 67284 - DNA, 103 bp, Artificial Sequence
  Synthetic Polynucleotide
taatacgactcactataggggaacacaagtatgtcaaaatagcactaggtaacagaggagaacctagatgtattttgacaacctggcggcagcgcaaaagatg

SEQ ID NO: 67285 - DNA, 103 bp, Artificial Sequence
  Synthetic Polynucleotide
taatacgactcactatagggcacaagaacacaagtatgtcaaaatagcacaacagaggagagtgctaatgtgacatactaacctggcggcagcgcaaaagatg

SEQ ID NO: 67286 - DNA, 103 bp, Artificial Sequence
  Synthetic Polynucleotide
taatacgactcactatagggaattacacaagaacacaagtatgtcaaaataacagaggagaattttgatgtacttgtgtaacctggcggcagcgcaaaagatg

SEQ ID NO: 67287 - DNA, 103 bp, Artificial Sequence
  Synthetic Polynucleotide
taatacgactcactatagggaccgcaattacacaagaacacaagtatgtcaacagaggagagacataatggtgttcttgaacctggcggcagcgcaaaagatg

SEQ ID NO: 67288 - DNA, 103 bp, Artificial Sequence
  Synthetic Polynucleotide
taatacgactcactatagggtagataccgcaattacacaagaacacaagtaacagaggagaacttgtatgcttgtgtaaaacctggcggcagcgcaaaagatg

SEQ ID NO: 67289 - DNA, 103 bp, Artificial Sequence
  Synthetic Polynucleotide
taatacgactcactatagggtaatatagataccgcaattacacaagaacaaacagaggagatgttctatggtaattgcgaacctggcggcagcgcaaaagatg

SEQ ID NO: 67290 - DNA, 103 bp, Artificial Sequence
  Synthetic Polynucleotide
taatacgactcactatagggtttaataatatagataccgcaattacacaaaacagaggagattgtgtatgtgcggtatcaacctggcggcagcgcaaaagatg

SEQ ID NO: 67291 - DNA, 103 bp, Artificial Sequence
  Synthetic Polynucleotide
taatacgactcactatagggcgtactttaataatatagataccgcaattaaacagaggagataattgatgtatctatataacctggcggcagcgcaaaagatg

SEQ ID NO: 67292 - DNA, 103 bp, Artificial Sequence
  Synthetic Polynucleotide
taatacgactcactatagggacaatcccaaagcttctacaatctcatggaaacagaggagatccatgatgttgtagaagaacctggcggcagcgcaaaagatg

SEQ ID NO: 67293 - DNA, 103 bp, Artificial Sequence
  Synthetic Polynucleotide
taatacgactcactatagggatttacgtactttaataatatagataccgcaacagaggagagcggtaatgatattattaaacctggcggcagcgcaaaagatg

SEQ ID NO: 67294 - DNA, 103 bp, Artificial Sequence
  Synthetic Polynucleotide
taatacgactcactataggggctagatttacgtactttaataatatagataacagaggagaatctatatgattaaagtaaacctggcggcagcgcaaaagatg

SEQ ID NO: 67295 - DNA, 103 bp, Artificial Sequence
  Synthetic Polynucleotide
taatacgactcactatagggctatagctagatttacgtactttaataataaacagaggagatattatatgagtacgtaaaacctggcggcagcgcaaaagatg

SEQ ID NO: 67296 - DNA, 103 bp, Artificial Sequence
  Synthetic Polynucleotide
taatacgactcactatagggtaaaactatagctagatttacgtactttaaaacagaggagattaaagatggtaaatctaaacctggcggcagcgcaaaagatg

SEQ ID NO: 67297 - DNA, 103 bp, Artificial Sequence
  Synthetic Polynucleotide
taatacgactcactatagggaataataaaactatagctagatttacgtacaacagaggagagtacgtatgtctagctataacctggcggcagcgcaaaagatg

SEQ ID NO: 67298 - DNA, 103 bp, Artificial Sequence
  Synthetic Polynucleotide
taatacgactcactatagggaattaaataataaaactatagctagatttaaacagaggagataaatcatgctatagtttaacctggcggcagcgcaaaagatg

SEQ ID NO: 67299 - DNA, 103 bp, Artificial Sequence
  Synthetic Polynucleotide
taatacgactcactatagggtctaaaattaaataataaaactatagctagaacagaggagactagctatggttttattaaacctggcggcagcgcaaaagatg

SEQ ID NO: 67300 - DNA, 103 bp, Artificial Sequence
  Synthetic Polynucleotide
taatacgactcactatagggtattatctaaaattaaataataaaactataaacagaggagatatagtatgattatttaaaacctggcggcagcgcaaaagatg

SEQ ID NO: 67301 - DNA, 103 bp, Artificial Sequence
  Synthetic Polynucleotide
taatacgactcactatagggtggtatattatctaaaattaaataataaaaaacagaggagattttatatgttaattttaaacctggcggcagcgcaaaagatg

SEQ ID NO: 67302 - DNA, 103 bp, Artificial Sequence
  Synthetic Polynucleotide
taatacgactcactatagggggagatggtatattatctaaaattaaataaaacagaggagattatttatgtttagataaaacctggcggcagcgcaaaagatg

SEQ ID NO: 67303 - DNA, 103 bp, Artificial Sequence
  Synthetic Polynucleotide
taatacgactcactataggggtcagacaatcccaaagcttctacaatctcaacagaggagagagattatggaagctttgaacctggcggcagcgcaaaagatg

SEQ ID NO: 67304 - DNA, 103 bp, Artificial Sequence
  Synthetic Polynucleotide
taatacgactcactatagggaataaggagatggtatattatctaaaattaaacagaggagataatttatgataatatacaacctggcggcagcgcaaaagatg

SEQ ID NO: 67305 - DNA, 103 bp, Artificial Sequence
  Synthetic Polynucleotide
taatacgactcactatagggttaaaaataaggagatggtatattatctaaaacagaggagattagatatgataccatctaacctggcggcagcgcaaaagatg

SEQ ID NO: 67306 - DNA, 103 bp, Artificial Sequence
  Synthetic Polynucleotide
taatacgactcactatagggaatttttaaaaataaggagatggtatattaaacagaggagataatatatgatctccttaaacctggcggcagcgcaaaagatg

SEQ ID NO: 67307 - DNA, 103 bp, Artificial Sequence
  Synthetic Polynucleotide
taatacgactcactataggggtggtaatttttaaaaataaggagatggtaaacagaggagataccatatgcttatttttaacctggcggcagcgcaaaagatg

SEQ ID NO: 67308 - DNA, 103 bp, Artificial Sequence
  Synthetic Polynucleotide
taatacgactcactatagggaggatgtggtaatttttaaaaataaggagaaacagaggagatctcctatgttttaaaaaaacctggcggcagcgcaaaagatg

SEQ ID NO: 67309 - DNA, 103 bp, Artificial Sequence
  Synthetic Polynucleotide
taatacgactcactatagggaataaaggatgtggtaatttttaaaaataaaacagaggagattatttatgaaaattaccaacctggcggcagcgcaaaagatg

SEQ ID NO: 67310 - DNA, 103 bp, Artificial Sequence
  Synthetic Polynucleotide
taatacgactcactataggggatttaataaaggatgtggtaatttttaaaaacagaggagatttaaaatgtaccacatcaacctggcggcagcgcaaaagatg

SEQ ID NO: 67311 - DNA, 103 bp, Artificial Sequence
  Synthetic Polynucleotide
taatacgactcactatagggtccatgatttaataaaggatgtggtaatttaacagaggagaaaattaatgcatcctttaaacctggcggcagcgcaaaagatg

SEQ ID NO: 67312 - DNA, 103 bp, Artificial Sequence
  Synthetic Polynucleotide
taatacgactcactatagggtcccatccatgatttaataaaggatgtggtaacagaggagaaccacaatgtttattaaaaacctggcggcagcgcaaaagatg

SEQ ID NO: 67313 - DNA, 103 bp, Artificial Sequence
  Synthetic Polynucleotide
taatacgactcactataggggaaattcccatccatgatttaataaaggataacagaggagaatccttatgtaaatcatgaacctggcggcagcgcaaaagatg

SEQ ID NO: 67314 - DNA, 103 bp, Artificial Sequence
  Synthetic Polynucleotide
taatacgactcactatagggcttatgtcagacaatcccaaagcttctacaaacagaggagatgtagaatgtttgggattaacctggcggcagcgcaaaagatg

SEQ ID NO: 67315 - DNA, 103 bp, Artificial Sequence
  Synthetic Polynucleotide
taatacgactcactatagggacatagaaattcccatccatgatttaataaaacagaggagattattaatgcatggatggaacctggcggcagcgcaaaagatg

SEQ ID NO: 67316 - DNA, 103 bp, Artificial Sequence
  Synthetic Polynucleotide
taatacgactcactatagggcgatgacatagaaattcccatccatgatttaacagaggagaaaatcaatgatgggaattaacctggcggcagcgcaaaagatg

SEQ ID NO: 67317 - DNA, 103 bp, Artificial Sequence
  Synthetic Polynucleotide
taatacgactcactatagggactaacgatgacatagaaattcccatccataacagaggagaatggatatgaatttctataacctggcggcagcgcaaaagatg

SEQ ID NO: 67318 - DNA, 103 bp, Artificial Sequence
  Synthetic Polynucleotide
taatacgactcactatagggaatatactaacgatgacatagaaattcccaaacagaggagatgggaaatgctatgtcataacctggcggcagcgcaaaagatg

SEQ ID NO: 67319 - DNA, 103 bp, Artificial Sequence
  Synthetic Polynucleotide
taatacgactcactatagggttcacaatatactaacgatgacatagaaataacagaggagaatttctatgtcatcgttaaacctggcggcagcgcaaaagatg

SEQ ID NO: 67320 - DNA, 103 bp, Artificial Sequence
  Synthetic Polynucleotide
taatacgactcactatagggtgttgttcacaatatactaacgatgacataaacagaggagatatgtcatggttagtataaacctggcggcagcgcaaaagatg

SEQ ID NO: 67321 - DNA, 103 bp, Artificial Sequence
  Synthetic Polynucleotide
taatacgactcactataggggctcttgttgttcacaatatactaacgatgaacagaggagacatcgtatgtatattgtgaacctggcggcagcgcaaaagatg

SEQ ID NO: 67322 - DNA, 103 bp, Artificial Sequence
  Synthetic Polynucleotide
taatacgactcactatagggtatctgctcttgttgttcacaatatactaaaacagaggagattagtaatgtgtgaacaaaacctggcggcagcgcaaaagatg

SEQ ID NO: 67323 - DNA, 103 bp, Artificial Sequence
  Synthetic Polynucleotide
taatacgactcactatagggatagatatctgctcttgttgttcacaatataacagaggagaatattgatgacaacaagaaacctggcggcagcgcaaaagatg

SEQ ID NO: 67324 - DNA, 103 bp, Artificial Sequence
  Synthetic Polynucleotide
taatacgactcactatagggttcctatagatatctgctcttgttgttcacaacagaggagagtgaacatgaagagcagaaacctggcggcagcgcaaaagatg

SEQ ID NO: 67325 - DNA, 103 bp, Artificial Sequence
  Synthetic Polynucleotide
taatacgactcactataggggacatcttatgtcagacaatcccaaagcttaacagaggagaaagcttatggattgtctgaacctggcggcagcgcaaaagatg

SEQ ID NO: 67326 - DNA, 103 bp, Artificial Sequence
  Synthetic Polynucleotide
taatacgactcactatagggaccctttcctatagatatctgctcttgttgaacagaggagacaacaaatgcagatatctaacctggcggcagcgcaaaagatg

SEQ ID NO: 67327 - DNA, 103 bp, Artificial Sequence
  Synthetic Polynucleotide
taatacgactcactatagggattccaccctttcctatagatatctgctctaacagaggagaagagcaatgatctataggaacctggcggcagcgcaaaagatg

SEQ ID NO: 67328 - DNA, 103 bp, Artificial Sequence
  Synthetic Polynucleotide
taatacgactcactatagggatcgcattccaccctttcctatagatatctaacagaggagaagatatatgtaggaaaggaacctggcggcagcgcaaaagatg

SEQ ID NO: 67329 - DNA, 103 bp, Artificial Sequence
  Synthetic Polynucleotide
taatacgactcactatagggaatgtatcgcattccaccctttcctatagaaacagaggagatctataatgaagggtggaaacctggcggcagcgcaaaagatg

SEQ ID NO: 67330 - DNA, 103 bp, Artificial Sequence
  Synthetic Polynucleotide
taatacgactcactatagggagatcaatgtatcgcattccaccctttcctaacagaggagaaggaaaatgtggaatgcgaacctggcggcagcgcaaaagatg

SEQ ID NO: 67331 - DNA, 103 bp, Artificial Sequence
  Synthetic Polynucleotide
taatacgactcactatagggtacatagatcaatgtatcgcattccaccctaacagaggagaagggtgatgtgcgatacaaacctggcggcagcgcaaaagatg

SEQ ID NO: 67332 - DNA, 103 bp, Artificial Sequence
  Synthetic Polynucleotide
taatacgactcactatagggaaaactacatagatcaatgtatcgcattccaacagaggagaggaatgatgtacattgataacctggcggcagcgcaaaagatg

SEQ ID NO: 67333 - DNA, 103 bp, Artificial Sequence
  Synthetic Polynucleotide
taatacgactcactataggggttttaaaactacatagatcaatgtatcgcaacagaggagagcgataatgtgatctatgaacctggcggcagcgcaaaagatg

SEQ ID NO: 67334 - DNA, 103 bp, Artificial Sequence
  Synthetic Polynucleotide
taatacgactcactatagggcgtgtgttttaaaactacatagatcaatgtaacagaggagaacattgatgtatgtagttaacctggcggcagcgcaaaagatg

SEQ ID NO: 67335 - DNA, 103 bp, Artificial Sequence
  Synthetic Polynucleotide
taatacgactcactataggggttctcgtgtgttttaaaactacatagatcaacagaggagagatctaatgagttttaaaaacctggcggcagcgcaaaagatg

SEQ ID NO: 67336 - DNA, 103 bp, Artificial Sequence
  Synthetic Polynucleotide
taatacgactcactatagggtcatagacatcttatgtcagacaatcccaaaacagaggagattgggaatgtctgacataaacctggcggcagcgcaaaagatg

SEQ ID NO: 67337 - DNA, 103 bp, Artificial Sequence
  Synthetic Polynucleotide
taatacgactcactatagggtcaaagttctcgtgtgttttaaaactacataacagaggagaatgtagatgtaaaacacaaacctggcggcagcgcaaaagatg

SEQ ID NO: 67338 - DNA, 103 bp, Artificial Sequence
  Synthetic Polynucleotide
taatacgactcactatagggattcttcaaagttctcgtgtgttttaaaacaacagaggagagttttaatgcacacgagaaacctggcggcagcgcaaaagatg

SEQ ID NO: 67339 - DNA, 103 bp, Artificial Sequence
  Synthetic Polynucleotide
taatacgactcactatagggtataaattcttcaaagttctcgtgtgttttaacagaggagaaaaacaatggagaactttaacctggcggcagcgcaaaagatg

SEQ ID NO: 67340 - DNA, 103 bp, Artificial Sequence
  Synthetic Polynucleotide
taatacgactcactatagggatttatataaattcttcaaagttctcgtgtaacagaggagaacacgaatgctttgaagaaacctggcggcagcgcaaaagatg

SEQ ID NO: 67341 - DNA, 103 bp, Artificial Sequence
  Synthetic Polynucleotide
taatacgactcactataggggaataatttatataaattcttcaaagttctaacagaggagaagaactatgaagaatttaaacctggcggcagcgcaaaagatg

SEQ ID NO: 67342 - DNA, 103 bp, Artificial Sequence
  Synthetic Polynucleotide
taatacgactcactatagggcgatggaataatttatataaattcttcaaaaacagaggagatttgaaatgtttatataaaacctggcggcagcgcaaaagatg

SEQ ID NO: 67343 - DNA, 103 bp, Artificial Sequence
  Synthetic Polynucleotide
taatacgactcactatagggtgtatcgatggaataatttatataaattctaacagaggagaagaattatgataaattataacctggcggcagcgcaaaagatg

SEQ ID NO: 67344 - DNA, 103 bp, Artificial Sequence
  Synthetic Polynucleotide
taatacgactcactatagggaaggatgtatcgatggaataatttatataaaacagaggagattatatatgttattccataacctggcggcagcgcaaaagatg

SEQ ID NO: 67345 - DNA, 103 bp, Artificial Sequence
  Synthetic Polynucleotide
taatacgactcactatagggcatagaaggatgtatcgatggaataatttaaacagaggagataaattatgccatcgataaacctggcggcagcgcaaaagatg

SEQ ID NO: 67346 - DNA, 103 bp, Artificial Sequence
  Synthetic Polynucleotide
taatacgactcactatagggattaacatagaaggatgtatcgatggaataaacagaggagatattccatggatacatccaacctggcggcagcgcaaaagatg

SEQ ID NO: 67347 - DNA, 103 bp, Artificial Sequence
  Synthetic Polynucleotide
taatacgactcactataggggtcgtctactggatgaagatgtgacgtacaaacagaggagatgtacgatgcatcttcataacctggcggcagcgcaaaagatg

SEQ ID NO: 67348 - DNA, 103 bp, Artificial Sequence
  Synthetic Polynucleotide
taatacgactcactatagggataatactatagatttagaatgtctaacgtaacagaggagaacgttaatgattctaaataacctggcggcagcgcaaaagatg

SEQ ID NO: 67349 - DNA, 103 bp, Artificial Sequence
  Synthetic Polynucleotide
taatacgactcactatagggcatattcatagacatcttatgtcagacaataacagaggagaattgtcatgcataagatgaacctggcggcagcgcaaaagatg

SEQ ID NO: 67350 - DNA, 103 bp, Artificial Sequence
  Synthetic Polynucleotide
taatacgactcactatagggtacatattaacatagaaggatgtatcgatgaacagaggagacatcgaatgatccttctaaacctggcggcagcgcaaaagatg

SEQ ID NO: 67351 - DNA, 103 bp, Artificial Sequence
  Synthetic Polynucleotide
taatacgactcactatagggatatatacatattaacatagaaggatgtataacagaggagaatacatatgtctatgttaaacctggcggcagcgcaaaagatg

SEQ ID NO: 67352 - DNA, 103 bp, Artificial Sequence
  Synthetic Polynucleotide
taatacgactcactatagggcctggatatatacatattaacatagaaggaaacagaggagatccttcatggttaatatgaacctggcggcagcgcaaaagatg

SEQ ID NO: 67353 - DNA, 103 bp, Artificial Sequence
  Synthetic Polynucleotide
taatacgactcactataggggaattcctggatatatacatattaacatagaacagaggagactatgtatgtatgtatataacctggcggcagcgcaaaagatg

SEQ ID NO: 67354 - DNA, 103 bp, Artificial Sequence
  Synthetic Polynucleotide
taatacgactcactatagggtaaaagaattcctggatatatacatattaaaacagaggagattaataatgatatatccaaacctggcggcagcgcaaaagatg

SEQ ID NO: 67355 - DNA, 103 bp, Artificial Sequence
  Synthetic Polynucleotide
taatacgactcactatagggattcataaaagaattcctggatatatacataacagaggagaatgtatatgtccaggaataacctggcggcagcgcaaaagatg

SEQ ID NO: 67356 - DNA, 103 bp, Artificial Sequence
  Synthetic Polynucleotide
taatacgactcactatagggctgatattcataaaagaattcctggatataaacagaggagatatatcatggaattctttaacctggcggcagcgcaaaagatg

SEQ ID NO: 67357 - DNA, 103 bp, Artificial Sequence
  Synthetic Polynucleotide
taatacgactcactatagggatttcctgatattcataaaagaattcctggaacagaggagaccaggaatgcttttatgaaacctggcggcagcgcaaaagatg

SEQ ID NO: 67358 - DNA, 103 bp, Artificial Sequence
  Synthetic Polynucleotide
taatacgactcactatagggtatacatttcctgatattcataaaagaattaacagaggagaaattctatgatgaatatcaacctggcggcagcgcaaaagatg

SEQ ID NO: 67359 - DNA, 103 bp, Artificial Sequence
  Synthetic Polynucleotide
taatacgactcactatagggtagtttatacatttcctgatattcataaaaaacagaggagattttatatgtatcaggaaaacctggcggcagcgcaaaagatg

SEQ ID NO: 67360 - DNA, 103 bp, Artificial Sequence
  Synthetic Polynucleotide
taatacgactcactatagggaaaatcatattcatagacatcttatgtcagaacagaggagactgacaatggatgtctataacctggcggcagcgcaaaagatg

SEQ ID NO: 67361 - DNA, 103 bp, Artificial Sequence
  Synthetic Polynucleotide
taatacgactcactatagggtgttttagtttatacatttcctgatattcaaacagaggagatgaataatgggaaatgtaaacctggcggcagcgcaaaagatg

SEQ ID NO: 67362 - DNA, 103 bp, Artificial Sequence
  Synthetic Polynucleotide
taatacgactcactatagggggcaatgttttagtttatacatttcctgataacagaggagaatcaggatgtgtataaacaacctggcggcagcgcaaaagatg

SEQ ID NO: 67363 - DNA, 103 bp, Artificial Sequence
  Synthetic Polynucleotide
taatacgactcactatagggatccgggcaatgttttagtttatacatttcaacagaggagagaaatgatgaaactaaaaaacctggcggcagcgcaaaagatg

SEQ ID NO: 67364 - DNA, 103 bp, Artificial Sequence
  Synthetic Polynucleotide
taatacgactcactatagggaccgtatccgggcaatgttttagtttatacaacagaggagagtataaatgaaaacattgaacctggcggcagcgcaaaagatg

SEQ ID NO: 67365 - DNA, 103 bp, Artificial Sequence
  Synthetic Polynucleotide
taatacgactcactataggggaagcaccgtatccgggcaatgttttagttaacagaggagaaactaaatgattgcccggaacctggcggcagcgcaaaagatg

SEQ ID NO: 67366 - DNA, 103 bp, Artificial Sequence
  Synthetic Polynucleotide
taatacgactcactatagggcaatagaagcaccgtatccgggcaatgtttaacagaggagaaaacatatgccggatacgaacctggcggcagcgcaaaagatg

SEQ ID NO: 67367 - DNA, 103 bp, Artificial Sequence
  Synthetic Polynucleotide
taatacgactcactatagggaatgccaatagaagcaccgtatccgggcaaaacagaggagattgcccatgtacggtgctaacctggcggcagcgcaaaagatg

SEQ ID NO: 67368 - DNA, 103 bp, Artificial Sequence
  Synthetic Polynucleotide
taatacgactcactataggggatataatgccaatagaagcaccgtatccgaacagaggagacggataatgtgcttctataacctggcggcagcgcaaaagatg

SEQ ID NO: 67369 - DNA, 103 bp, Artificial Sequence
  Synthetic Polynucleotide
taatacgactcactataggggaacggatataatgccaatagaagcaccgtaacagaggagaacggtgatgctattggcaaacctggcggcagcgcaaaagatg

SEQ ID NO: 67370 - DNA, 103 bp, Artificial Sequence
  Synthetic Polynucleotide
taatacgactcactataggggttaagaacggatataatgccaatagaagcaacagaggagagcttctatgggcattataaacctggcggcagcgcaaaagatg

SEQ ID NO: 67371 - DNA, 103 bp, Artificial Sequence
  Synthetic Polynucleotide
taatacgactcactatagggtggcaaaaatcatattcatagacatcttataacagaggagaataagaatgctatgaataaacctggcggcagcgcaaaagatg

SEQ ID NO: 67372 - DNA, 103 bp, Artificial Sequence
  Synthetic Polynucleotide
taatacgactcactatagggtgcaagttaagaacggatataatgccaataaacagaggagatattggatgtatatccgtaacctggcggcagcgcaaaagatg

SEQ ID NO: 67373 - DNA, 103 bp, Artificial Sequence
  Synthetic Polynucleotide
taatacgactcactatagggcattttgcaagttaagaacggatataatgcaacagaggagagcattaatgccgttcttaaacctggcggcagcgcaaaagatg

SEQ ID NO: 67374 - DNA, 103 bp, Artificial Sequence
  Synthetic Polynucleotide
taatacgactcactatagggggttacattttgcaagttaagaacggatataacagaggagaatatccatgcttaacttgaacctggcggcagcgcaaaagatg

SEQ ID NO: 67375 - DNA, 103 bp, Artificial Sequence
  Synthetic Polynucleotide
taatacgactcactataggggtattggttacattttgcaagttaagaacgaacagaggagacgttctatgcttgcaaaaaacctggcggcagcgcaaaagatg

SEQ ID NO: 67376 - DNA, 103 bp, Artificial Sequence
  Synthetic Polynucleotide
taatacgactcactatagggcaaaggtattggttacattttgcaagttaaaacagaggagattaactatgaaaatgtaaaacctggcggcagcgcaaaagatg

SEQ ID NO: 67377 - DNA, 103 bp, Artificial Sequence
  Synthetic Polynucleotide
taatacgactcactatagggccatgcaaaggtattggttacattttgcaaaacagaggagattgcaaatggtaaccaataacctggcggcagcgcaaaagatg

SEQ ID NO: 67378 - DNA, 103 bp, Artificial Sequence
  Synthetic Polynucleotide
taatacgactcactatagggacaagccatgcaaaggtattggttacatttaacagaggagaaaatgtatgcaataccttaacctggcggcagcgcaaaagatg

SEQ ID NO: 67379 - DNA, 103 bp, Artificial Sequence
  Synthetic Polynucleotide
taatacgactcactatagggacaaaacaagccatgcaaaggtattggttaaacagaggagataaccaatgcctttgcataacctggcggcagcgcaaaagatg

SEQ ID NO: 67380 - DNA, 103 bp, Artificial Sequence
  Synthetic Polynucleotide
taatacgactcactatagggaccgaacaaaacaagccatgcaaaggtattaacagaggagaaataccatggcatggcttaacctggcggcagcgcaaaagatg

SEQ ID NO: 67381 - DNA, 103 bp, Artificial Sequence
  Synthetic Polynucleotide
taatacgactcactatagggacgttaccgaacaaaacaagccatgcaaagaacagaggagactttgcatggcttgttttaacctggcggcagcgcaaaagatg

SEQ ID NO: 67382 - DNA, 103 bp, Artificial Sequence
  Synthetic Polynucleotide
taatacgactcactatagggaaatttggcaaaaatcatattcatagacataacagaggagaatgtctatgaatatgattaacctggcggcagcgcaaaagatg

SEQ ID NO: 67383 - DNA, 103 bp, Artificial Sequence
  Synthetic Polynucleotide
taatacgactcactatagggaactaacgttaccgaacaaaacaagccatgaacagaggagacatggcatgttttgttcgaacctggcggcagcgcaaaagatg

SEQ ID NO: 67384 - DNA, 103 bp, Artificial Sequence
  Synthetic Polynucleotide
taatacgactcactataggggtttaaactaacgttaccgaacaaaacaagaacagaggagacttgttatgttcggtaacaacctggcggcagcgcaaaagatg

SEQ ID NO: 67385 - DNA, 103 bp, Artificial Sequence
  Synthetic Polynucleotide
taatacgactcactataggggtcaagtttaaactaacgttaccgaacaaaaacagaggagatttgttatgtaacgttagaacctggcggcagcgcaaaagatg

SEQ ID NO: 67386 - DNA, 103 bp, Artificial Sequence
  Synthetic Polynucleotide
taatacgactcactatagggcattcgtcaagtttaaactaacgttaccgaaacagaggagatcggtaatgttagtttaaaacctggcggcagcgcaaaagatg

SEQ ID NO: 67387 - DNA, 103 bp, Artificial Sequence
  Synthetic Polynucleotide
taatacgactcactatagggtaatccattcgtcaagtttaaactaacgttaacagaggagaaacgttatgttaaacttgaacctggcggcagcgcaaaagatg

SEQ ID NO: 67388 - DNA, 103 bp, Artificial Sequence
  Synthetic Polynucleotide
taatacgactcactataggggtaattaatccattcgtcaagtttaaactaaacagaggagatagtttatgcttgacgaaaacctggcggcagcgcaaaagatg

SEQ ID NO: 67389 - DNA, 103 bp, Artificial Sequence
  Synthetic Polynucleotide
taatacgactcactatagggctattgtaattaatccattcgtcaagtttaaacagaggagataaactatgcgaatggataacctggcggcagcgcaaaagatg

SEQ ID NO: 67390 - DNA, 103 bp, Artificial Sequence
  Synthetic Polynucleotide
taatacgactcactatagggtcatgctattgtaattaatccattcgtcaaaacagaggagattgacgatgggattaattaacctggcggcagcgcaaaagatg

SEQ ID NO: 67391 - DNA, 103 bp, Artificial Sequence
  Synthetic Polynucleotide
taatacgactcactataggggcagatcatgctattgtaattaatccattcaacagaggagagaatggatgaattacaataacctggcggcagcgcaaaagatg

SEQ ID NO: 67392 - DNA, 103 bp, Artificial Sequence
  Synthetic Polynucleotide
taatacgactcactataggggatgcgcagatcatgctattgtaattaatcaacagaggagagattaaatgcaatagcataacctggcggcagcgcaaaagatg

SEQ ID NO: 67393 - DNA, 103 bp, Artificial Sequence
  Synthetic Polynucleotide
taatacgactcactatagggtagataaatttggcaaaaatcatattcataaacagaggagatatgaaatggatttttgcaacctggcggcagcgcaaaagatg

SEQ ID NO: 67394 - DNA, 103 bp, Artificial Sequence
  Synthetic Polynucleotide
taatacgactcactatagggtaatagatgcgcagatcatgctattgtaataacagaggagaattacaatggcatgatctaacctggcggcagcgcaaaagatg

SEQ ID NO: 67395 - DNA, 103 bp, Artificial Sequence
  Synthetic Polynucleotide
taatacgactcactatagggaaacttaatagatgcgcagatcatgctattaacagaggagaaatagcatgatctgcgcaaacctggcggcagcgcaaaagatg

SEQ ID NO: 67396 - DNA, 103 bp, Artificial Sequence
  Synthetic Polynucleotide
taatacgactcactatagggtaaaaaaacttaatagatgcgcagatcatgaacagaggagacatgatatgcgcatctataacctggcggcagcgcaaaagatg

SEQ ID NO: 67397 - DNA, 103 bp, Artificial Sequence
  Synthetic Polynucleotide
taatacgactcactatagggtaaagtaaaaaaacttaatagatgcgcagaaacagaggagatctgcgatgctattaagtaacctggcggcagcgcaaaagatg

SEQ ID NO: 67398 - DNA, 103 bp, Artificial Sequence
  Synthetic Polynucleotide
taatacgactcactatagggggcgttaaagtaaaaaaacttaatagatgcaacagaggagagcatctatgaagttttttaacctggcggcagcgcaaaagatg

SEQ ID NO: 67399 - DNA, 103 bp, Artificial Sequence
  Synthetic Polynucleotide
taatacgactcactatagggacaagggcgttaaagtaaaaaaacttaataaacagaggagatattaaatgtttttacttaacctggcggcagcgcaaaagatg

SEQ ID NO: 67400 - DNA, 103 bp, Artificial Sequence
  Synthetic Polynucleotide
taatacgactcactatagggaacatacaagggcgttaaagtaaaaaaactaacagaggagaagttttatgactttaacgaacctggcggcagcgcaaaagatg

SEQ ID NO: 67401 - DNA, 103 bp, Artificial Sequence
  Synthetic Polynucleotide
taatacgactcactataggggtaaaaacatacaagggcgttaaagtaaaaaacagaggagattttacatgaacgcccttaacctggcggcagcgcaaaagatg

SEQ ID NO: 67402 - DNA, 103 bp, Artificial Sequence
  Synthetic Polynucleotide
taatacgactcactatagggtctctgtaaaaacatacaagggcgttaaagaacagaggagactttaaatgccttgtatgaacctggcggcagcgcaaaagatg

SEQ ID NO: 67403 - DNA, 103 bp, Artificial Sequence
  Synthetic Polynucleotide
taatacgactcactatagggtaaagtctctgtaaaaacatacaagggcgtaacagaggagaacgcccatgtatgtttttaacctggcggcagcgcaaaagatg

SEQ ID NO: 67404 - DNA, 103 bp, Artificial Sequence
  Synthetic Polynucleotide
taatacgactcactataggggatagtagataaatttggcaaaaatcatataacagaggagaatatgaatgttgccaaataacctggcggcagcgcaaaagatg

SEQ ID NO: 67405 - DNA, 103 bp, Artificial Sequence
  Synthetic Polynucleotide
taatacgactcactatagggttagataaagtctctgtaaaaacatacaagaacagaggagacttgtaatgttttacagaaacctggcggcagcgcaaaagatg

SEQ ID NO: 67406 - DNA, 103 bp, Artificial Sequence
  Synthetic Polynucleotide
taatacgactcactataggggaaatttagataaagtctctgtaaaaacataacagaggagaatgtttatgcagagacttaacctggcggcagcgcaaaagatg

SEQ ID NO: 67407 - DNA, 103 bp, Artificial Sequence
  Synthetic Polynucleotide
taatacgactcactatagggcactagaaatttagataaagtctctgtaaaaacagaggagatttacaatgactttatctaacctggcggcagcgcaaaagatg

SEQ ID NO: 67408 - DNA, 103 bp, Artificial Sequence
  Synthetic Polynucleotide
taatacgactcactatagggacaagcactagaaatttagataaagtctctaacagaggagaagagacatgatctaaattaacctggcggcagcgcaaaagatg

SEQ ID NO: 67409 - DNA, 103 bp, Artificial Sequence
  Synthetic Polynucleotide
taatacgactcactatagggcacatacaagcactagaaatttagataaagaacagaggagactttatatgaatttctagaacctggcggcagcgcaaaagatg

SEQ ID NO: 67410 - DNA, 103 bp, Artificial Sequence
  Synthetic Polynucleotide
taatacgactcactatagggtataacacatacaagcactagaaatttagaaacagaggagatctaaaatgctagtgcttaacctggcggcagcgcaaaagatg

SEQ ID NO: 67411 - DNA, 103 bp, Artificial Sequence
  Synthetic Polynucleotide
taatacgactcactatagggatatttataacacatacaagcactagaaataacagaggagaatttctatggcttgtatgaacctggcggcagcgcaaaagatg

SEQ ID NO: 67412 - DNA, 103 bp, Artificial Sequence
  Synthetic Polynucleotide
taatacgactcactatagggcagttatatttataacacatacaagcactaaacagaggagatagtgcatgtatgtgttaaacctggcggcagcgcaaaagatg

SEQ ID NO: 67413 - DNA, 103 bp, Artificial Sequence
  Synthetic Polynucleotide
taatacgactcactatagggatatccagttatatttataacacatacaagaacagaggagacttgtaatggttataaataacctggcggcagcgcaaaagatg

SEQ ID NO: 67414 - DNA, 103 bp, Artificial Sequence
  Synthetic Polynucleotide
taatacgactcactataggggttctatatccagttatatttataacacataacagaggagaatgtgtatgaaatataacaacctggcggcagcgcaaaagatg

SEQ ID NO: 67415 - DNA, 103 bp, Artificial Sequence
  Synthetic Polynucleotide
taatacgactcactataggggccaggatagtagataaatttggcaaaaataacagaggagaatttttatgaaatttatcaacctggcggcagcgcaaaagatg

SEQ ID NO: 67416 - DNA, 103 bp, Artificial Sequence
  Synthetic Polynucleotide
taatacgactcactatagggattcagttctatatccagttatatttataaaacagaggagattataaatgtaactggataacctggcggcagcgcaaaagatg

SEQ ID NO: 67417 - DNA, 103 bp, Artificial Sequence
  Synthetic Polynucleotide
taatacgactcactatagggaggtgattcagttctatatccagttatattaacagaggagaaatataatgggatatagaaacctggcggcagcgcaaaagatg

SEQ ID NO: 67418 - DNA, 103 bp, Artificial Sequence
  Synthetic Polynucleotide
taatacgactcactatagggaaggtaggtgattcagttctatatccagttaacagaggagaaactggatgtagaactgaaacctggcggcagcgcaaaagatg

SEQ ID NO: 67419 - DNA, 103 bp, Artificial Sequence
  Synthetic Polynucleotide
taatacgactcactatagggtatctaaggtaggtgattcagttctatatcaacagaggagagatataatgctgaatcacaacctggcggcagcgcaaaagatg

SEQ ID NO: 67420 - DNA, 103 bp, Artificial Sequence
  Synthetic Polynucleotide
taatacgactcactatagggttgggtatctaaggtaggtgattcagttctaacagaggagaagaactatgtcacctaccaacctggcggcagcgcaaaagatg

SEQ ID NO: 67421 - DNA, 103 bp, Artificial Sequence
  Synthetic Polynucleotide
taatacgactcactatagggtgtaattgggtatctaaggtaggtgattcaaacagaggagatgaatcatgtaccttagaaacctggcggcagcgcaaaagatg

SEQ ID NO: 67422 - DNA, 103 bp, Artificial Sequence
  Synthetic Polynucleotide
taatacgactcactatagggtaaaatgtaattgggtatctaaggtaggtgaacagaggagacacctaatgtagatacccaacctggcggcagcgcaaaagatg

SEQ ID NO: 67423 - DNA, 103 bp, Artificial Sequence
  Synthetic Polynucleotide
taatacgactcactatagggtctgataaaatgtaattgggtatctaaggtaacagaggagaaccttaatgacccaattaaacctggcggcagcgcaaaagatg

SEQ ID NO: 67424 - DNA, 103 bp, Artificial Sequence
  Synthetic Polynucleotide
taatacgactcactatagggctggatctgataaaatgtaattgggtatctaacagaggagaagatacatgattacatttaacctggcggcagcgcaaaagatg

SEQ ID NO: 67425 - DNA, 103 bp, Artificial Sequence
  Synthetic Polynucleotide
taatacgactcactatagggattatctggatctgataaaatgtaattgggaacagaggagacccaatatgattttatcaaacctggcggcagcgcaaaagatg

SEQ ID NO: 67426 - DNA, 103 bp, Artificial Sequence
  Synthetic Polynucleotide
taatacgactcactatagggttgaagccaggatagtagataaatttggcaaacagaggagatgccaaatgtatctactaaacctggcggcagcgcaaaagatg

SEQ ID NO: 67427 - DNA, 103 bp, Artificial Sequence
  Synthetic Polynucleotide
taatacgactcactatagggtgtttattatctggatctgataaaatgtaaaacagaggagattacatatgatcagatccaacctggcggcagcgcaaaagatg

SEQ ID NO: 67428 - DNA, 103 bp, Artificial Sequence
  Synthetic Polynucleotide
taatacgactcactatagggaaatttgtttattatctggatctgataaaaaacagaggagattttatatgatccagataaacctggcggcagcgcaaaagatg

SEQ ID NO: 67429 - DNA, 103 bp, Artificial Sequence
  Synthetic Polynucleotide
taatacgactcactatagggcgacaaaatttgtttattatctggatctgaaacagaggagatcagatatggataataaaaacctggcggcagcgcaaaagatg

SEQ ID NO: 67430 - DNA, 103 bp, Artificial Sequence
  Synthetic Polynucleotide
taatacgactcactatagggtagggcgacaaaatttgtttattatctggaaacagaggagatccagaatgtaaacaaataacctggcggcagcgcaaaagatg

SEQ ID NO: 67431 - DNA, 103 bp, Artificial Sequence
  Synthetic Polynucleotide
taatacgactcactatagggttagttagggcgacaaaatttgtttattataacagaggagaataataatgaaattttgtaacctggcggcagcgcaaaagatg

SEQ ID NO: 67432 - DNA, 103 bp, Artificial Sequence
  Synthetic Polynucleotide
taatacgactcactatagggtagaattagttagggcgacaaaatttgtttaacagaggagaaaacaaatgttgtcgcccaacctggcggcagcgcaaaagatg

SEQ ID NO: 67433 - DNA, 103 bp, Artificial Sequence
  Synthetic Polynucleotide
taatacgactcactatagggcaatatagaattagttagggcgacaaaattaacagaggagaaattttatggccctaactaacctggcggcagcgcaaaagatg

SEQ ID NO: 67434 - DNA, 103 bp, Artificial Sequence
  Synthetic Polynucleotide
taatacgactcactatagggtataacaatatagaattagttagggcgacaaacagaggagatgtcgcatgaactaattcaacctggcggcagcgcaaaagatg

SEQ ID NO: 67435 - DNA, 103 bp, Artificial Sequence
  Synthetic Polynucleotide
taatacgactcactatagggaaatatataacaatatagaattagttagggaacagaggagaccctaaatgattctatataacctggcggcagcgcaaaagatg

SEQ ID NO: 67436 - DNA, 103 bp, Artificial Sequence
  Synthetic Polynucleotide
taatacgactcactatagggttgtaaaatatataacaatatagaattagtaacagaggagaactaatatgatattgttaaacctggcggcagcgcaaaagatg

SEQ ID NO: 67437 - DNA, 103 bp, Artificial Sequence
  Synthetic Polynucleotide
taatacgactcactatagggtggatttgaagccaggatagtagataaattaacagaggagaaatttaatgactatcctgaacctggcggcagcgcaaaagatg

SEQ ID NO: 67438 - DNA, 103 bp, Artificial Sequence
  Synthetic Polynucleotide
taatacgactcactatagggaccaattgtaaaatatataacaatatagaaaacagaggagattctatatggttatatataacctggcggcagcgcaaaagatg

SEQ ID NO: 67439 - DNA, 103 bp, Artificial Sequence
  Synthetic Polynucleotide
taatacgactcactatagggtcataaccaattgtaaaatatataacaataaacagaggagatattgtatgatattttacaacctggcggcagcgcaaaagatg

SEQ ID NO: 67440 - DNA, 103 bp, Artificial Sequence
  Synthetic Polynucleotide
taatacgactcactatagggtgatatcataaccaattgtaaaatatataaaacagaggagattatatatgttacaattgaacctggcggcagcgcaaaagatg

SEQ ID NO: 67441 - DNA, 103 bp, Artificial Sequence
  Synthetic Polynucleotide
taatacgactcactatagggttacatgatatcataaccaattgtaaaataaacagaggagatattttatgattggttataacctggcggcagcgcaaaagatg

SEQ ID NO: 67442 - DNA, 103 bp, Artificial Sequence
  Synthetic Polynucleotide
taatacgactcactatagggagttattacatgatatcataaccaattgtaaacagaggagatacaatatgttatgatataacctggcggcagcgcaaaagatg

SEQ ID NO: 67443 - DNA, 103 bp, Artificial Sequence
  Synthetic Polynucleotide
taatacgactcactatagggttccaagttattacatgatatcataaccaaaacagaggagattggttatgatatcatgtaacctggcggcagcgcaaaagatg

SEQ ID NO: 67444 - DNA, 103 bp, Artificial Sequence
  Synthetic Polynucleotide
taatacgactcactatagggttagattccaagttattacatgatatcataaacagaggagatatgatatgatgtaataaaacctggcggcagcgcaaaagatg

SEQ ID NO: 67445 - DNA, 103 bp, Artificial Sequence
  Synthetic Polynucleotide
taatacgactcactataggggcgcgttagattccaagttattacatgataaacagaggagatatcatatgataacttggaacctggcggcagcgcaaaagatg

SEQ ID NO: 67446 - DNA, 103 bp, Artificial Sequence
  Synthetic Polynucleotide
taatacgactcactatagggacgatgcgcgttagattccaagttattacaaacagaggagatgtaatatgttggaatctaacctggcggcagcgcaaaagatg

SEQ ID NO: 67447 - DNA, 103 bp, Artificial Sequence
  Synthetic Polynucleotide
taatacgactcactataggggtacgacgatgcgcgttagattccaagttaaacagaggagataacttatgatctaacgcaacctggcggcagcgcaaaagatg

SEQ ID NO: 67448 - DNA, 103 bp, Artificial Sequence
  Synthetic Polynucleotide
taatacgactcactatagggtccattggatttgaagccaggatagtagataacagaggagaatctacatgcctggcttcaacctggcggcagcgcaaaagatg

SEQ ID NO: 67449 - DNA, 103 bp, Artificial Sequence
  Synthetic Polynucleotide
taatacgactcactatagggtaaacgtacgacgatgcgcgttagattccaaacagaggagatggaatatgacgcgcatcaacctggcggcagcgcaaaagatg

SEQ ID NO: 67450 - DNA, 103 bp, Artificial Sequence
  Synthetic Polynucleotide
taatacgactcactatagggttgtgtaaacgtacgacgatgcgcgttagaaacagaggagatctaacatgcatcgtcgtaacctggcggcagcgcaaaagatg

SEQ ID NO: 67451 - DNA, 103 bp, Artificial Sequence
  Synthetic Polynucleotide
taatacgactcactatagggcacaattgtgtaaacgtacgacgatgcgcgaacagaggagacgcgcaatgtcgtacgttaacctggcggcagcgcaaaagatg

SEQ ID NO: 67452 - DNA, 103 bp, Artificial Sequence
  Synthetic Polynucleotide
taatacgactcactatagggtaaatcacaattgtgtaaacgtacgacgataacagaggagaatcgtcatgcgtttacacaacctggcggcagcgcaaaagatg

SEQ ID NO: 67453 - DNA, 103 bp, Artificial Sequence
  Synthetic Polynucleotide
taatacgactcactatagggtatactaaatcacaattgtgtaaacgtacgaacagaggagacgtacgatgacacaattgaacctggcggcagcgcaaaagatg

SEQ ID NO: 67454 - DNA, 103 bp, Artificial Sequence
  Synthetic Polynucleotide
taatacgactcactatagggtatactatactaaatcacaattgtgtaaacaacagaggagagtttacatgattgtgattaacctggcggcagcgcaaaagatg

SEQ ID NO: 67455 - DNA, 103 bp, Artificial Sequence
  Synthetic Polynucleotide
taatacgactcactataggggtagatatactatactaaatcacaattgtgaacagaggagacacaatatggatttagtaaacctggcggcagcgcaaaagatg

SEQ ID NO: 67456 - DNA, 103 bp, Artificial Sequence
  Synthetic Polynucleotide
taatacgactcactatagggtatgtgtagatatactatactaaatcacaaaacagaggagattgtgaatgagtatagtaaacctggcggcagcgcaaaagatg

SEQ ID NO: 67457 - DNA, 103 bp, Artificial Sequence
  Synthetic Polynucleotide
taatacgactcactatagggaaatatatgtgtagatatactatactaaataacagaggagaatttagatgagtatatctaacctggcggcagcgcaaaagatg

SEQ ID NO: 67458 - DNA, 103 bp, Artificial Sequence
  Synthetic Polynucleotide
taatacgactcactatagggcggaaaaatatatgtgtagatatactatacaacagaggagagtatagatgatctacacaaacctggcggcagcgcaaaagatg

SEQ ID NO: 67459 - DNA, 103 bp, Artificial Sequence
  Synthetic Polynucleotide
taatacgactcactatagggaatagataatactatagatttagaatgtctaacagaggagaagacatatgaaatctataaacctggcggcagcgcaaaagatg

SEQ ID NO: 67460 - DNA, 103 bp, Artificial Sequence
  Synthetic Polynucleotide
taatacgactcactatagggtaatgtccattggatttgaagccaggatagaacagaggagactatccatgcttcaaatcaacctggcggcagcgcaaaagatg

SEQ ID NO: 67461 - DNA, 103 bp, Artificial Sequence
  Synthetic Polynucleotide
taatacgactcactatagggtagcgcggaaaaatatatgtgtagatatacaacagaggagagtatatatgcacatatataacctggcggcagcgcaaaagatg

SEQ ID NO: 67462 - DNA, 103 bp, Artificial Sequence
  Synthetic Polynucleotide
taatacgactcactatagggtactatagcgcggaaaaatatatgtgtagaaacagaggagatctacaatgatatttttcaacctggcggcagcgcaaaagatg

SEQ ID NO: 67463 - DNA, 103 bp, Artificial Sequence
  Synthetic Polynucleotide
taatacgactcactatagggcagaatactatagcgcggaaaaatatatgtaacagaggagaacatatatgtttccgcgcaacctggcggcagcgcaaaagatg

SEQ ID NO: 67464 - DNA, 103 bp, Artificial Sequence
  Synthetic Polynucleotide
taatacgactcactatagggtagtccagaatactatagcgcggaaaaataaacagaggagatattttatggcgctatagaacctggcggcagcgcaaaagatg

SEQ ID NO: 67465 - DNA, 103 bp, Artificial Sequence
  Synthetic Polynucleotide
taatacgactcactatagggatcgctagtccagaatactatagcgcggaaaacagaggagattccgcatgatagtattcaacctggcggcagcgcaaaagatg

SEQ ID NO: 67466 - DNA, 103 bp, Artificial Sequence
  Synthetic Polynucleotide
taatacgactcactataggggttttatcgctagtccagaatactatagcgaacagaggagacgctatatgattctggacaacctggcggcagcgcaaaagatg

SEQ ID NO: 67467 - DNA, 103 bp, Artificial Sequence
  Synthetic Polynucleotide
taatacgactcactatagggcgatagttttatcgctagtccagaatactaaacagaggagatagtatatgggactagcgaacctggcggcagcgcaaaagatg

SEQ ID NO: 67468 - DNA, 103 bp, Artificial Sequence
  Synthetic Polynucleotide
taatacgactcactatagggtataacgatagttttatcgctagtccagaaaacagaggagattctggatgagcgataaaaacctggcggcagcgcaaaagatg

SEQ ID NO: 67469 - DNA, 103 bp, Artificial Sequence
  Synthetic Polynucleotide
taatacgactcactatagggacagatataacgatagttttatcgctagtcaacagaggagagactagatgtaaaactataacctggcggcagcgcaaaagatg

SEQ ID NO: 67470 - DNA, 103 bp, Artificial Sequence
  Synthetic Polynucleotide
taatacgactcactatagggcgaagacagatataacgatagttttatcgcaacagaggagagcgataatgctatcgttaaacctggcggcagcgcaaaagatg

SEQ ID NO: 67471 - DNA, 103 bp, Artificial Sequence
  Synthetic Polynucleotide
taatacgactcactatagggaaaaataatgtccattggatttgaagccagaacagaggagactggctatgaatccaatgaacctggcggcagcgcaaaagatg

SEQ ID NO: 67472 - DNA, 103 bp, Artificial Sequence
  Synthetic Polynucleotide
taatacgactcactatagggttcatcgaagacagatataacgatagttttaacagaggagaaaaactatggttatatctaacctggcggcagcgcaaaagatg

SEQ ID NO: 67473 - DNA, 103 bp, Artificial Sequence
  Synthetic Polynucleotide
taatacgactcactatagggatgagttcatcgaagacagatataacgataaacagaggagatatcgtatgatctgtcttaacctggcggcagcgcaaaagatg

SEQ ID NO: 67474 - DNA, 103 bp, Artificial Sequence
  Synthetic Polynucleotide
taatacgactcactatagggtcttgatgagttcatcgaagacagatataaaacagaggagattatatatgtcttcgatgaacctggcggcagcgcaaaagatg

SEQ ID NO: 67475 - DNA, 103 bp, Artificial Sequence
  Synthetic Polynucleotide
taatacgactcactatagggcaatatcttgatgagttcatcgaagacagaaacagaggagatctgtcatggatgaactcaacctggcggcagcgcaaaagatg

SEQ ID NO: 67476 - DNA, 103 bp, Artificial Sequence
  Synthetic Polynucleotide
taatacgactcactataggggagagcaatatcttgatgagttcatcgaagaacagaggagacttcgaatgactcatcaaaacctggcggcagcgcaaaagatg

SEQ ID NO: 67477 - DNA, 103 bp, Artificial Sequence
  Synthetic Polynucleotide
taatacgactcactatagggtgacagagagcaatatcttgatgagttcataacagaggagaatgaacatgtcaagatataacctggcggcagcgcaaaagatg

SEQ ID NO: 67478 - DNA, 103 bp, Artificial Sequence
  Synthetic Polynucleotide
taatacgactcactataggggaatatgacagagagcaatatcttgatgagaacagaggagactcatcatgatattgctcaacctggcggcagcgcaaaagatg

SEQ ID NO: 67479 - DNA, 103 bp, Artificial Sequence
  Synthetic Polynucleotide
taatacgactcactatagggtgtatgaatatgacagagagcaatatcttgaacagaggagacaagatatggctctctgtaacctggcggcagcgcaaaagatg

SEQ ID NO: 67480 - DNA, 103 bp, Artificial Sequence
  Synthetic Polynucleotide
taatacgactcactataggggcaggtgtatgaatatgacagagagcaataaacagaggagatattgcatgctgtcatataacctggcggcagcgcaaaagatg

SEQ ID NO: 67481 - DNA, 103 bp, Artificial Sequence
  Synthetic Polynucleotide
taatacgactcactatagggtttatgcaggtgtatgaatatgacagagagaacagaggagactctctatgatattcataaacctggcggcagcgcaaaagatg

SEQ ID NO: 67482 - DNA, 103 bp, Artificial Sequence
  Synthetic Polynucleotide
taatacgactcactatagggtttaaaaaaataatgtccattggatttgaaaacagaggagattcaaaatgaatggacataacctggcggcagcgcaaaagatg

SEQ ID NO: 67483 - DNA, 103 bp, Artificial Sequence
  Synthetic Polynucleotide
taatacgactcactataggggaaagtttatgcaggtgtatgaatatgacaaacagaggagatgtcatatgcatacacctaacctggcggcagcgcaaaagatg

SEQ ID NO: 67484 - DNA, 103 bp, Artificial Sequence
  Synthetic Polynucleotide
taatacgactcactataggggtctagaaagtttatgcaggtgtatgaataaacagaggagatattcaatgacctgcataaacctggcggcagcgcaaaagatg

SEQ ID NO: 67485 - DNA, 103 bp, Artificial Sequence
  Synthetic Polynucleotide
taatacgactcactatagggacaatgtctagaaagtttatgcaggtgtataacagaggagaatacacatgcataaacttaacctggcggcagcgcaaaagatg

SEQ ID NO: 67486 - DNA, 103 bp, Artificial Sequence
  Synthetic Polynucleotide
taatacgactcactatagggattgtacaatgtctagaaagtttatgcaggaacagaggagacctgcaatgactttctagaacctggcggcagcgcaaaagatg

SEQ ID NO: 67487 - DNA, 103 bp, Artificial Sequence
  Synthetic Polynucleotide
taatacgactcactatagggcacatattgtacaatgtctagaaagtttataacagaggagaataaacatgctagacattaacctggcggcagcgcaaaagatg

SEQ ID NO: 67488 - DNA, 103 bp, Artificial Sequence
  Synthetic Polynucleotide
taatacgactcactatagggaataacacatattgtacaatgtctagaaagaacagaggagactttctatgcattgtacaaacctggcggcagcgcaaaagatg

SEQ ID NO: 67489 - DNA, 103 bp, Artificial Sequence
  Synthetic Polynucleotide
taatacgactcactatagggcctaaaataacacatattgtacaatgtctaaacagaggagatagacaatgtacaatatgaacctggcggcagcgcaaaagatg

SEQ ID NO: 67490 - DNA, 103 bp, Artificial Sequence
  Synthetic Polynucleotide
taatacgactcactatagggatgatcctaaaataacacatattgtacaataacagaggagaattgtaatgtatgtgttaaacctggcggcagcgcaaaagatg

SEQ ID NO: 67491 - DNA, 103 bp, Artificial Sequence
  Synthetic Polynucleotide
taatacgactcactatagggtaaatatgatcctaaaataacacatattgtaacagaggagaacaataatggttattttaaacctggcggcagcgcaaaagatg

SEQ ID NO: 67492 - DNA, 103 bp, Artificial Sequence
  Synthetic Polynucleotide
taatacgactcactatagggatatgtaaatatgatcctaaaataacacataacagaggagaatgtgtatgtttaggatcaacctggcggcagcgcaaaagatg

SEQ ID NO: 67493 - DNA, 103 bp, Artificial Sequence
  Synthetic Polynucleotide
taatacgactcactataggggagtgtttaaaaaaataatgtccattggataacagaggagaatccaaatgacattatttaacctggcggcagcgcaaaagatg

SEQ ID NO: 67494 - DNA, 103 bp, Artificial Sequence
  Synthetic Polynucleotide
taatacgactcactatagggcgtaaatatgtaaatatgatcctaaaataaaacagaggagattatttatggatcatattaacctggcggcagcgcaaaagatg

SEQ ID NO: 67495 - DNA, 103 bp, Artificial Sequence
  Synthetic Polynucleotide
taatacgactcactatagggtataccgtaaatatgtaaatatgatcctaaaacagaggagattaggaatgtatttacataacctggcggcagcgcaaaagatg

SEQ ID NO: 67496 - DNA, 103 bp, Artificial Sequence
  Synthetic Polynucleotide
taatacgactcactatagggtttgatataccgtaaatatgtaaatatgataacagaggagaatcataatgacatatttaaacctggcggcagcgcaaaagatg

SEQ ID NO: 67497 - DNA, 103 bp, Artificial Sequence
  Synthetic Polynucleotide
taatacgactcactatagggacatctttgatataccgtaaatatgtaaataacagaggagaatttacatgtttacggtaaacctggcggcagcgcaaaagatg

SEQ ID NO: 67498 - DNA, 103 bp, Artificial Sequence
  Synthetic Polynucleotide
taatacgactcactatagggatctaacatctttgatataccgtaaatatgaacagaggagacatattatgggtatatcaaacctggcggcagcgcaaaagatg

SEQ ID NO: 67499 - DNA, 103 bp, Artificial Sequence
  Synthetic Polynucleotide
taatacgactcactatagggactatatctaacatctttgatataccgtaaaacagaggagattacggatgatcaaagataacctggcggcagcgcaaaagatg

SEQ ID NO: 67500 - DNA, 103 bp, Artificial Sequence
  Synthetic Polynucleotide
taatacgactcactatagggtattaactatatctaacatctttgatatacaacagaggagagtatatatgagatgttagaacctggcggcagcgcaaaagatg

SEQ ID NO: 67501 - DNA, 103 bp, Artificial Sequence
  Synthetic Polynucleotide
taatacgactcactatagggtgtcctattaactatatctaacatctttgaaacagaggagatcaaagatgttagatataaacctggcggcagcgcaaaagatg

SEQ ID NO: 67502 - DNA, 103 bp, Artificial Sequence
  Synthetic Polynucleotide
taatacgactcactatagggatatgtgtcctattaactatatctaacatcaacagaggagagatgttatgtatagttaaaacctggcggcagcgcaaaagatg

SEQ ID NO: 67503 - DNA, 103 bp, Artificial Sequence
  Synthetic Polynucleotide
taatacgactcactatagggttattatatgtgtcctattaactatatctaaacagaggagatagataatgttaataggaaacctggcggcagcgcaaaagatg

SEQ ID NO: 67504 - DNA, 103 bp, Artificial Sequence
  Synthetic Polynucleotide
taatacgactcactatagggagaaagagtgtttaaaaaaataatgtccataacagaggagaatggacatgatttttttaaacctggcggcagcgcaaaagatg

SEQ ID NO: 67505 - DNA, 103 bp, Artificial Sequence
  Synthetic Polynucleotide
taatacgactcactatagggattcattattatatgtgtcctattaactataacagaggagaatagttatgaggacacataacctggcggcagcgcaaaagatg

SEQ ID NO: 67506 - DNA, 103 bp, Artificial Sequence
  Synthetic Polynucleotide
taatacgactcactatagggttaatattcattattatatgtgtcctattaaacagaggagataatagatgacatataataacctggcggcagcgcaaaagatg

SEQ ID NO: 67507 - DNA, 103 bp, Artificial Sequence
  Synthetic Polynucleotide
taatacgactcactatagggagtgtttaatattcattattatatgtgtccaacagaggagaggacacatgtaataatgaaacctggcggcagcgcaaaagatg

SEQ ID NO: 67508 - DNA, 103 bp, Artificial Sequence
  Synthetic Polynucleotide
taatacgactcactatagggatactagtgtttaatattcattattatatgaacagaggagacatataatgatgaatattaacctggcggcagcgcaaaagatg

SEQ ID NO: 67509 - DNA, 103 bp, Artificial Sequence
  Synthetic Polynucleotide
taatacgactcactatagggctgctatactagtgtttaatattcattattaacagaggagaaataatatgtattaaacaaacctggcggcagcgcaaaagatg

SEQ ID NO: 67510 - DNA, 103 bp, Artificial Sequence
  Synthetic Polynucleotide
taatacgactcactatagggaacttctgctatactagtgtttaatattcaaacagaggagatgaataatgaacactagtaacctggcggcagcgcaaaagatg

SEQ ID NO: 67511 - DNA, 103 bp, Artificial Sequence
  Synthetic Polynucleotide
taatacgactcactataggggtataaacttctgctatactagtgtttaataacagaggagaattaaaatgtagtatagcaacctggcggcagcgcaaaagatg

SEQ ID NO: 67512 - DNA, 103 bp, Artificial Sequence
  Synthetic Polynucleotide
taatacgactcactatagggtgtgagtataaacttctgctatactagtgtaacagaggagaacactaatgtagcagaagaacctggcggcagcgcaaaagatg

SEQ ID NO: 67513 - DNA, 103 bp, Artificial Sequence
  Synthetic Polynucleotide
taatacgactcactatagggtgttttgtgagtataaacttctgctatactaacagaggagaagtataatggaagtttataacctggcggcagcgcaaaagatg

SEQ ID NO: 67514 - DNA, 103 bp, Artificial Sequence
  Synthetic Polynucleotide
taatacgactcactatagggtatgatgttttgtgagtataaacttctgctaacagaggagaagcagaatgttatactcaaacctggcggcagcgcaaaagatg

SEQ ID NO: 67515 - DNA, 103 bp, Artificial Sequence
  Synthetic Polynucleotide
taatacgactcactatagggccttcagaaagagtgtttaaaaaaataatgaacagaggagacattatatgtttaaacacaacctggcggcagcgcaaaagatg

SEQ ID NO: 67516 - DNA, 103 bp, Artificial Sequence
  Synthetic Polynucleotide
taatacgactcactatagggcattttatgatgttttgtgagtataaacttaacagaggagaaagtttatgctcacaaaaaacctggcggcagcgcaaaagatg

SEQ ID NO: 67517 - DNA, 103 bp, Artificial Sequence
  Synthetic Polynucleotide
taatacgactcactatagggcgactcattttatgatgttttgtgagtataaacagaggagatatactatgaaaacatcaaacctggcggcagcgcaaaagatg

SEQ ID NO: 67518 - DNA, 103 bp, Artificial Sequence
  Synthetic Polynucleotide
taatacgactcactataggggacgacgactcattttatgatgttttgtgaaacagaggagatcacaaatgatcataaaaaacctggcggcagcgcaaaagatg

SEQ ID NO: 67519 - DNA, 103 bp, Artificial Sequence
  Synthetic Polynucleotide
taatacgactcactatagggaatcagacgacgactcattttatgatgtttaacagaggagaaaacatatgaaaatgagtaacctggcggcagcgcaaaagatg

SEQ ID NO: 67520 - DNA, 103 bp, Artificial Sequence
  Synthetic Polynucleotide
taatacgactcactatagggacataaatcagacgacgactcattttatgaaacagaggagatcataaatggagtcgtcgaacctggcggcagcgcaaaagatg

SEQ ID NO: 67521 - DNA, 103 bp, Artificial Sequence
  Synthetic Polynucleotide
taatacgactcactatagggttaaaacataaatcagacgacgactcatttaacagaggagaaaatgaatggtcgtctgaaacctggcggcagcgcaaaagatg
